United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 168

SEQ ID NO: 7026236 - DNA, 22 bp, Homo sapiens
cagccctctgaagaggcgcttg

SEQ ID NO: 7026237 - DNA, 22 bp, Homo sapiens
ttcatagacccatgtgaggaag

SEQ ID NO: 7026238 - DNA, 22 bp, Homo sapiens
aaccattagtcaatcagcaaga

SEQ ID NO: 7026239 - DNA, 22 bp, Homo sapiens
ctgcctgcttaccatgcatcag

SEQ ID NO: 7026240 - DNA, 22 bp, Homo sapiens
aagtccgaaggctggagtggac

SEQ ID NO: 7026241 - DNA, 22 bp, Homo sapiens
tgactgtgccgtgcccctagga

SEQ ID NO: 7026242 - DNA, 23 bp, Homo sapiens
ctgaggtaaaatattctgaagga

SEQ ID NO: 7026243 - DNA, 22 bp, Homo sapiens
tttctacaatttttggcatgag

SEQ ID NO: 7026244 - DNA, 22 bp, Homo sapiens
acacaggagagagttgggaagg

SEQ ID NO: 7026245 - DNA, 22 bp, Homo sapiens
cctgcccaggagtctctctgtg

SEQ ID NO: 7026246 - DNA, 21 bp, Homo sapiens
acatcagagttgtgaaggtag

SEQ ID NO: 7026247 - DNA, 22 bp, Homo sapiens
ctgtctgtggtctcagtaggcc

SEQ ID NO: 7026248 - DNA, 22 bp, Homo sapiens
gcagctgggtctgtgtgggctg

SEQ ID NO: 7026249 - DNA, 22 bp, Homo sapiens
tattcccaccctaagtagtagg

SEQ ID NO: 7026250 - DNA, 22 bp, Homo sapiens
ctggctttctgaacatcagtga

SEQ ID NO: 7026251 - DNA, 22 bp, Homo sapiens
ccaggagcgcgtgaacaggctg

SEQ ID NO: 7026252 - DNA, 22 bp, Homo sapiens
taaaggtcatcagattagcggg

SEQ ID NO: 7026253 - DNA, 22 bp, Homo sapiens
taacagtgtgaggtctcaggcg

SEQ ID NO: 7026254 - DNA, 22 bp, Homo sapiens
cacactagcacttcagaggttc

SEQ ID NO: 7026255 - DNA, 22 bp, Homo sapiens
tgtcacttcaggaatgcaggga

SEQ ID NO: 7026256 - DNA, 22 bp, Homo sapiens
gagggcactcgagactacggca

SEQ ID NO: 7026257 - DNA, 17 bp, Homo sapiens
aaacttcacggtcagcc

SEQ ID NO: 7026258 - DNA, 22 bp, Homo sapiens
acaatatgggatatacatttta

SEQ ID NO: 7026259 - DNA, 22 bp, Homo sapiens
aggtggatctcagctcatctaa

SEQ ID NO: 7026260 - DNA, 22 bp, Homo sapiens
aagatgcttgagaactgtttga

SEQ ID NO: 7026261 - DNA, 22 bp, Homo sapiens
atgacactgagaataacaggta

SEQ ID NO: 7026262 - DNA, 22 bp, Homo sapiens
acagtatgaatgcagaatgtag

SEQ ID NO: 7026263 - DNA, 22 bp, Homo sapiens
caaaacattcagagagctcact

SEQ ID NO: 7026264 - DNA, 22 bp, Homo sapiens
agtggcagagctgggatttggg

SEQ ID NO: 7026265 - DNA, 22 bp, Homo sapiens
ccagcttgaagatgtgctggtt

SEQ ID NO: 7026266 - DNA, 22 bp, Homo sapiens
agtgtacattctgtttgaggta

SEQ ID NO: 7026267 - DNA, 22 bp, Homo sapiens
gggccagagcttggcagctggg

SEQ ID NO: 7026268 - DNA, 22 bp, Homo sapiens
ggctgctctgcacaggggctgg

SEQ ID NO: 7026269 - DNA, 22 bp, Homo sapiens
aagaacatggtaggataacaaa

SEQ ID NO: 7026270 - DNA, 22 bp, Homo sapiens
ggaacattttttaaggcagaaa

SEQ ID NO: 7026271 - DNA, 22 bp, Homo sapiens
tttgagaaatgggctctgtgct

SEQ ID NO: 7026272 - DNA, 22 bp, Homo sapiens
gagaggaagccagggggtgttg

SEQ ID NO: 7026273 - DNA, 22 bp, Homo sapiens
atgtttcaagagaaaaagagac

SEQ ID NO: 7026274 - DNA, 22 bp, Homo sapiens
tcactgtctgaaagaaatggcc

SEQ ID NO: 7026275 - DNA, 22 bp, Homo sapiens
tccaaaggccctaataagcttg

SEQ ID NO: 7026276 - DNA, 22 bp, Homo sapiens
ttattgcagccgcagggcgctg

SEQ ID NO: 7026277 - DNA, 22 bp, Homo sapiens
acatgtgcagacagcaagcagg

SEQ ID NO: 7026278 - DNA, 22 bp, Homo sapiens
tcactctctaagcatgacagac

SEQ ID NO: 7026279 - DNA, 23 bp, Homo sapiens
cacattgaacactctctttcctg

SEQ ID NO: 7026280 - DNA, 22 bp, Homo sapiens
tcctggtgaggctagaagtgtc

SEQ ID NO: 7026281 - DNA, 22 bp, Homo sapiens
aggccacatagcttgcatgtag

SEQ ID NO: 7026282 - DNA, 22 bp, Homo sapiens
ttcactgtcctgcaactctaga

SEQ ID NO: 7026283 - DNA, 22 bp, Homo sapiens
gtaaagtacaagcctcattaca

SEQ ID NO: 7026284 - DNA, 22 bp, Homo sapiens
gggcaagcagtgaggacagcac

SEQ ID NO: 7026285 - DNA, 22 bp, Homo sapiens
cttctcagtcttggttagagag

SEQ ID NO: 7026286 - DNA, 22 bp, Homo sapiens
tgggagaagcagcagccaagtg

SEQ ID NO: 7026287 - DNA, 22 bp, Homo sapiens
cctgtcagggtttgcctcagaa

SEQ ID NO: 7026288 - DNA, 22 bp, Homo sapiens
gaggccctggtaggtcagagtg

SEQ ID NO: 7026289 - DNA, 20 bp, Homo sapiens
ctagtctcacatccctggca

SEQ ID NO: 7026290 - DNA, 22 bp, Homo sapiens
taaagcatttttgaaattatga

SEQ ID NO: 7026291 - DNA, 22 bp, Homo sapiens
aactgttacatagttatagatc

SEQ ID NO: 7026292 - DNA, 22 bp, Homo sapiens
cctgtgtgctgatgacgacaga

SEQ ID NO: 7026293 - DNA, 22 bp, Homo sapiens
ctcaagcctgctgagttttgga

SEQ ID NO: 7026294 - DNA, 18 bp, Homo sapiens
aaacatggcttaaaggct

SEQ ID NO: 7026295 - DNA, 22 bp, Homo sapiens
gaggctgggaagtccaatatca

SEQ ID NO: 7026296 - DNA, 22 bp, Homo sapiens
atttaattaatcatggtgaatt

SEQ ID NO: 7026297 - DNA, 22 bp, Homo sapiens
aagtttagcttgagatggaaag

SEQ ID NO: 7026298 - DNA, 22 bp, Homo sapiens
caggcaggagccagggattcca

SEQ ID NO: 7026299 - DNA, 22 bp, Homo sapiens
tactaagtggggcattgttata

SEQ ID NO: 7026300 - DNA, 22 bp, Homo sapiens
ccctttggaagaggctcactga

SEQ ID NO: 7026301 - DNA, 22 bp, Homo sapiens
gcaagaaaaaggcttcatgaac

SEQ ID NO: 7026302 - DNA, 22 bp, Homo sapiens
aagccaggataaagttgtttta

SEQ ID NO: 7026303 - DNA, 22 bp, Homo sapiens
tgtttaataattctatgatagt

SEQ ID NO: 7026304 - DNA, 22 bp, Homo sapiens
tatattgaaatgattcagccct

SEQ ID NO: 7026305 - DNA, 22 bp, Homo sapiens
gcttggcatatacttagtgcat

SEQ ID NO: 7026306 - DNA, 17 bp, Homo sapiens
aggcaacctttggtaca

SEQ ID NO: 7026307 - DNA, 23 bp, Homo sapiens
tgacagctgcccagagggtttgg

SEQ ID NO: 7026308 - DNA, 22 bp, Homo sapiens
accatgcatcaaagctaatata

SEQ ID NO: 7026309 - DNA, 22 bp, Homo sapiens
cctggatctcctctattcatat

SEQ ID NO: 7026310 - DNA, 22 bp, Homo sapiens
atgtgagtgtatacttacgtgt

SEQ ID NO: 7026311 - DNA, 22 bp, Homo sapiens
cctgcagcctcttctgaaaatc

SEQ ID NO: 7026312 - DNA, 22 bp, Homo sapiens
gtttcagactattctgtttctg

SEQ ID NO: 7026313 - DNA, 22 bp, Homo sapiens
aaatcactgattaaagttagaa

SEQ ID NO: 7026314 - DNA, 19 bp, Homo sapiens
tgaggattgaggtccagta

SEQ ID NO: 7026315 - DNA, 22 bp, Homo sapiens
gctgggctcagacctagtgaac

SEQ ID NO: 7026316 - DNA, 22 bp, Homo sapiens
ttcctgtgtgaccgagacagtg

SEQ ID NO: 7026317 - DNA, 22 bp, Homo sapiens
gacatctggaggagatgaatgg

SEQ ID NO: 7026318 - DNA, 22 bp, Homo sapiens
gggaggacggtccagggcaaag

SEQ ID NO: 7026319 - DNA, 23 bp, Homo sapiens
aggtggccaccagaatgttaagg

SEQ ID NO: 7026320 - DNA, 18 bp, Homo sapiens
tcatggcttgcagatggt

SEQ ID NO: 7026321 - DNA, 22 bp, Homo sapiens
aaaatctaagtagcgagtaagg

SEQ ID NO: 7026322 - DNA, 22 bp, Homo sapiens
tctagtttaagatctgttagtc

SEQ ID NO: 7026323 - DNA, 22 bp, Homo sapiens
gggaacactccagggcttggaa

SEQ ID NO: 7026324 - DNA, 22 bp, Homo sapiens
taccagcatcacagcatgttgg

SEQ ID NO: 7026325 - DNA, 19 bp, Homo sapiens
ttcacatttttgtggcact

SEQ ID NO: 7026326 - DNA, 22 bp, Homo sapiens
tcttccaggtatgtttctagtt

SEQ ID NO: 7026327 - DNA, 22 bp, Homo sapiens
cctcggggcaccgcggcctgct

SEQ ID NO: 7026328 - DNA, 22 bp, Homo sapiens
ctctattctaatggattctggg

SEQ ID NO: 7026329 - DNA, 22 bp, Homo sapiens
gtgtattagtgagaaggaagat

SEQ ID NO: 7026330 - DNA, 22 bp, Homo sapiens
cctctgggggcttccttaccct

SEQ ID NO: 7026331 - DNA, 20 bp, Homo sapiens
accccagtgtgtgcctcaag

SEQ ID NO: 7026332 - DNA, 22 bp, Homo sapiens
gcagcctgggcaacagagtgag

SEQ ID NO: 7026333 - DNA, 22 bp, Homo sapiens
acatgattgtctggcttggcca

SEQ ID NO: 7026334 - DNA, 22 bp, Homo sapiens
agcttgcctgtttcctagggct

SEQ ID NO: 7026335 - DNA, 19 bp, Homo sapiens
gtgggccaggcagaaggct

SEQ ID NO: 7026336 - DNA, 22 bp, Homo sapiens
ccttgagatgagctaatttttt

SEQ ID NO: 7026337 - DNA, 22 bp, Homo sapiens
gactgtggactctcatgataga

SEQ ID NO: 7026338 - DNA, 22 bp, Homo sapiens
tcctctgaatgtacttcataat

SEQ ID NO: 7026339 - DNA, 22 bp, Homo sapiens
ctacttctaagtacatggtgat

SEQ ID NO: 7026340 - DNA, 22 bp, Homo sapiens
cttcataatctgaaatttgtaa

SEQ ID NO: 7026341 - DNA, 22 bp, Homo sapiens
gcaggcctgactgtagggggca

SEQ ID NO: 7026342 - DNA, 18 bp, Homo sapiens
gttaacaattactaacgc

SEQ ID NO: 7026343 - DNA, 22 bp, Homo sapiens
tttatccattcaccagttgaac

SEQ ID NO: 7026344 - DNA, 22 bp, Homo sapiens
gaatttcattgctctgctgtgt

SEQ ID NO: 7026345 - DNA, 22 bp, Homo sapiens
agacagtggatcgggatgcact

SEQ ID NO: 7026346 - DNA, 22 bp, Homo sapiens
aatatatttgaatcaggaacaa

SEQ ID NO: 7026347 - DNA, 22 bp, Homo sapiens
gggcccaggcctccttccttcc

SEQ ID NO: 7026348 - DNA, 22 bp, Homo sapiens
tgtctgaactgcatttgctcct

SEQ ID NO: 7026349 - DNA, 22 bp, Homo sapiens
tgtcctcacatggtggggagag

SEQ ID NO: 7026350 - DNA, 22 bp, Homo sapiens
gctcgtgagagcggctcgtcat

SEQ ID NO: 7026351 - DNA, 22 bp, Homo sapiens
tgaagaatgttgcagtgagcat

SEQ ID NO: 7026352 - DNA, 22 bp, Homo sapiens
atctgcctgcagtggaggtggg

SEQ ID NO: 7026353 - DNA, 22 bp, Homo sapiens
ttggaggttccatgatttgtct

SEQ ID NO: 7026354 - DNA, 22 bp, Homo sapiens
gcagggctgtttagtgaatagg

SEQ ID NO: 7026355 - DNA, 22 bp, Homo sapiens
tagcactatcttgggatttgga

SEQ ID NO: 7026356 - DNA, 17 bp, Homo sapiens
tttggtaatatattaag

SEQ ID NO: 7026357 - DNA, 22 bp, Homo sapiens
ctgccccaccccaacctgaggt

SEQ ID NO: 7026358 - DNA, 22 bp, Homo sapiens
agtacacagtagactttctcat

SEQ ID NO: 7026359 - DNA, 22 bp, Homo sapiens
tggcagcagtagccaccccagc

SEQ ID NO: 7026360 - DNA, 22 bp, Homo sapiens
ctgaataatacagactagcttc

SEQ ID NO: 7026361 - DNA, 22 bp, Homo sapiens
ttgcataatagctacccactca

SEQ ID NO: 7026362 - DNA, 22 bp, Homo sapiens
cagtggacacttcctctacaat

SEQ ID NO: 7026363 - DNA, 18 bp, Homo sapiens
gaggtcctgctctagccc

SEQ ID NO: 7026364 - DNA, 21 bp, Homo sapiens
atcccggctttgaggcagatg

SEQ ID NO: 7026365 - DNA, 23 bp, Homo sapiens
tcccatctattgtgatcaatgcc

SEQ ID NO: 7026366 - DNA, 22 bp, Homo sapiens
aggacaggattgagctgaactg

SEQ ID NO: 7026367 - DNA, 20 bp, Homo sapiens
agtgtgcatttagagtctgc

SEQ ID NO: 7026368 - DNA, 22 bp, Homo sapiens
ttatgtgaggttcagctttatc

SEQ ID NO: 7026369 - DNA, 22 bp, Homo sapiens
tcagttaacggaaaggggtgtg

SEQ ID NO: 7026370 - DNA, 22 bp, Homo sapiens
catctcaggtctgtggttcact

SEQ ID NO: 7026371 - DNA, 22 bp, Homo sapiens
aagtttaacttgaattctttct

SEQ ID NO: 7026372 - DNA, 22 bp, Homo sapiens
cctgatgtccataatcctgtaa

SEQ ID NO: 7026373 - DNA, 22 bp, Homo sapiens
tggtggctcacacctgtaatcc

SEQ ID NO: 7026374 - DNA, 22 bp, Homo sapiens
atttgacagtgagttgtggatg

SEQ ID NO: 7026375 - DNA, 22 bp, Homo sapiens
cagctggtgtcaggcactgcag

SEQ ID NO: 7026376 - DNA, 22 bp, Homo sapiens
tcaatgtcttctcaagtctttt

SEQ ID NO: 7026377 - DNA, 22 bp, Homo sapiens
gcacagtcaacacttattcacc

SEQ ID NO: 7026378 - DNA, 22 bp, Homo sapiens
gtattagctgatggtcctgtct

SEQ ID NO: 7026379 - DNA, 22 bp, Homo sapiens
atgtgtcattatccagaataac

SEQ ID NO: 7026380 - DNA, 20 bp, Homo sapiens
tgccgggcagcctgaggagt

SEQ ID NO: 7026381 - DNA, 22 bp, Homo sapiens
ggtctcagccctcgccagcagc

SEQ ID NO: 7026382 - DNA, 22 bp, Homo sapiens
gaacagcagctcgttctcgatg

SEQ ID NO: 7026383 - DNA, 22 bp, Homo sapiens
ttccagtctggcctgtgcttag

SEQ ID NO: 7026384 - DNA, 22 bp, Homo sapiens
gtgctctagaaattgtcagtgg

SEQ ID NO: 7026385 - DNA, 22 bp, Homo sapiens
aacatttgtactaaagaagttc

SEQ ID NO: 7026386 - DNA, 22 bp, Homo sapiens
gctggggagggcgtcaaggcca

SEQ ID NO: 7026387 - DNA, 22 bp, Homo sapiens
tccaaatatacagaatctcctc

SEQ ID NO: 7026388 - DNA, 22 bp, Homo sapiens
atgaaggctgtgtggagccccc

SEQ ID NO: 7026389 - DNA, 22 bp, Homo sapiens
cctatgactctgattctttaga

SEQ ID NO: 7026390 - DNA, 22 bp, Homo sapiens
tgtacagagactaccattaata

SEQ ID NO: 7026391 - DNA, 22 bp, Homo sapiens
tagcaggagcagcctgcctaga

SEQ ID NO: 7026392 - DNA, 22 bp, Homo sapiens
tgagagagcgcctgggatcatt

SEQ ID NO: 7026393 - DNA, 22 bp, Homo sapiens
tatccatctttgaaactttaag

SEQ ID NO: 7026394 - DNA, 22 bp, Homo sapiens
gaggcagctgggctggtggttt

SEQ ID NO: 7026395 - DNA, 22 bp, Homo sapiens
gtttcctttttctgccctcaat

SEQ ID NO: 7026396 - DNA, 22 bp, Homo sapiens
catcagaaccagctgggtgagg

SEQ ID NO: 7026397 - DNA, 22 bp, Homo sapiens
tattttaaagactgccagccta

SEQ ID NO: 7026398 - DNA, 20 bp, Homo sapiens
tggaagttctgttgcattgg

SEQ ID NO: 7026399 - DNA, 22 bp, Homo sapiens
cagctacaggacctgatgcacc

SEQ ID NO: 7026400 - DNA, 20 bp, Homo sapiens
ctgcttccaggctcaccccc

SEQ ID NO: 7026401 - DNA, 22 bp, Homo sapiens
gcattggcatttctccagcgga

SEQ ID NO: 7026402 - DNA, 22 bp, Homo sapiens
tatcacagtaaatctgggtgca

SEQ ID NO: 7026403 - DNA, 22 bp, Homo sapiens
gtcctgcaggagttgtactctg

SEQ ID NO: 7026404 - DNA, 22 bp, Homo sapiens
gacagggacgaggcttcaggca

SEQ ID NO: 7026405 - DNA, 22 bp, Homo sapiens
aaggttatgcaagaacagggac

SEQ ID NO: 7026406 - DNA, 22 bp, Homo sapiens
aatgtacaaaagtcagccaact

SEQ ID NO: 7026407 - DNA, 22 bp, Homo sapiens
aactctagtgctccttggagga

SEQ ID NO: 7026408 - DNA, 22 bp, Homo sapiens
gtggcagcatggcttttagctg

SEQ ID NO: 7026409 - DNA, 22 bp, Homo sapiens
ggtgaattctcagcttttacaa

SEQ ID NO: 7026410 - DNA, 22 bp, Homo sapiens
ctcaggggacctggctccgagt

SEQ ID NO: 7026411 - DNA, 22 bp, Homo sapiens
agtttgaaagcttaacagtaca

SEQ ID NO: 7026412 - DNA, 22 bp, Homo sapiens
ctgggaccctgccctgtggcct

SEQ ID NO: 7026413 - DNA, 22 bp, Homo sapiens
tgcctgttattgttggcttagt

SEQ ID NO: 7026414 - DNA, 23 bp, Homo sapiens
ggcctatgggcaggcaaggaagc

SEQ ID NO: 7026415 - DNA, 22 bp, Homo sapiens
ttacttcttgtctcatgcctat

SEQ ID NO: 7026416 - DNA, 22 bp, Homo sapiens
ctctgcagaatttgagctgctc

SEQ ID NO: 7026417 - DNA, 22 bp, Homo sapiens
gtccacattttaaacttatgga

SEQ ID NO: 7026418 - DNA, 20 bp, Homo sapiens
agctatgtgacctgatggaa

SEQ ID NO: 7026419 - DNA, 22 bp, Homo sapiens
ggcaggtagcctagaggaggtt

SEQ ID NO: 7026420 - DNA, 22 bp, Homo sapiens
gtggaatttttacctatgaatg

SEQ ID NO: 7026421 - DNA, 16 bp, Homo sapiens
tggcttcttatttcta

SEQ ID NO: 7026422 - DNA, 22 bp, Homo sapiens
aataccttgctcatagggctga

SEQ ID NO: 7026423 - DNA, 22 bp, Homo sapiens
cgtaatggtttatgttgcagga

SEQ ID NO: 7026424 - DNA, 22 bp, Homo sapiens
tagcacagttcactatgataca

SEQ ID NO: 7026425 - DNA, 22 bp, Homo sapiens
ccctggaactgccaagcctcag

SEQ ID NO: 7026426 - DNA, 22 bp, Homo sapiens
tgcctgaacatgaatagtttat

SEQ ID NO: 7026427 - DNA, 22 bp, Homo sapiens
tttgactcttagcccaggactc

SEQ ID NO: 7026428 - DNA, 22 bp, Homo sapiens
attgttccctactgttcaactg

SEQ ID NO: 7026429 - DNA, 22 bp, Homo sapiens
agtgtccttgattcctgttgtt

SEQ ID NO: 7026430 - DNA, 22 bp, Homo sapiens
tctggcatcactcgcaagagca

SEQ ID NO: 7026431 - DNA, 22 bp, Homo sapiens
tgtgaggctacctgccagggtc

SEQ ID NO: 7026432 - DNA, 22 bp, Homo sapiens
aaaagctcattgataaaaagtc

SEQ ID NO: 7026433 - DNA, 22 bp, Homo sapiens
gttcttcagaggtcggaggcta

SEQ ID NO: 7026434 - DNA, 22 bp, Homo sapiens
taggtttactgaattagtggaa

SEQ ID NO: 7026435 - DNA, 22 bp, Homo sapiens
tggtgttttctttagactttat

SEQ ID NO: 7026436 - DNA, 22 bp, Homo sapiens
gagacacagttatcaggcatac

SEQ ID NO: 7026437 - DNA, 22 bp, Homo sapiens
tcagggttgtggtggaattcag

SEQ ID NO: 7026438 - DNA, 22 bp, Homo sapiens
acttgtctttaatccgaatgta

SEQ ID NO: 7026439 - DNA, 22 bp, Homo sapiens
agtggcagggctggctgctgca

SEQ ID NO: 7026440 - DNA, 22 bp, Homo sapiens
agacagacatgctagttttctt

SEQ ID NO: 7026441 - DNA, 22 bp, Homo sapiens
ggagcggtcagctggccacacg

SEQ ID NO: 7026442 - DNA, 22 bp, Homo sapiens
gtggtaaagctgattgaattga

SEQ ID NO: 7026443 - DNA, 22 bp, Homo sapiens
cctgttcaagttgcagggctgg

SEQ ID NO: 7026444 - DNA, 23 bp, Homo sapiens
tgctgggtatcagaatcactgag

SEQ ID NO: 7026445 - DNA, 22 bp, Homo sapiens
ccagtgtgcattatcatgtgtc

SEQ ID NO: 7026446 - DNA, 22 bp, Homo sapiens
gggagccacagtttatagtgat

SEQ ID NO: 7026447 - DNA, 22 bp, Homo sapiens
agcagctagaatagtgcctggt

SEQ ID NO: 7026448 - DNA, 22 bp, Homo sapiens
tgctgggtggacttggctctca

SEQ ID NO: 7026449 - DNA, 22 bp, Homo sapiens
attcatttgctattgtgtatgg

SEQ ID NO: 7026450 - DNA, 22 bp, Homo sapiens
agacaaacccagtggctgtttt

SEQ ID NO: 7026451 - DNA, 22 bp, Homo sapiens
acaggcctgatgccttggctgg

SEQ ID NO: 7026452 - DNA, 22 bp, Homo sapiens
agaggtctgagcaatctcaagc

SEQ ID NO: 7026453 - DNA, 22 bp, Homo sapiens
agcgaggtgagtcctccagctc

SEQ ID NO: 7026454 - DNA, 21 bp, Homo sapiens
tttgttcacacacagggcagc

SEQ ID NO: 7026455 - DNA, 22 bp, Homo sapiens
actgccttataatatgtcaaca

SEQ ID NO: 7026456 - DNA, 22 bp, Homo sapiens
gtagttagagttgtgctggaga

SEQ ID NO: 7026457 - DNA, 22 bp, Homo sapiens
cttcaaagattattgaaaacaa

SEQ ID NO: 7026458 - DNA, 17 bp, Homo sapiens
ctgggcctctgcccttt

SEQ ID NO: 7026459 - DNA, 22 bp, Homo sapiens
ttcataatgaggtcctagaggc

SEQ ID NO: 7026460 - DNA, 22 bp, Homo sapiens
cttaaagtctatcctttctaga

SEQ ID NO: 7026461 - DNA, 22 bp, Homo sapiens
ctagagtgaagggtcttgaggc

SEQ ID NO: 7026462 - DNA, 22 bp, Homo sapiens
catttgctggggtcttgggagt

SEQ ID NO: 7026463 - DNA, 22 bp, Homo sapiens
ttgcctcccagcatgggcagct

SEQ ID NO: 7026464 - DNA, 22 bp, Homo sapiens
tcaagatgaaccaggacattca

SEQ ID NO: 7026465 - DNA, 22 bp, Homo sapiens
tcaggagggattgttgcctatt

SEQ ID NO: 7026466 - DNA, 22 bp, Homo sapiens
gtgcgggggttcccagcagccg

SEQ ID NO: 7026467 - DNA, 22 bp, Homo sapiens
ataatgtttcagtactgtctgt

SEQ ID NO: 7026468 - DNA, 22 bp, Homo sapiens
atggcacatgaccttgatggat

SEQ ID NO: 7026469 - DNA, 22 bp, Homo sapiens
tagaatcccagccagctggaag

SEQ ID NO: 7026470 - DNA, 22 bp, Homo sapiens
ggtgaaatatttttgatatgtt

SEQ ID NO: 7026471 - DNA, 22 bp, Homo sapiens
tggagttcctttgaaaggctct

SEQ ID NO: 7026472 - DNA, 22 bp, Homo sapiens
gagtcaccactgtgatagtcga

SEQ ID NO: 7026473 - DNA, 20 bp, Homo sapiens
tccaggccttgttctcagat

SEQ ID NO: 7026474 - DNA, 22 bp, Homo sapiens
tgacacaggggaaggagtctgg

SEQ ID NO: 7026475 - DNA, 21 bp, Homo sapiens
gaagttcatgatctttctgct

SEQ ID NO: 7026476 - DNA, 22 bp, Homo sapiens
ttcccagagaaggatgaaaaag

SEQ ID NO: 7026477 - DNA, 22 bp, Homo sapiens
agagtactgcctcagttatgaa

SEQ ID NO: 7026478 - DNA, 22 bp, Homo sapiens
aaagacagatggcaaggatgat

SEQ ID NO: 7026479 - DNA, 22 bp, Homo sapiens
ggtgccagtgggtctcaggata

SEQ ID NO: 7026480 - DNA, 22 bp, Homo sapiens
gtacaagtgctgtgagggaaaa

SEQ ID NO: 7026481 - DNA, 22 bp, Homo sapiens
aggttcaaatgcaagagatgct

SEQ ID NO: 7026482 - DNA, 22 bp, Homo sapiens
acagtgataaaatttcacatgt

SEQ ID NO: 7026483 - DNA, 22 bp, Homo sapiens
tagctgttattttgctacccat

SEQ ID NO: 7026484 - DNA, 22 bp, Homo sapiens
gtcctggtgggacaatggacat

SEQ ID NO: 7026485 - DNA, 22 bp, Homo sapiens
aatgtgtgaacactaatgcaac

SEQ ID NO: 7026486 - DNA, 22 bp, Homo sapiens
ctggctcctccaaggcctggag

SEQ ID NO: 7026487 - DNA, 22 bp, Homo sapiens
ggaaccttagtgttcttttacc

SEQ ID NO: 7026488 - DNA, 22 bp, Homo sapiens
agagctgaaaaagctgacccgg

SEQ ID NO: 7026489 - DNA, 22 bp, Homo sapiens
agcccttagtacatttctcaag

SEQ ID NO: 7026490 - DNA, 22 bp, Homo sapiens
gcaaagaaagttttaatgaggt

SEQ ID NO: 7026491 - DNA, 22 bp, Homo sapiens
cttagttttattaaggaggatt

SEQ ID NO: 7026492 - DNA, 22 bp, Homo sapiens
caggctgaagtgcagtggtgtg

SEQ ID NO: 7026493 - DNA, 22 bp, Homo sapiens
gatgggctgtctgagcgctgtg

SEQ ID NO: 7026494 - DNA, 22 bp, Homo sapiens
tttgacagagctcttagtctct

SEQ ID NO: 7026495 - DNA, 22 bp, Homo sapiens
cctgggctttcaaaaccagcct

SEQ ID NO: 7026496 - DNA, 22 bp, Homo sapiens
ccatgatttgagctacttactg

SEQ ID NO: 7026497 - DNA, 21 bp, Homo sapiens
tgtcagttataatcaccacag

SEQ ID NO: 7026498 - DNA, 22 bp, Homo sapiens
gtggcattttagaacagctgac

SEQ ID NO: 7026499 - DNA, 22 bp, Homo sapiens
tcaggtaagtgtaatatataga

SEQ ID NO: 7026500 - DNA, 22 bp, Homo sapiens
tcaggagtgccagtaccttttg

SEQ ID NO: 7026501 - DNA, 23 bp, Homo sapiens
aaatgccagggagacaggaacca

SEQ ID NO: 7026502 - DNA, 22 bp, Homo sapiens
agaggctagagatctgtcctac

SEQ ID NO: 7026503 - DNA, 22 bp, Homo sapiens
atcctctatgatatgtatgggt

SEQ ID NO: 7026504 - DNA, 22 bp, Homo sapiens
caggaagggggatccttggaag

SEQ ID NO: 7026505 - DNA, 22 bp, Homo sapiens
gagcacagggaatagacagata

SEQ ID NO: 7026506 - DNA, 22 bp, Homo sapiens
ctccactcaccagatgccagga

SEQ ID NO: 7026507 - DNA, 22 bp, Homo sapiens
aacagacatatttttaatatgc

SEQ ID NO: 7026508 - DNA, 22 bp, Homo sapiens
ttgtgaaaagccgcaagtatag

SEQ ID NO: 7026509 - DNA, 22 bp, Homo sapiens
aaggcctccctctttcatggga

SEQ ID NO: 7026510 - DNA, 22 bp, Homo sapiens
tcccagtgtggcaggccatgga

SEQ ID NO: 7026511 - DNA, 22 bp, Homo sapiens
tcttgattacaaataacatcat

SEQ ID NO: 7026512 - DNA, 22 bp, Homo sapiens
tcaacactaaagaataatcttt

SEQ ID NO: 7026513 - DNA, 22 bp, Homo sapiens
attcagcaatgagcttggattt

SEQ ID NO: 7026514 - DNA, 22 bp, Homo sapiens
agtgaaatgatagtgtaaatac

SEQ ID NO: 7026515 - DNA, 22 bp, Homo sapiens
tttggaaactgcctcagctctt

SEQ ID NO: 7026516 - DNA, 22 bp, Homo sapiens
tctgtccatgcttttctctcac

SEQ ID NO: 7026517 - DNA, 22 bp, Homo sapiens
agagtgtggaacttgaggagct

SEQ ID NO: 7026518 - DNA, 22 bp, Homo sapiens
tgctctggtcctccctcggcgc

SEQ ID NO: 7026519 - DNA, 22 bp, Homo sapiens
cacgggcagtgagcacagcctg

SEQ ID NO: 7026520 - DNA, 22 bp, Homo sapiens
ggatcagaggatcagggacagt

SEQ ID NO: 7026521 - DNA, 22 bp, Homo sapiens
tttgaatagggctttgcaggga

SEQ ID NO: 7026522 - DNA, 22 bp, Homo sapiens
ctgctggcttctagtcattcaa

SEQ ID NO: 7026523 - DNA, 22 bp, Homo sapiens
tggatttattaggttggtgaaa

SEQ ID NO: 7026524 - DNA, 22 bp, Homo sapiens
tggacagggcagagaccgagtc

SEQ ID NO: 7026525 - DNA, 22 bp, Homo sapiens
ttgacagagctaggtcaactct

SEQ ID NO: 7026526 - DNA, 22 bp, Homo sapiens
attgagaatgaagggacatttt

SEQ ID NO: 7026527 - DNA, 22 bp, Homo sapiens
tcattcatcagttggtagagat

SEQ ID NO: 7026528 - DNA, 22 bp, Homo sapiens
tcacatacattgcctttggaag

SEQ ID NO: 7026529 - DNA, 18 bp, Homo sapiens
attttgaacaatgctgta

SEQ ID NO: 7026530 - DNA, 22 bp, Homo sapiens
ctgtgccctggccaggcctctc

SEQ ID NO: 7026531 - DNA, 22 bp, Homo sapiens
tgaggtaggaggattgattgag

SEQ ID NO: 7026532 - DNA, 22 bp, Homo sapiens
ctgaggtggcgcctctctttaa

SEQ ID NO: 7026533 - DNA, 22 bp, Homo sapiens
tcctagttctggttctgtcact

SEQ ID NO: 7026534 - DNA, 22 bp, Homo sapiens
tgtattccaaaatgctgaggat

SEQ ID NO: 7026535 - DNA, 22 bp, Homo sapiens
ggaggactgagacactcctggc

SEQ ID NO: 7026536 - DNA, 22 bp, Homo sapiens
tgtacagtacatgtgtagtgat

SEQ ID NO: 7026537 - DNA, 22 bp, Homo sapiens
atgctgcagctgcaggatcaga

SEQ ID NO: 7026538 - DNA, 23 bp, Homo sapiens
tgaaagttctgaagagatcatgc

SEQ ID NO: 7026539 - DNA, 21 bp, Homo sapiens
ttcagctctgcttcagggaat

SEQ ID NO: 7026540 - DNA, 19 bp, Homo sapiens
ccccaaagtttagatgttg

SEQ ID NO: 7026541 - DNA, 22 bp, Homo sapiens
tgagtaataaactgtcttgctc

SEQ ID NO: 7026542 - DNA, 22 bp, Homo sapiens
aattgctttgaagaagggagcg

SEQ ID NO: 7026543 - DNA, 22 bp, Homo sapiens
gcctcagctgttgcaggggccc

SEQ ID NO: 7026544 - DNA, 22 bp, Homo sapiens
acagtttggcagtttcttacta

SEQ ID NO: 7026545 - DNA, 22 bp, Homo sapiens
atgtgcttgcagatgagcctca

SEQ ID NO: 7026546 - DNA, 23 bp, Homo sapiens
ctgttattccaggctgatgggtg

SEQ ID NO: 7026547 - DNA, 22 bp, Homo sapiens
agccaactaggagattaaggta

SEQ ID NO: 7026548 - DNA, 22 bp, Homo sapiens
atgggcagttaggaggccagga

SEQ ID NO: 7026549 - DNA, 22 bp, Homo sapiens
cagtagtgaaaagcagcccagc

SEQ ID NO: 7026550 - DNA, 19 bp, Homo sapiens
aacatcatggctctttcca

SEQ ID NO: 7026551 - DNA, 22 bp, Homo sapiens
cctctgactcctggacttgggg

SEQ ID NO: 7026552 - DNA, 22 bp, Homo sapiens
ccagtgttccctcgggttcatg

SEQ ID NO: 7026553 - DNA, 16 bp, Homo sapiens
gctctgctgaggccca

SEQ ID NO: 7026554 - DNA, 18 bp, Homo sapiens
gcattctgttaatgtgga

SEQ ID NO: 7026555 - DNA, 22 bp, Homo sapiens
ctgaagctgaaaacttccagca

SEQ ID NO: 7026556 - DNA, 22 bp, Homo sapiens
acagtacatagatctctaccct

SEQ ID NO: 7026557 - DNA, 22 bp, Homo sapiens
gggaaattaatgactggttgga

SEQ ID NO: 7026558 - DNA, 22 bp, Homo sapiens
tctccccagctgagctgccctt

SEQ ID NO: 7026559 - DNA, 22 bp, Homo sapiens
ggctcaggcctgtaatcctagc

SEQ ID NO: 7026560 - DNA, 22 bp, Homo sapiens
tcttctgttttagattgcatac

SEQ ID NO: 7026561 - DNA, 22 bp, Homo sapiens
tggctacatcacagagaattcc

SEQ ID NO: 7026562 - DNA, 22 bp, Homo sapiens
gggctctgaatgagttaccaag

SEQ ID NO: 7026563 - DNA, 22 bp, Homo sapiens
gatgtgtcctagtacgggtggg

SEQ ID NO: 7026564 - DNA, 22 bp, Homo sapiens
gtaaatgtttgctgatgattct

SEQ ID NO: 7026565 - DNA, 22 bp, Homo sapiens
ttttggaatctgggaaaacagt

SEQ ID NO: 7026566 - DNA, 22 bp, Homo sapiens
tcacattaggaagtaatgttgt

SEQ ID NO: 7026567 - DNA, 22 bp, Homo sapiens
tggcagatagagctcctgaaga

SEQ ID NO: 7026568 - DNA, 23 bp, Homo sapiens
agctgtgtgcgcgtccgggttct

SEQ ID NO: 7026569 - DNA, 22 bp, Homo sapiens
ttcttaatggcaaaggatttta

SEQ ID NO: 7026570 - DNA, 22 bp, Homo sapiens
tcagctctacacacacctgtgt

SEQ ID NO: 7026571 - DNA, 17 bp, Homo sapiens
ttgcctttatggtcact

SEQ ID NO: 7026572 - DNA, 22 bp, Homo sapiens
cggatcctcagtcgtgcgggag

SEQ ID NO: 7026573 - DNA, 22 bp, Homo sapiens
aggaaactgggtatggttatac

SEQ ID NO: 7026574 - DNA, 21 bp, Homo sapiens
tatctacagtgtccattcagt

SEQ ID NO: 7026575 - DNA, 22 bp, Homo sapiens
aaataatcaatttttgtagata

SEQ ID NO: 7026576 - DNA, 22 bp, Homo sapiens
gagaagtttttcttattacatg

SEQ ID NO: 7026577 - DNA, 22 bp, Homo sapiens
aatgtgacaagcacagactgtg

SEQ ID NO: 7026578 - DNA, 22 bp, Homo sapiens
aaaggagataaagggcccttca

SEQ ID NO: 7026579 - DNA, 22 bp, Homo sapiens
ggcctgtgctgagaacctggct

SEQ ID NO: 7026580 - DNA, 22 bp, Homo sapiens
acagggccaagtaaaccctacc

SEQ ID NO: 7026581 - DNA, 22 bp, Homo sapiens
aactagttttagctctagcaac

SEQ ID NO: 7026582 - DNA, 22 bp, Homo sapiens
aagactacttttggcagtgtgt

SEQ ID NO: 7026583 - DNA, 22 bp, Homo sapiens
tctgcttatcactagagacaga

SEQ ID NO: 7026584 - DNA, 22 bp, Homo sapiens
cctggcttctcaccttgttctg

SEQ ID NO: 7026585 - DNA, 19 bp, Homo sapiens
cctgagttgggtgaagaga

SEQ ID NO: 7026586 - DNA, 22 bp, Homo sapiens
tctcattaaaacattttaatta

SEQ ID NO: 7026587 - DNA, 22 bp, Homo sapiens
tattatcattggtaatatggtc

SEQ ID NO: 7026588 - DNA, 22 bp, Homo sapiens
ttcagcagttcctattagatgt

SEQ ID NO: 7026589 - DNA, 22 bp, Homo sapiens
gtgttgatgacattttagaaac

SEQ ID NO: 7026590 - DNA, 22 bp, Homo sapiens
tctgtgccagcagcctcctgga

SEQ ID NO: 7026591 - DNA, 22 bp, Homo sapiens
ttcctgccctgcctgtgccact

SEQ ID NO: 7026592 - DNA, 22 bp, Homo sapiens
tagagcattctatctccaacag

SEQ ID NO: 7026593 - DNA, 22 bp, Homo sapiens
ggatgcaggagttgaagaagga

SEQ ID NO: 7026594 - DNA, 17 bp, Homo sapiens
ttagcaaaatagcactt

SEQ ID NO: 7026595 - DNA, 22 bp, Homo sapiens
caggaaatgaacaggaatgaac

SEQ ID NO: 7026596 - DNA, 22 bp, Homo sapiens
ctctaaatccacggtatagttg

SEQ ID NO: 7026597 - DNA, 16 bp, Homo sapiens
atctaagaatgtagag

SEQ ID NO: 7026598 - DNA, 19 bp, Homo sapiens
tctcttgaataggtcaaac

SEQ ID NO: 7026599 - DNA, 22 bp, Homo sapiens
atggtttaaagagtatgacttt

SEQ ID NO: 7026600 - DNA, 22 bp, Homo sapiens
ggagaactccaaatccatattt

SEQ ID NO: 7026601 - DNA, 22 bp, Homo sapiens
gtggcatttgctgaagagcggt

SEQ ID NO: 7026602 - DNA, 23 bp, Homo sapiens
tttgaagcattttgtatcttagt

SEQ ID NO: 7026603 - DNA, 22 bp, Homo sapiens
ctttggaatgcacagaggtgta

SEQ ID NO: 7026604 - DNA, 22 bp, Homo sapiens
tatgtgtgctttttccatgcat

SEQ ID NO: 7026605 - DNA, 22 bp, Homo sapiens
actgtctgagctgattgagcta

SEQ ID NO: 7026606 - DNA, 22 bp, Homo sapiens
acagaagtggcttcaaagagca

SEQ ID NO: 7026607 - DNA, 22 bp, Homo sapiens
ttctttttggatagctgatgaa

SEQ ID NO: 7026608 - DNA, 22 bp, Homo sapiens
ttttcttaggtgctccaagtag

SEQ ID NO: 7026609 - DNA, 22 bp, Homo sapiens
ccagcagagctcaaacttcctg

SEQ ID NO: 7026610 - DNA, 22 bp, Homo sapiens
ggactgaagtgctgtctagtgt

SEQ ID NO: 7026611 - DNA, 22 bp, Homo sapiens
agttcagcttcccaggtcactg

SEQ ID NO: 7026612 - DNA, 22 bp, Homo sapiens
tcagtgtccggagcctgagtgc

SEQ ID NO: 7026613 - DNA, 22 bp, Homo sapiens
tgagtcttttatcctgggaatg

SEQ ID NO: 7026614 - DNA, 22 bp, Homo sapiens
gaagctaaaccacagctaagaa

SEQ ID NO: 7026615 - DNA, 22 bp, Homo sapiens
tcctgattaggtttccatagct

SEQ ID NO: 7026616 - DNA, 22 bp, Homo sapiens
ggagctgggaactatgtagtat

SEQ ID NO: 7026617 - DNA, 22 bp, Homo sapiens
ggttatttctgattatatgata

SEQ ID NO: 7026618 - DNA, 22 bp, Homo sapiens
agaaaaactaagagtgggtggt

SEQ ID NO: 7026619 - DNA, 22 bp, Homo sapiens
attccaaacagtgctgcagact

SEQ ID NO: 7026620 - DNA, 22 bp, Homo sapiens
tgatggatgtggctctggagct

SEQ ID NO: 7026621 - DNA, 22 bp, Homo sapiens
cttcttgagcatgggtagtact

SEQ ID NO: 7026622 - DNA, 22 bp, Homo sapiens
gcacatgagttaagctggggca

SEQ ID NO: 7026623 - DNA, 23 bp, Homo sapiens
aactagctaggcagcctgtcagc

SEQ ID NO: 7026624 - DNA, 22 bp, Homo sapiens
taatacatgtattccagagagt

SEQ ID NO: 7026625 - DNA, 22 bp, Homo sapiens
aatgataccaaacatgtagata

SEQ ID NO: 7026626 - DNA, 22 bp, Homo sapiens
tatcatgtctctttggtctcca

SEQ ID NO: 7026627 - DNA, 17 bp, Homo sapiens
gcacagaggccaaagga

SEQ ID NO: 7026628 - DNA, 22 bp, Homo sapiens
gacacatgtcagacggacaccc

SEQ ID NO: 7026629 - DNA, 22 bp, Homo sapiens
aatcactgtggccaggtggtgt

SEQ ID NO: 7026630 - DNA, 22 bp, Homo sapiens
gtaaacaagtctaccattagaa

SEQ ID NO: 7026631 - DNA, 22 bp, Homo sapiens
gtctgagattagggaagatttt

SEQ ID NO: 7026632 - DNA, 22 bp, Homo sapiens
attgtatacaagcttaattgtt

SEQ ID NO: 7026633 - DNA, 22 bp, Homo sapiens
agggcttgcagaaatgagaaat

SEQ ID NO: 7026634 - DNA, 22 bp, Homo sapiens
tccagcctgaactttgtccaga

SEQ ID NO: 7026635 - DNA, 22 bp, Homo sapiens
cagagggctcggcggccgctcc

SEQ ID NO: 7026636 - DNA, 22 bp, Homo sapiens
aaacaaagccagggaagttatg

SEQ ID NO: 7026637 - DNA, 20 bp, Homo sapiens
gggggccagcagcagacgcc

SEQ ID NO: 7026638 - DNA, 22 bp, Homo sapiens
gagtgattgctcctttaaactt

SEQ ID NO: 7026639 - DNA, 22 bp, Homo sapiens
gttccacatttgtaaaatgagg

SEQ ID NO: 7026640 - DNA, 22 bp, Homo sapiens
catctacaggagaatgtcactg

SEQ ID NO: 7026641 - DNA, 22 bp, Homo sapiens
tgctcccaggcattctctgttg

SEQ ID NO: 7026642 - DNA, 22 bp, Homo sapiens
attggcatagtaggacagatca

SEQ ID NO: 7026643 - DNA, 22 bp, Homo sapiens
tccacagggatgcctgcggctt

SEQ ID NO: 7026644 - DNA, 17 bp, Homo sapiens
cgggcccgcggccgctc

SEQ ID NO: 7026645 - DNA, 17 bp, Homo sapiens
gcccgcggcccggggtg

SEQ ID NO: 7026646 - DNA, 21 bp, Homo sapiens
ttggtatgactctgcaggtga

SEQ ID NO: 7026647 - DNA, 17 bp, Homo sapiens
aggttcaggttacattc

SEQ ID NO: 7026648 - DNA, 22 bp, Homo sapiens
tagaataagttgatgatatatg

SEQ ID NO: 7026649 - DNA, 22 bp, Homo sapiens
tctgctgctgcagctacactat

SEQ ID NO: 7026650 - DNA, 22 bp, Homo sapiens
attcagcagccatggcttctga

SEQ ID NO: 7026651 - DNA, 22 bp, Homo sapiens
gtaggcactcagataatgaatg

SEQ ID NO: 7026652 - DNA, 22 bp, Homo sapiens
gcttgggacaggcttaggtgac

SEQ ID NO: 7026653 - DNA, 22 bp, Homo sapiens
tgtgattagctgaatacactgg

SEQ ID NO: 7026654 - DNA, 20 bp, Homo sapiens
tgtgaagcaggagggtggtt

SEQ ID NO: 7026655 - DNA, 22 bp, Homo sapiens
tgagccccggagtttcaggctg

SEQ ID NO: 7026656 - DNA, 22 bp, Homo sapiens
ctggtttataaatctgtggcca

SEQ ID NO: 7026657 - DNA, 22 bp, Homo sapiens
gcaagtgatgatggcaacttca

SEQ ID NO: 7026658 - DNA, 22 bp, Homo sapiens
tgtgattttcaaggtgactcaa

SEQ ID NO: 7026659 - DNA, 22 bp, Homo sapiens
gtgtctgcaagatagccaagtc

SEQ ID NO: 7026660 - DNA, 22 bp, Homo sapiens
tgcatgtttctgtatgttaatg

SEQ ID NO: 7026661 - DNA, 22 bp, Homo sapiens
taaggcagtagtgtctgtaggg

SEQ ID NO: 7026662 - DNA, 22 bp, Homo sapiens
taggaaattgacacctgcttga

SEQ ID NO: 7026663 - DNA, 19 bp, Homo sapiens
atcttgggaaatggtaact

SEQ ID NO: 7026664 - DNA, 22 bp, Homo sapiens
catggatagatgaatgcttaaa

SEQ ID NO: 7026665 - DNA, 22 bp, Homo sapiens
cattgcactccagcctaggcaa

SEQ ID NO: 7026666 - DNA, 22 bp, Homo sapiens
gtggcagtgccagctccgacaa

SEQ ID NO: 7026667 - DNA, 22 bp, Homo sapiens
ttctagaaatccgtaagtgaat

SEQ ID NO: 7026668 - DNA, 22 bp, Homo sapiens
gaattataggcaaagcagtcat

SEQ ID NO: 7026669 - DNA, 22 bp, Homo sapiens
gcactgaggaaggagggagtgg

SEQ ID NO: 7026670 - DNA, 21 bp, Homo sapiens
ttatggagaaggaaagtaagg

SEQ ID NO: 7026671 - DNA, 22 bp, Homo sapiens
ctcagttgttagtattttgcct

SEQ ID NO: 7026672 - DNA, 22 bp, Homo sapiens
tacaaagcctggtagatatctg

SEQ ID NO: 7026673 - DNA, 22 bp, Homo sapiens
ctggactttggcccatctgcca

SEQ ID NO: 7026674 - DNA, 22 bp, Homo sapiens
gggctgtccgcacatctggaat

SEQ ID NO: 7026675 - DNA, 23 bp, Homo sapiens
ttcatgagttggacaagactggg

SEQ ID NO: 7026676 - DNA, 22 bp, Homo sapiens
atattcttgaaagatcctggta

SEQ ID NO: 7026677 - DNA, 22 bp, Homo sapiens
ttggaatcactcacataagtct

SEQ ID NO: 7026678 - DNA, 22 bp, Homo sapiens
tgggaatgggcctagaaggctg

SEQ ID NO: 7026679 - DNA, 22 bp, Homo sapiens
acctttcacggtatcagacatc

SEQ ID NO: 7026680 - DNA, 22 bp, Homo sapiens
gctgcttctcctccctggggat

SEQ ID NO: 7026681 - DNA, 22 bp, Homo sapiens
tttgagtagtgagactaggcag

SEQ ID NO: 7026682 - DNA, 22 bp, Homo sapiens
gcctctggggcagctgagtcat

SEQ ID NO: 7026683 - DNA, 22 bp, Homo sapiens
tatgtcttttgcttgcaaatag

SEQ ID NO: 7026684 - DNA, 22 bp, Homo sapiens
atactttgctacattgtacatt

SEQ ID NO: 7026685 - DNA, 22 bp, Homo sapiens
tgctttcacctgtttgcaccca

SEQ ID NO: 7026686 - DNA, 22 bp, Homo sapiens
gatctcagagtaactgaggggc

SEQ ID NO: 7026687 - DNA, 22 bp, Homo sapiens
gagttttaaagctggggaagag

SEQ ID NO: 7026688 - DNA, 22 bp, Homo sapiens
agggctgagtggtgcagtcaaa

SEQ ID NO: 7026689 - DNA, 22 bp, Homo sapiens
gggaactattttaagcacttga

SEQ ID NO: 7026690 - DNA, 23 bp, Homo sapiens
acacgtgtgtgtacatagatagt

SEQ ID NO: 7026691 - DNA, 22 bp, Homo sapiens
aggccaaattgatcatctttag

SEQ ID NO: 7026692 - DNA, 22 bp, Homo sapiens
cagagcctctcagccccttggg

SEQ ID NO: 7026693 - DNA, 22 bp, Homo sapiens
tcttccaaatgcagctaaagct

SEQ ID NO: 7026694 - DNA, 22 bp, Homo sapiens
agggcgctgtctggccagcggt

SEQ ID NO: 7026695 - DNA, 22 bp, Homo sapiens
agctcaagtgcagttgggggat

SEQ ID NO: 7026696 - DNA, 22 bp, Homo sapiens
tgtggcagtataagagctagaa

SEQ ID NO: 7026697 - DNA, 22 bp, Homo sapiens
tagacagagtgaagacaagtgg

SEQ ID NO: 7026698 - DNA, 22 bp, Homo sapiens
agcatttagttagtaaatgttt

SEQ ID NO: 7026699 - DNA, 19 bp, Homo sapiens
agcctggctttgctctgct

SEQ ID NO: 7026700 - DNA, 22 bp, Homo sapiens
cagggagggacaattgtcacct

SEQ ID NO: 7026701 - DNA, 22 bp, Homo sapiens
tctggaataggtcctgagtatt

SEQ ID NO: 7026702 - DNA, 22 bp, Homo sapiens
tatctctgtaaaagaaatcaca

SEQ ID NO: 7026703 - DNA, 22 bp, Homo sapiens
cagctctgagactgaggctatg

SEQ ID NO: 7026704 - DNA, 22 bp, Homo sapiens
ctgagagcctcctgttggctag

SEQ ID NO: 7026705 - DNA, 22 bp, Homo sapiens
gggtggagcctgagaatttgca

SEQ ID NO: 7026706 - DNA, 22 bp, Homo sapiens
gagttagtatgttctgtaagta

SEQ ID NO: 7026707 - DNA, 22 bp, Homo sapiens
acagcataatcacttctttctt

SEQ ID NO: 7026708 - DNA, 22 bp, Homo sapiens
ggcagcactgcagcttgttggg

SEQ ID NO: 7026709 - DNA, 22 bp, Homo sapiens
tatgttatattttgtcaattgt

SEQ ID NO: 7026710 - DNA, 22 bp, Homo sapiens
atagtggttggatatgtcagag

SEQ ID NO: 7026711 - DNA, 22 bp, Homo sapiens
tttagcattggagtctgggcta

SEQ ID NO: 7026712 - DNA, 22 bp, Homo sapiens
caggacagctcaacacctcctc

SEQ ID NO: 7026713 - DNA, 21 bp, Homo sapiens
gaaaaccatttgcatcatgag

SEQ ID NO: 7026714 - DNA, 22 bp, Homo sapiens
acaagctttgtgatagtagaga

SEQ ID NO: 7026715 - DNA, 22 bp, Homo sapiens
gtgtgcagaggcaggaggtgct

SEQ ID NO: 7026716 - DNA, 22 bp, Homo sapiens
aaggcctgggagtactgggaca

SEQ ID NO: 7026717 - DNA, 22 bp, Homo sapiens
tgggcagggagctggaaccaca

SEQ ID NO: 7026718 - DNA, 17 bp, Homo sapiens
acagtaactatgttatg

SEQ ID NO: 7026719 - DNA, 22 bp, Homo sapiens
acgatatactgcaagtatggct

SEQ ID NO: 7026720 - DNA, 22 bp, Homo sapiens
atcctccagctcctgcttctgc

SEQ ID NO: 7026721 - DNA, 21 bp, Homo sapiens
ttatttcacatggacttccag

SEQ ID NO: 7026722 - DNA, 23 bp, Homo sapiens
gcctgctgtcacagcgggcccag

SEQ ID NO: 7026723 - DNA, 20 bp, Homo sapiens
gtaactctggctaagtaaat

SEQ ID NO: 7026724 - DNA, 22 bp, Homo sapiens
ctggccaggccccttgcagggc

SEQ ID NO: 7026725 - DNA, 22 bp, Homo sapiens
tccagtttcctgtggctgccta

SEQ ID NO: 7026726 - DNA, 22 bp, Homo sapiens
tcatcctgcactggctcctcct

SEQ ID NO: 7026727 - DNA, 22 bp, Homo sapiens
gatacttgaggagatcaccaca

SEQ ID NO: 7026728 - DNA, 22 bp, Homo sapiens
atgctgtgattgtagaaatatt

SEQ ID NO: 7026729 - DNA, 22 bp, Homo sapiens
gcatgtctttgtctcaatataa

SEQ ID NO: 7026730 - DNA, 22 bp, Homo sapiens
ctggatttgcctatggtgcttt

SEQ ID NO: 7026731 - DNA, 22 bp, Homo sapiens
tgaacaggagaaaggtttcttt

SEQ ID NO: 7026732 - DNA, 22 bp, Homo sapiens
tctgaggtcattccaaggacat

SEQ ID NO: 7026733 - DNA, 23 bp, Homo sapiens
aatttcccctgtctctgatttgg

SEQ ID NO: 7026734 - DNA, 22 bp, Homo sapiens
aactcctgaggaaatggtctca

SEQ ID NO: 7026735 - DNA, 22 bp, Homo sapiens
gtaggcaggtggaggagtgaag

SEQ ID NO: 7026736 - DNA, 22 bp, Homo sapiens
ctggctccatcctaggcaaatg

SEQ ID NO: 7026737 - DNA, 22 bp, Homo sapiens
cttcagctgttagacgtggaaa

SEQ ID NO: 7026738 - DNA, 22 bp, Homo sapiens
attccagaataccggcaagatg

SEQ ID NO: 7026739 - DNA, 22 bp, Homo sapiens
gaaggtgcaggcaaggttggtt

SEQ ID NO: 7026740 - DNA, 23 bp, Homo sapiens
gggatatggaccttggaggagtc

SEQ ID NO: 7026741 - DNA, 22 bp, Homo sapiens
ccttacacctaaaatgagagtt

SEQ ID NO: 7026742 - DNA, 23 bp, Homo sapiens
cagtgggcttctaactgctcctg

SEQ ID NO: 7026743 - DNA, 22 bp, Homo sapiens
gtctagagaggaaggaagtgtg

SEQ ID NO: 7026744 - DNA, 22 bp, Homo sapiens
aattggctatattatttagcct

SEQ ID NO: 7026745 - DNA, 22 bp, Homo sapiens
agaatacagttcagtaatggat

SEQ ID NO: 7026746 - DNA, 23 bp, Homo sapiens
agagttgctaaaaacactcagat

SEQ ID NO: 7026747 - DNA, 22 bp, Homo sapiens
agactaaatagttacaggtagg

SEQ ID NO: 7026748 - DNA, 22 bp, Homo sapiens
agtcagtgtgattctcaggagg

SEQ ID NO: 7026749 - DNA, 22 bp, Homo sapiens
tataaagagtctatctggtggc

SEQ ID NO: 7026750 - DNA, 21 bp, Homo sapiens
ctttgcaagatgtctatgaaa

SEQ ID NO: 7026751 - DNA, 22 bp, Homo sapiens
tcagtgactccttcttcctgct

SEQ ID NO: 7026752 - DNA, 22 bp, Homo sapiens
tgggagtagatgaggagtgggc

SEQ ID NO: 7026753 - DNA, 22 bp, Homo sapiens
aggcacagtttcatccccgggc

SEQ ID NO: 7026754 - DNA, 22 bp, Homo sapiens
actgtgggggagccagtcccat

SEQ ID NO: 7026755 - DNA, 22 bp, Homo sapiens
gctgaataatgtgtaatgtctc

SEQ ID NO: 7026756 - DNA, 22 bp, Homo sapiens
tgccaggctgtcctgggcctgg

SEQ ID NO: 7026757 - DNA, 22 bp, Homo sapiens
tgctttcagggatgtctgtgag

SEQ ID NO: 7026758 - DNA, 22 bp, Homo sapiens
cactggacctgctttgatcctg

SEQ ID NO: 7026759 - DNA, 22 bp, Homo sapiens
ttggaacaatcacatccttgct

SEQ ID NO: 7026760 - DNA, 22 bp, Homo sapiens
gcctgccccttcctgggcaggg

SEQ ID NO: 7026761 - DNA, 22 bp, Homo sapiens
catggacagtgggacagtgtgt

SEQ ID NO: 7026762 - DNA, 15 bp, Homo sapiens
aagtccagtctcctg

SEQ ID NO: 7026763 - DNA, 20 bp, Homo sapiens
aaggaactcacccatgggct

SEQ ID NO: 7026764 - DNA, 22 bp, Homo sapiens
acacatgagttctcatcttgtg

SEQ ID NO: 7026765 - DNA, 22 bp, Homo sapiens
ggccaagatggaaggagagatg

SEQ ID NO: 7026766 - DNA, 22 bp, Homo sapiens
caggctccctgggcagtggcag

SEQ ID NO: 7026767 - DNA, 22 bp, Homo sapiens
cagagtcctgcaccagctccag

SEQ ID NO: 7026768 - DNA, 17 bp, Homo sapiens
ttagtgtatctgttttg

SEQ ID NO: 7026769 - DNA, 21 bp, Homo sapiens
tctccagtgcttctgcctctt

SEQ ID NO: 7026770 - DNA, 22 bp, Homo sapiens
acaatacttaccaatgtttttg

SEQ ID NO: 7026771 - DNA, 22 bp, Homo sapiens
tcatgcaaactctagtccttta

SEQ ID NO: 7026772 - DNA, 22 bp, Homo sapiens
gaggggagacagggaaatcagt

SEQ ID NO: 7026773 - DNA, 22 bp, Homo sapiens
tgaggtctcagctgggaagact

SEQ ID NO: 7026774 - DNA, 21 bp, Homo sapiens
actggctgtcttcctactggt

SEQ ID NO: 7026775 - DNA, 22 bp, Homo sapiens
aggtcctccaccaggtctcctg

SEQ ID NO: 7026776 - DNA, 17 bp, Homo sapiens
accagcctctcctgggg

SEQ ID NO: 7026777 - DNA, 22 bp, Homo sapiens
ttagtgataggactttaaagcc

SEQ ID NO: 7026778 - DNA, 18 bp, Homo sapiens
ctgaccctggctctgggt

SEQ ID NO: 7026779 - DNA, 22 bp, Homo sapiens
aaatgcatgagaaagtattctg

SEQ ID NO: 7026780 - DNA, 22 bp, Homo sapiens
aatgcacagctaaagtggttcc

SEQ ID NO: 7026781 - DNA, 22 bp, Homo sapiens
atacagatcccacagcatgtga

SEQ ID NO: 7026782 - DNA, 22 bp, Homo sapiens
tgtatgcaaatttattagcaca

SEQ ID NO: 7026783 - DNA, 22 bp, Homo sapiens
acagattcactgcactggccat

SEQ ID NO: 7026784 - DNA, 22 bp, Homo sapiens
tccagccttccttttcactctc

SEQ ID NO: 7026785 - DNA, 22 bp, Homo sapiens
aaagggctgtcaaataagcaac

SEQ ID NO: 7026786 - DNA, 22 bp, Homo sapiens
tgtgagacgtaggccatcgagg

SEQ ID NO: 7026787 - DNA, 22 bp, Homo sapiens
aggtacagtagacagacagtta

SEQ ID NO: 7026788 - DNA, 22 bp, Homo sapiens
tgtgtatatatgtgcacatgta

SEQ ID NO: 7026789 - DNA, 22 bp, Homo sapiens
tctggccaggggtccctgaagg

SEQ ID NO: 7026790 - DNA, 22 bp, Homo sapiens
tatcagaaagatattactgggg

SEQ ID NO: 7026791 - DNA, 22 bp, Homo sapiens
ggtgggagtgggcacagttacg

SEQ ID NO: 7026792 - DNA, 22 bp, Homo sapiens
aggaaactctgagcggaccagc

SEQ ID NO: 7026793 - DNA, 22 bp, Homo sapiens
gcccatgtagtatttcctttgt

SEQ ID NO: 7026794 - DNA, 22 bp, Homo sapiens
gctggtatttgcagcctgtcat

SEQ ID NO: 7026795 - DNA, 22 bp, Homo sapiens
acaagagcttatttccctgttt

SEQ ID NO: 7026796 - DNA, 19 bp, Homo sapiens
aggaaccttcattgctccc

SEQ ID NO: 7026797 - DNA, 20 bp, Homo sapiens
tatgagtattactttcagga

SEQ ID NO: 7026798 - DNA, 22 bp, Homo sapiens
cagtgcagacgtggagggggca

SEQ ID NO: 7026799 - DNA, 22 bp, Homo sapiens
gcagggctcaacaggacacccc

SEQ ID NO: 7026800 - DNA, 22 bp, Homo sapiens
ctggaaggagcccgggcggatc

SEQ ID NO: 7026801 - DNA, 22 bp, Homo sapiens
gagctgacatccagcagtgacc

SEQ ID NO: 7026802 - DNA, 22 bp, Homo sapiens
tactcagtcagattcaacctag

SEQ ID NO: 7026803 - DNA, 23 bp, Homo sapiens
ggtctgcttcctagtttgcagat

SEQ ID NO: 7026804 - DNA, 22 bp, Homo sapiens
aaagctctggaagattaggtaa

SEQ ID NO: 7026805 - DNA, 22 bp, Homo sapiens
gtgtgaaatggttctctttgtt

SEQ ID NO: 7026806 - DNA, 22 bp, Homo sapiens
ggctccagtttgtgccttcagc

SEQ ID NO: 7026807 - DNA, 22 bp, Homo sapiens
tggcagaccatcttattaacaa

SEQ ID NO: 7026808 - DNA, 22 bp, Homo sapiens
atccaaagccctaagttaactg

SEQ ID NO: 7026809 - DNA, 22 bp, Homo sapiens
tgcgcgccagctcccaggttcg

SEQ ID NO: 7026810 - DNA, 22 bp, Homo sapiens
ctgtaatcccagctacctggga

SEQ ID NO: 7026811 - DNA, 21 bp, Homo sapiens
tatcttgggctctgtgcttga

SEQ ID NO: 7026812 - DNA, 22 bp, Homo sapiens
aagagggcagcacaggtgggtc

SEQ ID NO: 7026813 - DNA, 22 bp, Homo sapiens
aaatacagcagactcctgttgt

SEQ ID NO: 7026814 - DNA, 22 bp, Homo sapiens
gtgaccagtgatgctgaggagt

SEQ ID NO: 7026815 - DNA, 22 bp, Homo sapiens
ggtcagaacaagcaaataatag

SEQ ID NO: 7026816 - DNA, 22 bp, Homo sapiens
ttctggaattctggctatggta

SEQ ID NO: 7026817 - DNA, 20 bp, Homo sapiens
acagcagccttgctagaaac

SEQ ID NO: 7026818 - DNA, 22 bp, Homo sapiens
gtggcacattggtagggtctgt

SEQ ID NO: 7026819 - DNA, 22 bp, Homo sapiens
aaatgatagtatggaactagga

SEQ ID NO: 7026820 - DNA, 22 bp, Homo sapiens
tggcagcaatttgtgatgttga

SEQ ID NO: 7026821 - DNA, 22 bp, Homo sapiens
ctgtggtcaccaggctggggcc

SEQ ID NO: 7026822 - DNA, 22 bp, Homo sapiens
cagcccgccctgaactttcggg

SEQ ID NO: 7026823 - DNA, 22 bp, Homo sapiens
gctcccaggatgaggagccagg

SEQ ID NO: 7026824 - DNA, 22 bp, Homo sapiens
gggcttctagaatttctgatat

SEQ ID NO: 7026825 - DNA, 22 bp, Homo sapiens
actggatctaattggttatagt

SEQ ID NO: 7026826 - DNA, 22 bp, Homo sapiens
ctgttcttctgggaatggccct

SEQ ID NO: 7026827 - DNA, 19 bp, Homo sapiens
tccttccagttcctggggt

SEQ ID NO: 7026828 - DNA, 22 bp, Homo sapiens
gccccagaaggggaaagcctgg

SEQ ID NO: 7026829 - DNA, 22 bp, Homo sapiens
gaaatccagttccctactctta

SEQ ID NO: 7026830 - DNA, 17 bp, Homo sapiens
cctggctgggaatctga

SEQ ID NO: 7026831 - DNA, 22 bp, Homo sapiens
agcaccagcgtgggggccgttg

SEQ ID NO: 7026832 - DNA, 22 bp, Homo sapiens
tgcaatttgacgtcagcacagt

SEQ ID NO: 7026833 - DNA, 22 bp, Homo sapiens
caggtagtccacagtgagggag

SEQ ID NO: 7026834 - DNA, 22 bp, Homo sapiens
acacagagggcagaagatacat

SEQ ID NO: 7026835 - DNA, 22 bp, Homo sapiens
agcaagctaacataggagattg

SEQ ID NO: 7026836 - DNA, 22 bp, Homo sapiens
tcagggacatttagacactgat

SEQ ID NO: 7026837 - DNA, 20 bp, Homo sapiens
tgaaggccctataattcaat

SEQ ID NO: 7026838 - DNA, 22 bp, Homo sapiens
aattccaaatgttttcaatcca

SEQ ID NO: 7026839 - DNA, 22 bp, Homo sapiens
cactgaactggtcttaggaggt

SEQ ID NO: 7026840 - DNA, 22 bp, Homo sapiens
ttctactttctctgtcattaaa

SEQ ID NO: 7026841 - DNA, 23 bp, Homo sapiens
aaagcaaggaattggcaacagag

SEQ ID NO: 7026842 - DNA, 22 bp, Homo sapiens
gctctctggaaggtatcattat

SEQ ID NO: 7026843 - DNA, 22 bp, Homo sapiens
gaaacaactactattgatttct

SEQ ID NO: 7026844 - DNA, 22 bp, Homo sapiens
cagaagctagcaggaaagtttt

SEQ ID NO: 7026845 - DNA, 22 bp, Homo sapiens
aaagttagtaaaatgggatata

SEQ ID NO: 7026846 - DNA, 22 bp, Homo sapiens
gagcctgaaatacaggtcactg

SEQ ID NO: 7026847 - DNA, 22 bp, Homo sapiens
caaatgtggtttctcagcattc

SEQ ID NO: 7026848 - DNA, 22 bp, Homo sapiens
cagctgttgcagcactgagaga

SEQ ID NO: 7026849 - DNA, 22 bp, Homo sapiens
tatctcttgtctgttttgcaaa

SEQ ID NO: 7026850 - DNA, 19 bp, Homo sapiens
ttcctgtgctgctgtgtcc

SEQ ID NO: 7026851 - DNA, 22 bp, Homo sapiens
tcattgaattctgggggttgag

SEQ ID NO: 7026852 - DNA, 21 bp, Homo sapiens
catcttaggttgtacatatat

SEQ ID NO: 7026853 - DNA, 22 bp, Homo sapiens
aagcatgtgtataagctgggca

SEQ ID NO: 7026854 - DNA, 22 bp, Homo sapiens
ctgaagttagttatgcctaaaa

SEQ ID NO: 7026855 - DNA, 22 bp, Homo sapiens
gcatctttagcctctccgtggc

SEQ ID NO: 7026856 - DNA, 22 bp, Homo sapiens
tgctggagagctagttctgcag

SEQ ID NO: 7026857 - DNA, 22 bp, Homo sapiens
caaggttctatagcaaaatctg

SEQ ID NO: 7026858 - DNA, 22 bp, Homo sapiens
gaactgtaaaataattggcaat

SEQ ID NO: 7026859 - DNA, 22 bp, Homo sapiens
caggatgttcaagggacctatg

SEQ ID NO: 7026860 - DNA, 22 bp, Homo sapiens
aggagcggatgtgtcctgccag

SEQ ID NO: 7026861 - DNA, 22 bp, Homo sapiens
gaatacaccaaggaatcagaat

SEQ ID NO: 7026862 - DNA, 22 bp, Homo sapiens
ttggtacatgcagatatttagt

SEQ ID NO: 7026863 - DNA, 22 bp, Homo sapiens
ctacatggagaagaaaattctt

SEQ ID NO: 7026864 - DNA, 22 bp, Homo sapiens
tcaggtgtcaagcagggagctg

SEQ ID NO: 7026865 - DNA, 22 bp, Homo sapiens
actccatacaatggcaggctgt

SEQ ID NO: 7026866 - DNA, 22 bp, Homo sapiens
agaatctacattttaacaagat

SEQ ID NO: 7026867 - DNA, 22 bp, Homo sapiens
gaacaactccaagggacatcat

SEQ ID NO: 7026868 - DNA, 22 bp, Homo sapiens
caatagttcggtcctgaaggcc

SEQ ID NO: 7026869 - DNA, 22 bp, Homo sapiens
cactgcttataaattctaggca

SEQ ID NO: 7026870 - DNA, 22 bp, Homo sapiens
aggtatttcctttaaagaaact

SEQ ID NO: 7026871 - DNA, 22 bp, Homo sapiens
tgaggaagaacaagaatttaga

SEQ ID NO: 7026872 - DNA, 22 bp, Homo sapiens
gacaagctcttgtttcatggtt

SEQ ID NO: 7026873 - DNA, 22 bp, Homo sapiens
gacagctgctcccgtttctgct

SEQ ID NO: 7026874 - DNA, 22 bp, Homo sapiens
gagctcttctggggtaagggac

SEQ ID NO: 7026875 - DNA, 22 bp, Homo sapiens
ctgggcctctcagctcccgcgg

SEQ ID NO: 7026876 - DNA, 22 bp, Homo sapiens
taaggcttggacttctccaacc

SEQ ID NO: 7026877 - DNA, 22 bp, Homo sapiens
cagcagcacctattatagtgtt

SEQ ID NO: 7026878 - DNA, 22 bp, Homo sapiens
ctctggtcatttggaagagcat

SEQ ID NO: 7026879 - DNA, 22 bp, Homo sapiens
aacataagggagcttcaaaact

SEQ ID NO: 7026880 - DNA, 22 bp, Homo sapiens
agagtgtctggtagctgctctg

SEQ ID NO: 7026881 - DNA, 22 bp, Homo sapiens
tgagcagagacttcaagggcag

SEQ ID NO: 7026882 - DNA, 20 bp, Homo sapiens
tggacctgtctctttaggga

SEQ ID NO: 7026883 - DNA, 22 bp, Homo sapiens
aaagagggacaggcgcagacac

SEQ ID NO: 7026884 - DNA, 22 bp, Homo sapiens
gtgcaaaaggcattgtggtttt

SEQ ID NO: 7026885 - DNA, 22 bp, Homo sapiens
cacatttttactgccaacttaa

SEQ ID NO: 7026886 - DNA, 22 bp, Homo sapiens
ttgagcatgtaactacacaggg

SEQ ID NO: 7026887 - DNA, 22 bp, Homo sapiens
agaatgcagcttgccagtatct

SEQ ID NO: 7026888 - DNA, 22 bp, Homo sapiens
agaggaacccagacagggcttt

SEQ ID NO: 7026889 - DNA, 22 bp, Homo sapiens
tacaaagctactcgagggcagg

SEQ ID NO: 7026890 - DNA, 22 bp, Homo sapiens
agcttttacataatgatcttga

SEQ ID NO: 7026891 - DNA, 23 bp, Homo sapiens
aaatggcttgccctctcgtttgg

SEQ ID NO: 7026892 - DNA, 22 bp, Homo sapiens
cctggctcagtgttgaaggggt

SEQ ID NO: 7026893 - DNA, 22 bp, Homo sapiens
tttgactcagtggacgtactag

SEQ ID NO: 7026894 - DNA, 22 bp, Homo sapiens
ataagaataattaagttagtcc

SEQ ID NO: 7026895 - DNA, 22 bp, Homo sapiens
gctcttatattgacatcatgct

SEQ ID NO: 7026896 - DNA, 22 bp, Homo sapiens
cacagaataaattggtatcaga

SEQ ID NO: 7026897 - DNA, 22 bp, Homo sapiens
tactgtgttgtgctgaaaggga

SEQ ID NO: 7026898 - DNA, 22 bp, Homo sapiens
gaggccaagttggagaccaggt

SEQ ID NO: 7026899 - DNA, 22 bp, Homo sapiens
gaggtggctgcttgctgggaaa

SEQ ID NO: 7026900 - DNA, 22 bp, Homo sapiens
tctctgagcccagtgtccccct

SEQ ID NO: 7026901 - DNA, 22 bp, Homo sapiens
attccttgtttcactgaaaagg

SEQ ID NO: 7026902 - DNA, 22 bp, Homo sapiens
gaagcttggataactgtatggg

SEQ ID NO: 7026903 - DNA, 22 bp, Homo sapiens
tctttggactttccaatttgtt

SEQ ID NO: 7026904 - DNA, 22 bp, Homo sapiens
gcctaggggtaagagtactggc

SEQ ID NO: 7026905 - DNA, 22 bp, Homo sapiens
gcctccatgtgtcctgagtcgc

SEQ ID NO: 7026906 - DNA, 22 bp, Homo sapiens
catggaattttctaggcataaa

SEQ ID NO: 7026907 - DNA, 23 bp, Homo sapiens
ccacagttcatcgttcactcacc

SEQ ID NO: 7026908 - DNA, 22 bp, Homo sapiens
atctggagtagaaaaatcgctt

SEQ ID NO: 7026909 - DNA, 22 bp, Homo sapiens
tgccttttgaagcctcacaggt

SEQ ID NO: 7026910 - DNA, 17 bp, Homo sapiens
tattgcctctgaggtca

SEQ ID NO: 7026911 - DNA, 22 bp, Homo sapiens
gttggccatcgctatgacaaga

SEQ ID NO: 7026912 - DNA, 23 bp, Homo sapiens
agaggcactaattattcagagat

SEQ ID NO: 7026913 - DNA, 22 bp, Homo sapiens
ctcagtcatgacgctcaggacc

SEQ ID NO: 7026914 - DNA, 22 bp, Homo sapiens
taggtgagggagcattgtgaga

SEQ ID NO: 7026915 - DNA, 22 bp, Homo sapiens
tagagcagttggcagctgtatt

SEQ ID NO: 7026916 - DNA, 23 bp, Homo sapiens
tatacacatgtggcagtatagtg

SEQ ID NO: 7026917 - DNA, 22 bp, Homo sapiens
tgagaagggttggagaaataat

SEQ ID NO: 7026918 - DNA, 22 bp, Homo sapiens
aactgaacataatgaaagccaa

SEQ ID NO: 7026919 - DNA, 21 bp, Homo sapiens
tacacaaagcgtggtccagag

SEQ ID NO: 7026920 - DNA, 22 bp, Homo sapiens
ctactgaaactcagaaattcaa

SEQ ID NO: 7026921 - DNA, 22 bp, Homo sapiens
tttccagtgaattagtctgttt

SEQ ID NO: 7026922 - DNA, 22 bp, Homo sapiens
ccagctggcccagctgtgctcc

SEQ ID NO: 7026923 - DNA, 22 bp, Homo sapiens
tgaggcattaaagggaggtcaa

SEQ ID NO: 7026924 - DNA, 22 bp, Homo sapiens
cattgcttgatagctgaaaatt

SEQ ID NO: 7026925 - DNA, 22 bp, Homo sapiens
caggacaccttagctaaaattc

SEQ ID NO: 7026926 - DNA, 22 bp, Homo sapiens
gcatggctgctccctggctgca

SEQ ID NO: 7026927 - DNA, 22 bp, Homo sapiens
aaattacagccttgggtagctt

SEQ ID NO: 7026928 - DNA, 22 bp, Homo sapiens
tggaagcactgaagagacaacc

SEQ ID NO: 7026929 - DNA, 22 bp, Homo sapiens
agtctggtctgttcatgggtca

SEQ ID NO: 7026930 - DNA, 21 bp, Homo sapiens
agcctgggtatcctttgagga

SEQ ID NO: 7026931 - DNA, 22 bp, Homo sapiens
ctgagaataaagccagcaggag

SEQ ID NO: 7026932 - DNA, 22 bp, Homo sapiens
gctgcaagttagtatacattct

SEQ ID NO: 7026933 - DNA, 22 bp, Homo sapiens
ctagacttcagctttgtgatct

SEQ ID NO: 7026934 - DNA, 22 bp, Homo sapiens
ccatgctgggatgctccaagtg

SEQ ID NO: 7026935 - DNA, 22 bp, Homo sapiens
aggaagctcagagaagtctttt

SEQ ID NO: 7026936 - DNA, 23 bp, Homo sapiens
aaatgcacagtattgatttttaa

SEQ ID NO: 7026937 - DNA, 22 bp, Homo sapiens
cggctgaggatctccaggcctg

SEQ ID NO: 7026938 - DNA, 22 bp, Homo sapiens
tgccacccatcatggctataat

SEQ ID NO: 7026939 - DNA, 22 bp, Homo sapiens
tttctgattctcactttggcat

SEQ ID NO: 7026940 - DNA, 22 bp, Homo sapiens
agggctggagccacagctggga

SEQ ID NO: 7026941 - DNA, 22 bp, Homo sapiens
gtagaaatggtgtgtttcttct

SEQ ID NO: 7026942 - DNA, 22 bp, Homo sapiens
gtaactctttggaaaacatttt

SEQ ID NO: 7026943 - DNA, 22 bp, Homo sapiens
taagaactcgtgatcatttgaa

SEQ ID NO: 7026944 - DNA, 22 bp, Homo sapiens
tgacctgcagtcaagaggggaa

SEQ ID NO: 7026945 - DNA, 22 bp, Homo sapiens
tctctaggttgatataaattat

SEQ ID NO: 7026946 - DNA, 22 bp, Homo sapiens
ttgttacatggacaactgtatg

SEQ ID NO: 7026947 - DNA, 22 bp, Homo sapiens
aattcatcattttatagctagt

SEQ ID NO: 7026948 - DNA, 22 bp, Homo sapiens
tgaagactttgctcttaaccac

SEQ ID NO: 7026949 - DNA, 22 bp, Homo sapiens
tccatcaagatgacttttgcta

SEQ ID NO: 7026950 - DNA, 22 bp, Homo sapiens
ctcttcaaaagtctaatcctta

SEQ ID NO: 7026951 - DNA, 22 bp, Homo sapiens
agtttctatgtgaaatgcacat

SEQ ID NO: 7026952 - DNA, 22 bp, Homo sapiens
ccagtggtgaatccagggatgt

SEQ ID NO: 7026953 - DNA, 22 bp, Homo sapiens
gagtcctgttgtcccagatggg

SEQ ID NO: 7026954 - DNA, 22 bp, Homo sapiens
cccagtggagataggagtgtgg

SEQ ID NO: 7026955 - DNA, 22 bp, Homo sapiens
gatccttattattgcccattta

SEQ ID NO: 7026956 - DNA, 22 bp, Homo sapiens
tccctgtctaatatgccatgaa

SEQ ID NO: 7026957 - DNA, 22 bp, Homo sapiens
gaagtacaggggttcttaggta

SEQ ID NO: 7026958 - DNA, 21 bp, Homo sapiens
ttgtttcccagagctcgctcc

SEQ ID NO: 7026959 - DNA, 22 bp, Homo sapiens
caggctcaaggctgacttccat

SEQ ID NO: 7026960 - DNA, 22 bp, Homo sapiens
gtgctctaggtgattccaaaat

SEQ ID NO: 7026961 - DNA, 21 bp, Homo sapiens
ttgtaaatggctttttccttc

SEQ ID NO: 7026962 - DNA, 17 bp, Homo sapiens
acacagccaggttctcc

SEQ ID NO: 7026963 - DNA, 22 bp, Homo sapiens
tagtatttaatcacttttgtct

SEQ ID NO: 7026964 - DNA, 22 bp, Homo sapiens
gccagtttccacctaggcaatt

SEQ ID NO: 7026965 - DNA, 22 bp, Homo sapiens
ttcccagaggcaaagtctggat

SEQ ID NO: 7026966 - DNA, 22 bp, Homo sapiens
gagcccatcctcgaggggctgc

SEQ ID NO: 7026967 - DNA, 22 bp, Homo sapiens
ttgtaatttgttcccaagcaga

SEQ ID NO: 7026968 - DNA, 22 bp, Homo sapiens
cagtcttctaacctagcagcct

SEQ ID NO: 7026969 - DNA, 22 bp, Homo sapiens
tggcagtgtcttatcaggagtg

SEQ ID NO: 7026970 - DNA, 22 bp, Homo sapiens
tttcatgagtggaagaagtgta

SEQ ID NO: 7026971 - DNA, 22 bp, Homo sapiens
ctgatctgtcctcctcagagcc

SEQ ID NO: 7026972 - DNA, 22 bp, Homo sapiens
gcagaggtgaccagcagcaggg

SEQ ID NO: 7026973 - DNA, 22 bp, Homo sapiens
caggggctctgggtgatgtgag

SEQ ID NO: 7026974 - DNA, 22 bp, Homo sapiens
gcaagagcaactttatggagct

SEQ ID NO: 7026975 - DNA, 22 bp, Homo sapiens
ctggctggtaatggaacgacag

SEQ ID NO: 7026976 - DNA, 22 bp, Homo sapiens
tagaagcacaggttaaaggcat

SEQ ID NO: 7026977 - DNA, 22 bp, Homo sapiens
agaagctgttgcattcctggcg

SEQ ID NO: 7026978 - DNA, 22 bp, Homo sapiens
cctctgggtgggaggccgggcg

SEQ ID NO: 7026979 - DNA, 22 bp, Homo sapiens
gggctcctggcagtcatgctca

SEQ ID NO: 7026980 - DNA, 22 bp, Homo sapiens
tgggatgaatacaatgggatca

SEQ ID NO: 7026981 - DNA, 22 bp, Homo sapiens
tggacatttggaatactatatt

SEQ ID NO: 7026982 - DNA, 22 bp, Homo sapiens
atgtctttctcacagccagttc

SEQ ID NO: 7026983 - DNA, 23 bp, Homo sapiens
aacagccacactgctgagattca

SEQ ID NO: 7026984 - DNA, 22 bp, Homo sapiens
cattccaagtatatacatgata

SEQ ID NO: 7026985 - DNA, 18 bp, Homo sapiens
tggattgaattgagaggt

SEQ ID NO: 7026986 - DNA, 22 bp, Homo sapiens
ctctgtgtatccaagttcaggt

SEQ ID NO: 7026987 - DNA, 20 bp, Homo sapiens
taaagcagccgtggagggta

SEQ ID NO: 7026988 - DNA, 22 bp, Homo sapiens
atgtgaggcagcacggagatta

SEQ ID NO: 7026989 - DNA, 22 bp, Homo sapiens
ttcctggccccacccctggaga

SEQ ID NO: 7026990 - DNA, 22 bp, Homo sapiens
tctcagacatgtaatctctacc

SEQ ID NO: 7026991 - DNA, 22 bp, Homo sapiens
agtggctggaattgcaggtgcg

SEQ ID NO: 7026992 - DNA, 22 bp, Homo sapiens
atttctcacaaagttgcttatc

SEQ ID NO: 7026993 - DNA, 22 bp, Homo sapiens
ctgcttcttttgggtaattgat

SEQ ID NO: 7026994 - DNA, 22 bp, Homo sapiens
aacacaggaggctatgttttct

SEQ ID NO: 7026995 - DNA, 22 bp, Homo sapiens
agaaggctaaagaaacagattg

SEQ ID NO: 7026996 - DNA, 22 bp, Homo sapiens
ttctggaaagatttgcgtgtaa

SEQ ID NO: 7026997 - DNA, 22 bp, Homo sapiens
atattattctagctcttgtgtg

SEQ ID NO: 7026998 - DNA, 22 bp, Homo sapiens
agcagcctctgtagaggtctcc

SEQ ID NO: 7026999 - DNA, 22 bp, Homo sapiens
ggccaggtgcggtggctcacac

SEQ ID NO: 7027000 - DNA, 22 bp, Homo sapiens
gctgtacatttgtgtacacttg

SEQ ID NO: 7027001 - DNA, 23 bp, Homo sapiens
tctttacatactgatgagttctc

SEQ ID NO: 7027002 - DNA, 20 bp, Homo sapiens
agcatttagcctttatccac

SEQ ID NO: 7027003 - DNA, 22 bp, Homo sapiens
gccctgtgccagtcacgctgtg

SEQ ID NO: 7027004 - DNA, 22 bp, Homo sapiens
atgaaagtggcttgattaaatg

SEQ ID NO: 7027005 - DNA, 22 bp, Homo sapiens
caaatgatgcatggctagtgag

SEQ ID NO: 7027006 - DNA, 22 bp, Homo sapiens
ctgtgtatctctgtgggacaga

SEQ ID NO: 7027007 - DNA, 22 bp, Homo sapiens
taagtcatttggagccactgga

SEQ ID NO: 7027008 - DNA, 23 bp, Homo sapiens
tcattgtgactgtgccacataac

SEQ ID NO: 7027009 - DNA, 22 bp, Homo sapiens
tcaggcagtggtaaatgagtta

SEQ ID NO: 7027010 - DNA, 22 bp, Homo sapiens
ggtctcagcagttgctttgact

SEQ ID NO: 7027011 - DNA, 22 bp, Homo sapiens
attgtgctgcctcatggaagca

SEQ ID NO: 7027012 - DNA, 22 bp, Homo sapiens
agtttcatccgatctggtctca

SEQ ID NO: 7027013 - DNA, 22 bp, Homo sapiens
tagaaaggcaagcgtgaaatat

SEQ ID NO: 7027014 - DNA, 22 bp, Homo sapiens
tttcataatctgtcaagtgggg

SEQ ID NO: 7027015 - DNA, 22 bp, Homo sapiens
ccagggctccccagaagtaccc

SEQ ID NO: 7027016 - DNA, 22 bp, Homo sapiens
tttgtagcagcatgatttataa

SEQ ID NO: 7027017 - DNA, 22 bp, Homo sapiens
cagtaggaaggatgcagaaaaa

SEQ ID NO: 7027018 - DNA, 22 bp, Homo sapiens
agatatttaaatcagacaaaga

SEQ ID NO: 7027019 - DNA, 22 bp, Homo sapiens
aagcagcagcaggattaaagag

SEQ ID NO: 7027020 - DNA, 22 bp, Homo sapiens
ctgggctcttctcaccctgttt

SEQ ID NO: 7027021 - DNA, 22 bp, Homo sapiens
agatacaagttaagagaaagga

SEQ ID NO: 7027022 - DNA, 22 bp, Homo sapiens
agcccagctcctccacagaata

SEQ ID NO: 7027023 - DNA, 22 bp, Homo sapiens
ctaagccagaactagtgattgg

SEQ ID NO: 7027024 - DNA, 22 bp, Homo sapiens
tggaacacatctaaggaagcag

SEQ ID NO: 7027025 - DNA, 22 bp, Homo sapiens
acaaagatcttgctttcctact

SEQ ID NO: 7027026 - DNA, 22 bp, Homo sapiens
gggcacagtctgcagcccccca

SEQ ID NO: 7027027 - DNA, 21 bp, Homo sapiens
tattaatatgtctaagctgat

SEQ ID NO: 7027028 - DNA, 22 bp, Homo sapiens
tccggccgaaagatctgaccga

SEQ ID NO: 7027029 - DNA, 22 bp, Homo sapiens
cccagctctgccatctacccac

SEQ ID NO: 7027030 - DNA, 22 bp, Homo sapiens
gacattcacagtttccgatggt

SEQ ID NO: 7027031 - DNA, 22 bp, Homo sapiens
gggattcatcaactgttttaca

SEQ ID NO: 7027032 - DNA, 22 bp, Homo sapiens
acactgctcacttcttcccttg

SEQ ID NO: 7027033 - DNA, 22 bp, Homo sapiens
gtagttatcatcatactccaga

SEQ ID NO: 7027034 - DNA, 22 bp, Homo sapiens
tagtttctttcacgtagtaata

SEQ ID NO: 7027035 - DNA, 22 bp, Homo sapiens
tgtcaggttctttaattctgca

SEQ ID NO: 7027036 - DNA, 22 bp, Homo sapiens
tatttcccagggagcaacaagc

SEQ ID NO: 7027037 - DNA, 22 bp, Homo sapiens
gtaggtgagtgggagaagaggc

SEQ ID NO: 7027038 - DNA, 22 bp, Homo sapiens
ctggcacagcttgggccccatc

SEQ ID NO: 7027039 - DNA, 22 bp, Homo sapiens
caggcagctgactgtcagatat

SEQ ID NO: 7027040 - DNA, 22 bp, Homo sapiens
gggtcagagcaagactggggtc

SEQ ID NO: 7027041 - DNA, 22 bp, Homo sapiens
ctggaaagatttacacggggaa

SEQ ID NO: 7027042 - DNA, 20 bp, Homo sapiens
caccagcagcagctgccacc

SEQ ID NO: 7027043 - DNA, 22 bp, Homo sapiens
tctagaagtccaaagttaaata

SEQ ID NO: 7027044 - DNA, 20 bp, Homo sapiens
tgttatggtgttctgatggg

SEQ ID NO: 7027045 - DNA, 19 bp, Homo sapiens
tgtcctcacagagcataac

SEQ ID NO: 7027046 - DNA, 22 bp, Homo sapiens
cagagcacagagcttgggacaa

SEQ ID NO: 7027047 - DNA, 22 bp, Homo sapiens
cagctctttattgccaatattc

SEQ ID NO: 7027048 - DNA, 22 bp, Homo sapiens
attattgttgcggctgttaccg

SEQ ID NO: 7027049 - DNA, 22 bp, Homo sapiens
tccttacagaaagcagtagaca

SEQ ID NO: 7027050 - DNA, 19 bp, Homo sapiens
aagcaatgttgtgaatcta

SEQ ID NO: 7027051 - DNA, 22 bp, Homo sapiens
ccagtggaaatgtggtcaggat

SEQ ID NO: 7027052 - DNA, 22 bp, Homo sapiens
tgacaccttgatcttggacttc

SEQ ID NO: 7027053 - DNA, 22 bp, Homo sapiens
gctggagtatctggggaaggag

SEQ ID NO: 7027054 - DNA, 22 bp, Homo sapiens
tcaggcagaaaaatcactaatt

SEQ ID NO: 7027055 - DNA, 22 bp, Homo sapiens
cctccagggcccctctcactgg

SEQ ID NO: 7027056 - DNA, 22 bp, Homo sapiens
cagcgaggtgaagggtacaagc

SEQ ID NO: 7027057 - DNA, 22 bp, Homo sapiens
gctctgttgtctctgaattgca

SEQ ID NO: 7027058 - DNA, 22 bp, Homo sapiens
tttctagttgttcatgaaagga

SEQ ID NO: 7027059 - DNA, 22 bp, Homo sapiens
tggttccttctgcattttcagc

SEQ ID NO: 7027060 - DNA, 22 bp, Homo sapiens
agcctggacagctacggagaac

SEQ ID NO: 7027061 - DNA, 22 bp, Homo sapiens
taacactgtgtctgccatatcc

SEQ ID NO: 7027062 - DNA, 22 bp, Homo sapiens
agtgatttactaccatattggg

SEQ ID NO: 7027063 - DNA, 22 bp, Homo sapiens
tttctaagtaaacacagcatac

SEQ ID NO: 7027064 - DNA, 22 bp, Homo sapiens
attcagtgtggacccatttaaa

SEQ ID NO: 7027065 - DNA, 22 bp, Homo sapiens
tcagtttcacttgaagaaaaga

SEQ ID NO: 7027066 - DNA, 22 bp, Homo sapiens
agtgtttgtaaactacagatct

SEQ ID NO: 7027067 - DNA, 22 bp, Homo sapiens
taggctttagtccctggaatta

SEQ ID NO: 7027068 - DNA, 22 bp, Homo sapiens
attcaagaggaacaatgaagat

SEQ ID NO: 7027069 - DNA, 17 bp, Homo sapiens
attaggttttgtcatga

SEQ ID NO: 7027070 - DNA, 22 bp, Homo sapiens
agcttcagcttgcagctgtgat

SEQ ID NO: 7027071 - DNA, 22 bp, Homo sapiens
tattcacctcttgttcttcata

SEQ ID NO: 7027072 - DNA, 22 bp, Homo sapiens
agtgtaggtgagggcctgggtt

SEQ ID NO: 7027073 - DNA, 22 bp, Homo sapiens
tcacttgactttccagtcttgg

SEQ ID NO: 7027074 - DNA, 16 bp, Homo sapiens
gttccttcccacacct

SEQ ID NO: 7027075 - DNA, 22 bp, Homo sapiens
gctctggaagcatctgagagga

SEQ ID NO: 7027076 - DNA, 22 bp, Homo sapiens
tgcctgggatctgtgccctttg

SEQ ID NO: 7027077 - DNA, 22 bp, Homo sapiens
atttattctccagatggcgaga

SEQ ID NO: 7027078 - DNA, 22 bp, Homo sapiens
tagaaatgttagatgtattgag

SEQ ID NO: 7027079 - DNA, 22 bp, Homo sapiens
aatacgtctgaatgcattctca

SEQ ID NO: 7027080 - DNA, 23 bp, Homo sapiens
tactgtatattactgtgttatac

SEQ ID NO: 7027081 - DNA, 22 bp, Homo sapiens
tttagcaaatatttctgttgat

SEQ ID NO: 7027082 - DNA, 22 bp, Homo sapiens
gaccctggagttagtcctgtgt

SEQ ID NO: 7027083 - DNA, 22 bp, Homo sapiens
tgaggactacctggggtgggag

SEQ ID NO: 7027084 - DNA, 22 bp, Homo sapiens
tttgcaaagtccctgggatgga

SEQ ID NO: 7027085 - DNA, 22 bp, Homo sapiens
ttgatttcttgaggcattggag

SEQ ID NO: 7027086 - DNA, 22 bp, Homo sapiens
tattggaatagttaaggaagat

SEQ ID NO: 7027087 - DNA, 22 bp, Homo sapiens
atagtagcattttctccatgta

SEQ ID NO: 7027088 - DNA, 22 bp, Homo sapiens
tctgtctgcgcttgccctggtg

SEQ ID NO: 7027089 - DNA, 22 bp, Homo sapiens
ttctctgttttcccctcgatgt

SEQ ID NO: 7027090 - DNA, 22 bp, Homo sapiens
aggcagtggagctggaataggc

SEQ ID NO: 7027091 - DNA, 22 bp, Homo sapiens
agtgattgagtgttagcagtct

SEQ ID NO: 7027092 - DNA, 20 bp, Homo sapiens
taaagacataagctactatc

SEQ ID NO: 7027093 - DNA, 22 bp, Homo sapiens
attgctctgcaatcctccccaa

SEQ ID NO: 7027094 - DNA, 22 bp, Homo sapiens
ctcctgacttgtgagcccctcc

SEQ ID NO: 7027095 - DNA, 19 bp, Homo sapiens
gatgtctcctttcattgag

SEQ ID NO: 7027096 - DNA, 22 bp, Homo sapiens
tctggagcttgaagctttggtt

SEQ ID NO: 7027097 - DNA, 22 bp, Homo sapiens
tggctagggcctttaacgagta

SEQ ID NO: 7027098 - DNA, 22 bp, Homo sapiens
attcacatgcccaagcagcacc

SEQ ID NO: 7027099 - DNA, 22 bp, Homo sapiens
gcttccaggggtgctttgaagg

SEQ ID NO: 7027100 - DNA, 22 bp, Homo sapiens
caagggctcacggtctgctggg

SEQ ID NO: 7027101 - DNA, 22 bp, Homo sapiens
ccaatgttttatacagaagtac

SEQ ID NO: 7027102 - DNA, 22 bp, Homo sapiens
ttcaacatttatcagtttatca

SEQ ID NO: 7027103 - DNA, 22 bp, Homo sapiens
tctcctctcctttcatgttgtt

SEQ ID NO: 7027104 - DNA, 22 bp, Homo sapiens
ttctgtatggaaacatcctcca

SEQ ID NO: 7027105 - DNA, 22 bp, Homo sapiens
caaagaatgagtgagtacataa

SEQ ID NO: 7027106 - DNA, 22 bp, Homo sapiens
tgacagtaattcactgggaccc

SEQ ID NO: 7027107 - DNA, 22 bp, Homo sapiens
ctggggtcagggatcagagagc

SEQ ID NO: 7027108 - DNA, 22 bp, Homo sapiens
caggacacagggtgtggctgat

SEQ ID NO: 7027109 - DNA, 22 bp, Homo sapiens
gctttacattttggaaaggtga

SEQ ID NO: 7027110 - DNA, 22 bp, Homo sapiens
ttagcaatgtatgattaaaata

SEQ ID NO: 7027111 - DNA, 22 bp, Homo sapiens
gtcccaggtgggctccacctct

SEQ ID NO: 7027112 - DNA, 21 bp, Homo sapiens
aataaaacagttggtgtcaat

SEQ ID NO: 7027113 - DNA, 22 bp, Homo sapiens
tcttccctaatcaccatcttca

SEQ ID NO: 7027114 - DNA, 22 bp, Homo sapiens
tctccagagtaaccttggagca

SEQ ID NO: 7027115 - DNA, 22 bp, Homo sapiens
ccctggctctgcctcagagccc

SEQ ID NO: 7027116 - DNA, 22 bp, Homo sapiens
gctggaaatcaaagaagtggat

SEQ ID NO: 7027117 - DNA, 22 bp, Homo sapiens
tacaggaagtctcagtacagta

SEQ ID NO: 7027118 - DNA, 23 bp, Homo sapiens
atagttttccctggttcttgcca

SEQ ID NO: 7027119 - DNA, 22 bp, Homo sapiens
cctgggatgctgtcctcatcta

SEQ ID NO: 7027120 - DNA, 22 bp, Homo sapiens
ttcttcagtttggtaaatgtaa

SEQ ID NO: 7027121 - DNA, 22 bp, Homo sapiens
tgacacttccggtaaaaaatgc

SEQ ID NO: 7027122 - DNA, 22 bp, Homo sapiens
tgcaggactgaaggagggctgg

SEQ ID NO: 7027123 - DNA, 22 bp, Homo sapiens
tttctagaatgactcatctgag

SEQ ID NO: 7027124 - DNA, 22 bp, Homo sapiens
atgaagtctatttacctaagct

SEQ ID NO: 7027125 - DNA, 22 bp, Homo sapiens
gaggccaggggcctggagatga

SEQ ID NO: 7027126 - DNA, 22 bp, Homo sapiens
tacattcagcaaaagaatggtt

SEQ ID NO: 7027127 - DNA, 22 bp, Homo sapiens
ggcaaaaatcacccctggttca

SEQ ID NO: 7027128 - DNA, 18 bp, Homo sapiens
ttccttctgatgtatatg

SEQ ID NO: 7027129 - DNA, 22 bp, Homo sapiens
atttaaccccgatgtctccaaa

SEQ ID NO: 7027130 - DNA, 22 bp, Homo sapiens
aagatatattttggtgatttca

SEQ ID NO: 7027131 - DNA, 22 bp, Homo sapiens
agaggccaccagaggtggtgcc

SEQ ID NO: 7027132 - DNA, 22 bp, Homo sapiens
atggggtgcatgcagattggga

SEQ ID NO: 7027133 - DNA, 22 bp, Homo sapiens
caaagtaattacggttttggcc

SEQ ID NO: 7027134 - DNA, 22 bp, Homo sapiens
agcaccctcagccttatccaga

SEQ ID NO: 7027135 - DNA, 22 bp, Homo sapiens
ccttagaggcaggaagaattgc

SEQ ID NO: 7027136 - DNA, 22 bp, Homo sapiens
cttagagccttactcttcttgt

SEQ ID NO: 7027137 - DNA, 22 bp, Homo sapiens
tgccaccctctctgctacccgc

SEQ ID NO: 7027138 - DNA, 22 bp, Homo sapiens
tgtttattacagttcttggaat

SEQ ID NO: 7027139 - DNA, 22 bp, Homo sapiens
tgtatgcagggcttgtatgcag

SEQ ID NO: 7027140 - DNA, 22 bp, Homo sapiens
tcaggcttcactcctgtccaag

SEQ ID NO: 7027141 - DNA, 22 bp, Homo sapiens
aaagtcatgatgaaccaccgta

SEQ ID NO: 7027142 - DNA, 22 bp, Homo sapiens
acaagcagtaaaggccacagtc

SEQ ID NO: 7027143 - DNA, 22 bp, Homo sapiens
acagtaacctctcctctgaagg

SEQ ID NO: 7027144 - DNA, 17 bp, Homo sapiens
cccacggaggtgtgaaa

SEQ ID NO: 7027145 - DNA, 22 bp, Homo sapiens
atttttaggctctaccctcaga

SEQ ID NO: 7027146 - DNA, 18 bp, Homo sapiens
gttattctctctgcagta

SEQ ID NO: 7027147 - DNA, 22 bp, Homo sapiens
tatctttaatgcttggaggtta

SEQ ID NO: 7027148 - DNA, 22 bp, Homo sapiens
gagctgtgagggacacattgct

SEQ ID NO: 7027149 - DNA, 22 bp, Homo sapiens
caaaccttgcagaactgggcag

SEQ ID NO: 7027150 - DNA, 22 bp, Homo sapiens
ggctcctgaaagactatgggaa

SEQ ID NO: 7027151 - DNA, 22 bp, Homo sapiens
tctcggtggcatttggcacagt

SEQ ID NO: 7027152 - DNA, 22 bp, Homo sapiens
acatacatcaagtatcacaaga

SEQ ID NO: 7027153 - DNA, 22 bp, Homo sapiens
atgccagaaaatgatggctgca

SEQ ID NO: 7027154 - DNA, 22 bp, Homo sapiens
gagcagtgccaaagaatttgcg

SEQ ID NO: 7027155 - DNA, 22 bp, Homo sapiens
ggtcctctgagcacgccaggca

SEQ ID NO: 7027156 - DNA, 22 bp, Homo sapiens
ctgtattattttcttagctctg

SEQ ID NO: 7027157 - DNA, 22 bp, Homo sapiens
tctgctgtgggcagagacccct

SEQ ID NO: 7027158 - DNA, 22 bp, Homo sapiens
ttctggggccaattgccactgc

SEQ ID NO: 7027159 - DNA, 22 bp, Homo sapiens
tttgtgtcgtcactgtcttctc

SEQ ID NO: 7027160 - DNA, 22 bp, Homo sapiens
atggtacaattttcatttgtgg

SEQ ID NO: 7027161 - DNA, 22 bp, Homo sapiens
atagagttgagttcaaatatgt

SEQ ID NO: 7027162 - DNA, 22 bp, Homo sapiens
ggcttccctgcctcacttattc

SEQ ID NO: 7027163 - DNA, 18 bp, Homo sapiens
aggtcatggtcatgggcg

SEQ ID NO: 7027164 - DNA, 22 bp, Homo sapiens
cagagctctctttgctactaca

SEQ ID NO: 7027165 - DNA, 20 bp, Homo sapiens
tgggattgttttttagcttc

SEQ ID NO: 7027166 - DNA, 22 bp, Homo sapiens
ctctttggtcgcatcatccatt

SEQ ID NO: 7027167 - DNA, 22 bp, Homo sapiens
aggggctagctttatgccttca

SEQ ID NO: 7027168 - DNA, 22 bp, Homo sapiens
gggctccagagtccatgttctt

SEQ ID NO: 7027169 - DNA, 22 bp, Homo sapiens
tgtgaacttaagattccttatc

SEQ ID NO: 7027170 - DNA, 22 bp, Homo sapiens
tgcctgatgcaggagtatcaga

SEQ ID NO: 7027171 - DNA, 22 bp, Homo sapiens
agctttatgaggagaccttagt

SEQ ID NO: 7027172 - DNA, 22 bp, Homo sapiens
ggagttcaggaatgaaaatgtt

SEQ ID NO: 7027173 - DNA, 23 bp, Homo sapiens
tcctccaatctcatggcccttaa

SEQ ID NO: 7027174 - DNA, 22 bp, Homo sapiens
gtgcatcagagtgtcctagaca

SEQ ID NO: 7027175 - DNA, 22 bp, Homo sapiens
gggacatttgctatcggagttc

SEQ ID NO: 7027176 - DNA, 22 bp, Homo sapiens
aggctgcaggtctgggtcatgt

SEQ ID NO: 7027177 - DNA, 22 bp, Homo sapiens
aaagctcttttccaagtattga

SEQ ID NO: 7027178 - DNA, 22 bp, Homo sapiens
atgttaaagatggtgggaaatt

SEQ ID NO: 7027179 - DNA, 20 bp, Homo sapiens
tagatgataattcctagact

SEQ ID NO: 7027180 - DNA, 22 bp, Homo sapiens
aagttgtatataccgctttaag

SEQ ID NO: 7027181 - DNA, 22 bp, Homo sapiens
ccaaggcacactctgcaaggtt

SEQ ID NO: 7027182 - DNA, 22 bp, Homo sapiens
tcagccttgcttctggactggt

SEQ ID NO: 7027183 - DNA, 22 bp, Homo sapiens
cagctttacctttaggagtaac

SEQ ID NO: 7027184 - DNA, 22 bp, Homo sapiens
gcgtgggctggactgggatgaa

SEQ ID NO: 7027185 - DNA, 22 bp, Homo sapiens
agtgcactggcaccatctcagc

SEQ ID NO: 7027186 - DNA, 22 bp, Homo sapiens
catgttgtagtatcataatggt

SEQ ID NO: 7027187 - DNA, 22 bp, Homo sapiens
tttcagatgaaatgtgtatatt

SEQ ID NO: 7027188 - DNA, 22 bp, Homo sapiens
accaagagccctcatgctaaga

SEQ ID NO: 7027189 - DNA, 22 bp, Homo sapiens
tatggctttaaattgaaggagt

SEQ ID NO: 7027190 - DNA, 22 bp, Homo sapiens
agtctttgaagttctgacagag

SEQ ID NO: 7027191 - DNA, 22 bp, Homo sapiens
tttcaagggaatatgaaattca

SEQ ID NO: 7027192 - DNA, 22 bp, Homo sapiens
tagacacaaatctcagtgacac

SEQ ID NO: 7027193 - DNA, 22 bp, Homo sapiens
cctttatactaaggcatacaat

SEQ ID NO: 7027194 - DNA, 20 bp, Homo sapiens
agcatgcagccagagccaac

SEQ ID NO: 7027195 - DNA, 22 bp, Homo sapiens
ttgagagtcatttaaggtgttg

SEQ ID NO: 7027196 - DNA, 22 bp, Homo sapiens
tccagcacctggaggcgtcccc

SEQ ID NO: 7027197 - DNA, 22 bp, Homo sapiens
atgggagttgggtaaggatcat

SEQ ID NO: 7027198 - DNA, 22 bp, Homo sapiens
aaggctgtccaggagaaaatag

SEQ ID NO: 7027199 - DNA, 22 bp, Homo sapiens
tgtcatctgtgttttgctggag

SEQ ID NO: 7027200 - DNA, 22 bp, Homo sapiens
aaatgggcctggaaagaggatg

SEQ ID NO: 7027201 - DNA, 22 bp, Homo sapiens
tgatttcttccttgtcattaga

SEQ ID NO: 7027202 - DNA, 22 bp, Homo sapiens
cctgttgctctgcatgagttta

SEQ ID NO: 7027203 - DNA, 20 bp, Homo sapiens
tgtcttcattatggtgccct

SEQ ID NO: 7027204 - DNA, 22 bp, Homo sapiens
ggagccttagacatctgatcct

SEQ ID NO: 7027205 - DNA, 22 bp, Homo sapiens
atgtttctgagtgtatatacat

SEQ ID NO: 7027206 - DNA, 22 bp, Homo sapiens
tgcttcattttgacttagccag

SEQ ID NO: 7027207 - DNA, 22 bp, Homo sapiens
ctgcagccacgagtcacagccc

SEQ ID NO: 7027208 - DNA, 22 bp, Homo sapiens
cagaagacagagcacttctctt

SEQ ID NO: 7027209 - DNA, 22 bp, Homo sapiens
agtgctgaggagaggtactcca

SEQ ID NO: 7027210 - DNA, 22 bp, Homo sapiens
tttaaggatgatgtgatatata

SEQ ID NO: 7027211 - DNA, 22 bp, Homo sapiens
gaggggcagtgcacccgggccc

SEQ ID NO: 7027212 - DNA, 22 bp, Homo sapiens
ataggcaagggatacaatatac

SEQ ID NO: 7027213 - DNA, 22 bp, Homo sapiens
ttattccagctaagagtcctgg

SEQ ID NO: 7027214 - DNA, 22 bp, Homo sapiens
atccactcggagggaatgttta

SEQ ID NO: 7027215 - DNA, 23 bp, Homo sapiens
catgtttttctatctcagcgtgt

SEQ ID NO: 7027216 - DNA, 22 bp, Homo sapiens
gctcggagtcccacctgggaaa

SEQ ID NO: 7027217 - DNA, 23 bp, Homo sapiens
ttcttcagccttatagccctggg

SEQ ID NO: 7027218 - DNA, 22 bp, Homo sapiens
tatcatcactgtaatccgttga

SEQ ID NO: 7027219 - DNA, 21 bp, Homo sapiens
tagaaagtcaaagctatcagc

SEQ ID NO: 7027220 - DNA, 22 bp, Homo sapiens
ctagaaaaatactttattgtga

SEQ ID NO: 7027221 - DNA, 22 bp, Homo sapiens
ttggagggtcttccacagccat

SEQ ID NO: 7027222 - DNA, 22 bp, Homo sapiens
catacattttgcatatttacca

SEQ ID NO: 7027223 - DNA, 22 bp, Homo sapiens
agtccctccaacacagtattag

SEQ ID NO: 7027224 - DNA, 22 bp, Homo sapiens
ataacctgagattgagctgcct

SEQ ID NO: 7027225 - DNA, 22 bp, Homo sapiens
tgctgtccctaagtctcttcaa

SEQ ID NO: 7027226 - DNA, 22 bp, Homo sapiens
actgagggtaatataaaacatt

SEQ ID NO: 7027227 - DNA, 22 bp, Homo sapiens
gaggactaaaataaattgggga

SEQ ID NO: 7027228 - DNA, 22 bp, Homo sapiens
aggcacagtggctcacacctgt

SEQ ID NO: 7027229 - DNA, 20 bp, Homo sapiens
caaatccctgctctgtgctg

SEQ ID NO: 7027230 - DNA, 22 bp, Homo sapiens
ggcctctcatgcccagagccaa

SEQ ID NO: 7027231 - DNA, 22 bp, Homo sapiens
gcatgatagctaactcccctca

SEQ ID NO: 7027232 - DNA, 23 bp, Homo sapiens
aagctgccagtctgaagcctggg

SEQ ID NO: 7027233 - DNA, 22 bp, Homo sapiens
gtttcacaggttggagccagca

SEQ ID NO: 7027234 - DNA, 20 bp, Homo sapiens
acacatgcatagagagagag

SEQ ID NO: 7027235 - DNA, 22 bp, Homo sapiens
agaagttctctccaccttgggt

SEQ ID NO: 7027236 - DNA, 22 bp, Homo sapiens
tccagtggtggctcccggacct

SEQ ID NO: 7027237 - DNA, 22 bp, Homo sapiens
cgctgcagatgggagctggttg

SEQ ID NO: 7027238 - DNA, 22 bp, Homo sapiens
agcaggtataggaggtatcctg

SEQ ID NO: 7027239 - DNA, 20 bp, Homo sapiens
tgtctccagggctgagtgga

SEQ ID NO: 7027240 - DNA, 22 bp, Homo sapiens
tcaggaggccggcaggatttga

SEQ ID NO: 7027241 - DNA, 22 bp, Homo sapiens
gcagagagttgggctgcgccag

SEQ ID NO: 7027242 - DNA, 22 bp, Homo sapiens
ttattgagcacctactatgtgt

SEQ ID NO: 7027243 - DNA, 22 bp, Homo sapiens
tgtgtaaattatttttaatgat

SEQ ID NO: 7027244 - DNA, 23 bp, Homo sapiens
gggcaggtttttataggcttcag

SEQ ID NO: 7027245 - DNA, 22 bp, Homo sapiens
gcactggaccccaggatatgga

SEQ ID NO: 7027246 - DNA, 22 bp, Homo sapiens
tcaggaggtccgcccgggaggg

SEQ ID NO: 7027247 - DNA, 18 bp, Homo sapiens
aaggcctagtccctctct

SEQ ID NO: 7027248 - DNA, 22 bp, Homo sapiens
agcagctcctgtttttgggata

SEQ ID NO: 7027249 - DNA, 22 bp, Homo sapiens
ggaatgtgcgtactcagtgtca

SEQ ID NO: 7027250 - DNA, 22 bp, Homo sapiens
ttcaaggagattggagtctact

SEQ ID NO: 7027251 - DNA, 22 bp, Homo sapiens
atgggatgatcacctgagctca

SEQ ID NO: 7027252 - DNA, 22 bp, Homo sapiens
ccttgagagaagtctgtgcctt

SEQ ID NO: 7027253 - DNA, 22 bp, Homo sapiens
ccattgaatcctcagctgctag

SEQ ID NO: 7027254 - DNA, 18 bp, Homo sapiens
aggtctgtggtcaccagg

SEQ ID NO: 7027255 - DNA, 22 bp, Homo sapiens
tgggcctcctgccctggcctag

SEQ ID NO: 7027256 - DNA, 22 bp, Homo sapiens
atcctgggcagtgtgtcactct

SEQ ID NO: 7027257 - DNA, 22 bp, Homo sapiens
gggtgaggagctgccagtcatg

SEQ ID NO: 7027258 - DNA, 22 bp, Homo sapiens
agcacatattcagttcatacaa

SEQ ID NO: 7027259 - DNA, 22 bp, Homo sapiens
tgtttacagaaggcagacttcc

SEQ ID NO: 7027260 - DNA, 22 bp, Homo sapiens
tgattgcctactatgtgccatg

SEQ ID NO: 7027261 - DNA, 20 bp, Homo sapiens
aactagaaagcacccatgga

SEQ ID NO: 7027262 - DNA, 19 bp, Homo sapiens
ttttcccaccctttagaat

SEQ ID NO: 7027263 - DNA, 22 bp, Homo sapiens
ctggctagcacctcagctcaga

SEQ ID NO: 7027264 - DNA, 22 bp, Homo sapiens
tggctctgtgaacagacgactg

SEQ ID NO: 7027265 - DNA, 22 bp, Homo sapiens
tgtggcacatacacaggagggc

SEQ ID NO: 7027266 - DNA, 22 bp, Homo sapiens
agcttcaggaacaggcagcctg

SEQ ID NO: 7027267 - DNA, 20 bp, Homo sapiens
atccctcttcctagagtccc

SEQ ID NO: 7027268 - DNA, 22 bp, Homo sapiens
catggtgatttgcgccttctat

SEQ ID NO: 7027269 - DNA, 22 bp, Homo sapiens
tggttataaattgctatgcaga

SEQ ID NO: 7027270 - DNA, 22 bp, Homo sapiens
ccacagagttgatgcaataaga

SEQ ID NO: 7027271 - DNA, 22 bp, Homo sapiens
attgatttgaacaaagatatta

SEQ ID NO: 7027272 - DNA, 22 bp, Homo sapiens
tgttcccacaccagcctcagcc

SEQ ID NO: 7027273 - DNA, 22 bp, Homo sapiens
tttgccctggagtcaggataca

SEQ ID NO: 7027274 - DNA, 22 bp, Homo sapiens
aagttctttgccagacacgtgt

SEQ ID NO: 7027275 - DNA, 22 bp, Homo sapiens
gttgtacaggcagggaaactga

SEQ ID NO: 7027276 - DNA, 22 bp, Homo sapiens
aaactctttccacgattacttt

SEQ ID NO: 7027277 - DNA, 22 bp, Homo sapiens
ttggtaaatactataatcaaat

SEQ ID NO: 7027278 - DNA, 22 bp, Homo sapiens
gggctggtctggcttagtcagg

SEQ ID NO: 7027279 - DNA, 22 bp, Homo sapiens
taaggaatgcttgaatgttcct

SEQ ID NO: 7027280 - DNA, 22 bp, Homo sapiens
aaagaacaaattagctgtttta

SEQ ID NO: 7027281 - DNA, 22 bp, Homo sapiens
tgtgttttccagaatggtgttt

SEQ ID NO: 7027282 - DNA, 22 bp, Homo sapiens
ttattgcaccttcctcactaac

SEQ ID NO: 7027283 - DNA, 22 bp, Homo sapiens
ggccaggttgggtggaagtggc

SEQ ID NO: 7027284 - DNA, 22 bp, Homo sapiens
acacattttggctaggtggaga

SEQ ID NO: 7027285 - DNA, 22 bp, Homo sapiens
tcttcaatttagaatggattta

SEQ ID NO: 7027286 - DNA, 22 bp, Homo sapiens
tctttgcaaactatggagtgtg

SEQ ID NO: 7027287 - DNA, 22 bp, Homo sapiens
gagcatctcctacctactcctt

SEQ ID NO: 7027288 - DNA, 22 bp, Homo sapiens
ttcaacaaactgttcacgaatg

SEQ ID NO: 7027289 - DNA, 22 bp, Homo sapiens
tgcaccgttgcactccagagtg

SEQ ID NO: 7027290 - DNA, 19 bp, Homo sapiens
caggcctcttaccctctct

SEQ ID NO: 7027291 - DNA, 22 bp, Homo sapiens
tgctaaattgcgttagccaaga

SEQ ID NO: 7027292 - DNA, 22 bp, Homo sapiens
aaattattataggcagagctga

SEQ ID NO: 7027293 - DNA, 22 bp, Homo sapiens
tggcccaggccaaagccctgga

SEQ ID NO: 7027294 - DNA, 22 bp, Homo sapiens
caggcacacaggctccctgggc

SEQ ID NO: 7027295 - DNA, 22 bp, Homo sapiens
agcgattctaattggagattaa

SEQ ID NO: 7027296 - DNA, 22 bp, Homo sapiens
gcaaatgctaaagtgtagagac

SEQ ID NO: 7027297 - DNA, 18 bp, Homo sapiens
tccagagagggagaagtg

SEQ ID NO: 7027298 - DNA, 20 bp, Homo sapiens
tgaaagcatgtggtatttgg

SEQ ID NO: 7027299 - DNA, 22 bp, Homo sapiens
aaattcatatgttgaaatgcta

SEQ ID NO: 7027300 - DNA, 22 bp, Homo sapiens
ttggcagaggggtttctggtgg

SEQ ID NO: 7027301 - DNA, 22 bp, Homo sapiens
ctcagcaagattaagcagcttg

SEQ ID NO: 7027302 - DNA, 22 bp, Homo sapiens
ctgggcttttgagtcacaaggg

SEQ ID NO: 7027303 - DNA, 19 bp, Homo sapiens
tgcagccacgtgagagact

SEQ ID NO: 7027304 - DNA, 22 bp, Homo sapiens
tggaatgtttgacttattcagt

SEQ ID NO: 7027305 - DNA, 22 bp, Homo sapiens
agttctctttagctcatatggt

SEQ ID NO: 7027306 - DNA, 22 bp, Homo sapiens
tatttgcaggacatagatatgg

SEQ ID NO: 7027307 - DNA, 22 bp, Homo sapiens
gccacagctcacgttccccatt

SEQ ID NO: 7027308 - DNA, 22 bp, Homo sapiens
attcttcacacctgttcctgtt

SEQ ID NO: 7027309 - DNA, 22 bp, Homo sapiens
cccactcctggagctagggctc

SEQ ID NO: 7027310 - DNA, 22 bp, Homo sapiens
cagcatgatgagtgcagtttgg

SEQ ID NO: 7027311 - DNA, 22 bp, Homo sapiens
acatgatttttaaagagataat

SEQ ID NO: 7027312 - DNA, 22 bp, Homo sapiens
agcactgggaacgcatggggcc

SEQ ID NO: 7027313 - DNA, 22 bp, Homo sapiens
tcagcctttatctttctcccat

SEQ ID NO: 7027314 - DNA, 22 bp, Homo sapiens
aaagtttcctgctaagtgctat

SEQ ID NO: 7027315 - DNA, 22 bp, Homo sapiens
tttccatgatcgttatagaact

SEQ ID NO: 7027316 - DNA, 22 bp, Homo sapiens
aataggtctgatagtatacctt

SEQ ID NO: 7027317 - DNA, 22 bp, Homo sapiens
cctgtggcgggggccagtgcct

SEQ ID NO: 7027318 - DNA, 22 bp, Homo sapiens
acagccaggacttggccctctt

SEQ ID NO: 7027319 - DNA, 18 bp, Homo sapiens
ggcagtttgtgtagggga

SEQ ID NO: 7027320 - DNA, 22 bp, Homo sapiens
agcacattgatttattttggag

SEQ ID NO: 7027321 - DNA, 22 bp, Homo sapiens
tacatacaagcattcaatttta

SEQ ID NO: 7027322 - DNA, 22 bp, Homo sapiens
gttagtagtaaagcagggattc

SEQ ID NO: 7027323 - DNA, 22 bp, Homo sapiens
aagaggcttatagtcttcctgt

SEQ ID NO: 7027324 - DNA, 19 bp, Homo sapiens
ccaaaggaagtttccctcc

SEQ ID NO: 7027325 - DNA, 22 bp, Homo sapiens
gatgggcacggcagtctgagag

SEQ ID NO: 7027326 - DNA, 22 bp, Homo sapiens
atgaagggaatataagtgctgc

SEQ ID NO: 7027327 - DNA, 22 bp, Homo sapiens
tgagaagctctgaaacagtatc

SEQ ID NO: 7027328 - DNA, 22 bp, Homo sapiens
aagctgtgtcctagaggtgtaa

SEQ ID NO: 7027329 - DNA, 22 bp, Homo sapiens
atgcacacgtaccctacaaggc

SEQ ID NO: 7027330 - DNA, 22 bp, Homo sapiens
aggtggagatcagggactaagg

SEQ ID NO: 7027331 - DNA, 22 bp, Homo sapiens
gatttcaaggagttttcacagt

SEQ ID NO: 7027332 - DNA, 22 bp, Homo sapiens
agaacattaatgcgaggtatta

SEQ ID NO: 7027333 - DNA, 22 bp, Homo sapiens
agagtggggacagggcctgtcc

SEQ ID NO: 7027334 - DNA, 22 bp, Homo sapiens
agctctgggctgacatgctccc

SEQ ID NO: 7027335 - DNA, 22 bp, Homo sapiens
cagtgtttgtggaattcaggtg

SEQ ID NO: 7027336 - DNA, 20 bp, Homo sapiens
tgctggttacaccaccaagg

SEQ ID NO: 7027337 - DNA, 22 bp, Homo sapiens
ttctggagagaagaccagtgtg

SEQ ID NO: 7027338 - DNA, 22 bp, Homo sapiens
agtgggtggcgcagaggaggaa

SEQ ID NO: 7027339 - DNA, 22 bp, Homo sapiens
aactacagtatgtccaaagaat

SEQ ID NO: 7027340 - DNA, 22 bp, Homo sapiens
atccattgtcttgttggcttct

SEQ ID NO: 7027341 - DNA, 22 bp, Homo sapiens
tttcacatataggggaagctac

SEQ ID NO: 7027342 - DNA, 22 bp, Homo sapiens
ccttaatttctgtccttcagat

SEQ ID NO: 7027343 - DNA, 22 bp, Homo sapiens
tggatgtgtcgccctggctctc

SEQ ID NO: 7027344 - DNA, 22 bp, Homo sapiens
gtctgggcatcagactgcgggc

SEQ ID NO: 7027345 - DNA, 22 bp, Homo sapiens
agaagatgactttggagttgga

SEQ ID NO: 7027346 - DNA, 22 bp, Homo sapiens
tgggacagtgaccccagaggtc

SEQ ID NO: 7027347 - DNA, 22 bp, Homo sapiens
ctattcaggtgtccattaatcc

SEQ ID NO: 7027348 - DNA, 22 bp, Homo sapiens
agggcttgtagggtggctgtag

SEQ ID NO: 7027349 - DNA, 22 bp, Homo sapiens
atatttttccatgtgggactct

SEQ ID NO: 7027350 - DNA, 22 bp, Homo sapiens
ggagtggtgtcactgagaggaa

SEQ ID NO: 7027351 - DNA, 22 bp, Homo sapiens
cccagtattgagctacaggcct

SEQ ID NO: 7027352 - DNA, 22 bp, Homo sapiens
tgccatttactgagattagaag

SEQ ID NO: 7027353 - DNA, 22 bp, Homo sapiens
gccaaatactggaatcatagaa

SEQ ID NO: 7027354 - DNA, 22 bp, Homo sapiens
ctttatgagccttgtgaaggag

SEQ ID NO: 7027355 - DNA, 22 bp, Homo sapiens
cagctttttagaatctagggca

SEQ ID NO: 7027356 - DNA, 22 bp, Homo sapiens
ttgttgcaagcctggaatctgg

SEQ ID NO: 7027357 - DNA, 22 bp, Homo sapiens
aattagcttatgtgtacttttc

SEQ ID NO: 7027358 - DNA, 22 bp, Homo sapiens
cagcctgacaccagctttgggc

SEQ ID NO: 7027359 - DNA, 22 bp, Homo sapiens
tcctgtgtcaattcctcattct

SEQ ID NO: 7027360 - DNA, 22 bp, Homo sapiens
tcgaagattctttttgttagta

SEQ ID NO: 7027361 - DNA, 22 bp, Homo sapiens
aggctggagtacagtggctatt

SEQ ID NO: 7027362 - DNA, 22 bp, Homo sapiens
caggggctgtggcacatggtgt

SEQ ID NO: 7027363 - DNA, 22 bp, Homo sapiens
aatgaacatggacaagttaata

SEQ ID NO: 7027364 - DNA, 23 bp, Homo sapiens
cctgacacaaaaggattcttgct

SEQ ID NO: 7027365 - DNA, 22 bp, Homo sapiens
caatgattgctatttacataaa

SEQ ID NO: 7027366 - DNA, 22 bp, Homo sapiens
taacctacatgagaactttaaa

SEQ ID NO: 7027367 - DNA, 22 bp, Homo sapiens
caaggtgatacttacattagtg

SEQ ID NO: 7027368 - DNA, 22 bp, Homo sapiens
ggagtcctgtgtcttccaggaa

SEQ ID NO: 7027369 - DNA, 21 bp, Homo sapiens
ttagaacacttgctcttggaa

SEQ ID NO: 7027370 - DNA, 22 bp, Homo sapiens
tcatgatttcctggttaaggac

SEQ ID NO: 7027371 - DNA, 22 bp, Homo sapiens
atactgtagaggcatagctagt

SEQ ID NO: 7027372 - DNA, 22 bp, Homo sapiens
aagctagatgacgttatttttt

SEQ ID NO: 7027373 - DNA, 22 bp, Homo sapiens
gtgtgcacagagctccagtgtt

SEQ ID NO: 7027374 - DNA, 22 bp, Homo sapiens
cagggcatgaggtgtgcttctc

SEQ ID NO: 7027375 - DNA, 22 bp, Homo sapiens
ttattctgtagaacctagtaca

SEQ ID NO: 7027376 - DNA, 20 bp, Homo sapiens
aaccaacagaatcatgtctc

SEQ ID NO: 7027377 - DNA, 22 bp, Homo sapiens
ctggccagcctgtcgatgccct

SEQ ID NO: 7027378 - DNA, 19 bp, Homo sapiens
tcatgacaaaacaggcgct

SEQ ID NO: 7027379 - DNA, 22 bp, Homo sapiens
tgtctgtcatcagggatatcct

SEQ ID NO: 7027380 - DNA, 22 bp, Homo sapiens
caaagaatagtgagaagatgta

SEQ ID NO: 7027381 - DNA, 22 bp, Homo sapiens
agcatgcagtaaagcccatgtc

SEQ ID NO: 7027382 - DNA, 22 bp, Homo sapiens
ctcccaggggaactatcaagta

SEQ ID NO: 7027383 - DNA, 22 bp, Homo sapiens
tggccaggccggggacagaact

SEQ ID NO: 7027384 - DNA, 22 bp, Homo sapiens
ctgcaggacagggaggagcaag

SEQ ID NO: 7027385 - DNA, 22 bp, Homo sapiens
tcaaaacccagccatcaggact

SEQ ID NO: 7027386 - DNA, 22 bp, Homo sapiens
ttcaaaacaatctgtttgcatt

SEQ ID NO: 7027387 - DNA, 22 bp, Homo sapiens
cctgctctggtttagtcagtct

SEQ ID NO: 7027388 - DNA, 22 bp, Homo sapiens
agctctggaataatgatgtgat

SEQ ID NO: 7027389 - DNA, 22 bp, Homo sapiens
cagcccttcttccaaccagctt

SEQ ID NO: 7027390 - DNA, 22 bp, Homo sapiens
accctcagcttcttggattaat

SEQ ID NO: 7027391 - DNA, 22 bp, Homo sapiens
ttctgagatgtgaatctgtcaa

SEQ ID NO: 7027392 - DNA, 22 bp, Homo sapiens
tgagcagaggaggctgccaact

SEQ ID NO: 7027393 - DNA, 22 bp, Homo sapiens
ctcctcccacggtctcaggaag

SEQ ID NO: 7027394 - DNA, 22 bp, Homo sapiens
tgtgtatgcatacacacataga

SEQ ID NO: 7027395 - DNA, 22 bp, Homo sapiens
gaaacactggtaaagactgccg

SEQ ID NO: 7027396 - DNA, 22 bp, Homo sapiens
gcctacggactccttgccctgt

SEQ ID NO: 7027397 - DNA, 22 bp, Homo sapiens
cacaggtgtgtcctggtcttgt

SEQ ID NO: 7027398 - DNA, 22 bp, Homo sapiens
cagctcttccctcttcttgtag

SEQ ID NO: 7027399 - DNA, 22 bp, Homo sapiens
aaggctgcttttaacatgcata

SEQ ID NO: 7027400 - DNA, 22 bp, Homo sapiens
tctgcaaatattagcttagaca

SEQ ID NO: 7027401 - DNA, 17 bp, Homo sapiens
gctctggcacaggattg

SEQ ID NO: 7027402 - DNA, 22 bp, Homo sapiens
ctagccagatgattcccaaata

SEQ ID NO: 7027403 - DNA, 22 bp, Homo sapiens
aagggtgggccctggcagccat

SEQ ID NO: 7027404 - DNA, 22 bp, Homo sapiens
cagggcagggccacaccccctg

SEQ ID NO: 7027405 - DNA, 22 bp, Homo sapiens
tgttaaaccagttttgcatcat

SEQ ID NO: 7027406 - DNA, 22 bp, Homo sapiens
tggaggcctggattattttgag

SEQ ID NO: 7027407 - DNA, 22 bp, Homo sapiens
tccacagaccagtatctgcagc

SEQ ID NO: 7027408 - DNA, 23 bp, Homo sapiens
tgtctgagttggaaggccacctc

SEQ ID NO: 7027409 - DNA, 22 bp, Homo sapiens
tctgggaacagcctggctgtgt

SEQ ID NO: 7027410 - DNA, 22 bp, Homo sapiens
agaaagcctcaatcttcaggcc

SEQ ID NO: 7027411 - DNA, 22 bp, Homo sapiens
ctcctctggaaattcctctgcc

SEQ ID NO: 7027412 - DNA, 22 bp, Homo sapiens
atttggatgaacaatggaaaaa

SEQ ID NO: 7027413 - DNA, 22 bp, Homo sapiens
ctgtctctgataagctcgaggg

SEQ ID NO: 7027414 - DNA, 22 bp, Homo sapiens
cgtggccagcacaaggcagtga

SEQ ID NO: 7027415 - DNA, 22 bp, Homo sapiens
gggctcagggacacatgtgtgt

SEQ ID NO: 7027416 - DNA, 22 bp, Homo sapiens
gaccagtaaccagtgaccagtg

SEQ ID NO: 7027417 - DNA, 19 bp, Homo sapiens
actgcactttagcctgggc

SEQ ID NO: 7027418 - DNA, 22 bp, Homo sapiens
attcttgtttaatttgcatccc

SEQ ID NO: 7027419 - DNA, 22 bp, Homo sapiens
aaggccctggccccagcttctt

SEQ ID NO: 7027420 - DNA, 22 bp, Homo sapiens
atactgattgatattcccatga

SEQ ID NO: 7027421 - DNA, 22 bp, Homo sapiens
gtgactcttgagcatgggtggg

SEQ ID NO: 7027422 - DNA, 22 bp, Homo sapiens
tgtgtacttgctgatcttatct

SEQ ID NO: 7027423 - DNA, 22 bp, Homo sapiens
agttatagccatattctaagat

SEQ ID NO: 7027424 - DNA, 22 bp, Homo sapiens
tccgaacactcaggaagccaga

SEQ ID NO: 7027425 - DNA, 22 bp, Homo sapiens
gctgcacagaacagtcattggc

SEQ ID NO: 7027426 - DNA, 22 bp, Homo sapiens
caggctcagcaggagcctgacc

SEQ ID NO: 7027427 - DNA, 22 bp, Homo sapiens
aaggctgcctctgccagaggag

SEQ ID NO: 7027428 - DNA, 21 bp, Homo sapiens
caggaaatcagtgtgaattag

SEQ ID NO: 7027429 - DNA, 21 bp, Homo sapiens
catttacatgacagattggtt

SEQ ID NO: 7027430 - DNA, 22 bp, Homo sapiens
atttattggtttgcatggtgaa

SEQ ID NO: 7027431 - DNA, 22 bp, Homo sapiens
ttgcaaattgcaagagttggat

SEQ ID NO: 7027432 - DNA, 22 bp, Homo sapiens
tacattgacctttgttaggttg

SEQ ID NO: 7027433 - DNA, 22 bp, Homo sapiens
agcagctcttaacaaagcatgg

SEQ ID NO: 7027434 - DNA, 22 bp, Homo sapiens
ctgcagtaaccactgtaggtgt

SEQ ID NO: 7027435 - DNA, 22 bp, Homo sapiens
agcgcgctgtcagactggctcg

SEQ ID NO: 7027436 - DNA, 22 bp, Homo sapiens
ctctttgtatttctttgggcca

SEQ ID NO: 7027437 - DNA, 22 bp, Homo sapiens
gtagggttggagagcacaacca

SEQ ID NO: 7027438 - DNA, 22 bp, Homo sapiens
ctcgggcaggagggccctctcc

SEQ ID NO: 7027439 - DNA, 22 bp, Homo sapiens
ttttgctggtttatctctatta

SEQ ID NO: 7027440 - DNA, 22 bp, Homo sapiens
gcttgccagacactcgaggggg

SEQ ID NO: 7027441 - DNA, 22 bp, Homo sapiens
gaagcccagcaaactgtgatca

SEQ ID NO: 7027442 - DNA, 22 bp, Homo sapiens
cggggagaacactgtgtccttc

SEQ ID NO: 7027443 - DNA, 22 bp, Homo sapiens
tcagggaaacaggttttccctt

SEQ ID NO: 7027444 - DNA, 23 bp, Homo sapiens
aaatggccaaaaccaggtggtta

SEQ ID NO: 7027445 - DNA, 22 bp, Homo sapiens
tggcaaaatgagcaattacttt

SEQ ID NO: 7027446 - DNA, 22 bp, Homo sapiens
tttcatggctaggactagagtg

SEQ ID NO: 7027447 - DNA, 23 bp, Homo sapiens
aacatagcattccattcattagt

SEQ ID NO: 7027448 - DNA, 22 bp, Homo sapiens
catgactctccctctgtttatt

SEQ ID NO: 7027449 - DNA, 22 bp, Homo sapiens
aaggggaagagaccgcagagtc

SEQ ID NO: 7027450 - DNA, 22 bp, Homo sapiens
ctggacaaccacaaggccaata

SEQ ID NO: 7027451 - DNA, 22 bp, Homo sapiens
cacccccaggagctccagggac

SEQ ID NO: 7027452 - DNA, 22 bp, Homo sapiens
tgctgcttggaaatggggctga

SEQ ID NO: 7027453 - DNA, 22 bp, Homo sapiens
agcaatcatgacaaattatctt

SEQ ID NO: 7027454 - DNA, 22 bp, Homo sapiens
cagtcttagaggtgactgtgga

SEQ ID NO: 7027455 - DNA, 22 bp, Homo sapiens
ttctgtgctcaaaactttccaa

SEQ ID NO: 7027456 - DNA, 22 bp, Homo sapiens
tgaaatgcttgggaccagaagt

SEQ ID NO: 7027457 - DNA, 20 bp, Homo sapiens
gttgaaagtaatatgatgct

SEQ ID NO: 7027458 - DNA, 22 bp, Homo sapiens
gaatacaagcctgccacctgga

SEQ ID NO: 7027459 - DNA, 22 bp, Homo sapiens
accttaaactttacagccaagt

SEQ ID NO: 7027460 - DNA, 22 bp, Homo sapiens
caaaagtaattgcagtttttgc

SEQ ID NO: 7027461 - DNA, 22 bp, Homo sapiens
cagccagcctctcaaccatgca

SEQ ID NO: 7027462 - DNA, 22 bp, Homo sapiens
catgaaatgttagaattagaca

SEQ ID NO: 7027463 - DNA, 22 bp, Homo sapiens
aaaggtttgaggtgggaagagg

SEQ ID NO: 7027464 - DNA, 22 bp, Homo sapiens
aaacaaagcatcttgctatgca

SEQ ID NO: 7027465 - DNA, 22 bp, Homo sapiens
tggatgtagatgctcttgctga

SEQ ID NO: 7027466 - DNA, 22 bp, Homo sapiens
tgttaaagttatatgccgtcct

SEQ ID NO: 7027467 - DNA, 22 bp, Homo sapiens
caggctactggggcttggatgg

SEQ ID NO: 7027468 - DNA, 22 bp, Homo sapiens
tgtctcttcagcccatggcttc

SEQ ID NO: 7027469 - DNA, 22 bp, Homo sapiens
aattagctaattaattgtagcc

SEQ ID NO: 7027470 - DNA, 22 bp, Homo sapiens
aagtagacagtcatctactttg

SEQ ID NO: 7027471 - DNA, 22 bp, Homo sapiens
gcccaatattgtgtgctacctt

SEQ ID NO: 7027472 - DNA, 22 bp, Homo sapiens
gagagaagggacttctacactt

SEQ ID NO: 7027473 - DNA, 22 bp, Homo sapiens
cagtgtcctcagccagcagcta

SEQ ID NO: 7027474 - DNA, 22 bp, Homo sapiens
tacattgtttgagatagtttgt

SEQ ID NO: 7027475 - DNA, 22 bp, Homo sapiens
tttaccatataagaaaggcatg

SEQ ID NO: 7027476 - DNA, 22 bp, Homo sapiens
gaagaatccatgctaatttacc

SEQ ID NO: 7027477 - DNA, 22 bp, Homo sapiens
aagctctttccctcttcagaac

SEQ ID NO: 7027478 - DNA, 22 bp, Homo sapiens
agtaatgtgcctgaaatacttg

SEQ ID NO: 7027479 - DNA, 22 bp, Homo sapiens
tgtcagagcaaggccaggccag

SEQ ID NO: 7027480 - DNA, 19 bp, Homo sapiens
agacaagtttccagaagcc

SEQ ID NO: 7027481 - DNA, 22 bp, Homo sapiens
gcaccttaattaagaaattgcc

SEQ ID NO: 7027482 - DNA, 22 bp, Homo sapiens
gaaagcactaaaagagaatcct

SEQ ID NO: 7027483 - DNA, 22 bp, Homo sapiens
tggggaaagacattcatacagt

SEQ ID NO: 7027484 - DNA, 22 bp, Homo sapiens
tatatcatggagattaacattc

SEQ ID NO: 7027485 - DNA, 22 bp, Homo sapiens
gagatcttcctgagattcattt

SEQ ID NO: 7027486 - DNA, 22 bp, Homo sapiens
tcatccatagtttggttggact

SEQ ID NO: 7027487 - DNA, 22 bp, Homo sapiens
tcaaatgctcagactcctgtgg

SEQ ID NO: 7027488 - DNA, 18 bp, Homo sapiens
atatgttaattaggtagg

SEQ ID NO: 7027489 - DNA, 22 bp, Homo sapiens
gaggcagctgaagcttcaaaga

SEQ ID NO: 7027490 - DNA, 22 bp, Homo sapiens
atgttacagaaactaagaggct

SEQ ID NO: 7027491 - DNA, 22 bp, Homo sapiens
aaaccgcaattacttttgcgtc

SEQ ID NO: 7027492 - DNA, 22 bp, Homo sapiens
gtgtcctgggtctctgattctt

SEQ ID NO: 7027493 - DNA, 22 bp, Homo sapiens
gttattaaagtatttgatgtta

SEQ ID NO: 7027494 - DNA, 22 bp, Homo sapiens
caggcagaggaggccttctcct

SEQ ID NO: 7027495 - DNA, 22 bp, Homo sapiens
tgctattttgttttcagtccat

SEQ ID NO: 7027496 - DNA, 22 bp, Homo sapiens
tgaacagtcaaaaagtgaccat

SEQ ID NO: 7027497 - DNA, 20 bp, Homo sapiens
gacctgtgtctgggatgcgg

SEQ ID NO: 7027498 - DNA, 19 bp, Homo sapiens
tggccacctctgctgttct

SEQ ID NO: 7027499 - DNA, 22 bp, Homo sapiens
tgaggccagagagtttgcattt

SEQ ID NO: 7027500 - DNA, 22 bp, Homo sapiens
ctgagaaatgcatttttccagc

SEQ ID NO: 7027501 - DNA, 22 bp, Homo sapiens
atgtagcagaggagacgtgtgt

SEQ ID NO: 7027502 - DNA, 22 bp, Homo sapiens
tcaagcaatctctgtgtccctg

SEQ ID NO: 7027503 - DNA, 22 bp, Homo sapiens
gagaaatgagtgattcactttt

SEQ ID NO: 7027504 - DNA, 19 bp, Homo sapiens
caggccctggacccatctg

SEQ ID NO: 7027505 - DNA, 22 bp, Homo sapiens
gtgcttctttctcctcaagcct

SEQ ID NO: 7027506 - DNA, 20 bp, Homo sapiens
tccaattaaaaattgtatgc

SEQ ID NO: 7027507 - DNA, 22 bp, Homo sapiens
agtaccatcatttagatgtgtt

SEQ ID NO: 7027508 - DNA, 22 bp, Homo sapiens
tggcaatacttgtcttggccgc

SEQ ID NO: 7027509 - DNA, 22 bp, Homo sapiens
cctcagagcagcacccagatga

SEQ ID NO: 7027510 - DNA, 22 bp, Homo sapiens
tctttggtattcacttgtgaag

SEQ ID NO: 7027511 - DNA, 23 bp, Homo sapiens
accccaggcatcgcattcctctt

SEQ ID NO: 7027512 - DNA, 22 bp, Homo sapiens
ataaagatttttaggcatttct

SEQ ID NO: 7027513 - DNA, 22 bp, Homo sapiens
tgggtcctaaatgcagtcacat

SEQ ID NO: 7027514 - DNA, 22 bp, Homo sapiens
tattttcattctgtgtgactgt

SEQ ID NO: 7027515 - DNA, 22 bp, Homo sapiens
aatcacagagtccagcagatga

SEQ ID NO: 7027516 - DNA, 22 bp, Homo sapiens
gtgataaaattcaaatagctct

SEQ ID NO: 7027517 - DNA, 22 bp, Homo sapiens
atcaaagatgtttcagggtgta

SEQ ID NO: 7027518 - DNA, 22 bp, Homo sapiens
ttttatgtgctggactggcagt

SEQ ID NO: 7027519 - DNA, 22 bp, Homo sapiens
ttctgggtgcaactctgttctg

SEQ ID NO: 7027520 - DNA, 22 bp, Homo sapiens
ctgaggcagagagaacccgggc

SEQ ID NO: 7027521 - DNA, 17 bp, Homo sapiens
ttgaacctagacacctt

SEQ ID NO: 7027522 - DNA, 22 bp, Homo sapiens
attcagacattaccctggacat

SEQ ID NO: 7027523 - DNA, 23 bp, Homo sapiens
gacaccaggcgtggccctcgaca

SEQ ID NO: 7027524 - DNA, 22 bp, Homo sapiens
aggcttctgctgatatttcatt

SEQ ID NO: 7027525 - DNA, 22 bp, Homo sapiens
gggctgggattgcttgctgtga

SEQ ID NO: 7027526 - DNA, 22 bp, Homo sapiens
gaggcttttagtatggggactg

SEQ ID NO: 7027527 - DNA, 18 bp, Homo sapiens
tatttcccaatggaaaca

SEQ ID NO: 7027528 - DNA, 22 bp, Homo sapiens
agaaggcacagtgctgctaaga

SEQ ID NO: 7027529 - DNA, 20 bp, Homo sapiens
gctaggctgtgtcctgccca

SEQ ID NO: 7027530 - DNA, 22 bp, Homo sapiens
tttcagttgtgccggcccctct

SEQ ID NO: 7027531 - DNA, 20 bp, Homo sapiens
agagtgagactccatctcag

SEQ ID NO: 7027532 - DNA, 22 bp, Homo sapiens
agactgggattctccctgatca

SEQ ID NO: 7027533 - DNA, 22 bp, Homo sapiens
tacttccaggcggacaaagccc

SEQ ID NO: 7027534 - DNA, 22 bp, Homo sapiens
tccctgagagcactggggagcc

SEQ ID NO: 7027535 - DNA, 20 bp, Homo sapiens
gctttttctaatagcagtcc

SEQ ID NO: 7027536 - DNA, 22 bp, Homo sapiens
attctggattatcagtccacca

SEQ ID NO: 7027537 - DNA, 22 bp, Homo sapiens
ggagcctgtgcccaagcccaga

SEQ ID NO: 7027538 - DNA, 22 bp, Homo sapiens
acagagaaactaaggagtttgg

SEQ ID NO: 7027539 - DNA, 22 bp, Homo sapiens
ataaagtcattatgaagatcta

SEQ ID NO: 7027540 - DNA, 22 bp, Homo sapiens
ccctctgcctgggaccaagtcc

SEQ ID NO: 7027541 - DNA, 22 bp, Homo sapiens
tttgatgcatctctactttgtt

SEQ ID NO: 7027542 - DNA, 22 bp, Homo sapiens
ccagtggacttctccctgtggt

SEQ ID NO: 7027543 - DNA, 22 bp, Homo sapiens
ctcaagttggcatgaacaaatt

SEQ ID NO: 7027544 - DNA, 22 bp, Homo sapiens
attccacttatatgaagtaacg

SEQ ID NO: 7027545 - DNA, 22 bp, Homo sapiens
agtcacagttagactacccaag

SEQ ID NO: 7027546 - DNA, 22 bp, Homo sapiens
acttcgtcataatttactgttc

SEQ ID NO: 7027547 - DNA, 22 bp, Homo sapiens
ccaggtgctgaccggtcagatt

SEQ ID NO: 7027548 - DNA, 22 bp, Homo sapiens
cagacagagtcttcccatcagt

SEQ ID NO: 7027549 - DNA, 17 bp, Homo sapiens
aggcgagaggaacatag

SEQ ID NO: 7027550 - DNA, 22 bp, Homo sapiens
agccaggaagagaggcctcacc

SEQ ID NO: 7027551 - DNA, 22 bp, Homo sapiens
tgataaacagctgatgaagacc

SEQ ID NO: 7027552 - DNA, 22 bp, Homo sapiens
caaatgcagtccctttgttgct

SEQ ID NO: 7027553 - DNA, 22 bp, Homo sapiens
gctgcccacaaccccgtgtcta

SEQ ID NO: 7027554 - DNA, 22 bp, Homo sapiens
ttctggagccccaagatctgta

SEQ ID NO: 7027555 - DNA, 22 bp, Homo sapiens
ttctggatataacattcagtcc

SEQ ID NO: 7027556 - DNA, 22 bp, Homo sapiens
acactgtgcttagatgctgaac

SEQ ID NO: 7027557 - DNA, 22 bp, Homo sapiens
atcctaaattgagagctctaat

SEQ ID NO: 7027558 - DNA, 22 bp, Homo sapiens
tccagtggcaccttggccctca

SEQ ID NO: 7027559 - DNA, 22 bp, Homo sapiens
tggcaggtttcctcctcatagt

SEQ ID NO: 7027560 - DNA, 22 bp, Homo sapiens
caagatatgtgttgttagctct

SEQ ID NO: 7027561 - DNA, 22 bp, Homo sapiens
aggacagcatatgggaaccagt

SEQ ID NO: 7027562 - DNA, 22 bp, Homo sapiens
ttgcaggtgaaatgggcctggc

SEQ ID NO: 7027563 - DNA, 22 bp, Homo sapiens
ctcttcaggtttctgctctgga

SEQ ID NO: 7027564 - DNA, 22 bp, Homo sapiens
tacaggcccatagtccctgctt

SEQ ID NO: 7027565 - DNA, 22 bp, Homo sapiens
ttcagtattcaaatatgtctta

SEQ ID NO: 7027566 - DNA, 22 bp, Homo sapiens
aagcccttggcgcacaccgggc

SEQ ID NO: 7027567 - DNA, 22 bp, Homo sapiens
tctgctacagggaaggacccct

SEQ ID NO: 7027568 - DNA, 22 bp, Homo sapiens
tccagaggctccaaagggagat

SEQ ID NO: 7027569 - DNA, 22 bp, Homo sapiens
tgaattctggctcttctgttta

SEQ ID NO: 7027570 - DNA, 22 bp, Homo sapiens
gattttatagtcaggaaaaaga

SEQ ID NO: 7027571 - DNA, 21 bp, Homo sapiens
tccaggggccagcacccaagc

SEQ ID NO: 7027572 - DNA, 22 bp, Homo sapiens
tgtaaacagtaggactaaagag

SEQ ID NO: 7027573 - DNA, 22 bp, Homo sapiens
acaggagtgaatctggcactta

SEQ ID NO: 7027574 - DNA, 22 bp, Homo sapiens
atagacacagatctatatatgt

SEQ ID NO: 7027575 - DNA, 22 bp, Homo sapiens
tctcaggaatagagtggcagca

SEQ ID NO: 7027576 - DNA, 22 bp, Homo sapiens
gtgggtgtcagtatctttaacg

SEQ ID NO: 7027577 - DNA, 22 bp, Homo sapiens
tctgcacacaatttatctttct

SEQ ID NO: 7027578 - DNA, 22 bp, Homo sapiens
cagctctttgagtattccattt

SEQ ID NO: 7027579 - DNA, 22 bp, Homo sapiens
agacttctctaacttgaggacc

SEQ ID NO: 7027580 - DNA, 22 bp, Homo sapiens
ccagacagttccttgaggttca

SEQ ID NO: 7027581 - DNA, 22 bp, Homo sapiens
cttcagttctaaagtagaatgt

SEQ ID NO: 7027582 - DNA, 22 bp, Homo sapiens
aaagaaatacctttctcagctt

SEQ ID NO: 7027583 - DNA, 22 bp, Homo sapiens
ttaacttcaacactctcttgta

SEQ ID NO: 7027584 - DNA, 22 bp, Homo sapiens
tgagggctgacaggaggacagc

SEQ ID NO: 7027585 - DNA, 21 bp, Homo sapiens
aaactagagtgtggcaaagct

SEQ ID NO: 7027586 - DNA, 22 bp, Homo sapiens
cacccaggctggagtgcagtgg

SEQ ID NO: 7027587 - DNA, 22 bp, Homo sapiens
cagggctcaggctctgggattc

SEQ ID NO: 7027588 - DNA, 22 bp, Homo sapiens
cattattaattcagcacatgct

SEQ ID NO: 7027589 - DNA, 22 bp, Homo sapiens
ctcccagggtagggagagacta

SEQ ID NO: 7027590 - DNA, 22 bp, Homo sapiens
ttacacttgtaaatggcatgta

SEQ ID NO: 7027591 - DNA, 22 bp, Homo sapiens
agttcaacctaatacagcagaa

SEQ ID NO: 7027592 - DNA, 22 bp, Homo sapiens
agaacttacattatagagctgt

SEQ ID NO: 7027593 - DNA, 22 bp, Homo sapiens
agtggcatcaactttatctgta

SEQ ID NO: 7027594 - DNA, 22 bp, Homo sapiens
gtgccacctctgccccagaggg

SEQ ID NO: 7027595 - DNA, 22 bp, Homo sapiens
ccttagggactaatagactgtc

SEQ ID NO: 7027596 - DNA, 22 bp, Homo sapiens
tggtccttgtaggcatttgagc

SEQ ID NO: 7027597 - DNA, 23 bp, Homo sapiens
cagtgtgacgaggtgaggcaggc

SEQ ID NO: 7027598 - DNA, 22 bp, Homo sapiens
atttgcagttattgttcatgaa

SEQ ID NO: 7027599 - DNA, 22 bp, Homo sapiens
gtgtgtgcaagaggtttattga

SEQ ID NO: 7027600 - DNA, 23 bp, Homo sapiens
aggaactgaggcctagggaggta

SEQ ID NO: 7027601 - DNA, 22 bp, Homo sapiens
cagaacttgctggacagcagat

SEQ ID NO: 7027602 - DNA, 22 bp, Homo sapiens
aagcttttctcagtgtccttgg

SEQ ID NO: 7027603 - DNA, 22 bp, Homo sapiens
cccagaggaggcaaagctctgt

SEQ ID NO: 7027604 - DNA, 22 bp, Homo sapiens
ttcattctcttagcatagtcct

SEQ ID NO: 7027605 - DNA, 22 bp, Homo sapiens
tggctctgttgtaaagaaattt

SEQ ID NO: 7027606 - DNA, 22 bp, Homo sapiens
tctgagttgaggaaatgcattt

SEQ ID NO: 7027607 - DNA, 22 bp, Homo sapiens
tccctgccctcagtgcacccgg

SEQ ID NO: 7027608 - DNA, 22 bp, Homo sapiens
tctccccaggggtatgggtatt

SEQ ID NO: 7027609 - DNA, 22 bp, Homo sapiens
tggaataactcaccaaggtcat

SEQ ID NO: 7027610 - DNA, 22 bp, Homo sapiens
gtggaatgtccttgatcataag

SEQ ID NO: 7027611 - DNA, 22 bp, Homo sapiens
catgcagggactagagaacagg

SEQ ID NO: 7027612 - DNA, 19 bp, Homo sapiens
agtttgaggaagttaagaa

SEQ ID NO: 7027613 - DNA, 22 bp, Homo sapiens
gcagtgggaaggttggcacatg

SEQ ID NO: 7027614 - DNA, 22 bp, Homo sapiens
tggatgtcatagttggatatac

SEQ ID NO: 7027615 - DNA, 23 bp, Homo sapiens
gtccctcacccctaggcaatgcc

SEQ ID NO: 7027616 - DNA, 22 bp, Homo sapiens
aagtttacataagtgatgatga

SEQ ID NO: 7027617 - DNA, 23 bp, Homo sapiens
aatgaactgagaatctgtacagt

SEQ ID NO: 7027618 - DNA, 22 bp, Homo sapiens
gctgcgccggatcccacgttcc

SEQ ID NO: 7027619 - DNA, 22 bp, Homo sapiens
gctccccaggctggtcccctcg

SEQ ID NO: 7027620 - DNA, 22 bp, Homo sapiens
atgtgttaatgagcaatgacct

SEQ ID NO: 7027621 - DNA, 21 bp, Homo sapiens
actcaagtgggcatgcgcaga

SEQ ID NO: 7027622 - DNA, 22 bp, Homo sapiens
catgaccaaaatcattacactg

SEQ ID NO: 7027623 - DNA, 22 bp, Homo sapiens
attcttcacataagtgctgtac

SEQ ID NO: 7027624 - DNA, 22 bp, Homo sapiens
gatgttctggggtgtttgtggc

SEQ ID NO: 7027625 - DNA, 22 bp, Homo sapiens
tgaagacagaccaaggagaatg

SEQ ID NO: 7027626 - DNA, 22 bp, Homo sapiens
gcagtgccgaccatccttccca

SEQ ID NO: 7027627 - DNA, 22 bp, Homo sapiens
aaggttagtgcatcttttgttt

SEQ ID NO: 7027628 - DNA, 22 bp, Homo sapiens
caaggccatattgcctgtatgt

SEQ ID NO: 7027629 - DNA, 22 bp, Homo sapiens
tctagctttgagatcagtagcc

SEQ ID NO: 7027630 - DNA, 22 bp, Homo sapiens
cagggtgcgccactcagatgta

SEQ ID NO: 7027631 - DNA, 19 bp, Homo sapiens
aaggtgtcccaactgcgtt

SEQ ID NO: 7027632 - DNA, 22 bp, Homo sapiens
cacatgaataaggctttattgt

SEQ ID NO: 7027633 - DNA, 22 bp, Homo sapiens
cccacacatttttcacttaccg

SEQ ID NO: 7027634 - DNA, 22 bp, Homo sapiens
ttccttagacagaggtggtcat

SEQ ID NO: 7027635 - DNA, 22 bp, Homo sapiens
caaagtgctggaattacaggtg

SEQ ID NO: 7027636 - DNA, 22 bp, Homo sapiens
tgagctgtgctacgccctggga

SEQ ID NO: 7027637 - DNA, 22 bp, Homo sapiens
taagggctgacttggaactgtc

SEQ ID NO: 7027638 - DNA, 22 bp, Homo sapiens
tctcttctctagtgagcaactg

SEQ ID NO: 7027639 - DNA, 22 bp, Homo sapiens
tgtgagactttctttggcctct

SEQ ID NO: 7027640 - DNA, 22 bp, Homo sapiens
tctgctgacatttatgaataga

SEQ ID NO: 7027641 - DNA, 22 bp, Homo sapiens
gcacttccactttgctttactg

SEQ ID NO: 7027642 - DNA, 22 bp, Homo sapiens
aggccctggcactgcctgggag

SEQ ID NO: 7027643 - DNA, 22 bp, Homo sapiens
ccattcattgtctccaattcta

SEQ ID NO: 7027644 - DNA, 22 bp, Homo sapiens
aatggaatgcctcacatgtatt

SEQ ID NO: 7027645 - DNA, 22 bp, Homo sapiens
attaagactgcccatgttttta

SEQ ID NO: 7027646 - DNA, 19 bp, Homo sapiens
catggctgccccatatagc

SEQ ID NO: 7027647 - DNA, 22 bp, Homo sapiens
gatttcgagaggtgtgaggcct

SEQ ID NO: 7027648 - DNA, 22 bp, Homo sapiens
cctgtgtcctaatccatcaggc

SEQ ID NO: 7027649 - DNA, 22 bp, Homo sapiens
taagttagatcttaattaaagt

SEQ ID NO: 7027650 - DNA, 22 bp, Homo sapiens
tctctgactggcctttcacctg

SEQ ID NO: 7027651 - DNA, 22 bp, Homo sapiens
tcattgcagttgagttgtgtta

SEQ ID NO: 7027652 - DNA, 21 bp, Homo sapiens
tgggcccagttcccgctgggc

SEQ ID NO: 7027653 - DNA, 19 bp, Homo sapiens
ttgtcttagctgcataaga

SEQ ID NO: 7027654 - DNA, 22 bp, Homo sapiens
tcagacagcttgcagggaggtg

SEQ ID NO: 7027655 - DNA, 22 bp, Homo sapiens
gctcaggaccgaggggtgggaa

SEQ ID NO: 7027656 - DNA, 22 bp, Homo sapiens
aggccacagttgaggccagcaa

SEQ ID NO: 7027657 - DNA, 22 bp, Homo sapiens
agtatgtaattttcaatgtgtt

SEQ ID NO: 7027658 - DNA, 22 bp, Homo sapiens
aggcctcagttcttgccaggtg

SEQ ID NO: 7027659 - DNA, 22 bp, Homo sapiens
caatgaaaatgaggactcctgt

SEQ ID NO: 7027660 - DNA, 22 bp, Homo sapiens
ttcccacagtgactccagagaa

SEQ ID NO: 7027661 - DNA, 22 bp, Homo sapiens
ctgaggagatccccccagaagt

SEQ ID NO: 7027662 - DNA, 22 bp, Homo sapiens
tggctcattctactctccctgg

SEQ ID NO: 7027663 - DNA, 22 bp, Homo sapiens
tcagttttgattcctggttctc

SEQ ID NO: 7027664 - DNA, 22 bp, Homo sapiens
aaagccattgaactgtacttta

SEQ ID NO: 7027665 - DNA, 19 bp, Homo sapiens
gttcttttcacctctgtgc

SEQ ID NO: 7027666 - DNA, 22 bp, Homo sapiens
gcaggctatgtcagggccgctc

SEQ ID NO: 7027667 - DNA, 22 bp, Homo sapiens
tgcaaattctttactctgtgat

SEQ ID NO: 7027668 - DNA, 22 bp, Homo sapiens
tgacagtagaagatgctgttac

SEQ ID NO: 7027669 - DNA, 22 bp, Homo sapiens
ttttatgagaatgcgccacttg

SEQ ID NO: 7027670 - DNA, 22 bp, Homo sapiens
ccttttgtcctgcttggtttcg

SEQ ID NO: 7027671 - DNA, 22 bp, Homo sapiens
acagtaggaatagatgtagata

SEQ ID NO: 7027672 - DNA, 22 bp, Homo sapiens
tcctcagaatccaaactgcagt

SEQ ID NO: 7027673 - DNA, 22 bp, Homo sapiens
gaatctgaactccttgcggtga

SEQ ID NO: 7027674 - DNA, 22 bp, Homo sapiens
tgatctaggttggcttcaactg

SEQ ID NO: 7027675 - DNA, 22 bp, Homo sapiens
tgctctcatggaggtagagaat

SEQ ID NO: 7027676 - DNA, 22 bp, Homo sapiens
aatacagcagatggagacaaat

SEQ ID NO: 7027677 - DNA, 22 bp, Homo sapiens
acacacagagtttatacaggca

SEQ ID NO: 7027678 - DNA, 22 bp, Homo sapiens
tttagctttacctcatagattt

SEQ ID NO: 7027679 - DNA, 22 bp, Homo sapiens
gctttcatgaaaataatctact

SEQ ID NO: 7027680 - DNA, 22 bp, Homo sapiens
agtgcttaggatttgagaggcg

SEQ ID NO: 7027681 - DNA, 22 bp, Homo sapiens
gcatccttaatccacatcagag

SEQ ID NO: 7027682 - DNA, 22 bp, Homo sapiens
taattccacctttttccaactt

SEQ ID NO: 7027683 - DNA, 22 bp, Homo sapiens
ttggttcaaagggattcaattt

SEQ ID NO: 7027684 - DNA, 20 bp, Homo sapiens
ctttaactggaaggctgctt

SEQ ID NO: 7027685 - DNA, 22 bp, Homo sapiens
agtggctccaaaccgtagtcat

SEQ ID NO: 7027686 - DNA, 23 bp, Homo sapiens
gtggagagattagtaattcaccc

SEQ ID NO: 7027687 - DNA, 22 bp, Homo sapiens
cagggtgcgggagatgtgcacc

SEQ ID NO: 7027688 - DNA, 22 bp, Homo sapiens
gtctcagttgtatcacctggtt

SEQ ID NO: 7027689 - DNA, 22 bp, Homo sapiens
cttcacagtataggtccctgag

SEQ ID NO: 7027690 - DNA, 22 bp, Homo sapiens
agccaactaattaaacaacttt

SEQ ID NO: 7027691 - DNA, 22 bp, Homo sapiens
tgaagtttcacgcgtcattcaa

SEQ ID NO: 7027692 - DNA, 22 bp, Homo sapiens
gtaagtctgagtgtaattcaca

SEQ ID NO: 7027693 - DNA, 22 bp, Homo sapiens
atccaggcttcagctgcctact

SEQ ID NO: 7027694 - DNA, 22 bp, Homo sapiens
tgctcccacactactcggaggc

SEQ ID NO: 7027695 - DNA, 22 bp, Homo sapiens
ttgattcacaattaccaagact

SEQ ID NO: 7027696 - DNA, 22 bp, Homo sapiens
agaaatcattgaattatttgct

SEQ ID NO: 7027697 - DNA, 22 bp, Homo sapiens
ctttagacatacagaatttcca

SEQ ID NO: 7027698 - DNA, 22 bp, Homo sapiens
aacatgtgagcaggttttttat

SEQ ID NO: 7027699 - DNA, 22 bp, Homo sapiens
tgtggaagaacactggccaggc

SEQ ID NO: 7027700 - DNA, 22 bp, Homo sapiens
ctccaggacccagtggctccag

SEQ ID NO: 7027701 - DNA, 23 bp, Homo sapiens
tgggacacagggtcatggttatt

SEQ ID NO: 7027702 - DNA, 21 bp, Homo sapiens
aacctgagacccacgggacta

SEQ ID NO: 7027703 - DNA, 20 bp, Homo sapiens
taagttactgatcggccatt

SEQ ID NO: 7027704 - DNA, 19 bp, Homo sapiens
tgggaaagtaacatacaaa

SEQ ID NO: 7027705 - DNA, 22 bp, Homo sapiens
aaatgtctctattgcctctggt

SEQ ID NO: 7027706 - DNA, 22 bp, Homo sapiens
ctgtgtcactcactgcgttatg

SEQ ID NO: 7027707 - DNA, 22 bp, Homo sapiens
tagcagaacaatagtcaatgat

SEQ ID NO: 7027708 - DNA, 21 bp, Homo sapiens
agcaccctcccttctggaggg

SEQ ID NO: 7027709 - DNA, 22 bp, Homo sapiens
ctctggagtaagagctatgaaa

SEQ ID NO: 7027710 - DNA, 22 bp, Homo sapiens
aggcttgcagaatttatgtaat

SEQ ID NO: 7027711 - DNA, 23 bp, Homo sapiens
tgcaggactcaagaaagaaaggc

SEQ ID NO: 7027712 - DNA, 22 bp, Homo sapiens
ttacagtcaggcatgaattcag

SEQ ID NO: 7027713 - DNA, 22 bp, Homo sapiens
aaattaccattgtaaagtattt

SEQ ID NO: 7027714 - DNA, 22 bp, Homo sapiens
gatgtcaccatcttcacatctc

SEQ ID NO: 7027715 - DNA, 22 bp, Homo sapiens
actagtataattgccctaacct

SEQ ID NO: 7027716 - DNA, 22 bp, Homo sapiens
actgtaatgttttaaagcagag

SEQ ID NO: 7027717 - DNA, 20 bp, Homo sapiens
tgtctgctcataataaaccc

SEQ ID NO: 7027718 - DNA, 22 bp, Homo sapiens
tccaaatgagctctgccttcca

SEQ ID NO: 7027719 - DNA, 22 bp, Homo sapiens
ctggctctatctccaaggctgg

SEQ ID NO: 7027720 - DNA, 22 bp, Homo sapiens
acatctgaggagaccagcctct

SEQ ID NO: 7027721 - DNA, 22 bp, Homo sapiens
gcagaggtggatgcaattgggg

SEQ ID NO: 7027722 - DNA, 22 bp, Homo sapiens
agagatgttcattcagcatgtt

SEQ ID NO: 7027723 - DNA, 22 bp, Homo sapiens
atggataatggtgatagttgca

SEQ ID NO: 7027724 - DNA, 22 bp, Homo sapiens
tcagagctgtgcttcaggaaag

SEQ ID NO: 7027725 - DNA, 22 bp, Homo sapiens
tttggttcttatctttggagat

SEQ ID NO: 7027726 - DNA, 22 bp, Homo sapiens
taagtggttgcttgttttcatt

SEQ ID NO: 7027727 - DNA, 22 bp, Homo sapiens
ccacaagtttgttgattgaaac

SEQ ID NO: 7027728 - DNA, 22 bp, Homo sapiens
tggggtaggagtcagcgagaga

SEQ ID NO: 7027729 - DNA, 22 bp, Homo sapiens
ccaggccagagtgcagtggcac

SEQ ID NO: 7027730 - DNA, 22 bp, Homo sapiens
ttgtgcttttctagggatgagg

SEQ ID NO: 7027731 - DNA, 22 bp, Homo sapiens
gtcaggagaggccatcagcttt

SEQ ID NO: 7027732 - DNA, 22 bp, Homo sapiens
gattaatagtacaggttcttag

SEQ ID NO: 7027733 - DNA, 22 bp, Homo sapiens
tgaacagatcaatagaactgac

SEQ ID NO: 7027734 - DNA, 22 bp, Homo sapiens
ttatttccagtccagaaattta

SEQ ID NO: 7027735 - DNA, 22 bp, Homo sapiens
caggtcagaggcgcagccccca

SEQ ID NO: 7027736 - DNA, 22 bp, Homo sapiens
caggtagctgctggccatgtac

SEQ ID NO: 7027737 - DNA, 22 bp, Homo sapiens
tgtctgctgccctggagcctgg

SEQ ID NO: 7027738 - DNA, 22 bp, Homo sapiens
agttctagaagacttttccatt

SEQ ID NO: 7027739 - DNA, 22 bp, Homo sapiens
cattcaggtacactcagtgcta

SEQ ID NO: 7027740 - DNA, 22 bp, Homo sapiens
aaagcagccacagagagagcgt

SEQ ID NO: 7027741 - DNA, 19 bp, Homo sapiens
tctctggcatagactcaat

SEQ ID NO: 7027742 - DNA, 22 bp, Homo sapiens
tgcactgcctttcttggcatga

SEQ ID NO: 7027743 - DNA, 22 bp, Homo sapiens
agcgccctgtgaggttggcagg

SEQ ID NO: 7027744 - DNA, 22 bp, Homo sapiens
ccctcagagcctgaagcaagca

SEQ ID NO: 7027745 - DNA, 22 bp, Homo sapiens
tttgacattatcctgttactgg

SEQ ID NO: 7027746 - DNA, 22 bp, Homo sapiens
aaaatggatagtgcgtcttctc

SEQ ID NO: 7027747 - DNA, 22 bp, Homo sapiens
ggcacagcaccttttcacattg

SEQ ID NO: 7027748 - DNA, 22 bp, Homo sapiens
ggcctgctttccgagcctgcag

SEQ ID NO: 7027749 - DNA, 20 bp, Homo sapiens
tgggcagcactgctggctgg

SEQ ID NO: 7027750 - DNA, 22 bp, Homo sapiens
ccaggagtggctggtgaccttc

SEQ ID NO: 7027751 - DNA, 22 bp, Homo sapiens
ggatggcagacagtgagtggct

SEQ ID NO: 7027752 - DNA, 22 bp, Homo sapiens
tcttcaggctctggctgccttt

SEQ ID NO: 7027753 - DNA, 22 bp, Homo sapiens
cctggtgttgccaatctgtgcc

SEQ ID NO: 7027754 - DNA, 22 bp, Homo sapiens
tttgactcccaaactgtgattt

SEQ ID NO: 7027755 - DNA, 22 bp, Homo sapiens
actgggctagagtggaagctgg

SEQ ID NO: 7027756 - DNA, 22 bp, Homo sapiens
tgttttaaagccattgcctttc

SEQ ID NO: 7027757 - DNA, 22 bp, Homo sapiens
tacactatgggctttgtgtaat

SEQ ID NO: 7027758 - DNA, 22 bp, Homo sapiens
tctctgagctcaggagctgcag

SEQ ID NO: 7027759 - DNA, 22 bp, Homo sapiens
tgtcatacaacaataagtaccg

SEQ ID NO: 7027760 - DNA, 22 bp, Homo sapiens
gtgcaggggcctccccttgctg

SEQ ID NO: 7027761 - DNA, 22 bp, Homo sapiens
tactaagtagcagaactaagaa

SEQ ID NO: 7027762 - DNA, 22 bp, Homo sapiens
agcacctgggctggaagacccc

SEQ ID NO: 7027763 - DNA, 22 bp, Homo sapiens
aaagttctggcattttctgtct

SEQ ID NO: 7027764 - DNA, 22 bp, Homo sapiens
gcagttggcagggagcccagat

SEQ ID NO: 7027765 - DNA, 22 bp, Homo sapiens
ccacgagggaaccaggtggggt

SEQ ID NO: 7027766 - DNA, 22 bp, Homo sapiens
agtagcagagttggactatgca

SEQ ID NO: 7027767 - DNA, 22 bp, Homo sapiens
tccttgcagggtttgataaaga

SEQ ID NO: 7027768 - DNA, 22 bp, Homo sapiens
cttctgggtgcctgtgagtgtt

SEQ ID NO: 7027769 - DNA, 22 bp, Homo sapiens
gcacatttaactgagctcagga

SEQ ID NO: 7027770 - DNA, 21 bp, Homo sapiens
tctttccaatattcatgtctc

SEQ ID NO: 7027771 - DNA, 22 bp, Homo sapiens
aagagctgcatctaagccatga

SEQ ID NO: 7027772 - DNA, 22 bp, Homo sapiens
cgctgccaggtcaccaggggta

SEQ ID NO: 7027773 - DNA, 22 bp, Homo sapiens
taatgagatacctcttgctgtc

SEQ ID NO: 7027774 - DNA, 22 bp, Homo sapiens
tggcatgtaacatctccagatt

SEQ ID NO: 7027775 - DNA, 22 bp, Homo sapiens
gatggggctggctttgagggtt

SEQ ID NO: 7027776 - DNA, 22 bp, Homo sapiens
agggagtcaacacagtaatgtt

SEQ ID NO: 7027777 - DNA, 22 bp, Homo sapiens
ttcttcaggtggttttggtaac

SEQ ID NO: 7027778 - DNA, 22 bp, Homo sapiens
ctgaagggtctggggctgtgcc

SEQ ID NO: 7027779 - DNA, 22 bp, Homo sapiens
tccaggaggctctggttgacgt

SEQ ID NO: 7027780 - DNA, 22 bp, Homo sapiens
ctttggttcaggagtacctctc

SEQ ID NO: 7027781 - DNA, 22 bp, Homo sapiens
agtgagttgaacattgataatg

SEQ ID NO: 7027782 - DNA, 22 bp, Homo sapiens
ttgcttcattttgggtgtgcag

SEQ ID NO: 7027783 - DNA, 22 bp, Homo sapiens
gggatggactgacggtagcgcg

SEQ ID NO: 7027784 - DNA, 22 bp, Homo sapiens
gggcgaggactgactctgggca

SEQ ID NO: 7027785 - DNA, 22 bp, Homo sapiens
tggaggcatcagagtgcttggc

SEQ ID NO: 7027786 - DNA, 22 bp, Homo sapiens
tggcttctcagaatactctgga

SEQ ID NO: 7027787 - DNA, 22 bp, Homo sapiens
cgtggccagtttcaagctacca

SEQ ID NO: 7027788 - DNA, 22 bp, Homo sapiens
ccagatgggttacttcaagcaa

SEQ ID NO: 7027789 - DNA, 22 bp, Homo sapiens
tttcatgttacagtgtaaaagt

SEQ ID NO: 7027790 - DNA, 22 bp, Homo sapiens
aagtttctttattagcttgtcc

SEQ ID NO: 7027791 - DNA, 22 bp, Homo sapiens
caggcagaagaagtggaaggac

SEQ ID NO: 7027792 - DNA, 22 bp, Homo sapiens
acagggaaggatttagtgggaa

SEQ ID NO: 7027793 - DNA, 22 bp, Homo sapiens
tgtgagtagctgaagcagaaca

SEQ ID NO: 7027794 - DNA, 22 bp, Homo sapiens
tgggagaagcagtgggacagta

SEQ ID NO: 7027795 - DNA, 22 bp, Homo sapiens
agcagggacatggcatctctcc

SEQ ID NO: 7027796 - DNA, 22 bp, Homo sapiens
ctgtgcatggcagatgctgtta

SEQ ID NO: 7027797 - DNA, 22 bp, Homo sapiens
ctgcagggaactgaggcccaga

SEQ ID NO: 7027798 - DNA, 22 bp, Homo sapiens
gtatctgtatgtgttttttcct

SEQ ID NO: 7027799 - DNA, 22 bp, Homo sapiens
cttccttgtggtccttctcatt

SEQ ID NO: 7027800 - DNA, 22 bp, Homo sapiens
gtgggcggggcctctcaagctg

SEQ ID NO: 7027801 - DNA, 22 bp, Homo sapiens
gcccagggcagggcaagagtga

SEQ ID NO: 7027802 - DNA, 22 bp, Homo sapiens
tcagatggtactaatttaagga

SEQ ID NO: 7027803 - DNA, 22 bp, Homo sapiens
accatgtgtttagatgtggcag

SEQ ID NO: 7027804 - DNA, 21 bp, Homo sapiens
ctcccagggtgactgttcaac

SEQ ID NO: 7027805 - DNA, 22 bp, Homo sapiens
tttacatgagtagcagatgttc

SEQ ID NO: 7027806 - DNA, 22 bp, Homo sapiens
acaaggctgtggggagaactga

SEQ ID NO: 7027807 - DNA, 22 bp, Homo sapiens
ctcatgatccaccgatgtcagc

SEQ ID NO: 7027808 - DNA, 22 bp, Homo sapiens
atggccaaataacagcttgcat

SEQ ID NO: 7027809 - DNA, 22 bp, Homo sapiens
tgagaaaattactataattgtc

SEQ ID NO: 7027810 - DNA, 22 bp, Homo sapiens
gaacatctgtgatctctttggg

SEQ ID NO: 7027811 - DNA, 22 bp, Homo sapiens
ttcaagtcaatttttgaatgac

SEQ ID NO: 7027812 - DNA, 22 bp, Homo sapiens
ggctgcagggcagctggtgtgg

SEQ ID NO: 7027813 - DNA, 22 bp, Homo sapiens
gctcagacctgtaatcttagca

SEQ ID NO: 7027814 - DNA, 22 bp, Homo sapiens
tctggaccaagtcctgtggtga

SEQ ID NO: 7027815 - DNA, 22 bp, Homo sapiens
ggctcagaggagctggaacggt

SEQ ID NO: 7027816 - DNA, 22 bp, Homo sapiens
tcagtgctcctaaagtgaatgc

SEQ ID NO: 7027817 - DNA, 18 bp, Homo sapiens
tctctccatctatttgtt

SEQ ID NO: 7027818 - DNA, 22 bp, Homo sapiens
aggcaacatgggccaggcagaa

SEQ ID NO: 7027819 - DNA, 22 bp, Homo sapiens
ctccactcaacaagcccagtgt

SEQ ID NO: 7027820 - DNA, 22 bp, Homo sapiens
tggggtggtaatacaccgttct

SEQ ID NO: 7027821 - DNA, 22 bp, Homo sapiens
actgaacagcctgaggagtcac

SEQ ID NO: 7027822 - DNA, 22 bp, Homo sapiens
aaggctcagagcctggagctgc

SEQ ID NO: 7027823 - DNA, 19 bp, Homo sapiens
tgaagtcctaacctccagt

SEQ ID NO: 7027824 - DNA, 22 bp, Homo sapiens
atgtaacacccacttttatagc

SEQ ID NO: 7027825 - DNA, 22 bp, Homo sapiens
gtggcttgagcaggggcagagg

SEQ ID NO: 7027826 - DNA, 19 bp, Homo sapiens
ggagtctgagcccaggtat

SEQ ID NO: 7027827 - DNA, 22 bp, Homo sapiens
gttccctttcgtatggactggg

SEQ ID NO: 7027828 - DNA, 22 bp, Homo sapiens
gaagaaagggaattaacttgag

SEQ ID NO: 7027829 - DNA, 22 bp, Homo sapiens
tgggagtggggcatagaaggta

SEQ ID NO: 7027830 - DNA, 22 bp, Homo sapiens
catcactggctgctgacagatg

SEQ ID NO: 7027831 - DNA, 22 bp, Homo sapiens
atttgtatcaatctcaatatat

SEQ ID NO: 7027832 - DNA, 22 bp, Homo sapiens
tctagatctgcactgttggaca

SEQ ID NO: 7027833 - DNA, 20 bp, Homo sapiens
gctgttagttgggggctccc

SEQ ID NO: 7027834 - DNA, 18 bp, Homo sapiens
gcagagcagaagctcaag

SEQ ID NO: 7027835 - DNA, 22 bp, Homo sapiens
cgtgtagcatgcgccaccacca

SEQ ID NO: 7027836 - DNA, 22 bp, Homo sapiens
tcaaagtaggggtaagccaggc

SEQ ID NO: 7027837 - DNA, 22 bp, Homo sapiens
taaactactgggcaaggacagg

SEQ ID NO: 7027838 - DNA, 22 bp, Homo sapiens
tcaaataggtatgagtagaaat

SEQ ID NO: 7027839 - DNA, 22 bp, Homo sapiens
cttcaaggccttccaggttgaa

SEQ ID NO: 7027840 - DNA, 22 bp, Homo sapiens
gcagatgcaactgcaggtgagt

SEQ ID NO: 7027841 - DNA, 22 bp, Homo sapiens
tccctgccaatgattggagcaa

SEQ ID NO: 7027842 - DNA, 22 bp, Homo sapiens
agccagggatgcagcacagtga

SEQ ID NO: 7027843 - DNA, 22 bp, Homo sapiens
gcagatgttctgtgtctcacaa

SEQ ID NO: 7027844 - DNA, 22 bp, Homo sapiens
attatcttgataaaatggcagt

SEQ ID NO: 7027845 - DNA, 22 bp, Homo sapiens
gtccagagccggaagagtgaca

SEQ ID NO: 7027846 - DNA, 22 bp, Homo sapiens
ctggcagagttgggtctcaaat

SEQ ID NO: 7027847 - DNA, 22 bp, Homo sapiens
tgaggcaacagaaagggccaat

SEQ ID NO: 7027848 - DNA, 22 bp, Homo sapiens
gctgctgagctgcaggagtagg

SEQ ID NO: 7027849 - DNA, 22 bp, Homo sapiens
agagactaatgggagcggaagt

SEQ ID NO: 7027850 - DNA, 22 bp, Homo sapiens
atggattataaatattttaagg

SEQ ID NO: 7027851 - DNA, 19 bp, Homo sapiens
atggacagacagtttggcc

SEQ ID NO: 7027852 - DNA, 22 bp, Homo sapiens
cagatacattaaaatgatgatt

SEQ ID NO: 7027853 - DNA, 22 bp, Homo sapiens
tgtcagggcatgcggtccagcc

SEQ ID NO: 7027854 - DNA, 22 bp, Homo sapiens
gggccacacagggcagctccct

SEQ ID NO: 7027855 - DNA, 22 bp, Homo sapiens
atcttgggcccctgtaagatgg

SEQ ID NO: 7027856 - DNA, 22 bp, Homo sapiens
gctccactgcccctgggcaccg

SEQ ID NO: 7027857 - DNA, 22 bp, Homo sapiens
ttctacatggttgctcagaggg

SEQ ID NO: 7027858 - DNA, 22 bp, Homo sapiens
ttgaaagtccttcttgagttac

SEQ ID NO: 7027859 - DNA, 22 bp, Homo sapiens
ggcactgcttcctgagcctgag

SEQ ID NO: 7027860 - DNA, 22 bp, Homo sapiens
tttggtttagggtcatttaaca

SEQ ID NO: 7027861 - DNA, 22 bp, Homo sapiens
ggacacttagcctcagtttgct

SEQ ID NO: 7027862 - DNA, 22 bp, Homo sapiens
tctgaggagttgggccagtgct

SEQ ID NO: 7027863 - DNA, 22 bp, Homo sapiens
tgcaaagaagccacagtcccag

SEQ ID NO: 7027864 - DNA, 22 bp, Homo sapiens
tttctcccagtctcctgagaca

SEQ ID NO: 7027865 - DNA, 23 bp, Homo sapiens
ggactgcaatggcgccgtctcag

SEQ ID NO: 7027866 - DNA, 22 bp, Homo sapiens
cagtgaggatgataattaaggt

SEQ ID NO: 7027867 - DNA, 22 bp, Homo sapiens
atctacagctgtctgcacagta

SEQ ID NO: 7027868 - DNA, 22 bp, Homo sapiens
tttccgacagaagctgggcgct

SEQ ID NO: 7027869 - DNA, 21 bp, Homo sapiens
agtatcataatgaatagttct

SEQ ID NO: 7027870 - DNA, 22 bp, Homo sapiens
ctgtgtattgaaaaagggttaa

SEQ ID NO: 7027871 - DNA, 20 bp, Homo sapiens
tccagttttggagacattct

SEQ ID NO: 7027872 - DNA, 22 bp, Homo sapiens
gccaggcatgtcctctgcagaa

SEQ ID NO: 7027873 - DNA, 22 bp, Homo sapiens
accctggtttgaataatctgtg

SEQ ID NO: 7027874 - DNA, 22 bp, Homo sapiens
tcaatcaatgtgtcagttccca

SEQ ID NO: 7027875 - DNA, 22 bp, Homo sapiens
ctggcagatagccacgcctgtc

SEQ ID NO: 7027876 - DNA, 22 bp, Homo sapiens
acagttgatttcattagaatcg

SEQ ID NO: 7027877 - DNA, 22 bp, Homo sapiens
cagtgatggatatggagaagtc

SEQ ID NO: 7027878 - DNA, 19 bp, Homo sapiens
tcagtggatgaacatgttt

SEQ ID NO: 7027879 - DNA, 22 bp, Homo sapiens
atctccagattgtgatcatcag

SEQ ID NO: 7027880 - DNA, 22 bp, Homo sapiens
tatgtctgcttggttttggaat

SEQ ID NO: 7027881 - DNA, 22 bp, Homo sapiens
gatttgactttgtcctacctca

SEQ ID NO: 7027882 - DNA, 22 bp, Homo sapiens
gagcaggcattctagtggctga

SEQ ID NO: 7027883 - DNA, 22 bp, Homo sapiens
agacatgtggtataatcagggg

SEQ ID NO: 7027884 - DNA, 22 bp, Homo sapiens
gtcattcaactgcacattaggt

SEQ ID NO: 7027885 - DNA, 22 bp, Homo sapiens
agttttcacactcaccaaaagg

SEQ ID NO: 7027886 - DNA, 22 bp, Homo sapiens
tttcagatgatgcatgcgctca

SEQ ID NO: 7027887 - DNA, 22 bp, Homo sapiens
gaataagtgaagttggcagctt

SEQ ID NO: 7027888 - DNA, 22 bp, Homo sapiens
aggcaaatctgagacatttaaa

SEQ ID NO: 7027889 - DNA, 22 bp, Homo sapiens
tcagagaaatgctgagctcatg

SEQ ID NO: 7027890 - DNA, 22 bp, Homo sapiens
cctgacctatttttctcagctg

SEQ ID NO: 7027891 - DNA, 22 bp, Homo sapiens
actttccttatggatggggaaa

SEQ ID NO: 7027892 - DNA, 22 bp, Homo sapiens
tctaggttagaacccagaaaag

SEQ ID NO: 7027893 - DNA, 22 bp, Homo sapiens
ccctgcagccttgcatgccttc

SEQ ID NO: 7027894 - DNA, 22 bp, Homo sapiens
catatcttatggttttctaagt

SEQ ID NO: 7027895 - DNA, 22 bp, Homo sapiens
tctcagggggacttaatttact

SEQ ID NO: 7027896 - DNA, 22 bp, Homo sapiens
attctggacaaggcaagctcct

SEQ ID NO: 7027897 - DNA, 22 bp, Homo sapiens
cttaacatggggggtaagtctg

SEQ ID NO: 7027898 - DNA, 22 bp, Homo sapiens
cctggctcttcgggagtttgtt

SEQ ID NO: 7027899 - DNA, 22 bp, Homo sapiens
ttggcagattcatttaataaat

SEQ ID NO: 7027900 - DNA, 22 bp, Homo sapiens
catgtatagcaaatatttgttc

SEQ ID NO: 7027901 - DNA, 22 bp, Homo sapiens
ttcagtttccacttacatttaa

SEQ ID NO: 7027902 - DNA, 22 bp, Homo sapiens
gaacagtagatgagatgctaga

SEQ ID NO: 7027903 - DNA, 22 bp, Homo sapiens
cactgtgtcagagtatgatgat

SEQ ID NO: 7027904 - DNA, 22 bp, Homo sapiens
tttgggaagaagttgcaaattt

SEQ ID NO: 7027905 - DNA, 22 bp, Homo sapiens
tttctcaagttcagatatttga

SEQ ID NO: 7027906 - DNA, 22 bp, Homo sapiens
aacactgtgctccccaggctgt

SEQ ID NO: 7027907 - DNA, 22 bp, Homo sapiens
ataataatgaaagccactgtgt

SEQ ID NO: 7027908 - DNA, 22 bp, Homo sapiens
tactgtttgaaattggcttgtt

SEQ ID NO: 7027909 - DNA, 22 bp, Homo sapiens
aggaagctggggtgttcttcat

SEQ ID NO: 7027910 - DNA, 22 bp, Homo sapiens
agccagggggacgctttctggc

SEQ ID NO: 7027911 - DNA, 22 bp, Homo sapiens
ttgccttgattcttctcatgtg

SEQ ID NO: 7027912 - DNA, 22 bp, Homo sapiens
ggagctgatgacgtcaccatgg

SEQ ID NO: 7027913 - DNA, 22 bp, Homo sapiens
gtgctccattgtctagaactgg

SEQ ID NO: 7027914 - DNA, 22 bp, Homo sapiens
gtgtggtggccctccttcaggc

SEQ ID NO: 7027915 - DNA, 22 bp, Homo sapiens
catcttcaggttcatggtcata

SEQ ID NO: 7027916 - DNA, 22 bp, Homo sapiens
aatgattgatagtggctacctt

SEQ ID NO: 7027917 - DNA, 22 bp, Homo sapiens
tggcagctgagtgcaccccctc

SEQ ID NO: 7027918 - DNA, 22 bp, Homo sapiens
tgcaattactgggaggttttat

SEQ ID NO: 7027919 - DNA, 22 bp, Homo sapiens
atccttggtaagagagttggat

SEQ ID NO: 7027920 - DNA, 22 bp, Homo sapiens
ccaggcttctgattccaggcac

SEQ ID NO: 7027921 - DNA, 22 bp, Homo sapiens
attctgcatgtaggtttgctca

SEQ ID NO: 7027922 - DNA, 22 bp, Homo sapiens
acatctcttcttaaggctccag

SEQ ID NO: 7027923 - DNA, 22 bp, Homo sapiens
tgagcagagcagtaacaggagc

SEQ ID NO: 7027924 - DNA, 22 bp, Homo sapiens
tgtacacaattcttaacataca

SEQ ID NO: 7027925 - DNA, 22 bp, Homo sapiens
tggccctgcacccagagcagtt

SEQ ID NO: 7027926 - DNA, 22 bp, Homo sapiens
tgcacacattaaggatacacag

SEQ ID NO: 7027927 - DNA, 23 bp, Homo sapiens
aaagactgaggaaagtctctgtc

SEQ ID NO: 7027928 - DNA, 22 bp, Homo sapiens
cagaggctcagatggccctggc

SEQ ID NO: 7027929 - DNA, 22 bp, Homo sapiens
cagctcatgacctttgttatct

SEQ ID NO: 7027930 - DNA, 18 bp, Homo sapiens
aaatggcacacagacctg

SEQ ID NO: 7027931 - DNA, 22 bp, Homo sapiens
ccagcaggaaagtgacgtttga

SEQ ID NO: 7027932 - DNA, 22 bp, Homo sapiens
tcctagtaacttatgcgtgcct

SEQ ID NO: 7027933 - DNA, 22 bp, Homo sapiens
ccttaaattctccatttgaaag

SEQ ID NO: 7027934 - DNA, 22 bp, Homo sapiens
tgacaatgacatggacagtgat

SEQ ID NO: 7027935 - DNA, 20 bp, Homo sapiens
aacaatctagaagctattct

SEQ ID NO: 7027936 - DNA, 22 bp, Homo sapiens
ggctctagagactctagagaaa

SEQ ID NO: 7027937 - DNA, 22 bp, Homo sapiens
gtgtgtcctcataagatggagg

SEQ ID NO: 7027938 - DNA, 22 bp, Homo sapiens
gcctttcatgcttggagggcca

SEQ ID NO: 7027939 - DNA, 22 bp, Homo sapiens
gggctctggagttctagaaaga

SEQ ID NO: 7027940 - DNA, 22 bp, Homo sapiens
ggctgaggggcccagaggaaca

SEQ ID NO: 7027941 - DNA, 22 bp, Homo sapiens
gcaagagtttctggagcagagt

SEQ ID NO: 7027942 - DNA, 22 bp, Homo sapiens
tttctcagttgtgcgagcagca

SEQ ID NO: 7027943 - DNA, 22 bp, Homo sapiens
cgcagctcttaccctcccctta

SEQ ID NO: 7027944 - DNA, 22 bp, Homo sapiens
tactgagggtatgaagccaagg

SEQ ID NO: 7027945 - DNA, 22 bp, Homo sapiens
tcctgctgctcacctttttgtc

SEQ ID NO: 7027946 - DNA, 22 bp, Homo sapiens
gaccaggacacagtggcaaggt

SEQ ID NO: 7027947 - DNA, 20 bp, Homo sapiens
tttctgtgaggactgtactg

SEQ ID NO: 7027948 - DNA, 22 bp, Homo sapiens
tttcacaggtacaaacactcct

SEQ ID NO: 7027949 - DNA, 22 bp, Homo sapiens
gaagttcttatgaaaacttgag

SEQ ID NO: 7027950 - DNA, 22 bp, Homo sapiens
gagcaacaaattagggggattt

SEQ ID NO: 7027951 - DNA, 22 bp, Homo sapiens
tgcctttaaactgatcatcagg

SEQ ID NO: 7027952 - DNA, 22 bp, Homo sapiens
tgctggctggatcagagattgg

SEQ ID NO: 7027953 - DNA, 22 bp, Homo sapiens
tccaggaaacatctccgcctaa

SEQ ID NO: 7027954 - DNA, 22 bp, Homo sapiens
tccttctggaggctgtaaagga

SEQ ID NO: 7027955 - DNA, 22 bp, Homo sapiens
ctgcagagtatagcgagttggg

SEQ ID NO: 7027956 - DNA, 22 bp, Homo sapiens
aactgcatgtgtgtggcatgat

SEQ ID NO: 7027957 - DNA, 22 bp, Homo sapiens
gaatgaaagatttgcattctat

SEQ ID NO: 7027958 - DNA, 22 bp, Homo sapiens
atacccagagtgggtagagtta

SEQ ID NO: 7027959 - DNA, 19 bp, Homo sapiens
tggcagcctccacttttgc

SEQ ID NO: 7027960 - DNA, 22 bp, Homo sapiens
caacagctttagaaacactttc

SEQ ID NO: 7027961 - DNA, 22 bp, Homo sapiens
tcctaagaagcatgggtcccaa

SEQ ID NO: 7027962 - DNA, 22 bp, Homo sapiens
catcaagtaggtcctttcaaga

SEQ ID NO: 7027963 - DNA, 22 bp, Homo sapiens
tgaaatgtgttatctgggcctg

SEQ ID NO: 7027964 - DNA, 22 bp, Homo sapiens
taatataccaaactgtaatttt

SEQ ID NO: 7027965 - DNA, 22 bp, Homo sapiens
acatgctacacagagctcctcg

SEQ ID NO: 7027966 - DNA, 18 bp, Homo sapiens
agtccttcttggttttac

SEQ ID NO: 7027967 - DNA, 19 bp, Homo sapiens
ctctggctcctgggctgcc

SEQ ID NO: 7027968 - DNA, 22 bp, Homo sapiens
tcagagtggtggttttgccttc

SEQ ID NO: 7027969 - DNA, 22 bp, Homo sapiens
ggcccctgtaaaatgtacatgt

SEQ ID NO: 7027970 - DNA, 22 bp, Homo sapiens
tacatggttggcccattcttct

SEQ ID NO: 7027971 - DNA, 22 bp, Homo sapiens
cagagtggcagtcccaggccca

SEQ ID NO: 7027972 - DNA, 22 bp, Homo sapiens
tgatgaatcctctatgcctttt

SEQ ID NO: 7027973 - DNA, 22 bp, Homo sapiens
tgcagctctgggtgtagaggct

SEQ ID NO: 7027974 - DNA, 18 bp, Homo sapiens
tttggtcctttataaaca

SEQ ID NO: 7027975 - DNA, 22 bp, Homo sapiens
agggaagcttgttactgagaag

SEQ ID NO: 7027976 - DNA, 22 bp, Homo sapiens
aaagacacaaatgtagaccaaa

SEQ ID NO: 7027977 - DNA, 22 bp, Homo sapiens
acatctcttataaactctctga

SEQ ID NO: 7027978 - DNA, 22 bp, Homo sapiens
ccttttcaactaagattctgca

SEQ ID NO: 7027979 - DNA, 17 bp, Homo sapiens
gcgtgtccccgcgtctc

SEQ ID NO: 7027980 - DNA, 20 bp, Homo sapiens
cctctctgccctgcaaggcc

SEQ ID NO: 7027981 - DNA, 22 bp, Homo sapiens
aaggctgacgtttgtgtttatt

SEQ ID NO: 7027982 - DNA, 22 bp, Homo sapiens
tatgacaaggtggagtatgagt

SEQ ID NO: 7027983 - DNA, 22 bp, Homo sapiens
ttccagagcccatgctctaggc

SEQ ID NO: 7027984 - DNA, 19 bp, Homo sapiens
cacaattatgagacactta

SEQ ID NO: 7027985 - DNA, 22 bp, Homo sapiens
tataaactcctcttgcattcct

SEQ ID NO: 7027986 - DNA, 22 bp, Homo sapiens
aaatgaacatcaagaatagcct

SEQ ID NO: 7027987 - DNA, 22 bp, Homo sapiens
gggcgccgtgggaaacagccgg

SEQ ID NO: 7027988 - DNA, 22 bp, Homo sapiens
ctggtcccatcctggcttcatg

SEQ ID NO: 7027989 - DNA, 20 bp, Homo sapiens
ttcttgaatacccaacccca

SEQ ID NO: 7027990 - DNA, 22 bp, Homo sapiens
gagtggggtctgggcatcagtc

SEQ ID NO: 7027991 - DNA, 22 bp, Homo sapiens
ggtctggggcaggcatctgaca

SEQ ID NO: 7027992 - DNA, 22 bp, Homo sapiens
aggcactgtgggtgtggccgga

SEQ ID NO: 7027993 - DNA, 22 bp, Homo sapiens
cagtcattatgggagttaatcc

SEQ ID NO: 7027994 - DNA, 22 bp, Homo sapiens
tccttggggtaactccagcctg

SEQ ID NO: 7027995 - DNA, 22 bp, Homo sapiens
catgcctgcctggtgggcgtgg

SEQ ID NO: 7027996 - DNA, 22 bp, Homo sapiens
ctgtaaaacactgtagtatctg

SEQ ID NO: 7027997 - DNA, 22 bp, Homo sapiens
tccctgggcacaatctgctggc

SEQ ID NO: 7027998 - DNA, 22 bp, Homo sapiens
tccaaattctatgttctttcca

SEQ ID NO: 7027999 - DNA, 22 bp, Homo sapiens
ctccccagctcgcgggtgacgg

SEQ ID NO: 7028000 - DNA, 22 bp, Homo sapiens
cttgcttcattagtgtcttagt

SEQ ID NO: 7028001 - DNA, 16 bp, Homo sapiens
gagttcaatggcagag

SEQ ID NO: 7028002 - DNA, 22 bp, Homo sapiens
gctatgcaggagcctaatgaca

SEQ ID NO: 7028003 - DNA, 22 bp, Homo sapiens
tggcagcagggcccctggagga

SEQ ID NO: 7028004 - DNA, 22 bp, Homo sapiens
tgagccctaagggtcaagcagg

SEQ ID NO: 7028005 - DNA, 22 bp, Homo sapiens
aggtcttgatgtgataagagga

SEQ ID NO: 7028006 - DNA, 22 bp, Homo sapiens
tctgagtgagtgtaggcctgac

SEQ ID NO: 7028007 - DNA, 22 bp, Homo sapiens
gaccactgatgacatgaggaga

SEQ ID NO: 7028008 - DNA, 20 bp, Homo sapiens
gcttccacctgaagcgcacc

SEQ ID NO: 7028009 - DNA, 22 bp, Homo sapiens
atgcaggttggatcctatgccc

SEQ ID NO: 7028010 - DNA, 22 bp, Homo sapiens
ctggggccctgggtctgccctc

SEQ ID NO: 7028011 - DNA, 22 bp, Homo sapiens
cgccctccacacagcccctggc

SEQ ID NO: 7028012 - DNA, 22 bp, Homo sapiens
tctggctttattccttcactga

SEQ ID NO: 7028013 - DNA, 22 bp, Homo sapiens
aaactgctggttgctggccagc

SEQ ID NO: 7028014 - DNA, 22 bp, Homo sapiens
tggctcaccttcagaatatacc

SEQ ID NO: 7028015 - DNA, 22 bp, Homo sapiens
ggagtctagggtcctgggcctg

SEQ ID NO: 7028016 - DNA, 22 bp, Homo sapiens
gtgagctgggtgaatggtaggg

SEQ ID NO: 7028017 - DNA, 22 bp, Homo sapiens
tgtgagcagagacatgaaaagc

SEQ ID NO: 7028018 - DNA, 22 bp, Homo sapiens
acaaatagaaaatctggattgg

SEQ ID NO: 7028019 - DNA, 22 bp, Homo sapiens
actaagtagtttgttcctcttt

SEQ ID NO: 7028020 - DNA, 22 bp, Homo sapiens
ttggcagcggggaccctggctg

SEQ ID NO: 7028021 - DNA, 22 bp, Homo sapiens
catgattatgtgttagagtttg

SEQ ID NO: 7028022 - DNA, 22 bp, Homo sapiens
gccacctggactcagagccagg

SEQ ID NO: 7028023 - DNA, 22 bp, Homo sapiens
gaatgtaagtgggcagaagaca

SEQ ID NO: 7028024 - DNA, 22 bp, Homo sapiens
agggttagtctttgcagctagg

SEQ ID NO: 7028025 - DNA, 22 bp, Homo sapiens
cacagaaaggctcaaatcccaa

SEQ ID NO: 7028026 - DNA, 22 bp, Homo sapiens
ccaggcaattctgaaagcattt

SEQ ID NO: 7028027 - DNA, 22 bp, Homo sapiens
tttgcaaataaataagtgctcg

SEQ ID NO: 7028028 - DNA, 22 bp, Homo sapiens
agctggagaataggaattagtg

SEQ ID NO: 7028029 - DNA, 22 bp, Homo sapiens
tgcaataagttgtgttatcact

SEQ ID NO: 7028030 - DNA, 22 bp, Homo sapiens
tggaatgaaggagatggccttt

SEQ ID NO: 7028031 - DNA, 22 bp, Homo sapiens
acattcattgagcaacaacaat

SEQ ID NO: 7028032 - DNA, 22 bp, Homo sapiens
ttctgcattatacacaacctaa

SEQ ID NO: 7028033 - DNA, 22 bp, Homo sapiens
tcttttagtaataaatatttgt

SEQ ID NO: 7028034 - DNA, 22 bp, Homo sapiens
ctctggagaggttcccatggga

SEQ ID NO: 7028035 - DNA, 22 bp, Homo sapiens
gctagagtggctaagcctgcag

SEQ ID NO: 7028036 - DNA, 22 bp, Homo sapiens
tcaattattttggctatgctaa

SEQ ID NO: 7028037 - DNA, 22 bp, Homo sapiens
taaaacacataaactctctatt

SEQ ID NO: 7028038 - DNA, 22 bp, Homo sapiens
taatttcactgatatgaagtca

SEQ ID NO: 7028039 - DNA, 22 bp, Homo sapiens
ggggtatgcttagtaagtacca

SEQ ID NO: 7028040 - DNA, 22 bp, Homo sapiens
cctgggtcttggttcatgctct

SEQ ID NO: 7028041 - DNA, 22 bp, Homo sapiens
agaggctgggaagggtccccgg

SEQ ID NO: 7028042 - DNA, 22 bp, Homo sapiens
gagccaccttcaactcaggaat

SEQ ID NO: 7028043 - DNA, 22 bp, Homo sapiens
atacacatgttattgtggaagc

SEQ ID NO: 7028044 - DNA, 22 bp, Homo sapiens
agacgctattttgaggggtcta

SEQ ID NO: 7028045 - DNA, 22 bp, Homo sapiens
tcctgagcaacacagctaagtg

SEQ ID NO: 7028046 - DNA, 22 bp, Homo sapiens
tgaaatactttggctctttgtt

SEQ ID NO: 7028047 - DNA, 22 bp, Homo sapiens
gccaggcagttcaagtacacca

SEQ ID NO: 7028048 - DNA, 22 bp, Homo sapiens
aatgatgtggtgggaaggacat

SEQ ID NO: 7028049 - DNA, 22 bp, Homo sapiens
agagccagccttctcagcttac

SEQ ID NO: 7028050 - DNA, 22 bp, Homo sapiens
acctgtctgcatgatctaaaac

SEQ ID NO: 7028051 - DNA, 22 bp, Homo sapiens
tgaagaggccaaactatcattg

SEQ ID NO: 7028052 - DNA, 22 bp, Homo sapiens
atgtactaaagaaatttgcagg

SEQ ID NO: 7028053 - DNA, 22 bp, Homo sapiens
cctggcaggtggcgccctcggc

SEQ ID NO: 7028054 - DNA, 22 bp, Homo sapiens
aaagcagtctgttttaacctga

SEQ ID NO: 7028055 - DNA, 22 bp, Homo sapiens
gatgttctagaagtgtggtgtt

SEQ ID NO: 7028056 - DNA, 22 bp, Homo sapiens
gtgcttcctctgccaacactct

SEQ ID NO: 7028057 - DNA, 22 bp, Homo sapiens
gaagttatagctatgatcttaa

SEQ ID NO: 7028058 - DNA, 22 bp, Homo sapiens
ctggacaggaagaattgggagc

SEQ ID NO: 7028059 - DNA, 22 bp, Homo sapiens
cacagcagggcatggctgttgt

SEQ ID NO: 7028060 - DNA, 22 bp, Homo sapiens
tccagccccttttactcattca

SEQ ID NO: 7028061 - DNA, 22 bp, Homo sapiens
cagcttttgcagacttcttgcc

SEQ ID NO: 7028062 - DNA, 22 bp, Homo sapiens
atttggcaaaaattagcagtag

SEQ ID NO: 7028063 - DNA, 22 bp, Homo sapiens
atccccagggaggcctgacctg

SEQ ID NO: 7028064 - DNA, 22 bp, Homo sapiens
ggtaggggaagacaagtgaaaa

SEQ ID NO: 7028065 - DNA, 22 bp, Homo sapiens
ggtgtgtagcatgtttaagacc

SEQ ID NO: 7028066 - DNA, 22 bp, Homo sapiens
tattagcttctggttttgttct

SEQ ID NO: 7028067 - DNA, 22 bp, Homo sapiens
cacccgtttctcagcagacctg

SEQ ID NO: 7028068 - DNA, 22 bp, Homo sapiens
tgtgtaacaatctacacttagg

SEQ ID NO: 7028069 - DNA, 22 bp, Homo sapiens
ctggttatggctgtggctatgg

SEQ ID NO: 7028070 - DNA, 22 bp, Homo sapiens
gataagttatgtaacttgctca

SEQ ID NO: 7028071 - DNA, 22 bp, Homo sapiens
gacaggctattttcttacgggt

SEQ ID NO: 7028072 - DNA, 22 bp, Homo sapiens
ccaggagcagagtaggtgttca

SEQ ID NO: 7028073 - DNA, 22 bp, Homo sapiens
agtgctaatgtgcaatatagag

SEQ ID NO: 7028074 - DNA, 21 bp, Homo sapiens
agcagaacagtcgagcactgc

SEQ ID NO: 7028075 - DNA, 22 bp, Homo sapiens
gtttagatttcatgaagacact

SEQ ID NO: 7028076 - DNA, 22 bp, Homo sapiens
tcagagaaggcaattttatggt

SEQ ID NO: 7028077 - DNA, 20 bp, Homo sapiens
tggacaggggcataggttgc

SEQ ID NO: 7028078 - DNA, 22 bp, Homo sapiens
atgtcaaagcagactgagagcg

SEQ ID NO: 7028079 - DNA, 22 bp, Homo sapiens
tgcaaacaggcatttcacaaac

SEQ ID NO: 7028080 - DNA, 22 bp, Homo sapiens
tattgacttttaaagtgatata

SEQ ID NO: 7028081 - DNA, 22 bp, Homo sapiens
aaggctcttgagtggtgatagt

SEQ ID NO: 7028082 - DNA, 22 bp, Homo sapiens
tttggtagtatcaatgtactca

SEQ ID NO: 7028083 - DNA, 22 bp, Homo sapiens
gttcccatcagggatgagggtg

SEQ ID NO: 7028084 - DNA, 22 bp, Homo sapiens
agcaatgactggctatatgatt

SEQ ID NO: 7028085 - DNA, 17 bp, Homo sapiens
aggtggctgctgcgcct

SEQ ID NO: 7028086 - DNA, 22 bp, Homo sapiens
attgagtacctccagattcata

SEQ ID NO: 7028087 - DNA, 22 bp, Homo sapiens
tcctgaatttcccagcatgaac

SEQ ID NO: 7028088 - DNA, 22 bp, Homo sapiens
aaaggtgactgcagcagctatt

SEQ ID NO: 7028089 - DNA, 22 bp, Homo sapiens
aggaaggtgcagtagggtgtgc

SEQ ID NO: 7028090 - DNA, 22 bp, Homo sapiens
agtgtagaaggagaaatggatc

SEQ ID NO: 7028091 - DNA, 22 bp, Homo sapiens
gtgcatttgtgcatgcacatgt

SEQ ID NO: 7028092 - DNA, 22 bp, Homo sapiens
agacctggagacctgagtggta

SEQ ID NO: 7028093 - DNA, 22 bp, Homo sapiens
gcagtaaagcctgagatatatg

SEQ ID NO: 7028094 - DNA, 22 bp, Homo sapiens
actgatgatctgggagtagagt

SEQ ID NO: 7028095 - DNA, 22 bp, Homo sapiens
gacagctcctttctgaggatga

SEQ ID NO: 7028096 - DNA, 22 bp, Homo sapiens
atagcatggcctgtgacacttt

SEQ ID NO: 7028097 - DNA, 22 bp, Homo sapiens
tcatgtgtcctagttcatataa

SEQ ID NO: 7028098 - DNA, 22 bp, Homo sapiens
ttacttgaaggcagaaaagttt

SEQ ID NO: 7028099 - DNA, 19 bp, Homo sapiens
aactttgctaccctatcct

SEQ ID NO: 7028100 - DNA, 17 bp, Homo sapiens
tattccaggaaataaag

SEQ ID NO: 7028101 - DNA, 22 bp, Homo sapiens
tgtgatatttgagtattgtcaa

SEQ ID NO: 7028102 - DNA, 22 bp, Homo sapiens
ggtgggtgagccctgggagctg

SEQ ID NO: 7028103 - DNA, 22 bp, Homo sapiens
cttctggagctcaccaacttcc

SEQ ID NO: 7028104 - DNA, 22 bp, Homo sapiens
aaagtgccccagacaagacccc

SEQ ID NO: 7028105 - DNA, 22 bp, Homo sapiens
ttacagaaaatgtgttttaact

SEQ ID NO: 7028106 - DNA, 22 bp, Homo sapiens
cagggagctttcccaggaccct

SEQ ID NO: 7028107 - DNA, 22 bp, Homo sapiens
tcaagtgtagtggtgtcaggtc

SEQ ID NO: 7028108 - DNA, 22 bp, Homo sapiens
ccatgcgcacccaggggaagct

SEQ ID NO: 7028109 - DNA, 22 bp, Homo sapiens
gcagccactctcattccacgtg

SEQ ID NO: 7028110 - DNA, 20 bp, Homo sapiens
gcctgagctccgcctcctgt

SEQ ID NO: 7028111 - DNA, 19 bp, Homo sapiens
tcagttttagtcatcagtt

SEQ ID NO: 7028112 - DNA, 22 bp, Homo sapiens
tcacagtgttggaatcagagct

SEQ ID NO: 7028113 - DNA, 22 bp, Homo sapiens
ctacagctgtgtgtttatgtgc

SEQ ID NO: 7028114 - DNA, 22 bp, Homo sapiens
tacacttttctggttactcttg

SEQ ID NO: 7028115 - DNA, 22 bp, Homo sapiens
gcagatgcagaactcagtgggt

SEQ ID NO: 7028116 - DNA, 22 bp, Homo sapiens
tgcctccaccattgctcacttt

SEQ ID NO: 7028117 - DNA, 22 bp, Homo sapiens
tggttcctcagggcagctgtac

SEQ ID NO: 7028118 - DNA, 22 bp, Homo sapiens
cctgtgccctggaaggagagag

SEQ ID NO: 7028119 - DNA, 22 bp, Homo sapiens
tctgtcctctttgaagctgctc

SEQ ID NO: 7028120 - DNA, 22 bp, Homo sapiens
attcccatttgtgtggtctgga

SEQ ID NO: 7028121 - DNA, 22 bp, Homo sapiens
cttaatttaagcctagaatgca

SEQ ID NO: 7028122 - DNA, 18 bp, Homo sapiens
tcatggctttagtccctc

SEQ ID NO: 7028123 - DNA, 22 bp, Homo sapiens
aaagcactcggcttcatccagg

SEQ ID NO: 7028124 - DNA, 22 bp, Homo sapiens
aactgtggacttgagactgatg

SEQ ID NO: 7028125 - DNA, 21 bp, Homo sapiens
cagaggcaggtcctgggacgg

SEQ ID NO: 7028126 - DNA, 22 bp, Homo sapiens
atgtacaggtcttggcaaaggg

SEQ ID NO: 7028127 - DNA, 22 bp, Homo sapiens
agaccctttgggtctgtgcagg

SEQ ID NO: 7028128 - DNA, 22 bp, Homo sapiens
tctttggctatgatttactgtt

SEQ ID NO: 7028129 - DNA, 22 bp, Homo sapiens
gggaaactgaattcaggactct

SEQ ID NO: 7028130 - DNA, 22 bp, Homo sapiens
acttaatggttcctaaaatgtg

SEQ ID NO: 7028131 - DNA, 22 bp, Homo sapiens
gactttattatagtggcaatag

SEQ ID NO: 7028132 - DNA, 22 bp, Homo sapiens
agatttcacatgctgctctatt

SEQ ID NO: 7028133 - DNA, 23 bp, Homo sapiens
tgcattcctcacagggcagaaga

SEQ ID NO: 7028134 - DNA, 22 bp, Homo sapiens
agcaggagtgtcccctggctgt

SEQ ID NO: 7028135 - DNA, 22 bp, Homo sapiens
aagatgaccctgagggcaattg

SEQ ID NO: 7028136 - DNA, 22 bp, Homo sapiens
tgccattttgagatgttaatga

SEQ ID NO: 7028137 - DNA, 22 bp, Homo sapiens
ttctcagtttcactgataacag

SEQ ID NO: 7028138 - DNA, 20 bp, Homo sapiens
cccagtgtccagccttgcca

SEQ ID NO: 7028139 - DNA, 22 bp, Homo sapiens
actctgcttaattaaaaccagg

SEQ ID NO: 7028140 - DNA, 22 bp, Homo sapiens
taaagccaacactttactgctc

SEQ ID NO: 7028141 - DNA, 22 bp, Homo sapiens
ttgattcagtaaagctaaattt

SEQ ID NO: 7028142 - DNA, 22 bp, Homo sapiens
tcagtttcacagtctgtgcaga

SEQ ID NO: 7028143 - DNA, 16 bp, Homo sapiens
aggcagatattgagtg

SEQ ID NO: 7028144 - DNA, 22 bp, Homo sapiens
gctggagatagaatggccactg

SEQ ID NO: 7028145 - DNA, 22 bp, Homo sapiens
tttggctctgcgtcttcaccca

SEQ ID NO: 7028146 - DNA, 22 bp, Homo sapiens
tacaagacgagggaagttcttt

SEQ ID NO: 7028147 - DNA, 22 bp, Homo sapiens
gctggctctacatttgaggtca

SEQ ID NO: 7028148 - DNA, 22 bp, Homo sapiens
agtttggacaaaagactcctta

SEQ ID NO: 7028149 - DNA, 22 bp, Homo sapiens
cctgggggccaggaaggtgtga

SEQ ID NO: 7028150 - DNA, 22 bp, Homo sapiens
tggtgcttgtggagctggtgct

SEQ ID NO: 7028151 - DNA, 22 bp, Homo sapiens
tcctccgacaccagctgggcta

SEQ ID NO: 7028152 - DNA, 22 bp, Homo sapiens
acttggtcgtggtgcagcatgg

SEQ ID NO: 7028153 - DNA, 19 bp, Homo sapiens
ggggtggctggggctccag

SEQ ID NO: 7028154 - DNA, 22 bp, Homo sapiens
ctgcacagtgggtggggcgtca

SEQ ID NO: 7028155 - DNA, 23 bp, Homo sapiens
ccagagctctttcatgcttccat

SEQ ID NO: 7028156 - DNA, 19 bp, Homo sapiens
ttcaccatgggactggagc

SEQ ID NO: 7028157 - DNA, 22 bp, Homo sapiens
ccagatcttcttttcagtgtct

SEQ ID NO: 7028158 - DNA, 22 bp, Homo sapiens
catatgaaatatgagttgaaca

SEQ ID NO: 7028159 - DNA, 22 bp, Homo sapiens
aagaaatcatatcatttcttgg

SEQ ID NO: 7028160 - DNA, 22 bp, Homo sapiens
cacataattgaacgtgatgagt

SEQ ID NO: 7028161 - DNA, 22 bp, Homo sapiens
cccaaagggtgtcagcagcaag

SEQ ID NO: 7028162 - DNA, 22 bp, Homo sapiens
tcatgcaatctcttgttcagga

SEQ ID NO: 7028163 - DNA, 22 bp, Homo sapiens
gtggtcatttgtctgagctcca

SEQ ID NO: 7028164 - DNA, 22 bp, Homo sapiens
aacaggcctatggtttattcat

SEQ ID NO: 7028165 - DNA, 21 bp, Homo sapiens
ggtctcttcatctgtaacctg

SEQ ID NO: 7028166 - DNA, 22 bp, Homo sapiens
gtctgtggagttgcttgctgga

SEQ ID NO: 7028167 - DNA, 18 bp, Homo sapiens
gctttctatgcgacagta

SEQ ID NO: 7028168 - DNA, 22 bp, Homo sapiens
gatcttttcagtcttggtagtt

SEQ ID NO: 7028169 - DNA, 22 bp, Homo sapiens
gtttgcaaattgtgttaaagct

SEQ ID NO: 7028170 - DNA, 22 bp, Homo sapiens
tagcaacgtgtataaactcaag

SEQ ID NO: 7028171 - DNA, 22 bp, Homo sapiens
gctctcatgccctctgggcttg

SEQ ID NO: 7028172 - DNA, 22 bp, Homo sapiens
aggggaggtgtccccaaatctc

SEQ ID NO: 7028173 - DNA, 22 bp, Homo sapiens
taactgtcacttctgcacatct

SEQ ID NO: 7028174 - DNA, 22 bp, Homo sapiens
tctacagctgctgcttctcatg

SEQ ID NO: 7028175 - DNA, 22 bp, Homo sapiens
tgtcacatgtttaatgtggact

SEQ ID NO: 7028176 - DNA, 22 bp, Homo sapiens
gttcagagtattaattgattta

SEQ ID NO: 7028177 - DNA, 22 bp, Homo sapiens
ttccaaactcatagtatggtgt

SEQ ID NO: 7028178 - DNA, 22 bp, Homo sapiens
gtggcagagccttgcggctttg

SEQ ID NO: 7028179 - DNA, 22 bp, Homo sapiens
ctgtcctggggaaagccagccc

SEQ ID NO: 7028180 - DNA, 22 bp, Homo sapiens
gctgttcggcagcacctggagc

SEQ ID NO: 7028181 - DNA, 20 bp, Homo sapiens
ttactttgtttggatgacat

SEQ ID NO: 7028182 - DNA, 22 bp, Homo sapiens
cagcaataactcaaagccattt

SEQ ID NO: 7028183 - DNA, 22 bp, Homo sapiens
tttctgcatgcatttaattaaa

SEQ ID NO: 7028184 - DNA, 20 bp, Homo sapiens
ggaattgctttcctgtcttt

SEQ ID NO: 7028185 - DNA, 22 bp, Homo sapiens
taaaggtcaagagatgctgtct

SEQ ID NO: 7028186 - DNA, 22 bp, Homo sapiens
actctggccaggtgcggtatgt

SEQ ID NO: 7028187 - DNA, 18 bp, Homo sapiens
tgagaatgtaagaaatgg

SEQ ID NO: 7028188 - DNA, 22 bp, Homo sapiens
ttcaagttttcagaatagccac

SEQ ID NO: 7028189 - DNA, 22 bp, Homo sapiens
tcccagctgctgagatagtgct

SEQ ID NO: 7028190 - DNA, 22 bp, Homo sapiens
ctcctctgtctggccctgagcc

SEQ ID NO: 7028191 - DNA, 22 bp, Homo sapiens
taaaggtatgtcttaatcaaac

SEQ ID NO: 7028192 - DNA, 22 bp, Homo sapiens
gagtcacttcccgaataaaccc

SEQ ID NO: 7028193 - DNA, 22 bp, Homo sapiens
ttgcaagggtgttttgaggtgt

SEQ ID NO: 7028194 - DNA, 22 bp, Homo sapiens
tcccagcttagatttgctcatt

SEQ ID NO: 7028195 - DNA, 22 bp, Homo sapiens
ctctgccagtttctggcctcag

SEQ ID NO: 7028196 - DNA, 22 bp, Homo sapiens
ctgccctgtctgcagcctggct

SEQ ID NO: 7028197 - DNA, 22 bp, Homo sapiens
gggccccaagaacctcctcctg

SEQ ID NO: 7028198 - DNA, 22 bp, Homo sapiens
tggcctctttcttccctttgac

SEQ ID NO: 7028199 - DNA, 22 bp, Homo sapiens
tatgaagatatatctgatctct

SEQ ID NO: 7028200 - DNA, 22 bp, Homo sapiens
gctaatcttcctaaaccttggt

SEQ ID NO: 7028201 - DNA, 22 bp, Homo sapiens
tgtatgctttccttctttctgg

SEQ ID NO: 7028202 - DNA, 22 bp, Homo sapiens
cacatacatacgtatgtataca

SEQ ID NO: 7028203 - DNA, 22 bp, Homo sapiens
aggtccagaacgtgcctactct

SEQ ID NO: 7028204 - DNA, 22 bp, Homo sapiens
tgatatttttcactggcctctg

SEQ ID NO: 7028205 - DNA, 18 bp, Homo sapiens
gggattttgacttgctgt

SEQ ID NO: 7028206 - DNA, 22 bp, Homo sapiens
aaacagtgccaggcagatgcca

SEQ ID NO: 7028207 - DNA, 22 bp, Homo sapiens
gtgcacactcttggggcacttt

SEQ ID NO: 7028208 - DNA, 22 bp, Homo sapiens
agtcatttatcttagccattat

SEQ ID NO: 7028209 - DNA, 22 bp, Homo sapiens
actcagaaccatttactctgag

SEQ ID NO: 7028210 - DNA, 22 bp, Homo sapiens
ttacagtgaagtaccattaaaa

SEQ ID NO: 7028211 - DNA, 23 bp, Homo sapiens
acagacattccataatgtacacc

SEQ ID NO: 7028212 - DNA, 23 bp, Homo sapiens
aatatcaaggtgatgttcccaga

SEQ ID NO: 7028213 - DNA, 22 bp, Homo sapiens
agacacagattttggaaaagat

SEQ ID NO: 7028214 - DNA, 18 bp, Homo sapiens
atgctgccctctgagggt

SEQ ID NO: 7028215 - DNA, 19 bp, Homo sapiens
ggacagtctcagcctcatg

SEQ ID NO: 7028216 - DNA, 22 bp, Homo sapiens
gggtccagcgacagcaggctca

SEQ ID NO: 7028217 - DNA, 22 bp, Homo sapiens
ggtatgaaatgattccatgtta

SEQ ID NO: 7028218 - DNA, 20 bp, Homo sapiens
agcagatagcgggagagttt

SEQ ID NO: 7028219 - DNA, 20 bp, Homo sapiens
atgcaaactcacaaaatacc

SEQ ID NO: 7028220 - DNA, 22 bp, Homo sapiens
tataggctgatggcttcctgag

SEQ ID NO: 7028221 - DNA, 22 bp, Homo sapiens
aggccttgtattaatttgtttt

SEQ ID NO: 7028222 - DNA, 20 bp, Homo sapiens
cagatgctggatcttggtcc

SEQ ID NO: 7028223 - DNA, 22 bp, Homo sapiens
tgaggtaggtaccattatcact

SEQ ID NO: 7028224 - DNA, 22 bp, Homo sapiens
taaactctcaacagagaaccac

SEQ ID NO: 7028225 - DNA, 22 bp, Homo sapiens
gacaagacagcttgcagacaac

SEQ ID NO: 7028226 - DNA, 22 bp, Homo sapiens
cctgtggcacatgcagggattc

SEQ ID NO: 7028227 - DNA, 22 bp, Homo sapiens
agctctggtgagatgttattca

SEQ ID NO: 7028228 - DNA, 22 bp, Homo sapiens
tcttctttgaatcatagtgacc

SEQ ID NO: 7028229 - DNA, 19 bp, Homo sapiens
ggatggtggggtgcccatc

SEQ ID NO: 7028230 - DNA, 22 bp, Homo sapiens
aagagagagcattcttctgtta

SEQ ID NO: 7028231 - DNA, 15 bp, Homo sapiens
gacattgctttgcag

SEQ ID NO: 7028232 - DNA, 22 bp, Homo sapiens
tggttcatgctcatggtgatag

SEQ ID NO: 7028233 - DNA, 22 bp, Homo sapiens
ctgccctgtttggacagcccgg

SEQ ID NO: 7028234 - DNA, 22 bp, Homo sapiens
tgtggctgggaagaaggtaact

SEQ ID NO: 7028235 - DNA, 22 bp, Homo sapiens
ggtggcagtggtctctgacaga

SEQ ID NO: 7028236 - DNA, 22 bp, Homo sapiens
cacctggatgccacaaagccac

SEQ ID NO: 7028237 - DNA, 22 bp, Homo sapiens
gggcctccggggtgagctgtgg

SEQ ID NO: 7028238 - DNA, 22 bp, Homo sapiens
tgaccttatttggaaatagggt

SEQ ID NO: 7028239 - DNA, 22 bp, Homo sapiens
gttaagcctgaatcacattaat

SEQ ID NO: 7028240 - DNA, 22 bp, Homo sapiens
gtgctgaattgtgctctttaca

SEQ ID NO: 7028241 - DNA, 22 bp, Homo sapiens
ttagcaggtttctggctcttgg

SEQ ID NO: 7028242 - DNA, 22 bp, Homo sapiens
taaaggtacgaagtgagggatt

SEQ ID NO: 7028243 - DNA, 22 bp, Homo sapiens
cacagggaggcggtcactggct

SEQ ID NO: 7028244 - DNA, 22 bp, Homo sapiens
tacaatcacccaaaagtggctc

SEQ ID NO: 7028245 - DNA, 21 bp, Homo sapiens
atatcaatacagcaggacttc

SEQ ID NO: 7028246 - DNA, 22 bp, Homo sapiens
tgagtgttgtaaccatatgatt

SEQ ID NO: 7028247 - DNA, 21 bp, Homo sapiens
actactggtgaaagcctagat

SEQ ID NO: 7028248 - DNA, 22 bp, Homo sapiens
gggggagagacgagcggctctg

SEQ ID NO: 7028249 - DNA, 22 bp, Homo sapiens
tgttccttcacagcagtggaca

SEQ ID NO: 7028250 - DNA, 22 bp, Homo sapiens
atcatgacatacttttgagaag

SEQ ID NO: 7028251 - DNA, 22 bp, Homo sapiens
tacttgtcaggtgggtgggagg

SEQ ID NO: 7028252 - DNA, 22 bp, Homo sapiens
tctctctggagctggggcatga

SEQ ID NO: 7028253 - DNA, 23 bp, Homo sapiens
ctagatgcaagctccatgaggga

SEQ ID NO: 7028254 - DNA, 22 bp, Homo sapiens
aggaagaaactgagctctgaca

SEQ ID NO: 7028255 - DNA, 22 bp, Homo sapiens
gctgtcttcacttcctggtttc

SEQ ID NO: 7028256 - DNA, 22 bp, Homo sapiens
aaacatgggcttcctgatgcga

SEQ ID NO: 7028257 - DNA, 22 bp, Homo sapiens
gagatcggtaaagagcatgcac

SEQ ID NO: 7028258 - DNA, 22 bp, Homo sapiens
ccacatctaagccttcatgata

SEQ ID NO: 7028259 - DNA, 22 bp, Homo sapiens
tgtcatggtagctgaaggatgt

SEQ ID NO: 7028260 - DNA, 22 bp, Homo sapiens
cagcaactggtcattgctctcc

SEQ ID NO: 7028261 - DNA, 22 bp, Homo sapiens
ttcctataagcctgtagtctca

SEQ ID NO: 7028262 - DNA, 22 bp, Homo sapiens
tcataagtggtttatatgcttg

SEQ ID NO: 7028263 - DNA, 22 bp, Homo sapiens
ggaggagcacttgacggggtct

SEQ ID NO: 7028264 - DNA, 22 bp, Homo sapiens
tctgggttgggagaaaagaggg

SEQ ID NO: 7028265 - DNA, 22 bp, Homo sapiens
cacattgctaggctcttcctca

SEQ ID NO: 7028266 - DNA, 20 bp, Homo sapiens
tatctaaatgcttacattac

SEQ ID NO: 7028267 - DNA, 22 bp, Homo sapiens
ttgtcctgcaacctcacatggc

SEQ ID NO: 7028268 - DNA, 22 bp, Homo sapiens
agaggaatggagactaaacgct

SEQ ID NO: 7028269 - DNA, 22 bp, Homo sapiens
tgcatacacaagcatacatgta

SEQ ID NO: 7028270 - DNA, 22 bp, Homo sapiens
aagctggagagttaggtgaata

SEQ ID NO: 7028271 - DNA, 22 bp, Homo sapiens
cttcctggatgagcaggctgat

SEQ ID NO: 7028272 - DNA, 22 bp, Homo sapiens
tggcaaattcatctttagttct

SEQ ID NO: 7028273 - DNA, 22 bp, Homo sapiens
acagtctggaagcagggggcaa

SEQ ID NO: 7028274 - DNA, 18 bp, Homo sapiens
cccagctccacttccctc

SEQ ID NO: 7028275 - DNA, 22 bp, Homo sapiens
tttcctgcctggacctctgctt

SEQ ID NO: 7028276 - DNA, 22 bp, Homo sapiens
atggttttgaagggaggtcaaa

SEQ ID NO: 7028277 - DNA, 22 bp, Homo sapiens
tagcttaaaatctctagattct

SEQ ID NO: 7028278 - DNA, 22 bp, Homo sapiens
actgtttatgatgatagagggg

SEQ ID NO: 7028279 - DNA, 22 bp, Homo sapiens
ctggttctgatgttcttggctt

SEQ ID NO: 7028280 - DNA, 22 bp, Homo sapiens
tctctgggagccaggatgacac

SEQ ID NO: 7028281 - DNA, 22 bp, Homo sapiens
tgagttaatctctacgatagaa

SEQ ID NO: 7028282 - DNA, 22 bp, Homo sapiens
aaagcaatgcttgtggaatgta

SEQ ID NO: 7028283 - DNA, 22 bp, Homo sapiens
aaagtgcttcctttttgagggt

SEQ ID NO: 7028284 - DNA, 22 bp, Homo sapiens
aatttgggcgaggagggaggca

SEQ ID NO: 7028285 - DNA, 22 bp, Homo sapiens
ccacaaggaggacagcagttgg

SEQ ID NO: 7028286 - DNA, 21 bp, Homo sapiens
tctgcattttagcaagatctc

SEQ ID NO: 7028287 - DNA, 21 bp, Homo sapiens
ctctggaggcaagggagagtg

SEQ ID NO: 7028288 - DNA, 20 bp, Homo sapiens
ttttccttgttgccgctgct

SEQ ID NO: 7028289 - DNA, 22 bp, Homo sapiens
tgtgtcaacaacagccttggat

SEQ ID NO: 7028290 - DNA, 22 bp, Homo sapiens
agctgcttagagtctcttctta

SEQ ID NO: 7028291 - DNA, 19 bp, Homo sapiens
acttcagcagggttcctgt

SEQ ID NO: 7028292 - DNA, 22 bp, Homo sapiens
agtggcagctgtcatgccctag

SEQ ID NO: 7028293 - DNA, 22 bp, Homo sapiens
aagtgtgggactagggctccag

SEQ ID NO: 7028294 - DNA, 22 bp, Homo sapiens
ttcctcagttagtgcctgaggc

SEQ ID NO: 7028295 - DNA, 22 bp, Homo sapiens
atgaagcttgaggtgagagctg

SEQ ID NO: 7028296 - DNA, 22 bp, Homo sapiens
atacagtagggaccatgtctga

SEQ ID NO: 7028297 - DNA, 22 bp, Homo sapiens
agggcagcacagctgtgctcct

SEQ ID NO: 7028298 - DNA, 22 bp, Homo sapiens
tagaggctgggaattattttca

SEQ ID NO: 7028299 - DNA, 22 bp, Homo sapiens
ttttatgagtgtccctctgtgg

SEQ ID NO: 7028300 - DNA, 22 bp, Homo sapiens
cagtaatagaggctttgagtct

SEQ ID NO: 7028301 - DNA, 22 bp, Homo sapiens
aggcatgcatcactattcttag

SEQ ID NO: 7028302 - DNA, 22 bp, Homo sapiens
tttcagaaagctgaacatatga

SEQ ID NO: 7028303 - DNA, 22 bp, Homo sapiens
agggctgagcccaggcatgtag

SEQ ID NO: 7028304 - DNA, 22 bp, Homo sapiens
gaaatatacattgcaggaagag

SEQ ID NO: 7028305 - DNA, 22 bp, Homo sapiens
tacaacagacctagatgaatga

SEQ ID NO: 7028306 - DNA, 22 bp, Homo sapiens
tatgagaagaacaggtgacttt

SEQ ID NO: 7028307 - DNA, 22 bp, Homo sapiens
ttgtttcattttggctaaactg

SEQ ID NO: 7028308 - DNA, 21 bp, Homo sapiens
gctgtactttgaactgggtgt

SEQ ID NO: 7028309 - DNA, 22 bp, Homo sapiens
ggcaggaacacagatggtgccg

SEQ ID NO: 7028310 - DNA, 22 bp, Homo sapiens
aacagcttttttggtcagcatt

SEQ ID NO: 7028311 - DNA, 22 bp, Homo sapiens
aggcttctcaataggtttgaag

SEQ ID NO: 7028312 - DNA, 23 bp, Homo sapiens
aggccctgcctgtccctcttttt

SEQ ID NO: 7028313 - DNA, 22 bp, Homo sapiens
atccttagaagggagtgaggac

SEQ ID NO: 7028314 - DNA, 22 bp, Homo sapiens
gttgttttattgtgagtcccat

SEQ ID NO: 7028315 - DNA, 22 bp, Homo sapiens
tggaagaggtggaagtggcttc

SEQ ID NO: 7028316 - DNA, 22 bp, Homo sapiens
gttgtacattctatgggtttgg

SEQ ID NO: 7028317 - DNA, 22 bp, Homo sapiens
gttttcctgagcccagagatgc

SEQ ID NO: 7028318 - DNA, 22 bp, Homo sapiens
tgatgctttaagattaatctgg

SEQ ID NO: 7028319 - DNA, 22 bp, Homo sapiens
ggcagaagacaggcaaatcatg

SEQ ID NO: 7028320 - DNA, 22 bp, Homo sapiens
accattaacatgattttgggga

SEQ ID NO: 7028321 - DNA, 22 bp, Homo sapiens
acagcaggagccttcatatgct

SEQ ID NO: 7028322 - DNA, 22 bp, Homo sapiens
tgggacagagtgagctttggcc

SEQ ID NO: 7028323 - DNA, 22 bp, Homo sapiens
cagttcaaaattttgaagaagg

SEQ ID NO: 7028324 - DNA, 20 bp, Homo sapiens
ctcccctctacagagggctg

SEQ ID NO: 7028325 - DNA, 22 bp, Homo sapiens
cttagccctgagagttctgagc

SEQ ID NO: 7028326 - DNA, 22 bp, Homo sapiens
agctgtcaggcagaactgagct

SEQ ID NO: 7028327 - DNA, 22 bp, Homo sapiens
tataatttttctgtggccagtt

SEQ ID NO: 7028328 - DNA, 22 bp, Homo sapiens
cagcaatggcaggcggagagtg

SEQ ID NO: 7028329 - DNA, 21 bp, Homo sapiens
tagcaatacgtggaccatggg

SEQ ID NO: 7028330 - DNA, 22 bp, Homo sapiens
atgaggagtcaaggagtcggag

SEQ ID NO: 7028331 - DNA, 22 bp, Homo sapiens
ccagctgtgctgttggcttgtc

SEQ ID NO: 7028332 - DNA, 22 bp, Homo sapiens
gtctcttgttatcatttctgag

SEQ ID NO: 7028333 - DNA, 22 bp, Homo sapiens
ttcttacattactttacatgtg

SEQ ID NO: 7028334 - DNA, 22 bp, Homo sapiens
caggcagaaagtattctgtgta

SEQ ID NO: 7028335 - DNA, 22 bp, Homo sapiens
gttgcttgttagtggtgaggtt

SEQ ID NO: 7028336 - DNA, 22 bp, Homo sapiens
ttcaaatgatggcagtcctggc

SEQ ID NO: 7028337 - DNA, 22 bp, Homo sapiens
attcagtgggtgctcagcacaa

SEQ ID NO: 7028338 - DNA, 18 bp, Homo sapiens
tggcaggtagactcaggt

SEQ ID NO: 7028339 - DNA, 22 bp, Homo sapiens
ttttcacttaaggaatttcatg

SEQ ID NO: 7028340 - DNA, 22 bp, Homo sapiens
tgttaatcaatcaacagtatta

SEQ ID NO: 7028341 - DNA, 22 bp, Homo sapiens
aacatcagtattctcatctgta

SEQ ID NO: 7028342 - DNA, 20 bp, Homo sapiens
aggaggccaaagtaatgggg

SEQ ID NO: 7028343 - DNA, 22 bp, Homo sapiens
ctttaattcagatttgaaggga

SEQ ID NO: 7028344 - DNA, 22 bp, Homo sapiens
gctcctctcctcggagtcgggg

SEQ ID NO: 7028345 - DNA, 22 bp, Homo sapiens
tttagactaattcctaaagggc

SEQ ID NO: 7028346 - DNA, 22 bp, Homo sapiens
ttggtgggagagatgagggttg

SEQ ID NO: 7028347 - DNA, 22 bp, Homo sapiens
gtgtcccactctggaggtgaag

SEQ ID NO: 7028348 - DNA, 22 bp, Homo sapiens
atacatgttgagaaaatatctg

SEQ ID NO: 7028349 - DNA, 22 bp, Homo sapiens
tcagatggattcattacatgac

SEQ ID NO: 7028350 - DNA, 22 bp, Homo sapiens
gcttcacagaatcaatagttgg

SEQ ID NO: 7028351 - DNA, 22 bp, Homo sapiens
agccctggaccttagcccccac

SEQ ID NO: 7028352 - DNA, 22 bp, Homo sapiens
ggggcagggaggttatcgccga

SEQ ID NO: 7028353 - DNA, 22 bp, Homo sapiens
actgtcgattatgatgagtcag

SEQ ID NO: 7028354 - DNA, 23 bp, Homo sapiens
tttgttcactcctgggaaagaca

SEQ ID NO: 7028355 - DNA, 22 bp, Homo sapiens
agcaatatgacattgctacatc

SEQ ID NO: 7028356 - DNA, 22 bp, Homo sapiens
ttctggagtcccacagccaggg

SEQ ID NO: 7028357 - DNA, 21 bp, Homo sapiens
tcattggtaagttttgtttgc

SEQ ID NO: 7028358 - DNA, 22 bp, Homo sapiens
gggtggagtagaaagatgaatt

SEQ ID NO: 7028359 - DNA, 22 bp, Homo sapiens
gcattttagaatattggagcaa

SEQ ID NO: 7028360 - DNA, 22 bp, Homo sapiens
tttcacagctgggtggcagagt

SEQ ID NO: 7028361 - DNA, 22 bp, Homo sapiens
gtgctgtcactggtaaatgcgg

SEQ ID NO: 7028362 - DNA, 22 bp, Homo sapiens
caggggcaggtgtgagatcatc

SEQ ID NO: 7028363 - DNA, 22 bp, Homo sapiens
atgctaaattcagacagggtta

SEQ ID NO: 7028364 - DNA, 22 bp, Homo sapiens
tttaacagatgtgaaattttca

SEQ ID NO: 7028365 - DNA, 15 bp, Homo sapiens
ccaagaactaattag

SEQ ID NO: 7028366 - DNA, 22 bp, Homo sapiens
gatgaggggtcattggctggga

SEQ ID NO: 7028367 - DNA, 22 bp, Homo sapiens
agctgcaaagatgatttgttgt

SEQ ID NO: 7028368 - DNA, 22 bp, Homo sapiens
ccaccagcttcagcagccgcgg

SEQ ID NO: 7028369 - DNA, 22 bp, Homo sapiens
gaggaggaagttctctgtaggc

SEQ ID NO: 7028370 - DNA, 22 bp, Homo sapiens
aactgtaagaaataaaattctg

SEQ ID NO: 7028371 - DNA, 18 bp, Homo sapiens
aggagaaagggaccaggg

SEQ ID NO: 7028372 - DNA, 22 bp, Homo sapiens
gatgagctgtctagctgttgga

SEQ ID NO: 7028373 - DNA, 22 bp, Homo sapiens
ttattacaatgcagaaaataga

SEQ ID NO: 7028374 - DNA, 22 bp, Homo sapiens
cactcagctgagccctcagccc

SEQ ID NO: 7028375 - DNA, 22 bp, Homo sapiens
aagcacaggagacgcacagcca

SEQ ID NO: 7028376 - DNA, 22 bp, Homo sapiens
tatacagatttctgggcaatct

SEQ ID NO: 7028377 - DNA, 23 bp, Homo sapiens
tgggacctgtttgcccacagatg

SEQ ID NO: 7028378 - DNA, 22 bp, Homo sapiens
tggatgagaaactctggtgact

SEQ ID NO: 7028379 - DNA, 22 bp, Homo sapiens
tcctgggttcatgtcctggtgc

SEQ ID NO: 7028380 - DNA, 22 bp, Homo sapiens
cagatgaataaatgatgaggta

SEQ ID NO: 7028381 - DNA, 22 bp, Homo sapiens
tgcctaggctggagtgtagtgg

SEQ ID NO: 7028382 - DNA, 22 bp, Homo sapiens
ccactggcatccagctgccatc

SEQ ID NO: 7028383 - DNA, 22 bp, Homo sapiens
aggatttagatttggaggaact

SEQ ID NO: 7028384 - DNA, 22 bp, Homo sapiens
ttggcctttaaactggactttc

SEQ ID NO: 7028385 - DNA, 22 bp, Homo sapiens
ttcctgacttgccaggtgtgac

SEQ ID NO: 7028386 - DNA, 22 bp, Homo sapiens
cttgtattcagagtggacatga

SEQ ID NO: 7028387 - DNA, 22 bp, Homo sapiens
tagcatagtttggaaatgcagg

SEQ ID NO: 7028388 - DNA, 22 bp, Homo sapiens
ttgaggtaggcggactcctcca

SEQ ID NO: 7028389 - DNA, 22 bp, Homo sapiens
ctgcagtacaagaagcatctct

SEQ ID NO: 7028390 - DNA, 22 bp, Homo sapiens
tttgagcaagttccattaagct

SEQ ID NO: 7028391 - DNA, 22 bp, Homo sapiens
agctggccggcctccaggtgga

SEQ ID NO: 7028392 - DNA, 22 bp, Homo sapiens
gatgcaggatagcttcacccag

SEQ ID NO: 7028393 - DNA, 19 bp, Homo sapiens
cagactggttaagtagtcc

SEQ ID NO: 7028394 - DNA, 22 bp, Homo sapiens
tcacaggagattatgtgtgcta

SEQ ID NO: 7028395 - DNA, 22 bp, Homo sapiens
agctctttcccctccctatggc

SEQ ID NO: 7028396 - DNA, 22 bp, Homo sapiens
gctgtgcagtagtaggtacagt

SEQ ID NO: 7028397 - DNA, 22 bp, Homo sapiens
tggcctgggcctgccggtgcaa

SEQ ID NO: 7028398 - DNA, 21 bp, Homo sapiens
atcccagcacccaggagtgca

SEQ ID NO: 7028399 - DNA, 22 bp, Homo sapiens
atgccaaagggagcactttggg

SEQ ID NO: 7028400 - DNA, 17 bp, Homo sapiens
tggggtgttgaagggtt

SEQ ID NO: 7028401 - DNA, 22 bp, Homo sapiens
cctcaaagctcaaatgaggctt

SEQ ID NO: 7028402 - DNA, 22 bp, Homo sapiens
acagaaattctgggacagaaaa

SEQ ID NO: 7028403 - DNA, 22 bp, Homo sapiens
aattcattaagaaagagctaaa

SEQ ID NO: 7028404 - DNA, 22 bp, Homo sapiens
ctcttgtggtttataaagatat

SEQ ID NO: 7028405 - DNA, 22 bp, Homo sapiens
aaagttctttttctataaatcc

SEQ ID NO: 7028406 - DNA, 20 bp, Homo sapiens
gcccaggatctctgaggcat

SEQ ID NO: 7028407 - DNA, 22 bp, Homo sapiens
tgtatacatttggtgcatattt

SEQ ID NO: 7028408 - DNA, 22 bp, Homo sapiens
tcagaggaataatgctgcattt

SEQ ID NO: 7028409 - DNA, 22 bp, Homo sapiens
cagagtgtattctgcagttgca

SEQ ID NO: 7028410 - DNA, 20 bp, Homo sapiens
gcacacatagaaatgcatat

SEQ ID NO: 7028411 - DNA, 22 bp, Homo sapiens
ctgttatttagaacatggaatc

SEQ ID NO: 7028412 - DNA, 22 bp, Homo sapiens
agttctaagatgctccacagag

SEQ ID NO: 7028413 - DNA, 22 bp, Homo sapiens
gtttgtcatttgtacttctagc

SEQ ID NO: 7028414 - DNA, 22 bp, Homo sapiens
aatgattgtcattccaaaaagt

SEQ ID NO: 7028415 - DNA, 22 bp, Homo sapiens
gcttcctgggacaggctatgtg

SEQ ID NO: 7028416 - DNA, 22 bp, Homo sapiens
aacaagtgagtcatttaaactc

SEQ ID NO: 7028417 - DNA, 22 bp, Homo sapiens
acaaatgaacatataagcttga

SEQ ID NO: 7028418 - DNA, 23 bp, Homo sapiens
agtctgaattgagatgtgctgtg

SEQ ID NO: 7028419 - DNA, 22 bp, Homo sapiens
tcaaaggcattgccaataagta

SEQ ID NO: 7028420 - DNA, 22 bp, Homo sapiens
tgcctatttacttcacagttga

SEQ ID NO: 7028421 - DNA, 22 bp, Homo sapiens
aaaggccacttgaaggattttt

SEQ ID NO: 7028422 - DNA, 22 bp, Homo sapiens
ctgggaacaggcactgctgtca

SEQ ID NO: 7028423 - DNA, 22 bp, Homo sapiens
gtttgcaaattatgttaaaagt

SEQ ID NO: 7028424 - DNA, 22 bp, Homo sapiens
tatgtacaagcacacatgtgac

SEQ ID NO: 7028425 - DNA, 22 bp, Homo sapiens
tgctgggtcaggcatctgcaga

SEQ ID NO: 7028426 - DNA, 22 bp, Homo sapiens
aagttcaagtctgcatcttttt

SEQ ID NO: 7028427 - DNA, 22 bp, Homo sapiens
gctcttcattctcccaaatagg

SEQ ID NO: 7028428 - DNA, 22 bp, Homo sapiens
gcaagagcaaaccttatctctt

SEQ ID NO: 7028429 - DNA, 20 bp, Homo sapiens
tggtctggagccagtgagga

SEQ ID NO: 7028430 - DNA, 22 bp, Homo sapiens
gagcacattcctcctgtgaatt

SEQ ID NO: 7028431 - DNA, 22 bp, Homo sapiens
aaggaaatacaacatgtattca

SEQ ID NO: 7028432 - DNA, 22 bp, Homo sapiens
ttcctggcaccaccacttctag

SEQ ID NO: 7028433 - DNA, 22 bp, Homo sapiens
agtcaggggatctagacttgaa

SEQ ID NO: 7028434 - DNA, 22 bp, Homo sapiens
tcagatttttgagatgtctgtt

SEQ ID NO: 7028435 - DNA, 22 bp, Homo sapiens
gcagggcacagacagtgccaag

SEQ ID NO: 7028436 - DNA, 19 bp, Homo sapiens
ataagttcaactggaccca

SEQ ID NO: 7028437 - DNA, 22 bp, Homo sapiens
tgtacgctcacgtcctcagtcc

SEQ ID NO: 7028438 - DNA, 22 bp, Homo sapiens
tgccaattgtgtgaatccttaa

SEQ ID NO: 7028439 - DNA, 22 bp, Homo sapiens
ccgggagactttgagcaccatg

SEQ ID NO: 7028440 - DNA, 22 bp, Homo sapiens
ctccttggccgttaatgtcaca

SEQ ID NO: 7028441 - DNA, 22 bp, Homo sapiens
atcaacagtgaagagatcaaga

SEQ ID NO: 7028442 - DNA, 20 bp, Homo sapiens
tccaggaggttagtgtggct

SEQ ID NO: 7028443 - DNA, 22 bp, Homo sapiens
cagccctgagaaggaggatctc

SEQ ID NO: 7028444 - DNA, 22 bp, Homo sapiens
agctgtgtgcatttgggtctca

SEQ ID NO: 7028445 - DNA, 22 bp, Homo sapiens
gttcctgtggggttaaccctga

SEQ ID NO: 7028446 - DNA, 22 bp, Homo sapiens
cagagcagtggggttggtcaga

SEQ ID NO: 7028447 - DNA, 22 bp, Homo sapiens
atttagacacaaaagtgccatg

SEQ ID NO: 7028448 - DNA, 22 bp, Homo sapiens
aaagtgcattcgaaagtccatc

SEQ ID NO: 7028449 - DNA, 22 bp, Homo sapiens
ggctgtatatactgtatacagt

SEQ ID NO: 7028450 - DNA, 22 bp, Homo sapiens
caccctgactggccctgcagga

SEQ ID NO: 7028451 - DNA, 22 bp, Homo sapiens
ctgagacattatgacaagtgga

SEQ ID NO: 7028452 - DNA, 22 bp, Homo sapiens
actttggtgaatcagttttgtt

SEQ ID NO: 7028453 - DNA, 22 bp, Homo sapiens
atgcagggaggtaagaggtgcc

SEQ ID NO: 7028454 - DNA, 22 bp, Homo sapiens
ttattcttcttctcttgccagg

SEQ ID NO: 7028455 - DNA, 22 bp, Homo sapiens
gtgaaaataaggctggttcttg

SEQ ID NO: 7028456 - DNA, 22 bp, Homo sapiens
tcacagactcttgattgtctaa

SEQ ID NO: 7028457 - DNA, 22 bp, Homo sapiens
cctcaggggcttttcgttgttg

SEQ ID NO: 7028458 - DNA, 22 bp, Homo sapiens
tctctaaatctggttcacttgc

SEQ ID NO: 7028459 - DNA, 22 bp, Homo sapiens
agctggagaaacctgggagggt

SEQ ID NO: 7028460 - DNA, 22 bp, Homo sapiens
taggtgcagtggctcatgcctg

SEQ ID NO: 7028461 - DNA, 22 bp, Homo sapiens
gtgctcatcgtggagcctgagg

SEQ ID NO: 7028462 - DNA, 22 bp, Homo sapiens
gagggtgggtacaccagccctc

SEQ ID NO: 7028463 - DNA, 22 bp, Homo sapiens
cctgagatgtgtaacagatggt

SEQ ID NO: 7028464 - DNA, 22 bp, Homo sapiens
agagttccacgtacagcttttg

SEQ ID NO: 7028465 - DNA, 20 bp, Homo sapiens
attgcagttggacctgtctc

SEQ ID NO: 7028466 - DNA, 22 bp, Homo sapiens
cccagctccttgtttgcatctc

SEQ ID NO: 7028467 - DNA, 22 bp, Homo sapiens
gcctccagggtagaggaggaag

SEQ ID NO: 7028468 - DNA, 22 bp, Homo sapiens
tttctacatgtcaatccaaacc

SEQ ID NO: 7028469 - DNA, 22 bp, Homo sapiens
tagtccattttcacactgctga

SEQ ID NO: 7028470 - DNA, 22 bp, Homo sapiens
tcttgggatctcttcaccacct

SEQ ID NO: 7028471 - DNA, 22 bp, Homo sapiens
ctggagtgaggtctgggagcct

SEQ ID NO: 7028472 - DNA, 22 bp, Homo sapiens
gagagctgggttcaagtagctg

SEQ ID NO: 7028473 - DNA, 22 bp, Homo sapiens
ctggcacaatgtcacttttgct

SEQ ID NO: 7028474 - DNA, 19 bp, Homo sapiens
aaggggtgagggaagcaga

SEQ ID NO: 7028475 - DNA, 22 bp, Homo sapiens
gtcttcaggacccggaattttg

SEQ ID NO: 7028476 - DNA, 23 bp, Homo sapiens
agcacctgtgatttcctagctct

SEQ ID NO: 7028477 - DNA, 21 bp, Homo sapiens
aggtttatttcaacttcagga

SEQ ID NO: 7028478 - DNA, 22 bp, Homo sapiens
aaaagattgttagggagaatgt

SEQ ID NO: 7028479 - DNA, 22 bp, Homo sapiens
gttaggaacattaatgtgattt

SEQ ID NO: 7028480 - DNA, 22 bp, Homo sapiens
gcagggttcctctctagcattt

SEQ ID NO: 7028481 - DNA, 22 bp, Homo sapiens
tactctctaggacattttctag

SEQ ID NO: 7028482 - DNA, 22 bp, Homo sapiens
ttgacagatgtgaaagtgagca

SEQ ID NO: 7028483 - DNA, 22 bp, Homo sapiens
ttcctgagcaccagacactgca

SEQ ID NO: 7028484 - DNA, 22 bp, Homo sapiens
ttggaaacttggatggaaaacc

SEQ ID NO: 7028485 - DNA, 22 bp, Homo sapiens
ttcttctcggctgtcagatagt

SEQ ID NO: 7028486 - DNA, 22 bp, Homo sapiens
acatcagagggctcacatgatc

SEQ ID NO: 7028487 - DNA, 22 bp, Homo sapiens
tgtttacagtttttagtaccct

SEQ ID NO: 7028488 - DNA, 22 bp, Homo sapiens
agcatgatgtagaatcactgga

SEQ ID NO: 7028489 - DNA, 22 bp, Homo sapiens
ggtgcaaaagtaattgcggttt

SEQ ID NO: 7028490 - DNA, 18 bp, Homo sapiens
aggcctgcccagcactgt

SEQ ID NO: 7028491 - DNA, 22 bp, Homo sapiens
aagtgtttatttataacgatct

SEQ ID NO: 7028492 - DNA, 22 bp, Homo sapiens
tgccaggatataagagtgcgat

SEQ ID NO: 7028493 - DNA, 22 bp, Homo sapiens
gcctctcctggagaaggcaggg

SEQ ID NO: 7028494 - DNA, 18 bp, Homo sapiens
cacaggctcccagtgagg

SEQ ID NO: 7028495 - DNA, 22 bp, Homo sapiens
ggcatgcatgttgttttaggtg

SEQ ID NO: 7028496 - DNA, 22 bp, Homo sapiens
tggcagagctggctgcggatga

SEQ ID NO: 7028497 - DNA, 22 bp, Homo sapiens
gccagccagtttgctgatggct

SEQ ID NO: 7028498 - DNA, 22 bp, Homo sapiens
tcccacactacacggttgttgg

SEQ ID NO: 7028499 - DNA, 22 bp, Homo sapiens
aatgtcctctttagagggttac

SEQ ID NO: 7028500 - DNA, 22 bp, Homo sapiens
atgtgcttcattctacatgaca

SEQ ID NO: 7028501 - DNA, 22 bp, Homo sapiens
ggagagtcttctgcttggttta

SEQ ID NO: 7028502 - DNA, 22 bp, Homo sapiens
tgaccagtgacccgaggcaagt

SEQ ID NO: 7028503 - DNA, 22 bp, Homo sapiens
attttccaaaataattgttact

SEQ ID NO: 7028504 - DNA, 22 bp, Homo sapiens
cagcaagagactgttctctaag

SEQ ID NO: 7028505 - DNA, 22 bp, Homo sapiens
caagtgggacctgtctgattcc

SEQ ID NO: 7028506 - DNA, 22 bp, Homo sapiens
tatgagcttccagtgttgcatg

SEQ ID NO: 7028507 - DNA, 22 bp, Homo sapiens
tctggatcgccggcgcctgggc

SEQ ID NO: 7028508 - DNA, 17 bp, Homo sapiens
ggcttacaggtgccagc

SEQ ID NO: 7028509 - DNA, 22 bp, Homo sapiens
taagagatgcttttctaaataa

SEQ ID NO: 7028510 - DNA, 22 bp, Homo sapiens
agctgaaagggtgttggagtgt

SEQ ID NO: 7028511 - DNA, 22 bp, Homo sapiens
ggagcagacataaccttacaga

SEQ ID NO: 7028512 - DNA, 22 bp, Homo sapiens
attgcacttcagcctgggtgac

SEQ ID NO: 7028513 - DNA, 22 bp, Homo sapiens
tgggatagattgatggatagag

SEQ ID NO: 7028514 - DNA, 22 bp, Homo sapiens
gagaacctactgtatactatat

SEQ ID NO: 7028515 - DNA, 22 bp, Homo sapiens
cgagatggtatttttaacgcag

SEQ ID NO: 7028516 - DNA, 22 bp, Homo sapiens
ccaggagggaccgcggcatccc

SEQ ID NO: 7028517 - DNA, 15 bp, Homo sapiens
tttaatatggagtta

SEQ ID NO: 7028518 - DNA, 22 bp, Homo sapiens
gcctcctgagaagccacaggct

SEQ ID NO: 7028519 - DNA, 22 bp, Homo sapiens
tcagatcatcagctgctttata

SEQ ID NO: 7028520 - DNA, 22 bp, Homo sapiens
tcagtgtaagtttttggatagg

SEQ ID NO: 7028521 - DNA, 22 bp, Homo sapiens
tcctagaatgcacctctgctgt

SEQ ID NO: 7028522 - DNA, 21 bp, Homo sapiens
cctggctccagaacttccggt

SEQ ID NO: 7028523 - DNA, 22 bp, Homo sapiens
ctgtccagtctttagcaagctg

SEQ ID NO: 7028524 - DNA, 22 bp, Homo sapiens
atgaggccagggtgccatgaaa

SEQ ID NO: 7028525 - DNA, 20 bp, Homo sapiens
ctcacagtcaatgcagaggt

SEQ ID NO: 7028526 - DNA, 22 bp, Homo sapiens
agaaagcttatgaatgggcaag

SEQ ID NO: 7028527 - DNA, 22 bp, Homo sapiens
tgggtgcaggtcttgtgccagg

SEQ ID NO: 7028528 - DNA, 22 bp, Homo sapiens
tggccaattgaattttaattat

SEQ ID NO: 7028529 - DNA, 22 bp, Homo sapiens
gggataggagattgggagtgtt

SEQ ID NO: 7028530 - DNA, 21 bp, Homo sapiens
caacctgagctgaacccgtgc

SEQ ID NO: 7028531 - DNA, 22 bp, Homo sapiens
gaggtaggaggtaggtattgtg

SEQ ID NO: 7028532 - DNA, 18 bp, Homo sapiens
ttcaggtcagaaagatgg

SEQ ID NO: 7028533 - DNA, 22 bp, Homo sapiens
cttacattgtgtgcatgagggg

SEQ ID NO: 7028534 - DNA, 22 bp, Homo sapiens
cttgggctctgtgggccttagt

SEQ ID NO: 7028535 - DNA, 22 bp, Homo sapiens
ttggccctggggccagcttcga

SEQ ID NO: 7028536 - DNA, 22 bp, Homo sapiens
agtctagaaacaaggtagagct

SEQ ID NO: 7028537 - DNA, 22 bp, Homo sapiens
cagagacctgcccatttacgct

SEQ ID NO: 7028538 - DNA, 21 bp, Homo sapiens
tacaagttgcttttgaagtcc

SEQ ID NO: 7028539 - DNA, 22 bp, Homo sapiens
tccaggaaatcataaattgctt

SEQ ID NO: 7028540 - DNA, 22 bp, Homo sapiens
atttcatctctggaacataact

SEQ ID NO: 7028541 - DNA, 22 bp, Homo sapiens
aggtcctgtctatcaccctcgc

SEQ ID NO: 7028542 - DNA, 22 bp, Homo sapiens
aggaaaatcaatgtctttttaa

SEQ ID NO: 7028543 - DNA, 22 bp, Homo sapiens
caactctgtaggatccaggtgg

SEQ ID NO: 7028544 - DNA, 22 bp, Homo sapiens
tagcttctcataatttatgctg

SEQ ID NO: 7028545 - DNA, 22 bp, Homo sapiens
agctctgctactctgtggggtg

SEQ ID NO: 7028546 - DNA, 22 bp, Homo sapiens
tacagtgagactggctcaggga

SEQ ID NO: 7028547 - DNA, 22 bp, Homo sapiens
ggtgtccactcagcccgtcctg

SEQ ID NO: 7028548 - DNA, 22 bp, Homo sapiens
gctttctggtttgtgctacagg

SEQ ID NO: 7028549 - DNA, 22 bp, Homo sapiens
gagtgtccgtgcagccccagac

SEQ ID NO: 7028550 - DNA, 22 bp, Homo sapiens
agcttctagcccatccagcagg

SEQ ID NO: 7028551 - DNA, 22 bp, Homo sapiens
actaaatagttttgacagaaca

SEQ ID NO: 7028552 - DNA, 22 bp, Homo sapiens
tcattgaaaactcagcatctac

SEQ ID NO: 7028553 - DNA, 23 bp, Homo sapiens
tttctgttgggtatatatccaag

SEQ ID NO: 7028554 - DNA, 22 bp, Homo sapiens
cattggtgaagcaaatatttag

SEQ ID NO: 7028555 - DNA, 22 bp, Homo sapiens
agaagccaacagggcaggagag

SEQ ID NO: 7028556 - DNA, 22 bp, Homo sapiens
gagcaccagcagtcccctggca

SEQ ID NO: 7028557 - DNA, 22 bp, Homo sapiens
gttataggtcatgctatgtcaa

SEQ ID NO: 7028558 - DNA, 22 bp, Homo sapiens
cattcatctatcaaatggtacc

SEQ ID NO: 7028559 - DNA, 22 bp, Homo sapiens
gatggctttgtgcaccatgatt

SEQ ID NO: 7028560 - DNA, 22 bp, Homo sapiens
gtggccttattatgtacaaaat

SEQ ID NO: 7028561 - DNA, 22 bp, Homo sapiens
tataaagtgtgaactgtgagta

SEQ ID NO: 7028562 - DNA, 22 bp, Homo sapiens
gttcacaatggctttacctaag

SEQ ID NO: 7028563 - DNA, 22 bp, Homo sapiens
tcctaactaatttgtagcaaaa

SEQ ID NO: 7028564 - DNA, 22 bp, Homo sapiens
agtacaatttaatgaagatagc

SEQ ID NO: 7028565 - DNA, 22 bp, Homo sapiens
gtccttcagcacctccctcggc

SEQ ID NO: 7028566 - DNA, 22 bp, Homo sapiens
agaacacttgctcctgattctc

SEQ ID NO: 7028567 - DNA, 22 bp, Homo sapiens
aggacaattttggcatagttct

SEQ ID NO: 7028568 - DNA, 22 bp, Homo sapiens
tggggaaatgtcctgccttccc

SEQ ID NO: 7028569 - DNA, 20 bp, Homo sapiens
ttttccactcctcaaaacag

SEQ ID NO: 7028570 - DNA, 22 bp, Homo sapiens
gcaggttagatttaatccattc

SEQ ID NO: 7028571 - DNA, 22 bp, Homo sapiens
caccagctgcaacaccatctcc

SEQ ID NO: 7028572 - DNA, 22 bp, Homo sapiens
aaattgtgagctatagatctag

SEQ ID NO: 7028573 - DNA, 22 bp, Homo sapiens
atggcttgcagagaaaagaggt

SEQ ID NO: 7028574 - DNA, 18 bp, Homo sapiens
ctcatgtgtggtcccagc

SEQ ID NO: 7028575 - DNA, 22 bp, Homo sapiens
aaccacaacactaaatgctggt

SEQ ID NO: 7028576 - DNA, 20 bp, Homo sapiens
agcccatctcccacagctac

SEQ ID NO: 7028577 - DNA, 22 bp, Homo sapiens
ctgtctcagcaggaagtcatca

SEQ ID NO: 7028578 - DNA, 22 bp, Homo sapiens
actgtacatgcatcttgtctat

SEQ ID NO: 7028579 - DNA, 22 bp, Homo sapiens
ctggcagtttgccaggagctcg

SEQ ID NO: 7028580 - DNA, 19 bp, Homo sapiens
agtcttgtggctttgtgca

SEQ ID NO: 7028581 - DNA, 22 bp, Homo sapiens
acagacactgcactcccacctt

SEQ ID NO: 7028582 - DNA, 22 bp, Homo sapiens
ctctgagggctcgagggacgcg

SEQ ID NO: 7028583 - DNA, 22 bp, Homo sapiens
gggaataacctgtgcccttcaa

SEQ ID NO: 7028584 - DNA, 22 bp, Homo sapiens
atggaatgtgaacatgatggca

SEQ ID NO: 7028585 - DNA, 22 bp, Homo sapiens
tgctggtcctggagctgggttc

SEQ ID NO: 7028586 - DNA, 22 bp, Homo sapiens
ctgacaggttggtagctttgga

SEQ ID NO: 7028587 - DNA, 22 bp, Homo sapiens
cttctagaaatgtgggtgatag

SEQ ID NO: 7028588 - DNA, 22 bp, Homo sapiens
gcagtactttaagggatgaagc

SEQ ID NO: 7028589 - DNA, 22 bp, Homo sapiens
gtgccaaagaacataaggctga

SEQ ID NO: 7028590 - DNA, 22 bp, Homo sapiens
atcacccaagctggagtgcagt

SEQ ID NO: 7028591 - DNA, 22 bp, Homo sapiens
tatcaaccaactactcgtgttg

SEQ ID NO: 7028592 - DNA, 22 bp, Homo sapiens
aaaaccaggcgtttcctattat

SEQ ID NO: 7028593 - DNA, 22 bp, Homo sapiens
ctcaggaggatgactgccttgg

SEQ ID NO: 7028594 - DNA, 22 bp, Homo sapiens
tatttagaatgcgtgtacgtgt

SEQ ID NO: 7028595 - DNA, 22 bp, Homo sapiens
tctaggttcatgggattcagtg

SEQ ID NO: 7028596 - DNA, 22 bp, Homo sapiens
agtccaggaaaataagctaggt

SEQ ID NO: 7028597 - DNA, 22 bp, Homo sapiens
ggcagctttcacctgtcttcct

SEQ ID NO: 7028598 - DNA, 22 bp, Homo sapiens
atggccttgatagcctaaaaca

SEQ ID NO: 7028599 - DNA, 22 bp, Homo sapiens
tgcccttatgaaagaggcccaa

SEQ ID NO: 7028600 - DNA, 22 bp, Homo sapiens
gacttctccgtcatctccagtg

SEQ ID NO: 7028601 - DNA, 21 bp, Homo sapiens
ataggtaacccagcagacttg

SEQ ID NO: 7028602 - DNA, 22 bp, Homo sapiens
gcatggcctccagccaacagca

SEQ ID NO: 7028603 - DNA, 22 bp, Homo sapiens
atccatacagtggaatattatt

SEQ ID NO: 7028604 - DNA, 22 bp, Homo sapiens
ctgggctgtcccaaccccatcc

SEQ ID NO: 7028605 - DNA, 22 bp, Homo sapiens
tacttctctccgcctcgtgctt

SEQ ID NO: 7028606 - DNA, 22 bp, Homo sapiens
tgactccacaatttgacttata

SEQ ID NO: 7028607 - DNA, 22 bp, Homo sapiens
cctcaaattgctcagcgtctag

SEQ ID NO: 7028608 - DNA, 22 bp, Homo sapiens
cattcattcacattttgtctat

SEQ ID NO: 7028609 - DNA, 22 bp, Homo sapiens
atgttaaaaaccagtacagttg

SEQ ID NO: 7028610 - DNA, 22 bp, Homo sapiens
tattccaattggttgtaaagaa

SEQ ID NO: 7028611 - DNA, 20 bp, Homo sapiens
agaaaatgttttcagctgga

SEQ ID NO: 7028612 - DNA, 22 bp, Homo sapiens
aaagtgcagggtgctctggtat

SEQ ID NO: 7028613 - DNA, 22 bp, Homo sapiens
tgggagcaccttgagggcagaa

SEQ ID NO: 7028614 - DNA, 22 bp, Homo sapiens
aaagtgggaacaatggagagtg

SEQ ID NO: 7028615 - DNA, 22 bp, Homo sapiens
tgttattctagtggatcacgtc

SEQ ID NO: 7028616 - DNA, 22 bp, Homo sapiens
atagtgttttacttagacttct

SEQ ID NO: 7028617 - DNA, 22 bp, Homo sapiens
gtgagcagacatcaaaggctgc

SEQ ID NO: 7028618 - DNA, 18 bp, Homo sapiens
tcacatacttaggccctc

SEQ ID NO: 7028619 - DNA, 22 bp, Homo sapiens
cacagcgtgatgaatgtagcgt

SEQ ID NO: 7028620 - DNA, 22 bp, Homo sapiens
tttgtgccctgcatgtgccttt

SEQ ID NO: 7028621 - DNA, 22 bp, Homo sapiens
aagcagggtttttccaccgcag

SEQ ID NO: 7028622 - DNA, 22 bp, Homo sapiens
ttcccagtcaaacgaaggactt

SEQ ID NO: 7028623 - DNA, 22 bp, Homo sapiens
ccagactgcttgcttcccagcc

SEQ ID NO: 7028624 - DNA, 20 bp, Homo sapiens
tgaagcagccttgattctgt

SEQ ID NO: 7028625 - DNA, 22 bp, Homo sapiens
tgaacacataaaagcaaagggt

SEQ ID NO: 7028626 - DNA, 22 bp, Homo sapiens
tcaaggtgtgttatgtgtaata

SEQ ID NO: 7028627 - DNA, 22 bp, Homo sapiens
attagcaactgtcttgaaaaca

SEQ ID NO: 7028628 - DNA, 22 bp, Homo sapiens
gcccacagtctatcagtttgcg

SEQ ID NO: 7028629 - DNA, 22 bp, Homo sapiens
ggctggctatctgtggttgcct

SEQ ID NO: 7028630 - DNA, 22 bp, Homo sapiens
taagttctgctgacggccagcc

SEQ ID NO: 7028631 - DNA, 22 bp, Homo sapiens
ccctaggctgaggccagggtgc

SEQ ID NO: 7028632 - DNA, 22 bp, Homo sapiens
caggaaatatctcctggcagag

SEQ ID NO: 7028633 - DNA, 22 bp, Homo sapiens
cctcaccttttctctgattgct

SEQ ID NO: 7028634 - DNA, 22 bp, Homo sapiens
ggaggcggagcttgcagtgagc

SEQ ID NO: 7028635 - DNA, 22 bp, Homo sapiens
tccttggcctgggtggggtctc

SEQ ID NO: 7028636 - DNA, 22 bp, Homo sapiens
ggacactacaatctgcctgcat

SEQ ID NO: 7028637 - DNA, 22 bp, Homo sapiens
ctgtgaatgttgaataaatcct

SEQ ID NO: 7028638 - DNA, 22 bp, Homo sapiens
ttctacctaccctctgcataca

SEQ ID NO: 7028639 - DNA, 22 bp, Homo sapiens
cctgagtgcttccagagtcatg

SEQ ID NO: 7028640 - DNA, 22 bp, Homo sapiens
agactttagggccatggtaggt

SEQ ID NO: 7028641 - DNA, 22 bp, Homo sapiens
ctgtgctctggcatcgctgcaa

SEQ ID NO: 7028642 - DNA, 22 bp, Homo sapiens
caggacaatctcgtcgggtcct

SEQ ID NO: 7028643 - DNA, 22 bp, Homo sapiens
acactgagcatctctagaggca

SEQ ID NO: 7028644 - DNA, 22 bp, Homo sapiens
tcagaacatgtttgagtaagac

SEQ ID NO: 7028645 - DNA, 22 bp, Homo sapiens
gctgtatttatatgaaggcatg

SEQ ID NO: 7028646 - DNA, 22 bp, Homo sapiens
tgccctgcccatctaccctgtc

SEQ ID NO: 7028647 - DNA, 22 bp, Homo sapiens
acagaggtggacctcagcaggc

SEQ ID NO: 7028648 - DNA, 22 bp, Homo sapiens
ctcagaaattacaaaagggaca

SEQ ID NO: 7028649 - DNA, 22 bp, Homo sapiens
aaatgcattaagtcagaacaat

SEQ ID NO: 7028650 - DNA, 18 bp, Homo sapiens
gagcttcaggctaacctg

SEQ ID NO: 7028651 - DNA, 22 bp, Homo sapiens
cactgctagtctgaagtactgg

SEQ ID NO: 7028652 - DNA, 22 bp, Homo sapiens
ccaagatttatattgaataata

SEQ ID NO: 7028653 - DNA, 22 bp, Homo sapiens
aatagctttctcatgacttcac

SEQ ID NO: 7028654 - DNA, 22 bp, Homo sapiens
tggacaggatctgagactgaga

SEQ ID NO: 7028655 - DNA, 22 bp, Homo sapiens
catctgagggaaaacatgtagt

SEQ ID NO: 7028656 - DNA, 18 bp, Homo sapiens
aaattgtgtaggagtcca

SEQ ID NO: 7028657 - DNA, 22 bp, Homo sapiens
actgcagctggtggtggctctg

SEQ ID NO: 7028658 - DNA, 22 bp, Homo sapiens
gagtgctggaggtgtgagtggg

SEQ ID NO: 7028659 - DNA, 22 bp, Homo sapiens
agaatgtgggggaaaagagtgt

SEQ ID NO: 7028660 - DNA, 18 bp, Homo sapiens
tgggaaagtttatagaat

SEQ ID NO: 7028661 - DNA, 22 bp, Homo sapiens
gaaggcctctaccatagaaggc

SEQ ID NO: 7028662 - DNA, 22 bp, Homo sapiens
atatagtcacactttgcaggca

SEQ ID NO: 7028663 - DNA, 22 bp, Homo sapiens
ctgctgtctagtatcttaaaaa

SEQ ID NO: 7028664 - DNA, 22 bp, Homo sapiens
ctgggagcttgttaggaatgca

SEQ ID NO: 7028665 - DNA, 22 bp, Homo sapiens
tgtggctgatcaaagcgctcag

SEQ ID NO: 7028666 - DNA, 22 bp, Homo sapiens
gctggctggcgggtgcgtcctc

SEQ ID NO: 7028667 - DNA, 22 bp, Homo sapiens
agacggaatttcatcatgttag

SEQ ID NO: 7028668 - DNA, 22 bp, Homo sapiens
tccatatatattagtcttcctt

SEQ ID NO: 7028669 - DNA, 22 bp, Homo sapiens
tgcagcagtcagtcaggcctgg

SEQ ID NO: 7028670 - DNA, 22 bp, Homo sapiens
gtcctggggatacagaagtgaa

SEQ ID NO: 7028671 - DNA, 22 bp, Homo sapiens
gcttcaaagattcacagtttca

SEQ ID NO: 7028672 - DNA, 22 bp, Homo sapiens
gatgtcctatttccatactgta

SEQ ID NO: 7028673 - DNA, 17 bp, Homo sapiens
atattccaagggcttgg

SEQ ID NO: 7028674 - DNA, 22 bp, Homo sapiens
ggccagggcctggggactgtcc

SEQ ID NO: 7028675 - DNA, 22 bp, Homo sapiens
gcacacagtactatatgctaca

SEQ ID NO: 7028676 - DNA, 22 bp, Homo sapiens
agggagcttctggcctcagcct

SEQ ID NO: 7028677 - DNA, 22 bp, Homo sapiens
tacccagttcagtgtttaaaaa

SEQ ID NO: 7028678 - DNA, 22 bp, Homo sapiens
ccaggaggatgattttaagagg

SEQ ID NO: 7028679 - DNA, 23 bp, Homo sapiens
cctcagcatggcaggagcccagc

SEQ ID NO: 7028680 - DNA, 22 bp, Homo sapiens
cttgtttaagccgctgttaagc

SEQ ID NO: 7028681 - DNA, 20 bp, Homo sapiens
ggaaatcaccaggctccacc

SEQ ID NO: 7028682 - DNA, 22 bp, Homo sapiens
tctgtcttggccagccatctgg

SEQ ID NO: 7028683 - DNA, 22 bp, Homo sapiens
cagtagcttcagttgaggcctg

SEQ ID NO: 7028684 - DNA, 18 bp, Homo sapiens
gagaggcccggctgtgcc

SEQ ID NO: 7028685 - DNA, 22 bp, Homo sapiens
acagttgaggacttaaacaaaa

SEQ ID NO: 7028686 - DNA, 22 bp, Homo sapiens
aaagcaaacagaaccccaagct

SEQ ID NO: 7028687 - DNA, 22 bp, Homo sapiens
aggcttgcacatgcacgcacgt

SEQ ID NO: 7028688 - DNA, 22 bp, Homo sapiens
gggctgctgccaatcacagcct

SEQ ID NO: 7028689 - DNA, 20 bp, Homo sapiens
atggaagctgctcttctcct

SEQ ID NO: 7028690 - DNA, 22 bp, Homo sapiens
gccagacactcccctgggcagg

SEQ ID NO: 7028691 - DNA, 22 bp, Homo sapiens
tagggctgtggtcagtcctcta

SEQ ID NO: 7028692 - DNA, 22 bp, Homo sapiens
acatgcttccaaattatgttgg

SEQ ID NO: 7028693 - DNA, 22 bp, Homo sapiens
gtttccaggctgggcagcgagc

SEQ ID NO: 7028694 - DNA, 22 bp, Homo sapiens
tgcttctccattgatgctaagt

SEQ ID NO: 7028695 - DNA, 22 bp, Homo sapiens
ttcttcagactactgatgattg

SEQ ID NO: 7028696 - DNA, 22 bp, Homo sapiens
tctgatgttgatgcttctgcct

SEQ ID NO: 7028697 - DNA, 18 bp, Homo sapiens
acatttctctctgcgtga

SEQ ID NO: 7028698 - DNA, 22 bp, Homo sapiens
tgagagtctgttcctcttgcag

SEQ ID NO: 7028699 - DNA, 22 bp, Homo sapiens
aaatgcacagagccttagagat

SEQ ID NO: 7028700 - DNA, 18 bp, Homo sapiens
caggctttgattttggag

SEQ ID NO: 7028701 - DNA, 22 bp, Homo sapiens
tctgccactgtgatgcatgata

SEQ ID NO: 7028702 - DNA, 22 bp, Homo sapiens
tgtattgtaagtggttatatgc

SEQ ID NO: 7028703 - DNA, 22 bp, Homo sapiens
tctgtttctccaacattgtgag

SEQ ID NO: 7028704 - DNA, 22 bp, Homo sapiens
taaacagagtgctagttcacgg

SEQ ID NO: 7028705 - DNA, 23 bp, Homo sapiens
cccagctgagacttcctgaactc

SEQ ID NO: 7028706 - DNA, 22 bp, Homo sapiens
tattgcttttatttctatggac

SEQ ID NO: 7028707 - DNA, 22 bp, Homo sapiens
agctttaaagcatatttctaag

SEQ ID NO: 7028708 - DNA, 20 bp, Homo sapiens
agtctgtcaatttacagtgg

SEQ ID NO: 7028709 - DNA, 22 bp, Homo sapiens
ccactgtgtccaccaggaatgc

SEQ ID NO: 7028710 - DNA, 22 bp, Homo sapiens
ttccagatatttttatgtggaa

SEQ ID NO: 7028711 - DNA, 22 bp, Homo sapiens
ctccagggctaccaggttttag

SEQ ID NO: 7028712 - DNA, 22 bp, Homo sapiens
ctgtggctgaactctgaagagg

SEQ ID NO: 7028713 - DNA, 22 bp, Homo sapiens
tctgctcacgtgtattctccat

SEQ ID NO: 7028714 - DNA, 22 bp, Homo sapiens
ctgaggctagtataaagagcat

SEQ ID NO: 7028715 - DNA, 22 bp, Homo sapiens
gtgtcatggaaaattgcaatgg

SEQ ID NO: 7028716 - DNA, 22 bp, Homo sapiens
atgggcaggcaaggtggcgagt

SEQ ID NO: 7028717 - DNA, 22 bp, Homo sapiens
ttttttcctgagccttgtggtc

SEQ ID NO: 7028718 - DNA, 22 bp, Homo sapiens
atatacacatctttttaaatat

SEQ ID NO: 7028719 - DNA, 22 bp, Homo sapiens
cagatctgtggtatctctattt

SEQ ID NO: 7028720 - DNA, 22 bp, Homo sapiens
gagttattttgagcagatggtt

SEQ ID NO: 7028721 - DNA, 22 bp, Homo sapiens
cctgagcttgatccttctgtct

SEQ ID NO: 7028722 - DNA, 22 bp, Homo sapiens
agttcacagccatgttcatgtg

SEQ ID NO: 7028723 - DNA, 22 bp, Homo sapiens
gggtgggaaggctaagggattg

SEQ ID NO: 7028724 - DNA, 22 bp, Homo sapiens
agcatccaggccaggttgggca

SEQ ID NO: 7028725 - DNA, 22 bp, Homo sapiens
tacattaacttacgtccacatg

SEQ ID NO: 7028726 - DNA, 22 bp, Homo sapiens
tcagctgaagtggagaagcaga

SEQ ID NO: 7028727 - DNA, 22 bp, Homo sapiens
cagtccttgctcaaagtctaca

SEQ ID NO: 7028728 - DNA, 22 bp, Homo sapiens
gtgttactgcttttatctacca

SEQ ID NO: 7028729 - DNA, 22 bp, Homo sapiens
ctgagccagctggcatgtgcta

SEQ ID NO: 7028730 - DNA, 22 bp, Homo sapiens
gagggagtctgtgcaaagaatt

SEQ ID NO: 7028731 - DNA, 19 bp, Homo sapiens
ggcagtgagaagactcctg

SEQ ID NO: 7028732 - DNA, 22 bp, Homo sapiens
tccaggcccgagatgggctgga

SEQ ID NO: 7028733 - DNA, 22 bp, Homo sapiens
gataattataggctaagccact

SEQ ID NO: 7028734 - DNA, 22 bp, Homo sapiens
cagtgttgctaagttctgaact

SEQ ID NO: 7028735 - DNA, 22 bp, Homo sapiens
aagacactcattatcactggtt

SEQ ID NO: 7028736 - DNA, 22 bp, Homo sapiens
gggttcaggttggcctgagcac

SEQ ID NO: 7028737 - DNA, 22 bp, Homo sapiens
ctgttgctcccagggagagggt

SEQ ID NO: 7028738 - DNA, 22 bp, Homo sapiens
cctctttgttcaggctgctggc

SEQ ID NO: 7028739 - DNA, 22 bp, Homo sapiens
aagccagatagaagaactcatt

SEQ ID NO: 7028740 - DNA, 22 bp, Homo sapiens
agggctcagggcacgtcatcca

SEQ ID NO: 7028741 - DNA, 22 bp, Homo sapiens
ggccaaggtgttctgatatgcc

SEQ ID NO: 7028742 - DNA, 22 bp, Homo sapiens
attttccttgtgggttagcgaa

SEQ ID NO: 7028743 - DNA, 22 bp, Homo sapiens
cctgtgcatgccagggtacacc

SEQ ID NO: 7028744 - DNA, 22 bp, Homo sapiens
cagcctgccctggaagcccagc

SEQ ID NO: 7028745 - DNA, 22 bp, Homo sapiens
ctgagatggtctctttgttact

SEQ ID NO: 7028746 - DNA, 22 bp, Homo sapiens
atacacttcatgttttcatctg

SEQ ID NO: 7028747 - DNA, 22 bp, Homo sapiens
tgaagccaccgaaccagaagag

SEQ ID NO: 7028748 - DNA, 22 bp, Homo sapiens
tggttacctattcatgaacatt

SEQ ID NO: 7028749 - DNA, 22 bp, Homo sapiens
ataaacagcataaaatacgctt

SEQ ID NO: 7028750 - DNA, 22 bp, Homo sapiens
ctgcagaggttggttctaagat

SEQ ID NO: 7028751 - DNA, 22 bp, Homo sapiens
cacaggtattatcggtgctgca

SEQ ID NO: 7028752 - DNA, 22 bp, Homo sapiens
gaagctgagctgaggcatgttg

SEQ ID NO: 7028753 - DNA, 22 bp, Homo sapiens
agcttgatagtggctatcaagc

SEQ ID NO: 7028754 - DNA, 22 bp, Homo sapiens
gctggctggatggttggttcgc

SEQ ID NO: 7028755 - DNA, 19 bp, Homo sapiens
agacagagctcagtgggtt

SEQ ID NO: 7028756 - DNA, 22 bp, Homo sapiens
ttgtaaagctgattagaaagcc

SEQ ID NO: 7028757 - DNA, 22 bp, Homo sapiens
aagcatttcaatataatattca

SEQ ID NO: 7028758 - DNA, 22 bp, Homo sapiens
tatcagaaatgccttaaattgg

SEQ ID NO: 7028759 - DNA, 22 bp, Homo sapiens
aaagtgactgccagtgctgggc

SEQ ID NO: 7028760 - DNA, 22 bp, Homo sapiens
acatcagattatgctttgctta

SEQ ID NO: 7028761 - DNA, 22 bp, Homo sapiens
aggggctcctctctgagagtag

SEQ ID NO: 7028762 - DNA, 21 bp, Homo sapiens
tggacattatggagagagtag

SEQ ID NO: 7028763 - DNA, 21 bp, Homo sapiens
tctttatgacttgcccatttg

SEQ ID NO: 7028764 - DNA, 22 bp, Homo sapiens
tcatagaaatatcacgtctttt

SEQ ID NO: 7028765 - DNA, 23 bp, Homo sapiens
ttgcacattggagctggtcttct

SEQ ID NO: 7028766 - DNA, 21 bp, Homo sapiens
tggcttctgccaatgttaaga

SEQ ID NO: 7028767 - DNA, 22 bp, Homo sapiens
tcaggcctagaacacagcagat

SEQ ID NO: 7028768 - DNA, 22 bp, Homo sapiens
tccccaccccagaactactagg

SEQ ID NO: 7028769 - DNA, 22 bp, Homo sapiens
ataggccagtgtcctttcttaa

SEQ ID NO: 7028770 - DNA, 22 bp, Homo sapiens
tctagctgacaacccacagcct

SEQ ID NO: 7028771 - DNA, 22 bp, Homo sapiens
gctgtatgagttcatgtgtaga

SEQ ID NO: 7028772 - DNA, 22 bp, Homo sapiens
tagaagatgccttaaagttgaa

SEQ ID NO: 7028773 - DNA, 21 bp, Homo sapiens
tcagttactgagagagaagtg

SEQ ID NO: 7028774 - DNA, 22 bp, Homo sapiens
cccgggaacataaagcagtgag

SEQ ID NO: 7028775 - DNA, 22 bp, Homo sapiens
tctttgcagccccaggaagtgg

SEQ ID NO: 7028776 - DNA, 22 bp, Homo sapiens
ctgaaactacagtaaggagaac

SEQ ID NO: 7028777 - DNA, 22 bp, Homo sapiens
actgctgatttagctttgtggg

SEQ ID NO: 7028778 - DNA, 22 bp, Homo sapiens
ttcagctaatgggaataagagt

SEQ ID NO: 7028779 - DNA, 22 bp, Homo sapiens
tccttggtgctggagctcagac

SEQ ID NO: 7028780 - DNA, 22 bp, Homo sapiens
ttgatttcaacatcatcccttt

SEQ ID NO: 7028781 - DNA, 22 bp, Homo sapiens
ccagaaacagatgacaagccct

SEQ ID NO: 7028782 - DNA, 22 bp, Homo sapiens
tatacagtttgagttcttgcat

SEQ ID NO: 7028783 - DNA, 20 bp, Homo sapiens
atcaggtgttcagccactgc

SEQ ID NO: 7028784 - DNA, 22 bp, Homo sapiens
taggcaccacctagggtgaccc

SEQ ID NO: 7028785 - DNA, 23 bp, Homo sapiens
tggacctgaaccagtgcctctgt

SEQ ID NO: 7028786 - DNA, 22 bp, Homo sapiens
cctgcctgtcatcgcctgcgcc

SEQ ID NO: 7028787 - DNA, 22 bp, Homo sapiens
gccaaaggttggcctgtgagtt

SEQ ID NO: 7028788 - DNA, 22 bp, Homo sapiens
gctctgttgaagtagaatagac

SEQ ID NO: 7028789 - DNA, 22 bp, Homo sapiens
gttattgtccagcacagttggg

SEQ ID NO: 7028790 - DNA, 22 bp, Homo sapiens
gcaataaactctctcaagccac

SEQ ID NO: 7028791 - DNA, 22 bp, Homo sapiens
cagggacagacagatatatttg

SEQ ID NO: 7028792 - DNA, 19 bp, Homo sapiens
tgcccaggccaggttgggc

SEQ ID NO: 7028793 - DNA, 23 bp, Homo sapiens
tgtaacaatttcatatacatgca

SEQ ID NO: 7028794 - DNA, 22 bp, Homo sapiens
attgaagtcctaatctccagta

SEQ ID NO: 7028795 - DNA, 22 bp, Homo sapiens
cagttctggtttgcagatatat

SEQ ID NO: 7028796 - DNA, 22 bp, Homo sapiens
caggctcactgtaaggtcagct

SEQ ID NO: 7028797 - DNA, 22 bp, Homo sapiens
tcaattctagtggagagagttt

SEQ ID NO: 7028798 - DNA, 22 bp, Homo sapiens
atataatttagaaggggaaaca

SEQ ID NO: 7028799 - DNA, 22 bp, Homo sapiens
tgcagcatttgctgaagcagga

SEQ ID NO: 7028800 - DNA, 17 bp, Homo sapiens
gccctcagctttaacca

SEQ ID NO: 7028801 - DNA, 22 bp, Homo sapiens
taaagtcagatatctgggttga

SEQ ID NO: 7028802 - DNA, 22 bp, Homo sapiens
tatctctagcgcacagaagaaa

SEQ ID NO: 7028803 - DNA, 22 bp, Homo sapiens
agaatctttcctcattgctgtc

SEQ ID NO: 7028804 - DNA, 22 bp, Homo sapiens
cttaagatgaggtcatgctata

SEQ ID NO: 7028805 - DNA, 22 bp, Homo sapiens
taacaagatatatgacttggat

SEQ ID NO: 7028806 - DNA, 22 bp, Homo sapiens
tctcacaactagaagggaaaga

SEQ ID NO: 7028807 - DNA, 22 bp, Homo sapiens
aaattgtgcatccttggcatat

SEQ ID NO: 7028808 - DNA, 22 bp, Homo sapiens
atccaggcattctgacttcaag

SEQ ID NO: 7028809 - DNA, 22 bp, Homo sapiens
cagaacatgatataaacagaag

SEQ ID NO: 7028810 - DNA, 23 bp, Homo sapiens
agctgtttcattattacaacacc

SEQ ID NO: 7028811 - DNA, 22 bp, Homo sapiens
agaggccaccactgtcagggac

SEQ ID NO: 7028812 - DNA, 22 bp, Homo sapiens
actaggaacggggtttgcactc

SEQ ID NO: 7028813 - DNA, 22 bp, Homo sapiens
caggccttgtcaagaaaatgcc

SEQ ID NO: 7028814 - DNA, 22 bp, Homo sapiens
agtccttactcgggggcccaga

SEQ ID NO: 7028815 - DNA, 22 bp, Homo sapiens
tgattctgttctccttgagaat

SEQ ID NO: 7028816 - DNA, 22 bp, Homo sapiens
tgcaggaaattccagggtggcc

SEQ ID NO: 7028817 - DNA, 22 bp, Homo sapiens
cggccaagccggggccccgaag

SEQ ID NO: 7028818 - DNA, 22 bp, Homo sapiens
ctcaaaatccataaaatcaggt

SEQ ID NO: 7028819 - DNA, 22 bp, Homo sapiens
cagcctggacagcgaccagagt

SEQ ID NO: 7028820 - DNA, 22 bp, Homo sapiens
acaaatctgttttatagacttt

SEQ ID NO: 7028821 - DNA, 22 bp, Homo sapiens
ttgtggttaaccgcacattttt

SEQ ID NO: 7028822 - DNA, 22 bp, Homo sapiens
tgcccaagcagaggagtgattc

SEQ ID NO: 7028823 - DNA, 22 bp, Homo sapiens
gatactttgtggaatcctggat

SEQ ID NO: 7028824 - DNA, 22 bp, Homo sapiens
tgaggtggctggatctcagcct

SEQ ID NO: 7028825 - DNA, 22 bp, Homo sapiens
gctctctgggtgtgtctagata

SEQ ID NO: 7028826 - DNA, 19 bp, Homo sapiens
ttgaaaatatggatctgag

SEQ ID NO: 7028827 - DNA, 22 bp, Homo sapiens
tactcttttagccccacagaga

SEQ ID NO: 7028828 - DNA, 22 bp, Homo sapiens
tctgttttgcataatgttcttt

SEQ ID NO: 7028829 - DNA, 22 bp, Homo sapiens
tctagcaggcaaaagctcggca

SEQ ID NO: 7028830 - DNA, 22 bp, Homo sapiens
ttccttggtacagagtagcttt

SEQ ID NO: 7028831 - DNA, 22 bp, Homo sapiens
tgggcagttttctatgctgcaa

SEQ ID NO: 7028832 - DNA, 22 bp, Homo sapiens
gactggtttgccaccgacagat

SEQ ID NO: 7028833 - DNA, 22 bp, Homo sapiens
cacagcttcagtttctgacttg

SEQ ID NO: 7028834 - DNA, 22 bp, Homo sapiens
ctctgttgtcagtggaagcagc

SEQ ID NO: 7028835 - DNA, 22 bp, Homo sapiens
ggagaggggaacttgttgcttg

SEQ ID NO: 7028836 - DNA, 22 bp, Homo sapiens
gcactttaaagtttggtggcat

SEQ ID NO: 7028837 - DNA, 22 bp, Homo sapiens
tttaaaaccaaagaaagcctct

SEQ ID NO: 7028838 - DNA, 22 bp, Homo sapiens
ttcaggattctctcccatttac

SEQ ID NO: 7028839 - DNA, 19 bp, Homo sapiens
cctgttcatgactctgtcc

SEQ ID NO: 7028840 - DNA, 22 bp, Homo sapiens
aagaatgaaggatttagctgtt

SEQ ID NO: 7028841 - DNA, 17 bp, Homo sapiens
ggctgcagtccaggagg

SEQ ID NO: 7028842 - DNA, 19 bp, Homo sapiens
gtatatggcttctacctac

SEQ ID NO: 7028843 - DNA, 22 bp, Homo sapiens
tgtagacaggatctagttaaaa

SEQ ID NO: 7028844 - DNA, 22 bp, Homo sapiens
catttctcataatattagcact

SEQ ID NO: 7028845 - DNA, 20 bp, Homo sapiens
ggatcagatggagcctctgc

SEQ ID NO: 7028846 - DNA, 22 bp, Homo sapiens
gctcactgcaacctctgcttcc

SEQ ID NO: 7028847 - DNA, 23 bp, Homo sapiens
agatgtcttagaaactgaagctg

SEQ ID NO: 7028848 - DNA, 22 bp, Homo sapiens
agagaatcctctacatgttttt

SEQ ID NO: 7028849 - DNA, 21 bp, Homo sapiens
aggcccagctttcctcttgct

SEQ ID NO: 7028850 - DNA, 22 bp, Homo sapiens
tgtgtaaaatctgattaatact

SEQ ID NO: 7028851 - DNA, 22 bp, Homo sapiens
aattttaagcatatgactggtt

SEQ ID NO: 7028852 - DNA, 23 bp, Homo sapiens
tctcaaatatgatctgggtcatc

SEQ ID NO: 7028853 - DNA, 22 bp, Homo sapiens
tggctgagttcctggcacacgg

SEQ ID NO: 7028854 - DNA, 22 bp, Homo sapiens
ttgaggattcatgtcagaattc

SEQ ID NO: 7028855 - DNA, 22 bp, Homo sapiens
tggcaggtggctctggcattct

SEQ ID NO: 7028856 - DNA, 22 bp, Homo sapiens
actgaagacctcctgtcagcgg

SEQ ID NO: 7028857 - DNA, 22 bp, Homo sapiens
gggcttctccctaaggactctg

SEQ ID NO: 7028858 - DNA, 20 bp, Homo sapiens
aggtgcaaggcatggcatgt

SEQ ID NO: 7028859 - DNA, 20 bp, Homo sapiens
gctctgaaccaagagctgtc

SEQ ID NO: 7028860 - DNA, 22 bp, Homo sapiens
taacctcaatttaattatctgt

SEQ ID NO: 7028861 - DNA, 22 bp, Homo sapiens
ggtgggatcaaagagtcattcg

SEQ ID NO: 7028862 - DNA, 22 bp, Homo sapiens
caatgtttttccttccttaata

SEQ ID NO: 7028863 - DNA, 22 bp, Homo sapiens
gtgattcttcctgctggcatac

SEQ ID NO: 7028864 - DNA, 22 bp, Homo sapiens
gagtccaagctagagccactca

SEQ ID NO: 7028865 - DNA, 22 bp, Homo sapiens
ttgtggctcttgaggctctcgt

SEQ ID NO: 7028866 - DNA, 20 bp, Homo sapiens
acagatatttgattttcagt

SEQ ID NO: 7028867 - DNA, 22 bp, Homo sapiens
taacaatttgcttcatttgttt

SEQ ID NO: 7028868 - DNA, 22 bp, Homo sapiens
aaaaatgcttggacttaataaa

SEQ ID NO: 7028869 - DNA, 22 bp, Homo sapiens
ttattcagattggctacaggat

SEQ ID NO: 7028870 - DNA, 21 bp, Homo sapiens
agggctcaaatgtgcttgctg

SEQ ID NO: 7028871 - DNA, 22 bp, Homo sapiens
gtggacagcttctaggtgccag

SEQ ID NO: 7028872 - DNA, 22 bp, Homo sapiens
ctccaagaggctataaaggcag

SEQ ID NO: 7028873 - DNA, 22 bp, Homo sapiens
ggtgaacagttgtttcaaatat

SEQ ID NO: 7028874 - DNA, 22 bp, Homo sapiens
agcatgtgtaatctcaatacct

SEQ ID NO: 7028875 - DNA, 22 bp, Homo sapiens
atggttttatttctctatagct

SEQ ID NO: 7028876 - DNA, 22 bp, Homo sapiens
cagctcttcctagccatgccac

SEQ ID NO: 7028877 - DNA, 22 bp, Homo sapiens
ggtctggcctggcattctatgg

SEQ ID NO: 7028878 - DNA, 22 bp, Homo sapiens
aacctggagcaccctcatatct

SEQ ID NO: 7028879 - DNA, 22 bp, Homo sapiens
tgtggacaagatgccaattgat

SEQ ID NO: 7028880 - DNA, 22 bp, Homo sapiens
tctcttaaaagattttaatgac

SEQ ID NO: 7028881 - DNA, 22 bp, Homo sapiens
atccccttgtgggctggcagca

SEQ ID NO: 7028882 - DNA, 22 bp, Homo sapiens
gtttcaatttgaatgcgaggct

SEQ ID NO: 7028883 - DNA, 22 bp, Homo sapiens
acagagacacggaagctaaaga

SEQ ID NO: 7028884 - DNA, 22 bp, Homo sapiens
gggcctgccaggctttcagcat

SEQ ID NO: 7028885 - DNA, 22 bp, Homo sapiens
ccaagtgagttgcgtaaatgga

SEQ ID NO: 7028886 - DNA, 22 bp, Homo sapiens
tgcaatattttatatccaacaa

SEQ ID NO: 7028887 - DNA, 20 bp, Homo sapiens
cagcctgcatcatctgcagc

SEQ ID NO: 7028888 - DNA, 17 bp, Homo sapiens
ctgcagctggagggcca

SEQ ID NO: 7028889 - DNA, 22 bp, Homo sapiens
agggtctctgggagtagggcac

SEQ ID NO: 7028890 - DNA, 22 bp, Homo sapiens
ccgagagcaggtggccgctggt

SEQ ID NO: 7028891 - DNA, 22 bp, Homo sapiens
atctgagtgttggatttattgt

SEQ ID NO: 7028892 - DNA, 22 bp, Homo sapiens
aatctgttttaaagtttgtgcc

SEQ ID NO: 7028893 - DNA, 22 bp, Homo sapiens
gaggcagaggaaggtggtctct

SEQ ID NO: 7028894 - DNA, 22 bp, Homo sapiens
ctggcagggctggtattcaaaa

SEQ ID NO: 7028895 - DNA, 22 bp, Homo sapiens
acattaaatttcatagtgatta

SEQ ID NO: 7028896 - DNA, 22 bp, Homo sapiens
gtccttggcttgaggcacctca

SEQ ID NO: 7028897 - DNA, 22 bp, Homo sapiens
ccaggaggcggaggttgcagcg

SEQ ID NO: 7028898 - DNA, 22 bp, Homo sapiens
tcaactggttcttgaatgtata

SEQ ID NO: 7028899 - DNA, 22 bp, Homo sapiens
tgtgtacatatctatcctagat

SEQ ID NO: 7028900 - DNA, 22 bp, Homo sapiens
ttcactgtgatggtgcagaggc

SEQ ID NO: 7028901 - DNA, 20 bp, Homo sapiens
cagccctccagtggaggcag

SEQ ID NO: 7028902 - DNA, 22 bp, Homo sapiens
tgtgtcactgttcctccagcta

SEQ ID NO: 7028903 - DNA, 22 bp, Homo sapiens
ctacacagttctgcctaatggc

SEQ ID NO: 7028904 - DNA, 22 bp, Homo sapiens
tggttccagttttcaatagagc

SEQ ID NO: 7028905 - DNA, 22 bp, Homo sapiens
tgctgggtgttccgcacttgac

SEQ ID NO: 7028906 - DNA, 22 bp, Homo sapiens
cccttcctcccaggcttctgtg

SEQ ID NO: 7028907 - DNA, 22 bp, Homo sapiens
cacttaactgtgtgccaagtac

SEQ ID NO: 7028908 - DNA, 22 bp, Homo sapiens
tgcgggtcatcagggagaacgt

SEQ ID NO: 7028909 - DNA, 22 bp, Homo sapiens
aggaactagtgcaacaggagcg

SEQ ID NO: 7028910 - DNA, 22 bp, Homo sapiens
catcatcaaaagtgacagagaa

SEQ ID NO: 7028911 - DNA, 22 bp, Homo sapiens
gacacaaagtttgtcagaaatt

SEQ ID NO: 7028912 - DNA, 20 bp, Homo sapiens
tagcagcagaaagaacttag

SEQ ID NO: 7028913 - DNA, 22 bp, Homo sapiens
acttctgaagcagagatttggg

SEQ ID NO: 7028914 - DNA, 21 bp, Homo sapiens
cgggaaggaggttctgaccct

SEQ ID NO: 7028915 - DNA, 22 bp, Homo sapiens
ggcagccatactcagacctggg

SEQ ID NO: 7028916 - DNA, 22 bp, Homo sapiens
aatctttctagattccagcggt

SEQ ID NO: 7028917 - DNA, 22 bp, Homo sapiens
acgtgcgtgtgcgcacacatac

SEQ ID NO: 7028918 - DNA, 22 bp, Homo sapiens
caggtctgcaggctggagtcca

SEQ ID NO: 7028919 - DNA, 21 bp, Homo sapiens
tgcaagaatcaggaagctgcc

SEQ ID NO: 7028920 - DNA, 22 bp, Homo sapiens
aggtttattatagaggatgacg

SEQ ID NO: 7028921 - DNA, 22 bp, Homo sapiens
ggtgcaggaaaattacctggag

SEQ ID NO: 7028922 - DNA, 17 bp, Homo sapiens
ttggcctcttgacattt

SEQ ID NO: 7028923 - DNA, 22 bp, Homo sapiens
ccaggcctggccaggggatgcc

SEQ ID NO: 7028924 - DNA, 20 bp, Homo sapiens
agaggcttccttgggaggag

SEQ ID NO: 7028925 - DNA, 22 bp, Homo sapiens
tcccagccaggctctaccactt

SEQ ID NO: 7028926 - DNA, 22 bp, Homo sapiens
catgcatcgatgaatgcgtggg

SEQ ID NO: 7028927 - DNA, 17 bp, Homo sapiens
tgctcaaatacttttga

SEQ ID NO: 7028928 - DNA, 22 bp, Homo sapiens
ggaatgttttccagacctagat

SEQ ID NO: 7028929 - DNA, 22 bp, Homo sapiens
cattagaagaacagttatatta

SEQ ID NO: 7028930 - DNA, 22 bp, Homo sapiens
ttccagaattgggagccttgag

SEQ ID NO: 7028931 - DNA, 18 bp, Homo sapiens
ggctccgacgggccgtgc

SEQ ID NO: 7028932 - DNA, 22 bp, Homo sapiens
tcccagcagtcagagctatgtg

SEQ ID NO: 7028933 - DNA, 22 bp, Homo sapiens
ctgtgtctcgttaaagcattgg

SEQ ID NO: 7028934 - DNA, 22 bp, Homo sapiens
cagctgaaagaaggaagtgtca

SEQ ID NO: 7028935 - DNA, 22 bp, Homo sapiens
ctctgccaggcagaacggcttt

SEQ ID NO: 7028936 - DNA, 22 bp, Homo sapiens
atctgcagaggacaggcgagga

SEQ ID NO: 7028937 - DNA, 22 bp, Homo sapiens
ggctgccttgggggttgtcatt

SEQ ID NO: 7028938 - DNA, 22 bp, Homo sapiens
ttaaagccatctagattttgag

SEQ ID NO: 7028939 - DNA, 22 bp, Homo sapiens
tcttcatatataaagtggaata

SEQ ID NO: 7028940 - DNA, 22 bp, Homo sapiens
agagcagaggcatggccgtggg

SEQ ID NO: 7028941 - DNA, 22 bp, Homo sapiens
tgagcagcaactgtccatggca

SEQ ID NO: 7028942 - DNA, 22 bp, Homo sapiens
cttgtgcatttcattcctcagg

SEQ ID NO: 7028943 - DNA, 22 bp, Homo sapiens
tctgagcctatttcaaattcct

SEQ ID NO: 7028944 - DNA, 22 bp, Homo sapiens
tttgatgagtttaataacagcc

SEQ ID NO: 7028945 - DNA, 22 bp, Homo sapiens
attcacttattctcaaagtcct

SEQ ID NO: 7028946 - DNA, 22 bp, Homo sapiens
gcctcctgaagtgctgggatta

SEQ ID NO: 7028947 - DNA, 22 bp, Homo sapiens
cccacaggtgtgagcttgctgg

SEQ ID NO: 7028948 - DNA, 22 bp, Homo sapiens
ggctgagagtttcctctggggc

SEQ ID NO: 7028949 - DNA, 22 bp, Homo sapiens
cccagcagtaaccagtggaaat

SEQ ID NO: 7028950 - DNA, 19 bp, Homo sapiens
gggacctgactaattggca

SEQ ID NO: 7028951 - DNA, 22 bp, Homo sapiens
tacagctttgggaaggccccat

SEQ ID NO: 7028952 - DNA, 22 bp, Homo sapiens
atggctttcagatggtgaaaga

SEQ ID NO: 7028953 - DNA, 22 bp, Homo sapiens
tatgctgtggaaaatacaaaga

SEQ ID NO: 7028954 - DNA, 22 bp, Homo sapiens
acgtggagccacagatggagca

SEQ ID NO: 7028955 - DNA, 22 bp, Homo sapiens
atttccagtgactctcacaggt

SEQ ID NO: 7028956 - DNA, 22 bp, Homo sapiens
agacatatggtgaaacatttta

SEQ ID NO: 7028957 - DNA, 22 bp, Homo sapiens
aatcttggaggtgacattccat

SEQ ID NO: 7028958 - DNA, 22 bp, Homo sapiens
tcctggctaatgctgctgatgg

SEQ ID NO: 7028959 - DNA, 22 bp, Homo sapiens
ttcactgccaactaacatggaa

SEQ ID NO: 7028960 - DNA, 22 bp, Homo sapiens
tttaaggcaatatagaattcat

SEQ ID NO: 7028961 - DNA, 22 bp, Homo sapiens
aaaaggctaatccagagcaact

SEQ ID NO: 7028962 - DNA, 22 bp, Homo sapiens
agagagggcatagaaaaaggga

SEQ ID NO: 7028963 - DNA, 22 bp, Homo sapiens
ctgtcttttactatcatttact

SEQ ID NO: 7028964 - DNA, 22 bp, Homo sapiens
acagtttatggtgttttatata

SEQ ID NO: 7028965 - DNA, 22 bp, Homo sapiens
tctcaaatatttggagagagga

SEQ ID NO: 7028966 - DNA, 22 bp, Homo sapiens
gtgcatattttgcacacagatg

SEQ ID NO: 7028967 - DNA, 22 bp, Homo sapiens
agtgatttggttcatacttcca

SEQ ID NO: 7028968 - DNA, 22 bp, Homo sapiens
tctaaactgctagctgactgag

SEQ ID NO: 7028969 - DNA, 22 bp, Homo sapiens
gttccacaaaatgtacccagtt

SEQ ID NO: 7028970 - DNA, 22 bp, Homo sapiens
cttcaagaagacagcagagcat

SEQ ID NO: 7028971 - DNA, 22 bp, Homo sapiens
tcctttgataaccaattttaag

SEQ ID NO: 7028972 - DNA, 22 bp, Homo sapiens
ttgtgtaaaacctgtgatcttt

SEQ ID NO: 7028973 - DNA, 22 bp, Homo sapiens
tccaggcctgcctggtgtttgc

SEQ ID NO: 7028974 - DNA, 22 bp, Homo sapiens
attgtacaaaaaagtagacctt

SEQ ID NO: 7028975 - DNA, 22 bp, Homo sapiens
tgcacctgcaatacctgtacct

SEQ ID NO: 7028976 - DNA, 22 bp, Homo sapiens
gcacagctcgagctcaggaggg

SEQ ID NO: 7028977 - DNA, 22 bp, Homo sapiens
ccagctcagggtcacatggcac

SEQ ID NO: 7028978 - DNA, 21 bp, Homo sapiens
atttacaaaacagtcccttcc

SEQ ID NO: 7028979 - DNA, 22 bp, Homo sapiens
catgaaacatcagagatttctc

SEQ ID NO: 7028980 - DNA, 22 bp, Homo sapiens
ggctttagtgtaggtttctgtt

SEQ ID NO: 7028981 - DNA, 22 bp, Homo sapiens
cacacagtagtatgaggcaaaa

SEQ ID NO: 7028982 - DNA, 22 bp, Homo sapiens
tgcagaaataaagatattatca

SEQ ID NO: 7028983 - DNA, 22 bp, Homo sapiens
ggtctttctactgcacttggct

SEQ ID NO: 7028984 - DNA, 22 bp, Homo sapiens
acagacagaggctccatgagga

SEQ ID NO: 7028985 - DNA, 23 bp, Homo sapiens
tgagctggtattgtccatctcca

SEQ ID NO: 7028986 - DNA, 22 bp, Homo sapiens
cagccaattctagcttgtgaat

SEQ ID NO: 7028987 - DNA, 22 bp, Homo sapiens
tattcctgggccccattccaga

SEQ ID NO: 7028988 - DNA, 22 bp, Homo sapiens
tcatggtatatttcactcttta

SEQ ID NO: 7028989 - DNA, 22 bp, Homo sapiens
aagtaaggccttcttgagcatg

SEQ ID NO: 7028990 - DNA, 22 bp, Homo sapiens
agcaccatttctctaaagcact

SEQ ID NO: 7028991 - DNA, 22 bp, Homo sapiens
tatatcagagttaaaagaatgt

SEQ ID NO: 7028992 - DNA, 22 bp, Homo sapiens
aattcccactatatgccaagca

SEQ ID NO: 7028993 - DNA, 22 bp, Homo sapiens
ggcttggaccagtcacagtggt

SEQ ID NO: 7028994 - DNA, 22 bp, Homo sapiens
gtacactccccctgtgaagttg

SEQ ID NO: 7028995 - DNA, 22 bp, Homo sapiens
tgcatcttggaagattgcacaa

SEQ ID NO: 7028996 - DNA, 21 bp, Homo sapiens
gtttgtaaggcactgtgttct

SEQ ID NO: 7028997 - DNA, 22 bp, Homo sapiens
agaatacaccacaggccgaaat

SEQ ID NO: 7028998 - DNA, 22 bp, Homo sapiens
ctgggactcagaccagttctgt

SEQ ID NO: 7028999 - DNA, 22 bp, Homo sapiens
ccaaatattaacaaagtaattt

SEQ ID NO: 7029000 - DNA, 22 bp, Homo sapiens
cctctgtgtcttggtttcaaga

SEQ ID NO: 7029001 - DNA, 22 bp, Homo sapiens
acagtgaataagacatgtgctt

SEQ ID NO: 7029002 - DNA, 22 bp, Homo sapiens
tcctgggcttcacagactctgt

SEQ ID NO: 7029003 - DNA, 22 bp, Homo sapiens
aaagctggcttttacaggggct

SEQ ID NO: 7029004 - DNA, 22 bp, Homo sapiens
cctcgggctgaggctcccaggc

SEQ ID NO: 7029005 - DNA, 22 bp, Homo sapiens
aaaggtcttctcaaacatccca

SEQ ID NO: 7029006 - DNA, 22 bp, Homo sapiens
attcttcagaatatctggcact

SEQ ID NO: 7029007 - DNA, 22 bp, Homo sapiens
ccctgcaggctcagactggagt

SEQ ID NO: 7029008 - DNA, 22 bp, Homo sapiens
cactgcaagctccgcctcctgg

SEQ ID NO: 7029009 - DNA, 22 bp, Homo sapiens
agctgctccaatttttaccatt

SEQ ID NO: 7029010 - DNA, 23 bp, Homo sapiens
agtcagagcagaagggctgcttg

SEQ ID NO: 7029011 - DNA, 21 bp, Homo sapiens
tagcatctctactgtcataga

SEQ ID NO: 7029012 - DNA, 22 bp, Homo sapiens
attgtaacagacacatcagatt

SEQ ID NO: 7029013 - DNA, 22 bp, Homo sapiens
tccaggaggtatgagtggcccc

SEQ ID NO: 7029014 - DNA, 22 bp, Homo sapiens
cctgcaggtaaggctaactgcc

SEQ ID NO: 7029015 - DNA, 22 bp, Homo sapiens
tcctggaagtgcttggtgaggg

SEQ ID NO: 7029016 - DNA, 22 bp, Homo sapiens
tgtcttcgctacaatgaaaagg

SEQ ID NO: 7029017 - DNA, 22 bp, Homo sapiens
gttaacacaggactctctgcct

SEQ ID NO: 7029018 - DNA, 22 bp, Homo sapiens
tcagcccagttaagaacctgtt

SEQ ID NO: 7029019 - DNA, 22 bp, Homo sapiens
tgcctgctagatatccaggtga

SEQ ID NO: 7029020 - DNA, 22 bp, Homo sapiens
tgcaaatagcctatatttatag

SEQ ID NO: 7029021 - DNA, 22 bp, Homo sapiens
aaggtttattaaaagttgatgg

SEQ ID NO: 7029022 - DNA, 22 bp, Homo sapiens
cacaaatgactgaaacgactgt

SEQ ID NO: 7029023 - DNA, 22 bp, Homo sapiens
ctgcttcacgttgtgccttgtt

SEQ ID NO: 7029024 - DNA, 22 bp, Homo sapiens
tccgttgagtcagcttcggacc

SEQ ID NO: 7029025 - DNA, 22 bp, Homo sapiens
ctttggaataaaattagttgtt

SEQ ID NO: 7029026 - DNA, 22 bp, Homo sapiens
ttaaatcaggcatcatttcagt

SEQ ID NO: 7029027 - DNA, 22 bp, Homo sapiens
tgtcataagtgtttgcacccag

SEQ ID NO: 7029028 - DNA, 22 bp, Homo sapiens
acaagagccctttcagattgac

SEQ ID NO: 7029029 - DNA, 22 bp, Homo sapiens
gccaaatacagtagtcattgcc

SEQ ID NO: 7029030 - DNA, 21 bp, Homo sapiens
gctctggcctactgttccctc

SEQ ID NO: 7029031 - DNA, 22 bp, Homo sapiens
accctgaaagcatcctcctgtc

SEQ ID NO: 7029032 - DNA, 19 bp, Homo sapiens
ggcatccagaactaccagt

SEQ ID NO: 7029033 - DNA, 22 bp, Homo sapiens
actgcatctgaaacatgggtca

SEQ ID NO: 7029034 - DNA, 22 bp, Homo sapiens
tgtgagcaagtgactggtgaga

SEQ ID NO: 7029035 - DNA, 22 bp, Homo sapiens
gctgggagccctggtctgctcc

SEQ ID NO: 7029036 - DNA, 22 bp, Homo sapiens
tgtaccgccttgtggggttggg

SEQ ID NO: 7029037 - DNA, 22 bp, Homo sapiens
ttaggcaatttgatttttcaag

SEQ ID NO: 7029038 - DNA, 22 bp, Homo sapiens
gtggtgtttttggggcagagga

SEQ ID NO: 7029039 - DNA, 22 bp, Homo sapiens
tgggcacctagcaacccttctc

SEQ ID NO: 7029040 - DNA, 23 bp, Homo sapiens
aggatttaaaggcaatgcatttt

SEQ ID NO: 7029041 - DNA, 22 bp, Homo sapiens
gttctcatatggcagagagagt

SEQ ID NO: 7029042 - DNA, 22 bp, Homo sapiens
agccacagcaacaagtgcaatt

SEQ ID NO: 7029043 - DNA, 22 bp, Homo sapiens
cgcaggaagacaagggtggaaa

SEQ ID NO: 7029044 - DNA, 20 bp, Homo sapiens
tgacttcttcatgctgtact

SEQ ID NO: 7029045 - DNA, 23 bp, Homo sapiens
ttgaatagggtggcaacaaactg

SEQ ID NO: 7029046 - DNA, 22 bp, Homo sapiens
agccagctaccggggctcctgg

SEQ ID NO: 7029047 - DNA, 20 bp, Homo sapiens
tggtggagagaagctatttg

SEQ ID NO: 7029048 - DNA, 22 bp, Homo sapiens
gcagcttgtcagacctttactg

SEQ ID NO: 7029049 - DNA, 22 bp, Homo sapiens
ccactcagaccaacgacccttc

SEQ ID NO: 7029050 - DNA, 22 bp, Homo sapiens
ccaggcagagggatccccatcc

SEQ ID NO: 7029051 - DNA, 22 bp, Homo sapiens
ggtcctctcccaagagcgcatc

SEQ ID NO: 7029052 - DNA, 22 bp, Homo sapiens
agcattccagtgcacagtagaa

SEQ ID NO: 7029053 - DNA, 22 bp, Homo sapiens
tgctgcagtgtttgctgaagtt

SEQ ID NO: 7029054 - DNA, 22 bp, Homo sapiens
aaatttaagaagtgtgtgcgtg

SEQ ID NO: 7029055 - DNA, 20 bp, Homo sapiens
tcacttattctcaacttgtg

SEQ ID NO: 7029056 - DNA, 22 bp, Homo sapiens
tgaatgttgatatgagtacaga

SEQ ID NO: 7029057 - DNA, 22 bp, Homo sapiens
agtcttagagtctgtgtcatga

SEQ ID NO: 7029058 - DNA, 22 bp, Homo sapiens
ggcagatggaagaggctgggtc

SEQ ID NO: 7029059 - DNA, 22 bp, Homo sapiens
ataaggcttaaaccttgttgcc

SEQ ID NO: 7029060 - DNA, 22 bp, Homo sapiens
aaagatgttttataagttatgg

SEQ ID NO: 7029061 - DNA, 22 bp, Homo sapiens
acagctctgagatattactatt

SEQ ID NO: 7029062 - DNA, 22 bp, Homo sapiens
cctccaggccttgcaggttaac

SEQ ID NO: 7029063 - DNA, 22 bp, Homo sapiens
tttagaggtctgtttcacatca

SEQ ID NO: 7029064 - DNA, 22 bp, Homo sapiens
agggccagagtggcaaaagcct

SEQ ID NO: 7029065 - DNA, 22 bp, Homo sapiens
attagatgtgtttaagtagaga

SEQ ID NO: 7029066 - DNA, 22 bp, Homo sapiens
tcagcacttactagtggccttt

SEQ ID NO: 7029067 - DNA, 22 bp, Homo sapiens
tgtcagtgagttagttgcaagt

SEQ ID NO: 7029068 - DNA, 22 bp, Homo sapiens
tagaaagacatgggccagcagc

SEQ ID NO: 7029069 - DNA, 22 bp, Homo sapiens
tacaaattaatgggcatgttta

SEQ ID NO: 7029070 - DNA, 22 bp, Homo sapiens
atcagatatttaagttatcaac

SEQ ID NO: 7029071 - DNA, 22 bp, Homo sapiens
tattagctgtgtaactctggtt

SEQ ID NO: 7029072 - DNA, 23 bp, Homo sapiens
tcatgagtggctgcggggctgag

SEQ ID NO: 7029073 - DNA, 22 bp, Homo sapiens
ggcctgtccagcctgcctggct

SEQ ID NO: 7029074 - DNA, 22 bp, Homo sapiens
gctgcatggagggtgcccagga

SEQ ID NO: 7029075 - DNA, 21 bp, Homo sapiens
actgtcatttgcttagggagg

SEQ ID NO: 7029076 - DNA, 22 bp, Homo sapiens
tgtctctcctgatgatctggtg

SEQ ID NO: 7029077 - DNA, 22 bp, Homo sapiens
acatcatcgtgcacatacataa

SEQ ID NO: 7029078 - DNA, 22 bp, Homo sapiens
gtgggtgtgataagaccaaggg

SEQ ID NO: 7029079 - DNA, 22 bp, Homo sapiens
aatagagtattttagcatctta

SEQ ID NO: 7029080 - DNA, 22 bp, Homo sapiens
aagccaaagtgggcatgcctca

SEQ ID NO: 7029081 - DNA, 22 bp, Homo sapiens
gggtacaaagatttcataagat

SEQ ID NO: 7029082 - DNA, 22 bp, Homo sapiens
tggcagtcttcatcagttctgg

SEQ ID NO: 7029083 - DNA, 22 bp, Homo sapiens
gccgatgaaaagaccaaagact

SEQ ID NO: 7029084 - DNA, 22 bp, Homo sapiens
acattgttgtgcaattatagtt

SEQ ID NO: 7029085 - DNA, 22 bp, Homo sapiens
tgaatcatggataaatagctta

SEQ ID NO: 7029086 - DNA, 22 bp, Homo sapiens
gtggacacaggagagagaactg

SEQ ID NO: 7029087 - DNA, 22 bp, Homo sapiens
gggagtgttgagcgccctgcca

SEQ ID NO: 7029088 - DNA, 18 bp, Homo sapiens
ggctgcttaaggagatcc

SEQ ID NO: 7029089 - DNA, 22 bp, Homo sapiens
agtgtttcccagtaggatgaaa

SEQ ID NO: 7029090 - DNA, 23 bp, Homo sapiens
tcactgatgttacagcagccagt

SEQ ID NO: 7029091 - DNA, 22 bp, Homo sapiens
actgttttgtgccttagtttcc

SEQ ID NO: 7029092 - DNA, 22 bp, Homo sapiens
ccagagggcttggtttgggcca

SEQ ID NO: 7029093 - DNA, 22 bp, Homo sapiens
acatttctggagtttctcaaca

SEQ ID NO: 7029094 - DNA, 22 bp, Homo sapiens
caggtcccgttccccagagatt

SEQ ID NO: 7029095 - DNA, 22 bp, Homo sapiens
agtgtctgcgggcagaggagcg

SEQ ID NO: 7029096 - DNA, 19 bp, Homo sapiens
tcagtaacttttaagagga

SEQ ID NO: 7029097 - DNA, 22 bp, Homo sapiens
tgcagcacatgtctggggctgg

SEQ ID NO: 7029098 - DNA, 22 bp, Homo sapiens
aggagctggaatggtccttttg

SEQ ID NO: 7029099 - DNA, 22 bp, Homo sapiens
cagctttgacctaaagtaggaa

SEQ ID NO: 7029100 - DNA, 22 bp, Homo sapiens
tcacaatgcaagtgttcagtgg

SEQ ID NO: 7029101 - DNA, 22 bp, Homo sapiens
catctttggagaaacttccgtt

SEQ ID NO: 7029102 - DNA, 22 bp, Homo sapiens
accctgaagaaacttctaagtg

SEQ ID NO: 7029103 - DNA, 22 bp, Homo sapiens
gtgagcagggcaggactgggga

SEQ ID NO: 7029104 - DNA, 22 bp, Homo sapiens
ataatagctaacacagagtgct

SEQ ID NO: 7029105 - DNA, 19 bp, Homo sapiens
atcagcaaggtaggatgtg

SEQ ID NO: 7029106 - DNA, 22 bp, Homo sapiens
cagccaggtatgggcgtgcggg

SEQ ID NO: 7029107 - DNA, 22 bp, Homo sapiens
tcatcatctgggcttgggggtg

SEQ ID NO: 7029108 - DNA, 22 bp, Homo sapiens
cagtaatattttactctaggcc

SEQ ID NO: 7029109 - DNA, 22 bp, Homo sapiens
acttcatagaatgagcttggaa

SEQ ID NO: 7029110 - DNA, 22 bp, Homo sapiens
tagctggggctttcattcttgc

SEQ ID NO: 7029111 - DNA, 22 bp, Homo sapiens
cttagaacattctgcctgggaa

SEQ ID NO: 7029112 - DNA, 22 bp, Homo sapiens
tgcaagagacatgggttgtgtg

SEQ ID NO: 7029113 - DNA, 22 bp, Homo sapiens
gtccttggcatcatgatttggt

SEQ ID NO: 7029114 - DNA, 22 bp, Homo sapiens
gtgtatgaacgaaagaatggat

SEQ ID NO: 7029115 - DNA, 22 bp, Homo sapiens
ctatccatatcctgggcatggc

SEQ ID NO: 7029116 - DNA, 22 bp, Homo sapiens
tgaagacagggtctttaacgag

SEQ ID NO: 7029117 - DNA, 20 bp, Homo sapiens
ttagaagggccagatgaagg

SEQ ID NO: 7029118 - DNA, 22 bp, Homo sapiens
ctgaagctctccagtttgtttc

SEQ ID NO: 7029119 - DNA, 22 bp, Homo sapiens
tgaggcagtgctgggaagcctg

SEQ ID NO: 7029120 - DNA, 22 bp, Homo sapiens
ccaggtaggagagagggatcct

SEQ ID NO: 7029121 - DNA, 22 bp, Homo sapiens
tcacagctggggttttggcagc

SEQ ID NO: 7029122 - DNA, 22 bp, Homo sapiens
gctaaaataactgagtttttgc

SEQ ID NO: 7029123 - DNA, 22 bp, Homo sapiens
tagatgttggtgagtgctgagg

SEQ ID NO: 7029124 - DNA, 22 bp, Homo sapiens
aggtctgtttaacaaagtcagg

SEQ ID NO: 7029125 - DNA, 22 bp, Homo sapiens
ctgcgttcattttgagtgctgt

SEQ ID NO: 7029126 - DNA, 22 bp, Homo sapiens
tccatgagggacactggatgct

SEQ ID NO: 7029127 - DNA, 22 bp, Homo sapiens
cagctatttatctttcatgata

SEQ ID NO: 7029128 - DNA, 22 bp, Homo sapiens
tgcttcatgcttctgacaatag

SEQ ID NO: 7029129 - DNA, 21 bp, Homo sapiens
tggctggatagatgggaactg

SEQ ID NO: 7029130 - DNA, 20 bp, Homo sapiens
actcctggtaacttttgtga

SEQ ID NO: 7029131 - DNA, 22 bp, Homo sapiens
cctcaaggatgattctgaaaga

SEQ ID NO: 7029132 - DNA, 22 bp, Homo sapiens
gttcattgttaacgtgtccact

SEQ ID NO: 7029133 - DNA, 22 bp, Homo sapiens
tagtgtggccccaagaggatct

SEQ ID NO: 7029134 - DNA, 22 bp, Homo sapiens
actggaaaacactactacatgc

SEQ ID NO: 7029135 - DNA, 22 bp, Homo sapiens
gctgttctgcgtcccaggctgg

SEQ ID NO: 7029136 - DNA, 19 bp, Homo sapiens
tcccagagtctagaggttg

SEQ ID NO: 7029137 - DNA, 22 bp, Homo sapiens
tttacctagtataatgcaacct

SEQ ID NO: 7029138 - DNA, 22 bp, Homo sapiens
atatagacagatgacagggata

SEQ ID NO: 7029139 - DNA, 22 bp, Homo sapiens
ttctggcttagttgttgtatat

SEQ ID NO: 7029140 - DNA, 22 bp, Homo sapiens
tgttaccaggcagtattgctta

SEQ ID NO: 7029141 - DNA, 22 bp, Homo sapiens
tagcagggtctcaggagtcagg

SEQ ID NO: 7029142 - DNA, 18 bp, Homo sapiens
tgccatccccagtcaagt

SEQ ID NO: 7029143 - DNA, 22 bp, Homo sapiens
ctacatgaactcttaagtcaca

SEQ ID NO: 7029144 - DNA, 22 bp, Homo sapiens
ggagtcacctgggaggactggg

SEQ ID NO: 7029145 - DNA, 21 bp, Homo sapiens
gtcacacaggcctggagctga

SEQ ID NO: 7029146 - DNA, 22 bp, Homo sapiens
atgtccttttaaaatgtgagaa

SEQ ID NO: 7029147 - DNA, 22 bp, Homo sapiens
aaagcaccggggagccttggga

SEQ ID NO: 7029148 - DNA, 22 bp, Homo sapiens
tctgggtctggctgctggtgca

SEQ ID NO: 7029149 - DNA, 22 bp, Homo sapiens
tttgtgcataaagggctatagt

SEQ ID NO: 7029150 - DNA, 22 bp, Homo sapiens
attgcagatgatccccaagtta

SEQ ID NO: 7029151 - DNA, 22 bp, Homo sapiens
agagtgaaaagctagagcagta

SEQ ID NO: 7029152 - DNA, 20 bp, Homo sapiens
cccagcccctacctgttgcc

SEQ ID NO: 7029153 - DNA, 22 bp, Homo sapiens
aaaggggtaatctaaggaattc

SEQ ID NO: 7029154 - DNA, 22 bp, Homo sapiens
acagcagagacactcaggaggc

SEQ ID NO: 7029155 - DNA, 22 bp, Homo sapiens
agtgtgggttttatggagccct

SEQ ID NO: 7029156 - DNA, 22 bp, Homo sapiens
actttactacatccacagatgg

SEQ ID NO: 7029157 - DNA, 22 bp, Homo sapiens
gggcacttaatgggcacagaga

SEQ ID NO: 7029158 - DNA, 22 bp, Homo sapiens
cagtctccgccagctcctcaca

SEQ ID NO: 7029159 - DNA, 22 bp, Homo sapiens
gaacactgagagagatgggcag

SEQ ID NO: 7029160 - DNA, 22 bp, Homo sapiens
ctttctgatccctgcaaccctc

SEQ ID NO: 7029161 - DNA, 22 bp, Homo sapiens
gcctgtaatcccagcactttgt

SEQ ID NO: 7029162 - DNA, 22 bp, Homo sapiens
acagcttgcaatggctttcaac

SEQ ID NO: 7029163 - DNA, 22 bp, Homo sapiens
aagagcctctgtgtttcagcct

SEQ ID NO: 7029164 - DNA, 22 bp, Homo sapiens
tggaatgtcagctacaagaggg

SEQ ID NO: 7029165 - DNA, 22 bp, Homo sapiens
aaagatttcacatcccaagcct

SEQ ID NO: 7029166 - DNA, 22 bp, Homo sapiens
tagcatctgtttctctttgtga

SEQ ID NO: 7029167 - DNA, 22 bp, Homo sapiens
ggtcagtgtacacatgtgcagg

SEQ ID NO: 7029168 - DNA, 22 bp, Homo sapiens
tcatgagtggattaatatggct

SEQ ID NO: 7029169 - DNA, 22 bp, Homo sapiens
aagagtatttggtatagaacac

SEQ ID NO: 7029170 - DNA, 22 bp, Homo sapiens
tcttctatcctcagcccctgcc

SEQ ID NO: 7029171 - DNA, 22 bp, Homo sapiens
gctggagctgagttccctgggc

SEQ ID NO: 7029172 - DNA, 22 bp, Homo sapiens
ttagctgcattatcaaagttat

SEQ ID NO: 7029173 - DNA, 21 bp, Homo sapiens
ctgtccctctttgcttccctc

SEQ ID NO: 7029174 - DNA, 22 bp, Homo sapiens
gatgaggcaggagtttgcttgt

SEQ ID NO: 7029175 - DNA, 22 bp, Homo sapiens
agggtctgcattccaacttggg

SEQ ID NO: 7029176 - DNA, 22 bp, Homo sapiens
ctctagaaagattgttgaccaa

SEQ ID NO: 7029177 - DNA, 22 bp, Homo sapiens
atgggaatataattttagcaac

SEQ ID NO: 7029178 - DNA, 22 bp, Homo sapiens
ttatagatgccttgagtaaatg

SEQ ID NO: 7029179 - DNA, 22 bp, Homo sapiens
gaaaatgtgcctttgggtattg

SEQ ID NO: 7029180 - DNA, 22 bp, Homo sapiens
cagtttatatgtcagagctgta

SEQ ID NO: 7029181 - DNA, 22 bp, Homo sapiens
caaaggcttcatctcagagcag

SEQ ID NO: 7029182 - DNA, 23 bp, Homo sapiens
acttggaagcagtgaacaacttt

SEQ ID NO: 7029183 - DNA, 22 bp, Homo sapiens
agcatttatagcccctatcatc

SEQ ID NO: 7029184 - DNA, 22 bp, Homo sapiens
cggctcctccgcccttgctcac

SEQ ID NO: 7029185 - DNA, 22 bp, Homo sapiens
aaaagaccacctcctggtcgaa

SEQ ID NO: 7029186 - DNA, 20 bp, Homo sapiens
atcaggctttctgttgcgat

SEQ ID NO: 7029187 - DNA, 22 bp, Homo sapiens
tggcccttcaaattccctagtc

SEQ ID NO: 7029188 - DNA, 22 bp, Homo sapiens
cctacacatctcacctcacagg

SEQ ID NO: 7029189 - DNA, 22 bp, Homo sapiens
agcaaagaaatggaggctcaga

SEQ ID NO: 7029190 - DNA, 22 bp, Homo sapiens
tctctggggatgcttattcttg

SEQ ID NO: 7029191 - DNA, 22 bp, Homo sapiens
ggagaaagggactgatctgctc

SEQ ID NO: 7029192 - DNA, 22 bp, Homo sapiens
cttcttcaagaggaccatccag

SEQ ID NO: 7029193 - DNA, 22 bp, Homo sapiens
tacaggtggtaaaaatattgtt

SEQ ID NO: 7029194 - DNA, 22 bp, Homo sapiens
acagagcctccaggagtgctgg

SEQ ID NO: 7029195 - DNA, 22 bp, Homo sapiens
acagtcttgagcatcagccaga

SEQ ID NO: 7029196 - DNA, 22 bp, Homo sapiens
tctgggggcgaccagggactgc

SEQ ID NO: 7029197 - DNA, 23 bp, Homo sapiens
agctgtttcttgtgagttgagtg

SEQ ID NO: 7029198 - DNA, 22 bp, Homo sapiens
gccccgtcgtggggccagggat

SEQ ID NO: 7029199 - DNA, 22 bp, Homo sapiens
ccctggagatcgggagaggaag

SEQ ID NO: 7029200 - DNA, 22 bp, Homo sapiens
ggaagaaagtagaaaaccgtgg

SEQ ID NO: 7029201 - DNA, 22 bp, Homo sapiens
tttatttggcatccagggagaa

SEQ ID NO: 7029202 - DNA, 22 bp, Homo sapiens
tagaacagagttccagtgatca

SEQ ID NO: 7029203 - DNA, 23 bp, Homo sapiens
tggctgagcccactatcttggcc

SEQ ID NO: 7029204 - DNA, 22 bp, Homo sapiens
ttacttgacataaatgagttta

SEQ ID NO: 7029205 - DNA, 18 bp, Homo sapiens
attctagaagatgccttg

SEQ ID NO: 7029206 - DNA, 22 bp, Homo sapiens
aggtttattatgtagcattatt

SEQ ID NO: 7029207 - DNA, 22 bp, Homo sapiens
cacagttaagggatgtcatgtt

SEQ ID NO: 7029208 - DNA, 22 bp, Homo sapiens
gcagagatctgagaaggctgcc

SEQ ID NO: 7029209 - DNA, 22 bp, Homo sapiens
tgctgcagggccttccctgcat

SEQ ID NO: 7029210 - DNA, 22 bp, Homo sapiens
gctcactgcaacctccacctcc

SEQ ID NO: 7029211 - DNA, 22 bp, Homo sapiens
cagctttgtctgattcctcttt

SEQ ID NO: 7029212 - DNA, 23 bp, Homo sapiens
tgagtcaccacagttacagtcac

SEQ ID NO: 7029213 - DNA, 22 bp, Homo sapiens
aggagctgcaaatattagtaat

SEQ ID NO: 7029214 - DNA, 22 bp, Homo sapiens
cctgagagagtgagccctgaca

SEQ ID NO: 7029215 - DNA, 22 bp, Homo sapiens
cctggcaggactgttgtaagaa

SEQ ID NO: 7029216 - DNA, 22 bp, Homo sapiens
agccactggcctgggcagctct

SEQ ID NO: 7029217 - DNA, 22 bp, Homo sapiens
agcaaatacttttcactgagcc

SEQ ID NO: 7029218 - DNA, 22 bp, Homo sapiens
tcgccatggaagtccttgcgga

SEQ ID NO: 7029219 - DNA, 22 bp, Homo sapiens
ttgctttattgggtttactgcc

SEQ ID NO: 7029220 - DNA, 22 bp, Homo sapiens
caggcctttctggggaagtgag

SEQ ID NO: 7029221 - DNA, 22 bp, Homo sapiens
caagttgtttaggaggtgttgt

SEQ ID NO: 7029222 - DNA, 22 bp, Homo sapiens
aggacttctccgataagtcaga

SEQ ID NO: 7029223 - DNA, 19 bp, Homo sapiens
attcagcattctgcacttc

SEQ ID NO: 7029224 - DNA, 22 bp, Homo sapiens
tgagagtgaaatgtcacatgtc

SEQ ID NO: 7029225 - DNA, 22 bp, Homo sapiens
ttaagtgtttagtaagagatgt

SEQ ID NO: 7029226 - DNA, 23 bp, Homo sapiens
tccaaggttgttgtggaaggggc

SEQ ID NO: 7029227 - DNA, 22 bp, Homo sapiens
tagctcttcatttcatctgatt

SEQ ID NO: 7029228 - DNA, 22 bp, Homo sapiens
agccaatagcattatacagtga

SEQ ID NO: 7029229 - DNA, 22 bp, Homo sapiens
gattagaatggatagatcccca

SEQ ID NO: 7029230 - DNA, 22 bp, Homo sapiens
ataacttcagtttctgtgtcct

SEQ ID NO: 7029231 - DNA, 22 bp, Homo sapiens
aagcagagaccggctaatggag

SEQ ID NO: 7029232 - DNA, 22 bp, Homo sapiens
aaagccagttcttagagaaagc

SEQ ID NO: 7029233 - DNA, 22 bp, Homo sapiens
tggctgtgttaccacttcatgt

SEQ ID NO: 7029234 - DNA, 23 bp, Homo sapiens
agctgggccaggtggtcagacct

SEQ ID NO: 7029235 - DNA, 22 bp, Homo sapiens
gatatattttccatggtctgca

SEQ ID NO: 7029236 - DNA, 22 bp, Homo sapiens
attctctggctaaaacctgaag

SEQ ID NO: 7029237 - DNA, 22 bp, Homo sapiens
attgtctctgaatttccagctg

SEQ ID NO: 7029238 - DNA, 22 bp, Homo sapiens
atactttggtcactattattgg

SEQ ID NO: 7029239 - DNA, 18 bp, Homo sapiens
agtttgaacaaggaagaa

SEQ ID NO: 7029240 - DNA, 22 bp, Homo sapiens
atgtgagcatcaccaggaggac

SEQ ID NO: 7029241 - DNA, 22 bp, Homo sapiens
attggaaagttcttaagggata

SEQ ID NO: 7029242 - DNA, 21 bp, Homo sapiens
gctggctgtctcttacacggt

SEQ ID NO: 7029243 - DNA, 21 bp, Homo sapiens
aagcttggctgatgttattgg

SEQ ID NO: 7029244 - DNA, 22 bp, Homo sapiens
tgggcttggaaagctgctgtgc

SEQ ID NO: 7029245 - DNA, 22 bp, Homo sapiens
ctggtaacaatatccacaaaga

SEQ ID NO: 7029246 - DNA, 22 bp, Homo sapiens
taacttcactggactcagcagc

SEQ ID NO: 7029247 - DNA, 22 bp, Homo sapiens
ctttgcttgacactgtgattgt

SEQ ID NO: 7029248 - DNA, 20 bp, Homo sapiens
aggcactgttgtctgtatcc

SEQ ID NO: 7029249 - DNA, 22 bp, Homo sapiens
tgcttgtcagtgtgctagaaac

SEQ ID NO: 7029250 - DNA, 22 bp, Homo sapiens
tgtttaatgcattgaccttggg

SEQ ID NO: 7029251 - DNA, 15 bp, Homo sapiens
atttggcatggcctc

SEQ ID NO: 7029252 - DNA, 22 bp, Homo sapiens
ctcttaaagcttccagtttcaa

SEQ ID NO: 7029253 - DNA, 22 bp, Homo sapiens
tagtgtcaaatagcctgagctt

SEQ ID NO: 7029254 - DNA, 22 bp, Homo sapiens
ctatcattttacatggttggtg

SEQ ID NO: 7029255 - DNA, 22 bp, Homo sapiens
agaacaatgaggtatggatgga

SEQ ID NO: 7029256 - DNA, 22 bp, Homo sapiens
gaacaaatcccttcctgtctcc

SEQ ID NO: 7029257 - DNA, 22 bp, Homo sapiens
aaatgtctttcaatagagaaat

SEQ ID NO: 7029258 - DNA, 22 bp, Homo sapiens
atgccctggggctacctctgag

SEQ ID NO: 7029259 - DNA, 22 bp, Homo sapiens
tggcccggctctgagctgtgct

SEQ ID NO: 7029260 - DNA, 22 bp, Homo sapiens
gagggcagaaaattatgcggtg

SEQ ID NO: 7029261 - DNA, 22 bp, Homo sapiens
agattcctgaaactgccattgg

SEQ ID NO: 7029262 - DNA, 22 bp, Homo sapiens
tctcatgccctgtttttggttg

SEQ ID NO: 7029263 - DNA, 22 bp, Homo sapiens
tggtcaaagctgcggtcagcaa

SEQ ID NO: 7029264 - DNA, 22 bp, Homo sapiens
actggcagaactggtgattgtc

SEQ ID NO: 7029265 - DNA, 22 bp, Homo sapiens
tgccatggaagtggccagacct

SEQ ID NO: 7029266 - DNA, 17 bp, Homo sapiens
attctagatgaggtgct

SEQ ID NO: 7029267 - DNA, 22 bp, Homo sapiens
gagttggctgttcgaaggtagc

SEQ ID NO: 7029268 - DNA, 22 bp, Homo sapiens
aggcatctgagtttgcaagctt

SEQ ID NO: 7029269 - DNA, 23 bp, Homo sapiens
tctcaaacagtgagttcaccaga

SEQ ID NO: 7029270 - DNA, 22 bp, Homo sapiens
ggatgctcagtgcctgtgtcca

SEQ ID NO: 7029271 - DNA, 22 bp, Homo sapiens
tctaggaggcggagattgcagt

SEQ ID NO: 7029272 - DNA, 21 bp, Homo sapiens
tctcctcccggggagaggccg

SEQ ID NO: 7029273 - DNA, 22 bp, Homo sapiens
atgtctgtctatagccatgaga

SEQ ID NO: 7029274 - DNA, 21 bp, Homo sapiens
ggcagcccgccctctcctggc

SEQ ID NO: 7029275 - DNA, 22 bp, Homo sapiens
ctaaacatggcttagaacactc

SEQ ID NO: 7029276 - DNA, 22 bp, Homo sapiens
tagcagcaattcaggtgtgatg

SEQ ID NO: 7029277 - DNA, 22 bp, Homo sapiens
tctcccagtggtgcagaaagca

SEQ ID NO: 7029278 - DNA, 22 bp, Homo sapiens
tttatgtaagtggaatgatgcc

SEQ ID NO: 7029279 - DNA, 22 bp, Homo sapiens
tgaaacgtgcagggtaatttta

SEQ ID NO: 7029280 - DNA, 22 bp, Homo sapiens
cctgccctgtcactggctaggg

SEQ ID NO: 7029281 - DNA, 22 bp, Homo sapiens
tccctggcagctaagggtggtc

SEQ ID NO: 7029282 - DNA, 21 bp, Homo sapiens
tacatagaggtgatatctgtt

SEQ ID NO: 7029283 - DNA, 22 bp, Homo sapiens
cccatttatcccaaggttactc

SEQ ID NO: 7029284 - DNA, 22 bp, Homo sapiens
ttccagtctttccaacatttca

SEQ ID NO: 7029285 - DNA, 19 bp, Homo sapiens
attcctcaaggacagaaat

SEQ ID NO: 7029286 - DNA, 22 bp, Homo sapiens
gatgtggctgccatggagcctg

SEQ ID NO: 7029287 - DNA, 22 bp, Homo sapiens
taggtacaaggagggattcttg

SEQ ID NO: 7029288 - DNA, 22 bp, Homo sapiens
agctgttttcttctaggaagac

SEQ ID NO: 7029289 - DNA, 22 bp, Homo sapiens
cctgagcacaagggagctttga

SEQ ID NO: 7029290 - DNA, 22 bp, Homo sapiens
gaacccagccagactccctaca

SEQ ID NO: 7029291 - DNA, 22 bp, Homo sapiens
tcactggggcccacatcaacat

SEQ ID NO: 7029292 - DNA, 22 bp, Homo sapiens
agctagaatgttccttttcatt

SEQ ID NO: 7029293 - DNA, 22 bp, Homo sapiens
atccactcctggaggtgcccca

SEQ ID NO: 7029294 - DNA, 22 bp, Homo sapiens
ctcacatgatggcctttttcat

SEQ ID NO: 7029295 - DNA, 22 bp, Homo sapiens
tgtcagttaaatgaggtacaag

SEQ ID NO: 7029296 - DNA, 22 bp, Homo sapiens
ctcagagcacttttgaaagctc

SEQ ID NO: 7029297 - DNA, 22 bp, Homo sapiens
gcctgggtgagggtctccttca

SEQ ID NO: 7029298 - DNA, 22 bp, Homo sapiens
ttatcatagtgcagttttctga

SEQ ID NO: 7029299 - DNA, 22 bp, Homo sapiens
cagccctcatcccgcctgcgtt

SEQ ID NO: 7029300 - DNA, 22 bp, Homo sapiens
caggggctgagaaggaacgtcc

SEQ ID NO: 7029301 - DNA, 22 bp, Homo sapiens
tgggcagtatttgcagaataat

SEQ ID NO: 7029302 - DNA, 22 bp, Homo sapiens
tagcaggagagaagttttaagt

SEQ ID NO: 7029303 - DNA, 22 bp, Homo sapiens
tcacgttttactgagtgagata

SEQ ID NO: 7029304 - DNA, 22 bp, Homo sapiens
tccctgagtgtatgtggtgaac

SEQ ID NO: 7029305 - DNA, 22 bp, Homo sapiens
gcaggcctgcccagcaggatgg

SEQ ID NO: 7029306 - DNA, 21 bp, Homo sapiens
tcttcagcagtggtgaggtgg

SEQ ID NO: 7029307 - DNA, 22 bp, Homo sapiens
catacagtgtggcatgtagtct

SEQ ID NO: 7029308 - DNA, 22 bp, Homo sapiens
atgcaagcaacattttgcacat

SEQ ID NO: 7029309 - DNA, 22 bp, Homo sapiens
gtctggctccaggatctcatga

SEQ ID NO: 7029310 - DNA, 22 bp, Homo sapiens
tccatggtaggtttcttaaaga

SEQ ID NO: 7029311 - DNA, 22 bp, Homo sapiens
tggcttttgcctttcaaattgg

SEQ ID NO: 7029312 - DNA, 22 bp, Homo sapiens
ttttcagagagcttttatgtcc

SEQ ID NO: 7029313 - DNA, 22 bp, Homo sapiens
tggcccaagcccgggacggcca

SEQ ID NO: 7029314 - DNA, 22 bp, Homo sapiens
gagggaaggacccattttaagt

SEQ ID NO: 7029315 - DNA, 22 bp, Homo sapiens
agcactgtagttatagctaaca

SEQ ID NO: 7029316 - DNA, 22 bp, Homo sapiens
ggaggcaccactcatcatcctc

SEQ ID NO: 7029317 - DNA, 22 bp, Homo sapiens
ctctgcgccaccctcgcctgct

SEQ ID NO: 7029318 - DNA, 22 bp, Homo sapiens
gagagggcaaggtagatgctac

SEQ ID NO: 7029319 - DNA, 22 bp, Homo sapiens
catctcacttccctgcagcatc

SEQ ID NO: 7029320 - DNA, 22 bp, Homo sapiens
gagatactgcgttgtattaggt

SEQ ID NO: 7029321 - DNA, 22 bp, Homo sapiens
actgatgttcagccatgttctg

SEQ ID NO: 7029322 - DNA, 22 bp, Homo sapiens
agattcaggactggccacagcc

SEQ ID NO: 7029323 - DNA, 22 bp, Homo sapiens
gtgtgctgcccaactcgcagat

SEQ ID NO: 7029324 - DNA, 22 bp, Homo sapiens
ttctggctgcagtccctgtaat

SEQ ID NO: 7029325 - DNA, 22 bp, Homo sapiens
cccaggctgccacgattactgc

SEQ ID NO: 7029326 - DNA, 22 bp, Homo sapiens
aaagttctagagttgcaagaga

SEQ ID NO: 7029327 - DNA, 22 bp, Homo sapiens
ttgtactagaaaattattcttt

SEQ ID NO: 7029328 - DNA, 22 bp, Homo sapiens
tagcaacataagaaacattttg

SEQ ID NO: 7029329 - DNA, 22 bp, Homo sapiens
aagtcagaaatatctgccatca

SEQ ID NO: 7029330 - DNA, 22 bp, Homo sapiens
ttaacacagggggagacaaagt

SEQ ID NO: 7029331 - DNA, 23 bp, Homo sapiens
tgacaaagcgagactccagctca

SEQ ID NO: 7029332 - DNA, 22 bp, Homo sapiens
atgccaaatttctttctgttct

SEQ ID NO: 7029333 - DNA, 23 bp, Homo sapiens
aagagctatacattcacctggta

SEQ ID NO: 7029334 - DNA, 22 bp, Homo sapiens
tgttaccaaggctgcttctagt

SEQ ID NO: 7029335 - DNA, 22 bp, Homo sapiens
aggaagaatgtttacatatcaa

SEQ ID NO: 7029336 - DNA, 20 bp, Homo sapiens
tatagtcccttttatgaagg

SEQ ID NO: 7029337 - DNA, 23 bp, Homo sapiens
actcgtggaattctctgcgatcg

SEQ ID NO: 7029338 - DNA, 22 bp, Homo sapiens
cactggtcagtgaaacagtatt

SEQ ID NO: 7029339 - DNA, 22 bp, Homo sapiens
agagcaggtggcaactctggga

SEQ ID NO: 7029340 - DNA, 22 bp, Homo sapiens
tgcctgccgctgtctagtactg

SEQ ID NO: 7029341 - DNA, 22 bp, Homo sapiens
gtggcatttgggagatgcgtgg

SEQ ID NO: 7029342 - DNA, 22 bp, Homo sapiens
caggtgagtaacaatgggtgat

SEQ ID NO: 7029343 - DNA, 22 bp, Homo sapiens
tctctggctgatattcctctgc

SEQ ID NO: 7029344 - DNA, 22 bp, Homo sapiens
acatgcacccagggcattgctt

SEQ ID NO: 7029345 - DNA, 22 bp, Homo sapiens
cagtacttttctggctttctac

SEQ ID NO: 7029346 - DNA, 21 bp, Homo sapiens
ctgttcactgtgctgtgcaaa

SEQ ID NO: 7029347 - DNA, 22 bp, Homo sapiens
aagctcttttctgcctcaccca

SEQ ID NO: 7029348 - DNA, 22 bp, Homo sapiens
ggccgtgctccaaagtcatcgt

SEQ ID NO: 7029349 - DNA, 22 bp, Homo sapiens
ttctacttctgacactgtttgt

SEQ ID NO: 7029350 - DNA, 22 bp, Homo sapiens
agcatctgcttaatggcttaac

SEQ ID NO: 7029351 - DNA, 22 bp, Homo sapiens
gaatccaggacggtcgtgggtt

SEQ ID NO: 7029352 - DNA, 22 bp, Homo sapiens
ttgtctgagagatggcagaggt

SEQ ID NO: 7029353 - DNA, 22 bp, Homo sapiens
agtatctttacttaaatagtca

SEQ ID NO: 7029354 - DNA, 22 bp, Homo sapiens
gctcctggtctggagcttcaag

SEQ ID NO: 7029355 - DNA, 22 bp, Homo sapiens
tccagagaaatctagtcttaca

SEQ ID NO: 7029356 - DNA, 22 bp, Homo sapiens
tggtcctggccttgaccccagg

SEQ ID NO: 7029357 - DNA, 22 bp, Homo sapiens
tgttcattctgtgacctggttc

SEQ ID NO: 7029358 - DNA, 22 bp, Homo sapiens
ttagagtgtagcaggaagaggc

SEQ ID NO: 7029359 - DNA, 22 bp, Homo sapiens
cttaattacccaatgtggtagg

SEQ ID NO: 7029360 - DNA, 22 bp, Homo sapiens
gttcctaaatctggaggacctc

SEQ ID NO: 7029361 - DNA, 22 bp, Homo sapiens
gcaccagagggggctctgcagg

SEQ ID NO: 7029362 - DNA, 22 bp, Homo sapiens
agctgcagctgttttctgagtg

SEQ ID NO: 7029363 - DNA, 22 bp, Homo sapiens
tgcatgcactatctagatgatg

SEQ ID NO: 7029364 - DNA, 22 bp, Homo sapiens
tttattagtgcttgtatcactg

SEQ ID NO: 7029365 - DNA, 23 bp, Homo sapiens
tggagttgatgtccttctgtgct

SEQ ID NO: 7029366 - DNA, 22 bp, Homo sapiens
acagctctgcattttgggttaa

SEQ ID NO: 7029367 - DNA, 22 bp, Homo sapiens
actttgacagcattttaattat

SEQ ID NO: 7029368 - DNA, 22 bp, Homo sapiens
tgtgttcatttaactgttcttt

SEQ ID NO: 7029369 - DNA, 22 bp, Homo sapiens
gggggcgcacagtcaccacaaa

SEQ ID NO: 7029370 - DNA, 22 bp, Homo sapiens
gcactgttctcagagcattaga

SEQ ID NO: 7029371 - DNA, 22 bp, Homo sapiens
atgctactcattaagtttgtca

SEQ ID NO: 7029372 - DNA, 22 bp, Homo sapiens
ttcttttcttggcaggagtaga

SEQ ID NO: 7029373 - DNA, 22 bp, Homo sapiens
gcaattcaatggttgctgagac

SEQ ID NO: 7029374 - DNA, 22 bp, Homo sapiens
attttcagtgatcatagcacac

SEQ ID NO: 7029375 - DNA, 22 bp, Homo sapiens
ttttaaatctccagttgacccc

SEQ ID NO: 7029376 - DNA, 22 bp, Homo sapiens
agcctttaactggataaagtgt

SEQ ID NO: 7029377 - DNA, 22 bp, Homo sapiens
caggcagcaggagccctgctcg

SEQ ID NO: 7029378 - DNA, 22 bp, Homo sapiens
ctgggcctgggaggccaggtct

SEQ ID NO: 7029379 - DNA, 22 bp, Homo sapiens
agtgtagggtggtcagagcaga

SEQ ID NO: 7029380 - DNA, 22 bp, Homo sapiens
catgctctccattggacacaga

SEQ ID NO: 7029381 - DNA, 20 bp, Homo sapiens
gctctgtgctggcggaggct

SEQ ID NO: 7029382 - DNA, 22 bp, Homo sapiens
accagaggctctgccacctcca

SEQ ID NO: 7029383 - DNA, 22 bp, Homo sapiens
gctctggctcaaaccaccggct

SEQ ID NO: 7029384 - DNA, 22 bp, Homo sapiens
ctagaatctccaagtttactca

SEQ ID NO: 7029385 - DNA, 21 bp, Homo sapiens
cacagaatatacattttagtt

SEQ ID NO: 7029386 - DNA, 22 bp, Homo sapiens
ccaggccctgctcctcacacca

SEQ ID NO: 7029387 - DNA, 22 bp, Homo sapiens
gttcacatgtgttatcttcttt

SEQ ID NO: 7029388 - DNA, 22 bp, Homo sapiens
gatgtggtgcagggcagtgctt

SEQ ID NO: 7029389 - DNA, 22 bp, Homo sapiens
gaagggaaggaaagaaccagca

SEQ ID NO: 7029390 - DNA, 22 bp, Homo sapiens
ctccttcaaaagtcatagtaaa

SEQ ID NO: 7029391 - DNA, 20 bp, Homo sapiens
ttatggctcctaccttgtga

SEQ ID NO: 7029392 - DNA, 22 bp, Homo sapiens
tggcaggaggatgaggcggcta

SEQ ID NO: 7029393 - DNA, 22 bp, Homo sapiens
gctgccctcccagggcaagctt

SEQ ID NO: 7029394 - DNA, 22 bp, Homo sapiens
acctcccagctctgagcttggg

SEQ ID NO: 7029395 - DNA, 22 bp, Homo sapiens
ttacagtaatcgagtgttgtgg

SEQ ID NO: 7029396 - DNA, 16 bp, Homo sapiens
cctctggcaattagat

SEQ ID NO: 7029397 - DNA, 22 bp, Homo sapiens
tgactcagtacatctggagttg

SEQ ID NO: 7029398 - DNA, 22 bp, Homo sapiens
tgatactagcagtattttttac

SEQ ID NO: 7029399 - DNA, 22 bp, Homo sapiens
gtctttaagggactgaatttgg

SEQ ID NO: 7029400 - DNA, 22 bp, Homo sapiens
ttccaaggctgtcctcactttg

SEQ ID NO: 7029401 - DNA, 19 bp, Homo sapiens
tccttctccggccaccccg

SEQ ID NO: 7029402 - DNA, 22 bp, Homo sapiens
gtccacattattatatgtctgt

SEQ ID NO: 7029403 - DNA, 19 bp, Homo sapiens
tctgcagactatattgtga

SEQ ID NO: 7029404 - DNA, 22 bp, Homo sapiens
tctgggcttttccatgcctgtg

SEQ ID NO: 7029405 - DNA, 22 bp, Homo sapiens
agcaacctggatcatggtgaaa

SEQ ID NO: 7029406 - DNA, 22 bp, Homo sapiens
aggaacacaatgcttctgtgtg

SEQ ID NO: 7029407 - DNA, 22 bp, Homo sapiens
atggaagcagacaggtaattcc

SEQ ID NO: 7029408 - DNA, 22 bp, Homo sapiens
cctcagaggcagatggtaagaa

SEQ ID NO: 7029409 - DNA, 22 bp, Homo sapiens
aatgtattatacataatttgtg

SEQ ID NO: 7029410 - DNA, 22 bp, Homo sapiens
cacccaggctggaatgcaatgg

SEQ ID NO: 7029411 - DNA, 21 bp, Homo sapiens
gctgttctttcagctggtctt

SEQ ID NO: 7029412 - DNA, 22 bp, Homo sapiens
cagtggcaggatttcagctcag

SEQ ID NO: 7029413 - DNA, 22 bp, Homo sapiens
aatgctttagaaaaccagcttt

SEQ ID NO: 7029414 - DNA, 22 bp, Homo sapiens
tccctctgctagtgcttgagct

SEQ ID NO: 7029415 - DNA, 22 bp, Homo sapiens
ggcttcacctgtgcactctacc

SEQ ID NO: 7029416 - DNA, 22 bp, Homo sapiens
cagttaaaagaagtctatctta

SEQ ID NO: 7029417 - DNA, 22 bp, Homo sapiens
ccaggcaggctagaatgtaaat

SEQ ID NO: 7029418 - DNA, 22 bp, Homo sapiens
taggaaaccaatcttttgggag

SEQ ID NO: 7029419 - DNA, 22 bp, Homo sapiens
caagcaggaggagaagtttctg

SEQ ID NO: 7029420 - DNA, 22 bp, Homo sapiens
gtcctgtgagattcatgctcaa

SEQ ID NO: 7029421 - DNA, 22 bp, Homo sapiens
gctgttcaagactaggaaattt

SEQ ID NO: 7029422 - DNA, 22 bp, Homo sapiens
ccaggctggagtgcagtggcac

SEQ ID NO: 7029423 - DNA, 22 bp, Homo sapiens
ctttcaagctcgcccccgctct

SEQ ID NO: 7029424 - DNA, 22 bp, Homo sapiens
cagcagagtttggcttctaatg

SEQ ID NO: 7029425 - DNA, 22 bp, Homo sapiens
ttatacctgaagcaggtgatgt

SEQ ID NO: 7029426 - DNA, 20 bp, Homo sapiens
atcaggaagagagactgacc

SEQ ID NO: 7029427 - DNA, 22 bp, Homo sapiens
tctaccagagcctagcaggccg

SEQ ID NO: 7029428 - DNA, 22 bp, Homo sapiens
attgagcaggcaaagtatcata

SEQ ID NO: 7029429 - DNA, 22 bp, Homo sapiens
taaagtttgtagcaattgatat

SEQ ID NO: 7029430 - DNA, 22 bp, Homo sapiens
agaggcttctcggatggggcag

SEQ ID NO: 7029431 - DNA, 22 bp, Homo sapiens
tctcagatgcccttgcatcacc

SEQ ID NO: 7029432 - DNA, 22 bp, Homo sapiens
ggactgaaggacaatctggttc

SEQ ID NO: 7029433 - DNA, 22 bp, Homo sapiens
cccaggcatcccattaaggagc

SEQ ID NO: 7029434 - DNA, 22 bp, Homo sapiens
ttaggcatgaacaggattcatt

SEQ ID NO: 7029435 - DNA, 22 bp, Homo sapiens
gccaagcactgaggacattgtt

SEQ ID NO: 7029436 - DNA, 22 bp, Homo sapiens
tcctggtttatagcttagggaa

SEQ ID NO: 7029437 - DNA, 22 bp, Homo sapiens
gataaacactaaggtcgctgaa

SEQ ID NO: 7029438 - DNA, 22 bp, Homo sapiens
aggctatttccactcttctcat

SEQ ID NO: 7029439 - DNA, 22 bp, Homo sapiens
ctgcaggttgactgaagtttgg

SEQ ID NO: 7029440 - DNA, 22 bp, Homo sapiens
gtattgtattgggatgagctct

SEQ ID NO: 7029441 - DNA, 22 bp, Homo sapiens
gcctagtggtgggtatgcagag

SEQ ID NO: 7029442 - DNA, 22 bp, Homo sapiens
ggctggatgtactttggggctg

SEQ ID NO: 7029443 - DNA, 22 bp, Homo sapiens
agaagaggggtgtccctgtggc

SEQ ID NO: 7029444 - DNA, 22 bp, Homo sapiens
ttgaaatagatgcgtcagagat

SEQ ID NO: 7029445 - DNA, 22 bp, Homo sapiens
cagctaatcctctctatccaag

SEQ ID NO: 7029446 - DNA, 22 bp, Homo sapiens
tattcattatgaccaaatctag

SEQ ID NO: 7029447 - DNA, 22 bp, Homo sapiens
ggacaggccatatggaatacat

SEQ ID NO: 7029448 - DNA, 22 bp, Homo sapiens
gtgcaggcattgggctagccat

SEQ ID NO: 7029449 - DNA, 22 bp, Homo sapiens
attcacagggacaatgggagag

SEQ ID NO: 7029450 - DNA, 22 bp, Homo sapiens
gaaatctttgccttagctgtgt

SEQ ID NO: 7029451 - DNA, 22 bp, Homo sapiens
aggctagctaatgagtactgtg

SEQ ID NO: 7029452 - DNA, 22 bp, Homo sapiens
tcaggccaggagatcagattga

SEQ ID NO: 7029453 - DNA, 19 bp, Homo sapiens
tgaattaaagattaaagtc

SEQ ID NO: 7029454 - DNA, 22 bp, Homo sapiens
attgacagagctttcaccatga

SEQ ID NO: 7029455 - DNA, 22 bp, Homo sapiens
tatgtcttactacagcaattaa

SEQ ID NO: 7029456 - DNA, 22 bp, Homo sapiens
ggcttctgtctcaagcaccagc

SEQ ID NO: 7029457 - DNA, 22 bp, Homo sapiens
cgttggagacacttgaggactt

SEQ ID NO: 7029458 - DNA, 22 bp, Homo sapiens
ttaaaatccagtgttggtggat

SEQ ID NO: 7029459 - DNA, 22 bp, Homo sapiens
cctgggtccaattctggcttgt

SEQ ID NO: 7029460 - DNA, 22 bp, Homo sapiens
tagggatgtaaacatagtaatt

SEQ ID NO: 7029461 - DNA, 22 bp, Homo sapiens
tgctgaatcccaccctccagtg

SEQ ID NO: 7029462 - DNA, 22 bp, Homo sapiens
gaggacctggaatccaagagtc

SEQ ID NO: 7029463 - DNA, 22 bp, Homo sapiens
aaagatcatgctgttttgtgat

SEQ ID NO: 7029464 - DNA, 22 bp, Homo sapiens
acctggccaatttttgtatttt

SEQ ID NO: 7029465 - DNA, 22 bp, Homo sapiens
tttaacttgatcagtagagcat

SEQ ID NO: 7029466 - DNA, 22 bp, Homo sapiens
acattcaaaattaggttagttg

SEQ ID NO: 7029467 - DNA, 22 bp, Homo sapiens
aaaggagagtgagtcagatgcc

SEQ ID NO: 7029468 - DNA, 22 bp, Homo sapiens
atcaatgctctgtacccagaat

SEQ ID NO: 7029469 - DNA, 22 bp, Homo sapiens
cctactgcccttcagtccagca

SEQ ID NO: 7029470 - DNA, 22 bp, Homo sapiens
gtagaagtgatgtcatgttata

SEQ ID NO: 7029471 - DNA, 22 bp, Homo sapiens
cgtcaggtttgtggcacctggg

SEQ ID NO: 7029472 - DNA, 22 bp, Homo sapiens
tccctctgtggttggttctgtc

SEQ ID NO: 7029473 - DNA, 22 bp, Homo sapiens
acaacagctgttcacaggggtc

SEQ ID NO: 7029474 - DNA, 22 bp, Homo sapiens
ctgtcgctgccaacagggctgg

SEQ ID NO: 7029475 - DNA, 22 bp, Homo sapiens
gaggtgaaagttattcatttat

SEQ ID NO: 7029476 - DNA, 22 bp, Homo sapiens
ccagcatttgcatggtgttaaa

SEQ ID NO: 7029477 - DNA, 22 bp, Homo sapiens
agtgacagagcttggtgccccc

SEQ ID NO: 7029478 - DNA, 22 bp, Homo sapiens
agtgggaccggtgctattccag

SEQ ID NO: 7029479 - DNA, 22 bp, Homo sapiens
tccttgagagccactgtcttgg

SEQ ID NO: 7029480 - DNA, 22 bp, Homo sapiens
tggactccagtgtctgtgttct

SEQ ID NO: 7029481 - DNA, 22 bp, Homo sapiens
agctttcgttccttagacacat

SEQ ID NO: 7029482 - DNA, 22 bp, Homo sapiens
tttggctaaggggcttctcaac

SEQ ID NO: 7029483 - DNA, 18 bp, Homo sapiens
tccattgttctactgtga

SEQ ID NO: 7029484 - DNA, 22 bp, Homo sapiens
gcatgtgggaacacttaggcac

SEQ ID NO: 7029485 - DNA, 22 bp, Homo sapiens
caggttagttaatctttgtttc

SEQ ID NO: 7029486 - DNA, 20 bp, Homo sapiens
tttgggcacggctagatttt

SEQ ID NO: 7029487 - DNA, 23 bp, Homo sapiens
ggtggtgctcatatctcaggcct

SEQ ID NO: 7029488 - DNA, 22 bp, Homo sapiens
tgtcattgaggaaaactaggtg

SEQ ID NO: 7029489 - DNA, 22 bp, Homo sapiens
atggtggacgggagacaggact

SEQ ID NO: 7029490 - DNA, 22 bp, Homo sapiens
ttaatgcagaaatcaaactgac

SEQ ID NO: 7029491 - DNA, 22 bp, Homo sapiens
gtgtgcagggatgagtgcaggt

SEQ ID NO: 7029492 - DNA, 22 bp, Homo sapiens
tcccttgtgagaacatgtgttg

SEQ ID NO: 7029493 - DNA, 22 bp, Homo sapiens
agcagcatgttcattacattat

SEQ ID NO: 7029494 - DNA, 17 bp, Homo sapiens
agaggcagatacttgga

SEQ ID NO: 7029495 - DNA, 22 bp, Homo sapiens
gtttcagatatatttgtactta

SEQ ID NO: 7029496 - DNA, 22 bp, Homo sapiens
acatgaaactgttgcattagaa

SEQ ID NO: 7029497 - DNA, 22 bp, Homo sapiens
gtgctgtacttctgtgttgaag

SEQ ID NO: 7029498 - DNA, 22 bp, Homo sapiens
agtggctttttagtggcagatg

SEQ ID NO: 7029499 - DNA, 22 bp, Homo sapiens
tcgcctcatcatcctaattaca

SEQ ID NO: 7029500 - DNA, 22 bp, Homo sapiens
gtttttatctaatagcagttat

SEQ ID NO: 7029501 - DNA, 22 bp, Homo sapiens
attcagtgtatcaatgaatgct

SEQ ID NO: 7029502 - DNA, 22 bp, Homo sapiens
ccagctctcttcaagcccactc

SEQ ID NO: 7029503 - DNA, 22 bp, Homo sapiens
aggtcaagaattgatgtggttt

SEQ ID NO: 7029504 - DNA, 22 bp, Homo sapiens
cagctttagtaacccactgctc

SEQ ID NO: 7029505 - DNA, 22 bp, Homo sapiens
ttactgttttggtacctcattg

SEQ ID NO: 7029506 - DNA, 22 bp, Homo sapiens
aaaattttcagcttgacttgat

SEQ ID NO: 7029507 - DNA, 22 bp, Homo sapiens
aggtcacacttggatcatagaa

SEQ ID NO: 7029508 - DNA, 22 bp, Homo sapiens
tcaatagaaatgcagagtctca

SEQ ID NO: 7029509 - DNA, 22 bp, Homo sapiens
agttactgctttcaggaagttt

SEQ ID NO: 7029510 - DNA, 22 bp, Homo sapiens
tgattaagttgcattttaatat

SEQ ID NO: 7029511 - DNA, 22 bp, Homo sapiens
tgctcctggatgaggtactcca

SEQ ID NO: 7029512 - DNA, 22 bp, Homo sapiens
ggctgccctcggggtcgcaggc

SEQ ID NO: 7029513 - DNA, 22 bp, Homo sapiens
ctgtggtggcacagcgggctgg

SEQ ID NO: 7029514 - DNA, 22 bp, Homo sapiens
tattacagttcgagtttctagg

SEQ ID NO: 7029515 - DNA, 22 bp, Homo sapiens
ggcctgacatttgcatcaacac

SEQ ID NO: 7029516 - DNA, 22 bp, Homo sapiens
aatgtctcaccgtaaatgtaac

SEQ ID NO: 7029517 - DNA, 22 bp, Homo sapiens
taatgctggattctttcttgtc

SEQ ID NO: 7029518 - DNA, 22 bp, Homo sapiens
ctgattgtcttggcacttgaag

SEQ ID NO: 7029519 - DNA, 22 bp, Homo sapiens
cagatgcttggaggacacttgg

SEQ ID NO: 7029520 - DNA, 22 bp, Homo sapiens
acattcttgaagtgaagtttat

SEQ ID NO: 7029521 - DNA, 22 bp, Homo sapiens
ctgctgctcttgtgcattagtg

SEQ ID NO: 7029522 - DNA, 22 bp, Homo sapiens
actgtcctggagctcacactct

SEQ ID NO: 7029523 - DNA, 22 bp, Homo sapiens
ggcaggagggcggacaatgacc

SEQ ID NO: 7029524 - DNA, 22 bp, Homo sapiens
actgggcagggaaggagaccga

SEQ ID NO: 7029525 - DNA, 22 bp, Homo sapiens
agtgttctcagctactagagag

SEQ ID NO: 7029526 - DNA, 22 bp, Homo sapiens
gtggaaatgcccccaaatagtg

SEQ ID NO: 7029527 - DNA, 22 bp, Homo sapiens
tgcttgatttggcagtgtattc

SEQ ID NO: 7029528 - DNA, 22 bp, Homo sapiens
tcaatcaatggtttccaaattt

SEQ ID NO: 7029529 - DNA, 22 bp, Homo sapiens
gtctgcctctattgcctacctg

SEQ ID NO: 7029530 - DNA, 22 bp, Homo sapiens
ccagggaaaatcaacttctact

SEQ ID NO: 7029531 - DNA, 22 bp, Homo sapiens
gagctgccctgagctttgcatg

SEQ ID NO: 7029532 - DNA, 22 bp, Homo sapiens
gtacatattacagacaaagctt

SEQ ID NO: 7029533 - DNA, 22 bp, Homo sapiens
aggtatatattctggtccttat

SEQ ID NO: 7029534 - DNA, 22 bp, Homo sapiens
caagatgaaattgtgatatttt

SEQ ID NO: 7029535 - DNA, 22 bp, Homo sapiens
ggttagagggcatgcgatcttt

SEQ ID NO: 7029536 - DNA, 22 bp, Homo sapiens
ttgcagctgaggaaattgaagc

SEQ ID NO: 7029537 - DNA, 22 bp, Homo sapiens
taataccactgtgctcattata

SEQ ID NO: 7029538 - DNA, 22 bp, Homo sapiens
ctaatgaagctgctttctatga

SEQ ID NO: 7029539 - DNA, 22 bp, Homo sapiens
tactgaattgtaagatgatgcc

SEQ ID NO: 7029540 - DNA, 22 bp, Homo sapiens
tctttgcatgtgcttcttggcc

SEQ ID NO: 7029541 - DNA, 22 bp, Homo sapiens
agtgcttggttcaatgaaggtt

SEQ ID NO: 7029542 - DNA, 22 bp, Homo sapiens
agatatttgtatcttgctattg

SEQ ID NO: 7029543 - DNA, 21 bp, Homo sapiens
agtctgaggtggggcctagga

SEQ ID NO: 7029544 - DNA, 22 bp, Homo sapiens
agccaaagtggtatatagggaa

SEQ ID NO: 7029545 - DNA, 22 bp, Homo sapiens
ctccctcacacccttgcccaga

SEQ ID NO: 7029546 - DNA, 17 bp, Homo sapiens
ccaggtgggaggtgggg

SEQ ID NO: 7029547 - DNA, 19 bp, Homo sapiens
ggcttcagggagttagcat

SEQ ID NO: 7029548 - DNA, 22 bp, Homo sapiens
aggtaagggtcacagttcatat

SEQ ID NO: 7029549 - DNA, 22 bp, Homo sapiens
tcagttttgaaaacattgaatg

SEQ ID NO: 7029550 - DNA, 22 bp, Homo sapiens
tgtcatctcactgatatagatg

SEQ ID NO: 7029551 - DNA, 22 bp, Homo sapiens
agaaaattactccagagacaag

SEQ ID NO: 7029552 - DNA, 22 bp, Homo sapiens
agctgggtccctctgctgatgg

SEQ ID NO: 7029553 - DNA, 22 bp, Homo sapiens
gcagagatattgatatagattt

SEQ ID NO: 7029554 - DNA, 22 bp, Homo sapiens
ccactgctgttacttacgcaaa

SEQ ID NO: 7029555 - DNA, 22 bp, Homo sapiens
tggttttagggaatcaatctat

SEQ ID NO: 7029556 - DNA, 20 bp, Homo sapiens
gagactggatctggagagac

SEQ ID NO: 7029557 - DNA, 22 bp, Homo sapiens
aggaaagaagtacattctcatg

SEQ ID NO: 7029558 - DNA, 22 bp, Homo sapiens
cttattggagagttgggccctt

SEQ ID NO: 7029559 - DNA, 19 bp, Homo sapiens
caagatttgttcacacatg

SEQ ID NO: 7029560 - DNA, 20 bp, Homo sapiens
tcagccattccttacctttc

SEQ ID NO: 7029561 - DNA, 22 bp, Homo sapiens
gtgttacatatatacccacacc

SEQ ID NO: 7029562 - DNA, 22 bp, Homo sapiens
tatgtctcatggaagggcatta

SEQ ID NO: 7029563 - DNA, 22 bp, Homo sapiens
tgcaggaccggaaccatgggat

SEQ ID NO: 7029564 - DNA, 22 bp, Homo sapiens
aagggctgtaagccaagtaaag

SEQ ID NO: 7029565 - DNA, 22 bp, Homo sapiens
tcctcccctcagggcaacggat

SEQ ID NO: 7029566 - DNA, 21 bp, Homo sapiens
atggaaattggcaaatgctac

SEQ ID NO: 7029567 - DNA, 22 bp, Homo sapiens
aaggcctccctgtgtgcaggtg

SEQ ID NO: 7029568 - DNA, 22 bp, Homo sapiens
tttcatgcacaaatgagcaagg

SEQ ID NO: 7029569 - DNA, 22 bp, Homo sapiens
agcaaggtggagaaggatgggt

SEQ ID NO: 7029570 - DNA, 17 bp, Homo sapiens
tgctgtctgcttcccta

SEQ ID NO: 7029571 - DNA, 22 bp, Homo sapiens
aagaaggcggaccagaagggag

SEQ ID NO: 7029572 - DNA, 22 bp, Homo sapiens
gagcaaggagggtggggccttt

SEQ ID NO: 7029573 - DNA, 22 bp, Homo sapiens
atgggagaaacatcatgaggca

SEQ ID NO: 7029574 - DNA, 22 bp, Homo sapiens
ctttgccaaaagctgcaggtgg

SEQ ID NO: 7029575 - DNA, 22 bp, Homo sapiens
tcaggaaggcgccccatcagga

SEQ ID NO: 7029576 - DNA, 22 bp, Homo sapiens
ttgctagataatctcacacact

SEQ ID NO: 7029577 - DNA, 22 bp, Homo sapiens
ttgttcttgtctttgccttcac

SEQ ID NO: 7029578 - DNA, 22 bp, Homo sapiens
cactgcccagagggcagcattg

SEQ ID NO: 7029579 - DNA, 22 bp, Homo sapiens
taatctgtaatttttgcaatag

SEQ ID NO: 7029580 - DNA, 22 bp, Homo sapiens
ttagcactgtctggttatcttg

SEQ ID NO: 7029581 - DNA, 22 bp, Homo sapiens
agagctcagtgtgttatggtta

SEQ ID NO: 7029582 - DNA, 19 bp, Homo sapiens
tgctggagggtagtgagtc

SEQ ID NO: 7029583 - DNA, 22 bp, Homo sapiens
aacttgaaaacctcatgaattg

SEQ ID NO: 7029584 - DNA, 23 bp, Homo sapiens
aaagatcaaagtggcaggcctgt

SEQ ID NO: 7029585 - DNA, 22 bp, Homo sapiens
aggattctgtaatctgtgaaat

SEQ ID NO: 7029586 - DNA, 22 bp, Homo sapiens
cctgatattaagaaggagtgag

SEQ ID NO: 7029587 - DNA, 22 bp, Homo sapiens
atgtttgtgtttgctatgcggt

SEQ ID NO: 7029588 - DNA, 22 bp, Homo sapiens
tgagatggtgaagaagacagca

SEQ ID NO: 7029589 - DNA, 22 bp, Homo sapiens
ttaaacatttttgatgatcgat

SEQ ID NO: 7029590 - DNA, 22 bp, Homo sapiens
caagttcttaactctgagcagc

SEQ ID NO: 7029591 - DNA, 22 bp, Homo sapiens
ttctgcccttgccagacaagta

SEQ ID NO: 7029592 - DNA, 22 bp, Homo sapiens
agtgagtggagagctctaggtt

SEQ ID NO: 7029593 - DNA, 22 bp, Homo sapiens
tggcatggccagtgctgggagt

SEQ ID NO: 7029594 - DNA, 22 bp, Homo sapiens
actgtctttgagctggaggagg

SEQ ID NO: 7029595 - DNA, 22 bp, Homo sapiens
tcagagtctatgcaacagaatt

SEQ ID NO: 7029596 - DNA, 22 bp, Homo sapiens
tgtctagttttagcttttggag

SEQ ID NO: 7029597 - DNA, 22 bp, Homo sapiens
gtcacactcaaaagctaggatg

SEQ ID NO: 7029598 - DNA, 22 bp, Homo sapiens
cattacatttcaaaatgtttcc

SEQ ID NO: 7029599 - DNA, 22 bp, Homo sapiens
gtgcctggaatgcgcctcggcg

SEQ ID NO: 7029600 - DNA, 22 bp, Homo sapiens
tccagagcatgcagatcatcaa

SEQ ID NO: 7029601 - DNA, 22 bp, Homo sapiens
tgaaacctcaaccaaaggttac

SEQ ID NO: 7029602 - DNA, 22 bp, Homo sapiens
aagctcttttcataagagcaaa

SEQ ID NO: 7029603 - DNA, 22 bp, Homo sapiens
agtgacagccaaatccatccat

SEQ ID NO: 7029604 - DNA, 22 bp, Homo sapiens
cggggctgcgctcttcctgccg

SEQ ID NO: 7029605 - DNA, 22 bp, Homo sapiens
gaattctggtcctgtccaaggt

SEQ ID NO: 7029606 - DNA, 22 bp, Homo sapiens
gaaagggaatggatttctgttg

SEQ ID NO: 7029607 - DNA, 23 bp, Homo sapiens
agctagcataatgtctggctcct

SEQ ID NO: 7029608 - DNA, 23 bp, Homo sapiens
tccctgggcccgtgccagcggtg

SEQ ID NO: 7029609 - DNA, 22 bp, Homo sapiens
gtaagttatattaaaatttcag

SEQ ID NO: 7029610 - DNA, 22 bp, Homo sapiens
tcaggaaatggaattcttgtgt

SEQ ID NO: 7029611 - DNA, 22 bp, Homo sapiens
tttgacagcttgcagtgagacc

SEQ ID NO: 7029612 - DNA, 22 bp, Homo sapiens
ctagggccaaaggctgtgatgc

SEQ ID NO: 7029613 - DNA, 22 bp, Homo sapiens
attgatgtgccgaaatagaggc

SEQ ID NO: 7029614 - DNA, 22 bp, Homo sapiens
ttccttttctcacggggatcca

SEQ ID NO: 7029615 - DNA, 22 bp, Homo sapiens
aaattgcctgagtatgtcacat

SEQ ID NO: 7029616 - DNA, 22 bp, Homo sapiens
acagtgggatgaggctggcccc

SEQ ID NO: 7029617 - DNA, 22 bp, Homo sapiens
atagaaaggtctttggcagaca

SEQ ID NO: 7029618 - DNA, 22 bp, Homo sapiens
tacattgctttctaatacatct

SEQ ID NO: 7029619 - DNA, 22 bp, Homo sapiens
actctggcagcagaaccagtgt

SEQ ID NO: 7029620 - DNA, 22 bp, Homo sapiens
tagatttgatgcaattggattg

SEQ ID NO: 7029621 - DNA, 22 bp, Homo sapiens
atcgcaagtttaaaaatctttg

SEQ ID NO: 7029622 - DNA, 22 bp, Homo sapiens
tcttcacagatgcatatacttc

SEQ ID NO: 7029623 - DNA, 20 bp, Homo sapiens
aagagaagaagtctttgaaa

SEQ ID NO: 7029624 - DNA, 19 bp, Homo sapiens
tctgggcagggccagcacc

SEQ ID NO: 7029625 - DNA, 22 bp, Homo sapiens
gctagatctctcataaattcca

SEQ ID NO: 7029626 - DNA, 22 bp, Homo sapiens
ctgagcgcatggttgctgggga

SEQ ID NO: 7029627 - DNA, 19 bp, Homo sapiens
cctaagtaacaacagttgt

SEQ ID NO: 7029628 - DNA, 22 bp, Homo sapiens
acctgaattttggatgagctgt

SEQ ID NO: 7029629 - DNA, 22 bp, Homo sapiens
atacaaggtggagtcaggaaaa

SEQ ID NO: 7029630 - DNA, 22 bp, Homo sapiens
tcagtaaatgcctttctgtgaa

SEQ ID NO: 7029631 - DNA, 22 bp, Homo sapiens
aggctggtgtgtcctgaagcct

SEQ ID NO: 7029632 - DNA, 22 bp, Homo sapiens
ggctttatttcactgtaccata

SEQ ID NO: 7029633 - DNA, 22 bp, Homo sapiens
tacaggaggattatcaaaggat

SEQ ID NO: 7029634 - DNA, 17 bp, Homo sapiens
ggccttgggctgctctt

SEQ ID NO: 7029635 - DNA, 22 bp, Homo sapiens
aagctgtatgacctaaatcttg

SEQ ID NO: 7029636 - DNA, 22 bp, Homo sapiens
ttctctaagagatgcagaagtt

SEQ ID NO: 7029637 - DNA, 22 bp, Homo sapiens
ttatatgtatgcttataaacca

SEQ ID NO: 7029638 - DNA, 22 bp, Homo sapiens
actccagggctccatcccttgt

SEQ ID NO: 7029639 - DNA, 22 bp, Homo sapiens
aagggacatagactgtacatct

SEQ ID NO: 7029640 - DNA, 18 bp, Homo sapiens
tggaagctggcagatttt

SEQ ID NO: 7029641 - DNA, 22 bp, Homo sapiens
tggctggagtctggtgctagcc

SEQ ID NO: 7029642 - DNA, 18 bp, Homo sapiens
gagaaagcagggaatgtt

SEQ ID NO: 7029643 - DNA, 22 bp, Homo sapiens
ttgtatgagtatggtgtatagg

SEQ ID NO: 7029644 - DNA, 22 bp, Homo sapiens
atagatttgaatttaagacttg

SEQ ID NO: 7029645 - DNA, 22 bp, Homo sapiens
agtgtgtttaggctgcgggttg

SEQ ID NO: 7029646 - DNA, 22 bp, Homo sapiens
ttctttttaaagtgtgtatgca

SEQ ID NO: 7029647 - DNA, 22 bp, Homo sapiens
aagtccagtatgagaaacctgc

SEQ ID NO: 7029648 - DNA, 22 bp, Homo sapiens
cggtggtcattatactcctttc

SEQ ID NO: 7029649 - DNA, 22 bp, Homo sapiens
ggccattgcaacgtcaggagga

SEQ ID NO: 7029650 - DNA, 22 bp, Homo sapiens
aggcttcagggcttttgagggt

SEQ ID NO: 7029651 - DNA, 22 bp, Homo sapiens
acacctgggtcagtgtgacagt

SEQ ID NO: 7029652 - DNA, 17 bp, Homo sapiens
agctgcagatgaagttg

SEQ ID NO: 7029653 - DNA, 18 bp, Homo sapiens
atgcttctgatagaagca

SEQ ID NO: 7029654 - DNA, 17 bp, Homo sapiens
tgaactttaggtggagc

SEQ ID NO: 7029655 - DNA, 22 bp, Homo sapiens
ataatggaggaagctatgtgga

SEQ ID NO: 7029656 - DNA, 22 bp, Homo sapiens
cagaggcattactgaaaaggtg

SEQ ID NO: 7029657 - DNA, 21 bp, Homo sapiens
acattataattcatattccac

SEQ ID NO: 7029658 - DNA, 22 bp, Homo sapiens
ctgtggaaggcctgtcctgaaa

SEQ ID NO: 7029659 - DNA, 22 bp, Homo sapiens
atggacaaatgtaaggcataat

SEQ ID NO: 7029660 - DNA, 22 bp, Homo sapiens
ctggcaggaagttagatggtaa

SEQ ID NO: 7029661 - DNA, 22 bp, Homo sapiens
aaactttttcttaggtatgtct

SEQ ID NO: 7029662 - DNA, 22 bp, Homo sapiens
tgagtcactgggtaatctggat

SEQ ID NO: 7029663 - DNA, 22 bp, Homo sapiens
tatacacatgtgtgtattcata

SEQ ID NO: 7029664 - DNA, 22 bp, Homo sapiens
agctcctgggccatcacaacca

SEQ ID NO: 7029665 - DNA, 22 bp, Homo sapiens
acacaatacagggctcaaaata

SEQ ID NO: 7029666 - DNA, 22 bp, Homo sapiens
aactacagcatctatacaaata

SEQ ID NO: 7029667 - DNA, 22 bp, Homo sapiens
tctgaatgttaggaaactttct

SEQ ID NO: 7029668 - DNA, 22 bp, Homo sapiens
ccgcaaggcagaggttgcagtg

SEQ ID NO: 7029669 - DNA, 22 bp, Homo sapiens
atgaagaaactgttctgggtgg

SEQ ID NO: 7029670 - DNA, 22 bp, Homo sapiens
ttccttggtagagagaatattt

SEQ ID NO: 7029671 - DNA, 22 bp, Homo sapiens
gggccagtgagtcgggagagct

SEQ ID NO: 7029672 - DNA, 22 bp, Homo sapiens
tgtttaatttcacaaagttgac

SEQ ID NO: 7029673 - DNA, 22 bp, Homo sapiens
tgcagggcccttggggttgaac

SEQ ID NO: 7029674 - DNA, 22 bp, Homo sapiens
cctctttgtgcctgcaggctgc

SEQ ID NO: 7029675 - DNA, 22 bp, Homo sapiens
atgtggagaggaagtgcaaact

SEQ ID NO: 7029676 - DNA, 22 bp, Homo sapiens
aattggctttgtggtttctgca

SEQ ID NO: 7029677 - DNA, 22 bp, Homo sapiens
cagccctgcttccccgctagtt

SEQ ID NO: 7029678 - DNA, 22 bp, Homo sapiens
cctgtcacctaggtactgagca

SEQ ID NO: 7029679 - DNA, 22 bp, Homo sapiens
ccaaggtgggaggattgcttga

SEQ ID NO: 7029680 - DNA, 22 bp, Homo sapiens
tggccttggcagtgagaagagt

SEQ ID NO: 7029681 - DNA, 22 bp, Homo sapiens
tcattccttatccgtatctttt

SEQ ID NO: 7029682 - DNA, 22 bp, Homo sapiens
ttgattactatgtgttgaaagc

SEQ ID NO: 7029683 - DNA, 22 bp, Homo sapiens
cgtgggtcgggactccgcctcg

SEQ ID NO: 7029684 - DNA, 22 bp, Homo sapiens
tgtggtcagctactggtcatct

SEQ ID NO: 7029685 - DNA, 22 bp, Homo sapiens
tgagcacctccctgacagtggg

SEQ ID NO: 7029686 - DNA, 22 bp, Homo sapiens
acacacttgcagagaggaggga

SEQ ID NO: 7029687 - DNA, 22 bp, Homo sapiens
tttgacagtgacgcctgtatga

SEQ ID NO: 7029688 - DNA, 22 bp, Homo sapiens
cagtaaagcatgtatgtcttca

SEQ ID NO: 7029689 - DNA, 22 bp, Homo sapiens
ctccactcaccgaggcagagca

SEQ ID NO: 7029690 - DNA, 22 bp, Homo sapiens
aggaggctggttcaggccatat

SEQ ID NO: 7029691 - DNA, 22 bp, Homo sapiens
tgatgtaagagatacacttgat

SEQ ID NO: 7029692 - DNA, 22 bp, Homo sapiens
gtcaccattgcccactccatgg

SEQ ID NO: 7029693 - DNA, 21 bp, Homo sapiens
agcgtgatcttggtctcctcc

SEQ ID NO: 7029694 - DNA, 22 bp, Homo sapiens
tccatttggcactctatttcca

SEQ ID NO: 7029695 - DNA, 22 bp, Homo sapiens
gggctctggtcctgaactgaag

SEQ ID NO: 7029696 - DNA, 22 bp, Homo sapiens
ttctgagcctttctaagaaaca

SEQ ID NO: 7029697 - DNA, 22 bp, Homo sapiens
agctacctataatgagacctgg

SEQ ID NO: 7029698 - DNA, 22 bp, Homo sapiens
tcctccacactctggactgttg

SEQ ID NO: 7029699 - DNA, 22 bp, Homo sapiens
tcactgcaatctcagcctcctg

SEQ ID NO: 7029700 - DNA, 22 bp, Homo sapiens
cagagacaggcttgccctccac

SEQ ID NO: 7029701 - DNA, 22 bp, Homo sapiens
atttcatagattgtaaatccct

SEQ ID NO: 7029702 - DNA, 22 bp, Homo sapiens
aagctttgggcagaagaggatt

SEQ ID NO: 7029703 - DNA, 22 bp, Homo sapiens
tcaggctgagaaaatctggacc

SEQ ID NO: 7029704 - DNA, 22 bp, Homo sapiens
agacggctggcagtgagcggct

SEQ ID NO: 7029705 - DNA, 20 bp, Homo sapiens
agggtctggccctgttcctt

SEQ ID NO: 7029706 - DNA, 19 bp, Homo sapiens
agctcctgattgtgcctcg

SEQ ID NO: 7029707 - DNA, 22 bp, Homo sapiens
tctcctttcttttaaaatgtca

SEQ ID NO: 7029708 - DNA, 22 bp, Homo sapiens
cagcccataccagaagtggagt

SEQ ID NO: 7029709 - DNA, 22 bp, Homo sapiens
cttgaatgtcctgtggcaaagt

SEQ ID NO: 7029710 - DNA, 22 bp, Homo sapiens
gattgtgttcataggcatgtta

SEQ ID NO: 7029711 - DNA, 22 bp, Homo sapiens
gaaatttattatctacatcatt

SEQ ID NO: 7029712 - DNA, 22 bp, Homo sapiens
tcctgaagcctgagtgatgact

SEQ ID NO: 7029713 - DNA, 20 bp, Homo sapiens
ggcgagctgggctctgtgca

SEQ ID NO: 7029714 - DNA, 22 bp, Homo sapiens
atctgggttcaccatgctcctg

SEQ ID NO: 7029715 - DNA, 22 bp, Homo sapiens
gctgcttctctgatggagtcca

SEQ ID NO: 7029716 - DNA, 22 bp, Homo sapiens
taatttcagtgggctctgggct

SEQ ID NO: 7029717 - DNA, 22 bp, Homo sapiens
tctttatggaaaatgaatggca

SEQ ID NO: 7029718 - DNA, 22 bp, Homo sapiens
acctgaatttgaaatgtttatt

SEQ ID NO: 7029719 - DNA, 22 bp, Homo sapiens
tgaggcaggagttcaggctgcg

SEQ ID NO: 7029720 - DNA, 22 bp, Homo sapiens
aggtctcctcatattctgcctc

SEQ ID NO: 7029721 - DNA, 22 bp, Homo sapiens
taagcctgtgcatgggcagatg

SEQ ID NO: 7029722 - DNA, 22 bp, Homo sapiens
gcccagtgctgagggtgctgct

SEQ ID NO: 7029723 - DNA, 22 bp, Homo sapiens
ccagcccgaatccctggccagg

SEQ ID NO: 7029724 - DNA, 22 bp, Homo sapiens
atttataacgtgcagccagggt

SEQ ID NO: 7029725 - DNA, 22 bp, Homo sapiens
gctctgggaattcagaaagcct

SEQ ID NO: 7029726 - DNA, 22 bp, Homo sapiens
tcaggctgatttcttttgaggg

SEQ ID NO: 7029727 - DNA, 22 bp, Homo sapiens
aagctggatgccttcctcccaa

SEQ ID NO: 7029728 - DNA, 22 bp, Homo sapiens
taggaaattgccaatatatgac

SEQ ID NO: 7029729 - DNA, 22 bp, Homo sapiens
tgggtgaggagaggctgtctaa

SEQ ID NO: 7029730 - DNA, 16 bp, Homo sapiens
catgagtcagtaagca

SEQ ID NO: 7029731 - DNA, 22 bp, Homo sapiens
tcttcatgcacctcacagctag

SEQ ID NO: 7029732 - DNA, 22 bp, Homo sapiens
gttggcagagagaagcctagca

SEQ ID NO: 7029733 - DNA, 22 bp, Homo sapiens
gtccttggaggtgtggaatctg

SEQ ID NO: 7029734 - DNA, 22 bp, Homo sapiens
agacaaataagtgctgggattt

SEQ ID NO: 7029735 - DNA, 22 bp, Homo sapiens
aaggtgtgctgtgagacctggt

SEQ ID NO: 7029736 - DNA, 22 bp, Homo sapiens
tgctgtcttttcccaatcctgg

SEQ ID NO: 7029737 - DNA, 23 bp, Homo sapiens
gcctggcttccaaggtaggggag

SEQ ID NO: 7029738 - DNA, 22 bp, Homo sapiens
cagctggcagccctggccctgc

SEQ ID NO: 7029739 - DNA, 22 bp, Homo sapiens
tatgttcttggaaatgaagctt

SEQ ID NO: 7029740 - DNA, 22 bp, Homo sapiens
atgaatcaaagttcatttgatc

SEQ ID NO: 7029741 - DNA, 22 bp, Homo sapiens
tggccagccttgtcatcgcttt

SEQ ID NO: 7029742 - DNA, 18 bp, Homo sapiens
agcaaatattaagtgcat

SEQ ID NO: 7029743 - DNA, 22 bp, Homo sapiens
ttcattgaaggagggacttgct

SEQ ID NO: 7029744 - DNA, 20 bp, Homo sapiens
ttatatcataatgtgccaat

SEQ ID NO: 7029745 - DNA, 22 bp, Homo sapiens
aggactggcggtcggtggggat

SEQ ID NO: 7029746 - DNA, 22 bp, Homo sapiens
tctagttagtggttgatactgt

SEQ ID NO: 7029747 - DNA, 22 bp, Homo sapiens
catgatgttatcaagcacaaag

SEQ ID NO: 7029748 - DNA, 22 bp, Homo sapiens
ggacagtgaatctggaggtata

SEQ ID NO: 7029749 - DNA, 22 bp, Homo sapiens
cctggctgctatagcagcatgt

SEQ ID NO: 7029750 - DNA, 22 bp, Homo sapiens
aaaggaagattgagcttttcca

SEQ ID NO: 7029751 - DNA, 22 bp, Homo sapiens
caggagtgtctccacacagcaa

SEQ ID NO: 7029752 - DNA, 22 bp, Homo sapiens
cattgctgacagatgaagagaa

SEQ ID NO: 7029753 - DNA, 22 bp, Homo sapiens
gaagaccatattcagcaggcat

SEQ ID NO: 7029754 - DNA, 22 bp, Homo sapiens
attggagacagatgggctccag

SEQ ID NO: 7029755 - DNA, 22 bp, Homo sapiens
tcctcaggatctaggagtgctt

SEQ ID NO: 7029756 - DNA, 22 bp, Homo sapiens
aaagctgggctggccaacccag

SEQ ID NO: 7029757 - DNA, 22 bp, Homo sapiens
atgtggctcattgtttgcttac

SEQ ID NO: 7029758 - DNA, 22 bp, Homo sapiens
cctctctgtcacaccagtggcc

SEQ ID NO: 7029759 - DNA, 22 bp, Homo sapiens
ggtgctgaataaatactagtta

SEQ ID NO: 7029760 - DNA, 22 bp, Homo sapiens
ggctgtgcttggtgtccttgga

SEQ ID NO: 7029761 - DNA, 19 bp, Homo sapiens
tcctcagtgacaacctcag

SEQ ID NO: 7029762 - DNA, 22 bp, Homo sapiens
aatttggtgtgttccaggaact

SEQ ID NO: 7029763 - DNA, 22 bp, Homo sapiens
tcagtcacactcactgaggtag

SEQ ID NO: 7029764 - DNA, 22 bp, Homo sapiens
ctacatgaaaataagtttgaaa

SEQ ID NO: 7029765 - DNA, 22 bp, Homo sapiens
cagcaggaaaatcaattctgtg

SEQ ID NO: 7029766 - DNA, 22 bp, Homo sapiens
tttcccatccatagccctgcaa

SEQ ID NO: 7029767 - DNA, 22 bp, Homo sapiens
acagaattaatgaaaattacaa

SEQ ID NO: 7029768 - DNA, 22 bp, Homo sapiens
tgtcaccaccggaagaaactgc

SEQ ID NO: 7029769 - DNA, 22 bp, Homo sapiens
aaatcagttctccctttcttca

SEQ ID NO: 7029770 - DNA, 22 bp, Homo sapiens
aggctttactgcctcaggactc

SEQ ID NO: 7029771 - DNA, 22 bp, Homo sapiens
aaatatagcaattatgcctact

SEQ ID NO: 7029772 - DNA, 22 bp, Homo sapiens
agcagctgatggggaaggagtt

SEQ ID NO: 7029773 - DNA, 23 bp, Homo sapiens
tgggtctctagtacaggcaggca

SEQ ID NO: 7029774 - DNA, 22 bp, Homo sapiens
tctacaaactaaggagggtaat

SEQ ID NO: 7029775 - DNA, 22 bp, Homo sapiens
cattattgatgcaacagccctt

SEQ ID NO: 7029776 - DNA, 22 bp, Homo sapiens
aatgctatcggctctaagcatg

SEQ ID NO: 7029777 - DNA, 22 bp, Homo sapiens
tttgttctgaagcaagtaggga

SEQ ID NO: 7029778 - DNA, 20 bp, Homo sapiens
tgtgcccaatgtccaggttc

SEQ ID NO: 7029779 - DNA, 22 bp, Homo sapiens
aaacagttacgagcgcagacct

SEQ ID NO: 7029780 - DNA, 22 bp, Homo sapiens
atgcagaagaaaccatggcttc

SEQ ID NO: 7029781 - DNA, 22 bp, Homo sapiens
gcagagctggaactggtactca

SEQ ID NO: 7029782 - DNA, 22 bp, Homo sapiens
tcttggttaggggaaataggca

SEQ ID NO: 7029783 - DNA, 22 bp, Homo sapiens
aagtttactgtccctggaaact

SEQ ID NO: 7029784 - DNA, 22 bp, Homo sapiens
tcctggctgagttcccaagtcg

SEQ ID NO: 7029785 - DNA, 22 bp, Homo sapiens
gtatggcttacataacttacta

SEQ ID NO: 7029786 - DNA, 22 bp, Homo sapiens
tggaggctggtttctgctgagg

SEQ ID NO: 7029787 - DNA, 22 bp, Homo sapiens
catgcaggcctatggagcagtg

SEQ ID NO: 7029788 - DNA, 22 bp, Homo sapiens
tgtttcaaaataacaagagggt

SEQ ID NO: 7029789 - DNA, 22 bp, Homo sapiens
gtatacaatacacaatgctctg

SEQ ID NO: 7029790 - DNA, 22 bp, Homo sapiens
ggacacgatttattgctaaggg

SEQ ID NO: 7029791 - DNA, 22 bp, Homo sapiens
gtctgtccagcaacacaggagt

SEQ ID NO: 7029792 - DNA, 22 bp, Homo sapiens
ttaaacacctgtctagtgtagc

SEQ ID NO: 7029793 - DNA, 22 bp, Homo sapiens
ttaatttttatgtatagtgtgt

SEQ ID NO: 7029794 - DNA, 22 bp, Homo sapiens
tggcctcttacgacatagcctt

SEQ ID NO: 7029795 - DNA, 18 bp, Homo sapiens
cccagctggtgggtcagt

SEQ ID NO: 7029796 - DNA, 22 bp, Homo sapiens
tccttacagttaaaatgggagt

SEQ ID NO: 7029797 - DNA, 22 bp, Homo sapiens
tagaaatgattgagctgtaata

SEQ ID NO: 7029798 - DNA, 22 bp, Homo sapiens
ttcttcaaagtccttattcctt

SEQ ID NO: 7029799 - DNA, 22 bp, Homo sapiens
tggaattatctgaagtgatttg

SEQ ID NO: 7029800 - DNA, 22 bp, Homo sapiens
tcctgagctttacagtaaggac

SEQ ID NO: 7029801 - DNA, 22 bp, Homo sapiens
caggtgtctaattctcaccccc

SEQ ID NO: 7029802 - DNA, 22 bp, Homo sapiens
tagactaaaagtatcagagggc

SEQ ID NO: 7029803 - DNA, 19 bp, Homo sapiens
ggtggcaggaataaaggtc

SEQ ID NO: 7029804 - DNA, 22 bp, Homo sapiens
caaaggctggtagaatgagcca

SEQ ID NO: 7029805 - DNA, 22 bp, Homo sapiens
gctccagctcgtggctcccagc

SEQ ID NO: 7029806 - DNA, 22 bp, Homo sapiens
acttataagagtgctatgggga

SEQ ID NO: 7029807 - DNA, 22 bp, Homo sapiens
tcaactttgaaaccatagtgaa

SEQ ID NO: 7029808 - DNA, 22 bp, Homo sapiens
cagcaggtatgtttgttcagca

SEQ ID NO: 7029809 - DNA, 22 bp, Homo sapiens
tctctctttttaatcatgtaat

SEQ ID NO: 7029810 - DNA, 22 bp, Homo sapiens
tttaggcacagagttgagggac

SEQ ID NO: 7029811 - DNA, 22 bp, Homo sapiens
tctgctgagatgcccatggtta

SEQ ID NO: 7029812 - DNA, 20 bp, Homo sapiens
gcctaggggttgggaaagca

SEQ ID NO: 7029813 - DNA, 22 bp, Homo sapiens
acttccttttcaaccatacagc

SEQ ID NO: 7029814 - DNA, 22 bp, Homo sapiens
agagggcattaactctgtcttg

SEQ ID NO: 7029815 - DNA, 22 bp, Homo sapiens
tacttttcacccagcccgcttc

SEQ ID NO: 7029816 - DNA, 22 bp, Homo sapiens
tttaatcttcaaaatagtctta

SEQ ID NO: 7029817 - DNA, 22 bp, Homo sapiens
tagctttgaacttctgggctca

SEQ ID NO: 7029818 - DNA, 22 bp, Homo sapiens
ttctgctcagtagtaagagtgc

SEQ ID NO: 7029819 - DNA, 22 bp, Homo sapiens
gggagaagtggaaatctcatta

SEQ ID NO: 7029820 - DNA, 22 bp, Homo sapiens
tctgtgttttaaacagtagaaa

SEQ ID NO: 7029821 - DNA, 22 bp, Homo sapiens
ttctgcatcctatgatcgcata

SEQ ID NO: 7029822 - DNA, 22 bp, Homo sapiens
tggtgggggaggctgtctagca

SEQ ID NO: 7029823 - DNA, 22 bp, Homo sapiens
aagaggagaaaggctggctttg

SEQ ID NO: 7029824 - DNA, 22 bp, Homo sapiens
tagggctgaggcaacaagggag

SEQ ID NO: 7029825 - DNA, 22 bp, Homo sapiens
agagaacattagcaaaaacagc

SEQ ID NO: 7029826 - DNA, 22 bp, Homo sapiens
tggaccccagacaagccagggt

SEQ ID NO: 7029827 - DNA, 22 bp, Homo sapiens
gcttggcagggcctgctggagc

SEQ ID NO: 7029828 - DNA, 22 bp, Homo sapiens
tcctgcagtgtgtctcctgcac

SEQ ID NO: 7029829 - DNA, 22 bp, Homo sapiens
gtatcttttggtggaaaaataa

SEQ ID NO: 7029830 - DNA, 22 bp, Homo sapiens
tctagaaacaggtttctagaaa

SEQ ID NO: 7029831 - DNA, 23 bp, Homo sapiens
gctgacgtttatccataaatata

SEQ ID NO: 7029832 - DNA, 22 bp, Homo sapiens
actgtccttttaatgcagccgt

SEQ ID NO: 7029833 - DNA, 22 bp, Homo sapiens
gtacttctttagtcaatatgta

SEQ ID NO: 7029834 - DNA, 22 bp, Homo sapiens
agtcttgctcttgcatctgctt

SEQ ID NO: 7029835 - DNA, 22 bp, Homo sapiens
tgaatgatctagttttgtagac

SEQ ID NO: 7029836 - DNA, 22 bp, Homo sapiens
cagaggctggcggccgccccga

SEQ ID NO: 7029837 - DNA, 22 bp, Homo sapiens
tgaagtcctaacttccagtaca

SEQ ID NO: 7029838 - DNA, 22 bp, Homo sapiens
tgggtaggtgtggcctgaatgt

SEQ ID NO: 7029839 - DNA, 22 bp, Homo sapiens
agcgaacacatcctctcctctt

SEQ ID NO: 7029840 - DNA, 22 bp, Homo sapiens
atttagagaataagacataaat

SEQ ID NO: 7029841 - DNA, 21 bp, Homo sapiens
agagaccagctgttactccca

SEQ ID NO: 7029842 - DNA, 22 bp, Homo sapiens
ccaggtcaagctcccctgtggt

SEQ ID NO: 7029843 - DNA, 20 bp, Homo sapiens
ccacctggccaaggctgtgc

SEQ ID NO: 7029844 - DNA, 22 bp, Homo sapiens
tgaggtgagatggctaccccaa

SEQ ID NO: 7029845 - DNA, 22 bp, Homo sapiens
agataattatttacttcaaagt

SEQ ID NO: 7029846 - DNA, 22 bp, Homo sapiens
gagggtggcctttagagcccat

SEQ ID NO: 7029847 - DNA, 22 bp, Homo sapiens
gagggcagagacagtgattcac

SEQ ID NO: 7029848 - DNA, 22 bp, Homo sapiens
ggtagggctgcaatggtagtga

SEQ ID NO: 7029849 - DNA, 22 bp, Homo sapiens
atgaggcattccactcaaactc

SEQ ID NO: 7029850 - DNA, 19 bp, Homo sapiens
ttcacaagtgatgtctctc

SEQ ID NO: 7029851 - DNA, 22 bp, Homo sapiens
ggctcttgaaatgtggctggcg

SEQ ID NO: 7029852 - DNA, 22 bp, Homo sapiens
cttcccaagtaaatttgtattt

SEQ ID NO: 7029853 - DNA, 22 bp, Homo sapiens
tccatctgtttactataaagat

SEQ ID NO: 7029854 - DNA, 22 bp, Homo sapiens
ctccccatggcaacagttatgg

SEQ ID NO: 7029855 - DNA, 22 bp, Homo sapiens
tcttcattccgtagatatttat

SEQ ID NO: 7029856 - DNA, 22 bp, Homo sapiens
catcaggaaaggacgtctagcc

SEQ ID NO: 7029857 - DNA, 22 bp, Homo sapiens
ccagccatgcacaaaccatgag

SEQ ID NO: 7029858 - DNA, 22 bp, Homo sapiens
tgactgaggcagcctgagttat

SEQ ID NO: 7029859 - DNA, 22 bp, Homo sapiens
tttgcaaggattttctggctca

SEQ ID NO: 7029860 - DNA, 22 bp, Homo sapiens
tgcccatggaccaagcaagggg

SEQ ID NO: 7029861 - DNA, 22 bp, Homo sapiens
tcatgtttgagactaatttttc

SEQ ID NO: 7029862 - DNA, 22 bp, Homo sapiens
tgcctggctctatcagtggtgg

SEQ ID NO: 7029863 - DNA, 23 bp, Homo sapiens
agcctcagccggtggcagaagtg

SEQ ID NO: 7029864 - DNA, 22 bp, Homo sapiens
aaccctggctttccctaattct

SEQ ID NO: 7029865 - DNA, 22 bp, Homo sapiens
tgaatacactaaaaatcacttt

SEQ ID NO: 7029866 - DNA, 22 bp, Homo sapiens
caaagtgagagaatggcagaaa

SEQ ID NO: 7029867 - DNA, 22 bp, Homo sapiens
gattttatcgtcatccttctgg

SEQ ID NO: 7029868 - DNA, 22 bp, Homo sapiens
gggttggatcctggtggctgcc

SEQ ID NO: 7029869 - DNA, 22 bp, Homo sapiens
agtatgaattgctttgcctgta

SEQ ID NO: 7029870 - DNA, 22 bp, Homo sapiens
ttctctggtttgctgtttctga

SEQ ID NO: 7029871 - DNA, 22 bp, Homo sapiens
agcctctggccctagactgctt

SEQ ID NO: 7029872 - DNA, 22 bp, Homo sapiens
cctggcagctaagtgctttgag

SEQ ID NO: 7029873 - DNA, 22 bp, Homo sapiens
cagagaactccagtggctggcg

SEQ ID NO: 7029874 - DNA, 22 bp, Homo sapiens
gcagggactttggcaacaggtg

SEQ ID NO: 7029875 - DNA, 19 bp, Homo sapiens
tgccctgcacgctgtcctg

SEQ ID NO: 7029876 - DNA, 22 bp, Homo sapiens
tattatgatcgtgactcaagga

SEQ ID NO: 7029877 - DNA, 22 bp, Homo sapiens
ctgggagcggctgtcactggtt

SEQ ID NO: 7029878 - DNA, 22 bp, Homo sapiens
tggtggaaataaacatccaatt

SEQ ID NO: 7029879 - DNA, 22 bp, Homo sapiens
aaaataacttctactatttgca

SEQ ID NO: 7029880 - DNA, 22 bp, Homo sapiens
atttcttcctctgtcagtaact

SEQ ID NO: 7029881 - DNA, 22 bp, Homo sapiens
aggtcaagggcaagagtgaggt

SEQ ID NO: 7029882 - DNA, 22 bp, Homo sapiens
ttgggagatagggtaatttagc

SEQ ID NO: 7029883 - DNA, 22 bp, Homo sapiens
actgtctgtagacatttttggt

SEQ ID NO: 7029884 - DNA, 22 bp, Homo sapiens
caaagcccagaggcctcacttt

SEQ ID NO: 7029885 - DNA, 22 bp, Homo sapiens
aagctgtcaatgtatctagtct

SEQ ID NO: 7029886 - DNA, 22 bp, Homo sapiens
cagagagaggccactgctatta

SEQ ID NO: 7029887 - DNA, 22 bp, Homo sapiens
tcagaagccgggcaggttttgg

SEQ ID NO: 7029888 - DNA, 21 bp, Homo sapiens
ggacaccagtcacactggatt

SEQ ID NO: 7029889 - DNA, 18 bp, Homo sapiens
agctctggggagatgggc

SEQ ID NO: 7029890 - DNA, 22 bp, Homo sapiens
taaaatgccagaccagttcacg

SEQ ID NO: 7029891 - DNA, 22 bp, Homo sapiens
atgaaattgatcttgaactttt

SEQ ID NO: 7029892 - DNA, 22 bp, Homo sapiens
agtgatggagcttcctctgcta

SEQ ID NO: 7029893 - DNA, 22 bp, Homo sapiens
acagacatcatcaacatcttcc

SEQ ID NO: 7029894 - DNA, 22 bp, Homo sapiens
ggtccttctgtaggggtcccct

SEQ ID NO: 7029895 - DNA, 22 bp, Homo sapiens
aaaggccattacttgcttttag

SEQ ID NO: 7029896 - DNA, 22 bp, Homo sapiens
tcaggcaaggctggtctcatac

SEQ ID NO: 7029897 - DNA, 22 bp, Homo sapiens
atgtgtctgaccactgtattgg

SEQ ID NO: 7029898 - DNA, 22 bp, Homo sapiens
ccaagatgatctttacagtgtt

SEQ ID NO: 7029899 - DNA, 22 bp, Homo sapiens
agaatgtcaacagcctctcaag

SEQ ID NO: 7029900 - DNA, 22 bp, Homo sapiens
tgcaggcataaccgatgttgat

SEQ ID NO: 7029901 - DNA, 22 bp, Homo sapiens
gcctgtgacccctccatctgct

SEQ ID NO: 7029902 - DNA, 22 bp, Homo sapiens
aagttcaaattggggcctgtga

SEQ ID NO: 7029903 - DNA, 23 bp, Homo sapiens
agtgacaatgggccagaggtggc

SEQ ID NO: 7029904 - DNA, 22 bp, Homo sapiens
tagggatgatggagcctatgta

SEQ ID NO: 7029905 - DNA, 22 bp, Homo sapiens
ttgagaatgtgttttgctaagt

SEQ ID NO: 7029906 - DNA, 22 bp, Homo sapiens
tcagtcctccacacaggcaccc

SEQ ID NO: 7029907 - DNA, 22 bp, Homo sapiens
aacagagcttgggtcatctcat

SEQ ID NO: 7029908 - DNA, 22 bp, Homo sapiens
caatttcaggtggataggtttt

SEQ ID NO: 7029909 - DNA, 22 bp, Homo sapiens
aggcctccagccacatgccagt

SEQ ID NO: 7029910 - DNA, 22 bp, Homo sapiens
cttgtcaagtcactttaacctc

SEQ ID NO: 7029911 - DNA, 22 bp, Homo sapiens
tgtccttttggctgtctatggt

SEQ ID NO: 7029912 - DNA, 22 bp, Homo sapiens
cagggttggtttctcctcaggc

SEQ ID NO: 7029913 - DNA, 22 bp, Homo sapiens
ggagtttcttgagcccttaagg

SEQ ID NO: 7029914 - DNA, 22 bp, Homo sapiens
gctgcaagatcttaaaagggag

SEQ ID NO: 7029915 - DNA, 22 bp, Homo sapiens
ttcttgttctcctcatttagag

SEQ ID NO: 7029916 - DNA, 22 bp, Homo sapiens
aaaagcaggtactcagcttggg

SEQ ID NO: 7029917 - DNA, 22 bp, Homo sapiens
tttgacagcatatcctcatatt

SEQ ID NO: 7029918 - DNA, 22 bp, Homo sapiens
tgggaagatatgagtgaccaac

SEQ ID NO: 7029919 - DNA, 22 bp, Homo sapiens
caaattaccctcaacatctaga

SEQ ID NO: 7029920 - DNA, 21 bp, Homo sapiens
tcttgtgtgctgccctgctac

SEQ ID NO: 7029921 - DNA, 22 bp, Homo sapiens
cttgaactcaatgtgaggaaga

SEQ ID NO: 7029922 - DNA, 22 bp, Homo sapiens
tgtattttctgaggagcattag

SEQ ID NO: 7029923 - DNA, 22 bp, Homo sapiens
tggcaacttgcaacctcattct

SEQ ID NO: 7029924 - DNA, 22 bp, Homo sapiens
aaggaggcaccctgagcctgcc

SEQ ID NO: 7029925 - DNA, 22 bp, Homo sapiens
atcctgtcatcatagtacttga

SEQ ID NO: 7029926 - DNA, 22 bp, Homo sapiens
tgcacacacatgaagtagcatg

SEQ ID NO: 7029927 - DNA, 20 bp, Homo sapiens
tgctggaggcgccggcgctc

SEQ ID NO: 7029928 - DNA, 22 bp, Homo sapiens
gatagaaaggtgttgaaatcca

SEQ ID NO: 7029929 - DNA, 22 bp, Homo sapiens
tgtccagaatgtgtggaaattc

SEQ ID NO: 7029930 - DNA, 22 bp, Homo sapiens
agaatgatagctagtatttact

SEQ ID NO: 7029931 - DNA, 18 bp, Homo sapiens
tgacatttccagagtgta

SEQ ID NO: 7029932 - DNA, 22 bp, Homo sapiens
catcgtgtctaggtgtgcagca

SEQ ID NO: 7029933 - DNA, 22 bp, Homo sapiens
gtggctgctaagtctccttcct

SEQ ID NO: 7029934 - DNA, 22 bp, Homo sapiens
tagtcttaagtaattcatggaa

SEQ ID NO: 7029935 - DNA, 22 bp, Homo sapiens
atgatggaggccgtgatggacg

SEQ ID NO: 7029936 - DNA, 21 bp, Homo sapiens
ttctcagtgtccatgttagtt

SEQ ID NO: 7029937 - DNA, 22 bp, Homo sapiens
cagcacagggcttgagaggtgt

SEQ ID NO: 7029938 - DNA, 22 bp, Homo sapiens
gcctgcagcctcagagaatttt

SEQ ID NO: 7029939 - DNA, 22 bp, Homo sapiens
tgcagggaaagggcactgggct

SEQ ID NO: 7029940 - DNA, 22 bp, Homo sapiens
ggaaacatgcctgctggacagt

SEQ ID NO: 7029941 - DNA, 22 bp, Homo sapiens
gagctgtttgtgacaggctgtg

SEQ ID NO: 7029942 - DNA, 22 bp, Homo sapiens
agatcgatttcatatcctctta

SEQ ID NO: 7029943 - DNA, 22 bp, Homo sapiens
atctcataactcatttgaagac

SEQ ID NO: 7029944 - DNA, 17 bp, Homo sapiens
tattagctagcttccag

SEQ ID NO: 7029945 - DNA, 22 bp, Homo sapiens
acagtaaacaatgcagcaaatt

SEQ ID NO: 7029946 - DNA, 22 bp, Homo sapiens
cagttaaagctgcatgtgtcag

SEQ ID NO: 7029947 - DNA, 22 bp, Homo sapiens
agctttggcttctgttgaacct

SEQ ID NO: 7029948 - DNA, 22 bp, Homo sapiens
caggcagctctgcttttcctaa

SEQ ID NO: 7029949 - DNA, 22 bp, Homo sapiens
ctcaggaagcctgtaatgtggg

SEQ ID NO: 7029950 - DNA, 22 bp, Homo sapiens
tagggcagttataacattagtg

SEQ ID NO: 7029951 - DNA, 22 bp, Homo sapiens
atcaggaatcttttgtcagaca

SEQ ID NO: 7029952 - DNA, 22 bp, Homo sapiens
gggaacagcatatctgaagggt

SEQ ID NO: 7029953 - DNA, 22 bp, Homo sapiens
agaggcctccgaaaggtgggct

SEQ ID NO: 7029954 - DNA, 22 bp, Homo sapiens
gctgatgtttagttgatgttac

SEQ ID NO: 7029955 - DNA, 22 bp, Homo sapiens
ggctggaagtccaagatcaagg

SEQ ID NO: 7029956 - DNA, 22 bp, Homo sapiens
cttgggaaaccaatgggctcct

SEQ ID NO: 7029957 - DNA, 19 bp, Homo sapiens
actcatctgccacctctgt

SEQ ID NO: 7029958 - DNA, 22 bp, Homo sapiens
aggtggcttctggccaggtgtg

SEQ ID NO: 7029959 - DNA, 22 bp, Homo sapiens
ctgtggcttctgcttgggcctc

SEQ ID NO: 7029960 - DNA, 22 bp, Homo sapiens
aaagtaattgtggtttctgtca

SEQ ID NO: 7029961 - DNA, 22 bp, Homo sapiens
gcatgtggtgctgaggctgtcg

SEQ ID NO: 7029962 - DNA, 19 bp, Homo sapiens
aaagaactttgggctaggc

SEQ ID NO: 7029963 - DNA, 21 bp, Homo sapiens
gctcagcaaaggtgaggtgca

SEQ ID NO: 7029964 - DNA, 22 bp, Homo sapiens
tgttgtaaaatttgagatgtca

SEQ ID NO: 7029965 - DNA, 22 bp, Homo sapiens
ttcttgcatcactctgctgttc

SEQ ID NO: 7029966 - DNA, 22 bp, Homo sapiens
tgttttcagtcatatagcaggt

SEQ ID NO: 7029967 - DNA, 22 bp, Homo sapiens
gtggaaaagaaagtcttccttg

SEQ ID NO: 7029968 - DNA, 22 bp, Homo sapiens
tatggctgaggcctccgtggcc

SEQ ID NO: 7029969 - DNA, 22 bp, Homo sapiens
gagccaggttggaggctgcagt

SEQ ID NO: 7029970 - DNA, 22 bp, Homo sapiens
ctggaggtcatgtaatatggaa

SEQ ID NO: 7029971 - DNA, 22 bp, Homo sapiens
cacagagtggaggcttggcctg

SEQ ID NO: 7029972 - DNA, 22 bp, Homo sapiens
gtcataggttcaaaaggcagat

SEQ ID NO: 7029973 - DNA, 22 bp, Homo sapiens
ctgactatctttctcaaagtgg

SEQ ID NO: 7029974 - DNA, 22 bp, Homo sapiens
taaagcagccagggtctaagcc

SEQ ID NO: 7029975 - DNA, 22 bp, Homo sapiens
tcatgccagttaaaggctgtga

SEQ ID NO: 7029976 - DNA, 22 bp, Homo sapiens
tcaggaacatttaaccacaggg

SEQ ID NO: 7029977 - DNA, 22 bp, Homo sapiens
gggctccagctgtttgccatga

SEQ ID NO: 7029978 - DNA, 22 bp, Homo sapiens
ggagggggaaactttggctgcc

SEQ ID NO: 7029979 - DNA, 22 bp, Homo sapiens
gctggcttccttctgcagctag

SEQ ID NO: 7029980 - DNA, 22 bp, Homo sapiens
ccactgtattttggaagcagat

SEQ ID NO: 7029981 - DNA, 22 bp, Homo sapiens
aatactggctgtcaaagatgga

SEQ ID NO: 7029982 - DNA, 22 bp, Homo sapiens
agagctgaggatccagctgagc

SEQ ID NO: 7029983 - DNA, 22 bp, Homo sapiens
caaaggcatgtgagtatatgtg

SEQ ID NO: 7029984 - DNA, 19 bp, Homo sapiens
gcaccagattgagtgacac

SEQ ID NO: 7029985 - DNA, 22 bp, Homo sapiens
gagaatctacaggaaaccgaag

SEQ ID NO: 7029986 - DNA, 22 bp, Homo sapiens
ttctacatgtcaagtctccaag

SEQ ID NO: 7029987 - DNA, 22 bp, Homo sapiens
gagtgctccgtcttggacaggg

SEQ ID NO: 7029988 - DNA, 22 bp, Homo sapiens
atatgttttgtgcttcattggt

SEQ ID NO: 7029989 - DNA, 22 bp, Homo sapiens
tgagtactgatttaagatacac

SEQ ID NO: 7029990 - DNA, 22 bp, Homo sapiens
gctgcagagggaggggctcgca

SEQ ID NO: 7029991 - DNA, 22 bp, Homo sapiens
tattggtgtacttatagcagag

SEQ ID NO: 7029992 - DNA, 22 bp, Homo sapiens
tgctggcaagtcttggaattgt

SEQ ID NO: 7029993 - DNA, 22 bp, Homo sapiens
ggagctgttaaatgcagaattt

SEQ ID NO: 7029994 - DNA, 22 bp, Homo sapiens
tccagtgggtctggcaagacca

SEQ ID NO: 7029995 - DNA, 22 bp, Homo sapiens
ttttcatgtgatgtgacatttc

SEQ ID NO: 7029996 - DNA, 22 bp, Homo sapiens
tgattcaagccaccacatactg

SEQ ID NO: 7029997 - DNA, 22 bp, Homo sapiens
taactgtagctaaccgatgaga

SEQ ID NO: 7029998 - DNA, 22 bp, Homo sapiens
tgtgagagagtgcatttgcata

SEQ ID NO: 7029999 - DNA, 22 bp, Homo sapiens
tgctgaggctagacctggaagt

SEQ ID NO: 7030000 - DNA, 22 bp, Homo sapiens
tgcatgcaatgtgaagaaagct

SEQ ID NO: 7030001 - DNA, 22 bp, Homo sapiens
ttctcttattctggatatgcag

SEQ ID NO: 7030002 - DNA, 22 bp, Homo sapiens
tactaagtgtttggcagtatca

SEQ ID NO: 7030003 - DNA, 22 bp, Homo sapiens
agctggtgatggcctaagaagg

SEQ ID NO: 7030004 - DNA, 22 bp, Homo sapiens
gagtttccaaatccctgaaggg

SEQ ID NO: 7030005 - DNA, 22 bp, Homo sapiens
tctgcctgccgagaacacctac

SEQ ID NO: 7030006 - DNA, 22 bp, Homo sapiens
tccagggctgttactttacata

SEQ ID NO: 7030007 - DNA, 22 bp, Homo sapiens
agggatggtggaggttgcaagt

SEQ ID NO: 7030008 - DNA, 22 bp, Homo sapiens
gacccagtcacacttgtgcttt

SEQ ID NO: 7030009 - DNA, 22 bp, Homo sapiens
tgggaagggtctgaatctgaga

SEQ ID NO: 7030010 - DNA, 22 bp, Homo sapiens
aggactccatgtgtcctggaga

SEQ ID NO: 7030011 - DNA, 20 bp, Homo sapiens
ctccagcccctgccctggtc

SEQ ID NO: 7030012 - DNA, 22 bp, Homo sapiens
tagtttttaagtgtacaatttc

SEQ ID NO: 7030013 - DNA, 22 bp, Homo sapiens
tttatctggactgtgatataaa

SEQ ID NO: 7030014 - DNA, 22 bp, Homo sapiens
ttaatccggggtgaatttaatt

SEQ ID NO: 7030015 - DNA, 22 bp, Homo sapiens
ttggccacactcactagagccc

SEQ ID NO: 7030016 - DNA, 22 bp, Homo sapiens
gattagtatccttattaagaga

SEQ ID NO: 7030017 - DNA, 22 bp, Homo sapiens
taccttgggagacgccaggccc

SEQ ID NO: 7030018 - DNA, 22 bp, Homo sapiens
tgagtattttccctatcaatgt

SEQ ID NO: 7030019 - DNA, 22 bp, Homo sapiens
tgcaagaagtcctctctgggtg

SEQ ID NO: 7030020 - DNA, 22 bp, Homo sapiens
ttgctataaatggtttcatatt

SEQ ID NO: 7030021 - DNA, 22 bp, Homo sapiens
tgtcttattccttctgttcagc

SEQ ID NO: 7030022 - DNA, 22 bp, Homo sapiens
acaatggcatgctagcaaatgg

SEQ ID NO: 7030023 - DNA, 22 bp, Homo sapiens
agatacatggaacgtcaaacct

SEQ ID NO: 7030024 - DNA, 22 bp, Homo sapiens
agcctctgggggagctgggagc

SEQ ID NO: 7030025 - DNA, 22 bp, Homo sapiens
tccttatagcccaagtgatgga

SEQ ID NO: 7030026 - DNA, 22 bp, Homo sapiens
aactacaatatgtatgtatgta

SEQ ID NO: 7030027 - DNA, 22 bp, Homo sapiens
ttgtgtacacgcctttaaatga

SEQ ID NO: 7030028 - DNA, 22 bp, Homo sapiens
caaaacctaaacagactgtcca

SEQ ID NO: 7030029 - DNA, 19 bp, Homo sapiens
cttcttgataaggttcttt

SEQ ID NO: 7030030 - DNA, 20 bp, Homo sapiens
tctaggcaggcaggctcgtg

SEQ ID NO: 7030031 - DNA, 22 bp, Homo sapiens
tgaaatggattgaagtggctta

SEQ ID NO: 7030032 - DNA, 22 bp, Homo sapiens
agcctattccaggatgagctca

SEQ ID NO: 7030033 - DNA, 22 bp, Homo sapiens
cttaggaacgctctgcctagtg

SEQ ID NO: 7030034 - DNA, 22 bp, Homo sapiens
aagatccaggcaaaagttggaa

SEQ ID NO: 7030035 - DNA, 22 bp, Homo sapiens
tgtattgaggattcatttttgt

SEQ ID NO: 7030036 - DNA, 22 bp, Homo sapiens
catgtgtgtggctgacaatttt

SEQ ID NO: 7030037 - DNA, 22 bp, Homo sapiens
ctctcaggcttgggtcgtggca

SEQ ID NO: 7030038 - DNA, 20 bp, Homo sapiens
agcaactctcacctggctgc

SEQ ID NO: 7030039 - DNA, 22 bp, Homo sapiens
acacactgctcgctcagattaa

SEQ ID NO: 7030040 - DNA, 22 bp, Homo sapiens
gagatttaattggattaactta

SEQ ID NO: 7030041 - DNA, 22 bp, Homo sapiens
tgtcacagggataccatggggc

SEQ ID NO: 7030042 - DNA, 22 bp, Homo sapiens
ctcccccttagctcttgtcttt

SEQ ID NO: 7030043 - DNA, 22 bp, Homo sapiens
tgctgcttggcaccctcagagt

SEQ ID NO: 7030044 - DNA, 20 bp, Homo sapiens
ttatgtgtacctgtgctccc

SEQ ID NO: 7030045 - DNA, 22 bp, Homo sapiens
tcactgaagactgggctctaaa

SEQ ID NO: 7030046 - DNA, 22 bp, Homo sapiens
ataccaaagcacatactgtttg

SEQ ID NO: 7030047 - DNA, 22 bp, Homo sapiens
ttggaggatgtcggcatattta

SEQ ID NO: 7030048 - DNA, 18 bp, Homo sapiens
agtctacactggttctta

SEQ ID NO: 7030049 - DNA, 22 bp, Homo sapiens
tctcagggcttttcttttgaat

SEQ ID NO: 7030050 - DNA, 22 bp, Homo sapiens
gcaggtctagaagctgcctctg

SEQ ID NO: 7030051 - DNA, 22 bp, Homo sapiens
cacacttttctggctcaggctc

SEQ ID NO: 7030052 - DNA, 22 bp, Homo sapiens
ttggcttgttaaaaatgcaatt

SEQ ID NO: 7030053 - DNA, 22 bp, Homo sapiens
attatggtaaagttaatatgta

SEQ ID NO: 7030054 - DNA, 22 bp, Homo sapiens
gttcagaaattaggagaataaa

SEQ ID NO: 7030055 - DNA, 22 bp, Homo sapiens
tctggcagctatcctctggcca

SEQ ID NO: 7030056 - DNA, 22 bp, Homo sapiens
cctaagaattaatgaatacacc

SEQ ID NO: 7030057 - DNA, 22 bp, Homo sapiens
tgagacaaaattgacagacaaa

SEQ ID NO: 7030058 - DNA, 22 bp, Homo sapiens
gaaagtgcctcagtcctcttat

SEQ ID NO: 7030059 - DNA, 22 bp, Homo sapiens
tgtaatggttaccaggtggggg

SEQ ID NO: 7030060 - DNA, 22 bp, Homo sapiens
gacttctgaattcctatcaggt

SEQ ID NO: 7030061 - DNA, 22 bp, Homo sapiens
tcttcattttatagcatctgtg

SEQ ID NO: 7030062 - DNA, 22 bp, Homo sapiens
tttgacaccaggagagaaaaca

SEQ ID NO: 7030063 - DNA, 22 bp, Homo sapiens
tgtcaacaaaacggttcaaatg

SEQ ID NO: 7030064 - DNA, 22 bp, Homo sapiens
atcatccatctagcgcgggggg

SEQ ID NO: 7030065 - DNA, 22 bp, Homo sapiens
tgcagtggtacaatttcggctc

SEQ ID NO: 7030066 - DNA, 22 bp, Homo sapiens
agctccctgcacgaccctgccc

SEQ ID NO: 7030067 - DNA, 23 bp, Homo sapiens
cttctcagaagtctgtgccagga

SEQ ID NO: 7030068 - DNA, 22 bp, Homo sapiens
ctgagatctttatacgaggcac

SEQ ID NO: 7030069 - DNA, 22 bp, Homo sapiens
gctgagcagcctaagcaaattt

SEQ ID NO: 7030070 - DNA, 22 bp, Homo sapiens
tcatgagttttctggtcacctt

SEQ ID NO: 7030071 - DNA, 22 bp, Homo sapiens
aggctaagaaagattcattgca

SEQ ID NO: 7030072 - DNA, 22 bp, Homo sapiens
gggctccatcggacttgggttt

SEQ ID NO: 7030073 - DNA, 18 bp, Homo sapiens
gacaggtgggtgagacca

SEQ ID NO: 7030074 - DNA, 22 bp, Homo sapiens
tctgcatcttctgcacatgcca

SEQ ID NO: 7030075 - DNA, 23 bp, Homo sapiens
cagttggaggtacagagacactg

SEQ ID NO: 7030076 - DNA, 22 bp, Homo sapiens
ggtgaagtatgaggaaatggag

SEQ ID NO: 7030077 - DNA, 22 bp, Homo sapiens
agtccatagaggctgctttcat

SEQ ID NO: 7030078 - DNA, 22 bp, Homo sapiens
ctttctagttgacagcatgcca

SEQ ID NO: 7030079 - DNA, 22 bp, Homo sapiens
tgacatcctacacccctgggtc

SEQ ID NO: 7030080 - DNA, 22 bp, Homo sapiens
tttgtcttccccctttaatcag

SEQ ID NO: 7030081 - DNA, 22 bp, Homo sapiens
aatgctgttgagttgttcctgt

SEQ ID NO: 7030082 - DNA, 22 bp, Homo sapiens
agtccaggcaagttgttgtgta

SEQ ID NO: 7030083 - DNA, 22 bp, Homo sapiens
tggagaattctatgttgagggg

SEQ ID NO: 7030084 - DNA, 22 bp, Homo sapiens
cacaattccatggcattctttg

SEQ ID NO: 7030085 - DNA, 22 bp, Homo sapiens
tagctctgtgctctggatctgt

SEQ ID NO: 7030086 - DNA, 22 bp, Homo sapiens
accagtgacttcattcctaaaa

SEQ ID NO: 7030087 - DNA, 22 bp, Homo sapiens
agggagacacatgaggaagtca

SEQ ID NO: 7030088 - DNA, 22 bp, Homo sapiens
gcaatttctgaggctgtccttc

SEQ ID NO: 7030089 - DNA, 22 bp, Homo sapiens
tgtctgtccttgtttggtatca

SEQ ID NO: 7030090 - DNA, 22 bp, Homo sapiens
ggcacagcacagtggacccagg

SEQ ID NO: 7030091 - DNA, 22 bp, Homo sapiens
agcagcccgaggatcatgtgtc

SEQ ID NO: 7030092 - DNA, 22 bp, Homo sapiens
tcatttcagatgcatttagaat

SEQ ID NO: 7030093 - DNA, 17 bp, Homo sapiens
aatgtccttggaccaca

SEQ ID NO: 7030094 - DNA, 22 bp, Homo sapiens
tctctgagtcaccgtggagacg

SEQ ID NO: 7030095 - DNA, 21 bp, Homo sapiens
ttaatttattcatgatagcta

SEQ ID NO: 7030096 - DNA, 23 bp, Homo sapiens
atccagcctgggggtttaaccac

SEQ ID NO: 7030097 - DNA, 22 bp, Homo sapiens
ttgctgaagtatgaaaaagaca

SEQ ID NO: 7030098 - DNA, 22 bp, Homo sapiens
ttcaagactccaagaaattagt

SEQ ID NO: 7030099 - DNA, 22 bp, Homo sapiens
cttccttcaatataatttttac

SEQ ID NO: 7030100 - DNA, 22 bp, Homo sapiens
atgttaagtttagcaggctagg

SEQ ID NO: 7030101 - DNA, 22 bp, Homo sapiens
cgtagcttcaggatgagggctt

SEQ ID NO: 7030102 - DNA, 22 bp, Homo sapiens
atttggctaattaaatttggag

SEQ ID NO: 7030103 - DNA, 22 bp, Homo sapiens
tttggcaaacttttaggacttt

SEQ ID NO: 7030104 - DNA, 22 bp, Homo sapiens
tactttgggtttagaataaact

SEQ ID NO: 7030105 - DNA, 22 bp, Homo sapiens
tgtggcccgatcttgggagaca

SEQ ID NO: 7030106 - DNA, 22 bp, Homo sapiens
ctgtgggcctagtctggcctag

SEQ ID NO: 7030107 - DNA, 22 bp, Homo sapiens
cgggctctcgccgagctatgtg

SEQ ID NO: 7030108 - DNA, 22 bp, Homo sapiens
ctgcctcagcgttgtggcccta

SEQ ID NO: 7030109 - DNA, 22 bp, Homo sapiens
tacagagatgccgaagagtgaa

SEQ ID NO: 7030110 - DNA, 22 bp, Homo sapiens
ttaggttggtgcaaaagtaatt

SEQ ID NO: 7030111 - DNA, 22 bp, Homo sapiens
tacagggacatggaacaggctc

SEQ ID NO: 7030112 - DNA, 22 bp, Homo sapiens
acccaggtggctctgacggggg

SEQ ID NO: 7030113 - DNA, 22 bp, Homo sapiens
accttccaggaatctgccagat

SEQ ID NO: 7030114 - DNA, 22 bp, Homo sapiens
tgttcacaggggagccatttat

SEQ ID NO: 7030115 - DNA, 19 bp, Homo sapiens
aagctccagcagatccttt

SEQ ID NO: 7030116 - DNA, 22 bp, Homo sapiens
ctgtggctgcgtaggtctggca

SEQ ID NO: 7030117 - DNA, 22 bp, Homo sapiens
tcccaggctaccagtgaggtca

SEQ ID NO: 7030118 - DNA, 22 bp, Homo sapiens
acacaatgtgcaggacacctgt

SEQ ID NO: 7030119 - DNA, 22 bp, Homo sapiens
taaatcttctacatcatcataa

SEQ ID NO: 7030120 - DNA, 22 bp, Homo sapiens
atccaaggcgcaagatggcgct

SEQ ID NO: 7030121 - DNA, 22 bp, Homo sapiens
ttggactcaaaaggagatttac

SEQ ID NO: 7030122 - DNA, 22 bp, Homo sapiens
acattctgtatcatctgtctca

SEQ ID NO: 7030123 - DNA, 22 bp, Homo sapiens
agagattctgtgtcaaaacgaa

SEQ ID NO: 7030124 - DNA, 22 bp, Homo sapiens
acaatgaagataatgttgcagt

SEQ ID NO: 7030125 - DNA, 22 bp, Homo sapiens
tggcctgcagctctcagggaag

SEQ ID NO: 7030126 - DNA, 23 bp, Homo sapiens
tgctaaaggcagaatattcacct

SEQ ID NO: 7030127 - DNA, 23 bp, Homo sapiens
ctggcttctggggcctctgtttc

SEQ ID NO: 7030128 - DNA, 22 bp, Homo sapiens
tatgcactggattacaaagcaa

SEQ ID NO: 7030129 - DNA, 22 bp, Homo sapiens
attattattgttgatgttaggg

SEQ ID NO: 7030130 - DNA, 22 bp, Homo sapiens
aacagtttgcctgaaatgtatt

SEQ ID NO: 7030131 - DNA, 22 bp, Homo sapiens
ctggggttggccagggccctag

SEQ ID NO: 7030132 - DNA, 22 bp, Homo sapiens
cagccaggcccccgagtcgttg

SEQ ID NO: 7030133 - DNA, 22 bp, Homo sapiens
tgctacaaattcgtaatcaatt

SEQ ID NO: 7030134 - DNA, 22 bp, Homo sapiens
tgcttctggcacttgagggggt

SEQ ID NO: 7030135 - DNA, 22 bp, Homo sapiens
agttcacagaatagtgccccac

SEQ ID NO: 7030136 - DNA, 22 bp, Homo sapiens
gcttgcacataagcacacactt

SEQ ID NO: 7030137 - DNA, 22 bp, Homo sapiens
aattcactccacttctgtgtct

SEQ ID NO: 7030138 - DNA, 22 bp, Homo sapiens
gaaaggaaattgagggacgcat

SEQ ID NO: 7030139 - DNA, 23 bp, Homo sapiens
tgggcccttggaatctctatttt

SEQ ID NO: 7030140 - DNA, 22 bp, Homo sapiens
tagaacttgaatgtgaaatcag

SEQ ID NO: 7030141 - DNA, 22 bp, Homo sapiens
tctgctcagcatccctctgaga

SEQ ID NO: 7030142 - DNA, 22 bp, Homo sapiens
attacaacaagaaaagggtaag

SEQ ID NO: 7030143 - DNA, 22 bp, Homo sapiens
ggctcaggatgagccttctcat

SEQ ID NO: 7030144 - DNA, 22 bp, Homo sapiens
cagggtgactgccctggccact

SEQ ID NO: 7030145 - DNA, 22 bp, Homo sapiens
atggattcaagtcccagtctga

SEQ ID NO: 7030146 - DNA, 22 bp, Homo sapiens
cctgagagccctagccaggcgc

SEQ ID NO: 7030147 - DNA, 22 bp, Homo sapiens
aacagcttgctgcaccttaata

SEQ ID NO: 7030148 - DNA, 22 bp, Homo sapiens
tctacagtagaaagatcccagt

SEQ ID NO: 7030149 - DNA, 22 bp, Homo sapiens
gaggtctgccttcaggagagtt

SEQ ID NO: 7030150 - DNA, 22 bp, Homo sapiens
ggactgtgaggtctgggtgagg

SEQ ID NO: 7030151 - DNA, 22 bp, Homo sapiens
tctgggtggcttcagaggccac

SEQ ID NO: 7030152 - DNA, 22 bp, Homo sapiens
aaattattatgcccctctataa

SEQ ID NO: 7030153 - DNA, 22 bp, Homo sapiens
tgccacacattgtcaggttagt

SEQ ID NO: 7030154 - DNA, 22 bp, Homo sapiens
tgggcagagagtagaggcaacg

SEQ ID NO: 7030155 - DNA, 22 bp, Homo sapiens
aacaacaacggagaaagggttg

SEQ ID NO: 7030156 - DNA, 22 bp, Homo sapiens
caggaagctgggtttccataca

SEQ ID NO: 7030157 - DNA, 22 bp, Homo sapiens
tgcggagggagcagtcggctgt

SEQ ID NO: 7030158 - DNA, 22 bp, Homo sapiens
acatatatgtgcacatgtgcag

SEQ ID NO: 7030159 - DNA, 22 bp, Homo sapiens
ctgggcagagctaacacctgag

SEQ ID NO: 7030160 - DNA, 22 bp, Homo sapiens
agaatgctaaatggattcttct

SEQ ID NO: 7030161 - DNA, 22 bp, Homo sapiens
agagctgttaattttgcactgg

SEQ ID NO: 7030162 - DNA, 22 bp, Homo sapiens
atcaagaaaagtgctttcggct

SEQ ID NO: 7030163 - DNA, 22 bp, Homo sapiens
gacagcctcatgaggagcaaaa

SEQ ID NO: 7030164 - DNA, 22 bp, Homo sapiens
tcctgagcacagagacaaggaa

SEQ ID NO: 7030165 - DNA, 22 bp, Homo sapiens
ataagcatgattaccgggagca

SEQ ID NO: 7030166 - DNA, 22 bp, Homo sapiens
tggctgagccacttgttcagat

SEQ ID NO: 7030167 - DNA, 22 bp, Homo sapiens
cattgttctggagaaggttcca

SEQ ID NO: 7030168 - DNA, 21 bp, Homo sapiens
ggaacattgttaatagtctct

SEQ ID NO: 7030169 - DNA, 22 bp, Homo sapiens
gttttgatatatgcatacatta

SEQ ID NO: 7030170 - DNA, 22 bp, Homo sapiens
gcgcacatgttcagatgtgtga

SEQ ID NO: 7030171 - DNA, 22 bp, Homo sapiens
ctgttatagctgtttgtattct

SEQ ID NO: 7030172 - DNA, 22 bp, Homo sapiens
cagattctgggcccagcttgtc

SEQ ID NO: 7030173 - DNA, 22 bp, Homo sapiens
gggctgatgatgagcagaggtg

SEQ ID NO: 7030174 - DNA, 22 bp, Homo sapiens
gatttgacacctggggcatata

SEQ ID NO: 7030175 - DNA, 22 bp, Homo sapiens
agaaatgcagtttcaagacaaa

SEQ ID NO: 7030176 - DNA, 22 bp, Homo sapiens
tctgtgtctggttgggccagta

SEQ ID NO: 7030177 - DNA, 22 bp, Homo sapiens
atttctcaggactccatgggcg

SEQ ID NO: 7030178 - DNA, 18 bp, Homo sapiens
tggagacatagacaatgt

SEQ ID NO: 7030179 - DNA, 22 bp, Homo sapiens
gaggcaggccctgaatgagtca

SEQ ID NO: 7030180 - DNA, 22 bp, Homo sapiens
tccagccctgcttcctgcctca

SEQ ID NO: 7030181 - DNA, 22 bp, Homo sapiens
aaagttttatatgctgcagcga

SEQ ID NO: 7030182 - DNA, 22 bp, Homo sapiens
gagcccagcccagagccatatg

SEQ ID NO: 7030183 - DNA, 22 bp, Homo sapiens
gagggagtaacgtactacagtg

SEQ ID NO: 7030184 - DNA, 22 bp, Homo sapiens
ccacattgactgtctgtagatt

SEQ ID NO: 7030185 - DNA, 21 bp, Homo sapiens
gctgagaggttgggaagttca

SEQ ID NO: 7030186 - DNA, 22 bp, Homo sapiens
ttagttagggctcctgaggacc

SEQ ID NO: 7030187 - DNA, 20 bp, Homo sapiens
tgtttctttaaggtgagaca

SEQ ID NO: 7030188 - DNA, 22 bp, Homo sapiens
gtggctcacacctgtaatccca

SEQ ID NO: 7030189 - DNA, 22 bp, Homo sapiens
agctgcagcactccagtagccg

SEQ ID NO: 7030190 - DNA, 22 bp, Homo sapiens
agaggctcactcttggaaccca

SEQ ID NO: 7030191 - DNA, 22 bp, Homo sapiens
attagcaaggcagcatcaggca

SEQ ID NO: 7030192 - DNA, 22 bp, Homo sapiens
agtcagcttgtctctagggttg

SEQ ID NO: 7030193 - DNA, 22 bp, Homo sapiens
tattcctagacctcacccgaga

SEQ ID NO: 7030194 - DNA, 17 bp, Homo sapiens
gaagtgtttcttcatga

SEQ ID NO: 7030195 - DNA, 22 bp, Homo sapiens
gattctggattgtctgcttgaa

SEQ ID NO: 7030196 - DNA, 22 bp, Homo sapiens
cactcagcccacccatgtttgt

SEQ ID NO: 7030197 - DNA, 22 bp, Homo sapiens
aggagacagccaggggcctgag

SEQ ID NO: 7030198 - DNA, 23 bp, Homo sapiens
tctttcctaatgaaacagtgaaa

SEQ ID NO: 7030199 - DNA, 22 bp, Homo sapiens
agcaagcagaattctgtcctct

SEQ ID NO: 7030200 - DNA, 22 bp, Homo sapiens
ggcccttggagcctccacagtg

SEQ ID NO: 7030201 - DNA, 22 bp, Homo sapiens
acatttgagatgccttttaggt

SEQ ID NO: 7030202 - DNA, 22 bp, Homo sapiens
atgtcatgggccaaaaatagtt

SEQ ID NO: 7030203 - DNA, 22 bp, Homo sapiens
ttgcaaataatagcctgaaact

SEQ ID NO: 7030204 - DNA, 21 bp, Homo sapiens
aagtttggaagaaagcaaggg

SEQ ID NO: 7030205 - DNA, 22 bp, Homo sapiens
aagacctgggagagattgggtt

SEQ ID NO: 7030206 - DNA, 22 bp, Homo sapiens
agcatgaaagcataggacagtc

SEQ ID NO: 7030207 - DNA, 22 bp, Homo sapiens
aaagactaagaagagtattatt

SEQ ID NO: 7030208 - DNA, 22 bp, Homo sapiens
acagggccttatatccagaagg

SEQ ID NO: 7030209 - DNA, 17 bp, Homo sapiens
tgttctcttcagaaatc

SEQ ID NO: 7030210 - DNA, 22 bp, Homo sapiens
tgcacacatgtttacaagcatc

SEQ ID NO: 7030211 - DNA, 22 bp, Homo sapiens
tttcagtgtatcttccaaaagc

SEQ ID NO: 7030212 - DNA, 22 bp, Homo sapiens
agtctacaaatcaccttgtcct

SEQ ID NO: 7030213 - DNA, 22 bp, Homo sapiens
tttagttttgatgaaaatgcca

SEQ ID NO: 7030214 - DNA, 22 bp, Homo sapiens
tgtaggcctatgtccagcaatt

SEQ ID NO: 7030215 - DNA, 22 bp, Homo sapiens
taccctgaagtagctctttccc

SEQ ID NO: 7030216 - DNA, 22 bp, Homo sapiens
tgtgtaaagcttgttccagaaa

SEQ ID NO: 7030217 - DNA, 22 bp, Homo sapiens
cagtgcttttttaccttccaac

SEQ ID NO: 7030218 - DNA, 22 bp, Homo sapiens
agcctgtgacattgactatgaa

SEQ ID NO: 7030219 - DNA, 23 bp, Homo sapiens
tgtacagttgtttgactcagctc

SEQ ID NO: 7030220 - DNA, 22 bp, Homo sapiens
tgagtcaccttggtattggcag

SEQ ID NO: 7030221 - DNA, 22 bp, Homo sapiens
gtaggggtgctgagatctggaa

SEQ ID NO: 7030222 - DNA, 23 bp, Homo sapiens
ccactgatgcattttctctctgt

SEQ ID NO: 7030223 - DNA, 22 bp, Homo sapiens
tatgtctggaccactgcagccc

SEQ ID NO: 7030224 - DNA, 22 bp, Homo sapiens
tgccagtgaaacgtggtctcat

SEQ ID NO: 7030225 - DNA, 22 bp, Homo sapiens
aataagtgagtttagcaagttt

SEQ ID NO: 7030226 - DNA, 22 bp, Homo sapiens
ggctgtggggggagcctgcccg

SEQ ID NO: 7030227 - DNA, 22 bp, Homo sapiens
ggggtggctggcacctcctggt

SEQ ID NO: 7030228 - DNA, 22 bp, Homo sapiens
aaagcgtaagttatattctgta

SEQ ID NO: 7030229 - DNA, 22 bp, Homo sapiens
ttacagaggtatgtatgtctct

SEQ ID NO: 7030230 - DNA, 22 bp, Homo sapiens
tccattaacacctgtacgtggc

SEQ ID NO: 7030231 - DNA, 22 bp, Homo sapiens
cttagctagtgctcagctgtca

SEQ ID NO: 7030232 - DNA, 22 bp, Homo sapiens
agaggccctggctagagcagct

SEQ ID NO: 7030233 - DNA, 22 bp, Homo sapiens
ttggctgaccagaacctgcccc

SEQ ID NO: 7030234 - DNA, 22 bp, Homo sapiens
gcagtggtgggacagtggaaaa

SEQ ID NO: 7030235 - DNA, 22 bp, Homo sapiens
aagttatgctgaagaatatgag

SEQ ID NO: 7030236 - DNA, 22 bp, Homo sapiens
atcacagtggcagggatttggg

SEQ ID NO: 7030237 - DNA, 22 bp, Homo sapiens
ggccagtgaccagtaaccagtg

SEQ ID NO: 7030238 - DNA, 22 bp, Homo sapiens
aatttgtatacatgttacattt

SEQ ID NO: 7030239 - DNA, 22 bp, Homo sapiens
ttattctgtatttcaggtatgt

SEQ ID NO: 7030240 - DNA, 18 bp, Homo sapiens
gaagttagtggtgtgcta

SEQ ID NO: 7030241 - DNA, 22 bp, Homo sapiens
ctgagagactgtttgtaatatt

SEQ ID NO: 7030242 - DNA, 22 bp, Homo sapiens
taaatcctttttgagggtatca

SEQ ID NO: 7030243 - DNA, 22 bp, Homo sapiens
gttcatctcacagataggcagt

SEQ ID NO: 7030244 - DNA, 22 bp, Homo sapiens
cagaaagacctgggctcaagag

SEQ ID NO: 7030245 - DNA, 22 bp, Homo sapiens
acacttatttcttgtctaacca

SEQ ID NO: 7030246 - DNA, 20 bp, Homo sapiens
gccaagaatatgcccgactc

SEQ ID NO: 7030247 - DNA, 22 bp, Homo sapiens
ttcctctagcttctcactaaca

SEQ ID NO: 7030248 - DNA, 22 bp, Homo sapiens
acacagattttacatgttatgc

SEQ ID NO: 7030249 - DNA, 18 bp, Homo sapiens
tatcactgctgaacaaga

SEQ ID NO: 7030250 - DNA, 22 bp, Homo sapiens
tctgtttcacgtcctgaatctc

SEQ ID NO: 7030251 - DNA, 22 bp, Homo sapiens
atgttagttgaattgaggagtg

SEQ ID NO: 7030252 - DNA, 22 bp, Homo sapiens
gaccctggctgccgcggtctgg

SEQ ID NO: 7030253 - DNA, 22 bp, Homo sapiens
cacttgaactgtttgaatgaga

SEQ ID NO: 7030254 - DNA, 22 bp, Homo sapiens
ttccagaggagtgattcagagg

SEQ ID NO: 7030255 - DNA, 20 bp, Homo sapiens
gcttcttttctggcccatga

SEQ ID NO: 7030256 - DNA, 22 bp, Homo sapiens
actgctcacgcattacttgagc

SEQ ID NO: 7030257 - DNA, 22 bp, Homo sapiens
ttctggaggacaactgttttca

SEQ ID NO: 7030258 - DNA, 22 bp, Homo sapiens
ccctggcaaaacactctcttga

SEQ ID NO: 7030259 - DNA, 22 bp, Homo sapiens
tgagaagagcaaggaactggtt

SEQ ID NO: 7030260 - DNA, 22 bp, Homo sapiens
tgtttcagtccacttaggcagc

SEQ ID NO: 7030261 - DNA, 22 bp, Homo sapiens
actgtctgcacccgaggaggcc

SEQ ID NO: 7030262 - DNA, 22 bp, Homo sapiens
accaggagtaacagtgagtggt

SEQ ID NO: 7030263 - DNA, 22 bp, Homo sapiens
cattttctcaatgaaccctctt

SEQ ID NO: 7030264 - DNA, 22 bp, Homo sapiens
gaatcaatggtagattaagtaa

SEQ ID NO: 7030265 - DNA, 19 bp, Homo sapiens
cagttacaggcactgtggg

SEQ ID NO: 7030266 - DNA, 22 bp, Homo sapiens
gttgacaggaaggcgttcccag

SEQ ID NO: 7030267 - DNA, 22 bp, Homo sapiens
tggctccagaagggagggcgcc

SEQ ID NO: 7030268 - DNA, 22 bp, Homo sapiens
aggtatgagagccactctgtag

SEQ ID NO: 7030269 - DNA, 21 bp, Homo sapiens
agctgcaggcctcccagggat

SEQ ID NO: 7030270 - DNA, 22 bp, Homo sapiens
catgaaattcagcaggtgagta

SEQ ID NO: 7030271 - DNA, 22 bp, Homo sapiens
aagagcagaagtccttggatcc

SEQ ID NO: 7030272 - DNA, 19 bp, Homo sapiens
cttttcaagccatcagttt

SEQ ID NO: 7030273 - DNA, 20 bp, Homo sapiens
agcttcattatagcccacag

SEQ ID NO: 7030274 - DNA, 22 bp, Homo sapiens
taacaagtcattttatcagcag

SEQ ID NO: 7030275 - DNA, 22 bp, Homo sapiens
caggatcctggctgcatggacg

SEQ ID NO: 7030276 - DNA, 18 bp, Homo sapiens
ctcctttccctacacctc

SEQ ID NO: 7030277 - DNA, 22 bp, Homo sapiens
tgtctcagatacgccatcaagg

SEQ ID NO: 7030278 - DNA, 22 bp, Homo sapiens
atttttccaattaggataaaga

SEQ ID NO: 7030279 - DNA, 22 bp, Homo sapiens
taaagcagtgtggttgtgtccc

SEQ ID NO: 7030280 - DNA, 22 bp, Homo sapiens
tttctaaggaaagtacctggga

SEQ ID NO: 7030281 - DNA, 22 bp, Homo sapiens
aaggccaggacaccaggggact

SEQ ID NO: 7030282 - DNA, 22 bp, Homo sapiens
tggactaataggagaaaacaag

SEQ ID NO: 7030283 - DNA, 22 bp, Homo sapiens
agtgttcatttattcattcact

SEQ ID NO: 7030284 - DNA, 22 bp, Homo sapiens
cagtgcctgtcttattcttaca

SEQ ID NO: 7030285 - DNA, 18 bp, Homo sapiens
gtttcctgtcttacgggg

SEQ ID NO: 7030286 - DNA, 22 bp, Homo sapiens
tggcggctttaattatcacttg

SEQ ID NO: 7030287 - DNA, 22 bp, Homo sapiens
gaggctcacgacgggacgaact

SEQ ID NO: 7030288 - DNA, 17 bp, Homo sapiens
ccctgcaccctactctc

SEQ ID NO: 7030289 - DNA, 22 bp, Homo sapiens
accagctctttcttttcactat

SEQ ID NO: 7030290 - DNA, 19 bp, Homo sapiens
actgtaaggcatttttttc

SEQ ID NO: 7030291 - DNA, 22 bp, Homo sapiens
cctcagaatagtcctcagatca

SEQ ID NO: 7030292 - DNA, 22 bp, Homo sapiens
agggagcagggctcctttgggt

SEQ ID NO: 7030293 - DNA, 22 bp, Homo sapiens
tccatccaccctgcattatatt

SEQ ID NO: 7030294 - DNA, 18 bp, Homo sapiens
caaattcagtgctggaag

SEQ ID NO: 7030295 - DNA, 22 bp, Homo sapiens
aggtgggaacccagcagggccc

SEQ ID NO: 7030296 - DNA, 22 bp, Homo sapiens
gtgaagaaggcaatacaaagaa

SEQ ID NO: 7030297 - DNA, 22 bp, Homo sapiens
tccttaaatgtgatctagattt

SEQ ID NO: 7030298 - DNA, 22 bp, Homo sapiens
agctacccgaggacaggctaag

SEQ ID NO: 7030299 - DNA, 22 bp, Homo sapiens
acttgcttgggccatctcgctt

SEQ ID NO: 7030300 - DNA, 18 bp, Homo sapiens
tcaaaatatttctgtgga

SEQ ID NO: 7030301 - DNA, 22 bp, Homo sapiens
cgcccccagggcctcgagcatg

SEQ ID NO: 7030302 - DNA, 22 bp, Homo sapiens
cctatgtctcatgggataagac

SEQ ID NO: 7030303 - DNA, 22 bp, Homo sapiens
gggaatgaggcagatagataaa

SEQ ID NO: 7030304 - DNA, 22 bp, Homo sapiens
tctggagcaacagagcaggaca

SEQ ID NO: 7030305 - DNA, 17 bp, Homo sapiens
tgtttggttgattggtg

SEQ ID NO: 7030306 - DNA, 22 bp, Homo sapiens
gctgtcagtgaggtgagacatg

SEQ ID NO: 7030307 - DNA, 22 bp, Homo sapiens
tacaagctcgggcagctcatta

SEQ ID NO: 7030308 - DNA, 22 bp, Homo sapiens
actctgcctgcggtgggcggga

SEQ ID NO: 7030309 - DNA, 22 bp, Homo sapiens
gtgatggatgtgtatcttttta

SEQ ID NO: 7030310 - DNA, 22 bp, Homo sapiens
ttatgaaggatcaggtacttgg

SEQ ID NO: 7030311 - DNA, 22 bp, Homo sapiens
gagacttaggcaagtcacttag

SEQ ID NO: 7030312 - DNA, 22 bp, Homo sapiens
ggctaatatacccagctctgta

SEQ ID NO: 7030313 - DNA, 20 bp, Homo sapiens
ttctgggatgcctgcatctt

SEQ ID NO: 7030314 - DNA, 22 bp, Homo sapiens
tcacacagctcctttccttagt

SEQ ID NO: 7030315 - DNA, 22 bp, Homo sapiens
ccctggtgtggatgtgattggc

SEQ ID NO: 7030316 - DNA, 22 bp, Homo sapiens
ttcattcagtgcatttgggaga

SEQ ID NO: 7030317 - DNA, 22 bp, Homo sapiens
accctgctttatgccgtcctct

SEQ ID NO: 7030318 - DNA, 22 bp, Homo sapiens
agcttaaactctttgaagttat

SEQ ID NO: 7030319 - DNA, 22 bp, Homo sapiens
tgcacctgctcagactcctgtc

SEQ ID NO: 7030320 - DNA, 22 bp, Homo sapiens
ctggcacttggcacccatgaaa

SEQ ID NO: 7030321 - DNA, 22 bp, Homo sapiens
agaatgtctaagtgttcagccc

SEQ ID NO: 7030322 - DNA, 22 bp, Homo sapiens
ccctttttcactctaccaaggt

SEQ ID NO: 7030323 - DNA, 22 bp, Homo sapiens
ctggacttggagtcagaaaact

SEQ ID NO: 7030324 - DNA, 22 bp, Homo sapiens
ttggcctgctccagagaggcca

SEQ ID NO: 7030325 - DNA, 22 bp, Homo sapiens
tgtgacagaattggtctgttct

SEQ ID NO: 7030326 - DNA, 22 bp, Homo sapiens
ttgaggctgcacagtacaggct

SEQ ID NO: 7030327 - DNA, 22 bp, Homo sapiens
ccaggttcaaatagctgtgtga

SEQ ID NO: 7030328 - DNA, 22 bp, Homo sapiens
gcctcaggactggcatactcat

SEQ ID NO: 7030329 - DNA, 20 bp, Homo sapiens
tggagctgtggtaaggagca

SEQ ID NO: 7030330 - DNA, 22 bp, Homo sapiens
gatgttcggcgattgggggtgg

SEQ ID NO: 7030331 - DNA, 22 bp, Homo sapiens
aggcccagagagccagttagtg

SEQ ID NO: 7030332 - DNA, 22 bp, Homo sapiens
cttggtgcattactcaatctgt

SEQ ID NO: 7030333 - DNA, 22 bp, Homo sapiens
tttcaaggatgttatataaatg

SEQ ID NO: 7030334 - DNA, 22 bp, Homo sapiens
gctgagaatcaagatggagagg

SEQ ID NO: 7030335 - DNA, 22 bp, Homo sapiens
agtggccactgacttggaaatc

SEQ ID NO: 7030336 - DNA, 22 bp, Homo sapiens
tccctgaaacatctctgtggat

SEQ ID NO: 7030337 - DNA, 22 bp, Homo sapiens
aggaggccaggccctcaagcct

SEQ ID NO: 7030338 - DNA, 22 bp, Homo sapiens
tcttccaaatgaatatggtttt

SEQ ID NO: 7030339 - DNA, 22 bp, Homo sapiens
tggcagcattttttccagaaca

SEQ ID NO: 7030340 - DNA, 22 bp, Homo sapiens
gaagccacagagattgtggggg

SEQ ID NO: 7030341 - DNA, 22 bp, Homo sapiens
gaatctcagtggaagcaggaag

SEQ ID NO: 7030342 - DNA, 22 bp, Homo sapiens
agccagggttagaagatagtca

SEQ ID NO: 7030343 - DNA, 23 bp, Homo sapiens
acacatgtttatgcttgggggca

SEQ ID NO: 7030344 - DNA, 22 bp, Homo sapiens
tggagctgagagccaggctggc

SEQ ID NO: 7030345 - DNA, 22 bp, Homo sapiens
ctccatggaaaaggctgttgtt

SEQ ID NO: 7030346 - DNA, 20 bp, Homo sapiens
tgcctataaagggccaggta

SEQ ID NO: 7030347 - DNA, 22 bp, Homo sapiens
tcatggcattgttaagggtttt

SEQ ID NO: 7030348 - DNA, 22 bp, Homo sapiens
cttgtattaagcttagagaggc

SEQ ID NO: 7030349 - DNA, 22 bp, Homo sapiens
agaatattgaaagttcttgaca

SEQ ID NO: 7030350 - DNA, 22 bp, Homo sapiens
gcacttctatttttttcagtgg

SEQ ID NO: 7030351 - DNA, 21 bp, Homo sapiens
atgggccagggatacagagag

SEQ ID NO: 7030352 - DNA, 22 bp, Homo sapiens
cacagcaggcagaacgtgggca

SEQ ID NO: 7030353 - DNA, 22 bp, Homo sapiens
cattatggcagccaggatattg

SEQ ID NO: 7030354 - DNA, 22 bp, Homo sapiens
agaggctgtctcatattttgta

SEQ ID NO: 7030355 - DNA, 22 bp, Homo sapiens
ggactttaattctttcctaagc

SEQ ID NO: 7030356 - DNA, 22 bp, Homo sapiens
aggcttgatttgtcctgcttaa

SEQ ID NO: 7030357 - DNA, 22 bp, Homo sapiens
tctgtggcatgttgcacttgta

SEQ ID NO: 7030358 - DNA, 22 bp, Homo sapiens
gacatcaggcctgcagtctggg

SEQ ID NO: 7030359 - DNA, 22 bp, Homo sapiens
ctctggctgcggggcgcgtgga

SEQ ID NO: 7030360 - DNA, 22 bp, Homo sapiens
agtacagatttctgggccctac

SEQ ID NO: 7030361 - DNA, 22 bp, Homo sapiens
atgagtgctgggcctccacccc

SEQ ID NO: 7030362 - DNA, 22 bp, Homo sapiens
ctttgcagagggggtgggagct

SEQ ID NO: 7030363 - DNA, 22 bp, Homo sapiens
atttgtcaataagatgaacata

SEQ ID NO: 7030364 - DNA, 22 bp, Homo sapiens
ctttgaagagattactgtgctc

SEQ ID NO: 7030365 - DNA, 22 bp, Homo sapiens
gtggcaggttataagcatctca

SEQ ID NO: 7030366 - DNA, 22 bp, Homo sapiens
tttattgttgttagtcataagt

SEQ ID NO: 7030367 - DNA, 22 bp, Homo sapiens
cttgtacagggaggcctgtggt

SEQ ID NO: 7030368 - DNA, 20 bp, Homo sapiens
cccaggcagagctagcggca

SEQ ID NO: 7030369 - DNA, 22 bp, Homo sapiens
aagtgattgttccgttgagtgt

SEQ ID NO: 7030370 - DNA, 22 bp, Homo sapiens
aaaggttttctagggttgaggg

SEQ ID NO: 7030371 - DNA, 22 bp, Homo sapiens
gttttatgagacctcaggaata

SEQ ID NO: 7030372 - DNA, 22 bp, Homo sapiens
tgcacacatatgagcatgtgtg

SEQ ID NO: 7030373 - DNA, 22 bp, Homo sapiens
ctgcctggcatggagaagagaa

SEQ ID NO: 7030374 - DNA, 22 bp, Homo sapiens
ttggaattgtgaactaagtgat

SEQ ID NO: 7030375 - DNA, 22 bp, Homo sapiens
actggctgcgatcttggcgctt

SEQ ID NO: 7030376 - DNA, 22 bp, Homo sapiens
taggcatgcaaataaatgtgca

SEQ ID NO: 7030377 - DNA, 22 bp, Homo sapiens
aaggtgccacagttcttttagc

SEQ ID NO: 7030378 - DNA, 22 bp, Homo sapiens
atagaacaggggcaggagcatt

SEQ ID NO: 7030379 - DNA, 20 bp, Homo sapiens
agactcagtttctatgctct

SEQ ID NO: 7030380 - DNA, 22 bp, Homo sapiens
ttcatagggagagtggtggaaa

SEQ ID NO: 7030381 - DNA, 22 bp, Homo sapiens
tcttctgatgccagtaaccatg

SEQ ID NO: 7030382 - DNA, 22 bp, Homo sapiens
cataacattattttctgaagat

SEQ ID NO: 7030383 - DNA, 22 bp, Homo sapiens
ttgactctggaggtcactgaag

SEQ ID NO: 7030384 - DNA, 20 bp, Homo sapiens
cagctagtggtaggagtcgg

SEQ ID NO: 7030385 - DNA, 22 bp, Homo sapiens
tggaggcatttgatgttcataa

SEQ ID NO: 7030386 - DNA, 22 bp, Homo sapiens
gtcagtaaatcttgttatgaag

SEQ ID NO: 7030387 - DNA, 22 bp, Homo sapiens
ttccagctcttgaaggtgggat

SEQ ID NO: 7030388 - DNA, 22 bp, Homo sapiens
caaagtcatggggatgcaggtc

SEQ ID NO: 7030389 - DNA, 22 bp, Homo sapiens
tccaaagcatctgagtgtgcat

SEQ ID NO: 7030390 - DNA, 22 bp, Homo sapiens
gtcaggatttacaaacttcagt

SEQ ID NO: 7030391 - DNA, 23 bp, Homo sapiens
aattaaattgctagatccagggc

SEQ ID NO: 7030392 - DNA, 22 bp, Homo sapiens
tattcacagctgccgcactcag

SEQ ID NO: 7030393 - DNA, 22 bp, Homo sapiens
acatttattttggcacggcaca

SEQ ID NO: 7030394 - DNA, 22 bp, Homo sapiens
tcatccatgtgcaaactttggt

SEQ ID NO: 7030395 - DNA, 22 bp, Homo sapiens
tgaggggggtaatcactgggtt

SEQ ID NO: 7030396 - DNA, 22 bp, Homo sapiens
atgtagacctttctttgtgatt

SEQ ID NO: 7030397 - DNA, 21 bp, Homo sapiens
tggctttgccctgcttgcccc

SEQ ID NO: 7030398 - DNA, 22 bp, Homo sapiens
caataatatcctgtgctgtttg

SEQ ID NO: 7030399 - DNA, 22 bp, Homo sapiens
tgatgttcagtgaagaggaccg

SEQ ID NO: 7030400 - DNA, 22 bp, Homo sapiens
tttgcagttccatccaggcaga

SEQ ID NO: 7030401 - DNA, 18 bp, Homo sapiens
atcctgggccagtctttc

SEQ ID NO: 7030402 - DNA, 22 bp, Homo sapiens
aatagcatgttaataaccagag

SEQ ID NO: 7030403 - DNA, 22 bp, Homo sapiens
atatggcattacattgttaaat

SEQ ID NO: 7030404 - DNA, 22 bp, Homo sapiens
cagcctgcagggctgcctgttg

SEQ ID NO: 7030405 - DNA, 22 bp, Homo sapiens
atatactgtgttccatggacca

SEQ ID NO: 7030406 - DNA, 22 bp, Homo sapiens
agtgtggaccttcacacagaga

SEQ ID NO: 7030407 - DNA, 22 bp, Homo sapiens
tgaggacaatccctaactcaga

SEQ ID NO: 7030408 - DNA, 20 bp, Homo sapiens
aagaaggcctgcccagacac

SEQ ID NO: 7030409 - DNA, 22 bp, Homo sapiens
tgctccaggcaagctgagagtt

SEQ ID NO: 7030410 - DNA, 22 bp, Homo sapiens
tccaggctagcctggtagagaa

SEQ ID NO: 7030411 - DNA, 22 bp, Homo sapiens
aagatacatcattcaggagtga

SEQ ID NO: 7030412 - DNA, 22 bp, Homo sapiens
tttgtgtgcttggtattgaaga

SEQ ID NO: 7030413 - DNA, 22 bp, Homo sapiens
actacagtactatatctatagg

SEQ ID NO: 7030414 - DNA, 22 bp, Homo sapiens
gcaggacaggcgttggtccagt

SEQ ID NO: 7030415 - DNA, 22 bp, Homo sapiens
agcctctggtcctccctcagct

SEQ ID NO: 7030416 - DNA, 21 bp, Homo sapiens
tttagaggacacagggaggca

SEQ ID NO: 7030417 - DNA, 22 bp, Homo sapiens
ttataagctctgaaatctccta

SEQ ID NO: 7030418 - DNA, 22 bp, Homo sapiens
tggggaggatatgtgagttatt

SEQ ID NO: 7030419 - DNA, 18 bp, Homo sapiens
accttgatggcagcttgc

SEQ ID NO: 7030420 - DNA, 22 bp, Homo sapiens
gtccagagaagggaggggactc

SEQ ID NO: 7030421 - DNA, 22 bp, Homo sapiens
aacaccgcaattacttttgtgc

SEQ ID NO: 7030422 - DNA, 22 bp, Homo sapiens
cagcatggccatttctcgctgc

SEQ ID NO: 7030423 - DNA, 22 bp, Homo sapiens
aatagatgggttaaacagcaaa

SEQ ID NO: 7030424 - DNA, 22 bp, Homo sapiens
gatcattaacaaccttaccctt

SEQ ID NO: 7030425 - DNA, 22 bp, Homo sapiens
gctgtcacaaattgggttcttt

SEQ ID NO: 7030426 - DNA, 22 bp, Homo sapiens
ccagggttggtattcacctgga

SEQ ID NO: 7030427 - DNA, 22 bp, Homo sapiens
atgtccttaatctgaatgttag

SEQ ID NO: 7030428 - DNA, 22 bp, Homo sapiens
aacaaaggccgttaataaccac

SEQ ID NO: 7030429 - DNA, 16 bp, Homo sapiens
cctgggctctgttgga

SEQ ID NO: 7030430 - DNA, 22 bp, Homo sapiens
gatatgtttaatgcctcagtat

SEQ ID NO: 7030431 - DNA, 22 bp, Homo sapiens
acacatggtctacttcttctca

SEQ ID NO: 7030432 - DNA, 22 bp, Homo sapiens
tggcctgccttcgctgagctga

SEQ ID NO: 7030433 - DNA, 19 bp, Homo sapiens
aggtctaatcataagacaa

SEQ ID NO: 7030434 - DNA, 22 bp, Homo sapiens
ctgtctggatataccttggcca

SEQ ID NO: 7030435 - DNA, 22 bp, Homo sapiens
agtttctctcagtatagaatag

SEQ ID NO: 7030436 - DNA, 22 bp, Homo sapiens
aatttgtgttatacctgctcct

SEQ ID NO: 7030437 - DNA, 22 bp, Homo sapiens
atccatgaaggtacttctcagg

SEQ ID NO: 7030438 - DNA, 22 bp, Homo sapiens
ctaagcaagttccactctacaa

SEQ ID NO: 7030439 - DNA, 17 bp, Homo sapiens
ccagctgctccctcaga

SEQ ID NO: 7030440 - DNA, 22 bp, Homo sapiens
taaatgtgcactttacttttca

SEQ ID NO: 7030441 - DNA, 22 bp, Homo sapiens
gaaggtttactgaagatttaaa

SEQ ID NO: 7030442 - DNA, 22 bp, Homo sapiens
ctagcagtgtactcaacaaggg

SEQ ID NO: 7030443 - DNA, 22 bp, Homo sapiens
actggtctagaagggagaagac

SEQ ID NO: 7030444 - DNA, 22 bp, Homo sapiens
tggtgcccttgacagagccagc

SEQ ID NO: 7030445 - DNA, 22 bp, Homo sapiens
aaagtttgtcacttggctagaa

SEQ ID NO: 7030446 - DNA, 22 bp, Homo sapiens
agtctacaaagggaagcccttt

SEQ ID NO: 7030447 - DNA, 22 bp, Homo sapiens
ctttggtgttcattaaacatgg

SEQ ID NO: 7030448 - DNA, 22 bp, Homo sapiens
aaattagaaatactttcaaagc

SEQ ID NO: 7030449 - DNA, 22 bp, Homo sapiens
aagtggctcatgtggcttctgc

SEQ ID NO: 7030450 - DNA, 22 bp, Homo sapiens
cttaaaagttgcttccctaact

SEQ ID NO: 7030451 - DNA, 22 bp, Homo sapiens
gtgtacatgagaaatcaacttt

SEQ ID NO: 7030452 - DNA, 22 bp, Homo sapiens
agttggatggattggaatgaag

SEQ ID NO: 7030453 - DNA, 22 bp, Homo sapiens
agcagcctggacttggatgtgg

SEQ ID NO: 7030454 - DNA, 21 bp, Homo sapiens
cgcagagcgaacttgcggcgc

SEQ ID NO: 7030455 - DNA, 22 bp, Homo sapiens
gctgggccccatccctcgagca

SEQ ID NO: 7030456 - DNA, 22 bp, Homo sapiens
tggagtcagaatgcgacaggcc

SEQ ID NO: 7030457 - DNA, 22 bp, Homo sapiens
cccagcagtttgcttagagtga

SEQ ID NO: 7030458 - DNA, 22 bp, Homo sapiens
ggtgcggagactccatgaggcc

SEQ ID NO: 7030459 - DNA, 20 bp, Homo sapiens
tctgacccagagcccaggct

SEQ ID NO: 7030460 - DNA, 22 bp, Homo sapiens
atgcatattttctgttggtgac

SEQ ID NO: 7030461 - DNA, 18 bp, Homo sapiens
agtcttgttctgttgccc

SEQ ID NO: 7030462 - DNA, 22 bp, Homo sapiens
aagaggcataaaatttatatgg

SEQ ID NO: 7030463 - DNA, 22 bp, Homo sapiens
gaaggcagggaatgtggtgcta

SEQ ID NO: 7030464 - DNA, 22 bp, Homo sapiens
acacagttgattgtcactcagg

SEQ ID NO: 7030465 - DNA, 22 bp, Homo sapiens
gatgaggcataaacacagtcac

SEQ ID NO: 7030466 - DNA, 22 bp, Homo sapiens
tcccagagtcagaggtggggcc

SEQ ID NO: 7030467 - DNA, 22 bp, Homo sapiens
ttgcaaaaaccacaattacttt

SEQ ID NO: 7030468 - DNA, 22 bp, Homo sapiens
aaatggatgcctgataacgtca

SEQ ID NO: 7030469 - DNA, 22 bp, Homo sapiens
cagccacttcgagcttcctgat

SEQ ID NO: 7030470 - DNA, 22 bp, Homo sapiens
tatacaggaaattttggaacag

SEQ ID NO: 7030471 - DNA, 22 bp, Homo sapiens
ctgcagggcattgtaactcttt

SEQ ID NO: 7030472 - DNA, 22 bp, Homo sapiens
catctttagtaggttctggaga

SEQ ID NO: 7030473 - DNA, 22 bp, Homo sapiens
ctttagatgtgcaaaggagaaa

SEQ ID NO: 7030474 - DNA, 19 bp, Homo sapiens
ataaggcaattggatttgg

SEQ ID NO: 7030475 - DNA, 21 bp, Homo sapiens
ggcagctgtggttaattgaac

SEQ ID NO: 7030476 - DNA, 22 bp, Homo sapiens
gcagtgatttgtttcagcagca

SEQ ID NO: 7030477 - DNA, 22 bp, Homo sapiens
tacacagtaaatggtaaataca

SEQ ID NO: 7030478 - DNA, 22 bp, Homo sapiens
gcttcagagatttcactagttt

SEQ ID NO: 7030479 - DNA, 19 bp, Homo sapiens
attctttggtgtccatttc

SEQ ID NO: 7030480 - DNA, 22 bp, Homo sapiens
ctgggtcccggcttctatccac

SEQ ID NO: 7030481 - DNA, 22 bp, Homo sapiens
caatatataatgagtactttcc

SEQ ID NO: 7030482 - DNA, 23 bp, Homo sapiens
gggcatctgctattacagcactg

SEQ ID NO: 7030483 - DNA, 22 bp, Homo sapiens
agaggtcagaggtcgccaggtc

SEQ ID NO: 7030484 - DNA, 22 bp, Homo sapiens
aaattgcaaaagtacttttagg

SEQ ID NO: 7030485 - DNA, 22 bp, Homo sapiens
taggctggaggaagcagtgcct

SEQ ID NO: 7030486 - DNA, 22 bp, Homo sapiens
agtgccaaatattgctggtgta

SEQ ID NO: 7030487 - DNA, 22 bp, Homo sapiens
aattacttaactctctgggcct

SEQ ID NO: 7030488 - DNA, 22 bp, Homo sapiens
atctgccctggggccaaaccca

SEQ ID NO: 7030489 - DNA, 20 bp, Homo sapiens
tctcagcataagaacccttc

SEQ ID NO: 7030490 - DNA, 22 bp, Homo sapiens
ctctgctttttagggagcctag

SEQ ID NO: 7030491 - DNA, 22 bp, Homo sapiens
agcccagaaatgaaaggatgat

SEQ ID NO: 7030492 - DNA, 22 bp, Homo sapiens
ggagtcagaatggcagggtggt

SEQ ID NO: 7030493 - DNA, 22 bp, Homo sapiens
tgagtgcctacggcacaggcgc

SEQ ID NO: 7030494 - DNA, 22 bp, Homo sapiens
cacacatattgtccctagtgtg

SEQ ID NO: 7030495 - DNA, 22 bp, Homo sapiens
ctctgaggaagtcaagtagcca

SEQ ID NO: 7030496 - DNA, 22 bp, Homo sapiens
tggatcatcttaagaagtgatt

SEQ ID NO: 7030497 - DNA, 22 bp, Homo sapiens
tcactgcgcttcagcctgggtg

SEQ ID NO: 7030498 - DNA, 22 bp, Homo sapiens
cctgagagtgagtgccacctta

SEQ ID NO: 7030499 - DNA, 22 bp, Homo sapiens
ctggctgagctagagtccatgg

SEQ ID NO: 7030500 - DNA, 22 bp, Homo sapiens
ggagcagtctaaatgataagag

SEQ ID NO: 7030501 - DNA, 22 bp, Homo sapiens
atggagtgcctgtggcagtggg

SEQ ID NO: 7030502 - DNA, 22 bp, Homo sapiens
gccatgcatccttggacttggc

SEQ ID NO: 7030503 - DNA, 22 bp, Homo sapiens
aaccaggacaatttgaatagaa

SEQ ID NO: 7030504 - DNA, 22 bp, Homo sapiens
tccttgggaaatcactagcact

SEQ ID NO: 7030505 - DNA, 22 bp, Homo sapiens
aaaggcttttggtatataggag

SEQ ID NO: 7030506 - DNA, 18 bp, Homo sapiens
tgtttccaaggaggaagt

SEQ ID NO: 7030507 - DNA, 22 bp, Homo sapiens
acttgggaaaggaagaattgca

SEQ ID NO: 7030508 - DNA, 22 bp, Homo sapiens
ttcaaatttggtatgcaagcca

SEQ ID NO: 7030509 - DNA, 17 bp, Homo sapiens
gagtgcagacacaagca

SEQ ID NO: 7030510 - DNA, 22 bp, Homo sapiens
tatgaggtaggtattatactta

SEQ ID NO: 7030511 - DNA, 22 bp, Homo sapiens
ctaagaaagtattgttttgtgg

SEQ ID NO: 7030512 - DNA, 22 bp, Homo sapiens
gagcagtgggaaggaacagggt

SEQ ID NO: 7030513 - DNA, 22 bp, Homo sapiens
agcacaggacgtagagcttgga

SEQ ID NO: 7030514 - DNA, 23 bp, Homo sapiens
gaagccctcattggttctccaga

SEQ ID NO: 7030515 - DNA, 22 bp, Homo sapiens
taaggcacccatgttcatacag

SEQ ID NO: 7030516 - DNA, 22 bp, Homo sapiens
ctcagaagctctgctcctttgc

SEQ ID NO: 7030517 - DNA, 22 bp, Homo sapiens
ccctggacggggaatatgactt

SEQ ID NO: 7030518 - DNA, 22 bp, Homo sapiens
acattaagttttagatgtcaat

SEQ ID NO: 7030519 - DNA, 22 bp, Homo sapiens
ctgcttcaccctgcctgagaac

SEQ ID NO: 7030520 - DNA, 22 bp, Homo sapiens
tgtaaaataattctccatgttt

SEQ ID NO: 7030521 - DNA, 22 bp, Homo sapiens
agcacagtgcctgacatatatg

SEQ ID NO: 7030522 - DNA, 22 bp, Homo sapiens
ggttacatgtatgtttggtata

SEQ ID NO: 7030523 - DNA, 22 bp, Homo sapiens
tcatgttattgactcataatat

SEQ ID NO: 7030524 - DNA, 22 bp, Homo sapiens
attgatatattatttctaactg

SEQ ID NO: 7030525 - DNA, 22 bp, Homo sapiens
atgtcaccttcggtggcacggt

SEQ ID NO: 7030526 - DNA, 22 bp, Homo sapiens
tccttaaatatttactgttaac

SEQ ID NO: 7030527 - DNA, 22 bp, Homo sapiens
tacagccatcatgtatgtatat

SEQ ID NO: 7030528 - DNA, 23 bp, Homo sapiens
acataaacagaaggtgtgcttcc

SEQ ID NO: 7030529 - DNA, 21 bp, Homo sapiens
gttttctttgatagagggaag

SEQ ID NO: 7030530 - DNA, 20 bp, Homo sapiens
ttggtcatttacttgttctt

SEQ ID NO: 7030531 - DNA, 18 bp, Homo sapiens
ctgacccttttacattcc

SEQ ID NO: 7030532 - DNA, 22 bp, Homo sapiens
agcgtgtgtgcgggtcttcttt

SEQ ID NO: 7030533 - DNA, 22 bp, Homo sapiens
atcatctgtctccttgtatgtt

SEQ ID NO: 7030534 - DNA, 22 bp, Homo sapiens
actagaaactaatggattatta

SEQ ID NO: 7030535 - DNA, 22 bp, Homo sapiens
gggagcaggagcctgcctgcca

SEQ ID NO: 7030536 - DNA, 22 bp, Homo sapiens
tattttcaccttctctggatat

SEQ ID NO: 7030537 - DNA, 23 bp, Homo sapiens
ctgtgcaatatcccatggtatga

SEQ ID NO: 7030538 - DNA, 19 bp, Homo sapiens
tggtggcaatgtcagctaa

SEQ ID NO: 7030539 - DNA, 22 bp, Homo sapiens
agtgagatcatgcaatatttgt

SEQ ID NO: 7030540 - DNA, 22 bp, Homo sapiens
agaggtgtcttgcttattgtta

SEQ ID NO: 7030541 - DNA, 22 bp, Homo sapiens
acttgcctccatattttattgc

SEQ ID NO: 7030542 - DNA, 22 bp, Homo sapiens
ttcaccataatgcaaagtggga

SEQ ID NO: 7030543 - DNA, 22 bp, Homo sapiens
agtctgagtctaaaggcttgag

SEQ ID NO: 7030544 - DNA, 22 bp, Homo sapiens
atctgagatgcaggtgggtgga

SEQ ID NO: 7030545 - DNA, 22 bp, Homo sapiens
ctgagaggggaccagggtgttt

SEQ ID NO: 7030546 - DNA, 22 bp, Homo sapiens
tctcaagactggttttcacagc

SEQ ID NO: 7030547 - DNA, 22 bp, Homo sapiens
atgcctttggcattatttcttg

SEQ ID NO: 7030548 - DNA, 22 bp, Homo sapiens
tgcaattttcagaaattccaaa

SEQ ID NO: 7030549 - DNA, 22 bp, Homo sapiens
aggcaccgctcctcagtccaga

SEQ ID NO: 7030550 - DNA, 22 bp, Homo sapiens
ctgggagaatttgttgaaggat

SEQ ID NO: 7030551 - DNA, 22 bp, Homo sapiens
atactacatcacagccaagaag

SEQ ID NO: 7030552 - DNA, 22 bp, Homo sapiens
cttctaatataaagtctttgca

SEQ ID NO: 7030553 - DNA, 21 bp, Homo sapiens
tcagcagaaagcaaggtcagt

SEQ ID NO: 7030554 - DNA, 22 bp, Homo sapiens
agggctcagagcaaaagggcac

SEQ ID NO: 7030555 - DNA, 17 bp, Homo sapiens
accaggcaacacgccca

SEQ ID NO: 7030556 - DNA, 22 bp, Homo sapiens
attctgagctactaattaggca

SEQ ID NO: 7030557 - DNA, 22 bp, Homo sapiens
aggaacacccccttcctaccag

SEQ ID NO: 7030558 - DNA, 22 bp, Homo sapiens
tgcagctgataattacatgttc

SEQ ID NO: 7030559 - DNA, 22 bp, Homo sapiens
atttcagagtagatcgttattt

SEQ ID NO: 7030560 - DNA, 16 bp, Homo sapiens
ctttttctcccctctt

SEQ ID NO: 7030561 - DNA, 22 bp, Homo sapiens
tctcagtcagtttggactgtgt

SEQ ID NO: 7030562 - DNA, 22 bp, Homo sapiens
tggcatcctctcttctgagtgc

SEQ ID NO: 7030563 - DNA, 22 bp, Homo sapiens
tctgcagaagtggctgggccac

SEQ ID NO: 7030564 - DNA, 22 bp, Homo sapiens
tattcctgtcaagatcttacaa

SEQ ID NO: 7030565 - DNA, 22 bp, Homo sapiens
ataggaaatcgctattaaccta

SEQ ID NO: 7030566 - DNA, 22 bp, Homo sapiens
aaatgcctcccattctactgac

SEQ ID NO: 7030567 - DNA, 22 bp, Homo sapiens
tacaacagacaggaataagatt

SEQ ID NO: 7030568 - DNA, 21 bp, Homo sapiens
aaagtgtgtggggaagaagga

SEQ ID NO: 7030569 - DNA, 22 bp, Homo sapiens
cccaggaattggaggctgcagt

SEQ ID NO: 7030570 - DNA, 22 bp, Homo sapiens
agtgggcatatgaagtctcaag

SEQ ID NO: 7030571 - DNA, 22 bp, Homo sapiens
tgtctcctatttcctgctaagg

SEQ ID NO: 7030572 - DNA, 19 bp, Homo sapiens
ggccagctgtctcctgcta

SEQ ID NO: 7030573 - DNA, 22 bp, Homo sapiens
tctccaagcagggctgcaaggc

SEQ ID NO: 7030574 - DNA, 22 bp, Homo sapiens
tgtttggtcatgaatgtcagtg

SEQ ID NO: 7030575 - DNA, 22 bp, Homo sapiens
atgtgtctctaaaatttagtaa

SEQ ID NO: 7030576 - DNA, 22 bp, Homo sapiens
taagtcttcatagtctaatgtc

SEQ ID NO: 7030577 - DNA, 22 bp, Homo sapiens
ttagctctggattaagcagaaa

SEQ ID NO: 7030578 - DNA, 22 bp, Homo sapiens
agcagtttggaaaatactagaa

SEQ ID NO: 7030579 - DNA, 22 bp, Homo sapiens
gcagtagttatagggaaatata

SEQ ID NO: 7030580 - DNA, 22 bp, Homo sapiens
atggtggtttgggagaaaaagc

SEQ ID NO: 7030581 - DNA, 22 bp, Homo sapiens
gtttcccaaattgttcacaggg

SEQ ID NO: 7030582 - DNA, 20 bp, Homo sapiens
cgtgctgtgaccttgagcat

SEQ ID NO: 7030583 - DNA, 20 bp, Homo sapiens
aaaatagccccaggctcatt

SEQ ID NO: 7030584 - DNA, 22 bp, Homo sapiens
gctcctccaatatggactcctc

SEQ ID NO: 7030585 - DNA, 23 bp, Homo sapiens
tcacatatgtagaagtggaattc

SEQ ID NO: 7030586 - DNA, 22 bp, Homo sapiens
atggagggaaaagtggagagcc

SEQ ID NO: 7030587 - DNA, 22 bp, Homo sapiens
aggcgtttattctcttcacgct

SEQ ID NO: 7030588 - DNA, 22 bp, Homo sapiens
aatgtttgaactttgcatattt

SEQ ID NO: 7030589 - DNA, 22 bp, Homo sapiens
ctttcaggggcttgactccaca

SEQ ID NO: 7030590 - DNA, 22 bp, Homo sapiens
gtatgaaagcatcattcctgct

SEQ ID NO: 7030591 - DNA, 22 bp, Homo sapiens
tccacagaatgtaagatccaca

SEQ ID NO: 7030592 - DNA, 22 bp, Homo sapiens
tatgaacattgaagaggagccc

SEQ ID NO: 7030593 - DNA, 22 bp, Homo sapiens
tttgaagtgcaatgaggattct

SEQ ID NO: 7030594 - DNA, 22 bp, Homo sapiens
tccaggcttgagaccaggctct

SEQ ID NO: 7030595 - DNA, 22 bp, Homo sapiens
gaacttgagcaacactgagtga

SEQ ID NO: 7030596 - DNA, 22 bp, Homo sapiens
caggcctgtctgcacatgaggc

SEQ ID NO: 7030597 - DNA, 22 bp, Homo sapiens
ttggccttgttaaggaggccct

SEQ ID NO: 7030598 - DNA, 22 bp, Homo sapiens
tcctcagaaacccctgtgaggt

SEQ ID NO: 7030599 - DNA, 22 bp, Homo sapiens
caggccaagcctccccagctcc

SEQ ID NO: 7030600 - DNA, 22 bp, Homo sapiens
ttggaattggacatgttgaagg

SEQ ID NO: 7030601 - DNA, 22 bp, Homo sapiens
ctgtacaggagacgtctgtgca

SEQ ID NO: 7030602 - DNA, 22 bp, Homo sapiens
gcattgtttaagtgggtggggt

SEQ ID NO: 7030603 - DNA, 22 bp, Homo sapiens
gctgtttctttcctggcacttg

SEQ ID NO: 7030604 - DNA, 22 bp, Homo sapiens
gcagaattctacagatgataaa

SEQ ID NO: 7030605 - DNA, 22 bp, Homo sapiens
ctccagagccagtgcttttcca

SEQ ID NO: 7030606 - DNA, 22 bp, Homo sapiens
atgtgtgcgggaaggaaagtga

SEQ ID NO: 7030607 - DNA, 22 bp, Homo sapiens
caaaggcaacatatacttgttt

SEQ ID NO: 7030608 - DNA, 22 bp, Homo sapiens
agagtcttggcattcatgcgtt

SEQ ID NO: 7030609 - DNA, 22 bp, Homo sapiens
agatattcaaccaaacactaat

SEQ ID NO: 7030610 - DNA, 22 bp, Homo sapiens
tagtgctttaagtttacagaga

SEQ ID NO: 7030611 - DNA, 22 bp, Homo sapiens
tttctaggaaaagatagaagga

SEQ ID NO: 7030612 - DNA, 22 bp, Homo sapiens
gctgagtgattgatattttagt

SEQ ID NO: 7030613 - DNA, 22 bp, Homo sapiens
gaatacatgtgtgtatagaggt

SEQ ID NO: 7030614 - DNA, 22 bp, Homo sapiens
agttttctttcatctatcagca

SEQ ID NO: 7030615 - DNA, 22 bp, Homo sapiens
tactaaatagcaggttggctat

SEQ ID NO: 7030616 - DNA, 22 bp, Homo sapiens
ttggcacaggggacttatgtgt

SEQ ID NO: 7030617 - DNA, 18 bp, Homo sapiens
tctcaatcgctgcagtct

SEQ ID NO: 7030618 - DNA, 22 bp, Homo sapiens
aaatagcacagcagctgaggct

SEQ ID NO: 7030619 - DNA, 22 bp, Homo sapiens
gcagtgattggatcagagatgg

SEQ ID NO: 7030620 - DNA, 22 bp, Homo sapiens
aggtaatttctccaaacatgct

SEQ ID NO: 7030621 - DNA, 22 bp, Homo sapiens
tgggaaatctttccgtatttat

SEQ ID NO: 7030622 - DNA, 16 bp, Homo sapiens
gcacgttttcaaggcc

SEQ ID NO: 7030623 - DNA, 22 bp, Homo sapiens
atcttgttaaagtgcagatttt

SEQ ID NO: 7030624 - DNA, 22 bp, Homo sapiens
agcaatgatgttttcaagtagg

SEQ ID NO: 7030625 - DNA, 22 bp, Homo sapiens
catcagtgttcactattccttc

SEQ ID NO: 7030626 - DNA, 22 bp, Homo sapiens
gaaggagagaaaggcaattctg

SEQ ID NO: 7030627 - DNA, 22 bp, Homo sapiens
acatttagtatgagtctctgta

SEQ ID NO: 7030628 - DNA, 22 bp, Homo sapiens
cctaaggaccagggcttccagc

SEQ ID NO: 7030629 - DNA, 22 bp, Homo sapiens
gagctgccaagattacaatcag

SEQ ID NO: 7030630 - DNA, 22 bp, Homo sapiens
cacaaggaggtcctgaggaagc

SEQ ID NO: 7030631 - DNA, 22 bp, Homo sapiens
ctgcctagatttgaatcctggc

SEQ ID NO: 7030632 - DNA, 22 bp, Homo sapiens
gggcagcagttgccctaatcaa

SEQ ID NO: 7030633 - DNA, 22 bp, Homo sapiens
gagctaagacctgagggcaagt

SEQ ID NO: 7030634 - DNA, 21 bp, Homo sapiens
tttcttaggctctaaaatgac

SEQ ID NO: 7030635 - DNA, 22 bp, Homo sapiens
ttagaaaatggaggtgggaggg

SEQ ID NO: 7030636 - DNA, 22 bp, Homo sapiens
ccagccgcggtgagggtggctg

SEQ ID NO: 7030637 - DNA, 22 bp, Homo sapiens
ggtgaggaattggggactgacc

SEQ ID NO: 7030638 - DNA, 22 bp, Homo sapiens
tcaggaaatgtcccaggttgtg

SEQ ID NO: 7030639 - DNA, 22 bp, Homo sapiens
ttctcataaatcctgagaccta

SEQ ID NO: 7030640 - DNA, 22 bp, Homo sapiens
ggatctcagggttctggtctgg

SEQ ID NO: 7030641 - DNA, 22 bp, Homo sapiens
agactgcagcaaccccttcagc

SEQ ID NO: 7030642 - DNA, 22 bp, Homo sapiens
actccgggagccaggagaggct

SEQ ID NO: 7030643 - DNA, 22 bp, Homo sapiens
atgtttcaatgcactttagcct

SEQ ID NO: 7030644 - DNA, 22 bp, Homo sapiens
atggccagagagagcacacctg

SEQ ID NO: 7030645 - DNA, 22 bp, Homo sapiens
tgtcatgagttatttcatagga

SEQ ID NO: 7030646 - DNA, 22 bp, Homo sapiens
ggcaaggcctgcagctcagtgt

SEQ ID NO: 7030647 - DNA, 22 bp, Homo sapiens
gtaaactgtagctacttaacta

SEQ ID NO: 7030648 - DNA, 22 bp, Homo sapiens
tttccttccaaatgcccgggag

SEQ ID NO: 7030649 - DNA, 17 bp, Homo sapiens
ctatgcattggactgaa

SEQ ID NO: 7030650 - DNA, 22 bp, Homo sapiens
acagctaggtcttcagcacttt

SEQ ID NO: 7030651 - DNA, 22 bp, Homo sapiens
ttccaatcaggataataattag

SEQ ID NO: 7030652 - DNA, 22 bp, Homo sapiens
aagcacacagaggcggaaggac

SEQ ID NO: 7030653 - DNA, 22 bp, Homo sapiens
atattaaatggattttgggagc

SEQ ID NO: 7030654 - DNA, 20 bp, Homo sapiens
tacattgtgagactaatgga

SEQ ID NO: 7030655 - DNA, 22 bp, Homo sapiens
acaagaagtaaaggtcggatgc

SEQ ID NO: 7030656 - DNA, 22 bp, Homo sapiens
agggaagtgataggacgtctct

SEQ ID NO: 7030657 - DNA, 22 bp, Homo sapiens
tttctcagtaatgtcctggaat

SEQ ID NO: 7030658 - DNA, 22 bp, Homo sapiens
aggcatctgctgcccttctgga

SEQ ID NO: 7030659 - DNA, 22 bp, Homo sapiens
ggcaatgtctcttgcttccagg

SEQ ID NO: 7030660 - DNA, 22 bp, Homo sapiens
ccctcagcagatatttgtgttt

SEQ ID NO: 7030661 - DNA, 22 bp, Homo sapiens
gtggagccctgccttgctcatg

SEQ ID NO: 7030662 - DNA, 22 bp, Homo sapiens
aataaactgctcaattgcatca

SEQ ID NO: 7030663 - DNA, 22 bp, Homo sapiens
gttctgcttccttgcttgcgca

SEQ ID NO: 7030664 - DNA, 22 bp, Homo sapiens
caggtacactcccttgtgctga

SEQ ID NO: 7030665 - DNA, 22 bp, Homo sapiens
ttctcagatccatcagaagtcc

SEQ ID NO: 7030666 - DNA, 22 bp, Homo sapiens
gtctgtccttttcatctcccaa

SEQ ID NO: 7030667 - DNA, 22 bp, Homo sapiens
acttgaataggtgtcaaggcca

SEQ ID NO: 7030668 - DNA, 22 bp, Homo sapiens
acttgtttgaatctctctagag

SEQ ID NO: 7030669 - DNA, 22 bp, Homo sapiens
gacataatcctcctcacctact

SEQ ID NO: 7030670 - DNA, 22 bp, Homo sapiens
taatgtctagatcagacctcga

SEQ ID NO: 7030671 - DNA, 22 bp, Homo sapiens
aggaactgacttggtttaaatg

SEQ ID NO: 7030672 - DNA, 22 bp, Homo sapiens
ttgtagtggccaaagaactctt

SEQ ID NO: 7030673 - DNA, 22 bp, Homo sapiens
tggctggggagccccgactccc

SEQ ID NO: 7030674 - DNA, 17 bp, Homo sapiens
tttagaggataagcccc

SEQ ID NO: 7030675 - DNA, 22 bp, Homo sapiens
aagtggagtccctacaaccagc

SEQ ID NO: 7030676 - DNA, 20 bp, Homo sapiens
tcctgtgtgtctcatcaacc

SEQ ID NO: 7030677 - DNA, 22 bp, Homo sapiens
cttgaatggtatgagagtaatt

SEQ ID NO: 7030678 - DNA, 22 bp, Homo sapiens
gacttgggagtcttctgagatg

SEQ ID NO: 7030679 - DNA, 22 bp, Homo sapiens
ttgtatttcctataacctttct

SEQ ID NO: 7030680 - DNA, 22 bp, Homo sapiens
tagtccaggtttccatctccac

SEQ ID NO: 7030681 - DNA, 22 bp, Homo sapiens
gagcagggccacttctgtacct

SEQ ID NO: 7030682 - DNA, 22 bp, Homo sapiens
tggctctttctgtctgggatcc

SEQ ID NO: 7030683 - DNA, 22 bp, Homo sapiens
gagaaattttgagtggctttct

SEQ ID NO: 7030684 - DNA, 22 bp, Homo sapiens
tttgtgaattcttggaagattg

SEQ ID NO: 7030685 - DNA, 22 bp, Homo sapiens
gaccagattcaggtcactcagg

SEQ ID NO: 7030686 - DNA, 22 bp, Homo sapiens
gtcctgtcccccaaggctgtgg

SEQ ID NO: 7030687 - DNA, 19 bp, Homo sapiens
tgctatttagaacgcctgg

SEQ ID NO: 7030688 - DNA, 22 bp, Homo sapiens
atcctgctgctgtggacttctc

SEQ ID NO: 7030689 - DNA, 22 bp, Homo sapiens
tagaaacatgttctgttctgtt

SEQ ID NO: 7030690 - DNA, 22 bp, Homo sapiens
tcaggagtaaagaagacttgac

SEQ ID NO: 7030691 - DNA, 22 bp, Homo sapiens
agacctggtaagcaggttgggc

SEQ ID NO: 7030692 - DNA, 22 bp, Homo sapiens
tgtagcagtctgggggaattac

SEQ ID NO: 7030693 - DNA, 22 bp, Homo sapiens
ggagctgttgcgcatgcgctcg

SEQ ID NO: 7030694 - DNA, 22 bp, Homo sapiens
taggttcatattctagaatcat

SEQ ID NO: 7030695 - DNA, 22 bp, Homo sapiens
tgtagcacagggttgggggaga

SEQ ID NO: 7030696 - DNA, 19 bp, Homo sapiens
aggagcactgccagcacca

SEQ ID NO: 7030697 - DNA, 22 bp, Homo sapiens
gaatgtttttataagtgttaca

SEQ ID NO: 7030698 - DNA, 22 bp, Homo sapiens
ctgtacatcttaaatggaaaaa

SEQ ID NO: 7030699 - DNA, 22 bp, Homo sapiens
ccctggcccctcactccgaggc

SEQ ID NO: 7030700 - DNA, 22 bp, Homo sapiens
tcagagaagacatcattgtgaa

SEQ ID NO: 7030701 - DNA, 22 bp, Homo sapiens
ccagaagccctttgtttgttgt

SEQ ID NO: 7030702 - DNA, 22 bp, Homo sapiens
attgtcgcttatttaggtgctt

SEQ ID NO: 7030703 - DNA, 22 bp, Homo sapiens
cagtcctgggcaggtcaggcca

SEQ ID NO: 7030704 - DNA, 22 bp, Homo sapiens
agtagacaataattcaactccc

SEQ ID NO: 7030705 - DNA, 22 bp, Homo sapiens
agagtttgggtgggacagcttg

SEQ ID NO: 7030706 - DNA, 23 bp, Homo sapiens
actgtctgatatgttttccatca

SEQ ID NO: 7030707 - DNA, 19 bp, Homo sapiens
atgaatgatccggtttctc

SEQ ID NO: 7030708 - DNA, 22 bp, Homo sapiens
ttctagtctatggctagatagt

SEQ ID NO: 7030709 - DNA, 22 bp, Homo sapiens
gttacagtgcttggcaataagt

SEQ ID NO: 7030710 - DNA, 22 bp, Homo sapiens
gagtgcatggactactggcttg

SEQ ID NO: 7030711 - DNA, 22 bp, Homo sapiens
tactgtcttttcctaaatgggt

SEQ ID NO: 7030712 - DNA, 22 bp, Homo sapiens
ctgtgtcctccccatcacttct

SEQ ID NO: 7030713 - DNA, 22 bp, Homo sapiens
ccaagggcgcctccgttccccc

SEQ ID NO: 7030714 - DNA, 19 bp, Homo sapiens
ctgcttccttccctcactg

SEQ ID NO: 7030715 - DNA, 22 bp, Homo sapiens
actggaggcccctcccagtgaa

SEQ ID NO: 7030716 - DNA, 22 bp, Homo sapiens
aagatcctgggtccacagaagc

SEQ ID NO: 7030717 - DNA, 19 bp, Homo sapiens
aggcctggggttttgcact

SEQ ID NO: 7030718 - DNA, 17 bp, Homo sapiens
tctaggagagcagagct

SEQ ID NO: 7030719 - DNA, 22 bp, Homo sapiens
taaaatgatctctcatgttctt

SEQ ID NO: 7030720 - DNA, 22 bp, Homo sapiens
acatagaagtgatgcttatcca

SEQ ID NO: 7030721 - DNA, 22 bp, Homo sapiens
cctgtgtctttgcctcagggtc

SEQ ID NO: 7030722 - DNA, 22 bp, Homo sapiens
ttgaagctaggctgtgcatatg

SEQ ID NO: 7030723 - DNA, 22 bp, Homo sapiens
ccatttgttcgcccagctccaa

SEQ ID NO: 7030724 - DNA, 22 bp, Homo sapiens
tctgagagtagagctgcctctt

SEQ ID NO: 7030725 - DNA, 22 bp, Homo sapiens
tagtgtatgtctaacatacact

SEQ ID NO: 7030726 - DNA, 22 bp, Homo sapiens
ttggaaggagtcaaccagctga

SEQ ID NO: 7030727 - DNA, 21 bp, Homo sapiens
tgtgaccaggtctactttccc

SEQ ID NO: 7030728 - DNA, 22 bp, Homo sapiens
tgcatgcacgtgctatgtatga

SEQ ID NO: 7030729 - DNA, 22 bp, Homo sapiens
gggccagcagtatcggaggcat

SEQ ID NO: 7030730 - DNA, 22 bp, Homo sapiens
tgggcactcctggggacagctg

SEQ ID NO: 7030731 - DNA, 22 bp, Homo sapiens
gagctcagaggattctggggag

SEQ ID NO: 7030732 - DNA, 22 bp, Homo sapiens
gggagggtgttctcccaagaac

SEQ ID NO: 7030733 - DNA, 22 bp, Homo sapiens
gtgtgcctttcacacactggga

SEQ ID NO: 7030734 - DNA, 20 bp, Homo sapiens
tccacatcttttgagatgtg

SEQ ID NO: 7030735 - DNA, 22 bp, Homo sapiens
gaagttattttacctgttaaag

SEQ ID NO: 7030736 - DNA, 22 bp, Homo sapiens
tcccacaggaggagttggaaat

SEQ ID NO: 7030737 - DNA, 19 bp, Homo sapiens
agaacagctttttgtgaca

SEQ ID NO: 7030738 - DNA, 22 bp, Homo sapiens
ataagagctatggtgggagttg

SEQ ID NO: 7030739 - DNA, 22 bp, Homo sapiens
ctcattgcagctgcattactgt

SEQ ID NO: 7030740 - DNA, 22 bp, Homo sapiens
gtgtgctattctcttatattca

SEQ ID NO: 7030741 - DNA, 22 bp, Homo sapiens
catttgttaagaaggaaaaagg

SEQ ID NO: 7030742 - DNA, 22 bp, Homo sapiens
aatgctacagaagtgatcttgg

SEQ ID NO: 7030743 - DNA, 22 bp, Homo sapiens
aaattagatcagtggattttct

SEQ ID NO: 7030744 - DNA, 22 bp, Homo sapiens
tctggagtaactctgtttctgg

SEQ ID NO: 7030745 - DNA, 22 bp, Homo sapiens
aaatgtacaacatccatatata

SEQ ID NO: 7030746 - DNA, 22 bp, Homo sapiens
tgttttgtctaatctaaattct

SEQ ID NO: 7030747 - DNA, 19 bp, Homo sapiens
gtgtccatggagcatggag

SEQ ID NO: 7030748 - DNA, 22 bp, Homo sapiens
tgacaactctagttaatgaatt

SEQ ID NO: 7030749 - DNA, 22 bp, Homo sapiens
aaaatgtgatctacaaatgcaa

SEQ ID NO: 7030750 - DNA, 22 bp, Homo sapiens
actggcagcagcagcccttggg

SEQ ID NO: 7030751 - DNA, 22 bp, Homo sapiens
acttaatcattctctctgcttt

SEQ ID NO: 7030752 - DNA, 22 bp, Homo sapiens
tgtaatggtagaaattagggat

SEQ ID NO: 7030753 - DNA, 22 bp, Homo sapiens
gccttggccaacaccttgcaaa

SEQ ID NO: 7030754 - DNA, 22 bp, Homo sapiens
attgtgtttgaatgaggctcca

SEQ ID NO: 7030755 - DNA, 22 bp, Homo sapiens
tcagaccatcctgctgttagtg

SEQ ID NO: 7030756 - DNA, 22 bp, Homo sapiens
cagtgacacccagtctggccca

SEQ ID NO: 7030757 - DNA, 22 bp, Homo sapiens
caagcatactgtgagagtttta

SEQ ID NO: 7030758 - DNA, 22 bp, Homo sapiens
tctgccaggcttggtgctagat

SEQ ID NO: 7030759 - DNA, 22 bp, Homo sapiens
cataatttctgtatcagcacca

SEQ ID NO: 7030760 - DNA, 19 bp, Homo sapiens
aggtgcaggtcacagggga

SEQ ID NO: 7030761 - DNA, 22 bp, Homo sapiens
tagcagaaccagcagtcaattt

SEQ ID NO: 7030762 - DNA, 22 bp, Homo sapiens
aaagctgctttaaacatctatg

SEQ ID NO: 7030763 - DNA, 22 bp, Homo sapiens
agtggtaagggcataggcactg

SEQ ID NO: 7030764 - DNA, 22 bp, Homo sapiens
actgttttcctaatgagcaaga

SEQ ID NO: 7030765 - DNA, 22 bp, Homo sapiens
tcatgtgttgcactgaggacct

SEQ ID NO: 7030766 - DNA, 22 bp, Homo sapiens
agcagtttggcccgagcagttc

SEQ ID NO: 7030767 - DNA, 22 bp, Homo sapiens
atactgtatcacttgtgagtga

SEQ ID NO: 7030768 - DNA, 22 bp, Homo sapiens
gtgattctggcaggcagaaggg

SEQ ID NO: 7030769 - DNA, 22 bp, Homo sapiens
tttacccattcagactcacttg

SEQ ID NO: 7030770 - DNA, 22 bp, Homo sapiens
caccatctggtaggcattagtg

SEQ ID NO: 7030771 - DNA, 22 bp, Homo sapiens
ccagagcctcttatgaagatcg

SEQ ID NO: 7030772 - DNA, 22 bp, Homo sapiens
aagtccctttaatcagtgcctt

SEQ ID NO: 7030773 - DNA, 23 bp, Homo sapiens
tgagctctatggaggactgaacc

SEQ ID NO: 7030774 - DNA, 21 bp, Homo sapiens
ttcaaagtttgcctaaagatt

SEQ ID NO: 7030775 - DNA, 22 bp, Homo sapiens
gccacgttgccacccgggtgac

SEQ ID NO: 7030776 - DNA, 22 bp, Homo sapiens
caggccctgctgctgagacctt

SEQ ID NO: 7030777 - DNA, 22 bp, Homo sapiens
tgtcacagagcaactatttctt

SEQ ID NO: 7030778 - DNA, 22 bp, Homo sapiens
ttgtaatggagcaaacaggttg

SEQ ID NO: 7030779 - DNA, 22 bp, Homo sapiens
tctcatctattcacattaactg

SEQ ID NO: 7030780 - DNA, 22 bp, Homo sapiens
ggctccctgcaacctccgcctc

SEQ ID NO: 7030781 - DNA, 22 bp, Homo sapiens
catggcttactttcagggagta

SEQ ID NO: 7030782 - DNA, 22 bp, Homo sapiens
tatcagatgacatcttctatgg

SEQ ID NO: 7030783 - DNA, 22 bp, Homo sapiens
ttctgtgttgtgacattctaga

SEQ ID NO: 7030784 - DNA, 22 bp, Homo sapiens
agactggatagctttggacttg

SEQ ID NO: 7030785 - DNA, 22 bp, Homo sapiens
agttcttttaccaaggcaaatg

SEQ ID NO: 7030786 - DNA, 22 bp, Homo sapiens
ttctgtttactcagaaatacaa

SEQ ID NO: 7030787 - DNA, 22 bp, Homo sapiens
cagaagttctttcatataggct

SEQ ID NO: 7030788 - DNA, 22 bp, Homo sapiens
ggagcaccgctcagacccttgg

SEQ ID NO: 7030789 - DNA, 22 bp, Homo sapiens
agaataatcactgaagttcaaa

SEQ ID NO: 7030790 - DNA, 22 bp, Homo sapiens
tttattatagtggtggggactg

SEQ ID NO: 7030791 - DNA, 22 bp, Homo sapiens
ttcctgggctctggctggccta

SEQ ID NO: 7030792 - DNA, 22 bp, Homo sapiens
tagaggcaaccagtgttgagaa

SEQ ID NO: 7030793 - DNA, 22 bp, Homo sapiens
gcagtctatcttgtgatttaac

SEQ ID NO: 7030794 - DNA, 22 bp, Homo sapiens
tcagcagagtggaacattgtca

SEQ ID NO: 7030795 - DNA, 22 bp, Homo sapiens
aaccagatcgactgttaacagc

SEQ ID NO: 7030796 - DNA, 20 bp, Homo sapiens
tttgctgtgggtgtaagaat

SEQ ID NO: 7030797 - DNA, 22 bp, Homo sapiens
acaaggtttggtcctatatttt

SEQ ID NO: 7030798 - DNA, 22 bp, Homo sapiens
tggacagtaagagaagatgtag

SEQ ID NO: 7030799 - DNA, 22 bp, Homo sapiens
ggtctgtgtcataggctgagtt

SEQ ID NO: 7030800 - DNA, 15 bp, Homo sapiens
gtggctaatggggca

SEQ ID NO: 7030801 - DNA, 22 bp, Homo sapiens
tattggaagattcaggattgca

SEQ ID NO: 7030802 - DNA, 22 bp, Homo sapiens
atatgcgtactatatactgtgt

SEQ ID NO: 7030803 - DNA, 19 bp, Homo sapiens
tacattgctggtggggatg

SEQ ID NO: 7030804 - DNA, 22 bp, Homo sapiens
aaaattgagagttatagatggt

SEQ ID NO: 7030805 - DNA, 23 bp, Homo sapiens
actagacttcatcgaaggttacc

SEQ ID NO: 7030806 - DNA, 22 bp, Homo sapiens
ttgagatacattgggaaatgcc

SEQ ID NO: 7030807 - DNA, 23 bp, Homo sapiens
ctggtaaatcactaaaattacaa

SEQ ID NO: 7030808 - DNA, 22 bp, Homo sapiens
actcttcacttcccctgccagc

SEQ ID NO: 7030809 - DNA, 22 bp, Homo sapiens
tacagagatactctagatcaaa

SEQ ID NO: 7030810 - DNA, 22 bp, Homo sapiens
attattgttagtgacagggtga

SEQ ID NO: 7030811 - DNA, 22 bp, Homo sapiens
tgagagggttcccaggggtttc

SEQ ID NO: 7030812 - DNA, 22 bp, Homo sapiens
cattaaatatcaacctagacta

SEQ ID NO: 7030813 - DNA, 22 bp, Homo sapiens
ttcaatcaccatcaggacatta

SEQ ID NO: 7030814 - DNA, 23 bp, Homo sapiens
agtcagtcatggtaaccatttga

SEQ ID NO: 7030815 - DNA, 22 bp, Homo sapiens
atggctgtttagcttctctgct

SEQ ID NO: 7030816 - DNA, 22 bp, Homo sapiens
gatgattcctttgttcattgtg

SEQ ID NO: 7030817 - DNA, 22 bp, Homo sapiens
tctgttcttctccactgtatgt

SEQ ID NO: 7030818 - DNA, 22 bp, Homo sapiens
ttttccttcatatcccttatgt

SEQ ID NO: 7030819 - DNA, 22 bp, Homo sapiens
aaactaatgaagtgaagacgct

SEQ ID NO: 7030820 - DNA, 22 bp, Homo sapiens
ttgcaatgcctcaattaaagcc

SEQ ID NO: 7030821 - DNA, 22 bp, Homo sapiens
ccccttggctgctctcaagtcc

SEQ ID NO: 7030822 - DNA, 22 bp, Homo sapiens
attagcaactcttatgtaagca

SEQ ID NO: 7030823 - DNA, 22 bp, Homo sapiens
tgtcctgttcatggctctggac

SEQ ID NO: 7030824 - DNA, 22 bp, Homo sapiens
aagaaacctagtctggagcagc

SEQ ID NO: 7030825 - DNA, 22 bp, Homo sapiens
tggcattgcttctgaagtggag

SEQ ID NO: 7030826 - DNA, 22 bp, Homo sapiens
gaccatttttacagagcattca

SEQ ID NO: 7030827 - DNA, 17 bp, Homo sapiens
tgtatttgtaccacagc

SEQ ID NO: 7030828 - DNA, 22 bp, Homo sapiens
atggagctaaattgtaatcata

SEQ ID NO: 7030829 - DNA, 22 bp, Homo sapiens
ccaatactgttgattcatagtg

SEQ ID NO: 7030830 - DNA, 22 bp, Homo sapiens
tgcatttattaccaggctttca

SEQ ID NO: 7030831 - DNA, 22 bp, Homo sapiens
caagttgtacagattgtattag

SEQ ID NO: 7030832 - DNA, 22 bp, Homo sapiens
gaggaagtgcgttatgcctttt

SEQ ID NO: 7030833 - DNA, 22 bp, Homo sapiens
aattaaattggtttagagagga

SEQ ID NO: 7030834 - DNA, 22 bp, Homo sapiens
tcagagccaatcatggtgcatt

SEQ ID NO: 7030835 - DNA, 22 bp, Homo sapiens
ctttagatttctatgtatcact

SEQ ID NO: 7030836 - DNA, 22 bp, Homo sapiens
ccaggtgtgccagcagggactg

SEQ ID NO: 7030837 - DNA, 22 bp, Homo sapiens
tcctccttcgggactgcttgac

SEQ ID NO: 7030838 - DNA, 22 bp, Homo sapiens
tgggacacaaaccagaccagga

SEQ ID NO: 7030839 - DNA, 22 bp, Homo sapiens
ttttgcaatgagatgcttgtca

SEQ ID NO: 7030840 - DNA, 22 bp, Homo sapiens
ggaagcacagcataaagttact

SEQ ID NO: 7030841 - DNA, 22 bp, Homo sapiens
gcaatgcaatctttattatatt

SEQ ID NO: 7030842 - DNA, 22 bp, Homo sapiens
tggctcttctcaagcattggct

SEQ ID NO: 7030843 - DNA, 22 bp, Homo sapiens
gctgaagagaggccttgagcac

SEQ ID NO: 7030844 - DNA, 22 bp, Homo sapiens
cttctagaaccctctattcttt

SEQ ID NO: 7030845 - DNA, 22 bp, Homo sapiens
cacccaggctggattgcagtgg

SEQ ID NO: 7030846 - DNA, 22 bp, Homo sapiens
atttctcaccctacctcactcc

SEQ ID NO: 7030847 - DNA, 22 bp, Homo sapiens
ttgactctaaatttacttttcc

SEQ ID NO: 7030848 - DNA, 22 bp, Homo sapiens
gagtctctgggagggaaagaag

SEQ ID NO: 7030849 - DNA, 22 bp, Homo sapiens
atagttacaaagactttttaaa

SEQ ID NO: 7030850 - DNA, 22 bp, Homo sapiens
aagctggagagtttcacagatg

SEQ ID NO: 7030851 - DNA, 22 bp, Homo sapiens
atccttaatttcctgggcctca

SEQ ID NO: 7030852 - DNA, 22 bp, Homo sapiens
aaaatagcatattgctttcttt

SEQ ID NO: 7030853 - DNA, 22 bp, Homo sapiens
gcagctgtgggcctcggagagc

SEQ ID NO: 7030854 - DNA, 22 bp, Homo sapiens
ctgcaaggtatatgttatcata

SEQ ID NO: 7030855 - DNA, 22 bp, Homo sapiens
gggtcctgcgtgggcccaggac

SEQ ID NO: 7030856 - DNA, 22 bp, Homo sapiens
cagctggtgagcttagtagggt

SEQ ID NO: 7030857 - DNA, 22 bp, Homo sapiens
cagcataggacagggtttcatc

SEQ ID NO: 7030858 - DNA, 22 bp, Homo sapiens
tttgactcctttgtgaaaagag

SEQ ID NO: 7030859 - DNA, 23 bp, Homo sapiens
tcagagatggaaagcagaccacg

SEQ ID NO: 7030860 - DNA, 22 bp, Homo sapiens
gtccaggaagcaataaatagaa

SEQ ID NO: 7030861 - DNA, 22 bp, Homo sapiens
tctcttctaacactagaaattc

SEQ ID NO: 7030862 - DNA, 19 bp, Homo sapiens
gggcatcaaagtgctggtg

SEQ ID NO: 7030863 - DNA, 22 bp, Homo sapiens
gacagctgaacaggtgggataa

SEQ ID NO: 7030864 - DNA, 22 bp, Homo sapiens
tggaagactcaaggtggtgaat

SEQ ID NO: 7030865 - DNA, 20 bp, Homo sapiens
ggagtcaccaagagagaccc

SEQ ID NO: 7030866 - DNA, 22 bp, Homo sapiens
acagctgcacactgaacttggt

SEQ ID NO: 7030867 - DNA, 23 bp, Homo sapiens
actgcctgctactatgcccacgg

SEQ ID NO: 7030868 - DNA, 22 bp, Homo sapiens
ctgagctggtgtttcagggtca

SEQ ID NO: 7030869 - DNA, 22 bp, Homo sapiens
attccactgttataaaatgtcc

SEQ ID NO: 7030870 - DNA, 22 bp, Homo sapiens
tcagccaggccctaagagattg

SEQ ID NO: 7030871 - DNA, 22 bp, Homo sapiens
agggcaatgttgctgttcagaa

SEQ ID NO: 7030872 - DNA, 22 bp, Homo sapiens
atggggaagagccagtgagctg

SEQ ID NO: 7030873 - DNA, 22 bp, Homo sapiens
ccagccttactgcccttcagtg

SEQ ID NO: 7030874 - DNA, 22 bp, Homo sapiens
attctctgaagtcaatggaaat

SEQ ID NO: 7030875 - DNA, 22 bp, Homo sapiens
gtaagtaataagtgctcaataa

SEQ ID NO: 7030876 - DNA, 21 bp, Homo sapiens
tgcaagcctctgtgagattct

SEQ ID NO: 7030877 - DNA, 22 bp, Homo sapiens
gttgccagacttctgtggctcc

SEQ ID NO: 7030878 - DNA, 22 bp, Homo sapiens
gcaatccaggaaaaaccaggga

SEQ ID NO: 7030879 - DNA, 22 bp, Homo sapiens
ccagctttccagggttgactgg

SEQ ID NO: 7030880 - DNA, 22 bp, Homo sapiens
ttagttctcatgaattttaagt

SEQ ID NO: 7030881 - DNA, 19 bp, Homo sapiens
cgtgaacatgactgcatgg

SEQ ID NO: 7030882 - DNA, 22 bp, Homo sapiens
tgtaccatctcagcattcagga

SEQ ID NO: 7030883 - DNA, 22 bp, Homo sapiens
cttagaattttaatccagaaag

SEQ ID NO: 7030884 - DNA, 22 bp, Homo sapiens
aaaagtttaagactcattctag

SEQ ID NO: 7030885 - DNA, 22 bp, Homo sapiens
tcatagaatgagttaatgaact

SEQ ID NO: 7030886 - DNA, 22 bp, Homo sapiens
tgcccagcactgtgccagtcac

SEQ ID NO: 7030887 - DNA, 22 bp, Homo sapiens
gcctgctcagacctagcaggcc

SEQ ID NO: 7030888 - DNA, 22 bp, Homo sapiens
cagctctgctggtggtgccagg

SEQ ID NO: 7030889 - DNA, 22 bp, Homo sapiens
tctctggaagcgcagatctgtt

SEQ ID NO: 7030890 - DNA, 22 bp, Homo sapiens
ctaaattatcatgagaattatg

SEQ ID NO: 7030891 - DNA, 22 bp, Homo sapiens
agaatcttgggcaaattcatct

SEQ ID NO: 7030892 - DNA, 17 bp, Homo sapiens
ctattttggagattaaa

SEQ ID NO: 7030893 - DNA, 22 bp, Homo sapiens
gctgctggggtggagaaacgct

SEQ ID NO: 7030894 - DNA, 22 bp, Homo sapiens
gaaatgtcctcatgaaggaagt

SEQ ID NO: 7030895 - DNA, 22 bp, Homo sapiens
agttacctttctgaaacttcgt

SEQ ID NO: 7030896 - DNA, 22 bp, Homo sapiens
gaaggctgcatggaggctgtgg

SEQ ID NO: 7030897 - DNA, 22 bp, Homo sapiens
cactgaacctgaaccaatactc

SEQ ID NO: 7030898 - DNA, 22 bp, Homo sapiens
atacatgtaactgcattgtaat

SEQ ID NO: 7030899 - DNA, 21 bp, Homo sapiens
cttctcaggaccacactagga

SEQ ID NO: 7030900 - DNA, 22 bp, Homo sapiens
atggaatttggagattaggcat

SEQ ID NO: 7030901 - DNA, 22 bp, Homo sapiens
agcttgtcagcagttaatgata

SEQ ID NO: 7030902 - DNA, 21 bp, Homo sapiens
agggcctctgtgtactggggg

SEQ ID NO: 7030903 - DNA, 22 bp, Homo sapiens
tgccagagatttcacactgcta

SEQ ID NO: 7030904 - DNA, 22 bp, Homo sapiens
acagcagctaaaggtgtctcct

SEQ ID NO: 7030905 - DNA, 22 bp, Homo sapiens
ttgggaaagccacaaattggag

SEQ ID NO: 7030906 - DNA, 22 bp, Homo sapiens
tacagtacacaggtaccaagct

SEQ ID NO: 7030907 - DNA, 22 bp, Homo sapiens
atgtgtttttattctggcatgt

SEQ ID NO: 7030908 - DNA, 22 bp, Homo sapiens
atggacagacactggccttctg

SEQ ID NO: 7030909 - DNA, 22 bp, Homo sapiens
ctctactgagagcagcagatat

SEQ ID NO: 7030910 - DNA, 17 bp, Homo sapiens
tccaggcagcaactgag

SEQ ID NO: 7030911 - DNA, 22 bp, Homo sapiens
aagcaactccctcctcattttt

SEQ ID NO: 7030912 - DNA, 22 bp, Homo sapiens
aataccacctcattctggaggc

SEQ ID NO: 7030913 - DNA, 22 bp, Homo sapiens
gacatttattggattttacgag

SEQ ID NO: 7030914 - DNA, 22 bp, Homo sapiens
gagagctgcattctcagacaca

SEQ ID NO: 7030915 - DNA, 22 bp, Homo sapiens
ggcgcccccttcaaacagagca

SEQ ID NO: 7030916 - DNA, 21 bp, Homo sapiens
tgtcacattgtccctgctgct

SEQ ID NO: 7030917 - DNA, 22 bp, Homo sapiens
agtgctgactctgggcacagtg

SEQ ID NO: 7030918 - DNA, 22 bp, Homo sapiens
cagacagaaggctccttgaggt

SEQ ID NO: 7030919 - DNA, 22 bp, Homo sapiens
agggtggcttaattccaaaggg

SEQ ID NO: 7030920 - DNA, 22 bp, Homo sapiens
aggctccttgttcatcatccat

SEQ ID NO: 7030921 - DNA, 22 bp, Homo sapiens
gaggaaggagggaaagcgcgcg

SEQ ID NO: 7030922 - DNA, 22 bp, Homo sapiens
gttgcagactcaagaaaataaa

SEQ ID NO: 7030923 - DNA, 22 bp, Homo sapiens
tagtttctaaactgaactgtca

SEQ ID NO: 7030924 - DNA, 22 bp, Homo sapiens
agctctttgagaaggcagtgtg

SEQ ID NO: 7030925 - DNA, 22 bp, Homo sapiens
caggagttcaaggttgcagtga

SEQ ID NO: 7030926 - DNA, 22 bp, Homo sapiens
aactttggccacaagtaccctg

SEQ ID NO: 7030927 - DNA, 22 bp, Homo sapiens
tcactggattctcttttgttcc

SEQ ID NO: 7030928 - DNA, 21 bp, Homo sapiens
tctcaggcgagaattctttta

SEQ ID NO: 7030929 - DNA, 22 bp, Homo sapiens
ttcagtttcagtcttgcaaaaa

SEQ ID NO: 7030930 - DNA, 22 bp, Homo sapiens
aaccaggagattaaagaaaggt

SEQ ID NO: 7030931 - DNA, 23 bp, Homo sapiens
gtgctttatgatctgctgtccct

SEQ ID NO: 7030932 - DNA, 22 bp, Homo sapiens
gcactggtcagcatgtttcgca

SEQ ID NO: 7030933 - DNA, 22 bp, Homo sapiens
tggcttctagtttgaggaaaaa

SEQ ID NO: 7030934 - DNA, 22 bp, Homo sapiens
ttttgtgtgtggtgatacaaag

SEQ ID NO: 7030935 - DNA, 22 bp, Homo sapiens
tatgccaggcgtggggtgaccg

SEQ ID NO: 7030936 - DNA, 22 bp, Homo sapiens
tctttgtaaatgcctagcataa

SEQ ID NO: 7030937 - DNA, 22 bp, Homo sapiens
gaaggcttgcaagtggttcata

SEQ ID NO: 7030938 - DNA, 22 bp, Homo sapiens
ttgtgttaaggtgcatctagtg

SEQ ID NO: 7030939 - DNA, 22 bp, Homo sapiens
tgctggctttaaggttaaagtg

SEQ ID NO: 7030940 - DNA, 22 bp, Homo sapiens
gcacgtgttctgtggcatgggt

SEQ ID NO: 7030941 - DNA, 22 bp, Homo sapiens
gcagtgtgtgtccccacactgg

SEQ ID NO: 7030942 - DNA, 22 bp, Homo sapiens
tgaaatacacaaatttagtaag

SEQ ID NO: 7030943 - DNA, 22 bp, Homo sapiens
ttacacatctagacccattttt

SEQ ID NO: 7030944 - DNA, 22 bp, Homo sapiens
tgaaagcagcaccaataccatt

SEQ ID NO: 7030945 - DNA, 22 bp, Homo sapiens
tccgccaggactgagggcccat

SEQ ID NO: 7030946 - DNA, 22 bp, Homo sapiens
tgcatcatgcggaactggcttt

SEQ ID NO: 7030947 - DNA, 22 bp, Homo sapiens
tgggagcaggaagcaggaagta

SEQ ID NO: 7030948 - DNA, 22 bp, Homo sapiens
acagctgacattggcagctatt

SEQ ID NO: 7030949 - DNA, 22 bp, Homo sapiens
aaattttagaccaggcaaaact

SEQ ID NO: 7030950 - DNA, 16 bp, Homo sapiens
gagtgctagaatcggg

SEQ ID NO: 7030951 - DNA, 22 bp, Homo sapiens
tctctgagcaccagtgtattcg

SEQ ID NO: 7030952 - DNA, 22 bp, Homo sapiens
cccaggaaaggaaatgaatggg

SEQ ID NO: 7030953 - DNA, 22 bp, Homo sapiens
gctgtcttggaaaaggcaaaga

SEQ ID NO: 7030954 - DNA, 22 bp, Homo sapiens
tttttctggataactgtatctc

SEQ ID NO: 7030955 - DNA, 22 bp, Homo sapiens
ggttcactccgatctctgcctc

SEQ ID NO: 7030956 - DNA, 19 bp, Homo sapiens
gcacacagtagggctggca

SEQ ID NO: 7030957 - DNA, 22 bp, Homo sapiens
agatgttttagagtttgacttg

SEQ ID NO: 7030958 - DNA, 22 bp, Homo sapiens
aagcaaaaggttacacttctgg

SEQ ID NO: 7030959 - DNA, 22 bp, Homo sapiens
ctgtccagtgactttgggccat

SEQ ID NO: 7030960 - DNA, 22 bp, Homo sapiens
caatcacaaagagacaagtgtc

SEQ ID NO: 7030961 - DNA, 20 bp, Homo sapiens
tcagataaggtgatctgtgg

SEQ ID NO: 7030962 - DNA, 22 bp, Homo sapiens
gtagggatggaagccatgaaat

SEQ ID NO: 7030963 - DNA, 18 bp, Homo sapiens
gagacacaagggcctgga

SEQ ID NO: 7030964 - DNA, 22 bp, Homo sapiens
gcaaatcaccacctagctggat

SEQ ID NO: 7030965 - DNA, 23 bp, Homo sapiens
ggagccagcctgtggggagcggg

SEQ ID NO: 7030966 - DNA, 22 bp, Homo sapiens
atggttaaattggttatttatg

SEQ ID NO: 7030967 - DNA, 21 bp, Homo sapiens
ccttgaggcccaggccaggcc

SEQ ID NO: 7030968 - DNA, 22 bp, Homo sapiens
ctggggctgcggtggaggagcc

SEQ ID NO: 7030969 - DNA, 22 bp, Homo sapiens
ccattaaaatggaatgtagtga

SEQ ID NO: 7030970 - DNA, 22 bp, Homo sapiens
tgtcacagtttgtactttatag

SEQ ID NO: 7030971 - DNA, 22 bp, Homo sapiens
cccacagggctgctgatggcag

SEQ ID NO: 7030972 - DNA, 22 bp, Homo sapiens
cttgacactgtcactcaggcca

SEQ ID NO: 7030973 - DNA, 22 bp, Homo sapiens
cctggtcccattgcggctgcct

SEQ ID NO: 7030974 - DNA, 22 bp, Homo sapiens
aggtttatggagcaccacatct

SEQ ID NO: 7030975 - DNA, 22 bp, Homo sapiens
aaggccagagcgtgtcctgcct

SEQ ID NO: 7030976 - DNA, 22 bp, Homo sapiens
gacatacagccctctccctggt

SEQ ID NO: 7030977 - DNA, 22 bp, Homo sapiens
atcagaatagtgggggacagtc

SEQ ID NO: 7030978 - DNA, 22 bp, Homo sapiens
aaattaagggtgagaagagttg

SEQ ID NO: 7030979 - DNA, 22 bp, Homo sapiens
ctttcatagttaaaatagtttg

SEQ ID NO: 7030980 - DNA, 22 bp, Homo sapiens
atgattctggggcaaaagctgg

SEQ ID NO: 7030981 - DNA, 22 bp, Homo sapiens
ctggtttaagcttatatagttg

SEQ ID NO: 7030982 - DNA, 22 bp, Homo sapiens
aaagccttgcccgtcactggga

SEQ ID NO: 7030983 - DNA, 21 bp, Homo sapiens
atttgcattaaaatattacgc

SEQ ID NO: 7030984 - DNA, 22 bp, Homo sapiens
gatcagtttattaattttctag

SEQ ID NO: 7030985 - DNA, 22 bp, Homo sapiens
tgttcactggaacacagctgta

SEQ ID NO: 7030986 - DNA, 22 bp, Homo sapiens
ttctttccccatggagttcgga

SEQ ID NO: 7030987 - DNA, 18 bp, Homo sapiens
tctgagggtgcgggagct

SEQ ID NO: 7030988 - DNA, 22 bp, Homo sapiens
cagagcaggaatagggtgttga

SEQ ID NO: 7030989 - DNA, 22 bp, Homo sapiens
gagcttgcctagttttttaaac

SEQ ID NO: 7030990 - DNA, 22 bp, Homo sapiens
gctcccttaggccttgccggga

SEQ ID NO: 7030991 - DNA, 19 bp, Homo sapiens
agccagggtccagacatgt

SEQ ID NO: 7030992 - DNA, 22 bp, Homo sapiens
tgctggcaggcacctcctgggg

SEQ ID NO: 7030993 - DNA, 22 bp, Homo sapiens
cggccctgctgagcttgtctgg

SEQ ID NO: 7030994 - DNA, 22 bp, Homo sapiens
ttatctgttgcttaatgcgcat

SEQ ID NO: 7030995 - DNA, 22 bp, Homo sapiens
ttctgggcccactgtagcatcc

SEQ ID NO: 7030996 - DNA, 22 bp, Homo sapiens
tggatgcctgggcctccttcca

SEQ ID NO: 7030997 - DNA, 22 bp, Homo sapiens
ttgtgtttctggccaagatgga

SEQ ID NO: 7030998 - DNA, 22 bp, Homo sapiens
cctgaggacatcagcatcacct

SEQ ID NO: 7030999 - DNA, 17 bp, Homo sapiens
ggaccaggggttgccat

SEQ ID NO: 7031000 - DNA, 22 bp, Homo sapiens
gcagtccccgtcgtggcaggga

SEQ ID NO: 7031001 - DNA, 22 bp, Homo sapiens
gcagggacagggcagggccttt

SEQ ID NO: 7031002 - DNA, 22 bp, Homo sapiens
tattgactaaattggaaagaat

SEQ ID NO: 7031003 - DNA, 22 bp, Homo sapiens
gcaaggctggtggtggtgaagt

SEQ ID NO: 7031004 - DNA, 22 bp, Homo sapiens
acagagttaatggataggcagg

SEQ ID NO: 7031005 - DNA, 19 bp, Homo sapiens
atgtacccagtgtcaatcc

SEQ ID NO: 7031006 - DNA, 22 bp, Homo sapiens
tgaggcctgaagcctggagcct

SEQ ID NO: 7031007 - DNA, 22 bp, Homo sapiens
tgggcagaaatcagtatcagat

SEQ ID NO: 7031008 - DNA, 20 bp, Homo sapiens
gcacatgcaacttttattta

SEQ ID NO: 7031009 - DNA, 22 bp, Homo sapiens
ctgctcctgtgggccagtggcc

SEQ ID NO: 7031010 - DNA, 22 bp, Homo sapiens
tttcttggatgtgaaactaggg

SEQ ID NO: 7031011 - DNA, 22 bp, Homo sapiens
ggcagaagaaaggctaagtctc

SEQ ID NO: 7031012 - DNA, 22 bp, Homo sapiens
accgggtaggtgtcaactctga

SEQ ID NO: 7031013 - DNA, 22 bp, Homo sapiens
gagattctttccagaactttga

SEQ ID NO: 7031014 - DNA, 22 bp, Homo sapiens
tagattccattggcccagagaa

SEQ ID NO: 7031015 - DNA, 22 bp, Homo sapiens
gtagaattttaataatggagat

SEQ ID NO: 7031016 - DNA, 22 bp, Homo sapiens
gctctgagtctcagctaccaca

SEQ ID NO: 7031017 - DNA, 22 bp, Homo sapiens
ttggcaattcaccaaggctcgc

SEQ ID NO: 7031018 - DNA, 22 bp, Homo sapiens
tcacattttcaaaagctggtgc

SEQ ID NO: 7031019 - DNA, 22 bp, Homo sapiens
agagcccctgggtcacacagcc

SEQ ID NO: 7031020 - DNA, 22 bp, Homo sapiens
atacactgatctttttatgggg

SEQ ID NO: 7031021 - DNA, 22 bp, Homo sapiens
atgtatgttttcagttgtatta

SEQ ID NO: 7031022 - DNA, 22 bp, Homo sapiens
tccaggtcatcttggagagctg

SEQ ID NO: 7031023 - DNA, 22 bp, Homo sapiens
gtaggtaagtacttctggtgag

SEQ ID NO: 7031024 - DNA, 22 bp, Homo sapiens
gtggcagtggagacccgagcct

SEQ ID NO: 7031025 - DNA, 22 bp, Homo sapiens
actgttatagttcacttttccc

SEQ ID NO: 7031026 - DNA, 20 bp, Homo sapiens
tcagatttttctaactttga

SEQ ID NO: 7031027 - DNA, 22 bp, Homo sapiens
aagctgttctctaagtttcatg

SEQ ID NO: 7031028 - DNA, 22 bp, Homo sapiens
gtggctcatctttgggaagtaa

SEQ ID NO: 7031029 - DNA, 22 bp, Homo sapiens
tatgttgaatagatgaatggca

SEQ ID NO: 7031030 - DNA, 22 bp, Homo sapiens
ctatacagcagcttactagtta

SEQ ID NO: 7031031 - DNA, 22 bp, Homo sapiens
cagtgtgtttcatgtaggtcct

SEQ ID NO: 7031032 - DNA, 22 bp, Homo sapiens
aataagacacgctattactaga

SEQ ID NO: 7031033 - DNA, 20 bp, Homo sapiens
agcatcctcatatccgctca

SEQ ID NO: 7031034 - DNA, 22 bp, Homo sapiens
ctgggttggggttacatgactg

SEQ ID NO: 7031035 - DNA, 22 bp, Homo sapiens
ttctctacttcacaagggatgg

SEQ ID NO: 7031036 - DNA, 22 bp, Homo sapiens
aagttcttgctgtgtgtcagat

SEQ ID NO: 7031037 - DNA, 22 bp, Homo sapiens
ttgatgtatgtatgtatgtagg

SEQ ID NO: 7031038 - DNA, 22 bp, Homo sapiens
tgctgggcttgaaagctgctaa

SEQ ID NO: 7031039 - DNA, 22 bp, Homo sapiens
ggaggcacttcccgtctcagcc

SEQ ID NO: 7031040 - DNA, 21 bp, Homo sapiens
tgaagggcagcctcaggctcc

SEQ ID NO: 7031041 - DNA, 22 bp, Homo sapiens
gagccctcaatgaatctgcatt

SEQ ID NO: 7031042 - DNA, 22 bp, Homo sapiens
ccagctggagccaaggtggact

SEQ ID NO: 7031043 - DNA, 21 bp, Homo sapiens
tccagctgtgattatgaatgt

SEQ ID NO: 7031044 - DNA, 22 bp, Homo sapiens
tggaaatggatctgatgagtct

SEQ ID NO: 7031045 - DNA, 22 bp, Homo sapiens
tggaaggcatttcacacaggat

SEQ ID NO: 7031046 - DNA, 22 bp, Homo sapiens
ccccagcccacaagcatattaa

SEQ ID NO: 7031047 - DNA, 20 bp, Homo sapiens
gcatccatatatgcatgtgt

SEQ ID NO: 7031048 - DNA, 22 bp, Homo sapiens
tggaagacaatgtacatgcagt

SEQ ID NO: 7031049 - DNA, 22 bp, Homo sapiens
tccaggccttgacaggtcagtt

SEQ ID NO: 7031050 - DNA, 22 bp, Homo sapiens
caagatttatattttcacacaa

SEQ ID NO: 7031051 - DNA, 22 bp, Homo sapiens
tgtagcactcatcaactatgtt

SEQ ID NO: 7031052 - DNA, 22 bp, Homo sapiens
tgcagaagaaaacagctgtgtg

SEQ ID NO: 7031053 - DNA, 22 bp, Homo sapiens
gcctaaggaaattaatgcaact

SEQ ID NO: 7031054 - DNA, 22 bp, Homo sapiens
agacaattgttctaagtaaaaa

SEQ ID NO: 7031055 - DNA, 22 bp, Homo sapiens
aagtatcaaatggtagcatatg

SEQ ID NO: 7031056 - DNA, 19 bp, Homo sapiens
caggtaacatatgcacaaa

SEQ ID NO: 7031057 - DNA, 22 bp, Homo sapiens
aggaaatgtagtcctcatctcc

SEQ ID NO: 7031058 - DNA, 22 bp, Homo sapiens
gagcctgcgagggagtaaggca

SEQ ID NO: 7031059 - DNA, 22 bp, Homo sapiens
agatcatattgtaactttattg

SEQ ID NO: 7031060 - DNA, 22 bp, Homo sapiens
gaaggctgcgaggggagtgccg

SEQ ID NO: 7031061 - DNA, 19 bp, Homo sapiens
aggtgctggtgagggtgtt

SEQ ID NO: 7031062 - DNA, 22 bp, Homo sapiens
acaatgaacgctttttaactgt

SEQ ID NO: 7031063 - DNA, 22 bp, Homo sapiens
gctgtgcaaatcgatttgttgg

SEQ ID NO: 7031064 - DNA, 22 bp, Homo sapiens
ctggatgtggtaatgactttga

SEQ ID NO: 7031065 - DNA, 22 bp, Homo sapiens
tgtgtgtctttgcctcctctca

SEQ ID NO: 7031066 - DNA, 22 bp, Homo sapiens
agactgaagcaattcaaccagt

SEQ ID NO: 7031067 - DNA, 22 bp, Homo sapiens
tggctctccagagcctatggta

SEQ ID NO: 7031068 - DNA, 22 bp, Homo sapiens
gctcaagactgttagcctggca

SEQ ID NO: 7031069 - DNA, 22 bp, Homo sapiens
attgcaaataactgtactgaat

SEQ ID NO: 7031070 - DNA, 22 bp, Homo sapiens
agctcaagtatttgggatttgt

SEQ ID NO: 7031071 - DNA, 22 bp, Homo sapiens
catgcaaatggtggctaaatgg

SEQ ID NO: 7031072 - DNA, 22 bp, Homo sapiens
aagcctcaccttttagaagcta

SEQ ID NO: 7031073 - DNA, 22 bp, Homo sapiens
tcaacagttctgtccaattaat

SEQ ID NO: 7031074 - DNA, 20 bp, Homo sapiens
acctggagagattattacca

SEQ ID NO: 7031075 - DNA, 22 bp, Homo sapiens
atatttataagcaagcaggact

SEQ ID NO: 7031076 - DNA, 22 bp, Homo sapiens
actaaagtgttggagaatgagg

SEQ ID NO: 7031077 - DNA, 22 bp, Homo sapiens
acaaagattcatttgcattatt

SEQ ID NO: 7031078 - DNA, 22 bp, Homo sapiens
ggaatgttctggtctggttcat

SEQ ID NO: 7031079 - DNA, 22 bp, Homo sapiens
gagcctgggactgggggtcatg

SEQ ID NO: 7031080 - DNA, 22 bp, Homo sapiens
agaaagcaccctgcactttctg

SEQ ID NO: 7031081 - DNA, 22 bp, Homo sapiens
ttaaattagtcaagcttctctg

SEQ ID NO: 7031082 - DNA, 22 bp, Homo sapiens
gctggctgcacaggggctcact

SEQ ID NO: 7031083 - DNA, 22 bp, Homo sapiens
tcctcgatgggcaggaagatct

SEQ ID NO: 7031084 - DNA, 22 bp, Homo sapiens
ttcatgttggcatgtttttagg

SEQ ID NO: 7031085 - DNA, 22 bp, Homo sapiens
ttggtcttgtggcatctttcca

SEQ ID NO: 7031086 - DNA, 22 bp, Homo sapiens
gagctgaggctgaggcctcact

SEQ ID NO: 7031087 - DNA, 22 bp, Homo sapiens
agcaccagagctatgggcctgc

SEQ ID NO: 7031088 - DNA, 22 bp, Homo sapiens
ttttccactttagtgcaataac

SEQ ID NO: 7031089 - DNA, 22 bp, Homo sapiens
agtacaagtgatgtggtaaaaa

SEQ ID NO: 7031090 - DNA, 22 bp, Homo sapiens
gggggaaagctcaggagcctgt

SEQ ID NO: 7031091 - DNA, 22 bp, Homo sapiens
ttctagttttgccttatcaaca

SEQ ID NO: 7031092 - DNA, 22 bp, Homo sapiens
atggttattactgctgttccag

SEQ ID NO: 7031093 - DNA, 23 bp, Homo sapiens
tttaactttccaataattcattg

SEQ ID NO: 7031094 - DNA, 22 bp, Homo sapiens
ttatgtactctgcaatgtttga

SEQ ID NO: 7031095 - DNA, 22 bp, Homo sapiens
aaggccaggagacttggagtca

SEQ ID NO: 7031096 - DNA, 22 bp, Homo sapiens
ctgcaaatccctactgggcaca

SEQ ID NO: 7031097 - DNA, 22 bp, Homo sapiens
ctcaggaaaatattgaagaagt

SEQ ID NO: 7031098 - DNA, 22 bp, Homo sapiens
tagggatgactatgattcccac

SEQ ID NO: 7031099 - DNA, 22 bp, Homo sapiens
atgagcttcccagacaggatgg

SEQ ID NO: 7031100 - DNA, 22 bp, Homo sapiens
tttggcttgcactggcaccaac

SEQ ID NO: 7031101 - DNA, 22 bp, Homo sapiens
ggaggtaacacaggcactgtgc

SEQ ID NO: 7031102 - DNA, 22 bp, Homo sapiens
ttgatattctgagaagctgaag

SEQ ID NO: 7031103 - DNA, 22 bp, Homo sapiens
tcaggcaggtggctggctatgg

SEQ ID NO: 7031104 - DNA, 22 bp, Homo sapiens
tttgcatttgcaaataatgaaa

SEQ ID NO: 7031105 - DNA, 18 bp, Homo sapiens
tttgttgggttgccttta

SEQ ID NO: 7031106 - DNA, 22 bp, Homo sapiens
actgaaggtctcagcaaggatg

SEQ ID NO: 7031107 - DNA, 22 bp, Homo sapiens
agactcatttgagacgatgatg

SEQ ID NO: 7031108 - DNA, 22 bp, Homo sapiens
gcagcagagaccccaggaagga

SEQ ID NO: 7031109 - DNA, 22 bp, Homo sapiens
gtataaggtatgtaaactattt

SEQ ID NO: 7031110 - DNA, 22 bp, Homo sapiens
acatgggatgacctccgatggt

SEQ ID NO: 7031111 - DNA, 22 bp, Homo sapiens
tggtgagagcagaccttctttt

SEQ ID NO: 7031112 - DNA, 22 bp, Homo sapiens
cctgaactctaaatagagcagt

SEQ ID NO: 7031113 - DNA, 22 bp, Homo sapiens
taacagtcatgtgctactgcta

SEQ ID NO: 7031114 - DNA, 22 bp, Homo sapiens
tccctgtgagaaatgaagcagg

SEQ ID NO: 7031115 - DNA, 22 bp, Homo sapiens
aagtgacaaaagggtatccaaa

SEQ ID NO: 7031116 - DNA, 22 bp, Homo sapiens
agtggctggtagttactgagca

SEQ ID NO: 7031117 - DNA, 22 bp, Homo sapiens
ctcagacccccagagctgctaa

SEQ ID NO: 7031118 - DNA, 22 bp, Homo sapiens
ttctaactggtgcagtgctgca

SEQ ID NO: 7031119 - DNA, 18 bp, Homo sapiens
aggttttcagagtttcca

SEQ ID NO: 7031120 - DNA, 22 bp, Homo sapiens
agtctggaatttggcctgagca

SEQ ID NO: 7031121 - DNA, 22 bp, Homo sapiens
agtcttagtatggttttaggtt

SEQ ID NO: 7031122 - DNA, 22 bp, Homo sapiens
actgcagccttgaactctgggc

SEQ ID NO: 7031123 - DNA, 22 bp, Homo sapiens
gagaggtgaaggctgccctggg

SEQ ID NO: 7031124 - DNA, 22 bp, Homo sapiens
ggaccagcaatcaagaacctac

SEQ ID NO: 7031125 - DNA, 22 bp, Homo sapiens
gaagctgcaataattgttttga

SEQ ID NO: 7031126 - DNA, 22 bp, Homo sapiens
cagaaattggaatagagaaata

SEQ ID NO: 7031127 - DNA, 20 bp, Homo sapiens
attaggattttaggtcatca

SEQ ID NO: 7031128 - DNA, 22 bp, Homo sapiens
agcatttatttcttagaaattg

SEQ ID NO: 7031129 - DNA, 22 bp, Homo sapiens
taaggcacttcaatgtttagaa

SEQ ID NO: 7031130 - DNA, 22 bp, Homo sapiens
catggctcggggacaggaggta

SEQ ID NO: 7031131 - DNA, 21 bp, Homo sapiens
tcccaagaatatgcataagtt

SEQ ID NO: 7031132 - DNA, 22 bp, Homo sapiens
taggatgaggggtggccaagta

SEQ ID NO: 7031133 - DNA, 22 bp, Homo sapiens
tgtaggcatcactttctcttgg

SEQ ID NO: 7031134 - DNA, 22 bp, Homo sapiens
tgggcctgaaattcccatttta

SEQ ID NO: 7031135 - DNA, 22 bp, Homo sapiens
ctctgcctgcccaccgacccat

SEQ ID NO: 7031136 - DNA, 22 bp, Homo sapiens
agggccagagtctgtgtagata

SEQ ID NO: 7031137 - DNA, 22 bp, Homo sapiens
atgcttaaccttggtgtacaat

SEQ ID NO: 7031138 - DNA, 22 bp, Homo sapiens
tcatggctaatgcagtatattc

SEQ ID NO: 7031139 - DNA, 22 bp, Homo sapiens
aatgaacccttcaagctctgat

SEQ ID NO: 7031140 - DNA, 22 bp, Homo sapiens
taacacagtgtctaccattatt

SEQ ID NO: 7031141 - DNA, 20 bp, Homo sapiens
tgcagagctggctggctcct

SEQ ID NO: 7031142 - DNA, 22 bp, Homo sapiens
actctgagtcatgcactccttg

SEQ ID NO: 7031143 - DNA, 20 bp, Homo sapiens
ttctttcatctacacgttgt

SEQ ID NO: 7031144 - DNA, 22 bp, Homo sapiens
ctgggcctttacctacggagtt

SEQ ID NO: 7031145 - DNA, 22 bp, Homo sapiens
caaggccttgctgtctcctcct

SEQ ID NO: 7031146 - DNA, 22 bp, Homo sapiens
tattccaggggaaggtatcctg

SEQ ID NO: 7031147 - DNA, 22 bp, Homo sapiens
catgtcagggaagagagtcagt

SEQ ID NO: 7031148 - DNA, 20 bp, Homo sapiens
tttgagaccagtctgcccaa

SEQ ID NO: 7031149 - DNA, 19 bp, Homo sapiens
gagctgagagtagcactgg

SEQ ID NO: 7031150 - DNA, 22 bp, Homo sapiens
ttgaaagaaggtggtagagaat

SEQ ID NO: 7031151 - DNA, 21 bp, Homo sapiens
ggccagctcggaaggtcccat

SEQ ID NO: 7031152 - DNA, 22 bp, Homo sapiens
atcaccaaggctttaggaattt

SEQ ID NO: 7031153 - DNA, 22 bp, Homo sapiens
acagcccgttctctggcacaca

SEQ ID NO: 7031154 - DNA, 22 bp, Homo sapiens
gctgtcaaggtagaaaacagag

SEQ ID NO: 7031155 - DNA, 22 bp, Homo sapiens
tgtgaaggtagctcttggcact

SEQ ID NO: 7031156 - DNA, 22 bp, Homo sapiens
caatggctttatgtatcatctc

SEQ ID NO: 7031157 - DNA, 22 bp, Homo sapiens
cagtgattcagactcatcattt

SEQ ID NO: 7031158 - DNA, 22 bp, Homo sapiens
catgtacatgcctactatcaat

SEQ ID NO: 7031159 - DNA, 21 bp, Homo sapiens
tattgcttgtaggtcatcctg

SEQ ID NO: 7031160 - DNA, 22 bp, Homo sapiens
caaggctgcactgttgccatag

SEQ ID NO: 7031161 - DNA, 20 bp, Homo sapiens
ggggctgcatgcagagaaga

SEQ ID NO: 7031162 - DNA, 22 bp, Homo sapiens
tccctcagatgagctcctagca

SEQ ID NO: 7031163 - DNA, 22 bp, Homo sapiens
ttccagagaaaaggtttatttc

SEQ ID NO: 7031164 - DNA, 22 bp, Homo sapiens
gacacaggggggcgctagaaga

SEQ ID NO: 7031165 - DNA, 22 bp, Homo sapiens
gtgcatggtaagatgcttcaca

SEQ ID NO: 7031166 - DNA, 22 bp, Homo sapiens
tattcatgtgttggaaaggaac

SEQ ID NO: 7031167 - DNA, 22 bp, Homo sapiens
tctcttctatttgagactattt

SEQ ID NO: 7031168 - DNA, 22 bp, Homo sapiens
tggcctgtgtggcttcctggga

SEQ ID NO: 7031169 - DNA, 22 bp, Homo sapiens
ggggccgaccgcggttcaggcc

SEQ ID NO: 7031170 - DNA, 20 bp, Homo sapiens
ataattacatagagattgcc

SEQ ID NO: 7031171 - DNA, 22 bp, Homo sapiens
tggtatttaatatatgagagtt

SEQ ID NO: 7031172 - DNA, 22 bp, Homo sapiens
tctgagctgggcacagaaggcg

SEQ ID NO: 7031173 - DNA, 22 bp, Homo sapiens
gacataaagttcttgcttgaat

SEQ ID NO: 7031174 - DNA, 22 bp, Homo sapiens
cggtccatgtcccctgcctcgg

SEQ ID NO: 7031175 - DNA, 22 bp, Homo sapiens
agtcaaggctattatgtgggaa

SEQ ID NO: 7031176 - DNA, 22 bp, Homo sapiens
catgtaaaacactcagaacagt

SEQ ID NO: 7031177 - DNA, 22 bp, Homo sapiens
tcagggaataagtagatgagtg

SEQ ID NO: 7031178 - DNA, 22 bp, Homo sapiens
tgtgtgacctggggtgagatag

SEQ ID NO: 7031179 - DNA, 22 bp, Homo sapiens
acaacagtttaggtatttgtag

SEQ ID NO: 7031180 - DNA, 22 bp, Homo sapiens
taatatacttcccatagtttga

SEQ ID NO: 7031181 - DNA, 22 bp, Homo sapiens
gaagcactgccataattcagac

SEQ ID NO: 7031182 - DNA, 22 bp, Homo sapiens
tagtggctgcagggctgtttga

SEQ ID NO: 7031183 - DNA, 22 bp, Homo sapiens
ggcagcttcttaatatggagac

SEQ ID NO: 7031184 - DNA, 22 bp, Homo sapiens
caggtccccagggtacctacct

SEQ ID NO: 7031185 - DNA, 22 bp, Homo sapiens
tccagcattttgatacttgaaa

SEQ ID NO: 7031186 - DNA, 21 bp, Homo sapiens
tcccctcacttgtcttctgag

SEQ ID NO: 7031187 - DNA, 19 bp, Homo sapiens
ttacagatgtggaaattga

SEQ ID NO: 7031188 - DNA, 19 bp, Homo sapiens
atttgctgcaatgcttcac

SEQ ID NO: 7031189 - DNA, 22 bp, Homo sapiens
ttcaaagtgcttttaaccttta

SEQ ID NO: 7031190 - DNA, 22 bp, Homo sapiens
tcaccactgaggccacgtggct

SEQ ID NO: 7031191 - DNA, 23 bp, Homo sapiens
gcctctgcagcctagttagtgtc

SEQ ID NO: 7031192 - DNA, 22 bp, Homo sapiens
acagaataactcttgcttgagt

SEQ ID NO: 7031193 - DNA, 22 bp, Homo sapiens
actggaaactacagcctatcct

SEQ ID NO: 7031194 - DNA, 22 bp, Homo sapiens
gggaatgtgattgttgttttaa

SEQ ID NO: 7031195 - DNA, 22 bp, Homo sapiens
gacaataagaacagatactgtg

SEQ ID NO: 7031196 - DNA, 22 bp, Homo sapiens
taatgcaaggaattccaagtag

SEQ ID NO: 7031197 - DNA, 22 bp, Homo sapiens
gttctagcctggggctccttgg

SEQ ID NO: 7031198 - DNA, 22 bp, Homo sapiens
agacaagactaggcagttgttg

SEQ ID NO: 7031199 - DNA, 17 bp, Homo sapiens
ggagtccaggggttagc

SEQ ID NO: 7031200 - DNA, 22 bp, Homo sapiens
aagaagatggttaactttcagt

SEQ ID NO: 7031201 - DNA, 22 bp, Homo sapiens
ctctggctttcccagggaggag

SEQ ID NO: 7031202 - DNA, 23 bp, Homo sapiens
cagggctggtagggaagagcgtg

SEQ ID NO: 7031203 - DNA, 22 bp, Homo sapiens
tacatttcagagctcctctctg

SEQ ID NO: 7031204 - DNA, 22 bp, Homo sapiens
gtctaaactttacagagtcaag

SEQ ID NO: 7031205 - DNA, 22 bp, Homo sapiens
tcccagaggctccagtctctat

SEQ ID NO: 7031206 - DNA, 22 bp, Homo sapiens
tctagcatttctttcctgagga

SEQ ID NO: 7031207 - DNA, 22 bp, Homo sapiens
ctccttcatgtcatgtgtccgg

SEQ ID NO: 7031208 - DNA, 22 bp, Homo sapiens
ggcatgcatcaccacgccacgc

SEQ ID NO: 7031209 - DNA, 22 bp, Homo sapiens
tttggtaaaatgaactagcttt

SEQ ID NO: 7031210 - DNA, 22 bp, Homo sapiens
agccattagtcattttagaata

SEQ ID NO: 7031211 - DNA, 22 bp, Homo sapiens
aggaagggctgtttctccaaga

SEQ ID NO: 7031212 - DNA, 22 bp, Homo sapiens
tcttctctacaccagcagcccc

SEQ ID NO: 7031213 - DNA, 22 bp, Homo sapiens
tgcacttttatatcactctggc

SEQ ID NO: 7031214 - DNA, 22 bp, Homo sapiens
ttgaggtattgataaaacattt

SEQ ID NO: 7031215 - DNA, 23 bp, Homo sapiens
tggatcagacagatctgggcttc

SEQ ID NO: 7031216 - DNA, 22 bp, Homo sapiens
ttgtccttcttcattcagtccc

SEQ ID NO: 7031217 - DNA, 22 bp, Homo sapiens
aatcaagaataagttgtaaagc

SEQ ID NO: 7031218 - DNA, 22 bp, Homo sapiens
ctgcttggcattggtaaagaat

SEQ ID NO: 7031219 - DNA, 22 bp, Homo sapiens
agttctcagaattgcacctcaa

SEQ ID NO: 7031220 - DNA, 22 bp, Homo sapiens
agcactttcctggcaaatgtgg

SEQ ID NO: 7031221 - DNA, 22 bp, Homo sapiens
agccagcaggtgggaaactgga

SEQ ID NO: 7031222 - DNA, 22 bp, Homo sapiens
agtgtacaaaatgatagataaa

SEQ ID NO: 7031223 - DNA, 22 bp, Homo sapiens
gcctctgctgacaagatggaca

SEQ ID NO: 7031224 - DNA, 22 bp, Homo sapiens
cccagccaaggtgctggtgttg

SEQ ID NO: 7031225 - DNA, 18 bp, Homo sapiens
tgtcttatgtttgggtgg

SEQ ID NO: 7031226 - DNA, 22 bp, Homo sapiens
caatcactgacctgcagatgca

SEQ ID NO: 7031227 - DNA, 22 bp, Homo sapiens
tgcagcagcagggaggaggctc

SEQ ID NO: 7031228 - DNA, 22 bp, Homo sapiens
aacttcagttgagaaaggcatg

SEQ ID NO: 7031229 - DNA, 21 bp, Homo sapiens
tccaggacttgagaattccag

SEQ ID NO: 7031230 - DNA, 22 bp, Homo sapiens
tgtttacttttaattacctgtc

SEQ ID NO: 7031231 - DNA, 22 bp, Homo sapiens
agattatgctggctgctacaag

SEQ ID NO: 7031232 - DNA, 22 bp, Homo sapiens
tatcagaagacttacagtatcg

SEQ ID NO: 7031233 - DNA, 22 bp, Homo sapiens
cagctgtgacagccagttgatg

SEQ ID NO: 7031234 - DNA, 22 bp, Homo sapiens
aagcagcaagtttatttctatc

SEQ ID NO: 7031235 - DNA, 22 bp, Homo sapiens
actgctctgttttcatatgttt

SEQ ID NO: 7031236 - DNA, 22 bp, Homo sapiens
aataccttgctgtagccacgca

SEQ ID NO: 7031237 - DNA, 22 bp, Homo sapiens
tttctctattaggggctagctt

SEQ ID NO: 7031238 - DNA, 22 bp, Homo sapiens
caggcagagtcagattagactt

SEQ ID NO: 7031239 - DNA, 22 bp, Homo sapiens
cagatccagccgctcctgggaa

SEQ ID NO: 7031240 - DNA, 22 bp, Homo sapiens
ttgcaacaggtgtgttttggtg

SEQ ID NO: 7031241 - DNA, 22 bp, Homo sapiens
tactgttttaaaaggtacttgt

SEQ ID NO: 7031242 - DNA, 22 bp, Homo sapiens
catggccctcttctggagcaat

SEQ ID NO: 7031243 - DNA, 22 bp, Homo sapiens
agtgaggctaataggcaatggt

SEQ ID NO: 7031244 - DNA, 22 bp, Homo sapiens
cagagggacagtatgatgaaag

SEQ ID NO: 7031245 - DNA, 22 bp, Homo sapiens
taggaggagggcatttgaagta

SEQ ID NO: 7031246 - DNA, 22 bp, Homo sapiens
gtagaatattttgttctactat

SEQ ID NO: 7031247 - DNA, 22 bp, Homo sapiens
ccaaaaagtacatttaggtgtg

SEQ ID NO: 7031248 - DNA, 22 bp, Homo sapiens
ttcatggtattggagtatgagg

SEQ ID NO: 7031249 - DNA, 22 bp, Homo sapiens
tcatttacatagaaacaatata

SEQ ID NO: 7031250 - DNA, 16 bp, Homo sapiens
caggaacctgtctggc

SEQ ID NO: 7031251 - DNA, 22 bp, Homo sapiens
aaattgtctctattttgattcg

SEQ ID NO: 7031252 - DNA, 22 bp, Homo sapiens
acatctcaaattccaggctcca

SEQ ID NO: 7031253 - DNA, 22 bp, Homo sapiens
tggtgcaatgttgaaagggagt

SEQ ID NO: 7031254 - DNA, 18 bp, Homo sapiens
tacttcaactcccagggc

SEQ ID NO: 7031255 - DNA, 22 bp, Homo sapiens
cagaagtgatgttgagctagtc

SEQ ID NO: 7031256 - DNA, 22 bp, Homo sapiens
atggtcataagaggagggccca

SEQ ID NO: 7031257 - DNA, 22 bp, Homo sapiens
aggccagacagctagaaacagg

SEQ ID NO: 7031258 - DNA, 22 bp, Homo sapiens
ccccacccacctaagagaaact

SEQ ID NO: 7031259 - DNA, 23 bp, Homo sapiens
atgacactcctgtgcgcaccctg

SEQ ID NO: 7031260 - DNA, 22 bp, Homo sapiens
ttccacaatggttaagctcgtt

SEQ ID NO: 7031261 - DNA, 22 bp, Homo sapiens
ttgggccctgctctgagttgct

SEQ ID NO: 7031262 - DNA, 22 bp, Homo sapiens
cagctctgggagtcccacccct

SEQ ID NO: 7031263 - DNA, 22 bp, Homo sapiens
attcaaagtaataaccagaact

SEQ ID NO: 7031264 - DNA, 22 bp, Homo sapiens
ttttcctgggctttctgtgtaa

SEQ ID NO: 7031265 - DNA, 22 bp, Homo sapiens
tatagttccatctgctctattt

SEQ ID NO: 7031266 - DNA, 22 bp, Homo sapiens
gagaggagtccctatcacagtt

SEQ ID NO: 7031267 - DNA, 22 bp, Homo sapiens
gtcacacagagccctgtgctca

SEQ ID NO: 7031268 - DNA, 22 bp, Homo sapiens
aacacagtcagttcctggatca

SEQ ID NO: 7031269 - DNA, 22 bp, Homo sapiens
ggagtgcggtggcaccatctca

SEQ ID NO: 7031270 - DNA, 22 bp, Homo sapiens
gaaagtatttacattaacatct

SEQ ID NO: 7031271 - DNA, 22 bp, Homo sapiens
tcagagacaccattttctttct

SEQ ID NO: 7031272 - DNA, 22 bp, Homo sapiens
actctgctcttatagtgttata

SEQ ID NO: 7031273 - DNA, 22 bp, Homo sapiens
atatttgtcatctgccttagtt

SEQ ID NO: 7031274 - DNA, 22 bp, Homo sapiens
actgtacacagtggtgtactgt

SEQ ID NO: 7031275 - DNA, 21 bp, Homo sapiens
aactttgcttaactgtgtgga

SEQ ID NO: 7031276 - DNA, 22 bp, Homo sapiens
ttgagcagatcgggctgtgggg

SEQ ID NO: 7031277 - DNA, 22 bp, Homo sapiens
caggttcccaggtccagggctt

SEQ ID NO: 7031278 - DNA, 22 bp, Homo sapiens
aaggacatggaaggaggagata

SEQ ID NO: 7031279 - DNA, 22 bp, Homo sapiens
atgacacccccacagcattgtt

SEQ ID NO: 7031280 - DNA, 22 bp, Homo sapiens
tgacatcattagtaacatagct

SEQ ID NO: 7031281 - DNA, 22 bp, Homo sapiens
ggagctgaggtaacagtgagtg

SEQ ID NO: 7031282 - DNA, 23 bp, Homo sapiens
aggaagagagagtgcctctttct

SEQ ID NO: 7031283 - DNA, 22 bp, Homo sapiens
tatgtgtcctgttaccggcagc

SEQ ID NO: 7031284 - DNA, 16 bp, Homo sapiens
tcagctatagggattg

SEQ ID NO: 7031285 - DNA, 22 bp, Homo sapiens
gtgaccataatagattatgagt

SEQ ID NO: 7031286 - DNA, 22 bp, Homo sapiens
aagatcaagatttaggttgagg

SEQ ID NO: 7031287 - DNA, 22 bp, Homo sapiens
gcaggtgggagccgctgcctga

SEQ ID NO: 7031288 - DNA, 22 bp, Homo sapiens
tgggccttacttggggctgact

SEQ ID NO: 7031289 - DNA, 21 bp, Homo sapiens
attattatttctgtgtccagc

SEQ ID NO: 7031290 - DNA, 22 bp, Homo sapiens
tgagtattgaagcgatttcaat

SEQ ID NO: 7031291 - DNA, 20 bp, Homo sapiens
tgtgtgtgtacttctaaata

SEQ ID NO: 7031292 - DNA, 22 bp, Homo sapiens
caagtttggattatgaaaaagt

SEQ ID NO: 7031293 - DNA, 22 bp, Homo sapiens
ctgtggtcatgagtccttccat

SEQ ID NO: 7031294 - DNA, 22 bp, Homo sapiens
tcaaggaaggtctgttgctcca

SEQ ID NO: 7031295 - DNA, 22 bp, Homo sapiens
ccaagggaaggatgtatatgat

SEQ ID NO: 7031296 - DNA, 22 bp, Homo sapiens
aaggcacagaggcagggcactt

SEQ ID NO: 7031297 - DNA, 22 bp, Homo sapiens
aggatcttcattgtgctgcaaa

SEQ ID NO: 7031298 - DNA, 22 bp, Homo sapiens
ttgtccatctgtatttcccatg

SEQ ID NO: 7031299 - DNA, 22 bp, Homo sapiens
gtttttctctgaaatagttgac

SEQ ID NO: 7031300 - DNA, 22 bp, Homo sapiens
cagaaactatgtaagaaagtga

SEQ ID NO: 7031301 - DNA, 22 bp, Homo sapiens
cgcaggctggcgcggagtggca

SEQ ID NO: 7031302 - DNA, 22 bp, Homo sapiens
ggtaattagattgattaaattg

SEQ ID NO: 7031303 - DNA, 22 bp, Homo sapiens
ggctgaagaactgggagtctca

SEQ ID NO: 7031304 - DNA, 22 bp, Homo sapiens
aggattttagataagacagcaa

SEQ ID NO: 7031305 - DNA, 22 bp, Homo sapiens
ggcctctggggtcctgagccca

SEQ ID NO: 7031306 - DNA, 22 bp, Homo sapiens
gtgtcatgtagaaattgatgaa

SEQ ID NO: 7031307 - DNA, 22 bp, Homo sapiens
atatatgcatgtgtacttatgt

SEQ ID NO: 7031308 - DNA, 22 bp, Homo sapiens
taagagcttcttcatttcaact

SEQ ID NO: 7031309 - DNA, 22 bp, Homo sapiens
tttaggaatgtggtttttgagc

SEQ ID NO: 7031310 - DNA, 22 bp, Homo sapiens
aggctatcagatagaatgaagg

SEQ ID NO: 7031311 - DNA, 19 bp, Homo sapiens
ggatccagaggatctgcca

SEQ ID NO: 7031312 - DNA, 22 bp, Homo sapiens
cttccagctgattacaggctat

SEQ ID NO: 7031313 - DNA, 18 bp, Homo sapiens
cagttacaccttcattca

SEQ ID NO: 7031314 - DNA, 21 bp, Homo sapiens
ctgctacttcatggaaaatag

SEQ ID NO: 7031315 - DNA, 22 bp, Homo sapiens
aagaggcctcacctcactgccc

SEQ ID NO: 7031316 - DNA, 22 bp, Homo sapiens
gttaggcagcccaagatgtcag

SEQ ID NO: 7031317 - DNA, 22 bp, Homo sapiens
tactagaacctcacaacaatcc

SEQ ID NO: 7031318 - DNA, 22 bp, Homo sapiens
acagggcctcagccagggcaga

SEQ ID NO: 7031319 - DNA, 22 bp, Homo sapiens
ctgcagtgttctggaatgcatt

SEQ ID NO: 7031320 - DNA, 22 bp, Homo sapiens
cagtgacagcaagcagtgctgg

SEQ ID NO: 7031321 - DNA, 22 bp, Homo sapiens
gaatggaaactgggagatggcc

SEQ ID NO: 7031322 - DNA, 22 bp, Homo sapiens
ccagttaaacaacatccatttc

SEQ ID NO: 7031323 - DNA, 22 bp, Homo sapiens
tgtttacttatgtgggtcacat

SEQ ID NO: 7031324 - DNA, 22 bp, Homo sapiens
tacagggaccaataataactat

SEQ ID NO: 7031325 - DNA, 22 bp, Homo sapiens
taaggtttgtggggagcaaaag

SEQ ID NO: 7031326 - DNA, 22 bp, Homo sapiens
cacctagcatgaaattcagcag

SEQ ID NO: 7031327 - DNA, 22 bp, Homo sapiens
gaagtctgcctgccttctctgt

SEQ ID NO: 7031328 - DNA, 22 bp, Homo sapiens
agaatacccatcccttcaactc

SEQ ID NO: 7031329 - DNA, 22 bp, Homo sapiens
tgagaaatattgcacagtgagg

SEQ ID NO: 7031330 - DNA, 19 bp, Homo sapiens
tctccagttgctttcaggg

SEQ ID NO: 7031331 - DNA, 22 bp, Homo sapiens
gggtccagaatgagaatgggct

SEQ ID NO: 7031332 - DNA, 21 bp, Homo sapiens
agtgacccatagggtagagta

SEQ ID NO: 7031333 - DNA, 22 bp, Homo sapiens
gagcacctgggacacagcttgt

SEQ ID NO: 7031334 - DNA, 22 bp, Homo sapiens
taacctgcaacagatctgtctt

SEQ ID NO: 7031335 - DNA, 22 bp, Homo sapiens
caatggaggtttactctgcagc

SEQ ID NO: 7031336 - DNA, 21 bp, Homo sapiens
aaaatgtttccttgttggtta

SEQ ID NO: 7031337 - DNA, 22 bp, Homo sapiens
tagaccaagacagagctgcttt

SEQ ID NO: 7031338 - DNA, 22 bp, Homo sapiens
caagggcaggagaggatggatg

SEQ ID NO: 7031339 - DNA, 22 bp, Homo sapiens
attcagtgccaaggagaacttg

SEQ ID NO: 7031340 - DNA, 22 bp, Homo sapiens
aataacttcatgtaacatttaa

SEQ ID NO: 7031341 - DNA, 22 bp, Homo sapiens
gacaagggttctgcagagcctg

SEQ ID NO: 7031342 - DNA, 22 bp, Homo sapiens
aagtggccctaggccaagggga

SEQ ID NO: 7031343 - DNA, 22 bp, Homo sapiens
tgagaagcagcttacaggtgtc

SEQ ID NO: 7031344 - DNA, 22 bp, Homo sapiens
ctgtgtctaatcaggtcagtca

SEQ ID NO: 7031345 - DNA, 22 bp, Homo sapiens
aggctgtgatctcatgatttgt

SEQ ID NO: 7031346 - DNA, 22 bp, Homo sapiens
gagatgctgaaatctgagtgta

SEQ ID NO: 7031347 - DNA, 22 bp, Homo sapiens
taatgcatgtaatgggctgata

SEQ ID NO: 7031348 - DNA, 22 bp, Homo sapiens
aaaggctcacgcagttagtgat

SEQ ID NO: 7031349 - DNA, 22 bp, Homo sapiens
tgagacagcccttctgcacagg

SEQ ID NO: 7031350 - DNA, 22 bp, Homo sapiens
agcttccttgaattctgtagaa

SEQ ID NO: 7031351 - DNA, 22 bp, Homo sapiens
ttgtgagatgatttgaaagtgt

SEQ ID NO: 7031352 - DNA, 22 bp, Homo sapiens
ggggaaactgaggcacagacag

SEQ ID NO: 7031353 - DNA, 22 bp, Homo sapiens
aagcagcctggacttgggctgg

SEQ ID NO: 7031354 - DNA, 22 bp, Homo sapiens
atttactctggctggaatacaa

SEQ ID NO: 7031355 - DNA, 22 bp, Homo sapiens
ggaattgctaacattctgaagg

SEQ ID NO: 7031356 - DNA, 20 bp, Homo sapiens
cctccaggcacacccatgtg

SEQ ID NO: 7031357 - DNA, 23 bp, Homo sapiens
cctcaaatgtagcctttttccca

SEQ ID NO: 7031358 - DNA, 22 bp, Homo sapiens
taaaggtagtgtgacatattgt

SEQ ID NO: 7031359 - DNA, 22 bp, Homo sapiens
aggcactgaagtggtaaatgta

SEQ ID NO: 7031360 - DNA, 21 bp, Homo sapiens
tggctgcctacatgctgcagg

SEQ ID NO: 7031361 - DNA, 22 bp, Homo sapiens
ccagtttataagaaagaaaacc

SEQ ID NO: 7031362 - DNA, 22 bp, Homo sapiens
agatcagttagatagcttgatg

SEQ ID NO: 7031363 - DNA, 22 bp, Homo sapiens
tgagagctgccacgtgaccatg

SEQ ID NO: 7031364 - DNA, 18 bp, Homo sapiens
gccaggtctctctgcttc

SEQ ID NO: 7031365 - DNA, 22 bp, Homo sapiens
taacgagcagctgttttcaaat

SEQ ID NO: 7031366 - DNA, 21 bp, Homo sapiens
gcattgttggctgctgctagg

SEQ ID NO: 7031367 - DNA, 22 bp, Homo sapiens
cctcccctgctcagaactctgg

SEQ ID NO: 7031368 - DNA, 22 bp, Homo sapiens
aagcacttggttttggaaagtt

SEQ ID NO: 7031369 - DNA, 20 bp, Homo sapiens
tccctcagtcctggctttgt

SEQ ID NO: 7031370 - DNA, 22 bp, Homo sapiens
tagagcattatgacaaccccat

SEQ ID NO: 7031371 - DNA, 22 bp, Homo sapiens
agctgggtgcggtggctcatgc

SEQ ID NO: 7031372 - DNA, 22 bp, Homo sapiens
ggaggaggggtgactgaatgct

SEQ ID NO: 7031373 - DNA, 22 bp, Homo sapiens
gtgcccagtaaatgaaagcttt

SEQ ID NO: 7031374 - DNA, 22 bp, Homo sapiens
atccagtcccacacatgctctg

SEQ ID NO: 7031375 - DNA, 22 bp, Homo sapiens
actgttctgcatgtacctgagg

SEQ ID NO: 7031376 - DNA, 22 bp, Homo sapiens
agctggaaagaaggtggcagcc

SEQ ID NO: 7031377 - DNA, 22 bp, Homo sapiens
gcaggatgcaacagcttgtagt

SEQ ID NO: 7031378 - DNA, 19 bp, Homo sapiens
ctgttattgtcagagctcc

SEQ ID NO: 7031379 - DNA, 22 bp, Homo sapiens
attgaactataattatgatttg

SEQ ID NO: 7031380 - DNA, 22 bp, Homo sapiens
caattagacatttattggccag

SEQ ID NO: 7031381 - DNA, 22 bp, Homo sapiens
cacagaggtctgggcccagcag

SEQ ID NO: 7031382 - DNA, 22 bp, Homo sapiens
ttcagtttcgttatctatgaga

SEQ ID NO: 7031383 - DNA, 22 bp, Homo sapiens
tgagggaatattgatagatccg

SEQ ID NO: 7031384 - DNA, 22 bp, Homo sapiens
gaccatttctaggaatcagact

SEQ ID NO: 7031385 - DNA, 22 bp, Homo sapiens
cctgcctgcagaaagtatctcc

SEQ ID NO: 7031386 - DNA, 22 bp, Homo sapiens
acagtgttcaaaccactaggct

SEQ ID NO: 7031387 - DNA, 22 bp, Homo sapiens
tagctttgtgtatgatgtctgt

SEQ ID NO: 7031388 - DNA, 22 bp, Homo sapiens
aaggcactgaacttaaattctg

SEQ ID NO: 7031389 - DNA, 22 bp, Homo sapiens
ccagtcagccaagctgcagcgg

SEQ ID NO: 7031390 - DNA, 22 bp, Homo sapiens
ccaaggagcaagtttacacctg

SEQ ID NO: 7031391 - DNA, 22 bp, Homo sapiens
acacagtaccccaaggctgggc

SEQ ID NO: 7031392 - DNA, 22 bp, Homo sapiens
taatgggcccaaaggagctgag

SEQ ID NO: 7031393 - DNA, 22 bp, Homo sapiens
gattgcgtctgtgtcaccttca

SEQ ID NO: 7031394 - DNA, 22 bp, Homo sapiens
aagccctggatagagagaactg

SEQ ID NO: 7031395 - DNA, 22 bp, Homo sapiens
agtaaacataatttacctgtag

SEQ ID NO: 7031396 - DNA, 22 bp, Homo sapiens
cagctcctattagacactgaat

SEQ ID NO: 7031397 - DNA, 21 bp, Homo sapiens
gctggctcaaatgcttgtgtc

SEQ ID NO: 7031398 - DNA, 22 bp, Homo sapiens
ctcaggctgccctgacagcccc

SEQ ID NO: 7031399 - DNA, 19 bp, Homo sapiens
agttatttctaaatttacc

SEQ ID NO: 7031400 - DNA, 22 bp, Homo sapiens
tcaggcaccttcctcttatctg

SEQ ID NO: 7031401 - DNA, 22 bp, Homo sapiens
tgatgaataaacttgagagtca

SEQ ID NO: 7031402 - DNA, 22 bp, Homo sapiens
tttttggcagctcagaaacttc

SEQ ID NO: 7031403 - DNA, 22 bp, Homo sapiens
agatcaagggagtgctcactct

SEQ ID NO: 7031404 - DNA, 22 bp, Homo sapiens
cgcaccccactgtccctcaacc

SEQ ID NO: 7031405 - DNA, 22 bp, Homo sapiens
ctcccaggcagggctgcccact

SEQ ID NO: 7031406 - DNA, 22 bp, Homo sapiens
tctatacatgtgcacacacatc

SEQ ID NO: 7031407 - DNA, 22 bp, Homo sapiens
cctaggccgcccggtgcgtggg

SEQ ID NO: 7031408 - DNA, 22 bp, Homo sapiens
tatccagtgtgaactcctctac

SEQ ID NO: 7031409 - DNA, 22 bp, Homo sapiens
ccaggagcagggctggctgcac

SEQ ID NO: 7031410 - DNA, 22 bp, Homo sapiens
cctgccaggagctggtgctgca

SEQ ID NO: 7031411 - DNA, 22 bp, Homo sapiens
tgtctatttttactggaccatg

SEQ ID NO: 7031412 - DNA, 22 bp, Homo sapiens
ggctccaggctcctatttcact

SEQ ID NO: 7031413 - DNA, 22 bp, Homo sapiens
tttgttcacctcaaggatggga

SEQ ID NO: 7031414 - DNA, 21 bp, Homo sapiens
tttattctcagatacagggag

SEQ ID NO: 7031415 - DNA, 21 bp, Homo sapiens
aggtagtaaatgtttgctcct

SEQ ID NO: 7031416 - DNA, 22 bp, Homo sapiens
agctgtgggagaatctctgggt

SEQ ID NO: 7031417 - DNA, 21 bp, Homo sapiens
tcacagttcaagatgaacccc

SEQ ID NO: 7031418 - DNA, 22 bp, Homo sapiens
aagtatgtgtgggatgctggga

SEQ ID NO: 7031419 - DNA, 22 bp, Homo sapiens
ttactgtactagtgagactagg

SEQ ID NO: 7031420 - DNA, 22 bp, Homo sapiens
tctcctggtacccttcctagca

SEQ ID NO: 7031421 - DNA, 22 bp, Homo sapiens
cttggctgttgggcattgagaa

SEQ ID NO: 7031422 - DNA, 22 bp, Homo sapiens
tatctgtatccccatctagcta

SEQ ID NO: 7031423 - DNA, 22 bp, Homo sapiens
gcccttcagttactccttgatg

SEQ ID NO: 7031424 - DNA, 22 bp, Homo sapiens
tacagcattgcattttcctttg

SEQ ID NO: 7031425 - DNA, 22 bp, Homo sapiens
gcaaggacctttgagcgtgcca

SEQ ID NO: 7031426 - DNA, 22 bp, Homo sapiens
cagtactgcttgtgggagcaga

SEQ ID NO: 7031427 - DNA, 22 bp, Homo sapiens
agtacagtcaggaagctgctgt

SEQ ID NO: 7031428 - DNA, 22 bp, Homo sapiens
aaatcagacacagtgaaagtta

SEQ ID NO: 7031429 - DNA, 22 bp, Homo sapiens
actcatctgccattcctgtacc

SEQ ID NO: 7031430 - DNA, 22 bp, Homo sapiens
atcaaagtaggcatatgttttt

SEQ ID NO: 7031431 - DNA, 22 bp, Homo sapiens
ttggccttctggtgttcatttt

SEQ ID NO: 7031432 - DNA, 21 bp, Homo sapiens
cacatgtgaattactgaactg

SEQ ID NO: 7031433 - DNA, 22 bp, Homo sapiens
cgcaggctgcagccaagaagag

SEQ ID NO: 7031434 - DNA, 18 bp, Homo sapiens
atccttggggctgctgct

SEQ ID NO: 7031435 - DNA, 22 bp, Homo sapiens
gcttccttctaccacatcatgc

SEQ ID NO: 7031436 - DNA, 22 bp, Homo sapiens
ttacatgaggttaattaagcat

SEQ ID NO: 7031437 - DNA, 22 bp, Homo sapiens
atcacatctcaccactgcaacc

SEQ ID NO: 7031438 - DNA, 22 bp, Homo sapiens
ttctgtaggcacacagtttcaa

SEQ ID NO: 7031439 - DNA, 18 bp, Homo sapiens
cctgtctggggtccccac

SEQ ID NO: 7031440 - DNA, 22 bp, Homo sapiens
aattgcttttatttagggccag

SEQ ID NO: 7031441 - DNA, 22 bp, Homo sapiens
atacctgtgtatccacaagcgt

SEQ ID NO: 7031442 - DNA, 22 bp, Homo sapiens
gaggagcttcagaggaatctta

SEQ ID NO: 7031443 - DNA, 22 bp, Homo sapiens
agaaatactaggaatattcata

SEQ ID NO: 7031444 - DNA, 22 bp, Homo sapiens
agtaaagcagagttgcagtaca

SEQ ID NO: 7031445 - DNA, 22 bp, Homo sapiens
agtggctgccaagatataattc

SEQ ID NO: 7031446 - DNA, 22 bp, Homo sapiens
agctgtctacagcaataaagga

SEQ ID NO: 7031447 - DNA, 22 bp, Homo sapiens
tagattcattttagcaaaagtt

SEQ ID NO: 7031448 - DNA, 22 bp, Homo sapiens
ggccaggagctgcacagggctc

SEQ ID NO: 7031449 - DNA, 22 bp, Homo sapiens
gggtctccatgttaacatcact

SEQ ID NO: 7031450 - DNA, 22 bp, Homo sapiens
ctcacagatgctgtgggtcagg

SEQ ID NO: 7031451 - DNA, 22 bp, Homo sapiens
accagctgatttaagaataaag

SEQ ID NO: 7031452 - DNA, 22 bp, Homo sapiens
gggcaggagaaggtggatgtcc

SEQ ID NO: 7031453 - DNA, 22 bp, Homo sapiens
caattgcaatagagaaaagagt

SEQ ID NO: 7031454 - DNA, 22 bp, Homo sapiens
attctacagggtacgttgggga

SEQ ID NO: 7031455 - DNA, 22 bp, Homo sapiens
ggcagggcaggaaagtcaggaa

SEQ ID NO: 7031456 - DNA, 22 bp, Homo sapiens
gctgaaggaggctctggtacta

SEQ ID NO: 7031457 - DNA, 22 bp, Homo sapiens
gggggctctgactccctcagct

SEQ ID NO: 7031458 - DNA, 22 bp, Homo sapiens
gccagtgtgcaagaggccacca

SEQ ID NO: 7031459 - DNA, 22 bp, Homo sapiens
agtgtgatttattggaagaggt

SEQ ID NO: 7031460 - DNA, 22 bp, Homo sapiens
ctgtgggcttgaggttagacag

SEQ ID NO: 7031461 - DNA, 23 bp, Homo sapiens
gtcctattttttgaaatactgag

SEQ ID NO: 7031462 - DNA, 22 bp, Homo sapiens
ggcagcaacgaggcttgatacc

SEQ ID NO: 7031463 - DNA, 22 bp, Homo sapiens
ctcataaggagctcacaaccta

SEQ ID NO: 7031464 - DNA, 22 bp, Homo sapiens
tgtatttgtgataacgacctga

SEQ ID NO: 7031465 - DNA, 20 bp, Homo sapiens
taggaaatcgaggcagggtg

SEQ ID NO: 7031466 - DNA, 19 bp, Homo sapiens
ctgtgccctatgacttgta

SEQ ID NO: 7031467 - DNA, 22 bp, Homo sapiens
tatgagaatctgcagtatgctt

SEQ ID NO: 7031468 - DNA, 22 bp, Homo sapiens
ttgtattaaaatgtgtttctgt

SEQ ID NO: 7031469 - DNA, 22 bp, Homo sapiens
tgtttcagagcactgggcttat

SEQ ID NO: 7031470 - DNA, 22 bp, Homo sapiens
catggcttctaagtgataacgt

SEQ ID NO: 7031471 - DNA, 22 bp, Homo sapiens
tggccagtgttggctagggaca

SEQ ID NO: 7031472 - DNA, 22 bp, Homo sapiens
tgtaaaaggttgttctttcgtt

SEQ ID NO: 7031473 - DNA, 20 bp, Homo sapiens
tctgataactggttgtgatt

SEQ ID NO: 7031474 - DNA, 22 bp, Homo sapiens
acttctctccacccaagtccct

SEQ ID NO: 7031475 - DNA, 22 bp, Homo sapiens
tccctgcctgacagcacccacc

SEQ ID NO: 7031476 - DNA, 22 bp, Homo sapiens
aagtgtttagagagggccttct

SEQ ID NO: 7031477 - DNA, 22 bp, Homo sapiens
agcacagagttgcagagagcgt

SEQ ID NO: 7031478 - DNA, 22 bp, Homo sapiens
tggcttcacctcagcatgaagg

SEQ ID NO: 7031479 - DNA, 22 bp, Homo sapiens
tatttggaatctgccttaggac

SEQ ID NO: 7031480 - DNA, 22 bp, Homo sapiens
aatgtcactctgtttcctctgc

SEQ ID NO: 7031481 - DNA, 22 bp, Homo sapiens
ttccataatgagattcccagcc

SEQ ID NO: 7031482 - DNA, 22 bp, Homo sapiens
cagcggagggcagccttgcagc

SEQ ID NO: 7031483 - DNA, 22 bp, Homo sapiens
cagagaaagaagcccattcatt

SEQ ID NO: 7031484 - DNA, 22 bp, Homo sapiens
ctcacagggttctatcgaagag

SEQ ID NO: 7031485 - DNA, 22 bp, Homo sapiens
ctgtgtcccttgtcccagagcc

SEQ ID NO: 7031486 - DNA, 22 bp, Homo sapiens
tgactttggactagtgatttaa

SEQ ID NO: 7031487 - DNA, 22 bp, Homo sapiens
atttggctattgaattattcct

SEQ ID NO: 7031488 - DNA, 21 bp, Homo sapiens
gaggactgcacactctgattg

SEQ ID NO: 7031489 - DNA, 22 bp, Homo sapiens
agagctgtgtttagtagttacg

SEQ ID NO: 7031490 - DNA, 21 bp, Homo sapiens
actctgaaaattaatagttat

SEQ ID NO: 7031491 - DNA, 22 bp, Homo sapiens
tccaggaacgagaggctgggca

SEQ ID NO: 7031492 - DNA, 22 bp, Homo sapiens
agccaggaattggacaacacat

SEQ ID NO: 7031493 - DNA, 19 bp, Homo sapiens
tgacttcctcacttagcat

SEQ ID NO: 7031494 - DNA, 22 bp, Homo sapiens
tgcaggcattggtgagagaagc

SEQ ID NO: 7031495 - DNA, 22 bp, Homo sapiens
aaggttgatatgtatctaggga

SEQ ID NO: 7031496 - DNA, 22 bp, Homo sapiens
gtggtcctgccagccaggtcca

SEQ ID NO: 7031497 - DNA, 22 bp, Homo sapiens
ctgattctgtctctcgggcctt

SEQ ID NO: 7031498 - DNA, 21 bp, Homo sapiens
caagttcagaaggttgggctg

SEQ ID NO: 7031499 - DNA, 22 bp, Homo sapiens
agttgttcgtggtggattcgct

SEQ ID NO: 7031500 - DNA, 22 bp, Homo sapiens
tttgcaaaatgtcttgtgttag

SEQ ID NO: 7031501 - DNA, 22 bp, Homo sapiens
agtggcagtttgggagctacag

SEQ ID NO: 7031502 - DNA, 22 bp, Homo sapiens
ccctgaacagtgagagataggg

SEQ ID NO: 7031503 - DNA, 22 bp, Homo sapiens
tccccagatggccagctacatg

SEQ ID NO: 7031504 - DNA, 22 bp, Homo sapiens
ctgcagatggctcagtggggca

SEQ ID NO: 7031505 - DNA, 22 bp, Homo sapiens
tgttccagggcgcgaaggtggt

SEQ ID NO: 7031506 - DNA, 22 bp, Homo sapiens
ttcaaagagaaattgtattttc

SEQ ID NO: 7031507 - DNA, 22 bp, Homo sapiens
tgcagcaggcacaggacggaag

SEQ ID NO: 7031508 - DNA, 22 bp, Homo sapiens
aggccctgcccagtgccacaag

SEQ ID NO: 7031509 - DNA, 22 bp, Homo sapiens
gtgtctgttatacagaggagac

SEQ ID NO: 7031510 - DNA, 22 bp, Homo sapiens
ttcatgaaacttaactgttggg

SEQ ID NO: 7031511 - DNA, 22 bp, Homo sapiens
aatcctttgcactagaggtcca

SEQ ID NO: 7031512 - DNA, 22 bp, Homo sapiens
tctggagagatcttccacaaca

SEQ ID NO: 7031513 - DNA, 22 bp, Homo sapiens
tcagagtcaggaatgcttgatt

SEQ ID NO: 7031514 - DNA, 22 bp, Homo sapiens
gggcacaggaatttgggatgtg

SEQ ID NO: 7031515 - DNA, 22 bp, Homo sapiens
agtgctgaacatagaatggaca

SEQ ID NO: 7031516 - DNA, 22 bp, Homo sapiens
tggcacttagcagggaaggtgt

SEQ ID NO: 7031517 - DNA, 22 bp, Homo sapiens
aggccaggttcctcaatcttga

SEQ ID NO: 7031518 - DNA, 22 bp, Homo sapiens
acaggctgcctaccaagtatca

SEQ ID NO: 7031519 - DNA, 22 bp, Homo sapiens
gggccactgggtcctgctggcc

SEQ ID NO: 7031520 - DNA, 20 bp, Homo sapiens
tgcagaagaacgttctggtt

SEQ ID NO: 7031521 - DNA, 22 bp, Homo sapiens
tcagtgcagtagaactttagtt

SEQ ID NO: 7031522 - DNA, 22 bp, Homo sapiens
tgctggctgtccctacctggct

SEQ ID NO: 7031523 - DNA, 18 bp, Homo sapiens
gctggcttgctgggtttg

SEQ ID NO: 7031524 - DNA, 22 bp, Homo sapiens
atcataagacccagccagtatt

SEQ ID NO: 7031525 - DNA, 22 bp, Homo sapiens
cactccctctagttgcattctg

SEQ ID NO: 7031526 - DNA, 22 bp, Homo sapiens
agaggccaccttctcttgagaa

SEQ ID NO: 7031527 - DNA, 22 bp, Homo sapiens
catctgtcaacagagacggtca

SEQ ID NO: 7031528 - DNA, 22 bp, Homo sapiens
gacccataggaatctgttgtcc

SEQ ID NO: 7031529 - DNA, 22 bp, Homo sapiens
tttcaagttcccagttttgtgg

SEQ ID NO: 7031530 - DNA, 22 bp, Homo sapiens
tgctcaggaaataatgtctgtg

SEQ ID NO: 7031531 - DNA, 22 bp, Homo sapiens
tattggtcaagttgaggaccct

SEQ ID NO: 7031532 - DNA, 22 bp, Homo sapiens
gctttcttagtgtgttaattgg

SEQ ID NO: 7031533 - DNA, 22 bp, Homo sapiens
tgagaataacagcctgtgttcc

SEQ ID NO: 7031534 - DNA, 22 bp, Homo sapiens
ctccaaggattctggacccttg

SEQ ID NO: 7031535 - DNA, 22 bp, Homo sapiens
tgtattttctgaagataatcaa

SEQ ID NO: 7031536 - DNA, 22 bp, Homo sapiens
tcatcttctattaatagggaga

SEQ ID NO: 7031537 - DNA, 19 bp, Homo sapiens
aatgtttaagagaaaaagg

SEQ ID NO: 7031538 - DNA, 19 bp, Homo sapiens
agggtacacgagagaagag

SEQ ID NO: 7031539 - DNA, 22 bp, Homo sapiens
tcctctgagtaaagaagattgc

SEQ ID NO: 7031540 - DNA, 22 bp, Homo sapiens
ttttttccttcatgacttaaga

SEQ ID NO: 7031541 - DNA, 22 bp, Homo sapiens
tccaggagtgctggttagagta

SEQ ID NO: 7031542 - DNA, 22 bp, Homo sapiens
gctcagagagattaaataattt

SEQ ID NO: 7031543 - DNA, 22 bp, Homo sapiens
acaaatgcaagttttatgtcaa

SEQ ID NO: 7031544 - DNA, 22 bp, Homo sapiens
acttcatatggacagcaaacta

SEQ ID NO: 7031545 - DNA, 22 bp, Homo sapiens
cctctttgagattcagttttcc

SEQ ID NO: 7031546 - DNA, 22 bp, Homo sapiens
tacaaggaggctaatgatgaca

SEQ ID NO: 7031547 - DNA, 22 bp, Homo sapiens
aatcatggcgtgtttagcttaa

SEQ ID NO: 7031548 - DNA, 22 bp, Homo sapiens
atacgtaagttgaacatcagaa

SEQ ID NO: 7031549 - DNA, 22 bp, Homo sapiens
tacatgaagttgtctaaactgg

SEQ ID NO: 7031550 - DNA, 22 bp, Homo sapiens
atggtggaatcggcgtgaatgg

SEQ ID NO: 7031551 - DNA, 20 bp, Homo sapiens
ctggctggaaacttagcctt

SEQ ID NO: 7031552 - DNA, 22 bp, Homo sapiens
tgggccaggtctgcggtcattt

SEQ ID NO: 7031553 - DNA, 22 bp, Homo sapiens
ggacagcttgcctggtaatgca

SEQ ID NO: 7031554 - DNA, 22 bp, Homo sapiens
ctgtataaccccatgcgactgt

SEQ ID NO: 7031555 - DNA, 22 bp, Homo sapiens
tcacacatgtaagggctttgga

SEQ ID NO: 7031556 - DNA, 22 bp, Homo sapiens
attagagaaatgttgccaagat

SEQ ID NO: 7031557 - DNA, 22 bp, Homo sapiens
cttcttgggttctgagattaca

SEQ ID NO: 7031558 - DNA, 22 bp, Homo sapiens
gccttcaggagggttccagaca

SEQ ID NO: 7031559 - DNA, 22 bp, Homo sapiens
caaaagaagctcttggggctag

SEQ ID NO: 7031560 - DNA, 22 bp, Homo sapiens
taactggtcctcggatgttgtg

SEQ ID NO: 7031561 - DNA, 20 bp, Homo sapiens
cccagtgaagcatggaagag

SEQ ID NO: 7031562 - DNA, 22 bp, Homo sapiens
ggctgcagtttgtcttttgctt

SEQ ID NO: 7031563 - DNA, 21 bp, Homo sapiens
cagggctagagagaatgacaa

SEQ ID NO: 7031564 - DNA, 22 bp, Homo sapiens
tgatggaaataaaagcatagct

SEQ ID NO: 7031565 - DNA, 22 bp, Homo sapiens
attcttgcttcacactcctctg

SEQ ID NO: 7031566 - DNA, 22 bp, Homo sapiens
aacacttcaagcagaaggttgg

SEQ ID NO: 7031567 - DNA, 22 bp, Homo sapiens
ttcccacagtgttgaatcctct

SEQ ID NO: 7031568 - DNA, 22 bp, Homo sapiens
cctgtattggaagcagtaggga

SEQ ID NO: 7031569 - DNA, 22 bp, Homo sapiens
atgtttccattttcttgtatca

SEQ ID NO: 7031570 - DNA, 22 bp, Homo sapiens
taacagtaaagtaagttagctt

SEQ ID NO: 7031571 - DNA, 22 bp, Homo sapiens
gggcaatggtcacatagagtga

SEQ ID NO: 7031572 - DNA, 22 bp, Homo sapiens
ctgagctgacatcttcctcttt

SEQ ID NO: 7031573 - DNA, 22 bp, Homo sapiens
cttgaagagtgggaaggatttg

SEQ ID NO: 7031574 - DNA, 22 bp, Homo sapiens
tacacagaacctggtgtacagt

SEQ ID NO: 7031575 - DNA, 22 bp, Homo sapiens
ggcagtgttctggttgtcagga

SEQ ID NO: 7031576 - DNA, 20 bp, Homo sapiens
tcccagtctttggtctgagc

SEQ ID NO: 7031577 - DNA, 22 bp, Homo sapiens
tgccatcttcaataacactgag

SEQ ID NO: 7031578 - DNA, 22 bp, Homo sapiens
tttgacattggcttattctgtt

SEQ ID NO: 7031579 - DNA, 22 bp, Homo sapiens
agttgttgatgttgcagtcctg

SEQ ID NO: 7031580 - DNA, 22 bp, Homo sapiens
tctgagggacaattttgatggt

SEQ ID NO: 7031581 - DNA, 22 bp, Homo sapiens
tagcagaagtcaccccgccact

SEQ ID NO: 7031582 - DNA, 22 bp, Homo sapiens
aattgcaaattcagacttaaga

SEQ ID NO: 7031583 - DNA, 22 bp, Homo sapiens
gtgtggaaccaaataacctaaa

SEQ ID NO: 7031584 - DNA, 22 bp, Homo sapiens
tttgatccgttgctggtgagga

SEQ ID NO: 7031585 - DNA, 18 bp, Homo sapiens
ggtcaagaaagtaaggca

SEQ ID NO: 7031586 - DNA, 22 bp, Homo sapiens
acagttaatcaaatggcatatg

SEQ ID NO: 7031587 - DNA, 22 bp, Homo sapiens
tccatggagtttttatttggta

SEQ ID NO: 7031588 - DNA, 22 bp, Homo sapiens
gccacgtagaagtgccgcgaga

SEQ ID NO: 7031589 - DNA, 20 bp, Homo sapiens
tggattccctcctgggactc

SEQ ID NO: 7031590 - DNA, 22 bp, Homo sapiens
agctactatgtgaaagccaggc

SEQ ID NO: 7031591 - DNA, 22 bp, Homo sapiens
acagacacaggcgtggagtcgc

SEQ ID NO: 7031592 - DNA, 22 bp, Homo sapiens
acagagcaacttgagtatcctc

SEQ ID NO: 7031593 - DNA, 19 bp, Homo sapiens
aaactaaggggaaatgttt

SEQ ID NO: 7031594 - DNA, 22 bp, Homo sapiens
agtggaattgctgattgaaata

SEQ ID NO: 7031595 - DNA, 22 bp, Homo sapiens
atgcatattgattatagattca

SEQ ID NO: 7031596 - DNA, 22 bp, Homo sapiens
gcactgaatgcttttactgtaa

SEQ ID NO: 7031597 - DNA, 22 bp, Homo sapiens
atatagtgagagattacagaag

SEQ ID NO: 7031598 - DNA, 22 bp, Homo sapiens
tgagcaaagggatgaatcactg

SEQ ID NO: 7031599 - DNA, 19 bp, Homo sapiens
aggcagtcattggaatata

SEQ ID NO: 7031600 - DNA, 22 bp, Homo sapiens
catcacatgtaggcagcatcac

SEQ ID NO: 7031601 - DNA, 22 bp, Homo sapiens
tatatgcagattttcatcatcg

SEQ ID NO: 7031602 - DNA, 22 bp, Homo sapiens
tgggatggcatcctgggccttg

SEQ ID NO: 7031603 - DNA, 22 bp, Homo sapiens
tgagcaggtcaggaagtacatt

SEQ ID NO: 7031604 - DNA, 23 bp, Homo sapiens
tcataagtgctcagttactgtta

SEQ ID NO: 7031605 - DNA, 21 bp, Homo sapiens
tcaggagagcccatctacaaa

SEQ ID NO: 7031606 - DNA, 22 bp, Homo sapiens
cccagttttctgattgaagagc

SEQ ID NO: 7031607 - DNA, 22 bp, Homo sapiens
catttagtctgatatggatgaa

SEQ ID NO: 7031608 - DNA, 22 bp, Homo sapiens
aagctgccacacggtgagtact

SEQ ID NO: 7031609 - DNA, 22 bp, Homo sapiens
cagtctggatctgtgctgctgt

SEQ ID NO: 7031610 - DNA, 20 bp, Homo sapiens
agtggtctagtttctctgca

SEQ ID NO: 7031611 - DNA, 22 bp, Homo sapiens
cacagcttctgagtgaggattt

SEQ ID NO: 7031612 - DNA, 22 bp, Homo sapiens
tttcttcccaagcagtttcaga

SEQ ID NO: 7031613 - DNA, 22 bp, Homo sapiens
aggctgaggtaggaggatcgct

SEQ ID NO: 7031614 - DNA, 20 bp, Homo sapiens
tggtgttatcctgaagaatt

SEQ ID NO: 7031615 - DNA, 22 bp, Homo sapiens
agcagatgaatcccagataaag

SEQ ID NO: 7031616 - DNA, 22 bp, Homo sapiens
cttcttttacaggtcttgggtt

SEQ ID NO: 7031617 - DNA, 22 bp, Homo sapiens
tctgtgccctcggtgctgggcc

SEQ ID NO: 7031618 - DNA, 22 bp, Homo sapiens
aaagcagaggtgatatgactta

SEQ ID NO: 7031619 - DNA, 22 bp, Homo sapiens
ctttggaataatttcctggagt

SEQ ID NO: 7031620 - DNA, 22 bp, Homo sapiens
agtgacattttccccgctatgt

SEQ ID NO: 7031621 - DNA, 19 bp, Homo sapiens
ttctgtaagggagagaggg

SEQ ID NO: 7031622 - DNA, 22 bp, Homo sapiens
gccatacatgaaaagtccacac

SEQ ID NO: 7031623 - DNA, 22 bp, Homo sapiens
agactttatccctgtttttctc

SEQ ID NO: 7031624 - DNA, 22 bp, Homo sapiens
aatcagtgtggtgacttgtctg

SEQ ID NO: 7031625 - DNA, 22 bp, Homo sapiens
ttacagagttcgcacctggtgg

SEQ ID NO: 7031626 - DNA, 22 bp, Homo sapiens
tattgacagacttgaaagtgtt

SEQ ID NO: 7031627 - DNA, 22 bp, Homo sapiens
gtgctttgttaagtctgaaatt

SEQ ID NO: 7031628 - DNA, 22 bp, Homo sapiens
tacagaggggacatggaagaca

SEQ ID NO: 7031629 - DNA, 22 bp, Homo sapiens
acatgcattctctaaaagcaaa

SEQ ID NO: 7031630 - DNA, 20 bp, Homo sapiens
tctgtgtgccatcacctaac

SEQ ID NO: 7031631 - DNA, 22 bp, Homo sapiens
tacaagtcattggatgaggaat

SEQ ID NO: 7031632 - DNA, 22 bp, Homo sapiens
agagacaccgcgcatcatggct

SEQ ID NO: 7031633 - DNA, 22 bp, Homo sapiens
tgaggcaaaagttatgtggtag

SEQ ID NO: 7031634 - DNA, 22 bp, Homo sapiens
agtctttattcagccaagtact

SEQ ID NO: 7031635 - DNA, 22 bp, Homo sapiens
cccaggagttggaggctgcagt

SEQ ID NO: 7031636 - DNA, 22 bp, Homo sapiens
ctggaatgcctccctgtcagag

SEQ ID NO: 7031637 - DNA, 22 bp, Homo sapiens
aagctggagtgcagtgcaatgg

SEQ ID NO: 7031638 - DNA, 22 bp, Homo sapiens
actttgggtaagttgattaatc

SEQ ID NO: 7031639 - DNA, 22 bp, Homo sapiens
tctccccagtatggattctctg

SEQ ID NO: 7031640 - DNA, 22 bp, Homo sapiens
gctgctttggaaagcatggaaa

SEQ ID NO: 7031641 - DNA, 21 bp, Homo sapiens
gcctgggatagtggcctccgg

SEQ ID NO: 7031642 - DNA, 22 bp, Homo sapiens
acacttatttttgtccacttcc

SEQ ID NO: 7031643 - DNA, 22 bp, Homo sapiens
tggcctgttgctcctaggggtc

SEQ ID NO: 7031644 - DNA, 22 bp, Homo sapiens
ctgtggagcttgtggcagtggg

SEQ ID NO: 7031645 - DNA, 22 bp, Homo sapiens
catgtggctttggcatgtgccc

SEQ ID NO: 7031646 - DNA, 22 bp, Homo sapiens
tccatctgcatttggtttctgt

SEQ ID NO: 7031647 - DNA, 22 bp, Homo sapiens
tgtgatttatgcatggggaagt

SEQ ID NO: 7031648 - DNA, 22 bp, Homo sapiens
gctgtccaggttgtggagcaac

SEQ ID NO: 7031649 - DNA, 22 bp, Homo sapiens
tggcttcacccgtcctccccac

SEQ ID NO: 7031650 - DNA, 22 bp, Homo sapiens
ctggctctctgagatattgagt

SEQ ID NO: 7031651 - DNA, 22 bp, Homo sapiens
gcacaataatttttttaagagg

SEQ ID NO: 7031652 - DNA, 19 bp, Homo sapiens
taaaccctggctttttctg

SEQ ID NO: 7031653 - DNA, 22 bp, Homo sapiens
tagggaccctccctgctctaac

SEQ ID NO: 7031654 - DNA, 22 bp, Homo sapiens
aggccaaagcaagaccctgtaa

SEQ ID NO: 7031655 - DNA, 22 bp, Homo sapiens
agaaatgtggaggaacagggct

SEQ ID NO: 7031656 - DNA, 22 bp, Homo sapiens
agttggatttggctagtggagg

SEQ ID NO: 7031657 - DNA, 22 bp, Homo sapiens
ttcctggcaaagtgagcatcac

SEQ ID NO: 7031658 - DNA, 22 bp, Homo sapiens
tcactaatgattttgaaagaag

SEQ ID NO: 7031659 - DNA, 22 bp, Homo sapiens
aagatgatgttgtgttttcact

SEQ ID NO: 7031660 - DNA, 22 bp, Homo sapiens
ttccaaagttagttattagaaa

SEQ ID NO: 7031661 - DNA, 21 bp, Homo sapiens
tgaatttcggtatggctataa

SEQ ID NO: 7031662 - DNA, 22 bp, Homo sapiens
tggtttaaggacagagagccag

SEQ ID NO: 7031663 - DNA, 22 bp, Homo sapiens
tgtaatcattacagtacatgga

SEQ ID NO: 7031664 - DNA, 22 bp, Homo sapiens
gagatgctgctcttactgtata

SEQ ID NO: 7031665 - DNA, 22 bp, Homo sapiens
ttgcctcattttctggtgaaat

SEQ ID NO: 7031666 - DNA, 22 bp, Homo sapiens
gatttccctatagttttctctt

SEQ ID NO: 7031667 - DNA, 23 bp, Homo sapiens
aggtcaaccacaagctgacaaac

SEQ ID NO: 7031668 - DNA, 22 bp, Homo sapiens
gaggctctttctttggacttca

SEQ ID NO: 7031669 - DNA, 23 bp, Homo sapiens
gaagcagatgtctgagtaggcag

SEQ ID NO: 7031670 - DNA, 22 bp, Homo sapiens
tggaagtggcagaaaatgaaca

SEQ ID NO: 7031671 - DNA, 22 bp, Homo sapiens
gtcgttgaaatgtttactgggg

SEQ ID NO: 7031672 - DNA, 23 bp, Homo sapiens
tgtgtccttaactgtatatacta

SEQ ID NO: 7031673 - DNA, 22 bp, Homo sapiens
ttctgtccaaagagaggttctt

SEQ ID NO: 7031674 - DNA, 22 bp, Homo sapiens
tggcctggtaccacatagattt

SEQ ID NO: 7031675 - DNA, 23 bp, Homo sapiens
ctttggcactttacaataaactc

SEQ ID NO: 7031676 - DNA, 22 bp, Homo sapiens
aggctctgggaagcagtgagtt

SEQ ID NO: 7031677 - DNA, 22 bp, Homo sapiens
ctccacagctcaggctcagagt

SEQ ID NO: 7031678 - DNA, 22 bp, Homo sapiens
ttagatacccaagtggatctgt

SEQ ID NO: 7031679 - DNA, 22 bp, Homo sapiens
agtgctttcttgctccatcagt

SEQ ID NO: 7031680 - DNA, 22 bp, Homo sapiens
tgagtctcgaaatgcaggaaag

SEQ ID NO: 7031681 - DNA, 22 bp, Homo sapiens
agtgctccctagagttgtgcaa

SEQ ID NO: 7031682 - DNA, 22 bp, Homo sapiens
gtctataagtacaattgcactc

SEQ ID NO: 7031683 - DNA, 22 bp, Homo sapiens
atcaagttttcttagttgactg

SEQ ID NO: 7031684 - DNA, 22 bp, Homo sapiens
ggagggcatcaatcaggcctgg

SEQ ID NO: 7031685 - DNA, 22 bp, Homo sapiens
tataagaaattgccaacctgtt

SEQ ID NO: 7031686 - DNA, 22 bp, Homo sapiens
tctcataatagcatttctcacc

SEQ ID NO: 7031687 - DNA, 22 bp, Homo sapiens
aaatcctaagcagaggaattta

SEQ ID NO: 7031688 - DNA, 22 bp, Homo sapiens
tattttgtaattggtcatagct

SEQ ID NO: 7031689 - DNA, 18 bp, Homo sapiens
ttattggtgctgctgttc

SEQ ID NO: 7031690 - DNA, 22 bp, Homo sapiens
agcaccgtcatagccaggtaag

SEQ ID NO: 7031691 - DNA, 22 bp, Homo sapiens
gagtccagcagaatgagccaag

SEQ ID NO: 7031692 - DNA, 21 bp, Homo sapiens
ttgcattttaagtttactgct

SEQ ID NO: 7031693 - DNA, 22 bp, Homo sapiens
tagcaggatttgaagaagatct

SEQ ID NO: 7031694 - DNA, 22 bp, Homo sapiens
agatgtctcactcagttctcat

SEQ ID NO: 7031695 - DNA, 22 bp, Homo sapiens
tcttacaagtcacccgctttct

SEQ ID NO: 7031696 - DNA, 22 bp, Homo sapiens
atagatacttataacaattgtg

SEQ ID NO: 7031697 - DNA, 22 bp, Homo sapiens
atttcactcattcatgttactt

SEQ ID NO: 7031698 - DNA, 22 bp, Homo sapiens
caggcacaaaaggaccccagca

SEQ ID NO: 7031699 - DNA, 22 bp, Homo sapiens
gaagtgaagagattagaaatca

SEQ ID NO: 7031700 - DNA, 22 bp, Homo sapiens
tcataaagagtgctgttgtttt

SEQ ID NO: 7031701 - DNA, 18 bp, Homo sapiens
gctttgcactcatgttgt

SEQ ID NO: 7031702 - DNA, 22 bp, Homo sapiens
gggaaggccttgtcagcggatt

SEQ ID NO: 7031703 - DNA, 22 bp, Homo sapiens
tgctaaattcattattgattta

SEQ ID NO: 7031704 - DNA, 22 bp, Homo sapiens
ttagattttaagaagggaggta

SEQ ID NO: 7031705 - DNA, 23 bp, Homo sapiens
agagaatcatggaaactctttct

SEQ ID NO: 7031706 - DNA, 22 bp, Homo sapiens
tttactgaatttggtatattcc

SEQ ID NO: 7031707 - DNA, 22 bp, Homo sapiens
ctaaacatgaactacatttagg

SEQ ID NO: 7031708 - DNA, 22 bp, Homo sapiens
ttctaacttttgaggcaatgtg

SEQ ID NO: 7031709 - DNA, 22 bp, Homo sapiens
tagagtctagtgtatacaaagt

SEQ ID NO: 7031710 - DNA, 22 bp, Homo sapiens
acttgaattatatttctagaga

SEQ ID NO: 7031711 - DNA, 22 bp, Homo sapiens
tgcacaggaggctgtggagaag

SEQ ID NO: 7031712 - DNA, 22 bp, Homo sapiens
gcctagcattgatcagcctgct

SEQ ID NO: 7031713 - DNA, 22 bp, Homo sapiens
ggaagaggctggtagtgcccgt

SEQ ID NO: 7031714 - DNA, 22 bp, Homo sapiens
aggaggaggtaagaaaagcata

SEQ ID NO: 7031715 - DNA, 22 bp, Homo sapiens
tcctggggctctgagcgagaca

SEQ ID NO: 7031716 - DNA, 22 bp, Homo sapiens
aggggaccaaaatgtcctgcct

SEQ ID NO: 7031717 - DNA, 22 bp, Homo sapiens
cactgcctccccaggctccaca

SEQ ID NO: 7031718 - DNA, 22 bp, Homo sapiens
gtgcatgtgtctttatagtaga

SEQ ID NO: 7031719 - DNA, 22 bp, Homo sapiens
atacaaaaattagccgggagta

SEQ ID NO: 7031720 - DNA, 22 bp, Homo sapiens
agggcagaggcggacacggaag

SEQ ID NO: 7031721 - DNA, 22 bp, Homo sapiens
gtgaggtagcagagacagtgaa

SEQ ID NO: 7031722 - DNA, 22 bp, Homo sapiens
aaagactggttggggtgggcag

SEQ ID NO: 7031723 - DNA, 22 bp, Homo sapiens
cttgacattagttatgcagata

SEQ ID NO: 7031724 - DNA, 22 bp, Homo sapiens
tttagcttaaatggagaaagag

SEQ ID NO: 7031725 - DNA, 22 bp, Homo sapiens
tagtcaactagtgagcatatgg

SEQ ID NO: 7031726 - DNA, 22 bp, Homo sapiens
gcagcatttctcaaagggtggt

SEQ ID NO: 7031727 - DNA, 22 bp, Homo sapiens
tataaagaaggcacagcaagac

SEQ ID NO: 7031728 - DNA, 22 bp, Homo sapiens
ttggttacaagtttgctctgcc

SEQ ID NO: 7031729 - DNA, 22 bp, Homo sapiens
tccctgtgtccatgccaggagg

SEQ ID NO: 7031730 - DNA, 22 bp, Homo sapiens
agttaactcattttataatgcc

SEQ ID NO: 7031731 - DNA, 22 bp, Homo sapiens
agctgttttactggttgtataa

SEQ ID NO: 7031732 - DNA, 22 bp, Homo sapiens
cctcccacattgaggacatgct

SEQ ID NO: 7031733 - DNA, 22 bp, Homo sapiens
acttccagggtagaggggaaga

SEQ ID NO: 7031734 - DNA, 22 bp, Homo sapiens
aattagggaggacaaaggtaca

SEQ ID NO: 7031735 - DNA, 22 bp, Homo sapiens
cagcagctcactgaataatgac

SEQ ID NO: 7031736 - DNA, 22 bp, Homo sapiens
ttacctgattccaactggcgcc

SEQ ID NO: 7031737 - DNA, 22 bp, Homo sapiens
aacagctgcttcagtacttgaa

SEQ ID NO: 7031738 - DNA, 22 bp, Homo sapiens
gtctggggcagcaaggcgcgcg

SEQ ID NO: 7031739 - DNA, 22 bp, Homo sapiens
tggaatgtgaacatacaaggta

SEQ ID NO: 7031740 - DNA, 22 bp, Homo sapiens
ctccttcaaagtggaattaaga

SEQ ID NO: 7031741 - DNA, 22 bp, Homo sapiens
tcttggtatacgcatggcattg

SEQ ID NO: 7031742 - DNA, 22 bp, Homo sapiens
gctggtttcacccaaccgatgt

SEQ ID NO: 7031743 - DNA, 22 bp, Homo sapiens
aatgttttgcattagttttcta

SEQ ID NO: 7031744 - DNA, 22 bp, Homo sapiens
acccagcccagaatctggggcc

SEQ ID NO: 7031745 - DNA, 21 bp, Homo sapiens
atgtagtgacttcattccttc

SEQ ID NO: 7031746 - DNA, 22 bp, Homo sapiens
acagacattttaagacacttta

SEQ ID NO: 7031747 - DNA, 21 bp, Homo sapiens
tttattaacaactgtggacgt

SEQ ID NO: 7031748 - DNA, 22 bp, Homo sapiens
ggagagtctgctggccacagtg

SEQ ID NO: 7031749 - DNA, 22 bp, Homo sapiens
gcattattaatagctgcatgag

SEQ ID NO: 7031750 - DNA, 22 bp, Homo sapiens
aggcagctgccctctccttcct

SEQ ID NO: 7031751 - DNA, 19 bp, Homo sapiens
tctcagtagactgtatgtt

SEQ ID NO: 7031752 - DNA, 22 bp, Homo sapiens
ttctgcaccatcttccagctga

SEQ ID NO: 7031753 - DNA, 18 bp, Homo sapiens
ttcatgttggcttaggga

SEQ ID NO: 7031754 - DNA, 22 bp, Homo sapiens
ttccaagtgggggaagctgagt

SEQ ID NO: 7031755 - DNA, 23 bp, Homo sapiens
agtgatctgtgtttgaagaatgc

SEQ ID NO: 7031756 - DNA, 22 bp, Homo sapiens
aggggctgtggaaaccaactct

SEQ ID NO: 7031757 - DNA, 22 bp, Homo sapiens
tgggacatctgtgaagctgaat

SEQ ID NO: 7031758 - DNA, 22 bp, Homo sapiens
ttactgatcccccaggtgaccc

SEQ ID NO: 7031759 - DNA, 22 bp, Homo sapiens
tccaggcagggcagccatcaag

SEQ ID NO: 7031760 - DNA, 22 bp, Homo sapiens
agaggaatttctggaaggaggc

SEQ ID NO: 7031761 - DNA, 22 bp, Homo sapiens
aactgtctgaaactggggtttc

SEQ ID NO: 7031762 - DNA, 22 bp, Homo sapiens
tgtctggaggggatgttatggt

SEQ ID NO: 7031763 - DNA, 22 bp, Homo sapiens
acagggcccttagatcctttta

SEQ ID NO: 7031764 - DNA, 22 bp, Homo sapiens
tgggcctgtggcttggctctag

SEQ ID NO: 7031765 - DNA, 22 bp, Homo sapiens
tgcaaaacttctcagagccttt

SEQ ID NO: 7031766 - DNA, 22 bp, Homo sapiens
aatgttgcagagtgattgtcca

SEQ ID NO: 7031767 - DNA, 22 bp, Homo sapiens
gatttcttgataagtagtgtga

SEQ ID NO: 7031768 - DNA, 22 bp, Homo sapiens
acaccatggttcccaaactgtg

SEQ ID NO: 7031769 - DNA, 22 bp, Homo sapiens
tgggagcagcctcagcttcggg

SEQ ID NO: 7031770 - DNA, 22 bp, Homo sapiens
ggtcttgctatgttgcccaggc

SEQ ID NO: 7031771 - DNA, 22 bp, Homo sapiens
tttcttaggctctaaaatgact

SEQ ID NO: 7031772 - DNA, 22 bp, Homo sapiens
tgaaagcagatagctctgttgt

SEQ ID NO: 7031773 - DNA, 22 bp, Homo sapiens
tcagcagggagaggagaatgca

SEQ ID NO: 7031774 - DNA, 22 bp, Homo sapiens
ctctatttatggcatctttatg

SEQ ID NO: 7031775 - DNA, 22 bp, Homo sapiens
acaaacagagttgaaaaatagg

SEQ ID NO: 7031776 - DNA, 22 bp, Homo sapiens
ttctgttagaattttgaaaata

SEQ ID NO: 7031777 - DNA, 18 bp, Homo sapiens
aaaatgttcccccattaa

SEQ ID NO: 7031778 - DNA, 22 bp, Homo sapiens
tagaggaggtgattcttgagct

SEQ ID NO: 7031779 - DNA, 22 bp, Homo sapiens
gggacatggctaggattccaat

SEQ ID NO: 7031780 - DNA, 23 bp, Homo sapiens
agctgcagatgctcagcgggcag

SEQ ID NO: 7031781 - DNA, 22 bp, Homo sapiens
tagttttagcagcaatgggatg

SEQ ID NO: 7031782 - DNA, 22 bp, Homo sapiens
tattggtagaaataggttctgg

SEQ ID NO: 7031783 - DNA, 22 bp, Homo sapiens
acacatatatttgcatatacac

SEQ ID NO: 7031784 - DNA, 23 bp, Homo sapiens
tacagaaggagtagtcactaaga

SEQ ID NO: 7031785 - DNA, 22 bp, Homo sapiens
aaagtgcttctctttggtgggt

SEQ ID NO: 7031786 - DNA, 22 bp, Homo sapiens
catactattactaggagcagga

SEQ ID NO: 7031787 - DNA, 22 bp, Homo sapiens
agctggaacgtcacaggagcag

SEQ ID NO: 7031788 - DNA, 22 bp, Homo sapiens
tataggctgctgagatcccttt

SEQ ID NO: 7031789 - DNA, 19 bp, Homo sapiens
tgctccgctaaggcagaca

SEQ ID NO: 7031790 - DNA, 22 bp, Homo sapiens
atcccatgagaccacgttggct

SEQ ID NO: 7031791 - DNA, 19 bp, Homo sapiens
ctgacagcgcctgataaga

SEQ ID NO: 7031792 - DNA, 22 bp, Homo sapiens
tggaattcttattctgacttca

SEQ ID NO: 7031793 - DNA, 22 bp, Homo sapiens
tgaaggccagcagagtgaaggc

SEQ ID NO: 7031794 - DNA, 22 bp, Homo sapiens
ctccgagactcgagtgtcctca

SEQ ID NO: 7031795 - DNA, 22 bp, Homo sapiens
tagcttctatacaacttcagca

SEQ ID NO: 7031796 - DNA, 22 bp, Homo sapiens
gaaggcaacaccaggatgcact

SEQ ID NO: 7031797 - DNA, 22 bp, Homo sapiens
agcaatgctaccgggtgattcg

SEQ ID NO: 7031798 - DNA, 22 bp, Homo sapiens
aaaatctggcaacactaagttt

SEQ ID NO: 7031799 - DNA, 22 bp, Homo sapiens
ggatgcccactatctgctggct

SEQ ID NO: 7031800 - DNA, 22 bp, Homo sapiens
gatagaaagagtggttcttttt

SEQ ID NO: 7031801 - DNA, 22 bp, Homo sapiens
ctggagttagagtagacactga

SEQ ID NO: 7031802 - DNA, 22 bp, Homo sapiens
gtctgtcatctgagatggagtg

SEQ ID NO: 7031803 - DNA, 22 bp, Homo sapiens
ggtgcccagagccaggaatgag

SEQ ID NO: 7031804 - DNA, 16 bp, Homo sapiens
agcagaggtgagtgaa

SEQ ID NO: 7031805 - DNA, 22 bp, Homo sapiens
tgatggctccttcattatgggt

SEQ ID NO: 7031806 - DNA, 22 bp, Homo sapiens
tgctaaggactgggaggcaggg

SEQ ID NO: 7031807 - DNA, 22 bp, Homo sapiens
tccctcagcaggaactggcctg

SEQ ID NO: 7031808 - DNA, 22 bp, Homo sapiens
cctgcactacctggggctgctg

SEQ ID NO: 7031809 - DNA, 22 bp, Homo sapiens
tgggagcagcattgccatgtgc

SEQ ID NO: 7031810 - DNA, 22 bp, Homo sapiens
tgcagagatctgggcgtcggct

SEQ ID NO: 7031811 - DNA, 22 bp, Homo sapiens
gctcagacagatatttcgagat

SEQ ID NO: 7031812 - DNA, 22 bp, Homo sapiens
atacattagctcatatgattaa

SEQ ID NO: 7031813 - DNA, 22 bp, Homo sapiens
atatgtgaatgatatcactttg

SEQ ID NO: 7031814 - DNA, 22 bp, Homo sapiens
tggggtggtgggaaccaagtag

SEQ ID NO: 7031815 - DNA, 22 bp, Homo sapiens
ttgaatgaatagttgctagaag

SEQ ID NO: 7031816 - DNA, 19 bp, Homo sapiens
ttacttcaggagtgaaatt

SEQ ID NO: 7031817 - DNA, 22 bp, Homo sapiens
cccgaggaaccagaggtagctc

SEQ ID NO: 7031818 - DNA, 22 bp, Homo sapiens
agaggtcttaagttccttgatg

SEQ ID NO: 7031819 - DNA, 22 bp, Homo sapiens
atattaccaatgcttggaaaaa

SEQ ID NO: 7031820 - DNA, 22 bp, Homo sapiens
gaaaaccacctcccatcaagca

SEQ ID NO: 7031821 - DNA, 22 bp, Homo sapiens
acgcggtgcggcaagttcatgg

SEQ ID NO: 7031822 - DNA, 22 bp, Homo sapiens
gtgggagtggggaagcagagtg

SEQ ID NO: 7031823 - DNA, 22 bp, Homo sapiens
gggctgagttcctgcctcactc

SEQ ID NO: 7031824 - DNA, 22 bp, Homo sapiens
gtgtatccttattcacacacat

SEQ ID NO: 7031825 - DNA, 22 bp, Homo sapiens
agctttagaattgttcagcaag

SEQ ID NO: 7031826 - DNA, 23 bp, Homo sapiens
tgcaagagttccaaactgttcaa

SEQ ID NO: 7031827 - DNA, 22 bp, Homo sapiens
gctatgaatatccatgatcagc

SEQ ID NO: 7031828 - DNA, 20 bp, Homo sapiens
agccagccacttcctgctcc

SEQ ID NO: 7031829 - DNA, 22 bp, Homo sapiens
aaggccttggttctgagcaata

SEQ ID NO: 7031830 - DNA, 22 bp, Homo sapiens
tctttccacattctctgtttag

SEQ ID NO: 7031831 - DNA, 22 bp, Homo sapiens
ggccttgacagttaagagacct

SEQ ID NO: 7031832 - DNA, 22 bp, Homo sapiens
aaatgtgtgcacaaagacagct

SEQ ID NO: 7031833 - DNA, 22 bp, Homo sapiens
tggaataaagtaagtctctatt

SEQ ID NO: 7031834 - DNA, 22 bp, Homo sapiens
gcttcctgagacaacattgagt

SEQ ID NO: 7031835 - DNA, 22 bp, Homo sapiens
tggccctgttctgtacctcata

SEQ ID NO: 7031836 - DNA, 20 bp, Homo sapiens
taaccaagaattggcaaggg

SEQ ID NO: 7031837 - DNA, 23 bp, Homo sapiens
tcacatatcaagaaagtggtaga

SEQ ID NO: 7031838 - DNA, 20 bp, Homo sapiens
gtgaccagaagacagtgggt

SEQ ID NO: 7031839 - DNA, 21 bp, Homo sapiens
ctctgcccagggcctcctgcc

SEQ ID NO: 7031840 - DNA, 22 bp, Homo sapiens
agcccagagcctctcctaaagg

SEQ ID NO: 7031841 - DNA, 22 bp, Homo sapiens
agcagagtgccccatcacaagg

SEQ ID NO: 7031842 - DNA, 22 bp, Homo sapiens
actgttcacccagcactagcag

SEQ ID NO: 7031843 - DNA, 22 bp, Homo sapiens
cagtgggaatgaagtggaggcc

SEQ ID NO: 7031844 - DNA, 20 bp, Homo sapiens
cctggagcctggaaggagtc

SEQ ID NO: 7031845 - DNA, 22 bp, Homo sapiens
acaggagcccaggatgggcgga

SEQ ID NO: 7031846 - DNA, 22 bp, Homo sapiens
ccctgggttctggctgggctgc

SEQ ID NO: 7031847 - DNA, 22 bp, Homo sapiens
acccatgggccagttggggtgg

SEQ ID NO: 7031848 - DNA, 20 bp, Homo sapiens
aggccccaggaaactctcag

SEQ ID NO: 7031849 - DNA, 21 bp, Homo sapiens
cctgagatctggagtggcttt

SEQ ID NO: 7031850 - DNA, 22 bp, Homo sapiens
tattgacaataggcaactgagg

SEQ ID NO: 7031851 - DNA, 22 bp, Homo sapiens
ttattaatacatgcacctgcat

SEQ ID NO: 7031852 - DNA, 22 bp, Homo sapiens
agccagcactttttctctgggc

SEQ ID NO: 7031853 - DNA, 22 bp, Homo sapiens
tgatgacagcatggaccccagg

SEQ ID NO: 7031854 - DNA, 22 bp, Homo sapiens
atgtacaagctgttttactgca

SEQ ID NO: 7031855 - DNA, 22 bp, Homo sapiens
atgctgaccaagcaggacatgg

SEQ ID NO: 7031856 - DNA, 22 bp, Homo sapiens
taccaaggtagtggagacagaa

SEQ ID NO: 7031857 - DNA, 22 bp, Homo sapiens
aagcagcatagctcccttagtt

SEQ ID NO: 7031858 - DNA, 22 bp, Homo sapiens
agcctggagaagatgtgtattg

SEQ ID NO: 7031859 - DNA, 23 bp, Homo sapiens
tgcagagtgtcacttgaaaacca

SEQ ID NO: 7031860 - DNA, 22 bp, Homo sapiens
agtctacagtctgggtcgggtg

SEQ ID NO: 7031861 - DNA, 22 bp, Homo sapiens
ttgtcaagaaaaatggatgaag

SEQ ID NO: 7031862 - DNA, 22 bp, Homo sapiens
tacaaagtttgagaatgctttc

SEQ ID NO: 7031863 - DNA, 22 bp, Homo sapiens
ctgaggctccctcgggtctgct

SEQ ID NO: 7031864 - DNA, 22 bp, Homo sapiens
gtattgcattttgaatgcatgg

SEQ ID NO: 7031865 - DNA, 22 bp, Homo sapiens
agctcctggctttcctctcacc

SEQ ID NO: 7031866 - DNA, 22 bp, Homo sapiens
tgatatttgctgactgcattgt

SEQ ID NO: 7031867 - DNA, 21 bp, Homo sapiens
ggagtttttctggaagggact

SEQ ID NO: 7031868 - DNA, 22 bp, Homo sapiens
atcctctgtggattacacctag

SEQ ID NO: 7031869 - DNA, 22 bp, Homo sapiens
ggcttctgccacgagagggaag

SEQ ID NO: 7031870 - DNA, 21 bp, Homo sapiens
ctcagacagggaggctctggg

SEQ ID NO: 7031871 - DNA, 22 bp, Homo sapiens
catgtggttcaagtactccaca

SEQ ID NO: 7031872 - DNA, 22 bp, Homo sapiens
agattaggtatggtttaagtag

SEQ ID NO: 7031873 - DNA, 22 bp, Homo sapiens
tgcttacgagctattttcactt

SEQ ID NO: 7031874 - DNA, 22 bp, Homo sapiens
gttgccgtttgttctaccagac

SEQ ID NO: 7031875 - DNA, 22 bp, Homo sapiens
tataagcctcgatggtaagcct

SEQ ID NO: 7031876 - DNA, 22 bp, Homo sapiens
tcagcagagctcaggctccagc

SEQ ID NO: 7031877 - DNA, 22 bp, Homo sapiens
tggcatccaggtcctcacatgg

SEQ ID NO: 7031878 - DNA, 22 bp, Homo sapiens
aggttctgttttaaaagagctc

SEQ ID NO: 7031879 - DNA, 22 bp, Homo sapiens
caagatgtgcctaatcagacct

SEQ ID NO: 7031880 - DNA, 22 bp, Homo sapiens
tgctgaaaagtaaataggccta

SEQ ID NO: 7031881 - DNA, 22 bp, Homo sapiens
aagccatggcatgccaggatca

SEQ ID NO: 7031882 - DNA, 22 bp, Homo sapiens
aagcagccacctcatctccact

SEQ ID NO: 7031883 - DNA, 20 bp, Homo sapiens
acctacatgtatagtgaggg

SEQ ID NO: 7031884 - DNA, 22 bp, Homo sapiens
agctatgctgcagttgtggagt

SEQ ID NO: 7031885 - DNA, 22 bp, Homo sapiens
tctgctgtttactgtgtgatat

SEQ ID NO: 7031886 - DNA, 22 bp, Homo sapiens
gtcttctgtttactttgaagtt

SEQ ID NO: 7031887 - DNA, 20 bp, Homo sapiens
ttgttcattgagctgttttc

SEQ ID NO: 7031888 - DNA, 20 bp, Homo sapiens
tcctggtcatgtggctgggc

SEQ ID NO: 7031889 - DNA, 22 bp, Homo sapiens
ttcagtatgttggacgttatgt

SEQ ID NO: 7031890 - DNA, 22 bp, Homo sapiens
agtctggccttgccttgtcgag

SEQ ID NO: 7031891 - DNA, 22 bp, Homo sapiens
ctcagagcacagtttatgacag

SEQ ID NO: 7031892 - DNA, 22 bp, Homo sapiens
ctgctggaaggtacacatcttg

SEQ ID NO: 7031893 - DNA, 22 bp, Homo sapiens
tgaaatgtgtaatgtggatgcc

SEQ ID NO: 7031894 - DNA, 22 bp, Homo sapiens
tggtgcccattctggtcccatg

SEQ ID NO: 7031895 - DNA, 22 bp, Homo sapiens
atgcatgcatgtaccccacctt

SEQ ID NO: 7031896 - DNA, 19 bp, Homo sapiens
ttctgggaggggctgactg

SEQ ID NO: 7031897 - DNA, 22 bp, Homo sapiens
aatgtctatgatcctttaagtt

SEQ ID NO: 7031898 - DNA, 22 bp, Homo sapiens
tggctgcctttcacctcatctc

SEQ ID NO: 7031899 - DNA, 22 bp, Homo sapiens
ctccctcatatacccagcgaga

SEQ ID NO: 7031900 - DNA, 22 bp, Homo sapiens
gacttctgagctatccagctgt

SEQ ID NO: 7031901 - DNA, 22 bp, Homo sapiens
ccaaagtcagtgctcagtcgtc

SEQ ID NO: 7031902 - DNA, 22 bp, Homo sapiens
atgtcagatgtttatctgattt

SEQ ID NO: 7031903 - DNA, 22 bp, Homo sapiens
tatagtacacttaggtacttca

SEQ ID NO: 7031904 - DNA, 22 bp, Homo sapiens
ttattgactgatcagagaggga

SEQ ID NO: 7031905 - DNA, 22 bp, Homo sapiens
tgtgttgtgacattcttggatg

SEQ ID NO: 7031906 - DNA, 22 bp, Homo sapiens
attcactgtcagcttgcatggg

SEQ ID NO: 7031907 - DNA, 22 bp, Homo sapiens
tagcatttcactgatcttcact

SEQ ID NO: 7031908 - DNA, 22 bp, Homo sapiens
tgggatatagtaaaacatgaat

SEQ ID NO: 7031909 - DNA, 22 bp, Homo sapiens
cctggcagaatattaaagtgca

SEQ ID NO: 7031910 - DNA, 22 bp, Homo sapiens
cctggagcttttccagttgaca

SEQ ID NO: 7031911 - DNA, 22 bp, Homo sapiens
atgttgtttttgtcccagaagg

SEQ ID NO: 7031912 - DNA, 16 bp, Homo sapiens
tgatgacagatatggc

SEQ ID NO: 7031913 - DNA, 22 bp, Homo sapiens
tgtttagatctcattcttccca

SEQ ID NO: 7031914 - DNA, 22 bp, Homo sapiens
tacacattctagggcacagtta

SEQ ID NO: 7031915 - DNA, 22 bp, Homo sapiens
catgaagcacagctctcttttt

SEQ ID NO: 7031916 - DNA, 22 bp, Homo sapiens
agcctgggtttttattaaggag

SEQ ID NO: 7031917 - DNA, 22 bp, Homo sapiens
tgaggtatgatttacatgcagt

SEQ ID NO: 7031918 - DNA, 22 bp, Homo sapiens
cttctgaggcagctattcagtt

SEQ ID NO: 7031919 - DNA, 22 bp, Homo sapiens
gaggaacagcagccacatgtcc

SEQ ID NO: 7031920 - DNA, 22 bp, Homo sapiens
aaatgcatggctgttttaaagc

SEQ ID NO: 7031921 - DNA, 22 bp, Homo sapiens
ggtgaaggtcagagcaggaaaa

SEQ ID NO: 7031922 - DNA, 22 bp, Homo sapiens
agattgtagaaactgtagcatt

SEQ ID NO: 7031923 - DNA, 18 bp, Homo sapiens
tggattagaggagaaggt

SEQ ID NO: 7031924 - DNA, 22 bp, Homo sapiens
tcaaaaatgttttatattggta

SEQ ID NO: 7031925 - DNA, 22 bp, Homo sapiens
tattctacgagtttggtaattt

SEQ ID NO: 7031926 - DNA, 22 bp, Homo sapiens
gggcaggtctgggtcagcctga

SEQ ID NO: 7031927 - DNA, 22 bp, Homo sapiens
tgagaaaacagtttgtaataat

SEQ ID NO: 7031928 - DNA, 22 bp, Homo sapiens
tcttcacatgaccttcatgtct

SEQ ID NO: 7031929 - DNA, 21 bp, Homo sapiens
tgaggtagtgtttgtcaagtt

SEQ ID NO: 7031930 - DNA, 22 bp, Homo sapiens
tgtgtgcacaaagagtacatgg

SEQ ID NO: 7031931 - DNA, 16 bp, Homo sapiens
cgtggtctgatttcct

SEQ ID NO: 7031932 - DNA, 22 bp, Homo sapiens
tcagtgcattctaccaaaaggc

SEQ ID NO: 7031933 - DNA, 22 bp, Homo sapiens
tacataattaatctttaagttc

SEQ ID NO: 7031934 - DNA, 22 bp, Homo sapiens
ggtagccagtccattacatgta

SEQ ID NO: 7031935 - DNA, 22 bp, Homo sapiens
tcagaagtcccttgcatcttag

SEQ ID NO: 7031936 - DNA, 22 bp, Homo sapiens
atttcccagggcctgggatttg

SEQ ID NO: 7031937 - DNA, 22 bp, Homo sapiens
gcagagcaggggctgaacctgg

SEQ ID NO: 7031938 - DNA, 22 bp, Homo sapiens
agtatctcaaagtggtttatgg

SEQ ID NO: 7031939 - DNA, 22 bp, Homo sapiens
atcagctcttgatgcctttctt

SEQ ID NO: 7031940 - DNA, 22 bp, Homo sapiens
aaatggatctgtggaatacatt

SEQ ID NO: 7031941 - DNA, 22 bp, Homo sapiens
gtaaaaaggccaagcccttgtg

SEQ ID NO: 7031942 - DNA, 22 bp, Homo sapiens
atcaaaacccagacaggctgga

SEQ ID NO: 7031943 - DNA, 22 bp, Homo sapiens
tcacagacactgggttattgca

SEQ ID NO: 7031944 - DNA, 22 bp, Homo sapiens
ttggaaattgcaagtgatttgc

SEQ ID NO: 7031945 - DNA, 22 bp, Homo sapiens
gggtcagctgctgggggctgac

SEQ ID NO: 7031946 - DNA, 22 bp, Homo sapiens
atggccctgaccttgatgacct

SEQ ID NO: 7031947 - DNA, 22 bp, Homo sapiens
agcagccagagtctgaacatta

SEQ ID NO: 7031948 - DNA, 22 bp, Homo sapiens
ctgtcaacacgggtgtgcgtgc

SEQ ID NO: 7031949 - DNA, 21 bp, Homo sapiens
tgtgtcactaactagaggcta

SEQ ID NO: 7031950 - DNA, 22 bp, Homo sapiens
gtcatctcaagtaagtgaacaa

SEQ ID NO: 7031951 - DNA, 22 bp, Homo sapiens
tctgctcaccctcagctgatgc

SEQ ID NO: 7031952 - DNA, 22 bp, Homo sapiens
tgaagccattactgtgttaggg

SEQ ID NO: 7031953 - DNA, 22 bp, Homo sapiens
ctggacacactggagtctggca

SEQ ID NO: 7031954 - DNA, 22 bp, Homo sapiens
ttctccagacaacagagggtga

SEQ ID NO: 7031955 - DNA, 22 bp, Homo sapiens
aaaccagtgatagactagacac

SEQ ID NO: 7031956 - DNA, 22 bp, Homo sapiens
caagatttccaaccctgggtaa

SEQ ID NO: 7031957 - DNA, 22 bp, Homo sapiens
accaggccctccagctgcgtgg

SEQ ID NO: 7031958 - DNA, 22 bp, Homo sapiens
taaatgtgtaaacctccattac

SEQ ID NO: 7031959 - DNA, 22 bp, Homo sapiens
ctatcttggtccagtctacacc

SEQ ID NO: 7031960 - DNA, 22 bp, Homo sapiens
aggtctggaaacagcagggaga

SEQ ID NO: 7031961 - DNA, 22 bp, Homo sapiens
aaatatgagatgttctctttcg

SEQ ID NO: 7031962 - DNA, 22 bp, Homo sapiens
tccaggctgacgcagctattta

SEQ ID NO: 7031963 - DNA, 22 bp, Homo sapiens
ggtctctgcagctcccggcccc

SEQ ID NO: 7031964 - DNA, 22 bp, Homo sapiens
ttggtcctgggcactgattaac

SEQ ID NO: 7031965 - DNA, 22 bp, Homo sapiens
tggaagtgagaagtttcctcag

SEQ ID NO: 7031966 - DNA, 22 bp, Homo sapiens
acatactttagcactgcattgt

SEQ ID NO: 7031967 - DNA, 22 bp, Homo sapiens
tatttgtatttcatgcagtaaa

SEQ ID NO: 7031968 - DNA, 22 bp, Homo sapiens
catcccttcccccgagcatggc

SEQ ID NO: 7031969 - DNA, 22 bp, Homo sapiens
gctgaggcaaatagttttaagt

SEQ ID NO: 7031970 - DNA, 22 bp, Homo sapiens
agctgctgaagtgagagaattg

SEQ ID NO: 7031971 - DNA, 22 bp, Homo sapiens
gcatgtactcaggggaaaggtg

SEQ ID NO: 7031972 - DNA, 22 bp, Homo sapiens
ttcttgcatcaagacagcctgt

SEQ ID NO: 7031973 - DNA, 22 bp, Homo sapiens
cagggccagccgcagcatccac

SEQ ID NO: 7031974 - DNA, 22 bp, Homo sapiens
agactactctgttttatatctt

SEQ ID NO: 7031975 - DNA, 22 bp, Homo sapiens
ggtggcatctcagttcatgggc

SEQ ID NO: 7031976 - DNA, 22 bp, Homo sapiens
tgggctctgggtggcctgagca

SEQ ID NO: 7031977 - DNA, 21 bp, Homo sapiens
gggcctggctgcgcaggacgg

SEQ ID NO: 7031978 - DNA, 22 bp, Homo sapiens
cttgaaagcactcctttgactg

SEQ ID NO: 7031979 - DNA, 22 bp, Homo sapiens
atcttgttctcccttgttctta

SEQ ID NO: 7031980 - DNA, 20 bp, Homo sapiens
atgcagtcttgtggcaacta

SEQ ID NO: 7031981 - DNA, 22 bp, Homo sapiens
tcagccagttgccccagttagt

SEQ ID NO: 7031982 - DNA, 22 bp, Homo sapiens
cagtgggtaggaaaggctcttc

SEQ ID NO: 7031983 - DNA, 22 bp, Homo sapiens
tctttaatgtgattgtaattat

SEQ ID NO: 7031984 - DNA, 22 bp, Homo sapiens
gttcctttcctatttggataag

SEQ ID NO: 7031985 - DNA, 22 bp, Homo sapiens
agcccagaggggtttgaggact

SEQ ID NO: 7031986 - DNA, 22 bp, Homo sapiens
acattgaatgtatgtgatgaaa

SEQ ID NO: 7031987 - DNA, 22 bp, Homo sapiens
gaaaagaactgcatgggattaa

SEQ ID NO: 7031988 - DNA, 22 bp, Homo sapiens
cacgtccacccaggctgcccag

SEQ ID NO: 7031989 - DNA, 22 bp, Homo sapiens
tgccagggtcctgagggccttg

SEQ ID NO: 7031990 - DNA, 22 bp, Homo sapiens
gggtctctcagaaggctgcaat

SEQ ID NO: 7031991 - DNA, 22 bp, Homo sapiens
ctgtatataatgtatgcatggg

SEQ ID NO: 7031992 - DNA, 21 bp, Homo sapiens
aggtgcaggcctcaagcccca

SEQ ID NO: 7031993 - DNA, 22 bp, Homo sapiens
tttaaccagtttacaaagaatt

SEQ ID NO: 7031994 - DNA, 22 bp, Homo sapiens
tgctgggctcaacctccagagc

SEQ ID NO: 7031995 - DNA, 22 bp, Homo sapiens
gagcagcttatgtcaagccaga

SEQ ID NO: 7031996 - DNA, 22 bp, Homo sapiens
ttcaaatggttagactgttagc

SEQ ID NO: 7031997 - DNA, 22 bp, Homo sapiens
attaactgtactttctaatttt

SEQ ID NO: 7031998 - DNA, 22 bp, Homo sapiens
aaacatcaccattttacctaat

SEQ ID NO: 7031999 - DNA, 22 bp, Homo sapiens
gcttctgttcaaggatataagg

SEQ ID NO: 7032000 - DNA, 22 bp, Homo sapiens
cttgaatcttctgagtatttgc

SEQ ID NO: 7032001 - DNA, 23 bp, Homo sapiens
atgcagagaataacaaatgccat

SEQ ID NO: 7032002 - DNA, 22 bp, Homo sapiens
ggccttgatcctccagagcact

SEQ ID NO: 7032003 - DNA, 22 bp, Homo sapiens
aaactgagtggcttataaacaa

SEQ ID NO: 7032004 - DNA, 22 bp, Homo sapiens
ttccagaagcctccatattact

SEQ ID NO: 7032005 - DNA, 22 bp, Homo sapiens
aacattagatttgtttttctag

SEQ ID NO: 7032006 - DNA, 22 bp, Homo sapiens
tagtttagtgaatggttaaaga

SEQ ID NO: 7032007 - DNA, 18 bp, Homo sapiens
tgcagcatgttcccataa

SEQ ID NO: 7032008 - DNA, 17 bp, Homo sapiens
tgcacaagagacaatag

SEQ ID NO: 7032009 - DNA, 22 bp, Homo sapiens
ctccagagtcatcgagcattcc

SEQ ID NO: 7032010 - DNA, 22 bp, Homo sapiens
caattgctttgtggaagccttt

SEQ ID NO: 7032011 - DNA, 22 bp, Homo sapiens
gaggctaaggtgccagacgaat

SEQ ID NO: 7032012 - DNA, 22 bp, Homo sapiens
gtttttattgtgtaaatgtggg

SEQ ID NO: 7032013 - DNA, 22 bp, Homo sapiens
tctagggagagttgttatgggt

SEQ ID NO: 7032014 - DNA, 22 bp, Homo sapiens
cccaaggggagattttcttgag

SEQ ID NO: 7032015 - DNA, 22 bp, Homo sapiens
atctcaggccctagtgacctca

SEQ ID NO: 7032016 - DNA, 22 bp, Homo sapiens
gttgggatgatttagtcaagca

SEQ ID NO: 7032017 - DNA, 22 bp, Homo sapiens
ttatactttatactacatcatt

SEQ ID NO: 7032018 - DNA, 22 bp, Homo sapiens
tccttggcctaaggagaagagg

SEQ ID NO: 7032019 - DNA, 22 bp, Homo sapiens
ttagactttaagctgggtgcag

SEQ ID NO: 7032020 - DNA, 22 bp, Homo sapiens
gaggatggaggcagttagggcc

SEQ ID NO: 7032021 - DNA, 22 bp, Homo sapiens
tgcagctgcaggagggtgggag

SEQ ID NO: 7032022 - DNA, 22 bp, Homo sapiens
tttgaatgcaggacatacagaa

SEQ ID NO: 7032023 - DNA, 19 bp, Homo sapiens
atgttttatgctgatggga

SEQ ID NO: 7032024 - DNA, 22 bp, Homo sapiens
gcatgcatgatgttggcagtgg

SEQ ID NO: 7032025 - DNA, 22 bp, Homo sapiens
gcgtttgttttgctggcgccag

SEQ ID NO: 7032026 - DNA, 22 bp, Homo sapiens
acacatatgtatgcatcatgtg

SEQ ID NO: 7032027 - DNA, 22 bp, Homo sapiens
ttattgctatggtgagagggat

SEQ ID NO: 7032028 - DNA, 22 bp, Homo sapiens
ctgggctgcggttctctgaagc

SEQ ID NO: 7032029 - DNA, 22 bp, Homo sapiens
actgtgctatctactgaattat

SEQ ID NO: 7032030 - DNA, 22 bp, Homo sapiens
gtggatccagtgttccatgtca

SEQ ID NO: 7032031 - DNA, 22 bp, Homo sapiens
aggttagaatgtaagagtttca

SEQ ID NO: 7032032 - DNA, 22 bp, Homo sapiens
tttagacactagggatgcagtg

SEQ ID NO: 7032033 - DNA, 22 bp, Homo sapiens
tacaatatgtgaactttggtgt

SEQ ID NO: 7032034 - DNA, 22 bp, Homo sapiens
tgcaccagagcagggtgcccaa

SEQ ID NO: 7032035 - DNA, 22 bp, Homo sapiens
aggagtttatccgagggcataa

SEQ ID NO: 7032036 - DNA, 22 bp, Homo sapiens
ttggggctctgaaaaagatgta

SEQ ID NO: 7032037 - DNA, 22 bp, Homo sapiens
caagtaaatgtgaactggaagg

SEQ ID NO: 7032038 - DNA, 22 bp, Homo sapiens
agcaggaggagagcctggcggt

SEQ ID NO: 7032039 - DNA, 22 bp, Homo sapiens
gcccagctcctctgcagaccct

SEQ ID NO: 7032040 - DNA, 22 bp, Homo sapiens
tggcacctggtgcagggtggcc

SEQ ID NO: 7032041 - DNA, 22 bp, Homo sapiens
actgtttgctgatagatattta

SEQ ID NO: 7032042 - DNA, 22 bp, Homo sapiens
ctattagacacaattagtgatt

SEQ ID NO: 7032043 - DNA, 22 bp, Homo sapiens
ttggatgatttccagtgtgaga

SEQ ID NO: 7032044 - DNA, 22 bp, Homo sapiens
atacaggtgtgagggtctcttt

SEQ ID NO: 7032045 - DNA, 22 bp, Homo sapiens
agcctgttctggtactccaggt

SEQ ID NO: 7032046 - DNA, 22 bp, Homo sapiens
agagccaggatctgttttgggg

SEQ ID NO: 7032047 - DNA, 22 bp, Homo sapiens
tgtgagcaagtttatgtgtaca

SEQ ID NO: 7032048 - DNA, 22 bp, Homo sapiens
ggggtggagctaaatgtctact

SEQ ID NO: 7032049 - DNA, 22 bp, Homo sapiens
cagtacttgggaatgctgggga

SEQ ID NO: 7032050 - DNA, 22 bp, Homo sapiens
ctgtgagaagaatcccacctga

SEQ ID NO: 7032051 - DNA, 22 bp, Homo sapiens
tcagctttgggggtctcaggag

SEQ ID NO: 7032052 - DNA, 22 bp, Homo sapiens
tgtgttaattttccctttctct

SEQ ID NO: 7032053 - DNA, 22 bp, Homo sapiens
tgggccacacacagaagaatca

SEQ ID NO: 7032054 - DNA, 22 bp, Homo sapiens
gtgcaggatctcagaacaagtg

SEQ ID NO: 7032055 - DNA, 22 bp, Homo sapiens
tgtttatcagggtaaagtgtag

SEQ ID NO: 7032056 - DNA, 22 bp, Homo sapiens
tgtggaaagtggtctaagcaca

SEQ ID NO: 7032057 - DNA, 22 bp, Homo sapiens
cttattcagaccttggattctt

SEQ ID NO: 7032058 - DNA, 23 bp, Homo sapiens
gtgtgcaggattatttgcagaca

SEQ ID NO: 7032059 - DNA, 22 bp, Homo sapiens
ggagacatcatgtaggtttctt

SEQ ID NO: 7032060 - DNA, 22 bp, Homo sapiens
gactttattttaacggagattc

SEQ ID NO: 7032061 - DNA, 22 bp, Homo sapiens
cttgctttatctggtttctcat

SEQ ID NO: 7032062 - DNA, 22 bp, Homo sapiens
tgaaaatgcacgctggaaagca

SEQ ID NO: 7032063 - DNA, 22 bp, Homo sapiens
tcacagtataacctcatatagg

SEQ ID NO: 7032064 - DNA, 22 bp, Homo sapiens
cttagagcttaggctagccatt

SEQ ID NO: 7032065 - DNA, 22 bp, Homo sapiens
ctgcagcatgacttatgtctgg

SEQ ID NO: 7032066 - DNA, 22 bp, Homo sapiens
gggggccttattcatctgccag

SEQ ID NO: 7032067 - DNA, 22 bp, Homo sapiens
gaggcgggcagatcacctgagg

SEQ ID NO: 7032068 - DNA, 18 bp, Homo sapiens
ccaggcacctttaaatat

SEQ ID NO: 7032069 - DNA, 22 bp, Homo sapiens
ggtgtgggaactacaggttttt

SEQ ID NO: 7032070 - DNA, 22 bp, Homo sapiens
cagttttggtcctttctaggta

SEQ ID NO: 7032071 - DNA, 22 bp, Homo sapiens
agataaaatggttcaaaggcta

SEQ ID NO: 7032072 - DNA, 22 bp, Homo sapiens
ctggccccagagtttcacttgg

SEQ ID NO: 7032073 - DNA, 22 bp, Homo sapiens
attaccgctgagtcctatggag

SEQ ID NO: 7032074 - DNA, 22 bp, Homo sapiens
gatttccaggacgggaggtggg

SEQ ID NO: 7032075 - DNA, 22 bp, Homo sapiens
ggctgccaggagggaggccagt

SEQ ID NO: 7032076 - DNA, 22 bp, Homo sapiens
cataaagtatagatctgtgggt

SEQ ID NO: 7032077 - DNA, 22 bp, Homo sapiens
tagcaaactcatacatgtgggt

SEQ ID NO: 7032078 - DNA, 22 bp, Homo sapiens
tgcagagagccagctctctcgg

SEQ ID NO: 7032079 - DNA, 22 bp, Homo sapiens
ccttggtgatctgggctggaag

SEQ ID NO: 7032080 - DNA, 22 bp, Homo sapiens
cagactgggctggtggaaagct

SEQ ID NO: 7032081 - DNA, 22 bp, Homo sapiens
actgttaattcaatcaacaggt

SEQ ID NO: 7032082 - DNA, 22 bp, Homo sapiens
tcctgaggtatatgctttgcag

SEQ ID NO: 7032083 - DNA, 20 bp, Homo sapiens
agaggatttatgtggatgtg

SEQ ID NO: 7032084 - DNA, 22 bp, Homo sapiens
tgagggtttccgggcagtggac

SEQ ID NO: 7032085 - DNA, 22 bp, Homo sapiens
gagctgcttctgtgtgccgggt

SEQ ID NO: 7032086 - DNA, 22 bp, Homo sapiens
ggcagtcagtgtggttcataaa

SEQ ID NO: 7032087 - DNA, 22 bp, Homo sapiens
gcaaacatcttagccatagagt

SEQ ID NO: 7032088 - DNA, 22 bp, Homo sapiens
gtccaaattccacagatttctc

SEQ ID NO: 7032089 - DNA, 22 bp, Homo sapiens
actgtgcacaattctaagtcct

SEQ ID NO: 7032090 - DNA, 22 bp, Homo sapiens
tacagctggactggtagctgtg

SEQ ID NO: 7032091 - DNA, 22 bp, Homo sapiens
gagcggaggcttggaggccagc

SEQ ID NO: 7032092 - DNA, 22 bp, Homo sapiens
gcccatgggcctgaggccctag

SEQ ID NO: 7032093 - DNA, 22 bp, Homo sapiens
agatggtcttttgagtaatgaa

SEQ ID NO: 7032094 - DNA, 22 bp, Homo sapiens
caggcagtgtgacgctagggtt

SEQ ID NO: 7032095 - DNA, 21 bp, Homo sapiens
ttacagcaatgttagcaggaa

SEQ ID NO: 7032096 - DNA, 22 bp, Homo sapiens
gatcattttgatgcccttttag

SEQ ID NO: 7032097 - DNA, 22 bp, Homo sapiens
ttactgatgtcattagaaacag

SEQ ID NO: 7032098 - DNA, 22 bp, Homo sapiens
tgttatcacttagacatgctag

SEQ ID NO: 7032099 - DNA, 22 bp, Homo sapiens
tgcaaatattccatgctgttca

SEQ ID NO: 7032100 - DNA, 22 bp, Homo sapiens
tgaggcaggaagttatataatg

SEQ ID NO: 7032101 - DNA, 22 bp, Homo sapiens
tgtcagcagatctcctgcagcc

SEQ ID NO: 7032102 - DNA, 22 bp, Homo sapiens
accagagaaaacacagcaggct

SEQ ID NO: 7032103 - DNA, 22 bp, Homo sapiens
ggctggcacagagggctggtgt

SEQ ID NO: 7032104 - DNA, 22 bp, Homo sapiens
ctcacagatacggctattcctg

SEQ ID NO: 7032105 - DNA, 22 bp, Homo sapiens
agagaggctgggcgtagggctt

SEQ ID NO: 7032106 - DNA, 22 bp, Homo sapiens
gagtctcggagggagcatggct

SEQ ID NO: 7032107 - DNA, 22 bp, Homo sapiens
acctagaaactgacagaatatt

SEQ ID NO: 7032108 - DNA, 18 bp, Homo sapiens
aagctgccctcaggcagg

SEQ ID NO: 7032109 - DNA, 22 bp, Homo sapiens
actcaggctacaacgcgtggct

SEQ ID NO: 7032110 - DNA, 22 bp, Homo sapiens
gaccagaaagtcatgagtcagt

SEQ ID NO: 7032111 - DNA, 17 bp, Homo sapiens
gcttgccttgtcttcct

SEQ ID NO: 7032112 - DNA, 22 bp, Homo sapiens
aggctgctggctaagaataaga

SEQ ID NO: 7032113 - DNA, 22 bp, Homo sapiens
tcaggaaggcaaattgcatgat

SEQ ID NO: 7032114 - DNA, 22 bp, Homo sapiens
gctgcaagtcatggcttttgca

SEQ ID NO: 7032115 - DNA, 21 bp, Homo sapiens
agggaaagaaaatgagctaat

SEQ ID NO: 7032116 - DNA, 22 bp, Homo sapiens
cctgagttgtcagttgctgtag

SEQ ID NO: 7032117 - DNA, 22 bp, Homo sapiens
gacagcagataagacctcatca

SEQ ID NO: 7032118 - DNA, 22 bp, Homo sapiens
attctgagacaattgccgtcag

SEQ ID NO: 7032119 - DNA, 22 bp, Homo sapiens
ttcacagtggtagtgcatttag

SEQ ID NO: 7032120 - DNA, 22 bp, Homo sapiens
tgttatatctaaatagccacat

SEQ ID NO: 7032121 - DNA, 22 bp, Homo sapiens
ggcctgctgtgtactgatgtca

SEQ ID NO: 7032122 - DNA, 22 bp, Homo sapiens
atggaaatacacaagaggtttc

SEQ ID NO: 7032123 - DNA, 22 bp, Homo sapiens
cggcttgttcaggaacctggct

SEQ ID NO: 7032124 - DNA, 22 bp, Homo sapiens
ttttcgtttatttgacatgtaa

SEQ ID NO: 7032125 - DNA, 22 bp, Homo sapiens
cagtgctggaggctggagggaa

SEQ ID NO: 7032126 - DNA, 22 bp, Homo sapiens
tggtcattgctattgtttctca

SEQ ID NO: 7032127 - DNA, 22 bp, Homo sapiens
actggacagaggaaatatggag

SEQ ID NO: 7032128 - DNA, 22 bp, Homo sapiens
atcctctgaccgctgcagggag

SEQ ID NO: 7032129 - DNA, 22 bp, Homo sapiens
aggctaggggcagtgccagcat

SEQ ID NO: 7032130 - DNA, 22 bp, Homo sapiens
gccatcttcaacatcagaagtt

SEQ ID NO: 7032131 - DNA, 22 bp, Homo sapiens
gccaggctgctccagggaggcc

SEQ ID NO: 7032132 - DNA, 22 bp, Homo sapiens
tttctctgtgccatttccataa

SEQ ID NO: 7032133 - DNA, 22 bp, Homo sapiens
ctgggagtctggaattttggta

SEQ ID NO: 7032134 - DNA, 22 bp, Homo sapiens
tggcaatttcagaaaatagaat

SEQ ID NO: 7032135 - DNA, 22 bp, Homo sapiens
cctggcagggctgcagtaatgg

SEQ ID NO: 7032136 - DNA, 22 bp, Homo sapiens
aaatccagtttgtcatttccca

SEQ ID NO: 7032137 - DNA, 22 bp, Homo sapiens
tttccagggaggaatgtggggt

SEQ ID NO: 7032138 - DNA, 22 bp, Homo sapiens
cctctggaggctctaagagaga

SEQ ID NO: 7032139 - DNA, 22 bp, Homo sapiens
ctcaatacccagggactctaga

SEQ ID NO: 7032140 - DNA, 22 bp, Homo sapiens
atttccttcatcagcctatcct

SEQ ID NO: 7032141 - DNA, 22 bp, Homo sapiens
tttgacattaaggaacatatat

SEQ ID NO: 7032142 - DNA, 22 bp, Homo sapiens
aatttagaattcgctagctaat

SEQ ID NO: 7032143 - DNA, 22 bp, Homo sapiens
cagcccaggtggcggaggttgc

SEQ ID NO: 7032144 - DNA, 22 bp, Homo sapiens
ccagctgcaggggagcagtgga

SEQ ID NO: 7032145 - DNA, 22 bp, Homo sapiens
atgtcaggaccctactgcattg

SEQ ID NO: 7032146 - DNA, 22 bp, Homo sapiens
gggtaggatggtagaagggacc

SEQ ID NO: 7032147 - DNA, 22 bp, Homo sapiens
atgaccacattccagctgtcca

SEQ ID NO: 7032148 - DNA, 22 bp, Homo sapiens
tcctgtcctctgggtgccccat

SEQ ID NO: 7032149 - DNA, 22 bp, Homo sapiens
gcagtggatccaatggtatctt

SEQ ID NO: 7032150 - DNA, 22 bp, Homo sapiens
tatttataacagtgagaacggg

SEQ ID NO: 7032151 - DNA, 22 bp, Homo sapiens
tcaggtgtctatctaacctggt

SEQ ID NO: 7032152 - DNA, 22 bp, Homo sapiens
ctgggaagggagtcaagatact

SEQ ID NO: 7032153 - DNA, 22 bp, Homo sapiens
tcaaggaagggatattcttgaa

SEQ ID NO: 7032154 - DNA, 22 bp, Homo sapiens
caggcattgttctaggttctca

SEQ ID NO: 7032155 - DNA, 22 bp, Homo sapiens
gcttttgaggtcctgctcagcc

SEQ ID NO: 7032156 - DNA, 22 bp, Homo sapiens
gatgctttccaagaaatcctca

SEQ ID NO: 7032157 - DNA, 22 bp, Homo sapiens
atgccctctgtttcccaaggcc

SEQ ID NO: 7032158 - DNA, 22 bp, Homo sapiens
tgaggtatccagtgaagcagcc

SEQ ID NO: 7032159 - DNA, 17 bp, Homo sapiens
gcaaggcctgtttgttc

SEQ ID NO: 7032160 - DNA, 22 bp, Homo sapiens
tctctcccctggccgctacgcg

SEQ ID NO: 7032161 - DNA, 22 bp, Homo sapiens
tcagacatggggagagagacct

SEQ ID NO: 7032162 - DNA, 22 bp, Homo sapiens
gagagtctagtgcacctagttt

SEQ ID NO: 7032163 - DNA, 23 bp, Homo sapiens
aaattcagtccttcaactctgag

SEQ ID NO: 7032164 - DNA, 22 bp, Homo sapiens
catgcagatatttttattgtgg

SEQ ID NO: 7032165 - DNA, 22 bp, Homo sapiens
atttctcagaccagagaggtgt

SEQ ID NO: 7032166 - DNA, 22 bp, Homo sapiens
gaaggcatcacagaggctgtgg

SEQ ID NO: 7032167 - DNA, 22 bp, Homo sapiens
gggtcgcttggagaggcttcct

SEQ ID NO: 7032168 - DNA, 22 bp, Homo sapiens
tagacaggaaacattaggatgg

SEQ ID NO: 7032169 - DNA, 22 bp, Homo sapiens
tcagtagttttgatctgagcag

SEQ ID NO: 7032170 - DNA, 22 bp, Homo sapiens
gtaggcagtggttggaagagaa

SEQ ID NO: 7032171 - DNA, 22 bp, Homo sapiens
acggtgaccaagcatcaccgag

SEQ ID NO: 7032172 - DNA, 23 bp, Homo sapiens
ggccactttgtgtcagtatgtgc

SEQ ID NO: 7032173 - DNA, 22 bp, Homo sapiens
aaaagtttgtgcaaacactcag

SEQ ID NO: 7032174 - DNA, 22 bp, Homo sapiens
tgaacaaatgaatcagtgtagc

SEQ ID NO: 7032175 - DNA, 22 bp, Homo sapiens
ggctctgctggattgaggccag

SEQ ID NO: 7032176 - DNA, 22 bp, Homo sapiens
ggctctgcatgcaggttgtcag

SEQ ID NO: 7032177 - DNA, 22 bp, Homo sapiens
tcccagagccaagctatggatg

SEQ ID NO: 7032178 - DNA, 22 bp, Homo sapiens
ctgggtggttctaactgttgat

SEQ ID NO: 7032179 - DNA, 22 bp, Homo sapiens
tgggtagagacacagtctgggg

SEQ ID NO: 7032180 - DNA, 22 bp, Homo sapiens
acagggaagctcaggggctctg

SEQ ID NO: 7032181 - DNA, 22 bp, Homo sapiens
aataatagcagagtttacaatc

SEQ ID NO: 7032182 - DNA, 22 bp, Homo sapiens
gtccccagctaatctctttgcc

SEQ ID NO: 7032183 - DNA, 22 bp, Homo sapiens
attgtgcaggtcagttattgca

SEQ ID NO: 7032184 - DNA, 22 bp, Homo sapiens
aaaccacacttagcagtttcgt

SEQ ID NO: 7032185 - DNA, 22 bp, Homo sapiens
ttttattcaaatagttcacact

SEQ ID NO: 7032186 - DNA, 21 bp, Homo sapiens
tctgagagcaactgcccttta

SEQ ID NO: 7032187 - DNA, 22 bp, Homo sapiens
tgctatgtgagtgctccaggtg

SEQ ID NO: 7032188 - DNA, 22 bp, Homo sapiens
tttcagaaccgctaaaataaat

SEQ ID NO: 7032189 - DNA, 22 bp, Homo sapiens
agacttaattctgcaagtgtag

SEQ ID NO: 7032190 - DNA, 22 bp, Homo sapiens
atttcctagcctctcttgcagt

SEQ ID NO: 7032191 - DNA, 22 bp, Homo sapiens
gcagtactttatcacatggaat

SEQ ID NO: 7032192 - DNA, 22 bp, Homo sapiens
agtatttgcatgttagggacct

SEQ ID NO: 7032193 - DNA, 22 bp, Homo sapiens
ctgggcaggagggctctatgga

SEQ ID NO: 7032194 - DNA, 22 bp, Homo sapiens
tctgtgctcaagttctgcctct

SEQ ID NO: 7032195 - DNA, 22 bp, Homo sapiens
ggactgaacacttaaatgtcca

SEQ ID NO: 7032196 - DNA, 22 bp, Homo sapiens
ttgaaagaacaattctgtgatg

SEQ ID NO: 7032197 - DNA, 22 bp, Homo sapiens
gcattctttccacgaggaggta

SEQ ID NO: 7032198 - DNA, 20 bp, Homo sapiens
actccaggtggcatgaggac

SEQ ID NO: 7032199 - DNA, 22 bp, Homo sapiens
aagatcaggcgtggaaaacact

SEQ ID NO: 7032200 - DNA, 22 bp, Homo sapiens
tcaaaacactattacctttaat

SEQ ID NO: 7032201 - DNA, 22 bp, Homo sapiens
agccagtctctctccctggaga

SEQ ID NO: 7032202 - DNA, 22 bp, Homo sapiens
caggactcacttctcacatccc

SEQ ID NO: 7032203 - DNA, 22 bp, Homo sapiens
tgcataaaaaccacatacaagg

SEQ ID NO: 7032204 - DNA, 22 bp, Homo sapiens
aagacatgcaattagcaaggaa

SEQ ID NO: 7032205 - DNA, 22 bp, Homo sapiens
tgtccatcttttcagattctgt

SEQ ID NO: 7032206 - DNA, 22 bp, Homo sapiens
gtgcgggcctgggggtttctct

SEQ ID NO: 7032207 - DNA, 22 bp, Homo sapiens
agagctggggctctgggtttaa

SEQ ID NO: 7032208 - DNA, 22 bp, Homo sapiens
ttaagtatatccatttgactgg

SEQ ID NO: 7032209 - DNA, 22 bp, Homo sapiens
gctatacagcaggagaatggaa

SEQ ID NO: 7032210 - DNA, 22 bp, Homo sapiens
gctggagtgcagttgcacagtc

SEQ ID NO: 7032211 - DNA, 22 bp, Homo sapiens
catggaactgtataaaggcact

SEQ ID NO: 7032212 - DNA, 22 bp, Homo sapiens
attattgtgtaaaatgaggctt

SEQ ID NO: 7032213 - DNA, 22 bp, Homo sapiens
ttccaaagcacttgatgtaaag

SEQ ID NO: 7032214 - DNA, 22 bp, Homo sapiens
catgtgtgagtatatcttatcc

SEQ ID NO: 7032215 - DNA, 22 bp, Homo sapiens
aatagcagttaaaaatcagccc

SEQ ID NO: 7032216 - DNA, 22 bp, Homo sapiens
aagtgcaaatctgtggctgaaa

SEQ ID NO: 7032217 - DNA, 22 bp, Homo sapiens
gtctctgtggtacgtttcatcc

SEQ ID NO: 7032218 - DNA, 22 bp, Homo sapiens
ggaacacaaatgggagagctgg

SEQ ID NO: 7032219 - DNA, 21 bp, Homo sapiens
tcatcttacagtcctttcttt

SEQ ID NO: 7032220 - DNA, 22 bp, Homo sapiens
gctcaccttcgtccagcagccg

SEQ ID NO: 7032221 - DNA, 22 bp, Homo sapiens
tatagccatttccagtggcatc

SEQ ID NO: 7032222 - DNA, 22 bp, Homo sapiens
cctgccctatgaccagcttcac

SEQ ID NO: 7032223 - DNA, 22 bp, Homo sapiens
ccagcccttagataaacctggc

SEQ ID NO: 7032224 - DNA, 22 bp, Homo sapiens
tgtccatgggcgtcaggcagga

SEQ ID NO: 7032225 - DNA, 22 bp, Homo sapiens
agcatacttgacacttctctat

SEQ ID NO: 7032226 - DNA, 22 bp, Homo sapiens
tggtagggacactatgcagaaa

SEQ ID NO: 7032227 - DNA, 22 bp, Homo sapiens
gcttctctttctcccctggcgg

SEQ ID NO: 7032228 - DNA, 22 bp, Homo sapiens
aagtttggtccttctaagaaga

SEQ ID NO: 7032229 - DNA, 22 bp, Homo sapiens
ctcagagttctcctgggaggtg

SEQ ID NO: 7032230 - DNA, 22 bp, Homo sapiens
ggaggctgctgcctcacgtggg

SEQ ID NO: 7032231 - DNA, 22 bp, Homo sapiens
tggacattccacccatatcaga

SEQ ID NO: 7032232 - DNA, 22 bp, Homo sapiens
ttcagggcagagagttcaggga

SEQ ID NO: 7032233 - DNA, 22 bp, Homo sapiens
catgagcattttggtctagttt

SEQ ID NO: 7032234 - DNA, 22 bp, Homo sapiens
taaagtcataagagtggatccg

SEQ ID NO: 7032235 - DNA, 22 bp, Homo sapiens
aattttctgcctagcaaaaact

SEQ ID NO: 7032236 - DNA, 22 bp, Homo sapiens
tgaccagtgcagggggagttag

SEQ ID NO: 7032237 - DNA, 22 bp, Homo sapiens
ccacgggcagatgtggttggtt

SEQ ID NO: 7032238 - DNA, 22 bp, Homo sapiens
ctgtggcattaataaaagtgca

SEQ ID NO: 7032239 - DNA, 22 bp, Homo sapiens
caaatctatatgttgatattct

SEQ ID NO: 7032240 - DNA, 22 bp, Homo sapiens
ggagcatgcgctctgtgaccga

SEQ ID NO: 7032241 - DNA, 22 bp, Homo sapiens
cagctggtggctgatgaccgtc

SEQ ID NO: 7032242 - DNA, 21 bp, Homo sapiens
tgttctatcagctcaggtgtc

SEQ ID NO: 7032243 - DNA, 22 bp, Homo sapiens
agctacagtcggaaggacagac

SEQ ID NO: 7032244 - DNA, 22 bp, Homo sapiens
aggcagattaggattaggaaat

SEQ ID NO: 7032245 - DNA, 22 bp, Homo sapiens
cctcagttttctcatctgtaaa

SEQ ID NO: 7032246 - DNA, 22 bp, Homo sapiens
ggctttctgtctgcgtctgtgt

SEQ ID NO: 7032247 - DNA, 22 bp, Homo sapiens
tgagcttctttatttggccaga

SEQ ID NO: 7032248 - DNA, 22 bp, Homo sapiens
cctgggtcccatcccagagtga

SEQ ID NO: 7032249 - DNA, 22 bp, Homo sapiens
tcagtagtcttgggccgacttg

SEQ ID NO: 7032250 - DNA, 22 bp, Homo sapiens
ctcctggaccagggctattggg

SEQ ID NO: 7032251 - DNA, 22 bp, Homo sapiens
ctgcagtagcacctgtggcttt

SEQ ID NO: 7032252 - DNA, 22 bp, Homo sapiens
gaacactttaacattccttttc

SEQ ID NO: 7032253 - DNA, 22 bp, Homo sapiens
attatttcagtcagacactggc

SEQ ID NO: 7032254 - DNA, 22 bp, Homo sapiens
gttgcttttctccatcacatgg

SEQ ID NO: 7032255 - DNA, 22 bp, Homo sapiens
gtggggaggcattcttctccct

SEQ ID NO: 7032256 - DNA, 22 bp, Homo sapiens
cccatttgtccaaagtataaaa

SEQ ID NO: 7032257 - DNA, 22 bp, Homo sapiens
ctttgtatttaatagctgtctt

SEQ ID NO: 7032258 - DNA, 22 bp, Homo sapiens
gaaactttggctaaaagccaga

SEQ ID NO: 7032259 - DNA, 22 bp, Homo sapiens
tatgtgtagtgtgatcccaatg

SEQ ID NO: 7032260 - DNA, 22 bp, Homo sapiens
caggttagtaaggtctacataa

SEQ ID NO: 7032261 - DNA, 22 bp, Homo sapiens
aagtccctgtggggtggaggct

SEQ ID NO: 7032262 - DNA, 22 bp, Homo sapiens
gtggtcctgagtagctttagaa

SEQ ID NO: 7032263 - DNA, 22 bp, Homo sapiens
gagctggggcagcttaggagtg

SEQ ID NO: 7032264 - DNA, 22 bp, Homo sapiens
gaaggttttgattccactgaat

SEQ ID NO: 7032265 - DNA, 22 bp, Homo sapiens
agatatcacctctaggctggtg

SEQ ID NO: 7032266 - DNA, 22 bp, Homo sapiens
atatttataaggcaggcaagta

SEQ ID NO: 7032267 - DNA, 18 bp, Homo sapiens
gcaggtgtggagaagggg

SEQ ID NO: 7032268 - DNA, 19 bp, Homo sapiens
tgtgtgccctcaccacata

SEQ ID NO: 7032269 - DNA, 18 bp, Homo sapiens
agcagctgtgccacactg

SEQ ID NO: 7032270 - DNA, 19 bp, Homo sapiens
tctcagaggaaaaattgct

SEQ ID NO: 7032271 - DNA, 22 bp, Homo sapiens
tctattgattggcttcctggat

SEQ ID NO: 7032272 - DNA, 22 bp, Homo sapiens
gcaccagctgctgggttctaga

SEQ ID NO: 7032273 - DNA, 22 bp, Homo sapiens
ttacaaaggtagttttgtctat

SEQ ID NO: 7032274 - DNA, 22 bp, Homo sapiens
tttaagctgtggcattaattct

SEQ ID NO: 7032275 - DNA, 22 bp, Homo sapiens
ggtcacatgcggggctgtagcc

SEQ ID NO: 7032276 - DNA, 22 bp, Homo sapiens
ctcctccacagagtccttgcca

SEQ ID NO: 7032277 - DNA, 22 bp, Homo sapiens
aataacttaagaaatttcccca

SEQ ID NO: 7032278 - DNA, 22 bp, Homo sapiens
cagccctgccatggagcctcct

SEQ ID NO: 7032279 - DNA, 22 bp, Homo sapiens
acaggtagcatttttcctcttt

SEQ ID NO: 7032280 - DNA, 22 bp, Homo sapiens
tgctgtttgccaagatcacttt

SEQ ID NO: 7032281 - DNA, 22 bp, Homo sapiens
cacctggctgtgaagcctgggt

SEQ ID NO: 7032282 - DNA, 22 bp, Homo sapiens
gtctcttagaatcgcatattgt

SEQ ID NO: 7032283 - DNA, 22 bp, Homo sapiens
agcaggcaccagggctcgtcct

SEQ ID NO: 7032284 - DNA, 22 bp, Homo sapiens
tcccagcagatgagctgaccta

SEQ ID NO: 7032285 - DNA, 19 bp, Homo sapiens
tctttagtcacatttttat

SEQ ID NO: 7032286 - DNA, 22 bp, Homo sapiens
ctggagggtggagagaagtctc

SEQ ID NO: 7032287 - DNA, 22 bp, Homo sapiens
aatgagttctggttcattttat

SEQ ID NO: 7032288 - DNA, 22 bp, Homo sapiens
actagactgggccagtcaaatt

SEQ ID NO: 7032289 - DNA, 22 bp, Homo sapiens
ggcatggctcggagtcagaaca

SEQ ID NO: 7032290 - DNA, 22 bp, Homo sapiens
aggctgaggatccctgtgttct

SEQ ID NO: 7032291 - DNA, 19 bp, Homo sapiens
tggaacaaactgcaatgac

SEQ ID NO: 7032292 - DNA, 22 bp, Homo sapiens
tcctggagcttcagtttccttt

SEQ ID NO: 7032293 - DNA, 18 bp, Homo sapiens
atttctactactataaag

SEQ ID NO: 7032294 - DNA, 23 bp, Homo sapiens
agtcacatcttagcagccaggtc

SEQ ID NO: 7032295 - DNA, 22 bp, Homo sapiens
gtaaacaggaatgtggtcatgg

SEQ ID NO: 7032296 - DNA, 20 bp, Homo sapiens
tccagggcaaactcatcacc

SEQ ID NO: 7032297 - DNA, 22 bp, Homo sapiens
tgtccaggtgtgtctaaagaga

SEQ ID NO: 7032298 - DNA, 22 bp, Homo sapiens
tgcatctgtgctccctcttcta

SEQ ID NO: 7032299 - DNA, 22 bp, Homo sapiens
tatacttatgctaaaaaatgtt

SEQ ID NO: 7032300 - DNA, 22 bp, Homo sapiens
tgtcaccactggctgaaacacc

SEQ ID NO: 7032301 - DNA, 22 bp, Homo sapiens
taaaggtaacatgaactgcttt

SEQ ID NO: 7032302 - DNA, 20 bp, Homo sapiens
ggaaggcttgaagtttacat

SEQ ID NO: 7032303 - DNA, 22 bp, Homo sapiens
atgggcttggcgacaatttgaa

SEQ ID NO: 7032304 - DNA, 21 bp, Homo sapiens
tgcaaaggacctgaggtagga

SEQ ID NO: 7032305 - DNA, 22 bp, Homo sapiens
ggctggcctgtgtggccgccac

SEQ ID NO: 7032306 - DNA, 22 bp, Homo sapiens
tttctaggtcttccatactgcc

SEQ ID NO: 7032307 - DNA, 22 bp, Homo sapiens
aaaaatgtgaccacagggtgtt

SEQ ID NO: 7032308 - DNA, 22 bp, Homo sapiens
agatcacataatttcctgtgac

SEQ ID NO: 7032309 - DNA, 22 bp, Homo sapiens
aggacttttcatcagctatcct

SEQ ID NO: 7032310 - DNA, 22 bp, Homo sapiens
actggagtgagtatcgatgaac

SEQ ID NO: 7032311 - DNA, 22 bp, Homo sapiens
gagattctcagaagtactagga

SEQ ID NO: 7032312 - DNA, 22 bp, Homo sapiens
tctgaattaggggttttcaggt

SEQ ID NO: 7032313 - DNA, 22 bp, Homo sapiens
ggcaaagccttccagctgttac

SEQ ID NO: 7032314 - DNA, 22 bp, Homo sapiens
aggagcagaactgttgtggagg

SEQ ID NO: 7032315 - DNA, 22 bp, Homo sapiens
ttactgtatgagtgtggtagtc

SEQ ID NO: 7032316 - DNA, 22 bp, Homo sapiens
tctcaagatctcaagatggccc

SEQ ID NO: 7032317 - DNA, 21 bp, Homo sapiens
tgggcactgagggtgctgctc

SEQ ID NO: 7032318 - DNA, 22 bp, Homo sapiens
taaaatttgtccctgagtgttg

SEQ ID NO: 7032319 - DNA, 22 bp, Homo sapiens
ggaaggtttttctcctggtggg

SEQ ID NO: 7032320 - DNA, 20 bp, Homo sapiens
cagaaagcatgttccagggc

SEQ ID NO: 7032321 - DNA, 22 bp, Homo sapiens
tttggagtttaacaacttgaag

SEQ ID NO: 7032322 - DNA, 22 bp, Homo sapiens
caactttggccccttcctagct

SEQ ID NO: 7032323 - DNA, 23 bp, Homo sapiens
ttgaggcaaacatgtaagtagga

SEQ ID NO: 7032324 - DNA, 22 bp, Homo sapiens
tggaccctggactgccctggcc

SEQ ID NO: 7032325 - DNA, 22 bp, Homo sapiens
actgtaaattttggttgcaggt

SEQ ID NO: 7032326 - DNA, 22 bp, Homo sapiens
gggcgcgggaaggagcccgaga

SEQ ID NO: 7032327 - DNA, 22 bp, Homo sapiens
aagtgtttccgggagacttggt

SEQ ID NO: 7032328 - DNA, 20 bp, Homo sapiens
tgtgttttgcagggcattta

SEQ ID NO: 7032329 - DNA, 22 bp, Homo sapiens
acatgacatagtagaaaagccc

SEQ ID NO: 7032330 - DNA, 22 bp, Homo sapiens
tttgacattgaaagcagaatcg

SEQ ID NO: 7032331 - DNA, 22 bp, Homo sapiens
taggatctatttgtatttcagg

SEQ ID NO: 7032332 - DNA, 22 bp, Homo sapiens
agtggtggagccaggaaatgtg

SEQ ID NO: 7032333 - DNA, 22 bp, Homo sapiens
tggcttcctaaactgatttcca

SEQ ID NO: 7032334 - DNA, 22 bp, Homo sapiens
tgagctggttcttgaggcatga

SEQ ID NO: 7032335 - DNA, 22 bp, Homo sapiens
cttattagaaagaaaagacatg

SEQ ID NO: 7032336 - DNA, 22 bp, Homo sapiens
tgaggaaattgaggctcacaga

SEQ ID NO: 7032337 - DNA, 22 bp, Homo sapiens
aagtccatgatcaagatgtggc

SEQ ID NO: 7032338 - DNA, 22 bp, Homo sapiens
aagtttatgttggtaagatatc

SEQ ID NO: 7032339 - DNA, 22 bp, Homo sapiens
gcaactgaacatgtgtgtggcc

SEQ ID NO: 7032340 - DNA, 22 bp, Homo sapiens
cctgagagtgagtgcctcctta

SEQ ID NO: 7032341 - DNA, 22 bp, Homo sapiens
catgacagtcctgaagagaacg

SEQ ID NO: 7032342 - DNA, 22 bp, Homo sapiens
tctgttatatagataatgtgtg

SEQ ID NO: 7032343 - DNA, 22 bp, Homo sapiens
caatctatagagctttagacta

SEQ ID NO: 7032344 - DNA, 23 bp, Homo sapiens
taggggctggcgtggagcctgcg

SEQ ID NO: 7032345 - DNA, 22 bp, Homo sapiens
tagcagaagaacaacatgatct

SEQ ID NO: 7032346 - DNA, 22 bp, Homo sapiens
caggtcctggcatcaggcaggt

SEQ ID NO: 7032347 - DNA, 22 bp, Homo sapiens
tggttagtgtatatttggactg

SEQ ID NO: 7032348 - DNA, 21 bp, Homo sapiens
ctgccaggatagcatgcaggc

SEQ ID NO: 7032349 - DNA, 22 bp, Homo sapiens
atgtgctggctaactggatggg

SEQ ID NO: 7032350 - DNA, 22 bp, Homo sapiens
aatagctgggacctgaattagc

SEQ ID NO: 7032351 - DNA, 20 bp, Homo sapiens
ttggccaaatcttagtcatg

SEQ ID NO: 7032352 - DNA, 22 bp, Homo sapiens
tgggagagcagagaaccctctt

SEQ ID NO: 7032353 - DNA, 22 bp, Homo sapiens
taatcctttaggttaaaagagg

SEQ ID NO: 7032354 - DNA, 22 bp, Homo sapiens
agctagggacagataccagcca

SEQ ID NO: 7032355 - DNA, 22 bp, Homo sapiens
ccactcttgaatcaagagctca

SEQ ID NO: 7032356 - DNA, 22 bp, Homo sapiens
atggcattccaagtcttctttt

SEQ ID NO: 7032357 - DNA, 22 bp, Homo sapiens
ttccttcctggggatttatcat

SEQ ID NO: 7032358 - DNA, 22 bp, Homo sapiens
ggtgatttatccattttctggt

SEQ ID NO: 7032359 - DNA, 22 bp, Homo sapiens
gagccctgcgtgtctgggggca

SEQ ID NO: 7032360 - DNA, 22 bp, Homo sapiens
tttttctactggtgttggtgta

SEQ ID NO: 7032361 - DNA, 22 bp, Homo sapiens
ctgaggaaggctgggggcatcc

SEQ ID NO: 7032362 - DNA, 23 bp, Homo sapiens
ctgttatgtaaatatgtttagtg

SEQ ID NO: 7032363 - DNA, 22 bp, Homo sapiens
ggatccagtccagggctgtgtg

SEQ ID NO: 7032364 - DNA, 22 bp, Homo sapiens
cagcaaaagccagcataagctc

SEQ ID NO: 7032365 - DNA, 22 bp, Homo sapiens
ctagagctgttctgtgcactca

SEQ ID NO: 7032366 - DNA, 20 bp, Homo sapiens
atatggctccgttcagtcgg

SEQ ID NO: 7032367 - DNA, 22 bp, Homo sapiens
gtttaaagtcttggaaggagga

SEQ ID NO: 7032368 - DNA, 22 bp, Homo sapiens
ttggcactttgaatgagctcag

SEQ ID NO: 7032369 - DNA, 22 bp, Homo sapiens
tctgcgccctgtcgcctgctcc

SEQ ID NO: 7032370 - DNA, 22 bp, Homo sapiens
taaatgttttgtgggttgagtt

SEQ ID NO: 7032371 - DNA, 22 bp, Homo sapiens
tgtgcatggccagctggatcga

SEQ ID NO: 7032372 - DNA, 17 bp, Homo sapiens
aagcatttaatttgcta

SEQ ID NO: 7032373 - DNA, 22 bp, Homo sapiens
tagatgaaggggttcagcatgg

SEQ ID NO: 7032374 - DNA, 22 bp, Homo sapiens
agggggtgcccagatgaaggat

SEQ ID NO: 7032375 - DNA, 22 bp, Homo sapiens
tggatttcagcatatggatttt

SEQ ID NO: 7032376 - DNA, 22 bp, Homo sapiens
agagcaggggcaatgtgttgca

SEQ ID NO: 7032377 - DNA, 22 bp, Homo sapiens
ctttggcatggtcctcactata

SEQ ID NO: 7032378 - DNA, 22 bp, Homo sapiens
agttatctcagtcctatgtgta

SEQ ID NO: 7032379 - DNA, 22 bp, Homo sapiens
gctcttggtctcagcctctgaa

SEQ ID NO: 7032380 - DNA, 22 bp, Homo sapiens
atacactgagtccttttctcat

SEQ ID NO: 7032381 - DNA, 22 bp, Homo sapiens
taggcctcaggaccccagggct

SEQ ID NO: 7032382 - DNA, 21 bp, Homo sapiens
gctatacagaatggccagagg

SEQ ID NO: 7032383 - DNA, 22 bp, Homo sapiens
taggagtaactctcgtcatcat

SEQ ID NO: 7032384 - DNA, 18 bp, Homo sapiens
acacagtggatgcctggt

SEQ ID NO: 7032385 - DNA, 22 bp, Homo sapiens
ttgaaagtttatggagtctgca

SEQ ID NO: 7032386 - DNA, 20 bp, Homo sapiens
actgcttctttctctgacct

SEQ ID NO: 7032387 - DNA, 22 bp, Homo sapiens
accagaggaggaattaccttcc

SEQ ID NO: 7032388 - DNA, 22 bp, Homo sapiens
ttgcagggataaaacaagtgaa

SEQ ID NO: 7032389 - DNA, 22 bp, Homo sapiens
gtgctgccagacagtgagaggg

SEQ ID NO: 7032390 - DNA, 22 bp, Homo sapiens
gggctggatgggagccttggcc

SEQ ID NO: 7032391 - DNA, 20 bp, Homo sapiens
tgcccacatcactcaggagt

SEQ ID NO: 7032392 - DNA, 22 bp, Homo sapiens
ttgttttggaagaacttactct

SEQ ID NO: 7032393 - DNA, 22 bp, Homo sapiens
tttgcatttctcgtaaggaaac

SEQ ID NO: 7032394 - DNA, 22 bp, Homo sapiens
aggctgagagcaacgtgtcaga

SEQ ID NO: 7032395 - DNA, 22 bp, Homo sapiens
tggcaaatattttgttttgtaa

SEQ ID NO: 7032396 - DNA, 22 bp, Homo sapiens
tcccaaatataatgcaagagac

SEQ ID NO: 7032397 - DNA, 20 bp, Homo sapiens
ttgttttaaatcctggatga

SEQ ID NO: 7032398 - DNA, 22 bp, Homo sapiens
tgcacctgtagtgagctgtgcc

SEQ ID NO: 7032399 - DNA, 22 bp, Homo sapiens
gagagctggattctggataggt

SEQ ID NO: 7032400 - DNA, 22 bp, Homo sapiens
gtataggtttggctctctccag

SEQ ID NO: 7032401 - DNA, 22 bp, Homo sapiens
gctgaataattctttgttgtgg

SEQ ID NO: 7032402 - DNA, 22 bp, Homo sapiens
gtctgggcttcagagttagaga

SEQ ID NO: 7032403 - DNA, 22 bp, Homo sapiens
tgtaagtagaacaacataatct

SEQ ID NO: 7032404 - DNA, 22 bp, Homo sapiens
tgagagctgaagatatgttaac

SEQ ID NO: 7032405 - DNA, 22 bp, Homo sapiens
aagagagacaataggtagcatt

SEQ ID NO: 7032406 - DNA, 22 bp, Homo sapiens
aatgtcaagggaagcaggaaat

SEQ ID NO: 7032407 - DNA, 22 bp, Homo sapiens
tgatttcttctaatttccatca

SEQ ID NO: 7032408 - DNA, 22 bp, Homo sapiens
tcagtcatcccagctttcatct

SEQ ID NO: 7032409 - DNA, 22 bp, Homo sapiens
aaatcccactcagaaactgcca

SEQ ID NO: 7032410 - DNA, 22 bp, Homo sapiens
tatgcatgtggtatatgcttat

SEQ ID NO: 7032411 - DNA, 23 bp, Homo sapiens
acaagcagcccagtgctctgcct

SEQ ID NO: 7032412 - DNA, 22 bp, Homo sapiens
ggtttcattttccagtttgcct

SEQ ID NO: 7032413 - DNA, 23 bp, Homo sapiens
ggagatgcttaagagtggttgag

SEQ ID NO: 7032414 - DNA, 22 bp, Homo sapiens
taacaggcaaggtcacaccttg

SEQ ID NO: 7032415 - DNA, 22 bp, Homo sapiens
taagacagggagggctctcagc

SEQ ID NO: 7032416 - DNA, 22 bp, Homo sapiens
gcagcagctctgaatgggcccc

SEQ ID NO: 7032417 - DNA, 22 bp, Homo sapiens
tgcgtgtgtgtatatacacagg

SEQ ID NO: 7032418 - DNA, 22 bp, Homo sapiens
gaggcgcagcccggaggagaca

SEQ ID NO: 7032419 - DNA, 22 bp, Homo sapiens
tgagggtgggcctgcaggaaga

SEQ ID NO: 7032420 - DNA, 22 bp, Homo sapiens
cctgaagaacctcacgggcact

SEQ ID NO: 7032421 - DNA, 22 bp, Homo sapiens
tcatgctatgagcgagggcctg

SEQ ID NO: 7032422 - DNA, 22 bp, Homo sapiens
aggcagcatgggcccagagtcc

SEQ ID NO: 7032423 - DNA, 22 bp, Homo sapiens
tccagttttaatactcactgcc

SEQ ID NO: 7032424 - DNA, 20 bp, Homo sapiens
tctgcacctccttccaatca

SEQ ID NO: 7032425 - DNA, 22 bp, Homo sapiens
tagagctgataatgaggccaag

SEQ ID NO: 7032426 - DNA, 22 bp, Homo sapiens
tgacacatgtgcttgtgggtag

SEQ ID NO: 7032427 - DNA, 22 bp, Homo sapiens
atgtcagaatctacattctact

SEQ ID NO: 7032428 - DNA, 22 bp, Homo sapiens
gctccgggggttccagatcatc

SEQ ID NO: 7032429 - DNA, 22 bp, Homo sapiens
ttattctggaggaagcaaatgg

SEQ ID NO: 7032430 - DNA, 22 bp, Homo sapiens
tgttgcagaatctcaaaacagt

SEQ ID NO: 7032431 - DNA, 22 bp, Homo sapiens
cggagtgcctgtcatgcaggtt

SEQ ID NO: 7032432 - DNA, 23 bp, Homo sapiens
tcaattatcaatggaaagaagtt

SEQ ID NO: 7032433 - DNA, 22 bp, Homo sapiens
gcccaggaaataaaagtgggct

SEQ ID NO: 7032434 - DNA, 22 bp, Homo sapiens
tccggcagcatctggagggatg

SEQ ID NO: 7032435 - DNA, 22 bp, Homo sapiens
gtcaaatatatgcaaaactatt

SEQ ID NO: 7032436 - DNA, 22 bp, Homo sapiens
agtggcagccttgttcattatg

SEQ ID NO: 7032437 - DNA, 22 bp, Homo sapiens
cctggctgggcctgatttctca

SEQ ID NO: 7032438 - DNA, 22 bp, Homo sapiens
gatgttcttataccattgtggg

SEQ ID NO: 7032439 - DNA, 20 bp, Homo sapiens
accaggtggctgatgacacc

SEQ ID NO: 7032440 - DNA, 22 bp, Homo sapiens
atctggaggcaaaggggcgtga

SEQ ID NO: 7032441 - DNA, 22 bp, Homo sapiens
tctctgggaattcacaagccct

SEQ ID NO: 7032442 - DNA, 22 bp, Homo sapiens
aggaaaaataaggcagcagggc

SEQ ID NO: 7032443 - DNA, 22 bp, Homo sapiens
ttaaggcatagcttgtgttgac

SEQ ID NO: 7032444 - DNA, 22 bp, Homo sapiens
ttcagttttctttagaatgtag

SEQ ID NO: 7032445 - DNA, 22 bp, Homo sapiens
gtggttttaatattcagtctag

SEQ ID NO: 7032446 - DNA, 23 bp, Homo sapiens
catggcagcaagagctcatggcc

SEQ ID NO: 7032447 - DNA, 22 bp, Homo sapiens
atatgtgtacgtgcagtatata

SEQ ID NO: 7032448 - DNA, 22 bp, Homo sapiens
ggaaaagaattgcagtgaagta

SEQ ID NO: 7032449 - DNA, 22 bp, Homo sapiens
ttcagagggttcagagggttcg

SEQ ID NO: 7032450 - DNA, 22 bp, Homo sapiens
tttattctagctcagaatagtt

SEQ ID NO: 7032451 - DNA, 22 bp, Homo sapiens
tcactgctcagtctgtactaca

SEQ ID NO: 7032452 - DNA, 22 bp, Homo sapiens
agctgctccttggctgtggttc

SEQ ID NO: 7032453 - DNA, 22 bp, Homo sapiens
agagtgggcctctgagtcccag

SEQ ID NO: 7032454 - DNA, 22 bp, Homo sapiens
gcctggctcctaagagcacaac

SEQ ID NO: 7032455 - DNA, 22 bp, Homo sapiens
atccagagaggttaggtgacat

SEQ ID NO: 7032456 - DNA, 22 bp, Homo sapiens
aacttttgtccgatctcctgga

SEQ ID NO: 7032457 - DNA, 22 bp, Homo sapiens
gctgcctagtctgctgagcaga

SEQ ID NO: 7032458 - DNA, 22 bp, Homo sapiens
tgcttcagagacatcctactca

SEQ ID NO: 7032459 - DNA, 22 bp, Homo sapiens
tatggaaactaattcatttttc

SEQ ID NO: 7032460 - DNA, 22 bp, Homo sapiens
aagaaaccaaccctgccagcac

SEQ ID NO: 7032461 - DNA, 22 bp, Homo sapiens
ataaatgcctcagaatcatccc

SEQ ID NO: 7032462 - DNA, 22 bp, Homo sapiens
tgtattgttataatttgtatgt

SEQ ID NO: 7032463 - DNA, 22 bp, Homo sapiens
atggcggcgccaggccctaatt

SEQ ID NO: 7032464 - DNA, 22 bp, Homo sapiens
tattccaacttcactattgtct

SEQ ID NO: 7032465 - DNA, 22 bp, Homo sapiens
aggctgccagaagccttcagga

SEQ ID NO: 7032466 - DNA, 22 bp, Homo sapiens
tgggctgctgcggtgctcttgg

SEQ ID NO: 7032467 - DNA, 22 bp, Homo sapiens
cctgcaagagcggagaagccag

SEQ ID NO: 7032468 - DNA, 22 bp, Homo sapiens
gtttgtcaggaggttgaagtca

SEQ ID NO: 7032469 - DNA, 22 bp, Homo sapiens
cttcagcccagcctccgcctcc

SEQ ID NO: 7032470 - DNA, 21 bp, Homo sapiens
tccaagctcaactcccttcct

SEQ ID NO: 7032471 - DNA, 22 bp, Homo sapiens
aaatagacacatgcgttcatat

SEQ ID NO: 7032472 - DNA, 22 bp, Homo sapiens
cacagtaactggcgtgtagtaa

SEQ ID NO: 7032473 - DNA, 14 bp, Homo sapiens
gcaggcagatcact

SEQ ID NO: 7032474 - DNA, 22 bp, Homo sapiens
acaaggaccatgaggcagaccc

SEQ ID NO: 7032475 - DNA, 21 bp, Homo sapiens
tggctgcaagcagctgcctcc

SEQ ID NO: 7032476 - DNA, 22 bp, Homo sapiens
cccccacctgaggacagtctta

SEQ ID NO: 7032477 - DNA, 22 bp, Homo sapiens
tagtttagcttagccttctggt

SEQ ID NO: 7032478 - DNA, 23 bp, Homo sapiens
tctctgagttgtactttcccttg

SEQ ID NO: 7032479 - DNA, 22 bp, Homo sapiens
tcagttgcatgggaagttcaga

SEQ ID NO: 7032480 - DNA, 19 bp, Homo sapiens
tccagggtcattaacaatg

SEQ ID NO: 7032481 - DNA, 22 bp, Homo sapiens
actgtcaaggaaacaaaattac

SEQ ID NO: 7032482 - DNA, 21 bp, Homo sapiens
tgctgtcctagaaccagggcc

SEQ ID NO: 7032483 - DNA, 22 bp, Homo sapiens
ctgtgtctctccttacaagact

SEQ ID NO: 7032484 - DNA, 22 bp, Homo sapiens
tcaaacatctaaactacccact

SEQ ID NO: 7032485 - DNA, 22 bp, Homo sapiens
ctgggatgctccggcctggatg

SEQ ID NO: 7032486 - DNA, 22 bp, Homo sapiens
tgggcagagatctggatcaaac

SEQ ID NO: 7032487 - DNA, 22 bp, Homo sapiens
tggaggcccacactgggtagat

SEQ ID NO: 7032488 - DNA, 22 bp, Homo sapiens
tccacattatgtttctcctttc

SEQ ID NO: 7032489 - DNA, 22 bp, Homo sapiens
aggcccagtagtcgacggcgct

SEQ ID NO: 7032490 - DNA, 22 bp, Homo sapiens
tattacgtaactacttaaattg

SEQ ID NO: 7032491 - DNA, 22 bp, Homo sapiens
agcaaggctaaatttcagttat

SEQ ID NO: 7032492 - DNA, 22 bp, Homo sapiens
ggctatggcaaagaactcagat

SEQ ID NO: 7032493 - DNA, 22 bp, Homo sapiens
ccaggtcttcactttactgaag

SEQ ID NO: 7032494 - DNA, 22 bp, Homo sapiens
aaccctgattttacaaatgtct

SEQ ID NO: 7032495 - DNA, 22 bp, Homo sapiens
cttcttaactgtatatactatg

SEQ ID NO: 7032496 - DNA, 22 bp, Homo sapiens
ttatttctactattttgcctga

SEQ ID NO: 7032497 - DNA, 22 bp, Homo sapiens
tggctacaagtgtgtttagttt

SEQ ID NO: 7032498 - DNA, 22 bp, Homo sapiens
aagatgttaaatctgtagaatt

SEQ ID NO: 7032499 - DNA, 23 bp, Homo sapiens
ccatcaggcctccgtgtccagcc

SEQ ID NO: 7032500 - DNA, 22 bp, Homo sapiens
catcacagtggctgtttattta

SEQ ID NO: 7032501 - DNA, 20 bp, Homo sapiens
acacaaagcaatggagtaca

SEQ ID NO: 7032502 - DNA, 22 bp, Homo sapiens
tatctgatacaacagaataaca

SEQ ID NO: 7032503 - DNA, 22 bp, Homo sapiens
agactccttctcactgcctgta

SEQ ID NO: 7032504 - DNA, 23 bp, Homo sapiens
ggcctaacagaggcagggctgag

SEQ ID NO: 7032505 - DNA, 22 bp, Homo sapiens
taatatttctaccctgctgcct

SEQ ID NO: 7032506 - DNA, 22 bp, Homo sapiens
cagcaaagcttaatttatatct

SEQ ID NO: 7032507 - DNA, 22 bp, Homo sapiens
ccccacagcttgtggagagaat

SEQ ID NO: 7032508 - DNA, 22 bp, Homo sapiens
gaaaggtttggcttttcagtag

SEQ ID NO: 7032509 - DNA, 22 bp, Homo sapiens
ggacaaatctcattatttctga

SEQ ID NO: 7032510 - DNA, 22 bp, Homo sapiens
tacaagaagaggcagagctgga

SEQ ID NO: 7032511 - DNA, 22 bp, Homo sapiens
gctctatgtcgaaagccagtta

SEQ ID NO: 7032512 - DNA, 22 bp, Homo sapiens
ccctgtttatttttggagagaa

SEQ ID NO: 7032513 - DNA, 22 bp, Homo sapiens
ataatcctgctttttcactatt

SEQ ID NO: 7032514 - DNA, 22 bp, Homo sapiens
ctctgtggcttgcctttctgtc

SEQ ID NO: 7032515 - DNA, 22 bp, Homo sapiens
gtacagtaatcccgttcttctg

SEQ ID NO: 7032516 - DNA, 22 bp, Homo sapiens
gatgcacatgtgagtatagaag

SEQ ID NO: 7032517 - DNA, 22 bp, Homo sapiens
gctgaggtggctgccttagtaa

SEQ ID NO: 7032518 - DNA, 22 bp, Homo sapiens
gtgatggagtcaaggctagaac

SEQ ID NO: 7032519 - DNA, 22 bp, Homo sapiens
cactcccttcaggagcctagga

SEQ ID NO: 7032520 - DNA, 22 bp, Homo sapiens
gctaaatctcctacaatgcaca

SEQ ID NO: 7032521 - DNA, 22 bp, Homo sapiens
aattggcagtttcatcagacag

SEQ ID NO: 7032522 - DNA, 22 bp, Homo sapiens
ctcagagatatagtccctgctt

SEQ ID NO: 7032523 - DNA, 22 bp, Homo sapiens
cactgtaaagcgtcacagggac

SEQ ID NO: 7032524 - DNA, 22 bp, Homo sapiens
gggggtggttctaagtcctata

SEQ ID NO: 7032525 - DNA, 22 bp, Homo sapiens
cactctcacatgccctgtcagt

SEQ ID NO: 7032526 - DNA, 22 bp, Homo sapiens
tcaggaagtgcctaggctggcc

SEQ ID NO: 7032527 - DNA, 22 bp, Homo sapiens
tgtccatacaatgtaacatctt

SEQ ID NO: 7032528 - DNA, 22 bp, Homo sapiens
ccctaaaagtctcattttccag

SEQ ID NO: 7032529 - DNA, 19 bp, Homo sapiens
tgaagcagcaaactctcag

SEQ ID NO: 7032530 - DNA, 22 bp, Homo sapiens
aaagtaattaagaagctggaca

SEQ ID NO: 7032531 - DNA, 22 bp, Homo sapiens
gtgattaataatggccatgcat

SEQ ID NO: 7032532 - DNA, 22 bp, Homo sapiens
aaacagctcaagaagttactct

SEQ ID NO: 7032533 - DNA, 22 bp, Homo sapiens
gtgagtcaatgtattgcagcaa

SEQ ID NO: 7032534 - DNA, 22 bp, Homo sapiens
atatgggggggcgtgcagagga

SEQ ID NO: 7032535 - DNA, 22 bp, Homo sapiens
acctcagaggaggctcctggct

SEQ ID NO: 7032536 - DNA, 22 bp, Homo sapiens
ctccttggtgtagtactgagca

SEQ ID NO: 7032537 - DNA, 18 bp, Homo sapiens
tgatggaggagggctggt

SEQ ID NO: 7032538 - DNA, 22 bp, Homo sapiens
tcctggcagagagcatgaggcc

SEQ ID NO: 7032539 - DNA, 22 bp, Homo sapiens
agtctcagcaagcatggctagt

SEQ ID NO: 7032540 - DNA, 23 bp, Homo sapiens
cttgcagggctggaggcttagaa

SEQ ID NO: 7032541 - DNA, 23 bp, Homo sapiens
aaggccagagagaggctagtgtc

SEQ ID NO: 7032542 - DNA, 22 bp, Homo sapiens
tcaggtcttgagccatcaggat

SEQ ID NO: 7032543 - DNA, 22 bp, Homo sapiens
gcacagaggatgaggcagctct

SEQ ID NO: 7032544 - DNA, 21 bp, Homo sapiens
gcatgtgtggtgtgctccaca

SEQ ID NO: 7032545 - DNA, 23 bp, Homo sapiens
ttttcctgtggagacatgactgg

SEQ ID NO: 7032546 - DNA, 22 bp, Homo sapiens
agtgtgaggggttctttgatat

SEQ ID NO: 7032547 - DNA, 22 bp, Homo sapiens
actagcagggatgttattactt

SEQ ID NO: 7032548 - DNA, 22 bp, Homo sapiens
agaaagctggaagagctgggat

SEQ ID NO: 7032549 - DNA, 19 bp, Homo sapiens
tgtccctggtcaccagact

SEQ ID NO: 7032550 - DNA, 22 bp, Homo sapiens
gatcctgttataatttggatgt

SEQ ID NO: 7032551 - DNA, 22 bp, Homo sapiens
ttgagctttacaacagctgtta

SEQ ID NO: 7032552 - DNA, 22 bp, Homo sapiens
atttcccagctttgatcagttt

SEQ ID NO: 7032553 - DNA, 22 bp, Homo sapiens
ttagaaactttggaggatagat

SEQ ID NO: 7032554 - DNA, 22 bp, Homo sapiens
tatgtgttttggatttagaatg

SEQ ID NO: 7032555 - DNA, 22 bp, Homo sapiens
ttcttattttcctgaggaagaa

SEQ ID NO: 7032556 - DNA, 19 bp, Homo sapiens
tttgtgccattcttggggc

SEQ ID NO: 7032557 - DNA, 18 bp, Homo sapiens
tcactgggtgtatgtggc

SEQ ID NO: 7032558 - DNA, 21 bp, Homo sapiens
ttaaaatgaggaagtggtggc

SEQ ID NO: 7032559 - DNA, 22 bp, Homo sapiens
tcagatactgtggcttatgggc

SEQ ID NO: 7032560 - DNA, 22 bp, Homo sapiens
tggagataacagatgcaaacct

SEQ ID NO: 7032561 - DNA, 18 bp, Homo sapiens
ttggcttctttccttcct

SEQ ID NO: 7032562 - DNA, 22 bp, Homo sapiens
gaggggaaagtgtgaggctgcg

SEQ ID NO: 7032563 - DNA, 22 bp, Homo sapiens
aattccaagtagcatcccatca

SEQ ID NO: 7032564 - DNA, 22 bp, Homo sapiens
atgattactcccatttgataga

SEQ ID NO: 7032565 - DNA, 22 bp, Homo sapiens
gtgtgtcctcagtagtggcatg

SEQ ID NO: 7032566 - DNA, 22 bp, Homo sapiens
ggtagtgaggtgaaagagaggt

SEQ ID NO: 7032567 - DNA, 22 bp, Homo sapiens
cttatagaattagagagatttt

SEQ ID NO: 7032568 - DNA, 22 bp, Homo sapiens
tcaaagtaaacgctttgggcca

SEQ ID NO: 7032569 - DNA, 22 bp, Homo sapiens
tccagggccatgaagttgcaca

SEQ ID NO: 7032570 - DNA, 22 bp, Homo sapiens
ctggctagataaaaccagccaa

SEQ ID NO: 7032571 - DNA, 22 bp, Homo sapiens
ccaggtgctagcaatcactgtc

SEQ ID NO: 7032572 - DNA, 22 bp, Homo sapiens
cagtacttagttctcatggttt

SEQ ID NO: 7032573 - DNA, 22 bp, Homo sapiens
aaaggctggattcagagaggtg

SEQ ID NO: 7032574 - DNA, 22 bp, Homo sapiens
gtgtctataatgaaatgcactt

SEQ ID NO: 7032575 - DNA, 21 bp, Homo sapiens
aatgacagccagatcctttta

SEQ ID NO: 7032576 - DNA, 22 bp, Homo sapiens
tagtaactctacacacgacact

SEQ ID NO: 7032577 - DNA, 22 bp, Homo sapiens
caccacttcataggctttaagg

SEQ ID NO: 7032578 - DNA, 22 bp, Homo sapiens
tgctggctgcagtgctgtcaaa

SEQ ID NO: 7032579 - DNA, 22 bp, Homo sapiens
agagctgagaatgtggcttcct

SEQ ID NO: 7032580 - DNA, 22 bp, Homo sapiens
ctctggacagcaggtgctgtgg

SEQ ID NO: 7032581 - DNA, 22 bp, Homo sapiens
tgggtccttcaaagctgggtct

SEQ ID NO: 7032582 - DNA, 18 bp, Homo sapiens
atactagagctctttgcc

SEQ ID NO: 7032583 - DNA, 22 bp, Homo sapiens
aggggagcttgcctggtcaccc

SEQ ID NO: 7032584 - DNA, 22 bp, Homo sapiens
agccatctgaattagctttgtt

SEQ ID NO: 7032585 - DNA, 22 bp, Homo sapiens
gggatggcctagactagcttgg

SEQ ID NO: 7032586 - DNA, 21 bp, Homo sapiens
gcctgcacacagtaggtgcac

SEQ ID NO: 7032587 - DNA, 22 bp, Homo sapiens
agaagtagtccagtggaaagta

SEQ ID NO: 7032588 - DNA, 22 bp, Homo sapiens
atggacaggcttataacagcaa

SEQ ID NO: 7032589 - DNA, 22 bp, Homo sapiens
tcattgaatttggttcaatatg

SEQ ID NO: 7032590 - DNA, 22 bp, Homo sapiens
gacagggcgcccagcctgtttc

SEQ ID NO: 7032591 - DNA, 22 bp, Homo sapiens
tatacagattaacagatttaaa

SEQ ID NO: 7032592 - DNA, 22 bp, Homo sapiens
atattcttatccttttctctgt

SEQ ID NO: 7032593 - DNA, 22 bp, Homo sapiens
ctgggcctgtccctgattgagg

SEQ ID NO: 7032594 - DNA, 23 bp, Homo sapiens
ttttcctttggacaggctgtatt

SEQ ID NO: 7032595 - DNA, 22 bp, Homo sapiens
ctgcagcagtagtccccaagtg

SEQ ID NO: 7032596 - DNA, 22 bp, Homo sapiens
tctggacatcctggagaatgac

SEQ ID NO: 7032597 - DNA, 22 bp, Homo sapiens
tggcttcctaggagcccgtgct

SEQ ID NO: 7032598 - DNA, 22 bp, Homo sapiens
tggaaggggttacgcagcagga

SEQ ID NO: 7032599 - DNA, 22 bp, Homo sapiens
gagaacctctccacaagtctgg

SEQ ID NO: 7032600 - DNA, 22 bp, Homo sapiens
gctgaggtgaggctggaaagga

SEQ ID NO: 7032601 - DNA, 22 bp, Homo sapiens
tgcaaggcagcaccagctcttg

SEQ ID NO: 7032602 - DNA, 22 bp, Homo sapiens
aagcagtttagataggcaaagg

SEQ ID NO: 7032603 - DNA, 22 bp, Homo sapiens
accaagctctcttcccggctct

SEQ ID NO: 7032604 - DNA, 22 bp, Homo sapiens
tcagagagttttcactagggtg

SEQ ID NO: 7032605 - DNA, 22 bp, Homo sapiens
agctctggtactgctgaccgaa

SEQ ID NO: 7032606 - DNA, 22 bp, Homo sapiens
aatgaggttggcataattaaat

SEQ ID NO: 7032607 - DNA, 22 bp, Homo sapiens
aagtatctgggagatttgcttt

SEQ ID NO: 7032608 - DNA, 23 bp, Homo sapiens
cacaaaggttccattctctcacc

SEQ ID NO: 7032609 - DNA, 22 bp, Homo sapiens
atgagatgttcaggagtctgag

SEQ ID NO: 7032610 - DNA, 21 bp, Homo sapiens
cccagaagttccatggggggc

SEQ ID NO: 7032611 - DNA, 22 bp, Homo sapiens
gcagggcacacaagaatgataa

SEQ ID NO: 7032612 - DNA, 22 bp, Homo sapiens
tcagctgagttctagagcactc

SEQ ID NO: 7032613 - DNA, 19 bp, Homo sapiens
ttatatacttggtttctct

SEQ ID NO: 7032614 - DNA, 22 bp, Homo sapiens
gtcatctctgggcccgcactgc

SEQ ID NO: 7032615 - DNA, 22 bp, Homo sapiens
acacaggcatagccatacatgt

SEQ ID NO: 7032616 - DNA, 22 bp, Homo sapiens
ggtcactgctctaaacaaaagt

SEQ ID NO: 7032617 - DNA, 22 bp, Homo sapiens
aggcttattttaggtctctctt

SEQ ID NO: 7032618 - DNA, 22 bp, Homo sapiens
gatgggtagaagtggaagaggt

SEQ ID NO: 7032619 - DNA, 22 bp, Homo sapiens
gaggactctgggcgtgtatggg

SEQ ID NO: 7032620 - DNA, 22 bp, Homo sapiens
aaggctgaggcagtgaggcaga

SEQ ID NO: 7032621 - DNA, 22 bp, Homo sapiens
aaatacagtggcagcagataat

SEQ ID NO: 7032622 - DNA, 22 bp, Homo sapiens
aaggcacattcctgaaaacaat

SEQ ID NO: 7032623 - DNA, 22 bp, Homo sapiens
gtctaaactttggcccagattt

SEQ ID NO: 7032624 - DNA, 22 bp, Homo sapiens
atggcttttaactttgatggca

SEQ ID NO: 7032625 - DNA, 23 bp, Homo sapiens
aagcaataccaggtgtgggccct

SEQ ID NO: 7032626 - DNA, 21 bp, Homo sapiens
tgcaatgagattgcgcagggc

SEQ ID NO: 7032627 - DNA, 21 bp, Homo sapiens
agagtctgcatttctgacaag

SEQ ID NO: 7032628 - DNA, 22 bp, Homo sapiens
ctaagggttgaaacagcaagaa

SEQ ID NO: 7032629 - DNA, 22 bp, Homo sapiens
atgagcaattaggaagaaaaca

SEQ ID NO: 7032630 - DNA, 22 bp, Homo sapiens
aggtctgtgaattcctgagaaa

SEQ ID NO: 7032631 - DNA, 22 bp, Homo sapiens
ctggaggagagtctgaatgaca

SEQ ID NO: 7032632 - DNA, 22 bp, Homo sapiens
ggtgtccttgttgaacgaaaat

SEQ ID NO: 7032633 - DNA, 22 bp, Homo sapiens
tcaggctggtccccacagtgga

SEQ ID NO: 7032634 - DNA, 22 bp, Homo sapiens
taggcaacatgtcgaatactgt

SEQ ID NO: 7032635 - DNA, 17 bp, Homo sapiens
ggccatggtgcaaggtt

SEQ ID NO: 7032636 - DNA, 22 bp, Homo sapiens
ctgggctcacctgtggctggca

SEQ ID NO: 7032637 - DNA, 22 bp, Homo sapiens
aggtgccctgctgtgcccttct

SEQ ID NO: 7032638 - DNA, 20 bp, Homo sapiens
catgccagaatgtgaggtag

SEQ ID NO: 7032639 - DNA, 22 bp, Homo sapiens
aggcgcagggtttggacccagg

SEQ ID NO: 7032640 - DNA, 22 bp, Homo sapiens
gcctcctcacaatgtacccacg

SEQ ID NO: 7032641 - DNA, 22 bp, Homo sapiens
ccatttggctcttaaactgagc

SEQ ID NO: 7032642 - DNA, 22 bp, Homo sapiens
ggagagttcatgtggagtgggg

SEQ ID NO: 7032643 - DNA, 22 bp, Homo sapiens
gtccatccctcgagttagggtg

SEQ ID NO: 7032644 - DNA, 22 bp, Homo sapiens
aggcaacttgaccaggctttct

SEQ ID NO: 7032645 - DNA, 22 bp, Homo sapiens
ggaatccttgggtctgaacgtg

SEQ ID NO: 7032646 - DNA, 22 bp, Homo sapiens
tatcacatacttctcatccagg

SEQ ID NO: 7032647 - DNA, 22 bp, Homo sapiens
gcaaattctaggcccctctcca

SEQ ID NO: 7032648 - DNA, 22 bp, Homo sapiens
tgctgaggcagatgtctgtgac

SEQ ID NO: 7032649 - DNA, 22 bp, Homo sapiens
aggcccagtcctctgccgtctg

SEQ ID NO: 7032650 - DNA, 22 bp, Homo sapiens
accatgggcagaatctttgcag

SEQ ID NO: 7032651 - DNA, 22 bp, Homo sapiens
ttgatacatttttaggataaac

SEQ ID NO: 7032652 - DNA, 22 bp, Homo sapiens
cacctgagtgtcagtattctca

SEQ ID NO: 7032653 - DNA, 22 bp, Homo sapiens
acaggcctggtgctgctgacag

SEQ ID NO: 7032654 - DNA, 22 bp, Homo sapiens
aagggccttcactgtctaagca

SEQ ID NO: 7032655 - DNA, 22 bp, Homo sapiens
tcctgaagtcacaggctctgag

SEQ ID NO: 7032656 - DNA, 22 bp, Homo sapiens
tctaacttgtatgtatagtttt

SEQ ID NO: 7032657 - DNA, 22 bp, Homo sapiens
ttggtctggagtatgatgataa

SEQ ID NO: 7032658 - DNA, 21 bp, Homo sapiens
tcatttcagggccttggcttc

SEQ ID NO: 7032659 - DNA, 22 bp, Homo sapiens
tccctgtgtcttcctcttgccc

SEQ ID NO: 7032660 - DNA, 22 bp, Homo sapiens
gctttgccttgaactctcatgt

SEQ ID NO: 7032661 - DNA, 22 bp, Homo sapiens
ttggccaagggctctttaggct

SEQ ID NO: 7032662 - DNA, 22 bp, Homo sapiens
ggagtgctttgaagccttcatt

SEQ ID NO: 7032663 - DNA, 22 bp, Homo sapiens
ttctttatggaatggtgatagt

SEQ ID NO: 7032664 - DNA, 22 bp, Homo sapiens
tgtctaatggcaatttcatgtg

SEQ ID NO: 7032665 - DNA, 22 bp, Homo sapiens
cctctggggcatcagacaaagg

SEQ ID NO: 7032666 - DNA, 22 bp, Homo sapiens
gtgccagcagttatggtgattt

SEQ ID NO: 7032667 - DNA, 22 bp, Homo sapiens
accaggtaccttacacttggct

SEQ ID NO: 7032668 - DNA, 22 bp, Homo sapiens
acaggaacgaatgtacattgtt

SEQ ID NO: 7032669 - DNA, 18 bp, Homo sapiens
cctggaggtcttcggggt

SEQ ID NO: 7032670 - DNA, 22 bp, Homo sapiens
tgtagcaagagcaatccattgt

SEQ ID NO: 7032671 - DNA, 22 bp, Homo sapiens
agagatcactacatttgtaaaa

SEQ ID NO: 7032672 - DNA, 22 bp, Homo sapiens
aaatcgcttgaacccaggaagt

SEQ ID NO: 7032673 - DNA, 22 bp, Homo sapiens
acttccagagggtgtggaaata

SEQ ID NO: 7032674 - DNA, 22 bp, Homo sapiens
gaacttggacctggtcctttgg

SEQ ID NO: 7032675 - DNA, 22 bp, Homo sapiens
tttcattcattatacagtagag

SEQ ID NO: 7032676 - DNA, 22 bp, Homo sapiens
cagactttcaaggagtgaaggc

SEQ ID NO: 7032677 - DNA, 22 bp, Homo sapiens
tgcagctgggacatttttgata

SEQ ID NO: 7032678 - DNA, 22 bp, Homo sapiens
tgaaagattgtgattcaatatg

SEQ ID NO: 7032679 - DNA, 22 bp, Homo sapiens
cttattggtggagtcaggccct

SEQ ID NO: 7032680 - DNA, 22 bp, Homo sapiens
agacagctgggagtgtccttct

SEQ ID NO: 7032681 - DNA, 22 bp, Homo sapiens
gcagtgctctgcctataatgga

SEQ ID NO: 7032682 - DNA, 22 bp, Homo sapiens
tggggtggaacccttctgctgg

SEQ ID NO: 7032683 - DNA, 22 bp, Homo sapiens
cagctttgtggccttgacctcg

SEQ ID NO: 7032684 - DNA, 22 bp, Homo sapiens
ggccagctggatgtgggtgacg

SEQ ID NO: 7032685 - DNA, 22 bp, Homo sapiens
aggtatgtacacacagctctaa

SEQ ID NO: 7032686 - DNA, 22 bp, Homo sapiens
ctctgccctcacttggggcctg

SEQ ID NO: 7032687 - DNA, 22 bp, Homo sapiens
caatcagtaaccggatcatggt

SEQ ID NO: 7032688 - DNA, 22 bp, Homo sapiens
tttgactccactcctaactcct

SEQ ID NO: 7032689 - DNA, 22 bp, Homo sapiens
agctgtgtgtgaatttggccta

SEQ ID NO: 7032690 - DNA, 19 bp, Homo sapiens
ttccttagaggaggcggtg

SEQ ID NO: 7032691 - DNA, 22 bp, Homo sapiens
aggccaagggcaaagcggagag

SEQ ID NO: 7032692 - DNA, 22 bp, Homo sapiens
tcctgaagcagttagcatgagc

SEQ ID NO: 7032693 - DNA, 22 bp, Homo sapiens
aacctggaggactgcaatccat

SEQ ID NO: 7032694 - DNA, 22 bp, Homo sapiens
ctaaatgttggtgttccccaca

SEQ ID NO: 7032695 - DNA, 22 bp, Homo sapiens
actgtactccagcctgggagac

SEQ ID NO: 7032696 - DNA, 22 bp, Homo sapiens
ccagaatcccattgtcacttca

SEQ ID NO: 7032697 - DNA, 22 bp, Homo sapiens
ttgaaacattacctgtatttcc

SEQ ID NO: 7032698 - DNA, 21 bp, Homo sapiens
ctcaggctggcagcaggctag

SEQ ID NO: 7032699 - DNA, 22 bp, Homo sapiens
aatgcaaattctagggccctat

SEQ ID NO: 7032700 - DNA, 16 bp, Homo sapiens
atttccagattatgca

SEQ ID NO: 7032701 - DNA, 22 bp, Homo sapiens
tgagtcctgctctgggcagggt

SEQ ID NO: 7032702 - DNA, 22 bp, Homo sapiens
gtttgggtccctctgtcccact

SEQ ID NO: 7032703 - DNA, 22 bp, Homo sapiens
agaatgttgatagcacctattt

SEQ ID NO: 7032704 - DNA, 22 bp, Homo sapiens
cagcatctctttttgcattcct

SEQ ID NO: 7032705 - DNA, 22 bp, Homo sapiens
acagtgattctgcaaaccatat

SEQ ID NO: 7032706 - DNA, 22 bp, Homo sapiens
tctcagaaatgacaggaggtac

SEQ ID NO: 7032707 - DNA, 22 bp, Homo sapiens
ccccacacctgccgggcagcag

SEQ ID NO: 7032708 - DNA, 17 bp, Homo sapiens
aggtgcagaggcagagc

SEQ ID NO: 7032709 - DNA, 22 bp, Homo sapiens
tctgtgccatgcccgtctacca

SEQ ID NO: 7032710 - DNA, 22 bp, Homo sapiens
agtgggaaactggagagacttc

SEQ ID NO: 7032711 - DNA, 22 bp, Homo sapiens
agataatgtcaaattctgtctg

SEQ ID NO: 7032712 - DNA, 22 bp, Homo sapiens
tattgcatattattctagtggc

SEQ ID NO: 7032713 - DNA, 22 bp, Homo sapiens
atgtgaactctgtactctctga

SEQ ID NO: 7032714 - DNA, 22 bp, Homo sapiens
caaagggctctagactcagcag

SEQ ID NO: 7032715 - DNA, 23 bp, Homo sapiens
agcatctggcttcccctggatgg

SEQ ID NO: 7032716 - DNA, 22 bp, Homo sapiens
acttccagatggccccatctaa

SEQ ID NO: 7032717 - DNA, 22 bp, Homo sapiens
cctctgcatgtgcagtaccgag

SEQ ID NO: 7032718 - DNA, 22 bp, Homo sapiens
ggactttagctgtaatgtgtgt

SEQ ID NO: 7032719 - DNA, 23 bp, Homo sapiens
acatttcaatactgagggtctga

SEQ ID NO: 7032720 - DNA, 22 bp, Homo sapiens
atcatgacatctgagtttaagt

SEQ ID NO: 7032721 - DNA, 22 bp, Homo sapiens
ctgcatgaagtcttttttatag

SEQ ID NO: 7032722 - DNA, 22 bp, Homo sapiens
tggacacagtggtgaaggtaca

SEQ ID NO: 7032723 - DNA, 22 bp, Homo sapiens
tacagtttttattcatgacaag

SEQ ID NO: 7032724 - DNA, 22 bp, Homo sapiens
agtggggaagattttgcagtca

SEQ ID NO: 7032725 - DNA, 22 bp, Homo sapiens
tattaggtatgaactggcaacc

SEQ ID NO: 7032726 - DNA, 22 bp, Homo sapiens
gccgtaaagctacgcttttgcg

SEQ ID NO: 7032727 - DNA, 22 bp, Homo sapiens
ctgagggaaggcagtcagttgg

SEQ ID NO: 7032728 - DNA, 22 bp, Homo sapiens
gctggcactgggaaggactgag

SEQ ID NO: 7032729 - DNA, 22 bp, Homo sapiens
tcacatgtactgtctgtgacat

SEQ ID NO: 7032730 - DNA, 22 bp, Homo sapiens
acttggtgaagtcaggtgatta

SEQ ID NO: 7032731 - DNA, 22 bp, Homo sapiens
tctttggatatgtatggataga

SEQ ID NO: 7032732 - DNA, 22 bp, Homo sapiens
aacagattgtaacctgatagcc

SEQ ID NO: 7032733 - DNA, 22 bp, Homo sapiens
agctggtgtcctcctggagctg

SEQ ID NO: 7032734 - DNA, 22 bp, Homo sapiens
ctgagtccttgggcttagagtg

SEQ ID NO: 7032735 - DNA, 15 bp, Homo sapiens
tgtttaagccacatt

SEQ ID NO: 7032736 - DNA, 22 bp, Homo sapiens
tgcatttgagttgggagcaggc

SEQ ID NO: 7032737 - DNA, 22 bp, Homo sapiens
ctgctctggctgtgtacttcag

SEQ ID NO: 7032738 - DNA, 22 bp, Homo sapiens
cagaggattatttcagaatcta

SEQ ID NO: 7032739 - DNA, 22 bp, Homo sapiens
tgcaggaattttttgcagaaag

SEQ ID NO: 7032740 - DNA, 22 bp, Homo sapiens
atgtttttcataccagtgttgg

SEQ ID NO: 7032741 - DNA, 21 bp, Homo sapiens
agatgcagtttgcaggtgggt

SEQ ID NO: 7032742 - DNA, 19 bp, Homo sapiens
tctggagctgatgcaggtg

SEQ ID NO: 7032743 - DNA, 18 bp, Homo sapiens
agtgaattaaggcaggaa

SEQ ID NO: 7032744 - DNA, 22 bp, Homo sapiens
tggcaataaagaccaacaggtt

SEQ ID NO: 7032745 - DNA, 22 bp, Homo sapiens
tgcagtgggccggaggccaggg

SEQ ID NO: 7032746 - DNA, 22 bp, Homo sapiens
ttgcagggattaccttattttt

SEQ ID NO: 7032747 - DNA, 22 bp, Homo sapiens
gcaaatacatgttgagcaccta

SEQ ID NO: 7032748 - DNA, 22 bp, Homo sapiens
ccgcttggatggggggtccaga

SEQ ID NO: 7032749 - DNA, 22 bp, Homo sapiens
agctggaattacaggagcccat

SEQ ID NO: 7032750 - DNA, 22 bp, Homo sapiens
gccagagccggcttcacaggat

SEQ ID NO: 7032751 - DNA, 22 bp, Homo sapiens
cttcaacttccctagatgtcat

SEQ ID NO: 7032752 - DNA, 22 bp, Homo sapiens
aaggccaggaaattatccctat

SEQ ID NO: 7032753 - DNA, 22 bp, Homo sapiens
tatgtgtccctgctactcaaca

SEQ ID NO: 7032754 - DNA, 22 bp, Homo sapiens
agtgaggaaatccattatcaag

SEQ ID NO: 7032755 - DNA, 22 bp, Homo sapiens
aggaatttgagtgctgtaggaa

SEQ ID NO: 7032756 - DNA, 22 bp, Homo sapiens
aacacatgccttaagaataagt

SEQ ID NO: 7032757 - DNA, 22 bp, Homo sapiens
ccatgagccagctctaagcaaa

SEQ ID NO: 7032758 - DNA, 22 bp, Homo sapiens
agcacctgttgcacttcataat

SEQ ID NO: 7032759 - DNA, 22 bp, Homo sapiens
agagcacactgacgtcagtctg

SEQ ID NO: 7032760 - DNA, 22 bp, Homo sapiens
ttgcttcagtcagtgctgccca

SEQ ID NO: 7032761 - DNA, 22 bp, Homo sapiens
cagtttctgagccctgtcattt

SEQ ID NO: 7032762 - DNA, 22 bp, Homo sapiens
ggccatgcaggtcagaggtggg

SEQ ID NO: 7032763 - DNA, 22 bp, Homo sapiens
aaggcagcacagcaactgctca

SEQ ID NO: 7032764 - DNA, 22 bp, Homo sapiens
tttgcattatatttatagaaga

SEQ ID NO: 7032765 - DNA, 22 bp, Homo sapiens
acttcagtaggtgatatgtgca

SEQ ID NO: 7032766 - DNA, 22 bp, Homo sapiens
ttggttttctcagctggaccat

SEQ ID NO: 7032767 - DNA, 20 bp, Homo sapiens
aactttgcattttattctcc

SEQ ID NO: 7032768 - DNA, 22 bp, Homo sapiens
cccaggggtaaggcgcagcgtg

SEQ ID NO: 7032769 - DNA, 22 bp, Homo sapiens
aacattctactgtactgcattg

SEQ ID NO: 7032770 - DNA, 22 bp, Homo sapiens
ccagaagcttctacacaggaga

SEQ ID NO: 7032771 - DNA, 22 bp, Homo sapiens
tggctctcaggcctgctgcgtt

SEQ ID NO: 7032772 - DNA, 22 bp, Homo sapiens
tggagaatatttccaaatctaa

SEQ ID NO: 7032773 - DNA, 22 bp, Homo sapiens
ttaataacattgtgtatcaccc

SEQ ID NO: 7032774 - DNA, 22 bp, Homo sapiens
aaattcagttttaataatcact

SEQ ID NO: 7032775 - DNA, 23 bp, Homo sapiens
cagctttcagggctttagggaag

SEQ ID NO: 7032776 - DNA, 22 bp, Homo sapiens
ccttggcttgcacacggccacc

SEQ ID NO: 7032777 - DNA, 22 bp, Homo sapiens
gtcctgacggctgattggcctg

SEQ ID NO: 7032778 - DNA, 22 bp, Homo sapiens
tgataactctcagtttctcatg

SEQ ID NO: 7032779 - DNA, 22 bp, Homo sapiens
acaggcctagggtcaatttcct

SEQ ID NO: 7032780 - DNA, 22 bp, Homo sapiens
ttcctgtgtcctatttcgactt

SEQ ID NO: 7032781 - DNA, 22 bp, Homo sapiens
cccttagtttgagaacttgtct

SEQ ID NO: 7032782 - DNA, 22 bp, Homo sapiens
gcagggtgaaggtcacatagaa

SEQ ID NO: 7032783 - DNA, 22 bp, Homo sapiens
agctacacttaaccacatagca

SEQ ID NO: 7032784 - DNA, 22 bp, Homo sapiens
gatgcttcaagcttccttataa

SEQ ID NO: 7032785 - DNA, 22 bp, Homo sapiens
tctctgggtttttgtcctgtac

SEQ ID NO: 7032786 - DNA, 22 bp, Homo sapiens
tggaacctggcattagggacac

SEQ ID NO: 7032787 - DNA, 22 bp, Homo sapiens
agcagaagaggtcttgttgctg

SEQ ID NO: 7032788 - DNA, 22 bp, Homo sapiens
ctgtgctgggtgtgcttatgat

SEQ ID NO: 7032789 - DNA, 22 bp, Homo sapiens
gtactgaataacaaagtctgtc

SEQ ID NO: 7032790 - DNA, 22 bp, Homo sapiens
tatttgtagaatggattaaggg

SEQ ID NO: 7032791 - DNA, 22 bp, Homo sapiens
ccctggcagcaatcactggtgt

SEQ ID NO: 7032792 - DNA, 22 bp, Homo sapiens
cttggtctataggagagattgt

SEQ ID NO: 7032793 - DNA, 22 bp, Homo sapiens
gcctttggactgaggtagtcag

SEQ ID NO: 7032794 - DNA, 22 bp, Homo sapiens
cttgagtattttaatccataat

SEQ ID NO: 7032795 - DNA, 22 bp, Homo sapiens
ggagttaaaaatgggttgtcat

SEQ ID NO: 7032796 - DNA, 22 bp, Homo sapiens
acagcagagttgagtagttgca

SEQ ID NO: 7032797 - DNA, 22 bp, Homo sapiens
ttcctgttgtgttagagtcaat

SEQ ID NO: 7032798 - DNA, 22 bp, Homo sapiens
acagctaggaaatggaagaact

SEQ ID NO: 7032799 - DNA, 22 bp, Homo sapiens
ccctggctgcttgtagtctggc

SEQ ID NO: 7032800 - DNA, 23 bp, Homo sapiens
cagatcatatatccagctgtaag

SEQ ID NO: 7032801 - DNA, 22 bp, Homo sapiens
atgtggctagtgcagatgaata

SEQ ID NO: 7032802 - DNA, 22 bp, Homo sapiens
ctgtcatttctattatagagga

SEQ ID NO: 7032803 - DNA, 22 bp, Homo sapiens
tggcccgggagttttgaagagt

SEQ ID NO: 7032804 - DNA, 22 bp, Homo sapiens
acctccctaacccttttggctc

SEQ ID NO: 7032805 - DNA, 22 bp, Homo sapiens
gaagtttagaagtgacaggttt

SEQ ID NO: 7032806 - DNA, 22 bp, Homo sapiens
tctctttgtctgctcttagttg

SEQ ID NO: 7032807 - DNA, 22 bp, Homo sapiens
ccttggctgtgttgcctgccct

SEQ ID NO: 7032808 - DNA, 22 bp, Homo sapiens
ttctgttctgatacttgtttct

SEQ ID NO: 7032809 - DNA, 22 bp, Homo sapiens
cacaggtgtctctagtagcgtt

SEQ ID NO: 7032810 - DNA, 22 bp, Homo sapiens
tgtatgtatgcatcttttatgt

SEQ ID NO: 7032811 - DNA, 22 bp, Homo sapiens
attaggacacatacatgtacag

SEQ ID NO: 7032812 - DNA, 22 bp, Homo sapiens
tgcagagacttgtgtgcatttg

SEQ ID NO: 7032813 - DNA, 20 bp, Homo sapiens
aagcatggtcaaaacttatg

SEQ ID NO: 7032814 - DNA, 23 bp, Homo sapiens
tccaattcaattgggtcaggaag

SEQ ID NO: 7032815 - DNA, 22 bp, Homo sapiens
ttacttgaatgttttgggtgtc

SEQ ID NO: 7032816 - DNA, 22 bp, Homo sapiens
cagaacctgaacgtgaggtgga

SEQ ID NO: 7032817 - DNA, 22 bp, Homo sapiens
aaggagtctcagctgggcctga

SEQ ID NO: 7032818 - DNA, 22 bp, Homo sapiens
gcagcagtgtctcccatcttgc

SEQ ID NO: 7032819 - DNA, 22 bp, Homo sapiens
aagctgtttgcagtggatggag

SEQ ID NO: 7032820 - DNA, 22 bp, Homo sapiens
atgcctgtaatcccagtgcttt

SEQ ID NO: 7032821 - DNA, 22 bp, Homo sapiens
agctgtgtggtgtctgacagct

SEQ ID NO: 7032822 - DNA, 22 bp, Homo sapiens
actggcagtttgagaatgcatt

SEQ ID NO: 7032823 - DNA, 22 bp, Homo sapiens
ttcaaagatggagggatagatt

SEQ ID NO: 7032824 - DNA, 22 bp, Homo sapiens
gagttgaacatatgcaatctct

SEQ ID NO: 7032825 - DNA, 22 bp, Homo sapiens
tgatccccttcccagtaagcct

SEQ ID NO: 7032826 - DNA, 22 bp, Homo sapiens
ctgtgctttcaggccgctgtgt

SEQ ID NO: 7032827 - DNA, 22 bp, Homo sapiens
gctgatataaaattacagagga

SEQ ID NO: 7032828 - DNA, 22 bp, Homo sapiens
gggtacagaaactgaggcttag

SEQ ID NO: 7032829 - DNA, 22 bp, Homo sapiens
ctgtgaggcgggtggagtggag

SEQ ID NO: 7032830 - DNA, 22 bp, Homo sapiens
ttcattcagtgagactaggacg

SEQ ID NO: 7032831 - DNA, 22 bp, Homo sapiens
gcccagcacctctctcagggtt

SEQ ID NO: 7032832 - DNA, 22 bp, Homo sapiens
tctcctctgcgcggcagtgccc

SEQ ID NO: 7032833 - DNA, 22 bp, Homo sapiens
cagcagttttgaagtgtggaga

SEQ ID NO: 7032834 - DNA, 22 bp, Homo sapiens
tatcaaggtcaacattgacagt

SEQ ID NO: 7032835 - DNA, 22 bp, Homo sapiens
gggctcattcatctgggcttgg

SEQ ID NO: 7032836 - DNA, 22 bp, Homo sapiens
tcctgcagctgcagacctgggg

SEQ ID NO: 7032837 - DNA, 22 bp, Homo sapiens
atttagcaagagtacaaaataa

SEQ ID NO: 7032838 - DNA, 22 bp, Homo sapiens
agggagtgttatattccatcag

SEQ ID NO: 7032839 - DNA, 22 bp, Homo sapiens
acatacatggtgctttcttggt

SEQ ID NO: 7032840 - DNA, 22 bp, Homo sapiens
gagagctgaggggcctggcact

SEQ ID NO: 7032841 - DNA, 22 bp, Homo sapiens
ttagttagtccctggtaccttt

SEQ ID NO: 7032842 - DNA, 22 bp, Homo sapiens
agaactctatattcatgaacaa

SEQ ID NO: 7032843 - DNA, 22 bp, Homo sapiens
ctgagttctgcccaaggtctgg

SEQ ID NO: 7032844 - DNA, 22 bp, Homo sapiens
acagagcagtaagaacacagct

SEQ ID NO: 7032845 - DNA, 17 bp, Homo sapiens
gtgtaaatgctagaaac

SEQ ID NO: 7032846 - DNA, 22 bp, Homo sapiens
gaaatgttgtctctgcagcaat

SEQ ID NO: 7032847 - DNA, 22 bp, Homo sapiens
tgcctaactccaccaggcaggt

SEQ ID NO: 7032848 - DNA, 22 bp, Homo sapiens
gatgtagcggcagctgtttttc

SEQ ID NO: 7032849 - DNA, 22 bp, Homo sapiens
tcgtgcaaaggcccatgtgggt

SEQ ID NO: 7032850 - DNA, 22 bp, Homo sapiens
tttgagttgcttatttaatagg

SEQ ID NO: 7032851 - DNA, 22 bp, Homo sapiens
gagctgggattcatctatgtct

SEQ ID NO: 7032852 - DNA, 22 bp, Homo sapiens
gctggagtgctgaggtgcagtg

SEQ ID NO: 7032853 - DNA, 22 bp, Homo sapiens
atgtgcagacctgggttagaac

SEQ ID NO: 7032854 - DNA, 22 bp, Homo sapiens
tctcttccagtggctttgattt

SEQ ID NO: 7032855 - DNA, 22 bp, Homo sapiens
tggctgcagacacctatggcag

SEQ ID NO: 7032856 - DNA, 22 bp, Homo sapiens
tggcacagcccattcagagaag

SEQ ID NO: 7032857 - DNA, 22 bp, Homo sapiens
agttaaacttgcctttattcct

SEQ ID NO: 7032858 - DNA, 22 bp, Homo sapiens
tggccagctttttgtagtgctc

SEQ ID NO: 7032859 - DNA, 22 bp, Homo sapiens
actttgccccaaagaagttggt

SEQ ID NO: 7032860 - DNA, 22 bp, Homo sapiens
cagctttaccaatatttggaaa

SEQ ID NO: 7032861 - DNA, 22 bp, Homo sapiens
aggtacataggaaagtggagct

SEQ ID NO: 7032862 - DNA, 22 bp, Homo sapiens
taaccagcatgaaatctgcagc

SEQ ID NO: 7032863 - DNA, 20 bp, Homo sapiens
atatagagtcaaaatggctt

SEQ ID NO: 7032864 - DNA, 22 bp, Homo sapiens
ttattctgtttgccgaccagta

SEQ ID NO: 7032865 - DNA, 22 bp, Homo sapiens
tagtgcttaataaatttcagaa

SEQ ID NO: 7032866 - DNA, 19 bp, Homo sapiens
agacttttgtaagttgaga

SEQ ID NO: 7032867 - DNA, 22 bp, Homo sapiens
ttgggctgaggagggcgtggcc

SEQ ID NO: 7032868 - DNA, 22 bp, Homo sapiens
gggctcatcagctaggaaaatg

SEQ ID NO: 7032869 - DNA, 22 bp, Homo sapiens
cttggtcacagttcccaacatt

SEQ ID NO: 7032870 - DNA, 22 bp, Homo sapiens
gatgtgtacctccttttgtttt

SEQ ID NO: 7032871 - DNA, 22 bp, Homo sapiens
ccttctagcctgcgccagggca

SEQ ID NO: 7032872 - DNA, 22 bp, Homo sapiens
ctgtggaagagggtcaccagta

SEQ ID NO: 7032873 - DNA, 22 bp, Homo sapiens
gtgtggaatggagtttttgccc

SEQ ID NO: 7032874 - DNA, 22 bp, Homo sapiens
atcagagacaaaaccagcactt

SEQ ID NO: 7032875 - DNA, 22 bp, Homo sapiens
tgagcagaagttataaataaga

SEQ ID NO: 7032876 - DNA, 22 bp, Homo sapiens
atctgtcctggagctaggcttc

SEQ ID NO: 7032877 - DNA, 22 bp, Homo sapiens
ccaggagcagccggcccacctg

SEQ ID NO: 7032878 - DNA, 22 bp, Homo sapiens
aaatctttccctttactatcca

SEQ ID NO: 7032879 - DNA, 23 bp, Homo sapiens
agagacatttggatacagaaaca

SEQ ID NO: 7032880 - DNA, 22 bp, Homo sapiens
tagtgatttaagaaaggtgact

SEQ ID NO: 7032881 - DNA, 22 bp, Homo sapiens
cacaggtgccatctcttcatgg

SEQ ID NO: 7032882 - DNA, 22 bp, Homo sapiens
ttattccaggcacagaaggagg

SEQ ID NO: 7032883 - DNA, 22 bp, Homo sapiens
agtataggtaggaggatggtat

SEQ ID NO: 7032884 - DNA, 22 bp, Homo sapiens
gatgctggcctggccatctggg

SEQ ID NO: 7032885 - DNA, 19 bp, Homo sapiens
tctcacatcagctcctagc

SEQ ID NO: 7032886 - DNA, 22 bp, Homo sapiens
cctggcacatagtgggcatgca

SEQ ID NO: 7032887 - DNA, 22 bp, Homo sapiens
acagggaaggagcatagaaaaa

SEQ ID NO: 7032888 - DNA, 22 bp, Homo sapiens
atcagtttctaccatgtggaat

SEQ ID NO: 7032889 - DNA, 22 bp, Homo sapiens
acaaatggagaaactgaggccc

SEQ ID NO: 7032890 - DNA, 22 bp, Homo sapiens
ttcctggtttatggaaagcatg

SEQ ID NO: 7032891 - DNA, 22 bp, Homo sapiens
attaggtggggttgttactgtt

SEQ ID NO: 7032892 - DNA, 22 bp, Homo sapiens
agtatttgaagatgttgagtac

SEQ ID NO: 7032893 - DNA, 22 bp, Homo sapiens
tagtttcctaggctgtattgtt

SEQ ID NO: 7032894 - DNA, 22 bp, Homo sapiens
ctgggaagcatggtgatggtat

SEQ ID NO: 7032895 - DNA, 22 bp, Homo sapiens
gaggtccactgaggcaacaggg

SEQ ID NO: 7032896 - DNA, 22 bp, Homo sapiens
tttgcattgcagtggtttacag

SEQ ID NO: 7032897 - DNA, 22 bp, Homo sapiens
cctgtcactgttgcagccagct

SEQ ID NO: 7032898 - DNA, 23 bp, Homo sapiens
agcaatgctgggagactctgtaa

SEQ ID NO: 7032899 - DNA, 22 bp, Homo sapiens
taagcattgtttctgaggatgg

SEQ ID NO: 7032900 - DNA, 22 bp, Homo sapiens
ttggttcaatactaacttgaac

SEQ ID NO: 7032901 - DNA, 22 bp, Homo sapiens
cttggagacaggacaggcagaa

SEQ ID NO: 7032902 - DNA, 22 bp, Homo sapiens
tcttaagtacctcctttatcac

SEQ ID NO: 7032903 - DNA, 20 bp, Homo sapiens
ccctaggaacgcagcaggag

SEQ ID NO: 7032904 - DNA, 22 bp, Homo sapiens
ttacacagtgcacaagcagagt

SEQ ID NO: 7032905 - DNA, 22 bp, Homo sapiens
ttactagtggagaaactgaggc

SEQ ID NO: 7032906 - DNA, 22 bp, Homo sapiens
tggctttacatcaaattgagta

SEQ ID NO: 7032907 - DNA, 22 bp, Homo sapiens
atgcacatgtatgtcaatattt

SEQ ID NO: 7032908 - DNA, 22 bp, Homo sapiens
aggcttcaaggacctgagggaa

SEQ ID NO: 7032909 - DNA, 22 bp, Homo sapiens
tgacacatgcaccagtctttaa

SEQ ID NO: 7032910 - DNA, 22 bp, Homo sapiens
ctgtctgtcaagttcatctcca

SEQ ID NO: 7032911 - DNA, 22 bp, Homo sapiens
ctgtttatgaagctgtggttta

SEQ ID NO: 7032912 - DNA, 20 bp, Homo sapiens
agcatttgaaatatgactat

SEQ ID NO: 7032913 - DNA, 22 bp, Homo sapiens
tatgcatagatattatcagcca

SEQ ID NO: 7032914 - DNA, 22 bp, Homo sapiens
caaagtatatttcatagtctca

SEQ ID NO: 7032915 - DNA, 22 bp, Homo sapiens
ggcacacagcggaatttgctct

SEQ ID NO: 7032916 - DNA, 22 bp, Homo sapiens
cgaggcctcaagacagtgtttg

SEQ ID NO: 7032917 - DNA, 22 bp, Homo sapiens
accatccaaactgctttctgtg

SEQ ID NO: 7032918 - DNA, 22 bp, Homo sapiens
ttacacaacagtgcatcagcag

SEQ ID NO: 7032919 - DNA, 18 bp, Homo sapiens
ggtggccttgacttctct

SEQ ID NO: 7032920 - DNA, 22 bp, Homo sapiens
tcagggctgcagaagaggcagg

SEQ ID NO: 7032921 - DNA, 22 bp, Homo sapiens
ttggtgctctctatgacatgaa

SEQ ID NO: 7032922 - DNA, 22 bp, Homo sapiens
ctcaagaatctagggaggattc

SEQ ID NO: 7032923 - DNA, 20 bp, Homo sapiens
cttggtggctctgggaagtg

SEQ ID NO: 7032924 - DNA, 22 bp, Homo sapiens
gggcctcagctgccaacaggat

SEQ ID NO: 7032925 - DNA, 22 bp, Homo sapiens
tttgcattgtaatatttagttc

SEQ ID NO: 7032926 - DNA, 22 bp, Homo sapiens
agctgggtggagggcccacggt

SEQ ID NO: 7032927 - DNA, 23 bp, Homo sapiens
cgggttcacgccattctcctgcc

SEQ ID NO: 7032928 - DNA, 22 bp, Homo sapiens
tgacggtatttagggagcagcg

SEQ ID NO: 7032929 - DNA, 22 bp, Homo sapiens
tccccagacagcgggaggcctg

SEQ ID NO: 7032930 - DNA, 22 bp, Homo sapiens
cctccctccctgcagaagccac

SEQ ID NO: 7032931 - DNA, 22 bp, Homo sapiens
aggccatattaattacacagga

SEQ ID NO: 7032932 - DNA, 22 bp, Homo sapiens
ttacacatgctcacttatttgt

SEQ ID NO: 7032933 - DNA, 22 bp, Homo sapiens
ttgaaagggttaaagtggtaaa

SEQ ID NO: 7032934 - DNA, 22 bp, Homo sapiens
tcctttatctgctcagaaagta

SEQ ID NO: 7032935 - DNA, 22 bp, Homo sapiens
agctaagacttagtgacttagt

SEQ ID NO: 7032936 - DNA, 22 bp, Homo sapiens
ttggcagactgacaatctgttt

SEQ ID NO: 7032937 - DNA, 22 bp, Homo sapiens
tcgccccgaggcagccctatgc

SEQ ID NO: 7032938 - DNA, 22 bp, Homo sapiens
cttagaatgggacccaatgggt

SEQ ID NO: 7032939 - DNA, 22 bp, Homo sapiens
acagagggtttctaaggatttg

SEQ ID NO: 7032940 - DNA, 22 bp, Homo sapiens
tgaggtagaaaaagcttgtagt

SEQ ID NO: 7032941 - DNA, 22 bp, Homo sapiens
ctgcagaatggggccaagtgga

SEQ ID NO: 7032942 - DNA, 22 bp, Homo sapiens
agccttcaacctagctagagca

SEQ ID NO: 7032943 - DNA, 22 bp, Homo sapiens
aagaagagaactggcatcctaa

SEQ ID NO: 7032944 - DNA, 22 bp, Homo sapiens
aatttgttaaaagtgagtgaca

SEQ ID NO: 7032945 - DNA, 22 bp, Homo sapiens
aaattgcacccgaggaggaggt

SEQ ID NO: 7032946 - DNA, 22 bp, Homo sapiens
ctgtggctgtctctttcccatg

SEQ ID NO: 7032947 - DNA, 23 bp, Homo sapiens
ataaggcataaaggtacattgga

SEQ ID NO: 7032948 - DNA, 22 bp, Homo sapiens
ttctatgtgaacgttatagttt

SEQ ID NO: 7032949 - DNA, 22 bp, Homo sapiens
ccaggccttctgaggacactct

SEQ ID NO: 7032950 - DNA, 22 bp, Homo sapiens
ctaaggaacaccaggagatggt

SEQ ID NO: 7032951 - DNA, 22 bp, Homo sapiens
tgtctgatggggattgctcttc

SEQ ID NO: 7032952 - DNA, 22 bp, Homo sapiens
ttaggcatcacgggggatgcag

SEQ ID NO: 7032953 - DNA, 22 bp, Homo sapiens
ggtgctgattaagaactgtata

SEQ ID NO: 7032954 - DNA, 22 bp, Homo sapiens
tggtaactggattctgtctcac

SEQ ID NO: 7032955 - DNA, 22 bp, Homo sapiens
tggttagtcagtacctgagtgt

SEQ ID NO: 7032956 - DNA, 22 bp, Homo sapiens
tatattcacttgtgtccaacca

SEQ ID NO: 7032957 - DNA, 22 bp, Homo sapiens
tgtctcttggagggtctagtga

SEQ ID NO: 7032958 - DNA, 20 bp, Homo sapiens
atccatcatgtccatgactt

SEQ ID NO: 7032959 - DNA, 23 bp, Homo sapiens
acagggcattgctggcctcgagg

SEQ ID NO: 7032960 - DNA, 22 bp, Homo sapiens
aaaggctcaacagctgtacttt

SEQ ID NO: 7032961 - DNA, 22 bp, Homo sapiens
tgccaagtgcttacttggccct

SEQ ID NO: 7032962 - DNA, 22 bp, Homo sapiens
tcttagaaattccccagtggct

SEQ ID NO: 7032963 - DNA, 22 bp, Homo sapiens
gttctcctcttagctgtgccac

SEQ ID NO: 7032964 - DNA, 22 bp, Homo sapiens
gcctttgaattgttgtggtgag

SEQ ID NO: 7032965 - DNA, 22 bp, Homo sapiens
agagaatctagaatgtttatac

SEQ ID NO: 7032966 - DNA, 22 bp, Homo sapiens
ttgaaggtcctgtttctatcca

SEQ ID NO: 7032967 - DNA, 22 bp, Homo sapiens
ctagttctaaatctgttgtcca

SEQ ID NO: 7032968 - DNA, 22 bp, Homo sapiens
tgggtagaaacaaggctggact

SEQ ID NO: 7032969 - DNA, 22 bp, Homo sapiens
gatgggcttcttccatgaagaa

SEQ ID NO: 7032970 - DNA, 22 bp, Homo sapiens
agcccctccagtggcataaaat

SEQ ID NO: 7032971 - DNA, 20 bp, Homo sapiens
agggacacaatatttctgtg

SEQ ID NO: 7032972 - DNA, 19 bp, Homo sapiens
tctaggagatctgaacctt

SEQ ID NO: 7032973 - DNA, 22 bp, Homo sapiens
acatgatcccacctgcctataa

SEQ ID NO: 7032974 - DNA, 22 bp, Homo sapiens
ctggtagggccccacatcctta

SEQ ID NO: 7032975 - DNA, 22 bp, Homo sapiens
cgcctcagccgtggtcatcttc

SEQ ID NO: 7032976 - DNA, 22 bp, Homo sapiens
ttaactgctaccattattttcc

SEQ ID NO: 7032977 - DNA, 20 bp, Homo sapiens
agatggctgtcatttctgtc

SEQ ID NO: 7032978 - DNA, 22 bp, Homo sapiens
ccttacactgcctggggccacg

SEQ ID NO: 7032979 - DNA, 22 bp, Homo sapiens
ggtagtatggattccctctctc

SEQ ID NO: 7032980 - DNA, 19 bp, Homo sapiens
tctgagtgagggttatcct

SEQ ID NO: 7032981 - DNA, 15 bp, Homo sapiens
ccttcccacccaccc

SEQ ID NO: 7032982 - DNA, 22 bp, Homo sapiens
agacaaagacagcatctcaggt

SEQ ID NO: 7032983 - DNA, 22 bp, Homo sapiens
ttttaagaactgttctgtgctt

SEQ ID NO: 7032984 - DNA, 22 bp, Homo sapiens
tagtgaaatttatgcacagcta

SEQ ID NO: 7032985 - DNA, 22 bp, Homo sapiens
cctgtattgtgcccagaatctc

SEQ ID NO: 7032986 - DNA, 22 bp, Homo sapiens
aaccaagctcaatggtctgagt

SEQ ID NO: 7032987 - DNA, 22 bp, Homo sapiens
tagatgctactttacatagggt

SEQ ID NO: 7032988 - DNA, 22 bp, Homo sapiens
atagaactccatccctctgacc

SEQ ID NO: 7032989 - DNA, 22 bp, Homo sapiens
atgtttgcattcttattatcgt

SEQ ID NO: 7032990 - DNA, 22 bp, Homo sapiens
tccacagggattcacccaaaag

SEQ ID NO: 7032991 - DNA, 22 bp, Homo sapiens
gcagaatgtccaagctgggccc

SEQ ID NO: 7032992 - DNA, 22 bp, Homo sapiens
cagtgattactgtgcttttggt

SEQ ID NO: 7032993 - DNA, 22 bp, Homo sapiens
gcaaatgctctccagcctgggt

SEQ ID NO: 7032994 - DNA, 22 bp, Homo sapiens
tcccacacctgtctattcctag

SEQ ID NO: 7032995 - DNA, 22 bp, Homo sapiens
tgtgcgtggattcctgtactca

SEQ ID NO: 7032996 - DNA, 22 bp, Homo sapiens
gtgtggctacctcagaggagca

SEQ ID NO: 7032997 - DNA, 22 bp, Homo sapiens
cagatcacttgaagccaggagt

SEQ ID NO: 7032998 - DNA, 22 bp, Homo sapiens
catcatctctcccccaggcctg

SEQ ID NO: 7032999 - DNA, 22 bp, Homo sapiens
aaaatgtatgatggaggtgcta

SEQ ID NO: 7033000 - DNA, 22 bp, Homo sapiens
tccttaaagtgcacctcctcat

SEQ ID NO: 7033001 - DNA, 22 bp, Homo sapiens
aagtgctgaatgaagacacaaa

SEQ ID NO: 7033002 - DNA, 22 bp, Homo sapiens
actgagcataaatatgtgtcca

SEQ ID NO: 7033003 - DNA, 22 bp, Homo sapiens
taacagaaatatttccaggtga

SEQ ID NO: 7033004 - DNA, 22 bp, Homo sapiens
cacagttgtctgatttcttcct

SEQ ID NO: 7033005 - DNA, 22 bp, Homo sapiens
atgttagtgaagttgctcaaat

SEQ ID NO: 7033006 - DNA, 22 bp, Homo sapiens
ctaaatgacttccagtggttat

SEQ ID NO: 7033007 - DNA, 22 bp, Homo sapiens
cttcttcatgtattgatagtct

SEQ ID NO: 7033008 - DNA, 22 bp, Homo sapiens
cctggctctgccgtaaccacca

SEQ ID NO: 7033009 - DNA, 22 bp, Homo sapiens
cagtgtgtcctcagaatatata

SEQ ID NO: 7033010 - DNA, 23 bp, Homo sapiens
agagactataagttatgttctgt

SEQ ID NO: 7033011 - DNA, 22 bp, Homo sapiens
aggtgctggcgccccaggagac

SEQ ID NO: 7033012 - DNA, 22 bp, Homo sapiens
gcctggccaacgtggtgaaacc

SEQ ID NO: 7033013 - DNA, 22 bp, Homo sapiens
agagggagtgaaatggaataga

SEQ ID NO: 7033014 - DNA, 22 bp, Homo sapiens
tacatggatgttatccttactg

SEQ ID NO: 7033015 - DNA, 22 bp, Homo sapiens
gtctctgtcacaactactcatc

SEQ ID NO: 7033016 - DNA, 22 bp, Homo sapiens
ctggactcactatggcttcaga

SEQ ID NO: 7033017 - DNA, 22 bp, Homo sapiens
agtgtctaaactggcttcctgg

SEQ ID NO: 7033018 - DNA, 22 bp, Homo sapiens
agttggcgggacatgtggaaag

SEQ ID NO: 7033019 - DNA, 22 bp, Homo sapiens
gggctgccttttaattcttccc

SEQ ID NO: 7033020 - DNA, 22 bp, Homo sapiens
ctggtccttgctacccagcaag

SEQ ID NO: 7033021 - DNA, 22 bp, Homo sapiens
gactgtggccttggaccatggg

SEQ ID NO: 7033022 - DNA, 22 bp, Homo sapiens
acccagataaatgacagggctt

SEQ ID NO: 7033023 - DNA, 22 bp, Homo sapiens
acagattgcttagaattgaatg

SEQ ID NO: 7033024 - DNA, 18 bp, Homo sapiens
tccctcctgcctgcttcc

SEQ ID NO: 7033025 - DNA, 22 bp, Homo sapiens
agctgaaattcacaaggatcca

SEQ ID NO: 7033026 - DNA, 20 bp, Homo sapiens
gcagtctgcctctgtgtggt

SEQ ID NO: 7033027 - DNA, 22 bp, Homo sapiens
tcctgctggaatggaaaatgaa

SEQ ID NO: 7033028 - DNA, 22 bp, Homo sapiens
ggaggagctgctgtgggggccc

SEQ ID NO: 7033029 - DNA, 22 bp, Homo sapiens
gcttcatgggtgtgcaacctgt

SEQ ID NO: 7033030 - DNA, 22 bp, Homo sapiens
agaaaaggcttgaagaggtttt

SEQ ID NO: 7033031 - DNA, 20 bp, Homo sapiens
cagccctgtgacctggccct

SEQ ID NO: 7033032 - DNA, 22 bp, Homo sapiens
tgattctgccctttcttctgac

SEQ ID NO: 7033033 - DNA, 23 bp, Homo sapiens
gccttggcgatccgtggggcatc

SEQ ID NO: 7033034 - DNA, 22 bp, Homo sapiens
tcaggaggcgtgctggggtaca

SEQ ID NO: 7033035 - DNA, 22 bp, Homo sapiens
ctctggaattaaggaagcctgt

SEQ ID NO: 7033036 - DNA, 22 bp, Homo sapiens
ttactgctaattctgtaggttt

SEQ ID NO: 7033037 - DNA, 22 bp, Homo sapiens
catttgtagagtaggaaagagt

SEQ ID NO: 7033038 - DNA, 22 bp, Homo sapiens
gggcagcaaatctgagtctggt

SEQ ID NO: 7033039 - DNA, 22 bp, Homo sapiens
gccagagaggccgaggtaccca

SEQ ID NO: 7033040 - DNA, 22 bp, Homo sapiens
agccaccttctccaaggcctag

SEQ ID NO: 7033041 - DNA, 22 bp, Homo sapiens
catgtcttaggaaagcagagga

SEQ ID NO: 7033042 - DNA, 22 bp, Homo sapiens
tcccatgttaccaaggagtcac

SEQ ID NO: 7033043 - DNA, 22 bp, Homo sapiens
acagacattttaattattaaat

SEQ ID NO: 7033044 - DNA, 21 bp, Homo sapiens
agagctggtaggtaggtaggt

SEQ ID NO: 7033045 - DNA, 22 bp, Homo sapiens
atgtgaaacctgtgagtagagt

SEQ ID NO: 7033046 - DNA, 22 bp, Homo sapiens
acctgcaggtgtttccacactt

SEQ ID NO: 7033047 - DNA, 22 bp, Homo sapiens
tggattgcacctctgcccggaa

SEQ ID NO: 7033048 - DNA, 22 bp, Homo sapiens
tgtggcacagaaagatgaaggg

SEQ ID NO: 7033049 - DNA, 22 bp, Homo sapiens
aaagaagcataggctagacttc

SEQ ID NO: 7033050 - DNA, 22 bp, Homo sapiens
cacattgaaccatatattagtg

SEQ ID NO: 7033051 - DNA, 22 bp, Homo sapiens
gattgtaattctactttccgct

SEQ ID NO: 7033052 - DNA, 22 bp, Homo sapiens
gggctctcgattagaccctggg

SEQ ID NO: 7033053 - DNA, 22 bp, Homo sapiens
gttagagggctgccttttgttt

SEQ ID NO: 7033054 - DNA, 22 bp, Homo sapiens
gtggcagtctcatctgtggctc

SEQ ID NO: 7033055 - DNA, 20 bp, Homo sapiens
agacaatgagtgacagagtt

SEQ ID NO: 7033056 - DNA, 22 bp, Homo sapiens
ttagttcttgggtgaacttttg

SEQ ID NO: 7033057 - DNA, 22 bp, Homo sapiens
gtacccaggcacgccttgctga

SEQ ID NO: 7033058 - DNA, 22 bp, Homo sapiens
ccagctcctgagcatggtttcc

SEQ ID NO: 7033059 - DNA, 22 bp, Homo sapiens
ggctggtctcagtgctgggttc

SEQ ID NO: 7033060 - DNA, 22 bp, Homo sapiens
gaaccagcagttgcctgaaaaa

SEQ ID NO: 7033061 - DNA, 22 bp, Homo sapiens
tcagaactatagtagtttcatg

SEQ ID NO: 7033062 - DNA, 22 bp, Homo sapiens
gccctgtgcgactctagaggtt

SEQ ID NO: 7033063 - DNA, 22 bp, Homo sapiens
tttcttctaggactaataagag

SEQ ID NO: 7033064 - DNA, 22 bp, Homo sapiens
agaggctgtcccttgctattcc

SEQ ID NO: 7033065 - DNA, 22 bp, Homo sapiens
tggcttctggtttatccttata

SEQ ID NO: 7033066 - DNA, 22 bp, Homo sapiens
tccttgaattgtgccacttacc

SEQ ID NO: 7033067 - DNA, 22 bp, Homo sapiens
acttgaatttagtttttcctaa

SEQ ID NO: 7033068 - DNA, 22 bp, Homo sapiens
gtgcattggtgcgccacttcac

SEQ ID NO: 7033069 - DNA, 22 bp, Homo sapiens
cacagtgaattacatagacgtg

SEQ ID NO: 7033070 - DNA, 22 bp, Homo sapiens
acaatgaatttaataccttatt

SEQ ID NO: 7033071 - DNA, 22 bp, Homo sapiens
ttgcatgtgtataaaagttgga

SEQ ID NO: 7033072 - DNA, 22 bp, Homo sapiens
cctgaataatttgtgaaaagat

SEQ ID NO: 7033073 - DNA, 22 bp, Homo sapiens
ctggaaagtagacaatctaaaa

SEQ ID NO: 7033074 - DNA, 22 bp, Homo sapiens
ctgagcctcctgcttctatttc

SEQ ID NO: 7033075 - DNA, 22 bp, Homo sapiens
ttgtgtgtgagccttcaccaca

SEQ ID NO: 7033076 - DNA, 22 bp, Homo sapiens
catgtgtgtctccaccagctgc

SEQ ID NO: 7033077 - DNA, 22 bp, Homo sapiens
tttcttcatagaccttgtcttg

SEQ ID NO: 7033078 - DNA, 22 bp, Homo sapiens
tccaggtagggaataaatgtca

SEQ ID NO: 7033079 - DNA, 22 bp, Homo sapiens
ataggggcagatgaggaatggg

SEQ ID NO: 7033080 - DNA, 22 bp, Homo sapiens
gtttcatgactgatgttgttga

SEQ ID NO: 7033081 - DNA, 22 bp, Homo sapiens
cagtggattaaggagggcagct

SEQ ID NO: 7033082 - DNA, 22 bp, Homo sapiens
tggccagtctgtggaagccagg

SEQ ID NO: 7033083 - DNA, 22 bp, Homo sapiens
ctccctcctcaaatatctttgt

SEQ ID NO: 7033084 - DNA, 22 bp, Homo sapiens
aggcactgacaattctggactg

SEQ ID NO: 7033085 - DNA, 22 bp, Homo sapiens
aggagggttctctggacagagg

SEQ ID NO: 7033086 - DNA, 22 bp, Homo sapiens
agcagtattctcctgtggtgga

SEQ ID NO: 7033087 - DNA, 22 bp, Homo sapiens
aaacaggtctgaaaatagctac

SEQ ID NO: 7033088 - DNA, 22 bp, Homo sapiens
tcaataagtaggatatcaagat

SEQ ID NO: 7033089 - DNA, 22 bp, Homo sapiens
gaggctccatggaggagtatgg

SEQ ID NO: 7033090 - DNA, 22 bp, Homo sapiens
ctacttagagacatgctaacat

SEQ ID NO: 7033091 - DNA, 22 bp, Homo sapiens
ccttgggatttctcatgccaat

SEQ ID NO: 7033092 - DNA, 22 bp, Homo sapiens
tttcctgtgcttaacaaatatt

SEQ ID NO: 7033093 - DNA, 22 bp, Homo sapiens
gtgactctgcattttatggatc

SEQ ID NO: 7033094 - DNA, 23 bp, Homo sapiens
tgcctctgcctccctagtctgca

SEQ ID NO: 7033095 - DNA, 19 bp, Homo sapiens
tgctgactgagctgcaaaa

SEQ ID NO: 7033096 - DNA, 21 bp, Homo sapiens
tgtcagagcttgtaggacatt

SEQ ID NO: 7033097 - DNA, 22 bp, Homo sapiens
atgttaaaagtgaggatggcca

SEQ ID NO: 7033098 - DNA, 22 bp, Homo sapiens
gagaacagaagcattcctaatt

SEQ ID NO: 7033099 - DNA, 22 bp, Homo sapiens
ctatttggccaagctgcccaca

SEQ ID NO: 7033100 - DNA, 22 bp, Homo sapiens
taggactgataaggggccagag

SEQ ID NO: 7033101 - DNA, 22 bp, Homo sapiens
gttgcatttagttatctgtctg

SEQ ID NO: 7033102 - DNA, 22 bp, Homo sapiens
ctcaaaggtattttagctcaca

SEQ ID NO: 7033103 - DNA, 22 bp, Homo sapiens
tgctctggtaactcacttccat

SEQ ID NO: 7033104 - DNA, 22 bp, Homo sapiens
ctgtgatatactcccaagagga

SEQ ID NO: 7033105 - DNA, 22 bp, Homo sapiens
ttctgggccaatctcttaatct

SEQ ID NO: 7033106 - DNA, 22 bp, Homo sapiens
tgttaaggtcctgacttctgca

SEQ ID NO: 7033107 - DNA, 22 bp, Homo sapiens
caagcgtctaattgggggttgc

SEQ ID NO: 7033108 - DNA, 22 bp, Homo sapiens
tctgaacagcatggaatcattt

SEQ ID NO: 7033109 - DNA, 22 bp, Homo sapiens
caatgtatcaagaagcatcagt

SEQ ID NO: 7033110 - DNA, 20 bp, Homo sapiens
gtgcctggagaagaggctgt

SEQ ID NO: 7033111 - DNA, 22 bp, Homo sapiens
tgaggtgataataactccctgc

SEQ ID NO: 7033112 - DNA, 22 bp, Homo sapiens
attcagtgacctaattacttac

SEQ ID NO: 7033113 - DNA, 22 bp, Homo sapiens
ctgtcaggggcgggtggagcgg

SEQ ID NO: 7033114 - DNA, 22 bp, Homo sapiens
aggcaatgcagatagatgaatg

SEQ ID NO: 7033115 - DNA, 22 bp, Homo sapiens
aatgactaataagttttactgt

SEQ ID NO: 7033116 - DNA, 22 bp, Homo sapiens
ttcaggctatagaccaatttgg

SEQ ID NO: 7033117 - DNA, 22 bp, Homo sapiens
gtcagtgtggttgctggcttgg

SEQ ID NO: 7033118 - DNA, 22 bp, Homo sapiens
cttccagtggttctggagggag

SEQ ID NO: 7033119 - DNA, 22 bp, Homo sapiens
ggcttcaccgcggggttgcagg

SEQ ID NO: 7033120 - DNA, 22 bp, Homo sapiens
gaaacagtgagaacttttcctg

SEQ ID NO: 7033121 - DNA, 22 bp, Homo sapiens
tcaagtagtacccaatgcgtgg

SEQ ID NO: 7033122 - DNA, 19 bp, Homo sapiens
taagtatgtactatcttgc

SEQ ID NO: 7033123 - DNA, 22 bp, Homo sapiens
tcacttgacccttctctagcct

SEQ ID NO: 7033124 - DNA, 22 bp, Homo sapiens
ttgcttgatgcttatatacttg

SEQ ID NO: 7033125 - DNA, 23 bp, Homo sapiens
atagactgatttggatgtgaaag

SEQ ID NO: 7033126 - DNA, 22 bp, Homo sapiens
atttcctgatttgtaaaattcc

SEQ ID NO: 7033127 - DNA, 22 bp, Homo sapiens
acaagttttggaagtcttaagg

SEQ ID NO: 7033128 - DNA, 22 bp, Homo sapiens
gaaggcttctccagggcttact

SEQ ID NO: 7033129 - DNA, 22 bp, Homo sapiens
tctaacagaaattctgacaaaa

SEQ ID NO: 7033130 - DNA, 22 bp, Homo sapiens
gcctgtccccaggagagtccgg

SEQ ID NO: 7033131 - DNA, 22 bp, Homo sapiens
tcaatgtctgcggctagctgga

SEQ ID NO: 7033132 - DNA, 23 bp, Homo sapiens
agggaacaagcaagctgctagtc

SEQ ID NO: 7033133 - DNA, 20 bp, Homo sapiens
gtggcagtggtggcagcagt

SEQ ID NO: 7033134 - DNA, 19 bp, Homo sapiens
tctttagccagagctctgg

SEQ ID NO: 7033135 - DNA, 22 bp, Homo sapiens
tcacactggcagtgctgaaggc

SEQ ID NO: 7033136 - DNA, 22 bp, Homo sapiens
tccagagcctttctgcttgaca

SEQ ID NO: 7033137 - DNA, 22 bp, Homo sapiens
agagatgcatctcttaaaattg

SEQ ID NO: 7033138 - DNA, 22 bp, Homo sapiens
ttcagtataaaatcaaagtgat

SEQ ID NO: 7033139 - DNA, 22 bp, Homo sapiens
taacccaaaggcaatgtctcga

SEQ ID NO: 7033140 - DNA, 22 bp, Homo sapiens
tacatgtaagacatgagactct

SEQ ID NO: 7033141 - DNA, 22 bp, Homo sapiens
aaggtctgttgagtgaatagta

SEQ ID NO: 7033142 - DNA, 19 bp, Homo sapiens
ctcctggctctgtcatttt

SEQ ID NO: 7033143 - DNA, 22 bp, Homo sapiens
ctggctctgtgggacctggcct

SEQ ID NO: 7033144 - DNA, 21 bp, Homo sapiens
agaaaagtatttgaatcaaga

SEQ ID NO: 7033145 - DNA, 22 bp, Homo sapiens
aagtgcttctgggattaggagt

SEQ ID NO: 7033146 - DNA, 22 bp, Homo sapiens
atctgtcttttaatgttaatgc

SEQ ID NO: 7033147 - DNA, 22 bp, Homo sapiens
gcagctgctgggatcatttagg

SEQ ID NO: 7033148 - DNA, 22 bp, Homo sapiens
gtggcacatgctgctgcttctg

SEQ ID NO: 7033149 - DNA, 22 bp, Homo sapiens
gagcacgttgaagcgcactgtc

SEQ ID NO: 7033150 - DNA, 22 bp, Homo sapiens
ctggcctcacagaggctaagcc

SEQ ID NO: 7033151 - DNA, 22 bp, Homo sapiens
tcacagttctagaggtaagcag

SEQ ID NO: 7033152 - DNA, 22 bp, Homo sapiens
ggtggtggagccagctgggagt

SEQ ID NO: 7033153 - DNA, 22 bp, Homo sapiens
ctccagctagggctggcttact

SEQ ID NO: 7033154 - DNA, 22 bp, Homo sapiens
ttactttgcttcaggaagagga

SEQ ID NO: 7033155 - DNA, 22 bp, Homo sapiens
tgtctcctgagagctggacaga

SEQ ID NO: 7033156 - DNA, 22 bp, Homo sapiens
tggcttcctgcacagtgtctgc

SEQ ID NO: 7033157 - DNA, 22 bp, Homo sapiens
tgagtggacgtgaggctgagta

SEQ ID NO: 7033158 - DNA, 22 bp, Homo sapiens
tttaagagttaaactttgacct

SEQ ID NO: 7033159 - DNA, 22 bp, Homo sapiens
ttaattgggtgcaacagctgaa

SEQ ID NO: 7033160 - DNA, 22 bp, Homo sapiens
tccttgaggaggtgacactgga

SEQ ID NO: 7033161 - DNA, 22 bp, Homo sapiens
aagttgctagtgcttttctgag

SEQ ID NO: 7033162 - DNA, 21 bp, Homo sapiens
agcttgtgtgtatcacagtgt

SEQ ID NO: 7033163 - DNA, 22 bp, Homo sapiens
aggtgggcaccaggcttgtggt

SEQ ID NO: 7033164 - DNA, 22 bp, Homo sapiens
gtgccagccgcaccccaggaga

SEQ ID NO: 7033165 - DNA, 22 bp, Homo sapiens
ttcttctagagttcagaagcca

SEQ ID NO: 7033166 - DNA, 20 bp, Homo sapiens
tgtcagcaattaggagaaaa

SEQ ID NO: 7033167 - DNA, 22 bp, Homo sapiens
aaggatctgacagactatagaa

SEQ ID NO: 7033168 - DNA, 22 bp, Homo sapiens
ttcacagagcttgttcatggcc

SEQ ID NO: 7033169 - DNA, 22 bp, Homo sapiens
tttccagtgagcaaatgtagaa

SEQ ID NO: 7033170 - DNA, 22 bp, Homo sapiens
atggggagctcaccacctgttt

SEQ ID NO: 7033171 - DNA, 22 bp, Homo sapiens
tttgggcatatagctgttccct

SEQ ID NO: 7033172 - DNA, 22 bp, Homo sapiens
ctgtcctgggggtggtccttgc

SEQ ID NO: 7033173 - DNA, 22 bp, Homo sapiens
tgacctctgtcctgcagtctgg

SEQ ID NO: 7033174 - DNA, 22 bp, Homo sapiens
tgacagttcaggtcagatttat

SEQ ID NO: 7033175 - DNA, 22 bp, Homo sapiens
aagccagtgtttttgagagttg

SEQ ID NO: 7033176 - DNA, 22 bp, Homo sapiens
gctgcaggcgcctgcggtctct

SEQ ID NO: 7033177 - DNA, 22 bp, Homo sapiens
aagaaagtgtggagagcctagc

SEQ ID NO: 7033178 - DNA, 22 bp, Homo sapiens
gcaggtgtggagagtggtcggg

SEQ ID NO: 7033179 - DNA, 22 bp, Homo sapiens
ggagccagctccctccttgtga

SEQ ID NO: 7033180 - DNA, 20 bp, Homo sapiens
gcaaggcaggttgaccaaga

SEQ ID NO: 7033181 - DNA, 22 bp, Homo sapiens
cctgatggctgtctgggcctga

SEQ ID NO: 7033182 - DNA, 22 bp, Homo sapiens
aaggcactgaaaaattgtgtgt

SEQ ID NO: 7033183 - DNA, 23 bp, Homo sapiens
aaactacaacgccaggcactgag

SEQ ID NO: 7033184 - DNA, 22 bp, Homo sapiens
gggcatgtcccgctgtgcaccg

SEQ ID NO: 7033185 - DNA, 22 bp, Homo sapiens
acactctttttgtggttgtcta

SEQ ID NO: 7033186 - DNA, 22 bp, Homo sapiens
gtttaaagtagcttccttttgg

SEQ ID NO: 7033187 - DNA, 22 bp, Homo sapiens
attaaggctcccatttccaatt

SEQ ID NO: 7033188 - DNA, 22 bp, Homo sapiens
attgccctctggctgacaggct

SEQ ID NO: 7033189 - DNA, 22 bp, Homo sapiens
tgaatgcaaatcatgattgtaa

SEQ ID NO: 7033190 - DNA, 22 bp, Homo sapiens
gctccctgtgggatgaggcgcc

SEQ ID NO: 7033191 - DNA, 22 bp, Homo sapiens
actgtactccagcctgggggac

SEQ ID NO: 7033192 - DNA, 19 bp, Homo sapiens
cttcattcttcagcttttg

SEQ ID NO: 7033193 - DNA, 22 bp, Homo sapiens
cttggaattgatgattttcata

SEQ ID NO: 7033194 - DNA, 22 bp, Homo sapiens
gatatttaactctcacaggtcc

SEQ ID NO: 7033195 - DNA, 18 bp, Homo sapiens
gcctgggagaagtttcac

SEQ ID NO: 7033196 - DNA, 22 bp, Homo sapiens
aggcactggtccattttctgca

SEQ ID NO: 7033197 - DNA, 22 bp, Homo sapiens
agagtaatattctccgaggtga

SEQ ID NO: 7033198 - DNA, 20 bp, Homo sapiens
tgttgggatgaagttaacct

SEQ ID NO: 7033199 - DNA, 21 bp, Homo sapiens
ggagcctctggcagggggcca

SEQ ID NO: 7033200 - DNA, 22 bp, Homo sapiens
ctgccttaaaagtacttttact

SEQ ID NO: 7033201 - DNA, 22 bp, Homo sapiens
agtgtatttgtctggcttctcc

SEQ ID NO: 7033202 - DNA, 22 bp, Homo sapiens
acatagagcattggatatggga

SEQ ID NO: 7033203 - DNA, 22 bp, Homo sapiens
atgctttatacaaaacacttaa

SEQ ID NO: 7033204 - DNA, 22 bp, Homo sapiens
catggccagattctttcttctc

SEQ ID NO: 7033205 - DNA, 22 bp, Homo sapiens
tgtggctctcagatcctccaat

SEQ ID NO: 7033206 - DNA, 22 bp, Homo sapiens
ggaacttatactgccagattct

SEQ ID NO: 7033207 - DNA, 22 bp, Homo sapiens
tcaaagcagcacattcgcaagc

SEQ ID NO: 7033208 - DNA, 23 bp, Homo sapiens
ggtggtggtgagtcacgggctca

SEQ ID NO: 7033209 - DNA, 22 bp, Homo sapiens
cctcagctcccatgagatctgc

SEQ ID NO: 7033210 - DNA, 22 bp, Homo sapiens
tctgagggttactttattaggc

SEQ ID NO: 7033211 - DNA, 19 bp, Homo sapiens
gccctgagtaagctaggag

SEQ ID NO: 7033212 - DNA, 22 bp, Homo sapiens
tggcattgctgtagtgtcagaa

SEQ ID NO: 7033213 - DNA, 22 bp, Homo sapiens
gggccagtgggacctgggtctc

SEQ ID NO: 7033214 - DNA, 22 bp, Homo sapiens
caggcacactgtctacactgag

SEQ ID NO: 7033215 - DNA, 22 bp, Homo sapiens
ttggactgaatctttctcacac

SEQ ID NO: 7033216 - DNA, 22 bp, Homo sapiens
tgggtaaactgggtctggagag

SEQ ID NO: 7033217 - DNA, 22 bp, Homo sapiens
aaagtcacaatattggaaggtg

SEQ ID NO: 7033218 - DNA, 19 bp, Homo sapiens
aggagaagactctctcccc

SEQ ID NO: 7033219 - DNA, 22 bp, Homo sapiens
gaggaggttgacggcactgtga

SEQ ID NO: 7033220 - DNA, 22 bp, Homo sapiens
cagcactgtgataactgagcca

SEQ ID NO: 7033221 - DNA, 19 bp, Homo sapiens
agagacacaggtaagtagg

SEQ ID NO: 7033222 - DNA, 22 bp, Homo sapiens
tgcatttgaagtcagacaggct

SEQ ID NO: 7033223 - DNA, 22 bp, Homo sapiens
tctgaacaagggcaccttccag

SEQ ID NO: 7033224 - DNA, 22 bp, Homo sapiens
tctgagcccagtgagtctcgca

SEQ ID NO: 7033225 - DNA, 22 bp, Homo sapiens
ttgaaagggatatatctttctg

SEQ ID NO: 7033226 - DNA, 22 bp, Homo sapiens
ccaggaaggtgtttaactagag

SEQ ID NO: 7033227 - DNA, 22 bp, Homo sapiens
ggagtcttcagatagagtattt

SEQ ID NO: 7033228 - DNA, 20 bp, Homo sapiens
tttgactaggtaagtgcttt

SEQ ID NO: 7033229 - DNA, 22 bp, Homo sapiens
ttgtttgtatgctgagaagaat

SEQ ID NO: 7033230 - DNA, 22 bp, Homo sapiens
aaacactttaagtgaggaggat

SEQ ID NO: 7033231 - DNA, 22 bp, Homo sapiens
tggtggcatgatagtgtgaatg

SEQ ID NO: 7033232 - DNA, 22 bp, Homo sapiens
gctggcagggtggttgagagag

SEQ ID NO: 7033233 - DNA, 22 bp, Homo sapiens
gagacctggaggatgtggatgg

SEQ ID NO: 7033234 - DNA, 22 bp, Homo sapiens
aaatgtgggtaatgggactgga

SEQ ID NO: 7033235 - DNA, 22 bp, Homo sapiens
tcagacatcgtaattacacaat

SEQ ID NO: 7033236 - DNA, 22 bp, Homo sapiens
atagaacaaggtagacagcttt

SEQ ID NO: 7033237 - DNA, 20 bp, Homo sapiens
tgctgcagacagggccattg

SEQ ID NO: 7033238 - DNA, 17 bp, Homo sapiens
tgtgtagagcatcgcca

SEQ ID NO: 7033239 - DNA, 22 bp, Homo sapiens
tttggtcctatgagcaagtttc

SEQ ID NO: 7033240 - DNA, 22 bp, Homo sapiens
tctgccctgcagggagcagtaa

SEQ ID NO: 7033241 - DNA, 22 bp, Homo sapiens
cagtgagagtatttgtgctaag

SEQ ID NO: 7033242 - DNA, 22 bp, Homo sapiens
tgcaggagggagggttacagtt

SEQ ID NO: 7033243 - DNA, 22 bp, Homo sapiens
ggcagcttttccaggctctcca

SEQ ID NO: 7033244 - DNA, 22 bp, Homo sapiens
aggatttactagcaaggattct

SEQ ID NO: 7033245 - DNA, 22 bp, Homo sapiens
aggagtgttccatccaagccct

SEQ ID NO: 7033246 - DNA, 22 bp, Homo sapiens
gccttaattagtaacagaccat

SEQ ID NO: 7033247 - DNA, 22 bp, Homo sapiens
gctgtacattctgtgggtttgg

SEQ ID NO: 7033248 - DNA, 22 bp, Homo sapiens
gtctgttttctcttctgtggga

SEQ ID NO: 7033249 - DNA, 22 bp, Homo sapiens
ctggccactggtggtcataggc

SEQ ID NO: 7033250 - DNA, 22 bp, Homo sapiens
atccaaatcttcacacataaca

SEQ ID NO: 7033251 - DNA, 22 bp, Homo sapiens
gcacacatgcgtgtatatgggt

SEQ ID NO: 7033252 - DNA, 22 bp, Homo sapiens
atatgcacatacatacataggt

SEQ ID NO: 7033253 - DNA, 22 bp, Homo sapiens
cccagcatctccaggcatggcc

SEQ ID NO: 7033254 - DNA, 20 bp, Homo sapiens
ttgattcaagggctgatgga

SEQ ID NO: 7033255 - DNA, 22 bp, Homo sapiens
actgccattggtcaaatgagtg

SEQ ID NO: 7033256 - DNA, 18 bp, Homo sapiens
tgcctggaaggaacagga

SEQ ID NO: 7033257 - DNA, 22 bp, Homo sapiens
tgggaaggcgtggaagtagaag

SEQ ID NO: 7033258 - DNA, 22 bp, Homo sapiens
ctttcagatagtctgagatata

SEQ ID NO: 7033259 - DNA, 22 bp, Homo sapiens
aaggcagcctttgtttgattga

SEQ ID NO: 7033260 - DNA, 22 bp, Homo sapiens
tttcacaggccttttgtagccc

SEQ ID NO: 7033261 - DNA, 22 bp, Homo sapiens
tcctctgctggaagggcaagag

SEQ ID NO: 7033262 - DNA, 22 bp, Homo sapiens
acccccttcgcacactctttca

SEQ ID NO: 7033263 - DNA, 22 bp, Homo sapiens
tagcgcaatgagagagcggtgc

SEQ ID NO: 7033264 - DNA, 22 bp, Homo sapiens
ttcagatgtggctttgtcaggc

SEQ ID NO: 7033265 - DNA, 22 bp, Homo sapiens
ctgggctctggggtcccggtgc

SEQ ID NO: 7033266 - DNA, 22 bp, Homo sapiens
tctggtccccattccaggtggg

SEQ ID NO: 7033267 - DNA, 22 bp, Homo sapiens
gactgggcagccggtagggaag

SEQ ID NO: 7033268 - DNA, 22 bp, Homo sapiens
ttgtaagtcacaccagggcagg

SEQ ID NO: 7033269 - DNA, 22 bp, Homo sapiens
tggaaatagctccagtttcatt

SEQ ID NO: 7033270 - DNA, 22 bp, Homo sapiens
accagaaaggaataatagaatt

SEQ ID NO: 7033271 - DNA, 22 bp, Homo sapiens
gctgcctttgtgagccaagggg

SEQ ID NO: 7033272 - DNA, 22 bp, Homo sapiens
ggtttaagacaggcttcacagt

SEQ ID NO: 7033273 - DNA, 22 bp, Homo sapiens
ggcagaatggaaagatatcata

SEQ ID NO: 7033274 - DNA, 22 bp, Homo sapiens
gaaattcaaaatgtcagtatag

SEQ ID NO: 7033275 - DNA, 22 bp, Homo sapiens
ttgagtctcctcagcagggcta

SEQ ID NO: 7033276 - DNA, 22 bp, Homo sapiens
tgagccaggttttccatcattc

SEQ ID NO: 7033277 - DNA, 22 bp, Homo sapiens
caggagtgagatgcgatcactt

SEQ ID NO: 7033278 - DNA, 22 bp, Homo sapiens
cacttccagagtctgggctggg

SEQ ID NO: 7033279 - DNA, 22 bp, Homo sapiens
agtcttttattcaaggctaagt

SEQ ID NO: 7033280 - DNA, 22 bp, Homo sapiens
cctgaccagcaggacgggggca

SEQ ID NO: 7033281 - DNA, 22 bp, Homo sapiens
aaagatttcagaagcctgtgcc

SEQ ID NO: 7033282 - DNA, 19 bp, Homo sapiens
caggaacatggagggaggg

SEQ ID NO: 7033283 - DNA, 19 bp, Homo sapiens
atgtcactcatgttccctg

SEQ ID NO: 7033284 - DNA, 17 bp, Homo sapiens
tctggccttcctgaact

SEQ ID NO: 7033285 - DNA, 22 bp, Homo sapiens
gcaagttggagactcatgagaa

SEQ ID NO: 7033286 - DNA, 22 bp, Homo sapiens
gagggtgtctgcgtaactggca

SEQ ID NO: 7033287 - DNA, 22 bp, Homo sapiens
gggcaggtggcctcttgtacta

SEQ ID NO: 7033288 - DNA, 22 bp, Homo sapiens
atactggagaagccaagaagcc

SEQ ID NO: 7033289 - DNA, 22 bp, Homo sapiens
tcctggagaatggacaatgcac

SEQ ID NO: 7033290 - DNA, 22 bp, Homo sapiens
cttggcctgcaggcagcagcgc

SEQ ID NO: 7033291 - DNA, 22 bp, Homo sapiens
ctcagaggaggcagggtgtgcc

SEQ ID NO: 7033292 - DNA, 22 bp, Homo sapiens
ccccttttcgcttggcctcatc

SEQ ID NO: 7033293 - DNA, 22 bp, Homo sapiens
tcagaggatcatgtccctactc

SEQ ID NO: 7033294 - DNA, 22 bp, Homo sapiens
ttcagtcttgttgaaaacttgg

SEQ ID NO: 7033295 - DNA, 23 bp, Homo sapiens
atggagctggtactagctacctc

SEQ ID NO: 7033296 - DNA, 22 bp, Homo sapiens
tctggctcatctctccaggtaa

SEQ ID NO: 7033297 - DNA, 22 bp, Homo sapiens
gctgctttctgttaggaattgg

SEQ ID NO: 7033298 - DNA, 19 bp, Homo sapiens
ttcatgtttgtagatggtg

SEQ ID NO: 7033299 - DNA, 22 bp, Homo sapiens
cccagtggtttgcagaaccaag

SEQ ID NO: 7033300 - DNA, 17 bp, Homo sapiens
gaacagtgtaagacact

SEQ ID NO: 7033301 - DNA, 22 bp, Homo sapiens
cctggccatagggcccaggaaa

SEQ ID NO: 7033302 - DNA, 23 bp, Homo sapiens
tcttggctggacaagtcactcac

SEQ ID NO: 7033303 - DNA, 22 bp, Homo sapiens
atctttctctgcactatacaat

SEQ ID NO: 7033304 - DNA, 22 bp, Homo sapiens
gagatgatatacaggcttttgg

SEQ ID NO: 7033305 - DNA, 22 bp, Homo sapiens
attctgtgactaccgtcccaca

SEQ ID NO: 7033306 - DNA, 22 bp, Homo sapiens
tacagttaagctactggagaat

SEQ ID NO: 7033307 - DNA, 22 bp, Homo sapiens
taccttggaaatgctagagtaa

SEQ ID NO: 7033308 - DNA, 22 bp, Homo sapiens
ttgacttcccagacttgtgttt

SEQ ID NO: 7033309 - DNA, 22 bp, Homo sapiens
gtgcattccaaggcactttaga

SEQ ID NO: 7033310 - DNA, 22 bp, Homo sapiens
tttataatagatttggggcggc

SEQ ID NO: 7033311 - DNA, 21 bp, Homo sapiens
ggattttaaaaactgcacctg

SEQ ID NO: 7033312 - DNA, 22 bp, Homo sapiens
tcaagacagggtttaaggttga

SEQ ID NO: 7033313 - DNA, 22 bp, Homo sapiens
cagcactggggccactggagtt

SEQ ID NO: 7033314 - DNA, 22 bp, Homo sapiens
ttaagaagtgagtagaagtaat

SEQ ID NO: 7033315 - DNA, 22 bp, Homo sapiens
gggcaagtccggtgcccagagc

SEQ ID NO: 7033316 - DNA, 22 bp, Homo sapiens
aacttcattcctttttatgact

SEQ ID NO: 7033317 - DNA, 22 bp, Homo sapiens
gtgggtgatgtactggaggcca

SEQ ID NO: 7033318 - DNA, 22 bp, Homo sapiens
tctaagcccccgcaccgcagga

SEQ ID NO: 7033319 - DNA, 22 bp, Homo sapiens
ctaagaggaagtactctgttat

SEQ ID NO: 7033320 - DNA, 22 bp, Homo sapiens
caattctgcaagtgactgacct

SEQ ID NO: 7033321 - DNA, 22 bp, Homo sapiens
tatgtataatcacagagtgtca

SEQ ID NO: 7033322 - DNA, 22 bp, Homo sapiens
catcagtttggtcaatgatggg

SEQ ID NO: 7033323 - DNA, 22 bp, Homo sapiens
aagtcacttcttaggaaaggag

SEQ ID NO: 7033324 - DNA, 22 bp, Homo sapiens
caaggccatgagcagcgagtgt

SEQ ID NO: 7033325 - DNA, 22 bp, Homo sapiens
atttctcagtgaaatgacaggc

SEQ ID NO: 7033326 - DNA, 22 bp, Homo sapiens
ggtcgctccttcactttcacaa

SEQ ID NO: 7033327 - DNA, 22 bp, Homo sapiens
ggagggagtcagctgattagaa

SEQ ID NO: 7033328 - DNA, 22 bp, Homo sapiens
ttctggagatgacttttagaaa

SEQ ID NO: 7033329 - DNA, 22 bp, Homo sapiens
gatacacattttagctttgtct

SEQ ID NO: 7033330 - DNA, 22 bp, Homo sapiens
tcctcccctgcccatgaggagg

SEQ ID NO: 7033331 - DNA, 22 bp, Homo sapiens
ttgcttcactacttctaggctc

SEQ ID NO: 7033332 - DNA, 22 bp, Homo sapiens
agcacttaactgacagtactat

SEQ ID NO: 7033333 - DNA, 23 bp, Homo sapiens
agccacttctatcttgctcctgg

SEQ ID NO: 7033334 - DNA, 22 bp, Homo sapiens
tcagaatgggccttcctgtccc

SEQ ID NO: 7033335 - DNA, 22 bp, Homo sapiens
tacatgaagaaaattaagcagt

SEQ ID NO: 7033336 - DNA, 22 bp, Homo sapiens
acaatgtaggctgaaaaagctt

SEQ ID NO: 7033337 - DNA, 22 bp, Homo sapiens
ctggaatgagagcccggggatc

SEQ ID NO: 7033338 - DNA, 16 bp, Homo sapiens
ctgacctgtgcactgt

SEQ ID NO: 7033339 - DNA, 22 bp, Homo sapiens
tgttcacaagcagatgttgctt

SEQ ID NO: 7033340 - DNA, 21 bp, Homo sapiens
gcaaatgagttaactaactca

SEQ ID NO: 7033341 - DNA, 22 bp, Homo sapiens
gtcaaacatagggactttgtgg

SEQ ID NO: 7033342 - DNA, 22 bp, Homo sapiens
aggaaataggaccagacaaagc

SEQ ID NO: 7033343 - DNA, 22 bp, Homo sapiens
cctattcagtccttcaaggagg

SEQ ID NO: 7033344 - DNA, 22 bp, Homo sapiens
ctttcttcatcaagtgccacgt

SEQ ID NO: 7033345 - DNA, 22 bp, Homo sapiens
gtcacacagggcctccaaatca

SEQ ID NO: 7033346 - DNA, 22 bp, Homo sapiens
cctctgggcaggtagcagcagc

SEQ ID NO: 7033347 - DNA, 22 bp, Homo sapiens
tctcagagagctgtgttttcct

SEQ ID NO: 7033348 - DNA, 22 bp, Homo sapiens
tgtagcacaagatagatacttc

SEQ ID NO: 7033349 - DNA, 22 bp, Homo sapiens
taaagataagacatcaactgag

SEQ ID NO: 7033350 - DNA, 22 bp, Homo sapiens
gtgagcatatatgtaatcgttt

SEQ ID NO: 7033351 - DNA, 22 bp, Homo sapiens
aaaatctgcttccttttacaga

SEQ ID NO: 7033352 - DNA, 22 bp, Homo sapiens
tatttgaatcctggttcttcag

SEQ ID NO: 7033353 - DNA, 22 bp, Homo sapiens
taatgaggcatttgagtcacct

SEQ ID NO: 7033354 - DNA, 22 bp, Homo sapiens
tggccactggcttccactgagt

SEQ ID NO: 7033355 - DNA, 22 bp, Homo sapiens
ctggtcactgagttggcaaagt

SEQ ID NO: 7033356 - DNA, 22 bp, Homo sapiens
gtgatttagtgagaggcagctg

SEQ ID NO: 7033357 - DNA, 22 bp, Homo sapiens
ctgcggtgggctgggctgtccc

SEQ ID NO: 7033358 - DNA, 22 bp, Homo sapiens
cctctggccagagaaaggccag

SEQ ID NO: 7033359 - DNA, 22 bp, Homo sapiens
aagcaatagggtaatctactca

SEQ ID NO: 7033360 - DNA, 22 bp, Homo sapiens
ctgcagcctcctggggtacatg

SEQ ID NO: 7033361 - DNA, 22 bp, Homo sapiens
agaaactgcagctcagagaagt

SEQ ID NO: 7033362 - DNA, 22 bp, Homo sapiens
gcagctggggccacacttaggc

SEQ ID NO: 7033363 - DNA, 22 bp, Homo sapiens
atatcaaagctagtggaaattt

SEQ ID NO: 7033364 - DNA, 22 bp, Homo sapiens
ttggttcattttctcatctaga

SEQ ID NO: 7033365 - DNA, 22 bp, Homo sapiens
aaagattgaaagagaatttgtc

SEQ ID NO: 7033366 - DNA, 22 bp, Homo sapiens
ctgctggaatctttaagctgga

SEQ ID NO: 7033367 - DNA, 22 bp, Homo sapiens
taggaagaaactttccctgcag

SEQ ID NO: 7033368 - DNA, 22 bp, Homo sapiens
agtcctttgctgaactgtcaca

SEQ ID NO: 7033369 - DNA, 22 bp, Homo sapiens
tgtttccaactgtgatcttact

SEQ ID NO: 7033370 - DNA, 22 bp, Homo sapiens
ttctgggacatctggacagttt

SEQ ID NO: 7033371 - DNA, 22 bp, Homo sapiens
gggtaattggaaatattaatag

SEQ ID NO: 7033372 - DNA, 22 bp, Homo sapiens
ttacagaatgtgccatttggtc

SEQ ID NO: 7033373 - DNA, 20 bp, Homo sapiens
gccaggagggtgtgatgagc

SEQ ID NO: 7033374 - DNA, 22 bp, Homo sapiens
aagcagatgggactccaaggca

SEQ ID NO: 7033375 - DNA, 22 bp, Homo sapiens
aatagtgcaatgttgttgaagt

SEQ ID NO: 7033376 - DNA, 22 bp, Homo sapiens
ttgtgtgataagtctcttgtgc

SEQ ID NO: 7033377 - DNA, 22 bp, Homo sapiens
taacatcaaacatgttttaaag

SEQ ID NO: 7033378 - DNA, 22 bp, Homo sapiens
ggagctctatctgggagttctt

SEQ ID NO: 7033379 - DNA, 22 bp, Homo sapiens
ttgggctgaaccctgcagctga

SEQ ID NO: 7033380 - DNA, 22 bp, Homo sapiens
atacagtcttcatattaagttt

SEQ ID NO: 7033381 - DNA, 22 bp, Homo sapiens
agcgcggctcagcctggaaacc

SEQ ID NO: 7033382 - DNA, 22 bp, Homo sapiens
ggggcttccagcgcccgccggt

SEQ ID NO: 7033383 - DNA, 22 bp, Homo sapiens
tacaaagaggtaattgcatata

SEQ ID NO: 7033384 - DNA, 22 bp, Homo sapiens
gcagtgtttggatccatagcga

SEQ ID NO: 7033385 - DNA, 22 bp, Homo sapiens
tctggatttgtggaaaatctgc

SEQ ID NO: 7033386 - DNA, 22 bp, Homo sapiens
gctgcctccgccggctccacag

SEQ ID NO: 7033387 - DNA, 22 bp, Homo sapiens
agtcattttgctaaatgagggt

SEQ ID NO: 7033388 - DNA, 22 bp, Homo sapiens
tgtttatcttaaatccactggg

SEQ ID NO: 7033389 - DNA, 22 bp, Homo sapiens
gtcctgggcatgcagggctttc

SEQ ID NO: 7033390 - DNA, 22 bp, Homo sapiens
acctctcaggtcttcctcatat

SEQ ID NO: 7033391 - DNA, 22 bp, Homo sapiens
ggaggccaaggcaggcggatca

SEQ ID NO: 7033392 - DNA, 22 bp, Homo sapiens
atgacagttctttagagatgta

SEQ ID NO: 7033393 - DNA, 22 bp, Homo sapiens
tgccctgtgtgtgcaagcactg

SEQ ID NO: 7033394 - DNA, 22 bp, Homo sapiens
tattaggttggtgcaaaagtca

SEQ ID NO: 7033395 - DNA, 22 bp, Homo sapiens
tcctgcgagtgcgcttttggtc

SEQ ID NO: 7033396 - DNA, 19 bp, Homo sapiens
tctaacagaagtgtcgtcc

SEQ ID NO: 7033397 - DNA, 22 bp, Homo sapiens
tcgtatgctctctgtgtcctgt

SEQ ID NO: 7033398 - DNA, 22 bp, Homo sapiens
agcagctggtgagcaagctcag

SEQ ID NO: 7033399 - DNA, 22 bp, Homo sapiens
ttagtaattagaaagtaattct

SEQ ID NO: 7033400 - DNA, 22 bp, Homo sapiens
attgcattgcagctagattttg

SEQ ID NO: 7033401 - DNA, 22 bp, Homo sapiens
tggggccatctcacccactgtt

SEQ ID NO: 7033402 - DNA, 22 bp, Homo sapiens
ggcactgccccctgcccaggac

SEQ ID NO: 7033403 - DNA, 22 bp, Homo sapiens
aactttctttcacagaagtatc

SEQ ID NO: 7033404 - DNA, 22 bp, Homo sapiens
cctgtgggaggttctgtgagtc

SEQ ID NO: 7033405 - DNA, 22 bp, Homo sapiens
aatgggtagttttggaatatga

SEQ ID NO: 7033406 - DNA, 22 bp, Homo sapiens
ctactgttattattaatagtaa

SEQ ID NO: 7033407 - DNA, 22 bp, Homo sapiens
tgaaatgaagggcttgttctgg

SEQ ID NO: 7033408 - DNA, 22 bp, Homo sapiens
gcaagatgttaacatagggaga

SEQ ID NO: 7033409 - DNA, 22 bp, Homo sapiens
ttctgtggaatatgaactagca

SEQ ID NO: 7033410 - DNA, 22 bp, Homo sapiens
agccgagagtatttgccagagc

SEQ ID NO: 7033411 - DNA, 22 bp, Homo sapiens
agctttgcctgctgacattctg

SEQ ID NO: 7033412 - DNA, 22 bp, Homo sapiens
tgcatgttccaactccatcact

SEQ ID NO: 7033413 - DNA, 22 bp, Homo sapiens
ttccacggtggcaaaggctgga

SEQ ID NO: 7033414 - DNA, 22 bp, Homo sapiens
attcttcctcatcaatctgtag

SEQ ID NO: 7033415 - DNA, 19 bp, Homo sapiens
cagcacatgcttctctgag

SEQ ID NO: 7033416 - DNA, 22 bp, Homo sapiens
tgacaagttggaaagcagtgca

SEQ ID NO: 7033417 - DNA, 22 bp, Homo sapiens
gggcacaccttgtctgagcaca

SEQ ID NO: 7033418 - DNA, 22 bp, Homo sapiens
acccagtgagcccgaccgatgg

SEQ ID NO: 7033419 - DNA, 22 bp, Homo sapiens
tctgtcataaacacacacaagc

SEQ ID NO: 7033420 - DNA, 22 bp, Homo sapiens
ctgagctgtgctaagtgaaatg

SEQ ID NO: 7033421 - DNA, 22 bp, Homo sapiens
tccagttagtgggcaaaattta

SEQ ID NO: 7033422 - DNA, 22 bp, Homo sapiens
caggaacacaagttcagggatg

SEQ ID NO: 7033423 - DNA, 20 bp, Homo sapiens
agcaagagtgtacctggcca

SEQ ID NO: 7033424 - DNA, 22 bp, Homo sapiens
gaacctctatatttgtgacatc

SEQ ID NO: 7033425 - DNA, 22 bp, Homo sapiens
agccagggaggtggaggttgca

SEQ ID NO: 7033426 - DNA, 22 bp, Homo sapiens
agagccaaggctgagagctatt

SEQ ID NO: 7033427 - DNA, 22 bp, Homo sapiens
tcagacagggagtcagaaaata

SEQ ID NO: 7033428 - DNA, 22 bp, Homo sapiens
gcagaatttaggaattaggaaa

SEQ ID NO: 7033429 - DNA, 22 bp, Homo sapiens
tctagctgagggtaggagacct

SEQ ID NO: 7033430 - DNA, 22 bp, Homo sapiens
attagcatgccaagcttttaga

SEQ ID NO: 7033431 - DNA, 22 bp, Homo sapiens
agctagactttccctttccatg

SEQ ID NO: 7033432 - DNA, 22 bp, Homo sapiens
atggtgtaagactgtatttctt

SEQ ID NO: 7033433 - DNA, 22 bp, Homo sapiens
agaacatctggatggctgcttt

SEQ ID NO: 7033434 - DNA, 22 bp, Homo sapiens
gcaggagtgacatggatgtgga

SEQ ID NO: 7033435 - DNA, 22 bp, Homo sapiens
tacctcactgaagctgagtttt

SEQ ID NO: 7033436 - DNA, 17 bp, Homo sapiens
gtctgggctttagagac

SEQ ID NO: 7033437 - DNA, 22 bp, Homo sapiens
gacccaggcccaaggctgccag

SEQ ID NO: 7033438 - DNA, 22 bp, Homo sapiens
tttcaagtggggacatttgaga

SEQ ID NO: 7033439 - DNA, 20 bp, Homo sapiens
gttcatgtctcaaatagaaa

SEQ ID NO: 7033440 - DNA, 22 bp, Homo sapiens
cccagagaattccacatagagg

SEQ ID NO: 7033441 - DNA, 23 bp, Homo sapiens
aaaaaaccatgtaggcactcagt

SEQ ID NO: 7033442 - DNA, 22 bp, Homo sapiens
gttgcaaactcctacttctcat

SEQ ID NO: 7033443 - DNA, 21 bp, Homo sapiens
ctgctacttttcttactgtag

SEQ ID NO: 7033444 - DNA, 21 bp, Homo sapiens
ttggctgcctgagattagaat

SEQ ID NO: 7033445 - DNA, 22 bp, Homo sapiens
acagtaattaaacattctgatt

SEQ ID NO: 7033446 - DNA, 22 bp, Homo sapiens
tgactgatgcccactttgtctg

SEQ ID NO: 7033447 - DNA, 18 bp, Homo sapiens
tgcaaaggacactgagat

SEQ ID NO: 7033448 - DNA, 22 bp, Homo sapiens
tctggtgtcagtattctttgaa

SEQ ID NO: 7033449 - DNA, 22 bp, Homo sapiens
ctcaagtaattagcaacaaata

SEQ ID NO: 7033450 - DNA, 17 bp, Homo sapiens
tcctttctttacctgtt

SEQ ID NO: 7033451 - DNA, 22 bp, Homo sapiens
tcttgcagaaaatagtatagat

SEQ ID NO: 7033452 - DNA, 22 bp, Homo sapiens
atgcacagacccaaaggccatc

SEQ ID NO: 7033453 - DNA, 22 bp, Homo sapiens
ctagattcaatatttttctgcc

SEQ ID NO: 7033454 - DNA, 22 bp, Homo sapiens
aaggtacagggaaggagcaaga

SEQ ID NO: 7033455 - DNA, 22 bp, Homo sapiens
agatgaggggtagaaaggactt

SEQ ID NO: 7033456 - DNA, 22 bp, Homo sapiens
ccagtcccgcatggtccagaat

SEQ ID NO: 7033457 - DNA, 22 bp, Homo sapiens
tagaaaatagggcctgtggagc

SEQ ID NO: 7033458 - DNA, 22 bp, Homo sapiens
tacactcttaggaattggttat

SEQ ID NO: 7033459 - DNA, 22 bp, Homo sapiens
ttcctcacactcccccattcga

SEQ ID NO: 7033460 - DNA, 22 bp, Homo sapiens
gtcccatttcaagaaattcatg

SEQ ID NO: 7033461 - DNA, 22 bp, Homo sapiens
ggtaggcactggtgggaagaga

SEQ ID NO: 7033462 - DNA, 22 bp, Homo sapiens
ttaattgatataaagaacttca

SEQ ID NO: 7033463 - DNA, 22 bp, Homo sapiens
ttgttgatgtggacgtctggaa

SEQ ID NO: 7033464 - DNA, 22 bp, Homo sapiens
aataacagagtcttcaagatag

SEQ ID NO: 7033465 - DNA, 22 bp, Homo sapiens
accgtttacaccactaccgctt

SEQ ID NO: 7033466 - DNA, 21 bp, Homo sapiens
aaaatcaccttaggtcactgg

SEQ ID NO: 7033467 - DNA, 20 bp, Homo sapiens
aggcagctgggaaatgaggg

SEQ ID NO: 7033468 - DNA, 22 bp, Homo sapiens
gggcaggggtcagtggccccaa

SEQ ID NO: 7033469 - DNA, 22 bp, Homo sapiens
ttcctgagaaatttgtacctgg

SEQ ID NO: 7033470 - DNA, 17 bp, Homo sapiens
ttcaaagcttatcaagg

SEQ ID NO: 7033471 - DNA, 22 bp, Homo sapiens
actctcactgcttggctcctgc

SEQ ID NO: 7033472 - DNA, 22 bp, Homo sapiens
tcttatgaaaagcacttagaac

SEQ ID NO: 7033473 - DNA, 21 bp, Homo sapiens
tttgtggaattctcactcttc

SEQ ID NO: 7033474 - DNA, 22 bp, Homo sapiens
cccatgggttttcctccctgcc

SEQ ID NO: 7033475 - DNA, 22 bp, Homo sapiens
ataaggtctgctggggagagtg

SEQ ID NO: 7033476 - DNA, 22 bp, Homo sapiens
ctgtgagatgtttctggttaga

SEQ ID NO: 7033477 - DNA, 22 bp, Homo sapiens
ttctctctggacctgggatgcg

SEQ ID NO: 7033478 - DNA, 22 bp, Homo sapiens
ctgcaccctgcaggtacccctg

SEQ ID NO: 7033479 - DNA, 19 bp, Homo sapiens
ctgctccaggagctgggga

SEQ ID NO: 7033480 - DNA, 22 bp, Homo sapiens
gtccacccatgacacctgcctg

SEQ ID NO: 7033481 - DNA, 22 bp, Homo sapiens
ttacacagaaattttattgcct

SEQ ID NO: 7033482 - DNA, 22 bp, Homo sapiens
tcttgaacttctgcacactcag

SEQ ID NO: 7033483 - DNA, 18 bp, Homo sapiens
gaggatggaaggagatgc

SEQ ID NO: 7033484 - DNA, 20 bp, Homo sapiens
gctgactgtttgggtggcgg

SEQ ID NO: 7033485 - DNA, 22 bp, Homo sapiens
gcactgaatgccaaagtgtagg

SEQ ID NO: 7033486 - DNA, 22 bp, Homo sapiens
ttccaagttgagcgattttcct

SEQ ID NO: 7033487 - DNA, 22 bp, Homo sapiens
tgtcacatccattttgcaagta

SEQ ID NO: 7033488 - DNA, 22 bp, Homo sapiens
cattacgagctctaaaatacta

SEQ ID NO: 7033489 - DNA, 23 bp, Homo sapiens
agctgaaagcttgcaacgaggca

SEQ ID NO: 7033490 - DNA, 22 bp, Homo sapiens
ttccaggctgcacagttgggac

SEQ ID NO: 7033491 - DNA, 22 bp, Homo sapiens
aacgaagcttaacttttctgag

SEQ ID NO: 7033492 - DNA, 22 bp, Homo sapiens
ccagcctcatcgcctgcctgtc

SEQ ID NO: 7033493 - DNA, 22 bp, Homo sapiens
gcagggaaggggcatgctggag

SEQ ID NO: 7033494 - DNA, 22 bp, Homo sapiens
gagagaaaggcttgcaggctgt

SEQ ID NO: 7033495 - DNA, 22 bp, Homo sapiens
accaggaagagattccaattta

SEQ ID NO: 7033496 - DNA, 22 bp, Homo sapiens
agctttggctgtgttgctctgt

SEQ ID NO: 7033497 - DNA, 19 bp, Homo sapiens
tccaccccagccagctctg

SEQ ID NO: 7033498 - DNA, 22 bp, Homo sapiens
gttcacagctgggacaagactg

SEQ ID NO: 7033499 - DNA, 22 bp, Homo sapiens
gttacaatgttcttcagttctg

SEQ ID NO: 7033500 - DNA, 21 bp, Homo sapiens
gaaagcacagaaaggactctt

SEQ ID NO: 7033501 - DNA, 22 bp, Homo sapiens
gatgaatgtgtccagaagactt

SEQ ID NO: 7033502 - DNA, 22 bp, Homo sapiens
tgcattcttggaagaagctctc

SEQ ID NO: 7033503 - DNA, 22 bp, Homo sapiens
agaaggcctaacttgggggcaa

SEQ ID NO: 7033504 - DNA, 22 bp, Homo sapiens
tggctgagagaagacggggaag

SEQ ID NO: 7033505 - DNA, 22 bp, Homo sapiens
gccactggacccagaaagggaa

SEQ ID NO: 7033506 - DNA, 22 bp, Homo sapiens
caggaatagggcgtgagcatat

SEQ ID NO: 7033507 - DNA, 22 bp, Homo sapiens
ggcagagctctggactgagaac

SEQ ID NO: 7033508 - DNA, 22 bp, Homo sapiens
ccagaggggctgagcaggtcac

SEQ ID NO: 7033509 - DNA, 22 bp, Homo sapiens
tagcttgccattttataaatat

SEQ ID NO: 7033510 - DNA, 21 bp, Homo sapiens
gctttctgtggactctgcacc

SEQ ID NO: 7033511 - DNA, 22 bp, Homo sapiens
tatcttacagactgaatgttgg

SEQ ID NO: 7033512 - DNA, 22 bp, Homo sapiens
cttcctggtttgaagctcgccg

SEQ ID NO: 7033513 - DNA, 22 bp, Homo sapiens
aaagcaggttatgaccatggcc

SEQ ID NO: 7033514 - DNA, 22 bp, Homo sapiens
aggtgctgtgctatgcacttgt

SEQ ID NO: 7033515 - DNA, 22 bp, Homo sapiens
taggcttgctgcagaatctgcc

SEQ ID NO: 7033516 - DNA, 17 bp, Homo sapiens
agcaaaagtatcaaagc

SEQ ID NO: 7033517 - DNA, 22 bp, Homo sapiens
tcatctcctcatgtatctggga

SEQ ID NO: 7033518 - DNA, 22 bp, Homo sapiens
ctgtgctggcagacctggagtt

SEQ ID NO: 7033519 - DNA, 22 bp, Homo sapiens
gaaactgagtaggctagagcac

SEQ ID NO: 7033520 - DNA, 22 bp, Homo sapiens
catcacatttaattaaaatgtc

SEQ ID NO: 7033521 - DNA, 22 bp, Homo sapiens
acagaagagctggctctgtgct

SEQ ID NO: 7033522 - DNA, 22 bp, Homo sapiens
cacaaacatcaatcctgttttc

SEQ ID NO: 7033523 - DNA, 22 bp, Homo sapiens
aaagggaatgtgtaggacatgt

SEQ ID NO: 7033524 - DNA, 22 bp, Homo sapiens
aggtccaggcctcatgatggcc

SEQ ID NO: 7033525 - DNA, 22 bp, Homo sapiens
gatcaggaatattggaaagtac

SEQ ID NO: 7033526 - DNA, 22 bp, Homo sapiens
tgcttccgctaaaaattaatcc

SEQ ID NO: 7033527 - DNA, 21 bp, Homo sapiens
tcccagctgggtcagtgctgc

SEQ ID NO: 7033528 - DNA, 22 bp, Homo sapiens
tagctttaccatagaagagtat

SEQ ID NO: 7033529 - DNA, 22 bp, Homo sapiens
tagctgtgtgtccttgggcaaa

SEQ ID NO: 7033530 - DNA, 22 bp, Homo sapiens
ggatggcagtctgcatgagaaa

SEQ ID NO: 7033531 - DNA, 22 bp, Homo sapiens
atttgacccgcctcagacccca

SEQ ID NO: 7033532 - DNA, 22 bp, Homo sapiens
acctggctgagaacgtgcagct

SEQ ID NO: 7033533 - DNA, 21 bp, Homo sapiens
tcagaactggtgcagatgaat

SEQ ID NO: 7033534 - DNA, 22 bp, Homo sapiens
taagtgggtgaagaggaaatat

SEQ ID NO: 7033535 - DNA, 22 bp, Homo sapiens
ctgtggctcagcacggggtcag

SEQ ID NO: 7033536 - DNA, 18 bp, Homo sapiens
tggtcctagggtttaagg

SEQ ID NO: 7033537 - DNA, 22 bp, Homo sapiens
aaatgcaggtagtatttatttt

SEQ ID NO: 7033538 - DNA, 22 bp, Homo sapiens
aactcagtcataaagcgaatgc

SEQ ID NO: 7033539 - DNA, 22 bp, Homo sapiens
tcttcatgttagttgggttttc

SEQ ID NO: 7033540 - DNA, 22 bp, Homo sapiens
agctgcccagctaggaagaagg

SEQ ID NO: 7033541 - DNA, 22 bp, Homo sapiens
tgacaaatgttaattcagtgga

SEQ ID NO: 7033542 - DNA, 22 bp, Homo sapiens
agtgtctttggctaagtgctgt

SEQ ID NO: 7033543 - DNA, 22 bp, Homo sapiens
tgctgtgtggatgtgaagaatc

SEQ ID NO: 7033544 - DNA, 22 bp, Homo sapiens
gcaatcaatttaaaatgaggtc

SEQ ID NO: 7033545 - DNA, 22 bp, Homo sapiens
gaaggctggccattccccattc

SEQ ID NO: 7033546 - DNA, 22 bp, Homo sapiens
ctacccttaagtttctgtgggg

SEQ ID NO: 7033547 - DNA, 22 bp, Homo sapiens
tcccagagatttcctctccttc

SEQ ID NO: 7033548 - DNA, 20 bp, Homo sapiens
tccaaagaagttcacattta

SEQ ID NO: 7033549 - DNA, 22 bp, Homo sapiens
tcttacatatacgtcatttagt

SEQ ID NO: 7033550 - DNA, 22 bp, Homo sapiens
gagatataacctaaaggtcact

SEQ ID NO: 7033551 - DNA, 22 bp, Homo sapiens
tggcctggggaagaccatgggc

SEQ ID NO: 7033552 - DNA, 22 bp, Homo sapiens
ggggctccagtcttcacatttt

SEQ ID NO: 7033553 - DNA, 22 bp, Homo sapiens
agtgtatcatggttggcagaca

SEQ ID NO: 7033554 - DNA, 22 bp, Homo sapiens
aagaccatttaatggagaaaga

SEQ ID NO: 7033555 - DNA, 21 bp, Homo sapiens
ttgcacacagtgtttctggtt

SEQ ID NO: 7033556 - DNA, 22 bp, Homo sapiens
gggaaactgtccagttctcccc

SEQ ID NO: 7033557 - DNA, 22 bp, Homo sapiens
ttctagcatgccttttagcaca

SEQ ID NO: 7033558 - DNA, 22 bp, Homo sapiens
tctggcttccctacttactatg

SEQ ID NO: 7033559 - DNA, 22 bp, Homo sapiens
ggccttgacctcagtgggtttg

SEQ ID NO: 7033560 - DNA, 22 bp, Homo sapiens
gctgtctgggttgagggccctg

SEQ ID NO: 7033561 - DNA, 22 bp, Homo sapiens
ctgtgcagtccagccctggaca

SEQ ID NO: 7033562 - DNA, 22 bp, Homo sapiens
ttggaaatgatttctattatta

SEQ ID NO: 7033563 - DNA, 22 bp, Homo sapiens
acaagccaattactgtgccagg

SEQ ID NO: 7033564 - DNA, 19 bp, Homo sapiens
tcgtcagttgctccatcgg

SEQ ID NO: 7033565 - DNA, 22 bp, Homo sapiens
acacagtaggatagtttgagga

SEQ ID NO: 7033566 - DNA, 22 bp, Homo sapiens
ttgatactattaagcactgggc

SEQ ID NO: 7033567 - DNA, 22 bp, Homo sapiens
gagctcataccctcttctcttt

SEQ ID NO: 7033568 - DNA, 22 bp, Homo sapiens
gattagatgactaatgagctgt

SEQ ID NO: 7033569 - DNA, 20 bp, Homo sapiens
agtagcagtgtgacattgac

SEQ ID NO: 7033570 - DNA, 22 bp, Homo sapiens
taaaatcatgacagattgacat

SEQ ID NO: 7033571 - DNA, 22 bp, Homo sapiens
agtgaagctggagaaaggcagt

SEQ ID NO: 7033572 - DNA, 20 bp, Homo sapiens
tatgaattctggtccctggg

SEQ ID NO: 7033573 - DNA, 22 bp, Homo sapiens
actctgtagagtataccaatgt

SEQ ID NO: 7033574 - DNA, 22 bp, Homo sapiens
cttggaggaaaggcagggagac

SEQ ID NO: 7033575 - DNA, 22 bp, Homo sapiens
tgcaggctgaggctggctcaac

SEQ ID NO: 7033576 - DNA, 22 bp, Homo sapiens
ctgcccctggctggtgaagcag

SEQ ID NO: 7033577 - DNA, 22 bp, Homo sapiens
cagctattgataaatgttgggg

SEQ ID NO: 7033578 - DNA, 22 bp, Homo sapiens
ggtgcttctgggcatagcagga

SEQ ID NO: 7033579 - DNA, 22 bp, Homo sapiens
ctgtttcatgtcttccgcagct

SEQ ID NO: 7033580 - DNA, 22 bp, Homo sapiens
tttcctcaactgtcaaatgggg

SEQ ID NO: 7033581 - DNA, 23 bp, Homo sapiens
gtgtgtccattcgcactcttagg

SEQ ID NO: 7033582 - DNA, 22 bp, Homo sapiens
cttgcctaacaaattccccctt

SEQ ID NO: 7033583 - DNA, 22 bp, Homo sapiens
gtgtcattactgaaagattgaa

SEQ ID NO: 7033584 - DNA, 22 bp, Homo sapiens
gcaccctgctctatccttgcta

SEQ ID NO: 7033585 - DNA, 23 bp, Homo sapiens
aatgggtgcaactatccatgaca

SEQ ID NO: 7033586 - DNA, 22 bp, Homo sapiens
aatcaactgagccctggttctc

SEQ ID NO: 7033587 - DNA, 22 bp, Homo sapiens
gatattttcagtctcctttcaa

SEQ ID NO: 7033588 - DNA, 22 bp, Homo sapiens
tgtcaggtatgcaacagaatgc

SEQ ID NO: 7033589 - DNA, 22 bp, Homo sapiens
atggctgttttgtgacttctca

SEQ ID NO: 7033590 - DNA, 22 bp, Homo sapiens
agagatataagtataaataggg

SEQ ID NO: 7033591 - DNA, 20 bp, Homo sapiens
atttggcatagtttaagcaa

SEQ ID NO: 7033592 - DNA, 22 bp, Homo sapiens
tgggctgcacctttgtaaatct

SEQ ID NO: 7033593 - DNA, 22 bp, Homo sapiens
acaactagcaggtattaatttt

SEQ ID NO: 7033594 - DNA, 22 bp, Homo sapiens
aattgtacaagccttgtgccat

SEQ ID NO: 7033595 - DNA, 22 bp, Homo sapiens
acaggatggagataatagaaaa

SEQ ID NO: 7033596 - DNA, 22 bp, Homo sapiens
actgtctgtctcccaattatgc

SEQ ID NO: 7033597 - DNA, 22 bp, Homo sapiens
tgctcagcaaaaagcttgtgag

SEQ ID NO: 7033598 - DNA, 22 bp, Homo sapiens
gtggacttgagatggaccgagg

SEQ ID NO: 7033599 - DNA, 22 bp, Homo sapiens
gtgataattgcagagaaaggag

SEQ ID NO: 7033600 - DNA, 22 bp, Homo sapiens
ttttaagctacaagagacatat

SEQ ID NO: 7033601 - DNA, 22 bp, Homo sapiens
tcattcatctggtgttagtcct

SEQ ID NO: 7033602 - DNA, 22 bp, Homo sapiens
tccaatttgtttgatgatggaa

SEQ ID NO: 7033603 - DNA, 22 bp, Homo sapiens
ggcacctgtgtaagatctggaa

SEQ ID NO: 7033604 - DNA, 22 bp, Homo sapiens
gctatgaacatgagaatgcaaa

SEQ ID NO: 7033605 - DNA, 22 bp, Homo sapiens
agagggatcaccctgtttctgg

SEQ ID NO: 7033606 - DNA, 22 bp, Homo sapiens
acatttctatcatcctgtaatg

SEQ ID NO: 7033607 - DNA, 22 bp, Homo sapiens
tcctccaagcagaggccctgaa

SEQ ID NO: 7033608 - DNA, 22 bp, Homo sapiens
cagggatggtaaatatgtaaag

SEQ ID NO: 7033609 - DNA, 22 bp, Homo sapiens
tggcagatgtggtttgagacag

SEQ ID NO: 7033610 - DNA, 22 bp, Homo sapiens
gaccctcattgtcaccgtgagc

SEQ ID NO: 7033611 - DNA, 22 bp, Homo sapiens
aacatcttaagatagaagggga

SEQ ID NO: 7033612 - DNA, 22 bp, Homo sapiens
agagcaacagagaaatttaggt

SEQ ID NO: 7033613 - DNA, 22 bp, Homo sapiens
tccccactcctgggcagatgcg

SEQ ID NO: 7033614 - DNA, 22 bp, Homo sapiens
ttaaagcaagtagaagcctgag

SEQ ID NO: 7033615 - DNA, 22 bp, Homo sapiens
tggttaaaatgcagattcagta

SEQ ID NO: 7033616 - DNA, 22 bp, Homo sapiens
caagaaatggggaggggagttg

SEQ ID NO: 7033617 - DNA, 22 bp, Homo sapiens
agatcttatttagctttaatca

SEQ ID NO: 7033618 - DNA, 22 bp, Homo sapiens
cttggggctttgtgtgtaggat

SEQ ID NO: 7033619 - DNA, 22 bp, Homo sapiens
tcagctttcctgcagctaaggg

SEQ ID NO: 7033620 - DNA, 22 bp, Homo sapiens
aaactagccaaggagagataga

SEQ ID NO: 7033621 - DNA, 22 bp, Homo sapiens
tgagtaaaaattctacatttcc

SEQ ID NO: 7033622 - DNA, 22 bp, Homo sapiens
tcttaggagtagaattctcaca

SEQ ID NO: 7033623 - DNA, 22 bp, Homo sapiens
ctgctctgcaaggcacagtgat

SEQ ID NO: 7033624 - DNA, 22 bp, Homo sapiens
agacataagtgctatgacattg

SEQ ID NO: 7033625 - DNA, 22 bp, Homo sapiens
acatggcattcactcccacagg

SEQ ID NO: 7033626 - DNA, 22 bp, Homo sapiens
tcagaagccggaagtgctcctc

SEQ ID NO: 7033627 - DNA, 22 bp, Homo sapiens
gactaaatgctttgtgcatgca

SEQ ID NO: 7033628 - DNA, 22 bp, Homo sapiens
gggaaaatattaagcaggactt

SEQ ID NO: 7033629 - DNA, 22 bp, Homo sapiens
cccagcttgcaaatgggttgct

SEQ ID NO: 7033630 - DNA, 22 bp, Homo sapiens
ttggggggttgaggagtagata

SEQ ID NO: 7033631 - DNA, 22 bp, Homo sapiens
aagtgattatttaatgcggttt

SEQ ID NO: 7033632 - DNA, 22 bp, Homo sapiens
gctctagctggcgctgacctgg

SEQ ID NO: 7033633 - DNA, 22 bp, Homo sapiens
ctgagatggagttttgctcttg

SEQ ID NO: 7033634 - DNA, 22 bp, Homo sapiens
cttgttttggctagtatgatgt

SEQ ID NO: 7033635 - DNA, 22 bp, Homo sapiens
ttactgtttgaaaaatgaatgt

SEQ ID NO: 7033636 - DNA, 22 bp, Homo sapiens
caatgataatggctgtatttat

SEQ ID NO: 7033637 - DNA, 22 bp, Homo sapiens
aggacagaatctatattcagtt

SEQ ID NO: 7033638 - DNA, 22 bp, Homo sapiens
ggagctggcagcgcaacccaga

SEQ ID NO: 7033639 - DNA, 22 bp, Homo sapiens
cacctagcattcctcttcctca

SEQ ID NO: 7033640 - DNA, 22 bp, Homo sapiens
tcagtgttgtgcacatacaaaa

SEQ ID NO: 7033641 - DNA, 22 bp, Homo sapiens
ttcatgtaataggatgtgttaa

SEQ ID NO: 7033642 - DNA, 22 bp, Homo sapiens
atgaggtagtattagaaggaga

SEQ ID NO: 7033643 - DNA, 22 bp, Homo sapiens
aggtaggccctgagtgctgttg

SEQ ID NO: 7033644 - DNA, 22 bp, Homo sapiens
tacagtgtctggatatcaaagg

SEQ ID NO: 7033645 - DNA, 22 bp, Homo sapiens
cattgggcggggacctcggctg

SEQ ID NO: 7033646 - DNA, 22 bp, Homo sapiens
taacagaaatagaaatgagagt

SEQ ID NO: 7033647 - DNA, 22 bp, Homo sapiens
tctgagcattgagctctccaaa

SEQ ID NO: 7033648 - DNA, 20 bp, Homo sapiens
ccaataaagctctataggga

SEQ ID NO: 7033649 - DNA, 22 bp, Homo sapiens
ttgtaagggttacaagaaaaca

SEQ ID NO: 7033650 - DNA, 22 bp, Homo sapiens
acattaaaattgggtggggtaa

SEQ ID NO: 7033651 - DNA, 22 bp, Homo sapiens
atagcattatttacaattagta

SEQ ID NO: 7033652 - DNA, 22 bp, Homo sapiens
gccagctagcggggaggaaatg

SEQ ID NO: 7033653 - DNA, 22 bp, Homo sapiens
ttcaggtttttaagttctgcct

SEQ ID NO: 7033654 - DNA, 22 bp, Homo sapiens
ggtctggacagaatgtgacact

SEQ ID NO: 7033655 - DNA, 22 bp, Homo sapiens
ggaatctcagtggagctgttag

SEQ ID NO: 7033656 - DNA, 22 bp, Homo sapiens
acactagtctcttcttgacttg

SEQ ID NO: 7033657 - DNA, 22 bp, Homo sapiens
ggtctcccttgctggttggctg

SEQ ID NO: 7033658 - DNA, 22 bp, Homo sapiens
ccagaaaggtaaacactggatt

SEQ ID NO: 7033659 - DNA, 22 bp, Homo sapiens
cagaagttctagatttgagtcc

SEQ ID NO: 7033660 - DNA, 22 bp, Homo sapiens
cacatggcagaatcatgcatct

SEQ ID NO: 7033661 - DNA, 22 bp, Homo sapiens
tctaaagtgagtcatttcgact

SEQ ID NO: 7033662 - DNA, 22 bp, Homo sapiens
catgcagatgtcatgaggcatg

SEQ ID NO: 7033663 - DNA, 22 bp, Homo sapiens
tctgggcacacaccatgcccac

SEQ ID NO: 7033664 - DNA, 22 bp, Homo sapiens
gatccacagcccgcttgggccc

SEQ ID NO: 7033665 - DNA, 22 bp, Homo sapiens
aggcacagcacacctggccccc

SEQ ID NO: 7033666 - DNA, 23 bp, Homo sapiens
tcccagggaaggtgagcgaggct

SEQ ID NO: 7033667 - DNA, 22 bp, Homo sapiens
ccagagcccctgagcttccctg

SEQ ID NO: 7033668 - DNA, 22 bp, Homo sapiens
gccctcagaatgggctctaatc

SEQ ID NO: 7033669 - DNA, 22 bp, Homo sapiens
tgatgttatggtactattcatt

SEQ ID NO: 7033670 - DNA, 22 bp, Homo sapiens
tttattagattatcaaagaggt

SEQ ID NO: 7033671 - DNA, 22 bp, Homo sapiens
tacattgagtattatttagcca

SEQ ID NO: 7033672 - DNA, 22 bp, Homo sapiens
acccagccatgttcagttctct

SEQ ID NO: 7033673 - DNA, 22 bp, Homo sapiens
aagactttcaagtatgcatgca

SEQ ID NO: 7033674 - DNA, 22 bp, Homo sapiens
ccataatctggctttgagagag

SEQ ID NO: 7033675 - DNA, 22 bp, Homo sapiens
ttcttacatcagtttattttgt

SEQ ID NO: 7033676 - DNA, 22 bp, Homo sapiens
ttctacatgtgatgcgtgcctg

SEQ ID NO: 7033677 - DNA, 22 bp, Homo sapiens
agggaagccaagccttagagaa

SEQ ID NO: 7033678 - DNA, 22 bp, Homo sapiens
aacatagaatggctccagagct

SEQ ID NO: 7033679 - DNA, 22 bp, Homo sapiens
aatgcagtgagccattaaatgg

SEQ ID NO: 7033680 - DNA, 22 bp, Homo sapiens
gtagggacccacagtctatatt

SEQ ID NO: 7033681 - DNA, 22 bp, Homo sapiens
taacctggatgtgccaacgtga

SEQ ID NO: 7033682 - DNA, 22 bp, Homo sapiens
ttttttcagcctgtctgtgcca

SEQ ID NO: 7033683 - DNA, 22 bp, Homo sapiens
tgtttaaccaccattctattct

SEQ ID NO: 7033684 - DNA, 22 bp, Homo sapiens
ttcagagaagcaaaggcagatt

SEQ ID NO: 7033685 - DNA, 22 bp, Homo sapiens
ttaatcttcagggactcttgct

SEQ ID NO: 7033686 - DNA, 22 bp, Homo sapiens
catcactgaaccccaactttct

SEQ ID NO: 7033687 - DNA, 22 bp, Homo sapiens
ggcacctttcatcccatctaga

SEQ ID NO: 7033688 - DNA, 22 bp, Homo sapiens
tttcattgtctacatatgacat

SEQ ID NO: 7033689 - DNA, 22 bp, Homo sapiens
tctggaatcagacctaatccca

SEQ ID NO: 7033690 - DNA, 22 bp, Homo sapiens
agagaatacaaagaagatatgt

SEQ ID NO: 7033691 - DNA, 22 bp, Homo sapiens
gcagttactagcaatttgtgaa

SEQ ID NO: 7033692 - DNA, 20 bp, Homo sapiens
agtgctgtggctgaataaga

SEQ ID NO: 7033693 - DNA, 20 bp, Homo sapiens
agggcacttttgctggagca

SEQ ID NO: 7033694 - DNA, 22 bp, Homo sapiens
gggtggggccaggcaatttgca

SEQ ID NO: 7033695 - DNA, 22 bp, Homo sapiens
agtgtacatagttaggaacatc

SEQ ID NO: 7033696 - DNA, 22 bp, Homo sapiens
agctggagagtttccaggaagg

SEQ ID NO: 7033697 - DNA, 22 bp, Homo sapiens
catccagagtccaaggctgggc

SEQ ID NO: 7033698 - DNA, 22 bp, Homo sapiens
ttaatacaactgttgtcactgg

SEQ ID NO: 7033699 - DNA, 17 bp, Homo sapiens
gccttccagcatgtggg

SEQ ID NO: 7033700 - DNA, 22 bp, Homo sapiens
atctctgttagatctgcttaaa

SEQ ID NO: 7033701 - DNA, 22 bp, Homo sapiens
atgggacaggcatgggacttag

SEQ ID NO: 7033702 - DNA, 22 bp, Homo sapiens
agtctcttggcattctgaaaca

SEQ ID NO: 7033703 - DNA, 22 bp, Homo sapiens
attattctctggaggaaagatt

SEQ ID NO: 7033704 - DNA, 22 bp, Homo sapiens
ctcagaaatcccactctgtgta

SEQ ID NO: 7033705 - DNA, 23 bp, Homo sapiens
gggagccaggacctcgcgcccca

SEQ ID NO: 7033706 - DNA, 22 bp, Homo sapiens
gcttgtttgtgatttctccaga

SEQ ID NO: 7033707 - DNA, 22 bp, Homo sapiens
caaattagaggtttgttttgat

SEQ ID NO: 7033708 - DNA, 22 bp, Homo sapiens
tgacagggtcagagctgagctg

SEQ ID NO: 7033709 - DNA, 22 bp, Homo sapiens
cgttttcatgggtagaggttct

SEQ ID NO: 7033710 - DNA, 22 bp, Homo sapiens
tcactgtaaagtaatactgtca

SEQ ID NO: 7033711 - DNA, 20 bp, Homo sapiens
ggctgaaagtagaaagtatt

SEQ ID NO: 7033712 - DNA, 22 bp, Homo sapiens
gagaggggtttgccatcctatg

SEQ ID NO: 7033713 - DNA, 22 bp, Homo sapiens
agatgacaaatcaggggacggg

SEQ ID NO: 7033714 - DNA, 18 bp, Homo sapiens
tatttcacttttgggcat

SEQ ID NO: 7033715 - DNA, 22 bp, Homo sapiens
ggtgcgggccgcctgcccttgg

SEQ ID NO: 7033716 - DNA, 22 bp, Homo sapiens
acccagctggatgcatggaggc

SEQ ID NO: 7033717 - DNA, 22 bp, Homo sapiens
actaggaaggcatatgggcaga

SEQ ID NO: 7033718 - DNA, 20 bp, Homo sapiens
ggggaagaaaaggatgtgat

SEQ ID NO: 7033719 - DNA, 22 bp, Homo sapiens
gtcttatttaaggcttatacaa

SEQ ID NO: 7033720 - DNA, 22 bp, Homo sapiens
tcttcctttcattcatgtgtta

SEQ ID NO: 7033721 - DNA, 22 bp, Homo sapiens
ctgagacaggagaatggcgtga

SEQ ID NO: 7033722 - DNA, 22 bp, Homo sapiens
agcaaggtgacatcatgctgag

SEQ ID NO: 7033723 - DNA, 22 bp, Homo sapiens
aaaggctatttcagggtcagta

SEQ ID NO: 7033724 - DNA, 22 bp, Homo sapiens
accccactcctctgttttaact

SEQ ID NO: 7033725 - DNA, 23 bp, Homo sapiens
tggggccaagtgaggaagggtct

SEQ ID NO: 7033726 - DNA, 22 bp, Homo sapiens
ctgaggcaggatggcctggctg

SEQ ID NO: 7033727 - DNA, 22 bp, Homo sapiens
gtctttagagctcctggcatct

SEQ ID NO: 7033728 - DNA, 22 bp, Homo sapiens
atttactttgctgagatccatc

SEQ ID NO: 7033729 - DNA, 22 bp, Homo sapiens
ttgtatcatcattatcagtctg

SEQ ID NO: 7033730 - DNA, 22 bp, Homo sapiens
ctgatttagatttcacacgtga

SEQ ID NO: 7033731 - DNA, 22 bp, Homo sapiens
tatgttacttctgtatctgctt

SEQ ID NO: 7033732 - DNA, 22 bp, Homo sapiens
ttgagggaaataactgatgctt

SEQ ID NO: 7033733 - DNA, 22 bp, Homo sapiens
cttggatttgggcccttaaatt

SEQ ID NO: 7033734 - DNA, 18 bp, Homo sapiens
tgtgaacacatttttctg

SEQ ID NO: 7033735 - DNA, 21 bp, Homo sapiens
tgtaggaggcaagcctgtctc

SEQ ID NO: 7033736 - DNA, 22 bp, Homo sapiens
tcctggagcctcattcaaacac

SEQ ID NO: 7033737 - DNA, 22 bp, Homo sapiens
tttgtaaaaggaggaagcatgg

SEQ ID NO: 7033738 - DNA, 22 bp, Homo sapiens
tggaccctacccggccctcggc

SEQ ID NO: 7033739 - DNA, 22 bp, Homo sapiens
atctgacatctccctctgacat

SEQ ID NO: 7033740 - DNA, 22 bp, Homo sapiens
gtgaataatattgtttataaaa

SEQ ID NO: 7033741 - DNA, 22 bp, Homo sapiens
ctctgggtgggcagcagatgga

SEQ ID NO: 7033742 - DNA, 19 bp, Homo sapiens
gtgatttctttccacaagc

SEQ ID NO: 7033743 - DNA, 22 bp, Homo sapiens
gtggggagtgttctgtgattgg

SEQ ID NO: 7033744 - DNA, 22 bp, Homo sapiens
ataattaatttcagtaatctcc

SEQ ID NO: 7033745 - DNA, 22 bp, Homo sapiens
ctaaaggattcttagttcctgg

SEQ ID NO: 7033746 - DNA, 22 bp, Homo sapiens
ctcactataatgtgttcagtgt

SEQ ID NO: 7033747 - DNA, 22 bp, Homo sapiens
acaggtgaggatctgagcctca

SEQ ID NO: 7033748 - DNA, 22 bp, Homo sapiens
cctgggcctgaaaacatttctc

SEQ ID NO: 7033749 - DNA, 22 bp, Homo sapiens
ttccccttgcactatcaccctg

SEQ ID NO: 7033750 - DNA, 22 bp, Homo sapiens
tgggacaggttggagagaagca

SEQ ID NO: 7033751 - DNA, 20 bp, Homo sapiens
tctaaagtacagtttgtgtg

SEQ ID NO: 7033752 - DNA, 22 bp, Homo sapiens
tgcctgtggagccactagtttt

SEQ ID NO: 7033753 - DNA, 22 bp, Homo sapiens
aggctagtatcatctacttttg

SEQ ID NO: 7033754 - DNA, 22 bp, Homo sapiens
gaaagccatagcccagctttac

SEQ ID NO: 7033755 - DNA, 22 bp, Homo sapiens
tcaggctacactcttttcatgg

SEQ ID NO: 7033756 - DNA, 22 bp, Homo sapiens
gaggcacaccagggagtcttgt

SEQ ID NO: 7033757 - DNA, 22 bp, Homo sapiens
ctgggtacctcaccgctgctgc

SEQ ID NO: 7033758 - DNA, 22 bp, Homo sapiens
catattagcctccactgggaca

SEQ ID NO: 7033759 - DNA, 22 bp, Homo sapiens
tgggcccttatgaagctcaaga

SEQ ID NO: 7033760 - DNA, 22 bp, Homo sapiens
tgtctgtatatcacttttgtcc

SEQ ID NO: 7033761 - DNA, 22 bp, Homo sapiens
caggcctctatggtcagctgag

SEQ ID NO: 7033762 - DNA, 22 bp, Homo sapiens
aaccagatgcttccccagatgc

SEQ ID NO: 7033763 - DNA, 22 bp, Homo sapiens
tttcttcattcaccttcacccc

SEQ ID NO: 7033764 - DNA, 22 bp, Homo sapiens
aaggcgacacaggcagcaggcc

SEQ ID NO: 7033765 - DNA, 22 bp, Homo sapiens
caactttagcaatgttagtata

SEQ ID NO: 7033766 - DNA, 22 bp, Homo sapiens
gggcacatgtaaagctggagaa

SEQ ID NO: 7033767 - DNA, 22 bp, Homo sapiens
tacagtaataaaatgagctaca

SEQ ID NO: 7033768 - DNA, 22 bp, Homo sapiens
ccaggtggaaggtctgtgctct

SEQ ID NO: 7033769 - DNA, 22 bp, Homo sapiens
aggtggaagatgaacccaaatt

SEQ ID NO: 7033770 - DNA, 22 bp, Homo sapiens
caggcattgccattcctccaga

SEQ ID NO: 7033771 - DNA, 22 bp, Homo sapiens
gcccaggttggagagcagtggc

SEQ ID NO: 7033772 - DNA, 22 bp, Homo sapiens
ttcaactttggagatttaataa

SEQ ID NO: 7033773 - DNA, 22 bp, Homo sapiens
tttattgtgttgaaactgaatt

SEQ ID NO: 7033774 - DNA, 22 bp, Homo sapiens
ctcacagatgatgtctatgtgg

SEQ ID NO: 7033775 - DNA, 22 bp, Homo sapiens
aaggctatctggcctccttgcc

SEQ ID NO: 7033776 - DNA, 22 bp, Homo sapiens
attctttcaaggaatagttatt

SEQ ID NO: 7033777 - DNA, 22 bp, Homo sapiens
ttagataaaagtgttcaataaa

SEQ ID NO: 7033778 - DNA, 22 bp, Homo sapiens
gcacacttaatactcactgtgc

SEQ ID NO: 7033779 - DNA, 22 bp, Homo sapiens
tggtgggctgagtctcatcgga

SEQ ID NO: 7033780 - DNA, 22 bp, Homo sapiens
ctgcagtagcagagctgagtag

SEQ ID NO: 7033781 - DNA, 22 bp, Homo sapiens
tgacagggctagaggcaatgca

SEQ ID NO: 7033782 - DNA, 18 bp, Homo sapiens
tgaggcagtcagtgatgg

SEQ ID NO: 7033783 - DNA, 22 bp, Homo sapiens
atcagtagtgtgaaaacagact

SEQ ID NO: 7033784 - DNA, 22 bp, Homo sapiens
cttcagtgcatgtttataatca

SEQ ID NO: 7033785 - DNA, 22 bp, Homo sapiens
atgacaaaggctgaaagggaaa

SEQ ID NO: 7033786 - DNA, 22 bp, Homo sapiens
tgcttagacgtcaagtacagcc

SEQ ID NO: 7033787 - DNA, 16 bp, Homo sapiens
caccagtccttcctgc

SEQ ID NO: 7033788 - DNA, 22 bp, Homo sapiens
aaggaccagttgagtgatctta

SEQ ID NO: 7033789 - DNA, 22 bp, Homo sapiens
taaagcaaggcaaattgttggt

SEQ ID NO: 7033790 - DNA, 22 bp, Homo sapiens
gcaaacattccacagaaggaag

SEQ ID NO: 7033791 - DNA, 22 bp, Homo sapiens
tggcagtcccctgtgcctggaa

SEQ ID NO: 7033792 - DNA, 22 bp, Homo sapiens
ggctcttcacacagtgatgtca

SEQ ID NO: 7033793 - DNA, 22 bp, Homo sapiens
aatgaaatgaagatatgatcag

SEQ ID NO: 7033794 - DNA, 22 bp, Homo sapiens
tggcaggcagtgtgggagctgg

SEQ ID NO: 7033795 - DNA, 18 bp, Homo sapiens
atccttgatgagaggtct

SEQ ID NO: 7033796 - DNA, 22 bp, Homo sapiens
ttcctagacagttcttcccaaa

SEQ ID NO: 7033797 - DNA, 22 bp, Homo sapiens
tcacaattgagatcctcccacc

SEQ ID NO: 7033798 - DNA, 22 bp, Homo sapiens
cttttaagggataataagatgt

SEQ ID NO: 7033799 - DNA, 22 bp, Homo sapiens
tctaaaacctgaacccatgatt

SEQ ID NO: 7033800 - DNA, 22 bp, Homo sapiens
tcaggaggttgaccacggggca

SEQ ID NO: 7033801 - DNA, 22 bp, Homo sapiens
aaagcacctagcatagtgctta

SEQ ID NO: 7033802 - DNA, 22 bp, Homo sapiens
tttacagtcaccaaactttgct

SEQ ID NO: 7033803 - DNA, 22 bp, Homo sapiens
cagtctaagactcacgccaaga

SEQ ID NO: 7033804 - DNA, 22 bp, Homo sapiens
caagactttggaaggctgaggc

SEQ ID NO: 7033805 - DNA, 19 bp, Homo sapiens
tgtgactggttgtctcgct

SEQ ID NO: 7033806 - DNA, 18 bp, Homo sapiens
ttatctgctgcaaagggt

SEQ ID NO: 7033807 - DNA, 22 bp, Homo sapiens
gtctgtggtccctgctggggac

SEQ ID NO: 7033808 - DNA, 22 bp, Homo sapiens
tggagtcactttctcttccagt

SEQ ID NO: 7033809 - DNA, 22 bp, Homo sapiens
agctccagcggatggtcttata

SEQ ID NO: 7033810 - DNA, 22 bp, Homo sapiens
gcttcacactaaaaatgttaaa

SEQ ID NO: 7033811 - DNA, 22 bp, Homo sapiens
gtaaaattctagcatctgaaag

SEQ ID NO: 7033812 - DNA, 22 bp, Homo sapiens
ctgcctgggttcaagtcctgtt

SEQ ID NO: 7033813 - DNA, 22 bp, Homo sapiens
tgtgtcagcatcctttgggaca

SEQ ID NO: 7033814 - DNA, 21 bp, Homo sapiens
ctgtccagtaattcctggcac

SEQ ID NO: 7033815 - DNA, 22 bp, Homo sapiens
ccaggctcaggcctgctcgttg

SEQ ID NO: 7033816 - DNA, 18 bp, Homo sapiens
aagaactgaggtcctaga

SEQ ID NO: 7033817 - DNA, 21 bp, Homo sapiens
tctgcccacactggccactgc

SEQ ID NO: 7033818 - DNA, 23 bp, Homo sapiens
cagttgatgttaccttccttaga

SEQ ID NO: 7033819 - DNA, 22 bp, Homo sapiens
aagttgatagcatgttaagctc

SEQ ID NO: 7033820 - DNA, 20 bp, Homo sapiens
ggagggcagctgagagttgg

SEQ ID NO: 7033821 - DNA, 22 bp, Homo sapiens
taaggcaggactggatagctat

SEQ ID NO: 7033822 - DNA, 22 bp, Homo sapiens
ttcagtgctaaaaagtctcaag

SEQ ID NO: 7033823 - DNA, 22 bp, Homo sapiens
gacaggtgagatgaggaacacc

SEQ ID NO: 7033824 - DNA, 22 bp, Homo sapiens
tggcctcggcatccagcaagag

SEQ ID NO: 7033825 - DNA, 22 bp, Homo sapiens
tttaaggccttgagggaaattt

SEQ ID NO: 7033826 - DNA, 19 bp, Homo sapiens
gggcagaatggcatctcag

SEQ ID NO: 7033827 - DNA, 22 bp, Homo sapiens
ttaagtaagaccttatgtcttg

SEQ ID NO: 7033828 - DNA, 22 bp, Homo sapiens
cctgcaggggagagacttctag

SEQ ID NO: 7033829 - DNA, 22 bp, Homo sapiens
tggctcagtttagcagctcagt

SEQ ID NO: 7033830 - DNA, 22 bp, Homo sapiens
cataatcctggtgtagccctct

SEQ ID NO: 7033831 - DNA, 22 bp, Homo sapiens
gaggacatagtccagatggcaa

SEQ ID NO: 7033832 - DNA, 22 bp, Homo sapiens
aaagctgggctaggtttgtttc

SEQ ID NO: 7033833 - DNA, 22 bp, Homo sapiens
tggtaaggttctacagtgttga

SEQ ID NO: 7033834 - DNA, 22 bp, Homo sapiens
aatgtcttcagttctgtattgt

SEQ ID NO: 7033835 - DNA, 22 bp, Homo sapiens
acacttctttgtcacctgcttc

SEQ ID NO: 7033836 - DNA, 22 bp, Homo sapiens
catctggacaaaactctgaagg

SEQ ID NO: 7033837 - DNA, 22 bp, Homo sapiens
gccaaaggacctgtgggtgaca

SEQ ID NO: 7033838 - DNA, 22 bp, Homo sapiens
cctgggctgtacctgtgcgcgg

SEQ ID NO: 7033839 - DNA, 22 bp, Homo sapiens
tggaatctttaggaagcacata

SEQ ID NO: 7033840 - DNA, 22 bp, Homo sapiens
tgggacaggatgaccagaaggt

SEQ ID NO: 7033841 - DNA, 22 bp, Homo sapiens
tggtctgagcaactgccctatc

SEQ ID NO: 7033842 - DNA, 22 bp, Homo sapiens
gcaggctgagttgggaaaccaa

SEQ ID NO: 7033843 - DNA, 22 bp, Homo sapiens
gggcagtttattctagatggtt

SEQ ID NO: 7033844 - DNA, 22 bp, Homo sapiens
tgccacacaattactgctgcta

SEQ ID NO: 7033845 - DNA, 22 bp, Homo sapiens
agctgggggttggataagggta

SEQ ID NO: 7033846 - DNA, 22 bp, Homo sapiens
tctcaattcatgaagttggaat

SEQ ID NO: 7033847 - DNA, 22 bp, Homo sapiens
actttagttcagtctctctgtt

SEQ ID NO: 7033848 - DNA, 22 bp, Homo sapiens
actgagaatattggctggcaca

SEQ ID NO: 7033849 - DNA, 19 bp, Homo sapiens
tgcttaattcctagtaggt

SEQ ID NO: 7033850 - DNA, 22 bp, Homo sapiens
tctgggaataaaactagggact

SEQ ID NO: 7033851 - DNA, 22 bp, Homo sapiens
acccagagtcatggcacttagc

SEQ ID NO: 7033852 - DNA, 18 bp, Homo sapiens
taggaaccacttgcagag

SEQ ID NO: 7033853 - DNA, 22 bp, Homo sapiens
cagccaccatacagcagaagct

SEQ ID NO: 7033854 - DNA, 22 bp, Homo sapiens
tctcagggcgcagtgaggcagt

SEQ ID NO: 7033855 - DNA, 22 bp, Homo sapiens
tagaagtttaaattcaccatgc

SEQ ID NO: 7033856 - DNA, 22 bp, Homo sapiens
ggcttgggagcaggcatgtgac

SEQ ID NO: 7033857 - DNA, 22 bp, Homo sapiens
tgatcacaagtctgaagaatga

SEQ ID NO: 7033858 - DNA, 22 bp, Homo sapiens
atagatgttcaatcagatattt

SEQ ID NO: 7033859 - DNA, 22 bp, Homo sapiens
agcaacttctacagatatagca

SEQ ID NO: 7033860 - DNA, 22 bp, Homo sapiens
aaaggctcatacagaaaataca

SEQ ID NO: 7033861 - DNA, 22 bp, Homo sapiens
gttttctaccagggaagagagt

SEQ ID NO: 7033862 - DNA, 22 bp, Homo sapiens
ttctgtcagcgtcagaaattct

SEQ ID NO: 7033863 - DNA, 17 bp, Homo sapiens
ggaaatgtacctctttt

SEQ ID NO: 7033864 - DNA, 22 bp, Homo sapiens
ttacagtgctcttcaagacttc

SEQ ID NO: 7033865 - DNA, 22 bp, Homo sapiens
gaacagtacagttgagtagttg

SEQ ID NO: 7033866 - DNA, 19 bp, Homo sapiens
acacatgctcctggagcct

SEQ ID NO: 7033867 - DNA, 22 bp, Homo sapiens
agtgtaaacttaagagaatatc

SEQ ID NO: 7033868 - DNA, 22 bp, Homo sapiens
ggcaccttgagggcagaacctt

SEQ ID NO: 7033869 - DNA, 22 bp, Homo sapiens
gctggctttgtcaagggcagca

SEQ ID NO: 7033870 - DNA, 22 bp, Homo sapiens
atgaggagaccaaggcctgatg

SEQ ID NO: 7033871 - DNA, 22 bp, Homo sapiens
gaatatcccgctatgcaaagta

SEQ ID NO: 7033872 - DNA, 22 bp, Homo sapiens
gcagctgctcccttttacagtg

SEQ ID NO: 7033873 - DNA, 22 bp, Homo sapiens
aggaccataagtagggcatgtg

SEQ ID NO: 7033874 - DNA, 22 bp, Homo sapiens
aaaatattttagggccaggaga

SEQ ID NO: 7033875 - DNA, 22 bp, Homo sapiens
aaagagccagggcattaggtga

SEQ ID NO: 7033876 - DNA, 22 bp, Homo sapiens
aaagagccgctgatgtcagccc

SEQ ID NO: 7033877 - DNA, 22 bp, Homo sapiens
aaacagcagctgtttaatttgc

SEQ ID NO: 7033878 - DNA, 22 bp, Homo sapiens
aaatataatttctgcctcaata

SEQ ID NO: 7033879 - DNA, 22 bp, Homo sapiens
aagcctgctttgttccacagca

SEQ ID NO: 7033880 - DNA, 22 bp, Homo sapiens
aagccttcagtccgttgcagag

SEQ ID NO: 7033881 - DNA, 22 bp, Homo sapiens
aaggctgggtttgggatgtgat

SEQ ID NO: 7033882 - DNA, 22 bp, Homo sapiens
aaggctggtcagatgtggtgaa

SEQ ID NO: 7033883 - DNA, 22 bp, Homo sapiens
aagaaactcactttgggaggca

SEQ ID NO: 7033884 - DNA, 22 bp, Homo sapiens
aagaaactgaaagtggcttcat

SEQ ID NO: 7033885 - DNA, 22 bp, Homo sapiens
aagaaactggaatatagagagc

SEQ ID NO: 7033886 - DNA, 22 bp, Homo sapiens
aagaaactgttgcgtgacagcg

SEQ ID NO: 7033887 - DNA, 20 bp, Homo sapiens
aagaaacttgaaagtacaag

SEQ ID NO: 7033888 - DNA, 21 bp, Homo sapiens
acacaaacctcctcagcctgg

SEQ ID NO: 7033889 - DNA, 22 bp, Homo sapiens
aagccttcctgagtgcaaggcc

SEQ ID NO: 7033890 - DNA, 22 bp, Homo sapiens
acagggcagagggcagttggta

SEQ ID NO: 7033891 - DNA, 22 bp, Homo sapiens
acagtgttcttggcgctgagtg

SEQ ID NO: 7033892 - DNA, 22 bp, Homo sapiens
acagtgttgaggtgcttgtttc

SEQ ID NO: 7033893 - DNA, 22 bp, Homo sapiens
acagtgttgtatttagtttgat

SEQ ID NO: 7033894 - DNA, 22 bp, Homo sapiens
acagtgttgtggctcttaatag

SEQ ID NO: 7033895 - DNA, 22 bp, Homo sapiens
acagtgtttaaaaatcagatct

SEQ ID NO: 7033896 - DNA, 22 bp, Homo sapiens
acagtgtttaaaataatatgct

SEQ ID NO: 7033897 - DNA, 22 bp, Homo sapiens
acagtgtttaagagatggcatt

SEQ ID NO: 7033898 - DNA, 22 bp, Homo sapiens
acagtgtttatgtacagattgt

SEQ ID NO: 7033899 - DNA, 22 bp, Homo sapiens
acagtgtttcacttaaccgttt

SEQ ID NO: 7033900 - DNA, 22 bp, Homo sapiens
acagtgtttggcaatgcatgca

SEQ ID NO: 7033901 - DNA, 19 bp, Homo sapiens
acatatgtggatatacatg

SEQ ID NO: 7033902 - DNA, 22 bp, Homo sapiens
aaggccttaaagctctctccag

SEQ ID NO: 7033903 - DNA, 22 bp, Homo sapiens
aaggctgggaaacatgcaggcc

SEQ ID NO: 7033904 - DNA, 22 bp, Homo sapiens
aattaaaaaaggagagcttgct

SEQ ID NO: 7033905 - DNA, 22 bp, Homo sapiens
agagccagttgttaagcactta

SEQ ID NO: 7033906 - DNA, 22 bp, Homo sapiens
acacccaggctggcgtgcagtg

SEQ ID NO: 7033907 - DNA, 22 bp, Homo sapiens
acactgagattttcctgacacc

SEQ ID NO: 7033908 - DNA, 22 bp, Homo sapiens
acactgagccatacaactggaa

SEQ ID NO: 7033909 - DNA, 22 bp, Homo sapiens
acactgagttttaccaggcaca

SEQ ID NO: 7033910 - DNA, 22 bp, Homo sapiens
acagagctaaatttcaatccca

SEQ ID NO: 7033911 - DNA, 22 bp, Homo sapiens
acagctctccctcagagaaatg

SEQ ID NO: 7033912 - DNA, 22 bp, Homo sapiens
acagctctgagatattactatt

SEQ ID NO: 7033913 - DNA, 22 bp, Homo sapiens
acagggagtctgaggggatagt

SEQ ID NO: 7033914 - DNA, 20 bp, Homo sapiens
aggaggaagaaagcacactg

SEQ ID NO: 7033915 - DNA, 22 bp, Homo sapiens
acagtgttctgctttttaatcc

SEQ ID NO: 7033916 - DNA, 22 bp, Homo sapiens
acagtgttttagaaaagcttga

SEQ ID NO: 7033917 - DNA, 22 bp, Homo sapiens
acagtgttcttgatattacagt

SEQ ID NO: 7033918 - DNA, 22 bp, Homo sapiens
acagtgttttatgagaattgtt

SEQ ID NO: 7033919 - DNA, 22 bp, Homo sapiens
acagtgttttcttaaggagaaa

SEQ ID NO: 7033920 - DNA, 22 bp, Homo sapiens
acagtgttttgtctggcagggc

SEQ ID NO: 7033921 - DNA, 20 bp, Homo sapiens
acagtgtttttgagtagagc

SEQ ID NO: 7033922 - DNA, 22 bp, Homo sapiens
aggcaggcactccggaagtgtc

SEQ ID NO: 7033923 - DNA, 22 bp, Homo sapiens
aggcaggggagctggaagggta

SEQ ID NO: 7033924 - DNA, 22 bp, Homo sapiens
acatgaaagttattctgagttg

SEQ ID NO: 7033925 - DNA, 19 bp, Homo sapiens
agggttacccgctgccacc

SEQ ID NO: 7033926 - DNA, 22 bp, Homo sapiens
acctgtggatcagattcttgta

SEQ ID NO: 7033927 - DNA, 22 bp, Homo sapiens
accttcacctccacaccttggg

SEQ ID NO: 7033928 - DNA, 22 bp, Homo sapiens
actgcaacctccacctcctggg

SEQ ID NO: 7033929 - DNA, 21 bp, Homo sapiens
agtttcctcaactgcagaagg

SEQ ID NO: 7033930 - DNA, 22 bp, Homo sapiens
actttggggatctacggctgga

SEQ ID NO: 7033931 - DNA, 22 bp, Homo sapiens
actttgggtaagccaggtgcta

SEQ ID NO: 7033932 - DNA, 22 bp, Homo sapiens
atccagctttgtctggtcttcg

SEQ ID NO: 7033933 - DNA, 22 bp, Homo sapiens
atgcaggggccgcctggccagg

SEQ ID NO: 7033934 - DNA, 22 bp, Homo sapiens
attaaagaaacccagcatgtga

SEQ ID NO: 7033935 - DNA, 22 bp, Homo sapiens
attaaagacagcagatggatgg

SEQ ID NO: 7033936 - DNA, 22 bp, Homo sapiens
agagggtgggcacgtgatggat

SEQ ID NO: 7033937 - DNA, 22 bp, Homo sapiens
caactgagcagtagcgtctgga

SEQ ID NO: 7033938 - DNA, 19 bp, Homo sapiens
cacagggcaggtctcatgt

SEQ ID NO: 7033939 - DNA, 22 bp, Homo sapiens
agcagggcagtgcttcagctct

SEQ ID NO: 7033940 - DNA, 22 bp, Homo sapiens
agcagggcctggcactcctggg

SEQ ID NO: 7033941 - DNA, 22 bp, Homo sapiens
agcagggctcacattagtggat

SEQ ID NO: 7033942 - DNA, 22 bp, Homo sapiens
agcagggctccatttcactgcc

SEQ ID NO: 7033943 - DNA, 22 bp, Homo sapiens
cagaactgagtctcatggccat

SEQ ID NO: 7033944 - DNA, 22 bp, Homo sapiens
agctctctgataaattgataaa

SEQ ID NO: 7033945 - DNA, 22 bp, Homo sapiens
agctggcagtatgactggtgac

SEQ ID NO: 7033946 - DNA, 22 bp, Homo sapiens
agctggcagtatgactggtgac

SEQ ID NO: 7033947 - DNA, 22 bp, Homo sapiens
agctggcagtcatcctagtgag

SEQ ID NO: 7033948 - DNA, 22 bp, Homo sapiens
agctggcagtcggccttgatgc

SEQ ID NO: 7033949 - DNA, 21 bp, Homo sapiens
agctggcagtgcctggacctc

SEQ ID NO: 7033950 - DNA, 22 bp, Homo sapiens
agctggcagttgcgataatgca

SEQ ID NO: 7033951 - DNA, 22 bp, Homo sapiens
agctggcatactttgctaggaa

SEQ ID NO: 7033952 - DNA, 22 bp, Homo sapiens
agctggcatactttgctaggaa

SEQ ID NO: 7033953 - DNA, 22 bp, Homo sapiens
agctggcatcgagcatttgaac

SEQ ID NO: 7033954 - DNA, 22 bp, Homo sapiens
agctggcatctgaagtcagggc

SEQ ID NO: 7033955 - DNA, 22 bp, Homo sapiens
agctggcattacaggagcatgc

SEQ ID NO: 7033956 - DNA, 22 bp, Homo sapiens
agctggcattctccttgttatt

SEQ ID NO: 7033957 - DNA, 22 bp, Homo sapiens
agctggcattgaagaatggtta

SEQ ID NO: 7033958 - DNA, 22 bp, Homo sapiens
agctggcattgaagaatggtta

SEQ ID NO: 7033959 - DNA, 22 bp, Homo sapiens
agctggcattgcagggagctgc

SEQ ID NO: 7033960 - DNA, 22 bp, Homo sapiens
agctggctgggtgccagtctcc

SEQ ID NO: 7033961 - DNA, 22 bp, Homo sapiens
agctgggaagactggaagacag

SEQ ID NO: 7033962 - DNA, 22 bp, Homo sapiens
agctgtgtggtgtctgacagct

SEQ ID NO: 7033963 - DNA, 22 bp, Homo sapiens
aggaggaagggaagacaagtaa

SEQ ID NO: 7033964 - DNA, 22 bp, Homo sapiens
catgcaggaggaaaaagcagct

SEQ ID NO: 7033965 - DNA, 21 bp, Homo sapiens
catgcaggatttaacctagaa

SEQ ID NO: 7033966 - DNA, 22 bp, Homo sapiens
catgcaggcacccagagcccac

SEQ ID NO: 7033967 - DNA, 22 bp, Homo sapiens
catgcaggcccgcctgaatggg

SEQ ID NO: 7033968 - DNA, 22 bp, Homo sapiens
catgcaggcctatggagcagtg

SEQ ID NO: 7033969 - DNA, 22 bp, Homo sapiens
aggcagtgagcagggtgtcatg

SEQ ID NO: 7033970 - DNA, 22 bp, Homo sapiens
aggcagtggatgtcaggaatgg

SEQ ID NO: 7033971 - DNA, 22 bp, Homo sapiens
aggctgtgtggtcatggtggct

SEQ ID NO: 7033972 - DNA, 22 bp, Homo sapiens
agggaagggcagggtctatgca

SEQ ID NO: 7033973 - DNA, 19 bp, Homo sapiens
agggaatccggctgaggga

SEQ ID NO: 7033974 - DNA, 22 bp, Homo sapiens
agggaatggatgatggcaggtt

SEQ ID NO: 7033975 - DNA, 22 bp, Homo sapiens
agggagagtagatatcaggtgt

SEQ ID NO: 7033976 - DNA, 22 bp, Homo sapiens
agggagccaggggccagctatt

SEQ ID NO: 7033977 - DNA, 22 bp, Homo sapiens
agggccagagtggcaaaagcct

SEQ ID NO: 7033978 - DNA, 22 bp, Homo sapiens
agggccagccgacttccagcct

SEQ ID NO: 7033979 - DNA, 22 bp, Homo sapiens
agggccagctagagccctcgcc

SEQ ID NO: 7033980 - DNA, 22 bp, Homo sapiens
agggccagctgcagaattagca

SEQ ID NO: 7033981 - DNA, 18 bp, Homo sapiens
agggccagctgtgagtag

SEQ ID NO: 7033982 - DNA, 22 bp, Homo sapiens
agggccagggaaacgatcagca

SEQ ID NO: 7033983 - DNA, 22 bp, Homo sapiens
cctctctctcctgcacacacac

SEQ ID NO: 7033984 - DNA, 22 bp, Homo sapiens
cctggcagcgccgaagctggcc

SEQ ID NO: 7033985 - DNA, 22 bp, Homo sapiens
cctggcagcgtgccgagctgcg

SEQ ID NO: 7033986 - DNA, 22 bp, Homo sapiens
cctggcagctaagtgctttgag

SEQ ID NO: 7033987 - DNA, 22 bp, Homo sapiens
cctggcagctgtttggcttggc

SEQ ID NO: 7033988 - DNA, 22 bp, Homo sapiens
cctggctgctttcactatggag

SEQ ID NO: 7033989 - DNA, 23 bp, Homo sapiens
cctggctggattctctgcattca

SEQ ID NO: 7033990 - DNA, 22 bp, Homo sapiens
aggtgggaacccagcagggccc

SEQ ID NO: 7033991 - DNA, 22 bp, Homo sapiens
aggtgggacccgtggggtgcga

SEQ ID NO: 7033992 - DNA, 22 bp, Homo sapiens
cgagcatgatgacggctgtggc

SEQ ID NO: 7033993 - DNA, 22 bp, Homo sapiens
cggaggggtttgaacagaggag

SEQ ID NO: 7033994 - DNA, 22 bp, Homo sapiens
agtctcagccacacagacctat

SEQ ID NO: 7033995 - DNA, 22 bp, Homo sapiens
ctccttctgggcctggcagtgg

SEQ ID NO: 7033996 - DNA, 22 bp, Homo sapiens
agtgggagaatgaataagggcc

SEQ ID NO: 7033997 - DNA, 22 bp, Homo sapiens
agtgggagagaagcaagtagta

SEQ ID NO: 7033998 - DNA, 22 bp, Homo sapiens
agttgtcccggtctagccactt

SEQ ID NO: 7033999 - DNA, 18 bp, Homo sapiens
ctgcccagagcacttgtg

SEQ ID NO: 7034000 - DNA, 22 bp, Homo sapiens
ctgctgtgtgaccatggacagg

SEQ ID NO: 7034001 - DNA, 22 bp, Homo sapiens
ctgggaagtagaatcagatgag

SEQ ID NO: 7034002 - DNA, 22 bp, Homo sapiens
atatgcaagcacatagaatact

SEQ ID NO: 7034003 - DNA, 23 bp, Homo sapiens
atatgtcatgcaccagcacttta

SEQ ID NO: 7034004 - DNA, 22 bp, Homo sapiens
atccccaggggcattcaagctt

SEQ ID NO: 7034005 - DNA, 22 bp, Homo sapiens
cttggctgaactccaggatgca

SEQ ID NO: 7034006 - DNA, 22 bp, Homo sapiens
atgagtgtgaagttagctcagt

SEQ ID NO: 7034007 - DNA, 20 bp, Homo sapiens
atgcaaactcacaaaatacc

SEQ ID NO: 7034008 - DNA, 22 bp, Homo sapiens
atgcagagacagatgtggcatg

SEQ ID NO: 7034009 - DNA, 22 bp, Homo sapiens
atggcagggactgtggcccttg

SEQ ID NO: 7034010 - DNA, 22 bp, Homo sapiens
atggcagggcacagctctagtt

SEQ ID NO: 7034011 - DNA, 22 bp, Homo sapiens
atggcagggcagcctctcagag

SEQ ID NO: 7034012 - DNA, 22 bp, Homo sapiens
atggcagtgataggctagtgat

SEQ ID NO: 7034013 - DNA, 22 bp, Homo sapiens
gagagctgtggtttgaccaggc

SEQ ID NO: 7034014 - DNA, 22 bp, Homo sapiens
gagctgggcctgcgagtgctgc

SEQ ID NO: 7034015 - DNA, 22 bp, Homo sapiens
gagctgggcgagccggggaagt

SEQ ID NO: 7034016 - DNA, 21 bp, Homo sapiens
gagctgggcgaggctccgggg

SEQ ID NO: 7034017 - DNA, 18 bp, Homo sapiens
atgtacatttgctaaagc

SEQ ID NO: 7034018 - DNA, 22 bp, Homo sapiens
gaggagctggctgtcgggaggc

SEQ ID NO: 7034019 - DNA, 22 bp, Homo sapiens
gaggagctgggctgagagggtc

SEQ ID NO: 7034020 - DNA, 22 bp, Homo sapiens
gaggggagaggcttatggatca

SEQ ID NO: 7034021 - DNA, 20 bp, Homo sapiens
attattcatacatgtgtgac

SEQ ID NO: 7034022 - DNA, 22 bp, Homo sapiens
attgaagattaaatgcttcctt

SEQ ID NO: 7034023 - DNA, 22 bp, Homo sapiens
attggaaatacagtagaaaaat

SEQ ID NO: 7034024 - DNA, 22 bp, Homo sapiens
gcgagggcacgcggttgaaggc

SEQ ID NO: 7034025 - DNA, 22 bp, Homo sapiens
caaaccttgcagaactgggcag

SEQ ID NO: 7034026 - DNA, 22 bp, Homo sapiens
gctgccttcccaggcctttgct

SEQ ID NO: 7034027 - DNA, 22 bp, Homo sapiens
gctgccttcccggaatgtcatc

SEQ ID NO: 7034028 - DNA, 20 bp, Homo sapiens
gctgccttgtcctgcttggt

SEQ ID NO: 7034029 - DNA, 22 bp, Homo sapiens
gctgctggatgcgcttgatggt

SEQ ID NO: 7034030 - DNA, 22 bp, Homo sapiens
gctgctggccccacatgctcca

SEQ ID NO: 7034031 - DNA, 22 bp, Homo sapiens
gcttggcatacacttagtgcgt

SEQ ID NO: 7034032 - DNA, 22 bp, Homo sapiens
gcttggcatatacttagtgcat

SEQ ID NO: 7034033 - DNA, 22 bp, Homo sapiens
gcttggcatttgctgggagctg

SEQ ID NO: 7034034 - DNA, 22 bp, Homo sapiens
cacagctgttttctccaggcag

SEQ ID NO: 7034035 - DNA, 22 bp, Homo sapiens
ggagggaggttagattcaagct

SEQ ID NO: 7034036 - DNA, 22 bp, Homo sapiens
ggcactgggagaggtgagacgg

SEQ ID NO: 7034037 - DNA, 22 bp, Homo sapiens
cacagtgtagactaataataga

SEQ ID NO: 7034038 - DNA, 22 bp, Homo sapiens
cacagtgtctgtgcttcagtgt

SEQ ID NO: 7034039 - DNA, 22 bp, Homo sapiens
cacagtgtgactgaccttcagc

SEQ ID NO: 7034040 - DNA, 22 bp, Homo sapiens
cacagtgtgggcatggtgcctg

SEQ ID NO: 7034041 - DNA, 22 bp, Homo sapiens
cactgaggactcccacgtaggt

SEQ ID NO: 7034042 - DNA, 22 bp, Homo sapiens
cactgaggagagaggtaactag

SEQ ID NO: 7034043 - DNA, 21 bp, Homo sapiens
cactgaggaggaaaaggagct

SEQ ID NO: 7034044 - DNA, 22 bp, Homo sapiens
cactgaggctgggggagaaggt

SEQ ID NO: 7034045 - DNA, 22 bp, Homo sapiens
ggctagggagacagagggcatg

SEQ ID NO: 7034046 - DNA, 22 bp, Homo sapiens
cactggaagagcatctgagcca

SEQ ID NO: 7034047 - DNA, 22 bp, Homo sapiens
cactggaatggatagagcagag

SEQ ID NO: 7034048 - DNA, 22 bp, Homo sapiens
cactggaatgttgaggagacaa

SEQ ID NO: 7034049 - DNA, 22 bp, Homo sapiens
cactggaattcaagatactgag

SEQ ID NO: 7034050 - DNA, 21 bp, Homo sapiens
cactggaattttctgtgacat

SEQ ID NO: 7034051 - DNA, 22 bp, Homo sapiens
cactggctaaaaaagaggcaga

SEQ ID NO: 7034052 - DNA, 22 bp, Homo sapiens
gggaaaggatcagtgggaggct

SEQ ID NO: 7034053 - DNA, 22 bp, Homo sapiens
gggactggaactactggtgcag

SEQ ID NO: 7034054 - DNA, 19 bp, Homo sapiens
gggactggaggatgtggag

SEQ ID NO: 7034055 - DNA, 22 bp, Homo sapiens
gggactggagtagaggccggtg

SEQ ID NO: 7034056 - DNA, 22 bp, Homo sapiens
gggactggatagatgtgggtga

SEQ ID NO: 7034057 - DNA, 22 bp, Homo sapiens
gggactggcacagggctgggag

SEQ ID NO: 7034058 - DNA, 22 bp, Homo sapiens
gggactggccagggtttggaat

SEQ ID NO: 7034059 - DNA, 21 bp, Homo sapiens
gggcgaggcctgatgtggctc

SEQ ID NO: 7034060 - DNA, 22 bp, Homo sapiens
gggcgagggcgaaagcgagagc

SEQ ID NO: 7034061 - DNA, 22 bp, Homo sapiens
cagagctgattggatccagaga

SEQ ID NO: 7034062 - DNA, 22 bp, Homo sapiens
gggtgggactctttggcctgag

SEQ ID NO: 7034063 - DNA, 22 bp, Homo sapiens
ggtgggagagctctgtctccag

SEQ ID NO: 7034064 - DNA, 22 bp, Homo sapiens
ggtgggagagctctgtctccag

SEQ ID NO: 7034065 - DNA, 22 bp, Homo sapiens
ggtggggtcacgacagagggaa

SEQ ID NO: 7034066 - DNA, 22 bp, Homo sapiens
ggtggggttttaggctgctgca

SEQ ID NO: 7034067 - DNA, 22 bp, Homo sapiens
gtaaaattctagcatctgaaag

SEQ ID NO: 7034068 - DNA, 22 bp, Homo sapiens
gtggcaggttccgtagacagca

SEQ ID NO: 7034069 - DNA, 22 bp, Homo sapiens
cagctgaggaatactagatgta

SEQ ID NO: 7034070 - DNA, 22 bp, Homo sapiens
cagctgagtggaccctagaggc

SEQ ID NO: 7034071 - DNA, 22 bp, Homo sapiens
gttctgtctgagcaccacagga

SEQ ID NO: 7034072 - DNA, 22 bp, Homo sapiens
gttggcactactccttgcttaa

SEQ ID NO: 7034073 - DNA, 19 bp, Homo sapiens
gttggcactgaaaatggct

SEQ ID NO: 7034074 - DNA, 22 bp, Homo sapiens
gttggcacttcataatatgaaa

SEQ ID NO: 7034075 - DNA, 22 bp, Homo sapiens
gtttggcaagaagaggagtaag

SEQ ID NO: 7034076 - DNA, 22 bp, Homo sapiens
gtttggcaatatttgtggaaca

SEQ ID NO: 7034077 - DNA, 22 bp, Homo sapiens
gtttggcacatgaacctatttt

SEQ ID NO: 7034078 - DNA, 22 bp, Homo sapiens
gtttggcagagcatggggatga

SEQ ID NO: 7034079 - DNA, 22 bp, Homo sapiens
gtttggcagtgttatgtaggtt

SEQ ID NO: 7034080 - DNA, 22 bp, Homo sapiens
gtttggcataaatattttcacc

SEQ ID NO: 7034081 - DNA, 18 bp, Homo sapiens
gtttggcataactgatgc

SEQ ID NO: 7034082 - DNA, 22 bp, Homo sapiens
gtttggcatctcacttaaaccg

SEQ ID NO: 7034083 - DNA, 22 bp, Homo sapiens
caggaggcccaaagggcgcaga

SEQ ID NO: 7034084 - DNA, 22 bp, Homo sapiens
tacaggggtaacagtggggaat

SEQ ID NO: 7034085 - DNA, 22 bp, Homo sapiens
tacatgtgttctgtttcaagtt

SEQ ID NO: 7034086 - DNA, 22 bp, Homo sapiens
tatggctggaatactgaaaggc

SEQ ID NO: 7034087 - DNA, 22 bp, Homo sapiens
tcagctctgttttgagtggaac

SEQ ID NO: 7034088 - DNA, 22 bp, Homo sapiens
tcagctcttccccccagccagg

SEQ ID NO: 7034089 - DNA, 22 bp, Homo sapiens
catgggaggcctgctgctggtg

SEQ ID NO: 7034090 - DNA, 21 bp, Homo sapiens
tcccagggccaggtgccatca

SEQ ID NO: 7034091 - DNA, 22 bp, Homo sapiens
ccacagctagggcaatctgatt

SEQ ID NO: 7034092 - DNA, 22 bp, Homo sapiens
tcctggggagggttctggctcc

SEQ ID NO: 7034093 - DNA, 22 bp, Homo sapiens
ccactgagaccttttggaggag

SEQ ID NO: 7034094 - DNA, 22 bp, Homo sapiens
ccactgagcagtagctgcgtcg

SEQ ID NO: 7034095 - DNA, 22 bp, Homo sapiens
ccactgaggaacatgggctcca

SEQ ID NO: 7034096 - DNA, 22 bp, Homo sapiens
ccactgaggcaggcagtatcta

SEQ ID NO: 7034097 - DNA, 19 bp, Homo sapiens
ccactgaggcttggttctt

SEQ ID NO: 7034098 - DNA, 22 bp, Homo sapiens
ccactgagtacccgatggctgc

SEQ ID NO: 7034099 - DNA, 22 bp, Homo sapiens
cccagcgagtttgccggtgaac

SEQ ID NO: 7034100 - DNA, 22 bp, Homo sapiens
tgcagggagctctggggtgcag

SEQ ID NO: 7034101 - DNA, 22 bp, Homo sapiens
cccagctccgagctccgagccg

SEQ ID NO: 7034102 - DNA, 22 bp, Homo sapiens
cccccggttcctgtttgcagag

SEQ ID NO: 7034103 - DNA, 22 bp, Homo sapiens
tggagctgactcacaccagcta

SEQ ID NO: 7034104 - DNA, 22 bp, Homo sapiens
tggcaaggaaattagttctcct

SEQ ID NO: 7034105 - DNA, 22 bp, Homo sapiens
tggcacagggcttggtcgctca

SEQ ID NO: 7034106 - DNA, 22 bp, Homo sapiens
tggcagctgtctgtggggtctc

SEQ ID NO: 7034107 - DNA, 22 bp, Homo sapiens
tggccaggaggctgcttctgac

SEQ ID NO: 7034108 - DNA, 23 bp, Homo sapiens
tggccaggcataaaggtgggtgg

SEQ ID NO: 7034109 - DNA, 22 bp, Homo sapiens
tggcccagccctgctctagggc

SEQ ID NO: 7034110 - DNA, 22 bp, Homo sapiens
tggctgccgactggctcttggc

SEQ ID NO: 7034111 - DNA, 22 bp, Homo sapiens
tggctgcctagtgtctgagcag

SEQ ID NO: 7034112 - DNA, 21 bp, Homo sapiens
tggctgcctggctctgtggtt

SEQ ID NO: 7034113 - DNA, 22 bp, Homo sapiens
cctggcagactgtgagggcagg

SEQ ID NO: 7034114 - DNA, 22 bp, Homo sapiens
tgtcatgggcatttattgaggg

SEQ ID NO: 7034115 - DNA, 22 bp, Homo sapiens
tgtcatgggtctaaacattgat

SEQ ID NO: 7034116 - DNA, 23 bp, Homo sapiens
cctggcagcaaacgaggaggtta

SEQ ID NO: 7034117 - DNA, 22 bp, Homo sapiens
cctggcagcaggtgggcccgtg

SEQ ID NO: 7034118 - DNA, 22 bp, Homo sapiens
cctggcagcattggtagagatt

SEQ ID NO: 7034119 - DNA, 18 bp, Homo sapiens
cctggcagccatgcgcgc

SEQ ID NO: 7034120 - DNA, 22 bp, Homo sapiens
cctggcagcccagagcgccgct

SEQ ID NO: 7034121 - DNA, 22 bp, Homo sapiens
cctggcaggcaagaggaaggga

SEQ ID NO: 7034122 - DNA, 22 bp, Homo sapiens
cctggcaggctggggacagtgc

SEQ ID NO: 7034123 - DNA, 22 bp, Homo sapiens
cctggcagggctgcagtaatgg

SEQ ID NO: 7034124 - DNA, 22 bp, Homo sapiens
cctggcaggtagcattgaggag

SEQ ID NO: 7034125 - DNA, 22 bp, Homo sapiens
cctggcaggtggcgccctcggc

SEQ ID NO: 7034126 - DNA, 22 bp, Homo sapiens
cctggcaggttacaaccagtta

SEQ ID NO: 7034127 - DNA, 22 bp, Homo sapiens
cctggcagtcaggggagtcctt

SEQ ID NO: 7034128 - DNA, 22 bp, Homo sapiens
cctggcagtggtgaagaagagg

SEQ ID NO: 7034129 - DNA, 22 bp, Homo sapiens
cctggcagttcatcaaatggca

SEQ ID NO: 7034130 - DNA, 22 bp, Homo sapiens
cctggcagttttgcccaggatt

SEQ ID NO: 7034131 - DNA, 22 bp, Homo sapiens
tgtctcatctcttaaccccact

SEQ ID NO: 7034132 - DNA, 21 bp, Homo sapiens
tgtctttggcctcattcccag

SEQ ID NO: 7034133 - DNA, 22 bp, Homo sapiens
tgtgagggttttaagggaatga

SEQ ID NO: 7034134 - DNA, 22 bp, Homo sapiens
ttcctttgggaaatcactaagg

SEQ ID NO: 7034135 - DNA, 22 bp, Homo sapiens
ctaggctgagctgggctgagct

SEQ ID NO: 7034136 - DNA, 22 bp, Homo sapiens
ctaggctgcacctaggatggct

SEQ ID NO: 7034137 - DNA, 22 bp, Homo sapiens
ctaggctgcagatgcatggaat

SEQ ID NO: 7034138 - DNA, 22 bp, Homo sapiens
ctaggctggagtgcagtggcac

SEQ ID NO: 7034139 - DNA, 22 bp, Homo sapiens
ctaggctggagtgcagtggcat

SEQ ID NO: 7034140 - DNA, 22 bp, Homo sapiens
ctaggctggagtgcattggcgt

SEQ ID NO: 7034141 - DNA, 22 bp, Homo sapiens
ctaggctgtaaagagctaggag

SEQ ID NO: 7034142 - DNA, 22 bp, Homo sapiens
ctaggctgtaacccctgccagg

SEQ ID NO: 7034143 - DNA, 22 bp, Homo sapiens
ctagggagtggcagagctggga

SEQ ID NO: 7034144 - DNA, 22 bp, Homo sapiens
ttgactgcaccactcagccctc

SEQ ID NO: 7034145 - DNA, 22 bp, Homo sapiens
ttggcattgaagtttcattggt

SEQ ID NO: 7034146 - DNA, 22 bp, Homo sapiens
ttggcattggagatgcaagaac

SEQ ID NO: 7034147 - DNA, 22 bp, Homo sapiens
ttgggcacactttgctggggag

SEQ ID NO: 7034148 - DNA, 22 bp, Homo sapiens
ctccagggatgagacagagtag

SEQ ID NO: 7034149 - DNA, 22 bp, Homo sapiens
tttacatggaatattgtcttgt

SEQ ID NO: 7034150 - DNA, 22 bp, Homo sapiens
ctcctggctatgactacatttc

SEQ ID NO: 7034151 - DNA, 22 bp, Homo sapiens
ctcctgggagctgtggcagagc

SEQ ID NO: 7034152 - DNA, 22 bp, Homo sapiens
ctgagactgtaccacttcctcc

SEQ ID NO: 7034153 - DNA, 22 bp, Homo sapiens
ctgaggagggaagtccccaaag

SEQ ID NO: 7034154 - DNA, 22 bp, Homo sapiens
ctgcagactagatagaaactga

SEQ ID NO: 7034155 - DNA, 22 bp, Homo sapiens
ctgccgagtgggtcatgaggca

SEQ ID NO: 7034156 - DNA, 22 bp, Homo sapiens
ctggacagaaaccagtcctggg

SEQ ID NO: 7034157 - DNA, 22 bp, Homo sapiens
ctggcacgcccacgtaggcact

SEQ ID NO: 7034158 - DNA, 22 bp, Homo sapiens
ctggcagatagccacgcctgtc

SEQ ID NO: 7034159 - DNA, 22 bp, Homo sapiens
ctggcaggtccagctggactca

SEQ ID NO: 7034160 - DNA, 22 bp, Homo sapiens
ctggcagtcacggccatgtgct

SEQ ID NO: 7034161 - DNA, 22 bp, Homo sapiens
ctggcagtggggcctcagtgtt

SEQ ID NO: 7034162 - DNA, 22 bp, Homo sapiens
ctggcagtgtccagctcgtgat

SEQ ID NO: 7034163 - DNA, 22 bp, Homo sapiens
ctggcagtttgccaggagctcg

SEQ ID NO: 7034164 - DNA, 22 bp, Homo sapiens
ctggcctggcagggagggcatg

SEQ ID NO: 7034165 - DNA, 22 bp, Homo sapiens
ctggctggaggtgagtcactga

SEQ ID NO: 7034166 - DNA, 22 bp, Homo sapiens
ctggctggagtgcaggtgagtg

SEQ ID NO: 7034167 - DNA, 22 bp, Homo sapiens
ctggctgggcagacagaatgct

SEQ ID NO: 7034168 - DNA, 22 bp, Homo sapiens
ctggctggggtaccagttgaac

SEQ ID NO: 7034169 - DNA, 22 bp, Homo sapiens
ctggctggtagaattgtgacct

SEQ ID NO: 7034170 - DNA, 22 bp, Homo sapiens
ctggctggtcatcagcagtacg

SEQ ID NO: 7034171 - DNA, 22 bp, Homo sapiens
ctggctggtcatgtcatgagcc

SEQ ID NO: 7034172 - DNA, 22 bp, Homo sapiens
ctggctggtctgagcagtcgca

SEQ ID NO: 7034173 - DNA, 22 bp, Homo sapiens
ctggctggttccctgctccagg

SEQ ID NO: 7034174 - DNA, 17 bp, Homo sapiens
cttggctgctgtgcgat

SEQ ID NO: 7034175 - DNA, 22 bp, Homo sapiens
cttggctgtaaaatcagaggct

SEQ ID NO: 7034176 - DNA, 22 bp, Homo sapiens
gaaatacaaagccagccatttt

SEQ ID NO: 7034177 - DNA, 22 bp, Homo sapiens
gaactgagaaggactagcccat

SEQ ID NO: 7034178 - DNA, 22 bp, Homo sapiens
gaactgggaatgctgtcccatc

SEQ ID NO: 7034179 - DNA, 22 bp, Homo sapiens
gaactggtgaagtgaagggcag

SEQ ID NO: 7034180 - DNA, 22 bp, Homo sapiens
gaaggcctagggatgctctgcg

SEQ ID NO: 7034181 - DNA, 22 bp, Homo sapiens
gaaggcctctccccttctccag

SEQ ID NO: 7034182 - DNA, 20 bp, Homo sapiens
gaaggcttggacagtgacag

SEQ ID NO: 7034183 - DNA, 22 bp, Homo sapiens
gaaggcttttctaccagatctt

SEQ ID NO: 7034184 - DNA, 22 bp, Homo sapiens
gactggaaagcctgtcctcaga

SEQ ID NO: 7034185 - DNA, 22 bp, Homo sapiens
gacttctcccaaccatcagagg

SEQ ID NO: 7034186 - DNA, 22 bp, Homo sapiens
gacttgggctgagggccagcag

SEQ ID NO: 7034187 - DNA, 23 bp, Homo sapiens
gagagctgactgtcaagactgtt

SEQ ID NO: 7034188 - DNA, 18 bp, Homo sapiens
gagagctgctacctagct

SEQ ID NO: 7034189 - DNA, 22 bp, Homo sapiens
gagagtggatggagctgcgaag

SEQ ID NO: 7034190 - DNA, 22 bp, Homo sapiens
gagctgggacatgggtcctctc

SEQ ID NO: 7034191 - DNA, 22 bp, Homo sapiens
gagctgggaggactgggaactt

SEQ ID NO: 7034192 - DNA, 22 bp, Homo sapiens
gaggaggctggcgccgcctgcc

SEQ ID NO: 7034193 - DNA, 22 bp, Homo sapiens
gaggaggctgtttctctgcatt

SEQ ID NO: 7034194 - DNA, 19 bp, Homo sapiens
gaggaggcttcagctttct

SEQ ID NO: 7034195 - DNA, 22 bp, Homo sapiens
gaggagggagaattaggcttaa

SEQ ID NO: 7034196 - DNA, 22 bp, Homo sapiens
gaggagggagctggaagctctt

SEQ ID NO: 7034197 - DNA, 22 bp, Homo sapiens
gaggaggtggagtcatgcagag

SEQ ID NO: 7034198 - DNA, 22 bp, Homo sapiens
gagggccaaagagcaagagcct

SEQ ID NO: 7034199 - DNA, 22 bp, Homo sapiens
gaggggatgcagagaggcttat

SEQ ID NO: 7034200 - DNA, 22 bp, Homo sapiens
gaggggcacagtaaagggtccc

SEQ ID NO: 7034201 - DNA, 22 bp, Homo sapiens
gaggggcaggattattgggatt

SEQ ID NO: 7034202 - DNA, 22 bp, Homo sapiens
gaggggcagtgcacccgggccc

SEQ ID NO: 7034203 - DNA, 22 bp, Homo sapiens
gaggtgggcggatcacaaggtc

SEQ ID NO: 7034204 - DNA, 22 bp, Homo sapiens
gaggtgggtgtatcacaggtca

SEQ ID NO: 7034205 - DNA, 22 bp, Homo sapiens
gagtgaggctggaatcatggct

SEQ ID NO: 7034206 - DNA, 22 bp, Homo sapiens
gagtgagggcagcaggggctgc

SEQ ID NO: 7034207 - DNA, 22 bp, Homo sapiens
gagtgtgggggtgctgaggaca

SEQ ID NO: 7034208 - DNA, 22 bp, Homo sapiens
gagtgtggtatgctctgaggct

SEQ ID NO: 7034209 - DNA, 21 bp, Homo sapiens
gatgaagcaatctttctgttg

SEQ ID NO: 7034210 - DNA, 22 bp, Homo sapiens
gatgaagcctgacttctcggtg

SEQ ID NO: 7034211 - DNA, 22 bp, Homo sapiens
gatgcaggatagcttcacccag

SEQ ID NO: 7034212 - DNA, 22 bp, Homo sapiens
gatgcagggaacttagtgggct

SEQ ID NO: 7034213 - DNA, 22 bp, Homo sapiens
gatgcagggcagctctgggaca

SEQ ID NO: 7034214 - DNA, 22 bp, Homo sapiens
gatgcagggctggcaggagctt

SEQ ID NO: 7034215 - DNA, 22 bp, Homo sapiens
gatgcagggggaacgacgccct

SEQ ID NO: 7034216 - DNA, 22 bp, Homo sapiens
gatgcaggtgtgccacagagct

SEQ ID NO: 7034217 - DNA, 22 bp, Homo sapiens
gattttcatgataaacttgtga

SEQ ID NO: 7034218 - DNA, 22 bp, Homo sapiens
gattttcatttgcactctagaa

SEQ ID NO: 7034219 - DNA, 22 bp, Homo sapiens
gcagggaccttgcccaccctcc

SEQ ID NO: 7034220 - DNA, 22 bp, Homo sapiens
gcaggtggcagaggtgggatct

SEQ ID NO: 7034221 - DNA, 22 bp, Homo sapiens
gcagtggggaatgctggggaga

SEQ ID NO: 7034222 - DNA, 22 bp, Homo sapiens
gcagtggggcgctgggagttgg

SEQ ID NO: 7034223 - DNA, 22 bp, Homo sapiens
gcagtgttaggaataaaaatga

SEQ ID NO: 7034224 - DNA, 22 bp, Homo sapiens
gcagtgttatgttttctataat

SEQ ID NO: 7034225 - DNA, 22 bp, Homo sapiens
gcagtgttcagtgaagcaggag

SEQ ID NO: 7034226 - DNA, 22 bp, Homo sapiens
gcagtgttccttctactggggc

SEQ ID NO: 7034227 - DNA, 22 bp, Homo sapiens
gcagtgttctaaattgggtgtg

SEQ ID NO: 7034228 - DNA, 22 bp, Homo sapiens
gcagtgttcttgttgcttttat

SEQ ID NO: 7034229 - DNA, 22 bp, Homo sapiens
gcagtgttgactatggtatgag

SEQ ID NO: 7034230 - DNA, 22 bp, Homo sapiens
gcagtgttgagccagctggggg

SEQ ID NO: 7034231 - DNA, 22 bp, Homo sapiens
gcagtgttgagtggtggctgaa

SEQ ID NO: 7034232 - DNA, 22 bp, Homo sapiens
gcagtgttgctaggtgcggtga

SEQ ID NO: 7034233 - DNA, 22 bp, Homo sapiens
gcctggcaggcctgggccagca

SEQ ID NO: 7034234 - DNA, 22 bp, Homo sapiens
gcctggcaggggcctgggagtg

SEQ ID NO: 7034235 - DNA, 21 bp, Homo sapiens
gcctggcaggtggaagggctc

SEQ ID NO: 7034236 - DNA, 22 bp, Homo sapiens
gctccaggagagggaagcagat

SEQ ID NO: 7034237 - DNA, 22 bp, Homo sapiens
gctcctggctctctgagggctg

SEQ ID NO: 7034238 - DNA, 22 bp, Homo sapiens
gctcttctcagattgtacactc

SEQ ID NO: 7034239 - DNA, 22 bp, Homo sapiens
gctgagcaacgtggagagtttt

SEQ ID NO: 7034240 - DNA, 22 bp, Homo sapiens
gctgagcacacctagggtagag

SEQ ID NO: 7034241 - DNA, 22 bp, Homo sapiens
gctggcggcagtggtgtctctg

SEQ ID NO: 7034242 - DNA, 22 bp, Homo sapiens
gctgggcaggcctcgtgagggc

SEQ ID NO: 7034243 - DNA, 22 bp, Homo sapiens
gcttccttattgttgccatagt

SEQ ID NO: 7034244 - DNA, 22 bp, Homo sapiens
gcttccttctaccacatcatgc

SEQ ID NO: 7034245 - DNA, 22 bp, Homo sapiens
ggaaactgcttacactagaggg

SEQ ID NO: 7034246 - DNA, 22 bp, Homo sapiens
ggaaactgtagtttgctgacat

SEQ ID NO: 7034247 - DNA, 22 bp, Homo sapiens
ggaactgagcaatggcatgaaa

SEQ ID NO: 7034248 - DNA, 22 bp, Homo sapiens
ggagatggagtggattcagcag

SEQ ID NO: 7034249 - DNA, 22 bp, Homo sapiens
ggagcctgtgggatgagatgtg

SEQ ID NO: 7034250 - DNA, 22 bp, Homo sapiens
ggaggcggggaaggcatcccat

SEQ ID NO: 7034251 - DNA, 22 bp, Homo sapiens
ggaggctgaggcaggcggatca

SEQ ID NO: 7034252 - DNA, 22 bp, Homo sapiens
ggaggggagatgtttgggctca

SEQ ID NO: 7034253 - DNA, 22 bp, Homo sapiens
ggaggggaggtccagctgatct

SEQ ID NO: 7034254 - DNA, 22 bp, Homo sapiens
ggaggggctgagcaactttcag

SEQ ID NO: 7034255 - DNA, 22 bp, Homo sapiens
ggaggggtctctagcgaggaga

SEQ ID NO: 7034256 - DNA, 22 bp, Homo sapiens
ggaggggtctctagcgaggaga

SEQ ID NO: 7034257 - DNA, 22 bp, Homo sapiens
ggaggggtgagaatggctgcct

SEQ ID NO: 7034258 - DNA, 22 bp, Homo sapiens
ggaggggtggtcacctggcagg

SEQ ID NO: 7034259 - DNA, 22 bp, Homo sapiens
ggaggtggcagagggacattct

SEQ ID NO: 7034260 - DNA, 22 bp, Homo sapiens
ggaggtgggagacataggcggc

SEQ ID NO: 7034261 - DNA, 22 bp, Homo sapiens
ggaggtgggattaggacctaaa

SEQ ID NO: 7034262 - DNA, 22 bp, Homo sapiens
ggaggtgggctaaggactctct

SEQ ID NO: 7034263 - DNA, 22 bp, Homo sapiens
ggagtggcagcgaggatcagat

SEQ ID NO: 7034264 - DNA, 22 bp, Homo sapiens
ggagtgggaacaatgacatggt

SEQ ID NO: 7034265 - DNA, 22 bp, Homo sapiens
ggagtgggcagcactgccctgt

SEQ ID NO: 7034266 - DNA, 22 bp, Homo sapiens
ggcaggtggaaggtctccattc

SEQ ID NO: 7034267 - DNA, 22 bp, Homo sapiens
ggcaggtggaagttggcagagc

SEQ ID NO: 7034268 - DNA, 22 bp, Homo sapiens
ggccccagattctgggctgggt

SEQ ID NO: 7034269 - DNA, 22 bp, Homo sapiens
ggctcagtgtttgtggaacata

SEQ ID NO: 7034270 - DNA, 22 bp, Homo sapiens
ggctcctggcatctggtgggta

SEQ ID NO: 7034271 - DNA, 22 bp, Homo sapiens
ggctcctgggcagctgctccct

SEQ ID NO: 7034272 - DNA, 22 bp, Homo sapiens
ggctgcagagctgggtgggcct

SEQ ID NO: 7034273 - DNA, 22 bp, Homo sapiens
ggctgcaggaacgacggagggg

SEQ ID NO: 7034274 - DNA, 22 bp, Homo sapiens
ggctggctggcttagcagagga

SEQ ID NO: 7034275 - DNA, 21 bp, Homo sapiens
ggctgtgttcagggcatgcgg

SEQ ID NO: 7034276 - DNA, 22 bp, Homo sapiens
ggcttcagtgactggtgccctc

SEQ ID NO: 7034277 - DNA, 22 bp, Homo sapiens
gggacgggcacggagggccctc

SEQ ID NO: 7034278 - DNA, 22 bp, Homo sapiens
gggacgggcagtccaaggggtc

SEQ ID NO: 7034279 - DNA, 22 bp, Homo sapiens
gggaggagggtgctggctaaac

SEQ ID NO: 7034280 - DNA, 20 bp, Homo sapiens
gggaggcgagggctgagcag

SEQ ID NO: 7034281 - DNA, 22 bp, Homo sapiens
gggagggaaggaccttatgaat

SEQ ID NO: 7034282 - DNA, 22 bp, Homo sapiens
gggagggaaggtacctgtgtga

SEQ ID NO: 7034283 - DNA, 22 bp, Homo sapiens
gggagggacacaaagagttccc

SEQ ID NO: 7034284 - DNA, 22 bp, Homo sapiens
gggatggggagctggaaagggg

SEQ ID NO: 7034285 - DNA, 22 bp, Homo sapiens
gggccaggtcggtgaatggtca

SEQ ID NO: 7034286 - DNA, 22 bp, Homo sapiens
gggcggggtggctcatgcctgt

SEQ ID NO: 7034287 - DNA, 22 bp, Homo sapiens
ggggaagggagtccaagtgtta

SEQ ID NO: 7034288 - DNA, 22 bp, Homo sapiens
gggggtgacgatggcagctggt

SEQ ID NO: 7034289 - DNA, 22 bp, Homo sapiens
gggtgaagctcctgcaggggcc

SEQ ID NO: 7034290 - DNA, 22 bp, Homo sapiens
gggtgggaaggctaagggattg

SEQ ID NO: 7034291 - DNA, 22 bp, Homo sapiens
gggtgggatggcaggagccgct

SEQ ID NO: 7034292 - DNA, 22 bp, Homo sapiens
gggtgggatggcaggagccgct

SEQ ID NO: 7034293 - DNA, 22 bp, Homo sapiens
ggtgagggtaaatataggcaaa

SEQ ID NO: 7034294 - DNA, 22 bp, Homo sapiens
gtaaacattactgtgctgtata

SEQ ID NO: 7034295 - DNA, 22 bp, Homo sapiens
gtctggcacataagaggagctc

SEQ ID NO: 7034296 - DNA, 22 bp, Homo sapiens
gtctggcagatcgagcagccca

SEQ ID NO: 7034297 - DNA, 22 bp, Homo sapiens
gtgacaggcatggggtcatgca

SEQ ID NO: 7034298 - DNA, 22 bp, Homo sapiens
gtggaaggtgaaggagcagcga

SEQ ID NO: 7034299 - DNA, 22 bp, Homo sapiens
gtggagggtgagctcatgtttg

SEQ ID NO: 7034300 - DNA, 22 bp, Homo sapiens
gtggcaggagactggaagatgg

SEQ ID NO: 7034301 - DNA, 22 bp, Homo sapiens
gtggcaggagtgggccttgaag

SEQ ID NO: 7034302 - DNA, 22 bp, Homo sapiens
gtggcaggatcacggctcactg

SEQ ID NO: 7034303 - DNA, 22 bp, Homo sapiens
gtggcagggagaagccattggg

SEQ ID NO: 7034304 - DNA, 22 bp, Homo sapiens
gtggcagggctttgctgttctt

SEQ ID NO: 7034305 - DNA, 22 bp, Homo sapiens
gtggcaggggcgggctgttccg

SEQ ID NO: 7034306 - DNA, 22 bp, Homo sapiens
gtggcattgacatgtaaacagt

SEQ ID NO: 7034307 - DNA, 22 bp, Homo sapiens
gtggctgctgtcctctctggtt

SEQ ID NO: 7034308 - DNA, 22 bp, Homo sapiens
gtggctggtttcctgcatgcaa

SEQ ID NO: 7034309 - DNA, 22 bp, Homo sapiens
gtggggcttcctggggcaagtt

SEQ ID NO: 7034310 - DNA, 22 bp, Homo sapiens
gtggtgagttcaggctggggtg

SEQ ID NO: 7034311 - DNA, 22 bp, Homo sapiens
gtggtgtaggtcacagttagga

SEQ ID NO: 7034312 - DNA, 22 bp, Homo sapiens
gttctctgagtcctggcaaaat

SEQ ID NO: 7034313 - DNA, 22 bp, Homo sapiens
tcctggagataattgcagtgaa

SEQ ID NO: 7034314 - DNA, 22 bp, Homo sapiens
tcctggctgttagagaggcaag

SEQ ID NO: 7034315 - DNA, 22 bp, Homo sapiens
tcctggggaggtcgaggctgag

SEQ ID NO: 7034316 - DNA, 22 bp, Homo sapiens
tcctggtggtgccagctgcagg

SEQ ID NO: 7034317 - DNA, 20 bp, Homo sapiens
tcctgtggacattgctggcc

SEQ ID NO: 7034318 - DNA, 22 bp, Homo sapiens
tccttcaaaagttgagagagcc

SEQ ID NO: 7034319 - DNA, 22 bp, Homo sapiens
tccttcaaagctcctagtgagc

SEQ ID NO: 7034320 - DNA, 22 bp, Homo sapiens
tccttctttccccctagtcatt

SEQ ID NO: 7034321 - DNA, 22 bp, Homo sapiens
tccttctttgacaagtggcaga

SEQ ID NO: 7034322 - DNA, 22 bp, Homo sapiens
tccttggaggtgttcatctgcc

SEQ ID NO: 7034323 - DNA, 22 bp, Homo sapiens
tcgaactcatagtcgtagctgt

SEQ ID NO: 7034324 - DNA, 20 bp, Homo sapiens
tctcagcataagaacccttc

SEQ ID NO: 7034325 - DNA, 22 bp, Homo sapiens
tctcagctgactgctttcctcg

SEQ ID NO: 7034326 - DNA, 19 bp, Homo sapiens
tctccaggcaggtgagcga

SEQ ID NO: 7034327 - DNA, 22 bp, Homo sapiens
tctccttgctacccagtatgtc

SEQ ID NO: 7034328 - DNA, 22 bp, Homo sapiens
tctcgacagcctggcacagtgg

SEQ ID NO: 7034329 - DNA, 22 bp, Homo sapiens
tctcgctctgtcgcccaggctg

SEQ ID NO: 7034330 - DNA, 22 bp, Homo sapiens
tctcgtgcaggccttgctcgga

SEQ ID NO: 7034331 - DNA, 20 bp, Homo sapiens
tctctgacttctccccgcct

SEQ ID NO: 7034332 - DNA, 22 bp, Homo sapiens
tctctgtgagatgccttcctga

SEQ ID NO: 7034333 - DNA, 22 bp, Homo sapiens
tctctgtgtcttagtgaaggga

SEQ ID NO: 7034334 - DNA, 22 bp, Homo sapiens
tctcttctaattagggtccatg

SEQ ID NO: 7034335 - DNA, 22 bp, Homo sapiens
tctcttctagcttcttgtggtt

SEQ ID NO: 7034336 - DNA, 19 bp, Homo sapiens
tctcttctccctggtttta

SEQ ID NO: 7034337 - DNA, 18 bp, Homo sapiens
tctcttcttggcagtcaa

SEQ ID NO: 7034338 - DNA, 22 bp, Homo sapiens
tctcttctttggggtgggctca

SEQ ID NO: 7034339 - DNA, 22 bp, Homo sapiens
tctgcccaggaggtcccatggg

SEQ ID NO: 7034340 - DNA, 22 bp, Homo sapiens
tctgcccagggacaggacacag

SEQ ID NO: 7034341 - DNA, 19 bp, Homo sapiens
tctgcccagttgtctgccc

SEQ ID NO: 7034342 - DNA, 22 bp, Homo sapiens
tctgcccagtttgtgctcaggt

SEQ ID NO: 7034343 - DNA, 22 bp, Homo sapiens
tctgcccattcttagagtctag

SEQ ID NO: 7034344 - DNA, 22 bp, Homo sapiens
tctgccgactataagccaacta

SEQ ID NO: 7034345 - DNA, 17 bp, Homo sapiens
tctgccgactgccagct

SEQ ID NO: 7034346 - DNA, 22 bp, Homo sapiens
tctgctgcagcaggattctctg

SEQ ID NO: 7034347 - DNA, 22 bp, Homo sapiens
tctgctgccatgcagagcagta

SEQ ID NO: 7034348 - DNA, 22 bp, Homo sapiens
tctgctgctacagactctctag

SEQ ID NO: 7034349 - DNA, 22 bp, Homo sapiens
tctggaagaacggggcatgctg

SEQ ID NO: 7034350 - DNA, 22 bp, Homo sapiens
tctggaagacagtgagcccgct

SEQ ID NO: 7034351 - DNA, 22 bp, Homo sapiens
tctggaagttagaggaggaaag

SEQ ID NO: 7034352 - DNA, 22 bp, Homo sapiens
tctggcagaagtgctgtcagta

SEQ ID NO: 7034353 - DNA, 22 bp, Homo sapiens
tctggcagaggaaggaggcctg

SEQ ID NO: 7034354 - DNA, 22 bp, Homo sapiens
tctggcagcaagtctgtttctc

SEQ ID NO: 7034355 - DNA, 22 bp, Homo sapiens
tctggcagtggatgagggcagc

SEQ ID NO: 7034356 - DNA, 22 bp, Homo sapiens
tctggcagttgccgcttcagtc

SEQ ID NO: 7034357 - DNA, 22 bp, Homo sapiens
tctgggagagtcacaggcattg

SEQ ID NO: 7034358 - DNA, 21 bp, Homo sapiens
tctgggcccatgctgcctcac

SEQ ID NO: 7034359 - DNA, 22 bp, Homo sapiens
tctgtgccatgcccgtctacca

SEQ ID NO: 7034360 - DNA, 22 bp, Homo sapiens
tcttctgttttagattgcatac

SEQ ID NO: 7034361 - DNA, 22 bp, Homo sapiens
tcttgaaggggggcagtgttga

SEQ ID NO: 7034362 - DNA, 22 bp, Homo sapiens
tcttggaacttattattgtaga

SEQ ID NO: 7034363 - DNA, 22 bp, Homo sapiens
tcttggaatctccatagagtga

SEQ ID NO: 7034364 - DNA, 22 bp, Homo sapiens
tcttggcaggcagtggggtaag

SEQ ID NO: 7034365 - DNA, 20 bp, Homo sapiens
tcttgggcatggatgtctgg

SEQ ID NO: 7034366 - DNA, 22 bp, Homo sapiens
tgaagcctgaaagctggacagg

SEQ ID NO: 7034367 - DNA, 21 bp, Homo sapiens
tgaagcctgaggcatagcccc

SEQ ID NO: 7034368 - DNA, 22 bp, Homo sapiens
tgaagctggaagttaggtagac

SEQ ID NO: 7034369 - DNA, 22 bp, Homo sapiens
tgaagctggcttgacatggcct

SEQ ID NO: 7034370 - DNA, 22 bp, Homo sapiens
tgaagctggttgtatgactgga

SEQ ID NO: 7034371 - DNA, 22 bp, Homo sapiens
tgaagctgtccttgataggggc

SEQ ID NO: 7034372 - DNA, 22 bp, Homo sapiens
tgaagctgtgggcagtggagcc

SEQ ID NO: 7034373 - DNA, 22 bp, Homo sapiens
tgaatgcttggagtcataaaat

SEQ ID NO: 7034374 - DNA, 22 bp, Homo sapiens
tgacaaaccctgcaaatagctc

SEQ ID NO: 7034375 - DNA, 22 bp, Homo sapiens
tgacagcccacctcacaggatt

SEQ ID NO: 7034376 - DNA, 22 bp, Homo sapiens
tgacagggaaaggtcctctttt

SEQ ID NO: 7034377 - DNA, 22 bp, Homo sapiens
tgacagggacagtggagatgga

SEQ ID NO: 7034378 - DNA, 22 bp, Homo sapiens
tgacagggcaggcttactggtt

SEQ ID NO: 7034379 - DNA, 22 bp, Homo sapiens
tgacagggccatgctgcactgc

SEQ ID NO: 7034380 - DNA, 22 bp, Homo sapiens
tgacagggctagaggcaatgca

SEQ ID NO: 7034381 - DNA, 22 bp, Homo sapiens
tgacagggctgttctgttttag

SEQ ID NO: 7034382 - DNA, 22 bp, Homo sapiens
tgacaggggctggtggataaat

SEQ ID NO: 7034383 - DNA, 22 bp, Homo sapiens
tgacagggggcagaggtggctg

SEQ ID NO: 7034384 - DNA, 22 bp, Homo sapiens
tgacagggtcagagctgagctg

SEQ ID NO: 7034385 - DNA, 22 bp, Homo sapiens
tgacagggtgattatgagagct

SEQ ID NO: 7034386 - DNA, 22 bp, Homo sapiens
tgacagggtgtttgtgagacta

SEQ ID NO: 7034387 - DNA, 22 bp, Homo sapiens
tgacctattagatttccttgcc

SEQ ID NO: 7034388 - DNA, 22 bp, Homo sapiens
tgactacctgttacaggtgagg

SEQ ID NO: 7034389 - DNA, 22 bp, Homo sapiens
tgactacctgtttagggaattg

SEQ ID NO: 7034390 - DNA, 22 bp, Homo sapiens
tgactcgcaacccctatgagat

SEQ ID NO: 7034391 - DNA, 22 bp, Homo sapiens
tgactgcccccaccgcacaggc

SEQ ID NO: 7034392 - DNA, 22 bp, Homo sapiens
tgactgccccttccattcctgc

SEQ ID NO: 7034393 - DNA, 19 bp, Homo sapiens
tgactgcctcaggggtgga

SEQ ID NO: 7034394 - DNA, 22 bp, Homo sapiens
tgagcctgggctttctctggag

SEQ ID NO: 7034395 - DNA, 22 bp, Homo sapiens
tgagcctgtggggtgacaacca

SEQ ID NO: 7034396 - DNA, 22 bp, Homo sapiens
tgagctctaagatcccctcaag

SEQ ID NO: 7034397 - DNA, 22 bp, Homo sapiens
tgagctgcagtgagctgagatg

SEQ ID NO: 7034398 - DNA, 22 bp, Homo sapiens
tgagctgcattacagcctctgt

SEQ ID NO: 7034399 - DNA, 18 bp, Homo sapiens
tgagctgctctgtgaaga

SEQ ID NO: 7034400 - DNA, 22 bp, Homo sapiens
tgagctggaggacaggagggta

SEQ ID NO: 7034401 - DNA, 22 bp, Homo sapiens
tgagctggagtctgtggctcct

SEQ ID NO: 7034402 - DNA, 22 bp, Homo sapiens
tgagctggatccaactccgttt

SEQ ID NO: 7034403 - DNA, 22 bp, Homo sapiens
tgagctggttcttgaggcatga

SEQ ID NO: 7034404 - DNA, 22 bp, Homo sapiens
tgagcttgcagtgccagccttg

SEQ ID NO: 7034405 - DNA, 22 bp, Homo sapiens
tgaggaggtcagagtctggctg

SEQ ID NO: 7034406 - DNA, 22 bp, Homo sapiens
tgaggggagacagagtggactc

SEQ ID NO: 7034407 - DNA, 22 bp, Homo sapiens
tgaggggagcccgccctggacg

SEQ ID NO: 7034408 - DNA, 22 bp, Homo sapiens
tgaggggaggttggggcacatc

SEQ ID NO: 7034409 - DNA, 22 bp, Homo sapiens
tgaggtggccgaggagcaggac

SEQ ID NO: 7034410 - DNA, 22 bp, Homo sapiens
tgaggtggttactgtggtgctc

SEQ ID NO: 7034411 - DNA, 22 bp, Homo sapiens
tgagtgggacctgcgtgtgtca

SEQ ID NO: 7034412 - DNA, 19 bp, Homo sapiens
tgagtgggcccctgcagac

SEQ ID NO: 7034413 - DNA, 22 bp, Homo sapiens
tgatcccaatctttcctgctcc

SEQ ID NO: 7034414 - DNA, 22 bp, Homo sapiens
tgatttaaaagaaacattgtct

SEQ ID NO: 7034415 - DNA, 22 bp, Homo sapiens
tgcagaggcgccgtgggtgggg

SEQ ID NO: 7034416 - DNA, 22 bp, Homo sapiens
tgcagctggtatcccatggatt

SEQ ID NO: 7034417 - DNA, 22 bp, Homo sapiens
tgcagctgttacggaccctgtc

SEQ ID NO: 7034418 - DNA, 22 bp, Homo sapiens
tgcagggcacacgcacgggtgt

SEQ ID NO: 7034419 - DNA, 22 bp, Homo sapiens
tgcagggccagactgggttgga

SEQ ID NO: 7034420 - DNA, 22 bp, Homo sapiens
tgcagggccatggtggcggctg

SEQ ID NO: 7034421 - DNA, 22 bp, Homo sapiens
tgcagggcccttggggttgaac

SEQ ID NO: 7034422 - DNA, 22 bp, Homo sapiens
tgcaggtgagtgcaggggctca

SEQ ID NO: 7034423 - DNA, 22 bp, Homo sapiens
tgcaggtgtgggcaggggagca

SEQ ID NO: 7034424 - DNA, 22 bp, Homo sapiens
tgcagtgtcttgtggacttgag

SEQ ID NO: 7034425 - DNA, 22 bp, Homo sapiens
tgcagtgtgattttctggctga

SEQ ID NO: 7034426 - DNA, 22 bp, Homo sapiens
tgcagtgtttggatgctgagtc

SEQ ID NO: 7034427 - DNA, 22 bp, Homo sapiens
tgcatgtgtgttaagatgcttt

SEQ ID NO: 7034428 - DNA, 22 bp, Homo sapiens
tgcatgttaagaaaatattgag

SEQ ID NO: 7034429 - DNA, 22 bp, Homo sapiens
tgcattcctttgtctgttaaag

SEQ ID NO: 7034430 - DNA, 22 bp, Homo sapiens
tgccagagatttcacactgcta

SEQ ID NO: 7034431 - DNA, 22 bp, Homo sapiens
tgccagctcccttttctcctcc

SEQ ID NO: 7034432 - DNA, 22 bp, Homo sapiens
tgccagggaccctgtcggccct

SEQ ID NO: 7034433 - DNA, 23 bp, Homo sapiens
tgccagggccctgtgtgcaatgc

SEQ ID NO: 7034434 - DNA, 22 bp, Homo sapiens
tgccatccaacagttccatctt

SEQ ID NO: 7034435 - DNA, 22 bp, Homo sapiens
tgccatttctttcaatattctt

SEQ ID NO: 7034436 - DNA, 20 bp, Homo sapiens
tgcccagcaagagtgcagtt

SEQ ID NO: 7034437 - DNA, 22 bp, Homo sapiens
tgcccctcgacgcaatgaaggg

SEQ ID NO: 7034438 - DNA, 22 bp, Homo sapiens
tgctcctgagtgtgcaggagat

SEQ ID NO: 7034439 - DNA, 17 bp, Homo sapiens
tgctcctgggacaagga

SEQ ID NO: 7034440 - DNA, 22 bp, Homo sapiens
tgctgccacctgtggtagtctg

SEQ ID NO: 7034441 - DNA, 22 bp, Homo sapiens
tgctgccagggctctgcccaca

SEQ ID NO: 7034442 - DNA, 22 bp, Homo sapiens
tgctgctgaaaaggtgtgctta

SEQ ID NO: 7034443 - DNA, 22 bp, Homo sapiens
tgctgctgatcatttatagtct

SEQ ID NO: 7034444 - DNA, 22 bp, Homo sapiens
tgctgctgatgcatagtctgct

SEQ ID NO: 7034445 - DNA, 22 bp, Homo sapiens
tgctgctgcttctgtacagcct

SEQ ID NO: 7034446 - DNA, 22 bp, Homo sapiens
tgctgctggatcttactcatct

SEQ ID NO: 7034447 - DNA, 22 bp, Homo sapiens
tgctgctgtatccttagtgtca

SEQ ID NO: 7034448 - DNA, 22 bp, Homo sapiens
tgctgctgtttcctacatctca

SEQ ID NO: 7034449 - DNA, 22 bp, Homo sapiens
tgctgctttgatgtgtaaatca

SEQ ID NO: 7034450 - DNA, 20 bp, Homo sapiens
tgctgctttgccactagttg

SEQ ID NO: 7034451 - DNA, 17 bp, Homo sapiens
tgctggcaacatacaaa

SEQ ID NO: 7034452 - DNA, 18 bp, Homo sapiens
tgctggcaactactattg

SEQ ID NO: 7034453 - DNA, 21 bp, Homo sapiens
tgctggcaagactcaggaata

SEQ ID NO: 7034454 - DNA, 22 bp, Homo sapiens
tgctggcaaggtaggtttcatt

SEQ ID NO: 7034455 - DNA, 22 bp, Homo sapiens
tgctggcaagtcttggaattgt

SEQ ID NO: 7034456 - DNA, 22 bp, Homo sapiens
tgctggcaatgctcttgacgtc

SEQ ID NO: 7034457 - DNA, 22 bp, Homo sapiens
tgctggcacatagagactggct

SEQ ID NO: 7034458 - DNA, 22 bp, Homo sapiens
tgctggcaccagaatgactgca

SEQ ID NO: 7034459 - DNA, 22 bp, Homo sapiens
tgctggcaccattttcggacat

SEQ ID NO: 7034460 - DNA, 22 bp, Homo sapiens
tgctggcacgaaagggtgtcca

SEQ ID NO: 7034461 - DNA, 20 bp, Homo sapiens
tgctggcacgggtggactcc

SEQ ID NO: 7034462 - DNA, 22 bp, Homo sapiens
tgctggcacgtgactgggaagt

SEQ ID NO: 7034463 - DNA, 22 bp, Homo sapiens
tgctggcacgtggaccaggaga

SEQ ID NO: 7034464 - DNA, 22 bp, Homo sapiens
tgctggcagaaggctcgtggaa

SEQ ID NO: 7034465 - DNA, 22 bp, Homo sapiens
tgctggcagccatgccttggaa

SEQ ID NO: 7034466 - DNA, 22 bp, Homo sapiens
tgctggcagccccagctttaac

SEQ ID NO: 7034467 - DNA, 22 bp, Homo sapiens
tgctggcagcttctttaaatgt

SEQ ID NO: 7034468 - DNA, 22 bp, Homo sapiens
tgctggcaggcacctcctgggg

SEQ ID NO: 7034469 - DNA, 22 bp, Homo sapiens
tgctggcagtggcagtgatggt

SEQ ID NO: 7034470 - DNA, 22 bp, Homo sapiens
tgctggcataccacctagttca

SEQ ID NO: 7034471 - DNA, 22 bp, Homo sapiens
tgctggcatactctctttgttg

SEQ ID NO: 7034472 - DNA, 22 bp, Homo sapiens
tgctggcatatgaaaatcctta

SEQ ID NO: 7034473 - DNA, 22 bp, Homo sapiens
tgctggcatcttaatgttctgt

SEQ ID NO: 7034474 - DNA, 20 bp, Homo sapiens
tgctggcatgcaagagggaa

SEQ ID NO: 7034475 - DNA, 22 bp, Homo sapiens
tgctggcatgcatgctgtagga

SEQ ID NO: 7034476 - DNA, 22 bp, Homo sapiens
tgctggcatggtcttggtgaca

SEQ ID NO: 7034477 - DNA, 22 bp, Homo sapiens
tgctggcattgcataggcagtt

SEQ ID NO: 7034478 - DNA, 21 bp, Homo sapiens
tgctggcattaccacaaaccc

SEQ ID NO: 7034479 - DNA, 22 bp, Homo sapiens
tgctggcatttcaggactcacc

SEQ ID NO: 7034480 - DNA, 22 bp, Homo sapiens
tgctggctgttctagggaggcc

SEQ ID NO: 7034481 - DNA, 22 bp, Homo sapiens
tgctggtaccgcgcctccgcca

SEQ ID NO: 7034482 - DNA, 22 bp, Homo sapiens
tgcttgcaagagatgcaatgac

SEQ ID NO: 7034483 - DNA, 22 bp, Homo sapiens
tgctttaaaccatggatgtgag

SEQ ID NO: 7034484 - DNA, 19 bp, Homo sapiens
tggaaaatggattgaatca

SEQ ID NO: 7034485 - DNA, 22 bp, Homo sapiens
tggaaagggacttatgagttcc

SEQ ID NO: 7034486 - DNA, 22 bp, Homo sapiens
tggaagggagtgacagtcagag

SEQ ID NO: 7034487 - DNA, 22 bp, Homo sapiens
tggaaggggagctggaaagggg

SEQ ID NO: 7034488 - DNA, 22 bp, Homo sapiens
tggaaggggagctggaaagggg

SEQ ID NO: 7034489 - DNA, 22 bp, Homo sapiens
tggaaggggccaggcgcggagt

SEQ ID NO: 7034490 - DNA, 22 bp, Homo sapiens
tggaaggggagttgttccacgt

SEQ ID NO: 7034491 - DNA, 22 bp, Homo sapiens
tggaagggggaagacagctctg

SEQ ID NO: 7034492 - DNA, 22 bp, Homo sapiens
tggaaggggttacgcagcagga

SEQ ID NO: 7034493 - DNA, 22 bp, Homo sapiens
tggaatggaaacaaactgagga

SEQ ID NO: 7034494 - DNA, 23 bp, Homo sapiens
tggacaggacccccttcggaccc

SEQ ID NO: 7034495 - DNA, 22 bp, Homo sapiens
tggacaggatagtgcagtacgc

SEQ ID NO: 7034496 - DNA, 22 bp, Homo sapiens
tggacaggctcctaggggttcc

SEQ ID NO: 7034497 - DNA, 22 bp, Homo sapiens
tggacagggcagagaccgagtc

SEQ ID NO: 7034498 - DNA, 20 bp, Homo sapiens
tggacaggggcataggttgc

SEQ ID NO: 7034499 - DNA, 22 bp, Homo sapiens
tggacaggggctgctgttgtca

SEQ ID NO: 7034500 - DNA, 18 bp, Homo sapiens
tggacagggtggagaaaa

SEQ ID NO: 7034501 - DNA, 22 bp, Homo sapiens
tggacaggtgagtgactcaggg

SEQ ID NO: 7034502 - DNA, 22 bp, Homo sapiens
tggacaggtgcacacagcagcc

SEQ ID NO: 7034503 - DNA, 22 bp, Homo sapiens
tggagaggaaagtgcagttttg

SEQ ID NO: 7034504 - DNA, 22 bp, Homo sapiens
tggagaggagcaccatggccat

SEQ ID NO: 7034505 - DNA, 23 bp, Homo sapiens
tggagctgggctcagaccctggg

SEQ ID NO: 7034506 - DNA, 22 bp, Homo sapiens
tggagctgtagccaccaccctg

SEQ ID NO: 7034507 - DNA, 22 bp, Homo sapiens
tggagggaacaaaggagtccca

SEQ ID NO: 7034508 - DNA, 21 bp, Homo sapiens
tggcacagcaagtgggctcat

SEQ ID NO: 7034509 - DNA, 22 bp, Homo sapiens
tggcacagttaaagttgtagaa

SEQ ID NO: 7034510 - DNA, 22 bp, Homo sapiens
tggcacgacaattggcaccaat

SEQ ID NO: 7034511 - DNA, 22 bp, Homo sapiens
tggcagctcatttggaaatgga

SEQ ID NO: 7034512 - DNA, 17 bp, Homo sapiens
tggcagctgaaagctct

SEQ ID NO: 7034513 - DNA, 22 bp, Homo sapiens
tggcagctgaatggctggatgg

SEQ ID NO: 7034514 - DNA, 22 bp, Homo sapiens
tggcagggagttcgttcacaac

SEQ ID NO: 7034515 - DNA, 22 bp, Homo sapiens
tggcagggagttgcaggatttc

SEQ ID NO: 7034516 - DNA, 22 bp, Homo sapiens
tggcagggcctgctcatcatcc

SEQ ID NO: 7034517 - DNA, 22 bp, Homo sapiens
tggcaggggaggtgcttgctta

SEQ ID NO: 7034518 - DNA, 18 bp, Homo sapiens
tggcaggggcagtacgcc

SEQ ID NO: 7034519 - DNA, 21 bp, Homo sapiens
tggcaggggtagtagtacagc

SEQ ID NO: 7034520 - DNA, 22 bp, Homo sapiens
tggcagggtcttgctgtgttgc

SEQ ID NO: 7034521 - DNA, 22 bp, Homo sapiens
tggcagggtgccagttgcgagt

SEQ ID NO: 7034522 - DNA, 22 bp, Homo sapiens
tggcagggtggcaacttttggt

SEQ ID NO: 7034523 - DNA, 18 bp, Homo sapiens
tggcaggtccagctgtgg

SEQ ID NO: 7034524 - DNA, 21 bp, Homo sapiens
tggcaggttcaaaggcctatc

SEQ ID NO: 7034525 - DNA, 18 bp, Homo sapiens
tggcagtgaggtaggcat

SEQ ID NO: 7034526 - DNA, 22 bp, Homo sapiens
tggcagtgatgcggcaggacat

SEQ ID NO: 7034527 - DNA, 18 bp, Homo sapiens
tggcagtgccaccttctc

SEQ ID NO: 7034528 - DNA, 22 bp, Homo sapiens
tggcagtgctgcagtgccctta

SEQ ID NO: 7034529 - DNA, 22 bp, Homo sapiens
tggcagtggataggggagcggt

SEQ ID NO: 7034530 - DNA, 22 bp, Homo sapiens
tggcatgcacagccctgttcgg

SEQ ID NO: 7034531 - DNA, 22 bp, Homo sapiens
tggcatggactagtgctgaggt

SEQ ID NO: 7034532 - DNA, 22 bp, Homo sapiens
tggcatttagttgcgtattgca

SEQ ID NO: 7034533 - DNA, 22 bp, Homo sapiens
tggccaggcctcttggtgccca

SEQ ID NO: 7034534 - DNA, 22 bp, Homo sapiens
tggccaggctggtctggaacgc

SEQ ID NO: 7034535 - DNA, 19 bp, Homo sapiens
tggccaggtactgtctgct

SEQ ID NO: 7034536 - DNA, 22 bp, Homo sapiens
tggccaggttgggctttgcagc

SEQ ID NO: 7034537 - DNA, 22 bp, Homo sapiens
tggcccagagcactgctgggca

SEQ ID NO: 7034538 - DNA, 22 bp, Homo sapiens
tggcccaggcgaggtgggcaga

SEQ ID NO: 7034539 - DNA, 22 bp, Homo sapiens
tggcccagggcacagcagggag

SEQ ID NO: 7034540 - DNA, 22 bp, Homo sapiens
tggcccaggggctcttggtgtt

SEQ ID NO: 7034541 - DNA, 22 bp, Homo sapiens
tggccctgacaggtcctgggca

SEQ ID NO: 7034542 - DNA, 22 bp, Homo sapiens
tggccctgtgtgcaggctgcac

SEQ ID NO: 7034543 - DNA, 22 bp, Homo sapiens
tggcgaggccaggccagggcct

SEQ ID NO: 7034544 - DNA, 18 bp, Homo sapiens
tggctctggacttgctcc

SEQ ID NO: 7034545 - DNA, 23 bp, Homo sapiens
tggctctgtgtcacatacaggat

SEQ ID NO: 7034546 - DNA, 22 bp, Homo sapiens
tggctgagcctttggggctttc

SEQ ID NO: 7034547 - DNA, 22 bp, Homo sapiens
tggctgaggagagggcggaagt

SEQ ID NO: 7034548 - DNA, 18 bp, Homo sapiens
tggctggcagtgggcagc

SEQ ID NO: 7034549 - DNA, 22 bp, Homo sapiens
tggctggctagtgggcaggatt

SEQ ID NO: 7034550 - DNA, 22 bp, Homo sapiens
tggctgggccgggccttgtgcc

SEQ ID NO: 7034551 - DNA, 22 bp, Homo sapiens
tggctggggcctgaatcctgca

SEQ ID NO: 7034552 - DNA, 19 bp, Homo sapiens
tggctgggtgccaatggcc

SEQ ID NO: 7034553 - DNA, 22 bp, Homo sapiens
tgggaagggtcaacagctggaa

SEQ ID NO: 7034554 - DNA, 22 bp, Homo sapiens
tgggaagggtcaacagctggaa

SEQ ID NO: 7034555 - DNA, 22 bp, Homo sapiens
tgggaaggtacacgggaaagag

SEQ ID NO: 7034556 - DNA, 22 bp, Homo sapiens
tgggactcactcttttggccag

SEQ ID NO: 7034557 - DNA, 22 bp, Homo sapiens
tgggaggacttgtgggcttcat

SEQ ID NO: 7034558 - DNA, 22 bp, Homo sapiens
tgggaggacttgtgggcttcat

SEQ ID NO: 7034559 - DNA, 22 bp, Homo sapiens
tgggaggcaggtaggtgatgat

SEQ ID NO: 7034560 - DNA, 22 bp, Homo sapiens
tgggaggccaaggcaggcggat

SEQ ID NO: 7034561 - DNA, 22 bp, Homo sapiens
tgggaggccgaggcaggtggat

SEQ ID NO: 7034562 - DNA, 22 bp, Homo sapiens
tgggagtcaaccctcacgagca

SEQ ID NO: 7034563 - DNA, 22 bp, Homo sapiens
tgggagtgatacagtatggaat

SEQ ID NO: 7034564 - DNA, 18 bp, Homo sapiens
tgggagtgggagtggata

SEQ ID NO: 7034565 - DNA, 22 bp, Homo sapiens
tgggatcttttgagatactgtg

SEQ ID NO: 7034566 - DNA, 22 bp, Homo sapiens
tgggcagggtctctgttatcag

SEQ ID NO: 7034567 - DNA, 22 bp, Homo sapiens
tgggcaggttgttatttgacat

SEQ ID NO: 7034568 - DNA, 22 bp, Homo sapiens
tgggccagcactgggtgctcat

SEQ ID NO: 7034569 - DNA, 22 bp, Homo sapiens
tgggccagctccctgcccctgg

SEQ ID NO: 7034570 - DNA, 22 bp, Homo sapiens
tgggccagtccagccccaggga

SEQ ID NO: 7034571 - DNA, 22 bp, Homo sapiens
tgggctctctcacctggaggct

SEQ ID NO: 7034572 - DNA, 22 bp, Homo sapiens
tggggaggacgggcgccttcct

SEQ ID NO: 7034573 - DNA, 23 bp, Homo sapiens
tggggagggaagtcatttctgta

SEQ ID NO: 7034574 - DNA, 22 bp, Homo sapiens
tggggaggtaacaatttcaggc

SEQ ID NO: 7034575 - DNA, 22 bp, Homo sapiens
tggggcctgcacaggctgaatg

SEQ ID NO: 7034576 - DNA, 20 bp, Homo sapiens
tggggcctgtttctgtggtt

SEQ ID NO: 7034577 - DNA, 22 bp, Homo sapiens
tggggctggctattgtctccct

SEQ ID NO: 7034578 - DNA, 22 bp, Homo sapiens
tgggggagagtgcaagcatgaa

SEQ ID NO: 7034579 - DNA, 22 bp, Homo sapiens
tgggggagagtttagatgattt

SEQ ID NO: 7034580 - DNA, 22 bp, Homo sapiens
tgggggagatagagtctgatgg

SEQ ID NO: 7034581 - DNA, 22 bp, Homo sapiens
tgggggagattagagcttctta

SEQ ID NO: 7034582 - DNA, 22 bp, Homo sapiens
tgggggagattgtgcatctcta

SEQ ID NO: 7034583 - DNA, 22 bp, Homo sapiens
tgggggagccttcacagtagct

SEQ ID NO: 7034584 - DNA, 22 bp, Homo sapiens
tgggggagcgacagacataatt

SEQ ID NO: 7034585 - DNA, 22 bp, Homo sapiens
tgggggagctcagtccagccca

SEQ ID NO: 7034586 - DNA, 22 bp, Homo sapiens
tgggggagtatagtctggcctc

SEQ ID NO: 7034587 - DNA, 22 bp, Homo sapiens
tgggggctccaggctccaggga

SEQ ID NO: 7034588 - DNA, 22 bp, Homo sapiens
tgggggctgagtaagatgagat

SEQ ID NO: 7034589 - DNA, 22 bp, Homo sapiens
tgggggctgtgcacaggctcac

SEQ ID NO: 7034590 - DNA, 22 bp, Homo sapiens
tggggggatacttgctactggc

SEQ ID NO: 7034591 - DNA, 18 bp, Homo sapiens
tggggtctctcaggtaag

SEQ ID NO: 7034592 - DNA, 22 bp, Homo sapiens
tggggtctgagtatctgcattt

SEQ ID NO: 7034593 - DNA, 22 bp, Homo sapiens
tggggtctggagttgcccatga

SEQ ID NO: 7034594 - DNA, 22 bp, Homo sapiens
tgggtcccttcagctctcatgg

SEQ ID NO: 7034595 - DNA, 17 bp, Homo sapiens
tgggtgctgggatgagg

SEQ ID NO: 7034596 - DNA, 22 bp, Homo sapiens
tggtaaggttccagatctagaa

SEQ ID NO: 7034597 - DNA, 22 bp, Homo sapiens
tggtgaggccaaagccatgaca

SEQ ID NO: 7034598 - DNA, 22 bp, Homo sapiens
tggtgcccactccagacaccta

SEQ ID NO: 7034599 - DNA, 22 bp, Homo sapiens
tggtgcccactctggacccagc

SEQ ID NO: 7034600 - DNA, 22 bp, Homo sapiens
tggtgcccatgtatcccttcac

SEQ ID NO: 7034601 - DNA, 22 bp, Homo sapiens
tggtgggagtgagggcatgcca

SEQ ID NO: 7034602 - DNA, 22 bp, Homo sapiens
tgtatacattctcttgggtttg

SEQ ID NO: 7034603 - DNA, 21 bp, Homo sapiens
tgtctgcctgcttcttcactc

SEQ ID NO: 7034604 - DNA, 22 bp, Homo sapiens
tgtgacccagactcatcttctt

SEQ ID NO: 7034605 - DNA, 22 bp, Homo sapiens
tgtgcacaggaagctattctct

SEQ ID NO: 7034606 - DNA, 22 bp, Homo sapiens
tgtgcacatatactcatattcc

SEQ ID NO: 7034607 - DNA, 22 bp, Homo sapiens
tgtgggagaaggaagcaagctg

SEQ ID NO: 7034608 - DNA, 22 bp, Homo sapiens
tgtgggaggaacacagccagaa

SEQ ID NO: 7034609 - DNA, 22 bp, Homo sapiens
tgtgggaggaattagaatggga

SEQ ID NO: 7034610 - DNA, 22 bp, Homo sapiens
tgtgggaggattcagaattggg

SEQ ID NO: 7034611 - DNA, 22 bp, Homo sapiens
tgtgggaggtctggaaggctcc

SEQ ID NO: 7034612 - DNA, 22 bp, Homo sapiens
tgtgtacatatctatcctagat

SEQ ID NO: 7034613 - DNA, 22 bp, Homo sapiens
ttaaaaatatgtagggcccgat

SEQ ID NO: 7034614 - DNA, 22 bp, Homo sapiens
ttaaaatttccccaccatgtat

SEQ ID NO: 7034615 - DNA, 22 bp, Homo sapiens
ttaaacacctgtctagtgtagc

SEQ ID NO: 7034616 - DNA, 22 bp, Homo sapiens
ttcaggaaggtcctatagcaga

SEQ ID NO: 7034617 - DNA, 22 bp, Homo sapiens
ttccagagttgggggagtggtt

SEQ ID NO: 7034618 - DNA, 22 bp, Homo sapiens
ttccaggaaaacagttggaagt

SEQ ID NO: 7034619 - DNA, 22 bp, Homo sapiens
aacacaaagaagctgcaggatc

SEQ ID NO: 7034620 - DNA, 22 bp, Homo sapiens
aactgaggaataactgagttgc

SEQ ID NO: 7034621 - DNA, 22 bp, Homo sapiens
aactgaggccaagtgaggaaag

SEQ ID NO: 7034622 - DNA, 22 bp, Homo sapiens
aactgagggccctgctgaagca

SEQ ID NO: 7034623 - DNA, 22 bp, Homo sapiens
aactgaggtatctgctgtgttt

SEQ ID NO: 7034624 - DNA, 22 bp, Homo sapiens
aactgaggtctccagtgcagaa

SEQ ID NO: 7034625 - DNA, 22 bp, Homo sapiens
aagaaagtgctttgtaaattat

SEQ ID NO: 7034626 - DNA, 22 bp, Homo sapiens
aagaattggtttcctctgtcat

SEQ ID NO: 7034627 - DNA, 22 bp, Homo sapiens
acactagctaaatgctgattaa

SEQ ID NO: 7034628 - DNA, 22 bp, Homo sapiens
acatggggcccaaagagaggtc

SEQ ID NO: 7034629 - DNA, 22 bp, Homo sapiens
acatgggggctgctgccagcga

SEQ ID NO: 7034630 - DNA, 22 bp, Homo sapiens
actgtgggggagccagtcccat

SEQ ID NO: 7034631 - DNA, 22 bp, Homo sapiens
agaaaataatttcttggctggt

SEQ ID NO: 7034632 - DNA, 22 bp, Homo sapiens
agacactgatgttcagctcaat

SEQ ID NO: 7034633 - DNA, 22 bp, Homo sapiens
agacactgccacttctgttccc

SEQ ID NO: 7034634 - DNA, 22 bp, Homo sapiens
agactgggccatttccccagct

SEQ ID NO: 7034635 - DNA, 22 bp, Homo sapiens
agactgggattctccctgatca

SEQ ID NO: 7034636 - DNA, 22 bp, Homo sapiens
agaggtggccatgggcgctgga

SEQ ID NO: 7034637 - DNA, 22 bp, Homo sapiens
agcagggcctctggcactggtc

SEQ ID NO: 7034638 - DNA, 22 bp, Homo sapiens
agcagggcttctgtgcctgtgc

SEQ ID NO: 7034639 - DNA, 22 bp, Homo sapiens
agcagggctttgtctctgtgaa

SEQ ID NO: 7034640 - DNA, 23 bp, Homo sapiens
agctgctgggcctgccgtggcct

SEQ ID NO: 7034641 - DNA, 19 bp, Homo sapiens
agctggcagcttccacttc

SEQ ID NO: 7034642 - DNA, 22 bp, Homo sapiens
agctggcaggggttcacactgc

SEQ ID NO: 7034643 - DNA, 22 bp, Homo sapiens
agctggcaggtgaagatgattt

SEQ ID NO: 7034644 - DNA, 22 bp, Homo sapiens
agctgggagcagagccacagcc

SEQ ID NO: 7034645 - DNA, 22 bp, Homo sapiens
aggaagcctggagtcctgccca

SEQ ID NO: 7034646 - DNA, 22 bp, Homo sapiens
acaggggctccgaaggtgaggg

SEQ ID NO: 7034647 - DNA, 22 bp, Homo sapiens
aggagctggagtccaggcaagt

SEQ ID NO: 7034648 - DNA, 22 bp, Homo sapiens
acatgaaaagactatctgatta

SEQ ID NO: 7034649 - DNA, 21 bp, Homo sapiens
actgccaggagagtaggggga

SEQ ID NO: 7034650 - DNA, 22 bp, Homo sapiens
actgccaggatggcactagagg

SEQ ID NO: 7034651 - DNA, 22 bp, Homo sapiens
actgccaggtgctccatctgaa

SEQ ID NO: 7034652 - DNA, 22 bp, Homo sapiens
actgcccagtgattggtggtta

SEQ ID NO: 7034653 - DNA, 22 bp, Homo sapiens
acttccttttgggaaactgttt

SEQ ID NO: 7034654 - DNA, 22 bp, Homo sapiens
atacatatccacaggagataaa

SEQ ID NO: 7034655 - DNA, 22 bp, Homo sapiens
atgcatttttgagtatgaatga

SEQ ID NO: 7034656 - DNA, 22 bp, Homo sapiens
agagattgtgctactcacccaa

SEQ ID NO: 7034657 - DNA, 22 bp, Homo sapiens
agagctggctgctgcggtgctt

SEQ ID NO: 7034658 - DNA, 22 bp, Homo sapiens
agagctggctgtgggtgacttt

SEQ ID NO: 7034659 - DNA, 22 bp, Homo sapiens
agaggaggtccttttctgatgt

SEQ ID NO: 7034660 - DNA, 18 bp, Homo sapiens
agaggctggacaggggat

SEQ ID NO: 7034661 - DNA, 22 bp, Homo sapiens
attttcagaacattcattcact

SEQ ID NO: 7034662 - DNA, 22 bp, Homo sapiens
agcacctgtgtggtagggaggt

SEQ ID NO: 7034663 - DNA, 22 bp, Homo sapiens
agcagggcaggtaaggatcaga

SEQ ID NO: 7034664 - DNA, 22 bp, Homo sapiens
caccagctacagactactgtgt

SEQ ID NO: 7034665 - DNA, 17 bp, Homo sapiens
cactgtgggggcattta

SEQ ID NO: 7034666 - DNA, 19 bp, Homo sapiens
cactgtggtccttcactgc

SEQ ID NO: 7034667 - DNA, 22 bp, Homo sapiens
agctgccgatgcccagctgcat

SEQ ID NO: 7034668 - DNA, 22 bp, Homo sapiens
agctgctgggagaagtgagcca

SEQ ID NO: 7034669 - DNA, 22 bp, Homo sapiens
agctggagcttcaagcaggtaa

SEQ ID NO: 7034670 - DNA, 22 bp, Homo sapiens
agctgggtgtagggctggacaa

SEQ ID NO: 7034671 - DNA, 19 bp, Homo sapiens
agctgggtgttagtggaga

SEQ ID NO: 7034672 - DNA, 22 bp, Homo sapiens
agctggtgctcaggggcatgga

SEQ ID NO: 7034673 - DNA, 22 bp, Homo sapiens
agctggtgctcggggagctggc

SEQ ID NO: 7034674 - DNA, 22 bp, Homo sapiens
cagggtgcttccgtggagctgt

SEQ ID NO: 7034675 - DNA, 22 bp, Homo sapiens
aggagatggagctcagtgggca

SEQ ID NO: 7034676 - DNA, 22 bp, Homo sapiens
aggagtggtgcaggacctgcca

SEQ ID NO: 7034677 - DNA, 22 bp, Homo sapiens
aggcactgactcaagggagcca

SEQ ID NO: 7034678 - DNA, 22 bp, Homo sapiens
aggcagctttctggtgcaccat

SEQ ID NO: 7034679 - DNA, 22 bp, Homo sapiens
ccaaaccatccatctccaggct

SEQ ID NO: 7034680 - DNA, 22 bp, Homo sapiens
aggcaggcctacacaatgggag

SEQ ID NO: 7034681 - DNA, 22 bp, Homo sapiens
aggcaggctgctatggagtaga

SEQ ID NO: 7034682 - DNA, 18 bp, Homo sapiens
aggcaggctggagtgact

SEQ ID NO: 7034683 - DNA, 22 bp, Homo sapiens
ccagctctgtaagctgtgaaat

SEQ ID NO: 7034684 - DNA, 22 bp, Homo sapiens
ccaggaaggcgttgttcctctc

SEQ ID NO: 7034685 - DNA, 22 bp, Homo sapiens
aggctggaggtttgttgcggct

SEQ ID NO: 7034686 - DNA, 22 bp, Homo sapiens
agggcctggaactggagaccac

SEQ ID NO: 7034687 - DNA, 22 bp, Homo sapiens
agggcctggcgcgtggccgccg

SEQ ID NO: 7034688 - DNA, 22 bp, Homo sapiens
aggggatggagctggaaggcag

SEQ ID NO: 7034689 - DNA, 22 bp, Homo sapiens
aggggatggagctggaaggcag

SEQ ID NO: 7034690 - DNA, 22 bp, Homo sapiens
cctcttcatcctggaagctgct

SEQ ID NO: 7034691 - DNA, 22 bp, Homo sapiens
cctgtgggtacaacagggtcac

SEQ ID NO: 7034692 - DNA, 19 bp, Homo sapiens
ccttccagctccttttcag

SEQ ID NO: 7034693 - DNA, 22 bp, Homo sapiens
ccttctctaccatgtgaggaaa

SEQ ID NO: 7034694 - DNA, 22 bp, Homo sapiens
ccttctctactcctgatgcatg

SEQ ID NO: 7034695 - DNA, 22 bp, Homo sapiens
agtaaactttctcaggctccct

SEQ ID NO: 7034696 - DNA, 22 bp, Homo sapiens
agtaaataacagagaaaatggg

SEQ ID NO: 7034697 - DNA, 22 bp, Homo sapiens
agtgagggactagtgctgggga

SEQ ID NO: 7034698 - DNA, 22 bp, Homo sapiens
agtgagggatgaagaactgcgg

SEQ ID NO: 7034699 - DNA, 22 bp, Homo sapiens
agtgaggggattcaggcaaggt

SEQ ID NO: 7034700 - DNA, 22 bp, Homo sapiens
agtgaggggcagctgagtgggc

SEQ ID NO: 7034701 - DNA, 22 bp, Homo sapiens
agtgcagggggaaagggtgtct

SEQ ID NO: 7034702 - DNA, 22 bp, Homo sapiens
agtgtctttgacacattcaaag

SEQ ID NO: 7034703 - DNA, 22 bp, Homo sapiens
agtgtctttgtctctcaagcac

SEQ ID NO: 7034704 - DNA, 22 bp, Homo sapiens
ctgagctgcagtcctggctctg

SEQ ID NO: 7034705 - DNA, 22 bp, Homo sapiens
ctgagctgcggcaggcacctgg

SEQ ID NO: 7034706 - DNA, 22 bp, Homo sapiens
ctgagctgcggcaggcacctgg

SEQ ID NO: 7034707 - DNA, 22 bp, Homo sapiens
ataaaaatgagggcggtagcta

SEQ ID NO: 7034708 - DNA, 22 bp, Homo sapiens
ctgcagggaactgaggcccaga

SEQ ID NO: 7034709 - DNA, 22 bp, Homo sapiens
ctgctgtgtcagagtccagggg

SEQ ID NO: 7034710 - DNA, 22 bp, Homo sapiens
ctggcaggtctcgctgacgtgt

SEQ ID NO: 7034711 - DNA, 22 bp, Homo sapiens
ctggcaggtggaggttgcagtg

SEQ ID NO: 7034712 - DNA, 22 bp, Homo sapiens
ctggcaggttatagagctgccc

SEQ ID NO: 7034713 - DNA, 22 bp, Homo sapiens
ctggcaggtttggtgtctggtg

SEQ ID NO: 7034714 - DNA, 22 bp, Homo sapiens
ctgggaggacaacttggagctc

SEQ ID NO: 7034715 - DNA, 22 bp, Homo sapiens
ctgggaggattcattgaggtga

SEQ ID NO: 7034716 - DNA, 22 bp, Homo sapiens
ctgggaggggtagccaatccta

SEQ ID NO: 7034717 - DNA, 22 bp, Homo sapiens
ctgggaggtggaggttgcattg

SEQ ID NO: 7034718 - DNA, 19 bp, Homo sapiens
ctgggaggtgttcagagaa

SEQ ID NO: 7034719 - DNA, 22 bp, Homo sapiens
atcatacagcctttgttagtgt

SEQ ID NO: 7034720 - DNA, 22 bp, Homo sapiens
cttcaaggtggctaaatggggc

SEQ ID NO: 7034721 - DNA, 22 bp, Homo sapiens
cttccttctgaagcatagaagc

SEQ ID NO: 7034722 - DNA, 22 bp, Homo sapiens
cttccttgcggcccctgcctag

SEQ ID NO: 7034723 - DNA, 19 bp, Homo sapiens
cttccttgctccccatgtg

SEQ ID NO: 7034724 - DNA, 22 bp, Homo sapiens
cttccttgctgtctgctccagg

SEQ ID NO: 7034725 - DNA, 22 bp, Homo sapiens
cttccttggcttctggggtgtg

SEQ ID NO: 7034726 - DNA, 22 bp, Homo sapiens
cttccttgtggtccttctcatt

SEQ ID NO: 7034727 - DNA, 22 bp, Homo sapiens
atgaatgcatggtagactctgt

SEQ ID NO: 7034728 - DNA, 22 bp, Homo sapiens
atgcacaagaggctagaaaaga

SEQ ID NO: 7034729 - DNA, 22 bp, Homo sapiens
gacagggcaagactctgtctaa

SEQ ID NO: 7034730 - DNA, 22 bp, Homo sapiens
gacagggcatggtgcagagttc

SEQ ID NO: 7034731 - DNA, 22 bp, Homo sapiens
gacagggccaaaccggctgatc

SEQ ID NO: 7034732 - DNA, 22 bp, Homo sapiens
gacagggccgcagatggagact

SEQ ID NO: 7034733 - DNA, 22 bp, Homo sapiens
gacagggcgagactcagtctca

SEQ ID NO: 7034734 - DNA, 22 bp, Homo sapiens
gacagggcgcccagcctgtttc

SEQ ID NO: 7034735 - DNA, 23 bp, Homo sapiens
gacagggctgacttggcagctgc

SEQ ID NO: 7034736 - DNA, 22 bp, Homo sapiens
atgctttagtgtcaagtttggg

SEQ ID NO: 7034737 - DNA, 22 bp, Homo sapiens
gagaggctctgaggactggggt

SEQ ID NO: 7034738 - DNA, 17 bp, Homo sapiens
gagcagggatgcggttc

SEQ ID NO: 7034739 - DNA, 22 bp, Homo sapiens
gagctctgccatggctcccacc

SEQ ID NO: 7034740 - DNA, 18 bp, Homo sapiens
gagctctgcctcccagtc

SEQ ID NO: 7034741 - DNA, 22 bp, Homo sapiens
gagctctgtgaatgtggggagg

SEQ ID NO: 7034742 - DNA, 22 bp, Homo sapiens
atgtaatttatgttatccataa

SEQ ID NO: 7034743 - DNA, 22 bp, Homo sapiens
atgtacaatctatcacaagaag

SEQ ID NO: 7034744 - DNA, 22 bp, Homo sapiens
gaggggggcgccctgcagtgca

SEQ ID NO: 7034745 - DNA, 22 bp, Homo sapiens
gcaactgaacatgtgtgtggcc

SEQ ID NO: 7034746 - DNA, 22 bp, Homo sapiens
gcacagggagacagccgtggcc

SEQ ID NO: 7034747 - DNA, 22 bp, Homo sapiens
gcacagggagcaggtctctggt

SEQ ID NO: 7034748 - DNA, 22 bp, Homo sapiens
gcaggggtagagattgctggtg

SEQ ID NO: 7034749 - DNA, 22 bp, Homo sapiens
gctcagggtgcagtgtccatga

SEQ ID NO: 7034750 - DNA, 22 bp, Homo sapiens
gctggcagagctctgggctggg

SEQ ID NO: 7034751 - DNA, 19 bp, Homo sapiens
gctggcagatgtggccgtg

SEQ ID NO: 7034752 - DNA, 22 bp, Homo sapiens
gctggcagcattagaccctggg

SEQ ID NO: 7034753 - DNA, 22 bp, Homo sapiens
gctggcagccaagtgaagaggg

SEQ ID NO: 7034754 - DNA, 22 bp, Homo sapiens
gctggccatggggagtgaggag

SEQ ID NO: 7034755 - DNA, 19 bp, Homo sapiens
gctgggagcagaccctccc

SEQ ID NO: 7034756 - DNA, 22 bp, Homo sapiens
gctgggagccctggtctgctcc

SEQ ID NO: 7034757 - DNA, 22 bp, Homo sapiens
gctgggagccgtacctgtcacg

SEQ ID NO: 7034758 - DNA, 22 bp, Homo sapiens
ggaacagggatttggcctggtt

SEQ ID NO: 7034759 - DNA, 22 bp, Homo sapiens
ggaggagaccctgtgtcagttt

SEQ ID NO: 7034760 - DNA, 22 bp, Homo sapiens
ggaggggatggtttgaccctgg

SEQ ID NO: 7034761 - DNA, 22 bp, Homo sapiens
ggaggggatttagtagatgcta

SEQ ID NO: 7034762 - DNA, 22 bp, Homo sapiens
ggaggggccggctgcctgccac

SEQ ID NO: 7034763 - DNA, 22 bp, Homo sapiens
ggccagggcctggggactgtcc

SEQ ID NO: 7034764 - DNA, 22 bp, Homo sapiens
ggcgagggaagtttactgtgag

SEQ ID NO: 7034765 - DNA, 22 bp, Homo sapiens
ggcgagggagcagtgcggtggg

SEQ ID NO: 7034766 - DNA, 22 bp, Homo sapiens
cactgaggcttccttaggcaat

SEQ ID NO: 7034767 - DNA, 22 bp, Homo sapiens
cactgagggagggtttcttctg

SEQ ID NO: 7034768 - DNA, 22 bp, Homo sapiens
cactgagggcggagcccaggga

SEQ ID NO: 7034769 - DNA, 22 bp, Homo sapiens
cactgagggggtggtttcagga

SEQ ID NO: 7034770 - DNA, 22 bp, Homo sapiens
cactgaggtatctgtctctcct

SEQ ID NO: 7034771 - DNA, 21 bp, Homo sapiens
cactgaggtcaggggtagggt

SEQ ID NO: 7034772 - DNA, 20 bp, Homo sapiens
cactgaggtgcagctcatgc

SEQ ID NO: 7034773 - DNA, 22 bp, Homo sapiens
cactgaggtttgttaactgagt

SEQ ID NO: 7034774 - DNA, 22 bp, Homo sapiens
ggctcctgtcccctcagctgct

SEQ ID NO: 7034775 - DNA, 22 bp, Homo sapiens
ggctgcagcggattggggattg

SEQ ID NO: 7034776 - DNA, 22 bp, Homo sapiens
ggctgggagccccacagagtca

SEQ ID NO: 7034777 - DNA, 22 bp, Homo sapiens
ggctgggagctggacaggccgg

SEQ ID NO: 7034778 - DNA, 22 bp, Homo sapiens
ggcttggcagaggtgggtgctt

SEQ ID NO: 7034779 - DNA, 22 bp, Homo sapiens
gggctcagggacacatgtgtgt

SEQ ID NO: 7034780 - DNA, 22 bp, Homo sapiens
gggctcagtctgcggcgcgcgg

SEQ ID NO: 7034781 - DNA, 22 bp, Homo sapiens
gggctcagtctggcgtggaatg

SEQ ID NO: 7034782 - DNA, 22 bp, Homo sapiens
gggggaggtgaatgcaataagg

SEQ ID NO: 7034783 - DNA, 22 bp, Homo sapiens
gggggatgctcaggaggctgct

SEQ ID NO: 7034784 - DNA, 22 bp, Homo sapiens
gggggatgctcaggaggctgct

SEQ ID NO: 7034785 - DNA, 22 bp, Homo sapiens
ggtggcagtagcactgggcctg

SEQ ID NO: 7034786 - DNA, 22 bp, Homo sapiens
ggtggcagtgcttgcgggtcta

SEQ ID NO: 7034787 - DNA, 22 bp, Homo sapiens
gtctttggagaggtgccatttc

SEQ ID NO: 7034788 - DNA, 22 bp, Homo sapiens
gtgccctgacacacctggtgtg

SEQ ID NO: 7034789 - DNA, 22 bp, Homo sapiens
cagctcctgaggactgctggga

SEQ ID NO: 7034790 - DNA, 22 bp, Homo sapiens
cagctcctgcagctgctgccgt

SEQ ID NO: 7034791 - DNA, 22 bp, Homo sapiens
cagggatgaccagagggatgtg

SEQ ID NO: 7034792 - DNA, 22 bp, Homo sapiens
cagggatgagcagatggagcaa

SEQ ID NO: 7034793 - DNA, 22 bp, Homo sapiens
cagggatggcctggcgggccac

SEQ ID NO: 7034794 - DNA, 22 bp, Homo sapiens
cagggccaccctctgctgggtg

SEQ ID NO: 7034795 - DNA, 22 bp, Homo sapiens
cagggctggatcctccagactc

SEQ ID NO: 7034796 - DNA, 22 bp, Homo sapiens
tagtgttctaagaacatccatg

SEQ ID NO: 7034797 - DNA, 22 bp, Homo sapiens
catgctttgggtcagaaatgcc

SEQ ID NO: 7034798 - DNA, 22 bp, Homo sapiens
catgtgggaagaggccagctgg

SEQ ID NO: 7034799 - DNA, 23 bp, Homo sapiens
ccaagactgttaggagtggggag

SEQ ID NO: 7034800 - DNA, 22 bp, Homo sapiens
tctgggccctgagatgttcttc

SEQ ID NO: 7034801 - DNA, 22 bp, Homo sapiens
tctgggcctcacctgctgctca

SEQ ID NO: 7034802 - DNA, 18 bp, Homo sapiens
ccagggatgcatggtccc

SEQ ID NO: 7034803 - DNA, 22 bp, Homo sapiens
ccagggcaattatttggagggt

SEQ ID NO: 7034804 - DNA, 22 bp, Homo sapiens
tgaagtgagtagtgtctagggg

SEQ ID NO: 7034805 - DNA, 22 bp, Homo sapiens
ccagtgttttccagtttgccca

SEQ ID NO: 7034806 - DNA, 22 bp, Homo sapiens
tgcactttgcaggcatggaaac

SEQ ID NO: 7034807 - DNA, 18 bp, Homo sapiens
cccagaggaatgcctgga

SEQ ID NO: 7034808 - DNA, 22 bp, Homo sapiens
tgcaggtgctccgggggtgccc

SEQ ID NO: 7034809 - DNA, 22 bp, Homo sapiens
tgctgcctggagccttttgttt

SEQ ID NO: 7034810 - DNA, 22 bp, Homo sapiens
tgctgcctggtttcttcttgct

SEQ ID NO: 7034811 - DNA, 22 bp, Homo sapiens
tgcttcctatccacacaatgcc

SEQ ID NO: 7034812 - DNA, 22 bp, Homo sapiens
tgcttcctgaggccgtcttctc

SEQ ID NO: 7034813 - DNA, 22 bp, Homo sapiens
tgcttccttcccgttcttctcc

SEQ ID NO: 7034814 - DNA, 22 bp, Homo sapiens
tgcttccttgagctctccaatc

SEQ ID NO: 7034815 - DNA, 22 bp, Homo sapiens
tgcttccttgatcattcccaaa

SEQ ID NO: 7034816 - DNA, 22 bp, Homo sapiens
tggcacagtgctggatggtgct

SEQ ID NO: 7034817 - DNA, 22 bp, Homo sapiens
tggcagggaatacagatgttta

SEQ ID NO: 7034818 - DNA, 22 bp, Homo sapiens
tggcagggagccaccggtcatg

SEQ ID NO: 7034819 - DNA, 22 bp, Homo sapiens
ccctttacagcctctagagggt

SEQ ID NO: 7034820 - DNA, 22 bp, Homo sapiens
tggcagtggtaccggctctcag

SEQ ID NO: 7034821 - DNA, 22 bp, Homo sapiens
tggcagtgtataggtggctcct

SEQ ID NO: 7034822 - DNA, 22 bp, Homo sapiens
tggcagtgtcctactggttggt

SEQ ID NO: 7034823 - DNA, 19 bp, Homo sapiens
tggcagtgtggggtatgaa

SEQ ID NO: 7034824 - DNA, 22 bp, Homo sapiens
cctcctgggacaggctggcaca

SEQ ID NO: 7034825 - DNA, 19 bp, Homo sapiens
tggcttggctgcagatgct

SEQ ID NO: 7034826 - DNA, 22 bp, Homo sapiens
tgggcaggataatatctcatgt

SEQ ID NO: 7034827 - DNA, 22 bp, Homo sapiens
tgggcaggcaagtgaatacctt

SEQ ID NO: 7034828 - DNA, 22 bp, Homo sapiens
tgggtggattaggatagggtat

SEQ ID NO: 7034829 - DNA, 22 bp, Homo sapiens
tggttcctacgcacattgaatt

SEQ ID NO: 7034830 - DNA, 22 bp, Homo sapiens
cctgtggcacatgcagggattc

SEQ ID NO: 7034831 - DNA, 22 bp, Homo sapiens
ttatggcattcattggggcttt

SEQ ID NO: 7034832 - DNA, 22 bp, Homo sapiens
ttctccttgaaaagctgcatct

SEQ ID NO: 7034833 - DNA, 22 bp, Homo sapiens
ctcagccccaattctccccatt

SEQ ID NO: 7034834 - DNA, 22 bp, Homo sapiens
ctccctgcttgtttcccttcag

SEQ ID NO: 7034835 - DNA, 22 bp, Homo sapiens
tttatattacctggaatagctt

SEQ ID NO: 7034836 - DNA, 20 bp, Homo sapiens
ctcctgtgcctctctgggcc

SEQ ID NO: 7034837 - DNA, 22 bp, Homo sapiens
ctcctgtggtcaagggtgggac

SEQ ID NO: 7034838 - DNA, 22 bp, Homo sapiens
ttttcagtttgcactgcagtgc

SEQ ID NO: 7034839 - DNA, 22 bp, Homo sapiens
ctgaagggggtttcactgagct

SEQ ID NO: 7034840 - DNA, 22 bp, Homo sapiens
ctgaagggtctggggctgtgcc

SEQ ID NO: 7034841 - DNA, 22 bp, Homo sapiens
ctgagctgggagcctggcacca

SEQ ID NO: 7034842 - DNA, 22 bp, Homo sapiens
ctgagctgttactctgtcctcg

SEQ ID NO: 7034843 - DNA, 22 bp, Homo sapiens
ctgcaggggctggagttggctt

SEQ ID NO: 7034844 - DNA, 22 bp, Homo sapiens
ctgctgcccctgagctcagcct

SEQ ID NO: 7034845 - DNA, 22 bp, Homo sapiens
ctgctgccctagacccagtcct

SEQ ID NO: 7034846 - DNA, 19 bp, Homo sapiens
ctgctgccggagactcgtc

SEQ ID NO: 7034847 - DNA, 22 bp, Homo sapiens
ctgctgcctgattgcagacctc

SEQ ID NO: 7034848 - DNA, 22 bp, Homo sapiens
ctgctggcccccatttcagggt

SEQ ID NO: 7034849 - DNA, 22 bp, Homo sapiens
ctgctggcctagcccatcctct

SEQ ID NO: 7034850 - DNA, 17 bp, Homo sapiens
ctgctggctggggcttg

SEQ ID NO: 7034851 - DNA, 22 bp, Homo sapiens
ctgctgtgcacccaggaaggct

SEQ ID NO: 7034852 - DNA, 22 bp, Homo sapiens
ctgctgtgttgccagtgtcacc

SEQ ID NO: 7034853 - DNA, 22 bp, Homo sapiens
ctgggagcaagaggctgcaaat

SEQ ID NO: 7034854 - DNA, 22 bp, Homo sapiens
ctgggagctagctctgagctga

SEQ ID NO: 7034855 - DNA, 22 bp, Homo sapiens
ctgtgctgattcagcacaggcc

SEQ ID NO: 7034856 - DNA, 22 bp, Homo sapiens
ctgtgctggcagcaatcaagga

SEQ ID NO: 7034857 - DNA, 22 bp, Homo sapiens
cttccaagttgctctgctgacc

SEQ ID NO: 7034858 - DNA, 22 bp, Homo sapiens
gaaagctgaaccaggaaccatg

SEQ ID NO: 7034859 - DNA, 22 bp, Homo sapiens
gactgaggaggtaaggtttgaa

SEQ ID NO: 7034860 - DNA, 22 bp, Homo sapiens
gactgaggcctttattgagaca

SEQ ID NO: 7034861 - DNA, 16 bp, Homo sapiens
gactgaggctcagaga

SEQ ID NO: 7034862 - DNA, 22 bp, Homo sapiens
gactgaggctcccctaggctca

SEQ ID NO: 7034863 - DNA, 22 bp, Homo sapiens
gactgagggacagggcagtgga

SEQ ID NO: 7034864 - DNA, 22 bp, Homo sapiens
gactgagggatagaggtgcttc

SEQ ID NO: 7034865 - DNA, 17 bp, Homo sapiens
gactgaggtaaggtgag

SEQ ID NO: 7034866 - DNA, 22 bp, Homo sapiens
gactgaggtaagtgaaataagc

SEQ ID NO: 7034867 - DNA, 22 bp, Homo sapiens
gactgaggtattaagatggctt

SEQ ID NO: 7034868 - DNA, 22 bp, Homo sapiens
gactgaggtgacctaggactac

SEQ ID NO: 7034869 - DNA, 22 bp, Homo sapiens
gactgaggtgcccagaggtgac

SEQ ID NO: 7034870 - DNA, 22 bp, Homo sapiens
gagaaactaacatctgaaggtg

SEQ ID NO: 7034871 - DNA, 22 bp, Homo sapiens
gagaaactgaaacatagggcca

SEQ ID NO: 7034872 - DNA, 22 bp, Homo sapiens
gagaaactgaatatttaacggg

SEQ ID NO: 7034873 - DNA, 22 bp, Homo sapiens
gagaaactgctctgattctgca

SEQ ID NO: 7034874 - DNA, 22 bp, Homo sapiens
gagaaactgttggaattttaat

SEQ ID NO: 7034875 - DNA, 22 bp, Homo sapiens
gagaaacttggagttattctgg

SEQ ID NO: 7034876 - DNA, 22 bp, Homo sapiens
gagcagggagacaactctggtg

SEQ ID NO: 7034877 - DNA, 22 bp, Homo sapiens
gagcccaggttctgcttccagc

SEQ ID NO: 7034878 - DNA, 22 bp, Homo sapiens
gagctgagatcgtgccattgca

SEQ ID NO: 7034879 - DNA, 22 bp, Homo sapiens
gagctgagcctgggtggaccgc

SEQ ID NO: 7034880 - DNA, 22 bp, Homo sapiens
gagctgaggatacatcagtgaa

SEQ ID NO: 7034881 - DNA, 22 bp, Homo sapiens
gagctgagggtctaggagggtt

SEQ ID NO: 7034882 - DNA, 22 bp, Homo sapiens
gagctgagtatcccactgaagt

SEQ ID NO: 7034883 - DNA, 18 bp, Homo sapiens
gaggaaacaggctctgtg

SEQ ID NO: 7034884 - DNA, 22 bp, Homo sapiens
gaggagagagggactgtctgca

SEQ ID NO: 7034885 - DNA, 22 bp, Homo sapiens
gaggagcccagcaccatcactt

SEQ ID NO: 7034886 - DNA, 22 bp, Homo sapiens
gaggagcccccactgggctcac

SEQ ID NO: 7034887 - DNA, 22 bp, Homo sapiens
gaggagcccccactgggctcac

SEQ ID NO: 7034888 - DNA, 22 bp, Homo sapiens
gagggagggactagcattctct

SEQ ID NO: 7034889 - DNA, 22 bp, Homo sapiens
gagggagtctgtgcaaagaatt

SEQ ID NO: 7034890 - DNA, 22 bp, Homo sapiens
gagggagtgagacacaaaagaa

SEQ ID NO: 7034891 - DNA, 22 bp, Homo sapiens
gagggagtgccagagggccagc

SEQ ID NO: 7034892 - DNA, 22 bp, Homo sapiens
gagggggaaagtccctggagtc

SEQ ID NO: 7034893 - DNA, 22 bp, Homo sapiens
gcactggagatggggttgtcgg

SEQ ID NO: 7034894 - DNA, 22 bp, Homo sapiens
gcactgggaatgagggcagctt

SEQ ID NO: 7034895 - DNA, 22 bp, Homo sapiens
gcactgggaatgctgatgggct

SEQ ID NO: 7034896 - DNA, 22 bp, Homo sapiens
gcactgggctccaggaaggagg

SEQ ID NO: 7034897 - DNA, 20 bp, Homo sapiens
gcagggcgacacgggggagg

SEQ ID NO: 7034898 - DNA, 22 bp, Homo sapiens
gcagggcggcccagagcaggcc

SEQ ID NO: 7034899 - DNA, 22 bp, Homo sapiens
gcagggctcaacaggacacccc

SEQ ID NO: 7034900 - DNA, 22 bp, Homo sapiens
gcagggctcattgccaggcatt

SEQ ID NO: 7034901 - DNA, 22 bp, Homo sapiens
gccctgagaatgtgtgtgtcta

SEQ ID NO: 7034902 - DNA, 21 bp, Homo sapiens
gccttcactcccagagtttgt

SEQ ID NO: 7034903 - DNA, 22 bp, Homo sapiens
gcggcggagacagcaggaagcc

SEQ ID NO: 7034904 - DNA, 22 bp, Homo sapiens
gcgggccaccttggagagcgct

SEQ ID NO: 7034905 - DNA, 22 bp, Homo sapiens
gctctcatgccctctgggcttg

SEQ ID NO: 7034906 - DNA, 22 bp, Homo sapiens
gctgcccaatggtagtgtcttt

SEQ ID NO: 7034907 - DNA, 22 bp, Homo sapiens
gctggcaaggtgctggagggcc

SEQ ID NO: 7034908 - DNA, 22 bp, Homo sapiens
gctggcacagaataagcaggca

SEQ ID NO: 7034909 - DNA, 22 bp, Homo sapiens
gctggcacaggtggatgctggc

SEQ ID NO: 7034910 - DNA, 22 bp, Homo sapiens
gctggcactgggaaggactgag

SEQ ID NO: 7034911 - DNA, 22 bp, Homo sapiens
gctggcagactgggggcagaac

SEQ ID NO: 7034912 - DNA, 22 bp, Homo sapiens
gctggcagagacaagaagacta

SEQ ID NO: 7034913 - DNA, 22 bp, Homo sapiens
gctggcagagagctggtgagga

SEQ ID NO: 7034914 - DNA, 22 bp, Homo sapiens
gctggcagggacagctgcgtgt

SEQ ID NO: 7034915 - DNA, 22 bp, Homo sapiens
gctggctgcacaggggctcact

SEQ ID NO: 7034916 - DNA, 18 bp, Homo sapiens
gctggctgcacttctgct

SEQ ID NO: 7034917 - DNA, 22 bp, Homo sapiens
gctgggaggcagcacctttagc

SEQ ID NO: 7034918 - DNA, 22 bp, Homo sapiens
gctggtagacctcactgcactc

SEQ ID NO: 7034919 - DNA, 22 bp, Homo sapiens
gctggtatttgcagcctgtcat

SEQ ID NO: 7034920 - DNA, 22 bp, Homo sapiens
gcttcctagcattagccattgc

SEQ ID NO: 7034921 - DNA, 22 bp, Homo sapiens
ggaaaggagatattggagagtg

SEQ ID NO: 7034922 - DNA, 22 bp, Homo sapiens
ggaaagggcagaggccttggag

SEQ ID NO: 7034923 - DNA, 22 bp, Homo sapiens
ggagatggctctgcaaggtcta

SEQ ID NO: 7034924 - DNA, 22 bp, Homo sapiens
ggagatggctggcaggtagatg

SEQ ID NO: 7034925 - DNA, 22 bp, Homo sapiens
ggagcactataatagagatttt

SEQ ID NO: 7034926 - DNA, 22 bp, Homo sapiens
ggagcactttctaggagaagcc

SEQ ID NO: 7034927 - DNA, 22 bp, Homo sapiens
ggatgcaggaggtcggggagca

SEQ ID NO: 7034928 - DNA, 22 bp, Homo sapiens
ggatggagatgaccatggtgac

SEQ ID NO: 7034929 - DNA, 22 bp, Homo sapiens
ggatggcatgttgggctctgtt

SEQ ID NO: 7034930 - DNA, 22 bp, Homo sapiens
ggcaggggtgaggccactctga

SEQ ID NO: 7034931 - DNA, 22 bp, Homo sapiens
ggcaggggtggccttcctttgg

SEQ ID NO: 7034932 - DNA, 22 bp, Homo sapiens
ggcaggggttcattttgtctta

SEQ ID NO: 7034933 - DNA, 22 bp, Homo sapiens
ggcagggtccacacctgggaaa

SEQ ID NO: 7034934 - DNA, 17 bp, Homo sapiens
ggcagggtgctgggtat

SEQ ID NO: 7034935 - DNA, 22 bp, Homo sapiens
ggcagggtggccctccagtgag

SEQ ID NO: 7034936 - DNA, 22 bp, Homo sapiens
ggcagggtgtggagttgggaca

SEQ ID NO: 7034937 - DNA, 19 bp, Homo sapiens
ggcatccacagctggagag

SEQ ID NO: 7034938 - DNA, 22 bp, Homo sapiens
ggcatgagaggtcctggggatt

SEQ ID NO: 7034939 - DNA, 22 bp, Homo sapiens
ggcatgcaaatgtgggtgacct

SEQ ID NO: 7034940 - DNA, 22 bp, Homo sapiens
ggcatgcatgcaaggtggtgta

SEQ ID NO: 7034941 - DNA, 22 bp, Homo sapiens
gggaagggacttgtttaaggtc

SEQ ID NO: 7034942 - DNA, 21 bp, Homo sapiens
gggaagtcataaaattagggc

SEQ ID NO: 7034943 - DNA, 21 bp, Homo sapiens
gggaatgagattcttggagat

SEQ ID NO: 7034944 - DNA, 22 bp, Homo sapiens
gggagctgagctggaagagaat

SEQ ID NO: 7034945 - DNA, 22 bp, Homo sapiens
gggagctgagggacctctgtgg

SEQ ID NO: 7034946 - DNA, 22 bp, Homo sapiens
gggagctggagctggaagactc

SEQ ID NO: 7034947 - DNA, 22 bp, Homo sapiens
gggagggaggtgatgcttggct

SEQ ID NO: 7034948 - DNA, 22 bp, Homo sapiens
gggagggaggtgctggttcacg

SEQ ID NO: 7034949 - DNA, 22 bp, Homo sapiens
gggagggaggtgctggttcacg

SEQ ID NO: 7034950 - DNA, 22 bp, Homo sapiens
gggagggatctgctaggcaatg

SEQ ID NO: 7034951 - DNA, 21 bp, Homo sapiens
gggagggatggaaatgatgtt

SEQ ID NO: 7034952 - DNA, 22 bp, Homo sapiens
gggagggattagttctgcctgg

SEQ ID NO: 7034953 - DNA, 22 bp, Homo sapiens
gggaggtgattaggaccatgta

SEQ ID NO: 7034954 - DNA, 22 bp, Homo sapiens
gggaggttgaggctgcagtgag

SEQ ID NO: 7034955 - DNA, 22 bp, Homo sapiens
gggcatgcaggactgtggcaga

SEQ ID NO: 7034956 - DNA, 20 bp, Homo sapiens
gggctggctcaactggatcc

SEQ ID NO: 7034957 - DNA, 22 bp, Homo sapiens
gggctggctcccaggtgttgaa

SEQ ID NO: 7034958 - DNA, 22 bp, Homo sapiens
ggggatggaggcgtgtggtcct

SEQ ID NO: 7034959 - DNA, 22 bp, Homo sapiens
ggggcaggagcccttcttcagc

SEQ ID NO: 7034960 - DNA, 22 bp, Homo sapiens
ggggcaggaggtgttctctttt

SEQ ID NO: 7034961 - DNA, 22 bp, Homo sapiens
gggtcaggctcagcagggcagc

SEQ ID NO: 7034962 - DNA, 22 bp, Homo sapiens
ggtgaaggaggaagctgatgga

SEQ ID NO: 7034963 - DNA, 22 bp, Homo sapiens
ggtgaaggcacaagagggcaag

SEQ ID NO: 7034964 - DNA, 22 bp, Homo sapiens
ggtgaagggccttaggagacag

SEQ ID NO: 7034965 - DNA, 22 bp, Homo sapiens
ggtgccacataaatggagagag

SEQ ID NO: 7034966 - DNA, 22 bp, Homo sapiens
ggtgggagagcttgctttgatg

SEQ ID NO: 7034967 - DNA, 23 bp, Homo sapiens
ggtgggagattatccagaattat

SEQ ID NO: 7034968 - DNA, 22 bp, Homo sapiens
ggtgggagccaacacccttctg

SEQ ID NO: 7034969 - DNA, 22 bp, Homo sapiens
ggtgggaggactgtttgaggca

SEQ ID NO: 7034970 - DNA, 22 bp, Homo sapiens
ggtgggaggcaggctgctccca

SEQ ID NO: 7034971 - DNA, 22 bp, Homo sapiens
ggtgggaggcaggctgctccca

SEQ ID NO: 7034972 - DNA, 22 bp, Homo sapiens
ggtgggagggctgcgttcctct

SEQ ID NO: 7034973 - DNA, 16 bp, Homo sapiens
ggtgggaggtgaggtg

SEQ ID NO: 7034974 - DNA, 22 bp, Homo sapiens
ggtgggagtggaacgtggaaga

SEQ ID NO: 7034975 - DNA, 22 bp, Homo sapiens
ggtgggagtgggcacagttacg

SEQ ID NO: 7034976 - DNA, 22 bp, Homo sapiens
gtagactgatgggactgaggta

SEQ ID NO: 7034977 - DNA, 22 bp, Homo sapiens
gtgccctgatcgctaggctccc

SEQ ID NO: 7034978 - DNA, 22 bp, Homo sapiens
gtgccctgcatgccccgggtat

SEQ ID NO: 7034979 - DNA, 22 bp, Homo sapiens
gtgccctgggccttcagggcca

SEQ ID NO: 7034980 - DNA, 22 bp, Homo sapiens
gttccaggaccctggcctctga

SEQ ID NO: 7034981 - DNA, 22 bp, Homo sapiens
gttccaggcaagtgggatagga

SEQ ID NO: 7034982 - DNA, 22 bp, Homo sapiens
gttccttggaagaacttgaggt

SEQ ID NO: 7034983 - DNA, 22 bp, Homo sapiens
gttccttgggaacaacgctgaa

SEQ ID NO: 7034984 - DNA, 22 bp, Homo sapiens
gttccttgtaatttgttaagga

SEQ ID NO: 7034985 - DNA, 22 bp, Homo sapiens
gttccttgtatttcagacatga

SEQ ID NO: 7034986 - DNA, 22 bp, Homo sapiens
gttcgcatcttgatcatggact

SEQ ID NO: 7034987 - DNA, 22 bp, Homo sapiens
gtttatatgaacttcataccca

SEQ ID NO: 7034988 - DNA, 22 bp, Homo sapiens
taagaaatttagttatagaatg

SEQ ID NO: 7034989 - DNA, 22 bp, Homo sapiens
tacatgtctacatgcatttttg

SEQ ID NO: 7034990 - DNA, 22 bp, Homo sapiens
tactgaggcaatagataacggc

SEQ ID NO: 7034991 - DNA, 22 bp, Homo sapiens
tactgaggccatgagtctcata

SEQ ID NO: 7034992 - DNA, 22 bp, Homo sapiens
tactgaggctgaattcttagca

SEQ ID NO: 7034993 - DNA, 22 bp, Homo sapiens
tactgaggctggcagccccttg

SEQ ID NO: 7034994 - DNA, 22 bp, Homo sapiens
tactgaggctgggttaagcatc

SEQ ID NO: 7034995 - DNA, 22 bp, Homo sapiens
tactgagggcaaagagtgaagc

SEQ ID NO: 7034996 - DNA, 22 bp, Homo sapiens
tactgagggctgtgtatgtatt

SEQ ID NO: 7034997 - DNA, 17 bp, Homo sapiens
tactgaggggtctggag

SEQ ID NO: 7034998 - DNA, 22 bp, Homo sapiens
tactgagggtatgaagccaagg

SEQ ID NO: 7034999 - DNA, 22 bp, Homo sapiens
tactgagggtgaaaaataaagt

SEQ ID NO: 7035000 - DNA, 22 bp, Homo sapiens
tactgaggtactttacttataa

SEQ ID NO: 7035001 - DNA, 20 bp, Homo sapiens
tactgaggttaggggatgga

SEQ ID NO: 7035002 - DNA, 22 bp, Homo sapiens
tactgaggttgagaagctgctc

SEQ ID NO: 7035003 - DNA, 22 bp, Homo sapiens
tagcactgagtctagctttgga

SEQ ID NO: 7035004 - DNA, 22 bp, Homo sapiens
tagcactgttctagcatgtttt

SEQ ID NO: 7035005 - DNA, 22 bp, Homo sapiens
taggctggaacttaggcagagg

SEQ ID NO: 7035006 - DNA, 22 bp, Homo sapiens
tagtgtttagtacatatgcata

SEQ ID NO: 7035007 - DNA, 22 bp, Homo sapiens
tagttaaagccctaaattgata

SEQ ID NO: 7035008 - DNA, 22 bp, Homo sapiens
tatgcaggattatctactacca

SEQ ID NO: 7035009 - DNA, 22 bp, Homo sapiens
tatgcagggtgggttctctgag

SEQ ID NO: 7035010 - DNA, 22 bp, Homo sapiens
tattcatgagataggcagtttt

SEQ ID NO: 7035011 - DNA, 22 bp, Homo sapiens
tattgacttgggcattgagaga

SEQ ID NO: 7035012 - DNA, 22 bp, Homo sapiens
tattgagttacagaaaatactt

SEQ ID NO: 7035013 - DNA, 22 bp, Homo sapiens
tattttcaccttctctggatat

SEQ ID NO: 7035014 - DNA, 22 bp, Homo sapiens
tattttcatcttgtccttggat

SEQ ID NO: 7035015 - DNA, 22 bp, Homo sapiens
tattttcattctgtgtgactgt

SEQ ID NO: 7035016 - DNA, 22 bp, Homo sapiens
tcacccaggtccaggctctggc

SEQ ID NO: 7035017 - DNA, 22 bp, Homo sapiens
tcaccgaggctggagtgcagtg

SEQ ID NO: 7035018 - DNA, 22 bp, Homo sapiens
tcactggaaagacagcactctt

SEQ ID NO: 7035019 - DNA, 22 bp, Homo sapiens
tcactggaaatgcacagctgta

SEQ ID NO: 7035020 - DNA, 21 bp, Homo sapiens
tcactggaatacaattgattt

SEQ ID NO: 7035021 - DNA, 22 bp, Homo sapiens
tcactggactcactgtggccag

SEQ ID NO: 7035022 - DNA, 22 bp, Homo sapiens
tcactggatcctagctgagcct

SEQ ID NO: 7035023 - DNA, 22 bp, Homo sapiens
tcactggattagtttgaactgt

SEQ ID NO: 7035024 - DNA, 23 bp, Homo sapiens
tcagcctcttaggacttctcacc

SEQ ID NO: 7035025 - DNA, 22 bp, Homo sapiens
tcagggagaggtgagagcctgt

SEQ ID NO: 7035026 - DNA, 22 bp, Homo sapiens
tcaggggaggttgaatcgtctc

SEQ ID NO: 7035027 - DNA, 22 bp, Homo sapiens
tccacagcacaaagccagtgtg

SEQ ID NO: 7035028 - DNA, 22 bp, Homo sapiens
tccaggacctgactgggcctgc

SEQ ID NO: 7035029 - DNA, 22 bp, Homo sapiens
tccaggcctaggccaagtgatt

SEQ ID NO: 7035030 - DNA, 22 bp, Homo sapiens
tccagggatgccagccatgttg

SEQ ID NO: 7035031 - DNA, 22 bp, Homo sapiens
tccagggatggtaatgagcagt

SEQ ID NO: 7035032 - DNA, 23 bp, Homo sapiens
tccagggattaatgaagtcagtc

SEQ ID NO: 7035033 - DNA, 22 bp, Homo sapiens
ttatttaaaagtggtaagattc

SEQ ID NO: 7035034 - DNA, 22 bp, Homo sapiens
ttccaagagctgctggggtaag

SEQ ID NO: 7035035 - DNA, 22 bp, Homo sapiens
ttccaaggtgggactggggtgc

SEQ ID NO: 7035036 - DNA, 19 bp, Homo sapiens
ttcccaggaaaggggtgca

SEQ ID NO: 7035037 - DNA, 22 bp, Homo sapiens
ttgagtctctgccaaaacacaa

SEQ ID NO: 7035038 - DNA, 22 bp, Homo sapiens
ttgcattttggttgtaaatatg

SEQ ID NO: 7035039 - DNA, 22 bp, Homo sapiens
ttgccagggccagtgggggtgt

SEQ ID NO: 7035040 - DNA, 22 bp, Homo sapiens
ttggaattcaagttgtagctta

SEQ ID NO: 7035041 - DNA, 22 bp, Homo sapiens
ttggagggacagatggctaggc

SEQ ID NO: 7035042 - DNA, 22 bp, Homo sapiens
ttggctggctacctgggccgag

SEQ ID NO: 7035043 - DNA, 22 bp, Homo sapiens
ttggctggtttcaagaaggcat

SEQ ID NO: 7035044 - DNA, 22 bp, Homo sapiens
ttgtttaaaagaaatcatagaa

SEQ ID NO: 7035045 - DNA, 22 bp, Homo sapiens
tttaacttagaagagatatcct

SEQ ID NO: 7035046 - DNA, 22 bp, Homo sapiens
tttccaggagaaagagagcctt

SEQ ID NO: 7035047 - DNA, 22 bp, Homo sapiens
tttccagggaggaatgtggggt

SEQ ID NO: 7035048 - DNA, 22 bp, Homo sapiens
tttccagggaggaatgtggggt

SEQ ID NO: 7035049 - DNA, 18 bp, Homo sapiens
tttccagggattaggtgg

SEQ ID NO: 7035050 - DNA, 22 bp, Homo sapiens
tttccaggtattaatactgtat

SEQ ID NO: 7035051 - DNA, 22 bp, Homo sapiens
tttccttgcacattggtttcca

SEQ ID NO: 7035052 - DNA, 22 bp, Homo sapiens
tttccttgcctcctgtccttct

SEQ ID NO: 7035053 - DNA, 22 bp, Homo sapiens
tttgggctggtttgccatgccc

SEQ ID NO: 7035054 - DNA, 22 bp, Homo sapiens
tttgtggcaggagcggagaccg

SEQ ID NO: 7035055 - DNA, 22 bp, Homo sapiens
aaacctttaccagactagcaag

SEQ ID NO: 7035056 - DNA, 22 bp, Homo sapiens
aaactgagtggcttataaacaa

SEQ ID NO: 7035057 - DNA, 22 bp, Homo sapiens
aaaggaagatgccaggactctg

SEQ ID NO: 7035058 - DNA, 22 bp, Homo sapiens
aaatgcagtttcctgagaccca

SEQ ID NO: 7035059 - DNA, 22 bp, Homo sapiens
aagctgagccagtggcaagtgc

SEQ ID NO: 7035060 - DNA, 19 bp, Homo sapiens
aagctgagggctgtccacc

SEQ ID NO: 7035061 - DNA, 22 bp, Homo sapiens
aacagagcttgggtcatctcat

SEQ ID NO: 7035062 - DNA, 22 bp, Homo sapiens
aaccaccattctctcctcttcc

SEQ ID NO: 7035063 - DNA, 22 bp, Homo sapiens
aacttaaacccactcatgtaga

SEQ ID NO: 7035064 - DNA, 22 bp, Homo sapiens
aagcacagggactcaggaccgg

SEQ ID NO: 7035065 - DNA, 22 bp, Homo sapiens
acatgtgtctaagaatgaaaga

SEQ ID NO: 7035066 - DNA, 22 bp, Homo sapiens
acatgtgtggacatgaatctac

SEQ ID NO: 7035067 - DNA, 22 bp, Homo sapiens
aagggcccggctgtgggcagag

SEQ ID NO: 7035068 - DNA, 22 bp, Homo sapiens
aagggcccttctgttagtggca

SEQ ID NO: 7035069 - DNA, 22 bp, Homo sapiens
aatcataattgtatacattcat

SEQ ID NO: 7035070 - DNA, 23 bp, Homo sapiens
aatgagagaccatgtggagcaga

SEQ ID NO: 7035071 - DNA, 22 bp, Homo sapiens
agaagggctacacgggctctcc

SEQ ID NO: 7035072 - DNA, 22 bp, Homo sapiens
agacagggtcttgatcagagct

SEQ ID NO: 7035073 - DNA, 22 bp, Homo sapiens
agacagggtgatcgcttgagcc

SEQ ID NO: 7035074 - DNA, 22 bp, Homo sapiens
aatgtccaccgtgatgatggaa

SEQ ID NO: 7035075 - DNA, 22 bp, Homo sapiens
agagctgggtggtggtgactca

SEQ ID NO: 7035076 - DNA, 22 bp, Homo sapiens
aattttcacagtgctgtgagat

SEQ ID NO: 7035077 - DNA, 22 bp, Homo sapiens
acaaacagagttgaaaaatagg

SEQ ID NO: 7035078 - DNA, 22 bp, Homo sapiens
acaatgtttttgttcaaagagt

SEQ ID NO: 7035079 - DNA, 23 bp, Homo sapiens
agcagggccagaatacttgctgt

SEQ ID NO: 7035080 - DNA, 22 bp, Homo sapiens
agctcctgttctgagagcagga

SEQ ID NO: 7035081 - DNA, 22 bp, Homo sapiens
agctggaggggccagcaggtgt

SEQ ID NO: 7035082 - DNA, 22 bp, Homo sapiens
agctggcaaaactaatgggaag

SEQ ID NO: 7035083 - DNA, 22 bp, Homo sapiens
agctggcaaacagcttacggcc

SEQ ID NO: 7035084 - DNA, 22 bp, Homo sapiens
agctggcaaggcaatttggatt

SEQ ID NO: 7035085 - DNA, 22 bp, Homo sapiens
agctggcaaggcaatttggatt

SEQ ID NO: 7035086 - DNA, 22 bp, Homo sapiens
agctggcaagttgaaggtggct

SEQ ID NO: 7035087 - DNA, 22 bp, Homo sapiens
agctggcaagttgaaggtggct

SEQ ID NO: 7035088 - DNA, 22 bp, Homo sapiens
agctggcaaggctttagattca

SEQ ID NO: 7035089 - DNA, 22 bp, Homo sapiens
agctggcaatctttctaaatac

SEQ ID NO: 7035090 - DNA, 22 bp, Homo sapiens
agctggcaatgtaagtccctgg

SEQ ID NO: 7035091 - DNA, 21 bp, Homo sapiens
agctggcaatgttgtcctctt

SEQ ID NO: 7035092 - DNA, 22 bp, Homo sapiens
agctggcacagaccaggagatc

SEQ ID NO: 7035093 - DNA, 22 bp, Homo sapiens
agctggcaccaaatatagtaaa

SEQ ID NO: 7035094 - DNA, 19 bp, Homo sapiens
agctggcactagaatccag

SEQ ID NO: 7035095 - DNA, 22 bp, Homo sapiens
agctggcactagcgtttccaag

SEQ ID NO: 7035096 - DNA, 22 bp, Homo sapiens
agctggcagaaagctttgcccg

SEQ ID NO: 7035097 - DNA, 22 bp, Homo sapiens
agctggcagagcatttgtggcc

SEQ ID NO: 7035098 - DNA, 21 bp, Homo sapiens
agctggcagatatggtgtctg

SEQ ID NO: 7035099 - DNA, 22 bp, Homo sapiens
agctggcagctctcaggggtac

SEQ ID NO: 7035100 - DNA, 18 bp, Homo sapiens
acagggagggcgctgggg

SEQ ID NO: 7035101 - DNA, 19 bp, Homo sapiens
acaggggcctttccagggt

SEQ ID NO: 7035102 - DNA, 22 bp, Homo sapiens
acagtgttacttgatagtgtat

SEQ ID NO: 7035103 - DNA, 21 bp, Homo sapiens
aggatggaaaggactaggggt

SEQ ID NO: 7035104 - DNA, 19 bp, Homo sapiens
aggatggagcaggcggtga

SEQ ID NO: 7035105 - DNA, 22 bp, Homo sapiens
aggatggattctgtatgtggga

SEQ ID NO: 7035106 - DNA, 22 bp, Homo sapiens
agggggaggctgtgctgcgtct

SEQ ID NO: 7035107 - DNA, 22 bp, Homo sapiens
agggggagtttcagttagaaag

SEQ ID NO: 7035108 - DNA, 22 bp, Homo sapiens
acctgaggcctccccagcagac

SEQ ID NO: 7035109 - DNA, 22 bp, Homo sapiens
aggtggccccaggcctctgcca

SEQ ID NO: 7035110 - DNA, 23 bp, Homo sapiens
aggtggcctttgcctctttctct

SEQ ID NO: 7035111 - DNA, 22 bp, Homo sapiens
agtgttcttcttcaaagctctg

SEQ ID NO: 7035112 - DNA, 22 bp, Homo sapiens
agtgtttaatgccttttccagc

SEQ ID NO: 7035113 - DNA, 22 bp, Homo sapiens
actgggagagcgaccagattct

SEQ ID NO: 7035114 - DNA, 22 bp, Homo sapiens
actgggagagtttgcttataat

SEQ ID NO: 7035115 - DNA, 22 bp, Homo sapiens
atacatgttgagaaaatatctg

SEQ ID NO: 7035116 - DNA, 22 bp, Homo sapiens
agaaaataaattgatggtggaa

SEQ ID NO: 7035117 - DNA, 22 bp, Homo sapiens
atcctgggcaaagtatgctgtc

SEQ ID NO: 7035118 - DNA, 22 bp, Homo sapiens
agaagtggtgtgtggccgagct

SEQ ID NO: 7035119 - DNA, 18 bp, Homo sapiens
agaattgctgcttcttct

SEQ ID NO: 7035120 - DNA, 22 bp, Homo sapiens
agagaagcagggagtcatctgt

SEQ ID NO: 7035121 - DNA, 22 bp, Homo sapiens
agagatgaagggcattccccag

SEQ ID NO: 7035122 - DNA, 22 bp, Homo sapiens
agagccagcaagtgaatagtga

SEQ ID NO: 7035123 - DNA, 22 bp, Homo sapiens
agaggagcctcagtttgcagcc

SEQ ID NO: 7035124 - DNA, 22 bp, Homo sapiens
agaggctgtgcagagggagtgc

SEQ ID NO: 7035125 - DNA, 23 bp, Homo sapiens
attccaggaaatacttggctttc

SEQ ID NO: 7035126 - DNA, 22 bp, Homo sapiens
attccaggaagtgtgggaccaa

SEQ ID NO: 7035127 - DNA, 22 bp, Homo sapiens
attccaggactaaaggaacagc

SEQ ID NO: 7035128 - DNA, 22 bp, Homo sapiens
attccaggagctaactgtggtc

SEQ ID NO: 7035129 - DNA, 22 bp, Homo sapiens
attccaggattccaggacaaat

SEQ ID NO: 7035130 - DNA, 22 bp, Homo sapiens
attccaggcaaagcagagaaga

SEQ ID NO: 7035131 - DNA, 22 bp, Homo sapiens
attccaggcagaccagagagat

SEQ ID NO: 7035132 - DNA, 22 bp, Homo sapiens
attccaggcatgcaggaacaag

SEQ ID NO: 7035133 - DNA, 22 bp, Homo sapiens
attccaggttgtagaaaagttt

SEQ ID NO: 7035134 - DNA, 17 bp, Homo sapiens
atttccagagtggccct

SEQ ID NO: 7035135 - DNA, 22 bp, Homo sapiens
atttggcaaaagttagaagaaa

SEQ ID NO: 7035136 - DNA, 22 bp, Homo sapiens
atttggcaaataatttgagggt

SEQ ID NO: 7035137 - DNA, 22 bp, Homo sapiens
atttggcaatgctagagaagtt

SEQ ID NO: 7035138 - DNA, 22 bp, Homo sapiens
atttggcagccacagcaatctt

SEQ ID NO: 7035139 - DNA, 20 bp, Homo sapiens
atttggcatagtttaagcaa

SEQ ID NO: 7035140 - DNA, 22 bp, Homo sapiens
agcacatgagctgatggtgggc

SEQ ID NO: 7035141 - DNA, 22 bp, Homo sapiens
agcacatgcacagtgctacact

SEQ ID NO: 7035142 - DNA, 22 bp, Homo sapiens
caaatattccaggtacatccct

SEQ ID NO: 7035143 - DNA, 22 bp, Homo sapiens
caaattaccctcaacatctaga

SEQ ID NO: 7035144 - DNA, 22 bp, Homo sapiens
caacagaggagtggcctgatcc

SEQ ID NO: 7035145 - DNA, 22 bp, Homo sapiens
cacagtgtttgatttaggggcc

SEQ ID NO: 7035146 - DNA, 22 bp, Homo sapiens
agcaggggcagggttttgtgct

SEQ ID NO: 7035147 - DNA, 22 bp, Homo sapiens
agcaggggctcctccacagcca

SEQ ID NO: 7035148 - DNA, 22 bp, Homo sapiens
agcagggggccacagtcacagc

SEQ ID NO: 7035149 - DNA, 22 bp, Homo sapiens
agccactgtctgaacttctgtg

SEQ ID NO: 7035150 - DNA, 22 bp, Homo sapiens
agcctgagctgcctgccgcctc

SEQ ID NO: 7035151 - DNA, 22 bp, Homo sapiens
cagctctgtaaattccttcatc

SEQ ID NO: 7035152 - DNA, 22 bp, Homo sapiens
cagctgagaaaggcaggctcac

SEQ ID NO: 7035153 - DNA, 22 bp, Homo sapiens
agctgcagttcgttccagctct

SEQ ID NO: 7035154 - DNA, 22 bp, Homo sapiens
agctgctgagccatgtcctgct

SEQ ID NO: 7035155 - DNA, 22 bp, Homo sapiens
cagggagctctgggccggactc

SEQ ID NO: 7035156 - DNA, 22 bp, Homo sapiens
cagggagctggctggctgtgcc

SEQ ID NO: 7035157 - DNA, 22 bp, Homo sapiens
cagggagctggtgccagccgac

SEQ ID NO: 7035158 - DNA, 19 bp, Homo sapiens
cagggatgggtagggactc

SEQ ID NO: 7035159 - DNA, 22 bp, Homo sapiens
cagggatgtctctggaagggag

SEQ ID NO: 7035160 - DNA, 22 bp, Homo sapiens
cagggctccctgcagcctctgt

SEQ ID NO: 7035161 - DNA, 22 bp, Homo sapiens
caggggctctgagattgtctaa

SEQ ID NO: 7035162 - DNA, 22 bp, Homo sapiens
caggggctctgggtgatgtgag

SEQ ID NO: 7035163 - DNA, 22 bp, Homo sapiens
caggggctgtggcacatggtgt

SEQ ID NO: 7035164 - DNA, 22 bp, Homo sapiens
caggggctgtttgcctcaggcc

SEQ ID NO: 7035165 - DNA, 22 bp, Homo sapiens
cagggtgcatacccatgcatac

SEQ ID NO: 7035166 - DNA, 20 bp, Homo sapiens
caggtgattccctggggaat

SEQ ID NO: 7035167 - DNA, 22 bp, Homo sapiens
cagtggcgtgatctctgctcac

SEQ ID NO: 7035168 - DNA, 22 bp, Homo sapiens
aggaggctgtggagcactccat

SEQ ID NO: 7035169 - DNA, 22 bp, Homo sapiens
catgcgggttccaggctgcact

SEQ ID NO: 7035170 - DNA, 22 bp, Homo sapiens
catggcagaaacctgagctgct

SEQ ID NO: 7035171 - DNA, 22 bp, Homo sapiens
catgggctttggaggctggagg

SEQ ID NO: 7035172 - DNA, 23 bp, Homo sapiens
catggggagcagtgctcctgacc

SEQ ID NO: 7035173 - DNA, 22 bp, Homo sapiens
catgggggctgaggctgctgta

SEQ ID NO: 7035174 - DNA, 22 bp, Homo sapiens
cattaaaatatctcatggtgtt

SEQ ID NO: 7035175 - DNA, 22 bp, Homo sapiens
ccagcttttcttatcattataa

SEQ ID NO: 7035176 - DNA, 22 bp, Homo sapiens
agggaaattaatgtgagcaatg

SEQ ID NO: 7035177 - DNA, 22 bp, Homo sapiens
agggactcctctgctcggctgc

SEQ ID NO: 7035178 - DNA, 22 bp, Homo sapiens
agggactgagctaggatctagt

SEQ ID NO: 7035179 - DNA, 22 bp, Homo sapiens
agggagaaaattggatgcacaa

SEQ ID NO: 7035180 - DNA, 22 bp, Homo sapiens
agggatggaagctcgtctgcaa

SEQ ID NO: 7035181 - DNA, 22 bp, Homo sapiens
agggatggcaagttaacctgag

SEQ ID NO: 7035182 - DNA, 22 bp, Homo sapiens
agggatgggaactcctccagca

SEQ ID NO: 7035183 - DNA, 22 bp, Homo sapiens
agggccagagtacatcagggct

SEQ ID NO: 7035184 - DNA, 22 bp, Homo sapiens
cccttcccttctgggagatcca

SEQ ID NO: 7035185 - DNA, 17 bp, Homo sapiens
aggggagagtgggaaga

SEQ ID NO: 7035186 - DNA, 22 bp, Homo sapiens
cctggagcgcgggtcaagctgg

SEQ ID NO: 7035187 - DNA, 22 bp, Homo sapiens
agtgactgggcagggcagggcc

SEQ ID NO: 7035188 - DNA, 22 bp, Homo sapiens
agtgcaggccccaggccaggcc

SEQ ID NO: 7035189 - DNA, 22 bp, Homo sapiens
agtggctgtatcagtcaaccct

SEQ ID NO: 7035190 - DNA, 20 bp, Homo sapiens
agtgggagagggcagactgc

SEQ ID NO: 7035191 - DNA, 22 bp, Homo sapiens
agtgttcatttattcattcact

SEQ ID NO: 7035192 - DNA, 22 bp, Homo sapiens
ctgcccagattttaccacctgc

SEQ ID NO: 7035193 - DNA, 22 bp, Homo sapiens
ctggaacccaggcctggaagcc

SEQ ID NO: 7035194 - DNA, 22 bp, Homo sapiens
ataggctgatctagcagcacag

SEQ ID NO: 7035195 - DNA, 22 bp, Homo sapiens
ataggctgtaataattcacatt

SEQ ID NO: 7035196 - DNA, 22 bp, Homo sapiens
ctgggcccacaagtggaatcgt

SEQ ID NO: 7035197 - DNA, 22 bp, Homo sapiens
ctgggctgtaatgtggcactga

SEQ ID NO: 7035198 - DNA, 22 bp, Homo sapiens
ctttgggcaaagggccaattcg

SEQ ID NO: 7035199 - DNA, 22 bp, Homo sapiens
ctttgggtattctcccttgggg

SEQ ID NO: 7035200 - DNA, 22 bp, Homo sapiens
atgagctgagtttgtaagtctt

SEQ ID NO: 7035201 - DNA, 22 bp, Homo sapiens
atgagctgtgggattccagagg

SEQ ID NO: 7035202 - DNA, 22 bp, Homo sapiens
gaagcctgctgtgcagccaaat

SEQ ID NO: 7035203 - DNA, 22 bp, Homo sapiens
gaagctgagctgaggcatgttg

SEQ ID NO: 7035204 - DNA, 22 bp, Homo sapiens
gaagctgagtggactctggcca

SEQ ID NO: 7035205 - DNA, 22 bp, Homo sapiens
atgctgtggtagacagcattcc

SEQ ID NO: 7035206 - DNA, 22 bp, Homo sapiens
gagaagtgcagagtggttaagc

SEQ ID NO: 7035207 - DNA, 18 bp, Homo sapiens
gagaagtgcatacattat

SEQ ID NO: 7035208 - DNA, 22 bp, Homo sapiens
atgggagtgacagggccactgg

SEQ ID NO: 7035209 - DNA, 22 bp, Homo sapiens
atgggagttttctctgatgctc

SEQ ID NO: 7035210 - DNA, 19 bp, Homo sapiens
gcaggtggatgtggtcagc

SEQ ID NO: 7035211 - DNA, 22 bp, Homo sapiens
attgaaaaatgactattgctta

SEQ ID NO: 7035212 - DNA, 22 bp, Homo sapiens
gcatggcaaatatcgagggcag

SEQ ID NO: 7035213 - DNA, 22 bp, Homo sapiens
gcatggcagtgaggatggtgct

SEQ ID NO: 7035214 - DNA, 22 bp, Homo sapiens
gcatggcattaacaagatggaa

SEQ ID NO: 7035215 - DNA, 22 bp, Homo sapiens
attttcagttgaaaaagttggt

SEQ ID NO: 7035216 - DNA, 22 bp, Homo sapiens
attttgcacactatgcagcttt

SEQ ID NO: 7035217 - DNA, 22 bp, Homo sapiens
gctgctggcgctgggcgtccgg

SEQ ID NO: 7035218 - DNA, 22 bp, Homo sapiens
gctggacaggccacatggagga

SEQ ID NO: 7035219 - DNA, 22 bp, Homo sapiens
gctggctgaggtctagctcttt

SEQ ID NO: 7035220 - DNA, 22 bp, Homo sapiens
gctggctgagttctgtcgtctg

SEQ ID NO: 7035221 - DNA, 22 bp, Homo sapiens
caatcccatcaccatctgctct

SEQ ID NO: 7035222 - DNA, 22 bp, Homo sapiens
ggaagagctgcttagttttgat

SEQ ID NO: 7035223 - DNA, 22 bp, Homo sapiens
ggagaagggtatgtgtggcgga

SEQ ID NO: 7035224 - DNA, 22 bp, Homo sapiens
cacagggcaggtactctcagag

SEQ ID NO: 7035225 - DNA, 22 bp, Homo sapiens
cacatgaaggctggggtcgtga

SEQ ID NO: 7035226 - DNA, 22 bp, Homo sapiens
caccaggctgcccaggacaggg

SEQ ID NO: 7035227 - DNA, 22 bp, Homo sapiens
ggccagggaggagaggcccctg

SEQ ID NO: 7035228 - DNA, 22 bp, Homo sapiens
cactccctctagttgcattctg

SEQ ID NO: 7035229 - DNA, 22 bp, Homo sapiens
ggctggcaaaaaccttctctga

SEQ ID NO: 7035230 - DNA, 22 bp, Homo sapiens
ggctggcaagtcagtgctgatg

SEQ ID NO: 7035231 - DNA, 19 bp, Homo sapiens
ggctggcaagtgacagtgt

SEQ ID NO: 7035232 - DNA, 22 bp, Homo sapiens
ggctggcaagtgtctgctcatg

SEQ ID NO: 7035233 - DNA, 22 bp, Homo sapiens
ggctggcacaaagctccaaatc

SEQ ID NO: 7035234 - DNA, 22 bp, Homo sapiens
ggctggcacagagggctggtgt

SEQ ID NO: 7035235 - DNA, 22 bp, Homo sapiens
ggctggcacccttggggatagg

SEQ ID NO: 7035236 - DNA, 22 bp, Homo sapiens
ggctggcacctgccctccgctg

SEQ ID NO: 7035237 - DNA, 22 bp, Homo sapiens
ggctggcacgaagccctgctgg

SEQ ID NO: 7035238 - DNA, 22 bp, Homo sapiens
ggctggcactctgtccagtgtc

SEQ ID NO: 7035239 - DNA, 22 bp, Homo sapiens
ggctggcactgaggagagctct

SEQ ID NO: 7035240 - DNA, 22 bp, Homo sapiens
ggctggcagaagtgtgctggct

SEQ ID NO: 7035241 - DNA, 22 bp, Homo sapiens
gggagctgccaccacccctggg

SEQ ID NO: 7035242 - DNA, 21 bp, Homo sapiens
gggagctggaaactgggtgac

SEQ ID NO: 7035243 - DNA, 22 bp, Homo sapiens
gggcaggggtcagtggccccaa

SEQ ID NO: 7035244 - DNA, 22 bp, Homo sapiens
gtgaggggccaagagtagggca

SEQ ID NO: 7035245 - DNA, 22 bp, Homo sapiens
gtgaggggtctggacgcacagt

SEQ ID NO: 7035246 - DNA, 22 bp, Homo sapiens
gtgaggggtggctgagcagttt

SEQ ID NO: 7035247 - DNA, 22 bp, Homo sapiens
gtgaggggtggctgagcagttt

SEQ ID NO: 7035248 - DNA, 22 bp, Homo sapiens
tactcaaactcactaagacaga

SEQ ID NO: 7035249 - DNA, 22 bp, Homo sapiens
caggggacactcctgcttgggc

SEQ ID NO: 7035250 - DNA, 22 bp, Homo sapiens
cagggtggccctgtggtctcat

SEQ ID NO: 7035251 - DNA, 22 bp, Homo sapiens
cagtgggacatgggcactgggc

SEQ ID NO: 7035252 - DNA, 22 bp, Homo sapiens
cagtgggatatgggggcagcat

SEQ ID NO: 7035253 - DNA, 22 bp, Homo sapiens
cagtggggaggccaggatagaa

SEQ ID NO: 7035254 - DNA, 22 bp, Homo sapiens
cagtggggggactgaggcctga

SEQ ID NO: 7035255 - DNA, 22 bp, Homo sapiens
cagtggggtttctgtgggtgct

SEQ ID NO: 7035256 - DNA, 22 bp, Homo sapiens
cagtgtgacttctgagctgcca

SEQ ID NO: 7035257 - DNA, 22 bp, Homo sapiens
cagtgtttgtggaattcaggtg

SEQ ID NO: 7035258 - DNA, 22 bp, Homo sapiens
tcagcttttgtcagaaattgta

SEQ ID NO: 7035259 - DNA, 22 bp, Homo sapiens
catgtgttaatctttctgcaaa

SEQ ID NO: 7035260 - DNA, 22 bp, Homo sapiens
catgtgttttgtcatttcaata

SEQ ID NO: 7035261 - DNA, 22 bp, Homo sapiens
cattgaaatatggaaactgatg

SEQ ID NO: 7035262 - DNA, 22 bp, Homo sapiens
tcctcagctttggtttactcat

SEQ ID NO: 7035263 - DNA, 22 bp, Homo sapiens
tcctcagcttttatttcacttg

SEQ ID NO: 7035264 - DNA, 22 bp, Homo sapiens
tcgctggcctggaggggagcca

SEQ ID NO: 7035265 - DNA, 22 bp, Homo sapiens
tcggtacctacatcctctcgac

SEQ ID NO: 7035266 - DNA, 23 bp, Homo sapiens
tcggtgggcgtggaggccgaggc

SEQ ID NO: 7035267 - DNA, 22 bp, Homo sapiens
tctccctctttgtctgctttgg

SEQ ID NO: 7035268 - DNA, 22 bp, Homo sapiens
tgaccacagacccaatgactac

SEQ ID NO: 7035269 - DNA, 22 bp, Homo sapiens
tgagctggcaggggctcaggga

SEQ ID NO: 7035270 - DNA, 22 bp, Homo sapiens
tgagctggcttgtcaaccaggg

SEQ ID NO: 7035271 - DNA, 23 bp, Homo sapiens
tgagctgggcctgcaggggtctc

SEQ ID NO: 7035272 - DNA, 22 bp, Homo sapiens
ccagtgttacggcttgaactat

SEQ ID NO: 7035273 - DNA, 22 bp, Homo sapiens
ccagtgttagagactgatacag

SEQ ID NO: 7035274 - DNA, 22 bp, Homo sapiens
ccagtgttattttagagtgtga

SEQ ID NO: 7035275 - DNA, 22 bp, Homo sapiens
ccagtgttcaatacatatttgt

SEQ ID NO: 7035276 - DNA, 22 bp, Homo sapiens
ccagtgttcagtatgcattaag

SEQ ID NO: 7035277 - DNA, 22 bp, Homo sapiens
ccagtgttcataattttacact

SEQ ID NO: 7035278 - DNA, 22 bp, Homo sapiens
ccagtgttcatcaagaaaatgt

SEQ ID NO: 7035279 - DNA, 22 bp, Homo sapiens
ccagtgttccagagagctgatg

SEQ ID NO: 7035280 - DNA, 22 bp, Homo sapiens
ccatggagcgggtgagtgagtg

SEQ ID NO: 7035281 - DNA, 22 bp, Homo sapiens
cccagagatctactgagcccag

SEQ ID NO: 7035282 - DNA, 22 bp, Homo sapiens
tgcaggtggacacgggagacgg

SEQ ID NO: 7035283 - DNA, 22 bp, Homo sapiens
tgcctgcctctggcagccctgc

SEQ ID NO: 7035284 - DNA, 22 bp, Homo sapiens
tggaagggaacaggtgggtgtt

SEQ ID NO: 7035285 - DNA, 22 bp, Homo sapiens
tggaagggagctggaatttgga

SEQ ID NO: 7035286 - DNA, 22 bp, Homo sapiens
tggacaggttgagtaggaggag

SEQ ID NO: 7035287 - DNA, 22 bp, Homo sapiens
tggacaggtttgggtgcctgtt

SEQ ID NO: 7035288 - DNA, 22 bp, Homo sapiens
tggaggggcaatggagcgcgga

SEQ ID NO: 7035289 - DNA, 19 bp, Homo sapiens
tggaggggtttgaatgtgg

SEQ ID NO: 7035290 - DNA, 22 bp, Homo sapiens
tgggccagcaattgctgctcag

SEQ ID NO: 7035291 - DNA, 22 bp, Homo sapiens
cctgacgaaaggcgtgctggag

SEQ ID NO: 7035292 - DNA, 22 bp, Homo sapiens
tgggggagagaggcattctttc

SEQ ID NO: 7035293 - DNA, 22 bp, Homo sapiens
cctgctgtgaaactggcatatg

SEQ ID NO: 7035294 - DNA, 22 bp, Homo sapiens
cctgctgttttcttcacttcag

SEQ ID NO: 7035295 - DNA, 22 bp, Homo sapiens
cctggagcttggtcacgctgcg

SEQ ID NO: 7035296 - DNA, 22 bp, Homo sapiens
cgctcctgaccagctgtgtccc

SEQ ID NO: 7035297 - DNA, 22 bp, Homo sapiens
cgctggcagggctgatctgaag

SEQ ID NO: 7035298 - DNA, 22 bp, Homo sapiens
cgctggcattagggcagtggcc

SEQ ID NO: 7035299 - DNA, 22 bp, Homo sapiens
cggagtcttgctatgttgccca

SEQ ID NO: 7035300 - DNA, 22 bp, Homo sapiens
cgggcaaggcgagactaggccc

SEQ ID NO: 7035301 - DNA, 22 bp, Homo sapiens
cgtgggaggaaaaatgggcttc

SEQ ID NO: 7035302 - DNA, 22 bp, Homo sapiens
cgtgggagtggtgggtgctcag

SEQ ID NO: 7035303 - DNA, 22 bp, Homo sapiens
ctaaaaatccacactaggtgaa

SEQ ID NO: 7035304 - DNA, 22 bp, Homo sapiens
ttctggcaaggcaagcctggct

SEQ ID NO: 7035305 - DNA, 22 bp, Homo sapiens
ttctggcatctgggggaggcct

SEQ ID NO: 7035306 - DNA, 22 bp, Homo sapiens
ttctggcatgagagatgggggt

SEQ ID NO: 7035307 - DNA, 22 bp, Homo sapiens
ctatacatcccaatttcagaga

SEQ ID NO: 7035308 - DNA, 22 bp, Homo sapiens
ctcagccccaatttgccctctt

SEQ ID NO: 7035309 - DNA, 22 bp, Homo sapiens
ctcctgtgttcaagcgattctc

SEQ ID NO: 7035310 - DNA, 22 bp, Homo sapiens
ctcttcttatggccgtggctga

SEQ ID NO: 7035311 - DNA, 22 bp, Homo sapiens
ctgagcagcgtggggagctggc

SEQ ID NO: 7035312 - DNA, 22 bp, Homo sapiens
ctgagcagctccctgagtggtc

SEQ ID NO: 7035313 - DNA, 22 bp, Homo sapiens
ctgagcagtgctttgcagtggg

SEQ ID NO: 7035314 - DNA, 20 bp, Homo sapiens
ctgcccagccactgagggat

SEQ ID NO: 7035315 - DNA, 22 bp, Homo sapiens
ctgctgagaaaagactgaggga

SEQ ID NO: 7035316 - DNA, 19 bp, Homo sapiens
ctgggagttcactgctgcc

SEQ ID NO: 7035317 - DNA, 22 bp, Homo sapiens
ctgggagttgacgaggcttgta

SEQ ID NO: 7035318 - DNA, 22 bp, Homo sapiens
ctgggcccacgagggctctggg

SEQ ID NO: 7035319 - DNA, 22 bp, Homo sapiens
ctggggggctactgacagagga

SEQ ID NO: 7035320 - DNA, 22 bp, Homo sapiens
ctggggtctcaattctagcggg

SEQ ID NO: 7035321 - DNA, 23 bp, Homo sapiens
ctgtggcaagtcctgcacctgcc

SEQ ID NO: 7035322 - DNA, 22 bp, Homo sapiens
ctgtggcattgccgaggctggc

SEQ ID NO: 7035323 - DNA, 22 bp, Homo sapiens
ctgtgggatgggacctcagctg

SEQ ID NO: 7035324 - DNA, 22 bp, Homo sapiens
ctgtgggcctagtctggcctag

SEQ ID NO: 7035325 - DNA, 22 bp, Homo sapiens
cttcactgagtagtctagactc

SEQ ID NO: 7035326 - DNA, 22 bp, Homo sapiens
cttcactgtgcttcaagcagct

SEQ ID NO: 7035327 - DNA, 22 bp, Homo sapiens
cttccaggacaccagggtagta

SEQ ID NO: 7035328 - DNA, 22 bp, Homo sapiens
cttctgtgaatgaagtgtggga

SEQ ID NO: 7035329 - DNA, 22 bp, Homo sapiens
gaaactgaatataagaaaggta

SEQ ID NO: 7035330 - DNA, 22 bp, Homo sapiens
gaaactgagtaggctagagcac

SEQ ID NO: 7035331 - DNA, 22 bp, Homo sapiens
gaaatacaggaatgccacacag

SEQ ID NO: 7035332 - DNA, 22 bp, Homo sapiens
gaaatattacagtggaggggat

SEQ ID NO: 7035333 - DNA, 22 bp, Homo sapiens
gaaatattcttgtcttgttttc

SEQ ID NO: 7035334 - DNA, 22 bp, Homo sapiens
gaaatattgggactcagagctt

SEQ ID NO: 7035335 - DNA, 22 bp, Homo sapiens
gaaatattgtactggagatgtt

SEQ ID NO: 7035336 - DNA, 22 bp, Homo sapiens
gaaatatttctcttgagcccct

SEQ ID NO: 7035337 - DNA, 22 bp, Homo sapiens
gagagaagggacttctacactt

SEQ ID NO: 7035338 - DNA, 22 bp, Homo sapiens
gagaggagtccctatcacagtt

SEQ ID NO: 7035339 - DNA, 22 bp, Homo sapiens
gagcaacagggcgaggagaact

SEQ ID NO: 7035340 - DNA, 22 bp, Homo sapiens
gagcaagactacaggcagatga

SEQ ID NO: 7035341 - DNA, 22 bp, Homo sapiens
gagcaatagaaagaatactgct

SEQ ID NO: 7035342 - DNA, 22 bp, Homo sapiens
gagcacatgagaggaaatcaaa

SEQ ID NO: 7035343 - DNA, 22 bp, Homo sapiens
gagcacatgtggagagtctggg

SEQ ID NO: 7035344 - DNA, 22 bp, Homo sapiens
gagcactgagctggaattggag

SEQ ID NO: 7035345 - DNA, 22 bp, Homo sapiens
gagcactgatttatttttgtct

SEQ ID NO: 7035346 - DNA, 22 bp, Homo sapiens
gagctcagcaaaggtctgtgtg

SEQ ID NO: 7035347 - DNA, 22 bp, Homo sapiens
gagctcattcattcattgcctg

SEQ ID NO: 7035348 - DNA, 22 bp, Homo sapiens
gagctgggtgtttatttgccaa

SEQ ID NO: 7035349 - DNA, 22 bp, Homo sapiens
gaggacagtgtgatctgccagc

SEQ ID NO: 7035350 - DNA, 22 bp, Homo sapiens
gaggagagaacattcctccata

SEQ ID NO: 7035351 - DNA, 18 bp, Homo sapiens
gaggatggaaggagatgc

SEQ ID NO: 7035352 - DNA, 22 bp, Homo sapiens
gaggctggtaggaaaggaaaca

SEQ ID NO: 7035353 - DNA, 22 bp, Homo sapiens
gagggccacgttcagggctctc

SEQ ID NO: 7035354 - DNA, 22 bp, Homo sapiens
gagggccagagtcctggggtca

SEQ ID NO: 7035355 - DNA, 22 bp, Homo sapiens
gagggccagatcccaggaggaa

SEQ ID NO: 7035356 - DNA, 22 bp, Homo sapiens
gagggccagcctgccaagggcc

SEQ ID NO: 7035357 - DNA, 22 bp, Homo sapiens
gagggccaggcggagacaggcg

SEQ ID NO: 7035358 - DNA, 22 bp, Homo sapiens
gagggccattctgagggggtga

SEQ ID NO: 7035359 - DNA, 22 bp, Homo sapiens
gagggtggcctttagagcccat

SEQ ID NO: 7035360 - DNA, 22 bp, Homo sapiens
gagggtggggaatagactgcta

SEQ ID NO: 7035361 - DNA, 22 bp, Homo sapiens
gagggtgggtacaccagccctc

SEQ ID NO: 7035362 - DNA, 22 bp, Homo sapiens
gaggtgctgctgtacttcttgc

SEQ ID NO: 7035363 - DNA, 22 bp, Homo sapiens
gcaccactaagagcagggaccg

SEQ ID NO: 7035364 - DNA, 22 bp, Homo sapiens
gcagctggctcagagaggtggg

SEQ ID NO: 7035365 - DNA, 22 bp, Homo sapiens
gcaggtgatgtgatgtgagcat

SEQ ID NO: 7035366 - DNA, 22 bp, Homo sapiens
gcagtgttggcaggatggggct

SEQ ID NO: 7035367 - DNA, 22 bp, Homo sapiens
gcagtgttggtttgctctgcag

SEQ ID NO: 7035368 - DNA, 22 bp, Homo sapiens
gcagtgttgtgatccaggtctt

SEQ ID NO: 7035369 - DNA, 22 bp, Homo sapiens
gcagtgttgttaaaagattaga

SEQ ID NO: 7035370 - DNA, 22 bp, Homo sapiens
gcagtgtttacatattagaaac

SEQ ID NO: 7035371 - DNA, 22 bp, Homo sapiens
gcagtgtttcaaatcaaaggca

SEQ ID NO: 7035372 - DNA, 22 bp, Homo sapiens
gcagtgtttcagtgctttttct

SEQ ID NO: 7035373 - DNA, 22 bp, Homo sapiens
gcagtgtttcccagagatggaa

SEQ ID NO: 7035374 - DNA, 23 bp, Homo sapiens
gcagtgtttgcttcatcttatcc

SEQ ID NO: 7035375 - DNA, 22 bp, Homo sapiens
gcagtgtttggatccatagcga

SEQ ID NO: 7035376 - DNA, 22 bp, Homo sapiens
gcagtgtttgtgttctcacatg

SEQ ID NO: 7035377 - DNA, 22 bp, Homo sapiens
gcagtgttttacagaccagcat

SEQ ID NO: 7035378 - DNA, 22 bp, Homo sapiens
gcagtgtttttcaatgcttcca

SEQ ID NO: 7035379 - DNA, 22 bp, Homo sapiens
gcctcaggtgcatctctcattc

SEQ ID NO: 7035380 - DNA, 22 bp, Homo sapiens
gcctgcagaactgtgaggcaat

SEQ ID NO: 7035381 - DNA, 22 bp, Homo sapiens
gcctgcagggtgatgggctgcc

SEQ ID NO: 7035382 - DNA, 20 bp, Homo sapiens
gcctgcaggttggatgggat

SEQ ID NO: 7035383 - DNA, 20 bp, Homo sapiens
gcctggcacccggggctggc

SEQ ID NO: 7035384 - DNA, 22 bp, Homo sapiens
gcctggcactcactgaagaggc

SEQ ID NO: 7035385 - DNA, 22 bp, Homo sapiens
gctgcaggctgtggcaggggag

SEQ ID NO: 7035386 - DNA, 22 bp, Homo sapiens
gctgcagggagctggaaggctc

SEQ ID NO: 7035387 - DNA, 21 bp, Homo sapiens
gctgcagggcccagggcaccc

SEQ ID NO: 7035388 - DNA, 22 bp, Homo sapiens
gctgctggaagcatgcgatgaa

SEQ ID NO: 7035389 - DNA, 22 bp, Homo sapiens
gctgctggcttcctgctgtttt

SEQ ID NO: 7035390 - DNA, 22 bp, Homo sapiens
gctgctgggatcctgggtctca

SEQ ID NO: 7035391 - DNA, 22 bp, Homo sapiens
gctgctggggtcacatggtaag

SEQ ID NO: 7035392 - DNA, 22 bp, Homo sapiens
gctggcaggtaaagccccgggg

SEQ ID NO: 7035393 - DNA, 22 bp, Homo sapiens
gctggccacactgctgatggag

SEQ ID NO: 7035394 - DNA, 22 bp, Homo sapiens
gcttggcacacttggacctgag

SEQ ID NO: 7035395 - DNA, 22 bp, Homo sapiens
gcttggcagcaacaggcatccc

SEQ ID NO: 7035396 - DNA, 22 bp, Homo sapiens
gctttggcccaggagccaaggt

SEQ ID NO: 7035397 - DNA, 22 bp, Homo sapiens
ggaaggctttctgttctgtgac

SEQ ID NO: 7035398 - DNA, 22 bp, Homo sapiens
ggaagggaaaattcattcggct

SEQ ID NO: 7035399 - DNA, 22 bp, Homo sapiens
ggacagggatcattatctgagc

SEQ ID NO: 7035400 - DNA, 23 bp, Homo sapiens
ggacagggccctgccctatggcc

SEQ ID NO: 7035401 - DNA, 22 bp, Homo sapiens
ggacagggctcttggcactcct

SEQ ID NO: 7035402 - DNA, 19 bp, Homo sapiens
ggacagggggagcttttat

SEQ ID NO: 7035403 - DNA, 22 bp, Homo sapiens
ggacagggtaagtactagtgtg

SEQ ID NO: 7035404 - DNA, 22 bp, Homo sapiens
ggagaagaggagctggaagcct

SEQ ID NO: 7035405 - DNA, 22 bp, Homo sapiens
ggagccaggcatatcggggcac

SEQ ID NO: 7035406 - DNA, 22 bp, Homo sapiens
ggagccaggggaccttcacaga

SEQ ID NO: 7035407 - DNA, 22 bp, Homo sapiens
ggagccagtttagacctcagtt

SEQ ID NO: 7035408 - DNA, 22 bp, Homo sapiens
ggagcctggagtttctgatggg

SEQ ID NO: 7035409 - DNA, 22 bp, Homo sapiens
ggagcctggtatagtgttgcat

SEQ ID NO: 7035410 - DNA, 22 bp, Homo sapiens
ggagcctggtcaggttggctcc

SEQ ID NO: 7035411 - DNA, 22 bp, Homo sapiens
ggagctggctacagagaactcc

SEQ ID NO: 7035412 - DNA, 22 bp, Homo sapiens
ggagctgggaattggatcatct

SEQ ID NO: 7035413 - DNA, 22 bp, Homo sapiens
ggagctgggaccctgtcatctg

SEQ ID NO: 7035414 - DNA, 18 bp, Homo sapiens
ggagctgggccccactcc

SEQ ID NO: 7035415 - DNA, 21 bp, Homo sapiens
ggagctggggagctggcccca

SEQ ID NO: 7035416 - DNA, 22 bp, Homo sapiens
ggagctggggttggcatcttcc

SEQ ID NO: 7035417 - DNA, 22 bp, Homo sapiens
ggagctgtgttatccattccca

SEQ ID NO: 7035418 - DNA, 22 bp, Homo sapiens
ggaggcagaacttcccgtcagt

SEQ ID NO: 7035419 - DNA, 22 bp, Homo sapiens
ggcacctgtgtaagatctggaa

SEQ ID NO: 7035420 - DNA, 22 bp, Homo sapiens
ggcagggccctgattcctgggg

SEQ ID NO: 7035421 - DNA, 22 bp, Homo sapiens
ggcagggcttgtctctgtgatg

SEQ ID NO: 7035422 - DNA, 22 bp, Homo sapiens
ggcaggggtcctggtgttgact

SEQ ID NO: 7035423 - DNA, 18 bp, Homo sapiens
ggcaggggtgaaccacag

SEQ ID NO: 7035424 - DNA, 22 bp, Homo sapiens
ggcagtggctcctctctactcc

SEQ ID NO: 7035425 - DNA, 22 bp, Homo sapiens
ggctcactgcaacttccgcctc

SEQ ID NO: 7035426 - DNA, 22 bp, Homo sapiens
ggctgcagggcagctggtgtgg

SEQ ID NO: 7035427 - DNA, 22 bp, Homo sapiens
ggctggcagaggggagtctgtg

SEQ ID NO: 7035428 - DNA, 22 bp, Homo sapiens
ggctggcagcttcatcccagat

SEQ ID NO: 7035429 - DNA, 22 bp, Homo sapiens
ggctggcaggactcacacttgg

SEQ ID NO: 7035430 - DNA, 22 bp, Homo sapiens
ggctggcaggcacagtatgcaa

SEQ ID NO: 7035431 - DNA, 22 bp, Homo sapiens
ggctggcaggggatgtcagatg

SEQ ID NO: 7035432 - DNA, 22 bp, Homo sapiens
ggctggcagtgtgagagaggga

SEQ ID NO: 7035433 - DNA, 22 bp, Homo sapiens
ggctggcagttaatacctgaag

SEQ ID NO: 7035434 - DNA, 22 bp, Homo sapiens
ggctggcatccagggaaatcca

SEQ ID NO: 7035435 - DNA, 22 bp, Homo sapiens
ggctggcattgctctattgcct

SEQ ID NO: 7035436 - DNA, 22 bp, Homo sapiens
ggctggcatttacacaatgcat

SEQ ID NO: 7035437 - DNA, 22 bp, Homo sapiens
ggctgtggcagctggaagtggt

SEQ ID NO: 7035438 - DNA, 22 bp, Homo sapiens
ggctgtggcattaggtgaggcc

SEQ ID NO: 7035439 - DNA, 22 bp, Homo sapiens
ggctgtggccagcggggctgag

SEQ ID NO: 7035440 - DNA, 22 bp, Homo sapiens
ggctgtggggccgggtacagtg

SEQ ID NO: 7035441 - DNA, 22 bp, Homo sapiens
ggctgtggtcattaggaggttg

SEQ ID NO: 7035442 - DNA, 22 bp, Homo sapiens
gggaaggcagtgtctggttgaa

SEQ ID NO: 7035443 - DNA, 22 bp, Homo sapiens
gggaaggccttgtcagcggatt

SEQ ID NO: 7035444 - DNA, 22 bp, Homo sapiens
gggagcgggactgcgcaggctt

SEQ ID NO: 7035445 - DNA, 22 bp, Homo sapiens
gggagctgaactgctgaagttg

SEQ ID NO: 7035446 - DNA, 22 bp, Homo sapiens
gggagtggagagcaatggatga

SEQ ID NO: 7035447 - DNA, 22 bp, Homo sapiens
gggagtggattatgtggaccca

SEQ ID NO: 7035448 - DNA, 22 bp, Homo sapiens
gggagtggggcttaccttgaag

SEQ ID NO: 7035449 - DNA, 22 bp, Homo sapiens
gggagtgggtttggcctaggcc

SEQ ID NO: 7035450 - DNA, 22 bp, Homo sapiens
gggataggagattgggagtgtt

SEQ ID NO: 7035451 - DNA, 23 bp, Homo sapiens
gggatatggaccttggaggagtc

SEQ ID NO: 7035452 - DNA, 21 bp, Homo sapiens
gggcagaggggcctcctgggt

SEQ ID NO: 7035453 - DNA, 22 bp, Homo sapiens
gggctcagaggagtggcctggg

SEQ ID NO: 7035454 - DNA, 23 bp, Homo sapiens
gggctcagatttcattctgtgcc

SEQ ID NO: 7035455 - DNA, 21 bp, Homo sapiens
gggctcagcgctcggctcctc

SEQ ID NO: 7035456 - DNA, 22 bp, Homo sapiens
gggctcagctgggcgtgctggt

SEQ ID NO: 7035457 - DNA, 22 bp, Homo sapiens
gggctgtgtgcccacttcccat

SEQ ID NO: 7035458 - DNA, 22 bp, Homo sapiens
ggggagtggttgcctgtgatcc

SEQ ID NO: 7035459 - DNA, 22 bp, Homo sapiens
ggggagtgttttcatgggcttg

SEQ ID NO: 7035460 - DNA, 22 bp, Homo sapiens
ggggagtgttttcatgggcttg

SEQ ID NO: 7035461 - DNA, 22 bp, Homo sapiens
ggggatggaatgtagtagtgat

SEQ ID NO: 7035462 - DNA, 20 bp, Homo sapiens
ggggcaggtttttatggcta

SEQ ID NO: 7035463 - DNA, 22 bp, Homo sapiens
ggggccagatatcactaaggtt

SEQ ID NO: 7035464 - DNA, 22 bp, Homo sapiens
ggggccagcaatgttgaggaat

SEQ ID NO: 7035465 - DNA, 22 bp, Homo sapiens
ggggtggatttcaggcggtgtc

SEQ ID NO: 7035466 - DNA, 22 bp, Homo sapiens
ggggtgggcgtgcagggacacc

SEQ ID NO: 7035467 - DNA, 22 bp, Homo sapiens
gggtgaggcccatttgaggcca

SEQ ID NO: 7035468 - DNA, 22 bp, Homo sapiens
ggtgaggcgtccccaccatggg

SEQ ID NO: 7035469 - DNA, 19 bp, Homo sapiens
ggtggcagaacgtgggtcc

SEQ ID NO: 7035470 - DNA, 22 bp, Homo sapiens
gtacaatagcagttttcccttt

SEQ ID NO: 7035471 - DNA, 22 bp, Homo sapiens
gtcactgtatccaggttccagc

SEQ ID NO: 7035472 - DNA, 22 bp, Homo sapiens
gtgcaggggatcaggttgcagc

SEQ ID NO: 7035473 - DNA, 22 bp, Homo sapiens
gtgctggcacccctctccagtt

SEQ ID NO: 7035474 - DNA, 22 bp, Homo sapiens
gtgctggccctgtcctcgagct

SEQ ID NO: 7035475 - DNA, 22 bp, Homo sapiens
gtgctggcctcagagggtcatg

SEQ ID NO: 7035476 - DNA, 17 bp, Homo sapiens
gtgctggcctggggctc

SEQ ID NO: 7035477 - DNA, 22 bp, Homo sapiens
gtgctggctgccaggaggctgc

SEQ ID NO: 7035478 - DNA, 22 bp, Homo sapiens
gtgctggctggggcatcaggca

SEQ ID NO: 7035479 - DNA, 22 bp, Homo sapiens
tacagtgtccctttttcagaca

SEQ ID NO: 7035480 - DNA, 22 bp, Homo sapiens
tacagtgtctggatatcaaagg

SEQ ID NO: 7035481 - DNA, 22 bp, Homo sapiens
tacagtgtgacatttctacaaa

SEQ ID NO: 7035482 - DNA, 22 bp, Homo sapiens
taccaagtgtattatgctttgt

SEQ ID NO: 7035483 - DNA, 22 bp, Homo sapiens
taccactgataccttggagttc

SEQ ID NO: 7035484 - DNA, 19 bp, Homo sapiens
tatcactgggcactgagga

SEQ ID NO: 7035485 - DNA, 22 bp, Homo sapiens
tatgctttacttttcattgtga

SEQ ID NO: 7035486 - DNA, 22 bp, Homo sapiens
tatgctttcattcatatgtgag

SEQ ID NO: 7035487 - DNA, 22 bp, Homo sapiens
tatgctttggtagagagttgtg

SEQ ID NO: 7035488 - DNA, 22 bp, Homo sapiens
tatgcttttaacctgtaactga

SEQ ID NO: 7035489 - DNA, 20 bp, Homo sapiens
tatgctttttataagattga

SEQ ID NO: 7035490 - DNA, 22 bp, Homo sapiens
tatgtacatcgttgaattcaaa

SEQ ID NO: 7035491 - DNA, 22 bp, Homo sapiens
tcactgcaacctccacctcccg

SEQ ID NO: 7035492 - DNA, 22 bp, Homo sapiens
tcactgcaacctccacctcctg

SEQ ID NO: 7035493 - DNA, 22 bp, Homo sapiens
tcagaaacactcttcttctgtc

SEQ ID NO: 7035494 - DNA, 22 bp, Homo sapiens
tcagaaaccagctctctcaatt

SEQ ID NO: 7035495 - DNA, 22 bp, Homo sapiens
tcagctctgcctgtggaggcac

SEQ ID NO: 7035496 - DNA, 22 bp, Homo sapiens
tcagtgttcttatttaattagg

SEQ ID NO: 7035497 - DNA, 22 bp, Homo sapiens
tcagtgttgaattttttgcaaa

SEQ ID NO: 7035498 - DNA, 22 bp, Homo sapiens
tcagtgttggagataattgcac

SEQ ID NO: 7035499 - DNA, 22 bp, Homo sapiens
tcagtgttggcattcagaaatg

SEQ ID NO: 7035500 - DNA, 22 bp, Homo sapiens
tcagtgttggctacatctgcct

SEQ ID NO: 7035501 - DNA, 22 bp, Homo sapiens
tcagtgttggtcaagaatcagt

SEQ ID NO: 7035502 - DNA, 22 bp, Homo sapiens
tcagtgttgtgcacatacaaaa

SEQ ID NO: 7035503 - DNA, 22 bp, Homo sapiens
tcagtgtttacatgcatccttg

SEQ ID NO: 7035504 - DNA, 22 bp, Homo sapiens
tcagtgtttaccgtatgttgtt

SEQ ID NO: 7035505 - DNA, 22 bp, Homo sapiens
tcagtgtttattcaatgttatt

SEQ ID NO: 7035506 - DNA, 22 bp, Homo sapiens
tcagtgtttattgcggtgtgta

SEQ ID NO: 7035507 - DNA, 22 bp, Homo sapiens
tcagtgtttcagtttggaaatg

SEQ ID NO: 7035508 - DNA, 22 bp, Homo sapiens
tcagtgtttcctagagcatata

SEQ ID NO: 7035509 - DNA, 22 bp, Homo sapiens
tcagtgtttcctgtggtacagc

SEQ ID NO: 7035510 - DNA, 22 bp, Homo sapiens
tcagtgtttgaacccagggtta

SEQ ID NO: 7035511 - DNA, 22 bp, Homo sapiens
tcagtgtttggtttcagaattg

SEQ ID NO: 7035512 - DNA, 22 bp, Homo sapiens
tcagtgtttgtggcaaatgtta

SEQ ID NO: 7035513 - DNA, 22 bp, Homo sapiens
tcagtgttttaactgtctttta

SEQ ID NO: 7035514 - DNA, 22 bp, Homo sapiens
tcagtgttttccagggtctact

SEQ ID NO: 7035515 - DNA, 22 bp, Homo sapiens
tcagtgtttttaaagcaatata

SEQ ID NO: 7035516 - DNA, 22 bp, Homo sapiens
tcatacattcagcagatatttg

SEQ ID NO: 7035517 - DNA, 18 bp, Homo sapiens
tccaggcctgaagtgtcc

SEQ ID NO: 7035518 - DNA, 22 bp, Homo sapiens
tccagggaaggtgtgaggctgg

SEQ ID NO: 7035519 - DNA, 22 bp, Homo sapiens
tccatgggtagccctggttgag

SEQ ID NO: 7035520 - DNA, 20 bp, Homo sapiens
tcccaggctgggctccagct

SEQ ID NO: 7035521 - DNA, 22 bp, Homo sapiens
tcctcagcaaacacttcactct

SEQ ID NO: 7035522 - DNA, 22 bp, Homo sapiens
ttcacaggcttggaggtggggg

SEQ ID NO: 7035523 - DNA, 22 bp, Homo sapiens
ttcacagggcagcagctgagcc

SEQ ID NO: 7035524 - DNA, 22 bp, Homo sapiens
ttccaggaacactctgtgtccc

SEQ ID NO: 7035525 - DNA, 22 bp, Homo sapiens
ttccaggaacagatgaaggttg

SEQ ID NO: 7035526 - DNA, 22 bp, Homo sapiens
ttccaggaagcagttagcagcc

SEQ ID NO: 7035527 - DNA, 22 bp, Homo sapiens
ttccaggaagctctcggcctct

SEQ ID NO: 7035528 - DNA, 22 bp, Homo sapiens
ttccaggctcccttggaggtgt

SEQ ID NO: 7035529 - DNA, 22 bp, Homo sapiens
ttccagggctaggtaatgggta

SEQ ID NO: 7035530 - DNA, 22 bp, Homo sapiens
ttccagtgaaacatgaggtgtg

SEQ ID NO: 7035531 - DNA, 22 bp, Homo sapiens
ttccttgaaagtttgaactgac

SEQ ID NO: 7035532 - DNA, 22 bp, Homo sapiens
ttccttgaatgagtcatggaaa

SEQ ID NO: 7035533 - DNA, 22 bp, Homo sapiens
ttccttgaccactgcataatga

SEQ ID NO: 7035534 - DNA, 22 bp, Homo sapiens
ttctcagatccatcagaagtcc

SEQ ID NO: 7035535 - DNA, 22 bp, Homo sapiens
ttctcaggcctttgggatggga

SEQ ID NO: 7035536 - DNA, 22 bp, Homo sapiens
ttctctggaaggctctacggga

SEQ ID NO: 7035537 - DNA, 21 bp, Homo sapiens
ttgacaggaaagaggggagat

SEQ ID NO: 7035538 - DNA, 22 bp, Homo sapiens
ttggcattcatgggacaacaaa

SEQ ID NO: 7035539 - DNA, 23 bp, Homo sapiens
tttaccagaatagcaggggagag

SEQ ID NO: 7035540 - DNA, 22 bp, Homo sapiens
tttatattgtaaaaatggttct

SEQ ID NO: 7035541 - DNA, 22 bp, Homo sapiens
tttcatgcacaaatgagcaagg

SEQ ID NO: 7035542 - DNA, 22 bp, Homo sapiens
tttgaagagccacagtgaaatt

SEQ ID NO: 7035543 - DNA, 22 bp, Homo sapiens
ttttaattgcaattatggtccc

SEQ ID NO: 7035544 - DNA, 22 bp, Homo sapiens
ttttcatgtcatgtccttgagg

SEQ ID NO: 7035545 - DNA, 22 bp, Homo sapiens
aaaacactgcaaagctgattgg

SEQ ID NO: 7035546 - DNA, 22 bp, Homo sapiens
aaaatactgtggagtgttgaaa

SEQ ID NO: 7035547 - DNA, 22 bp, Homo sapiens
aaatacacgtacatgtgtaaaa

SEQ ID NO: 7035548 - DNA, 22 bp, Homo sapiens
aaattgctctttaaaagtactg

SEQ ID NO: 7035549 - DNA, 22 bp, Homo sapiens
aaatattggtaggatgcttgtt

SEQ ID NO: 7035550 - DNA, 22 bp, Homo sapiens
aacagtgtcaggattacagata

SEQ ID NO: 7035551 - DNA, 22 bp, Homo sapiens
aacagtgtttttcttcagcact

SEQ ID NO: 7035552 - DNA, 22 bp, Homo sapiens
aatattgagaaccagcatgttt

SEQ ID NO: 7035553 - DNA, 22 bp, Homo sapiens
aatgcacctaccttgattctgc

SEQ ID NO: 7035554 - DNA, 22 bp, Homo sapiens
aatgcaggcacgtgcaagcaag

SEQ ID NO: 7035555 - DNA, 22 bp, Homo sapiens
aatgcaggttcttgggccacat

SEQ ID NO: 7035556 - DNA, 22 bp, Homo sapiens
aagccagtaagtttttgtcatt

SEQ ID NO: 7035557 - DNA, 22 bp, Homo sapiens
aaggaagcagcaatgcatgatt

SEQ ID NO: 7035558 - DNA, 22 bp, Homo sapiens
aaggaagcagccagagaccctc

SEQ ID NO: 7035559 - DNA, 22 bp, Homo sapiens
acccagggtagaacctcagagc

SEQ ID NO: 7035560 - DNA, 22 bp, Homo sapiens
actgggaggcatctggagctga

SEQ ID NO: 7035561 - DNA, 22 bp, Homo sapiens
actgggagttctccatgtccct

SEQ ID NO: 7035562 - DNA, 22 bp, Homo sapiens
acttttcaaatgggaaactcag

SEQ ID NO: 7035563 - DNA, 22 bp, Homo sapiens
aatgaagccactgaagacaatc

SEQ ID NO: 7035564 - DNA, 22 bp, Homo sapiens
aattccagaccacaagtgattt

SEQ ID NO: 7035565 - DNA, 22 bp, Homo sapiens
aattccagctacttggaaggtt

SEQ ID NO: 7035566 - DNA, 22 bp, Homo sapiens
agaggaggtggtgatgctttaa

SEQ ID NO: 7035567 - DNA, 22 bp, Homo sapiens
agcaaatacttgaataaaaaga

SEQ ID NO: 7035568 - DNA, 22 bp, Homo sapiens
acacccagagcgccagtgccga

SEQ ID NO: 7035569 - DNA, 23 bp, Homo sapiens
acagaggcttaaatgagtggcag

SEQ ID NO: 7035570 - DNA, 22 bp, Homo sapiens
acagagggtgtggaggaagacg

SEQ ID NO: 7035571 - DNA, 22 bp, Homo sapiens
agcggtggtgtcggcagcggct

SEQ ID NO: 7035572 - DNA, 22 bp, Homo sapiens
agctgagcatttgatccacctc

SEQ ID NO: 7035573 - DNA, 21 bp, Homo sapiens
agctgaggtaaggcaagagag

SEQ ID NO: 7035574 - DNA, 22 bp, Homo sapiens
agctgatacatttcttgtagcc

SEQ ID NO: 7035575 - DNA, 22 bp, Homo sapiens
acagggccctgtgggccccact

SEQ ID NO: 7035576 - DNA, 22 bp, Homo sapiens
acagggcctcagccagggcaga

SEQ ID NO: 7035577 - DNA, 22 bp, Homo sapiens
acagggcctttgatggattata

SEQ ID NO: 7035578 - DNA, 22 bp, Homo sapiens
aggacagggattcaaactccca

SEQ ID NO: 7035579 - DNA, 20 bp, Homo sapiens
acagtgttaggtttttcctt

SEQ ID NO: 7035580 - DNA, 20 bp, Homo sapiens
acagtgttagttatcatctc

SEQ ID NO: 7035581 - DNA, 22 bp, Homo sapiens
acagtgttatttctgagtaatg

SEQ ID NO: 7035582 - DNA, 22 bp, Homo sapiens
acagtgttcaaaccactaggct

SEQ ID NO: 7035583 - DNA, 22 bp, Homo sapiens
acagtgttcactaaggttagct

SEQ ID NO: 7035584 - DNA, 22 bp, Homo sapiens
acagtgttcacttaacaatgga

SEQ ID NO: 7035585 - DNA, 22 bp, Homo sapiens
acagtgttcctttgttgtgact

SEQ ID NO: 7035586 - DNA, 22 bp, Homo sapiens
acagtgttctcttcctgtatag

SEQ ID NO: 7035587 - DNA, 22 bp, Homo sapiens
acagtgttctgaaagttgaggg

SEQ ID NO: 7035588 - DNA, 22 bp, Homo sapiens
aggcagtgtattgctagcggct

SEQ ID NO: 7035589 - DNA, 22 bp, Homo sapiens
aggcagtgttcttctaagggca

SEQ ID NO: 7035590 - DNA, 22 bp, Homo sapiens
acattaacaccataagtgtgtt

SEQ ID NO: 7035591 - DNA, 22 bp, Homo sapiens
acattaacaccgtgagtttggt

SEQ ID NO: 7035592 - DNA, 22 bp, Homo sapiens
acattaacactggtgctggtgt

SEQ ID NO: 7035593 - DNA, 22 bp, Homo sapiens
aggctgggaaacctgaagttgt

SEQ ID NO: 7035594 - DNA, 22 bp, Homo sapiens
agggaggcattagctactgcga

SEQ ID NO: 7035595 - DNA, 22 bp, Homo sapiens
agggaggtccatccctgcagag

SEQ ID NO: 7035596 - DNA, 17 bp, Homo sapiens
agggagtcagaggatcg

SEQ ID NO: 7035597 - DNA, 22 bp, Homo sapiens
agggccagcactcctggcagga

SEQ ID NO: 7035598 - DNA, 22 bp, Homo sapiens
agggccagcagcttggccaacc

SEQ ID NO: 7035599 - DNA, 22 bp, Homo sapiens
agggccagtaccaggtgggtgg

SEQ ID NO: 7035600 - DNA, 22 bp, Homo sapiens
agggccagtgggttgaaaggca

SEQ ID NO: 7035601 - DNA, 22 bp, Homo sapiens
agggctcactacaaccctggga

SEQ ID NO: 7035602 - DNA, 19 bp, Homo sapiens
aggtgaggggcaccatgtc

SEQ ID NO: 7035603 - DNA, 22 bp, Homo sapiens
actcagctcaggagctggctgg

SEQ ID NO: 7035604 - DNA, 22 bp, Homo sapiens
actcagctgatgaagcacaagt

SEQ ID NO: 7035605 - DNA, 22 bp, Homo sapiens
actcagcttcctacagctagaa

SEQ ID NO: 7035606 - DNA, 22 bp, Homo sapiens
agtgggagataacttaacagct

SEQ ID NO: 7035607 - DNA, 22 bp, Homo sapiens
agtgggagccagcagcttgggg

SEQ ID NO: 7035608 - DNA, 22 bp, Homo sapiens
agtgggagcggcagtcggggac

SEQ ID NO: 7035609 - DNA, 22 bp, Homo sapiens
agtgggaggaagtggtgatatt

SEQ ID NO: 7035610 - DNA, 16 bp, Homo sapiens
agtgggaggagaaaga

SEQ ID NO: 7035611 - DNA, 22 bp, Homo sapiens
agtgggaggcggctgacgggcg

SEQ ID NO: 7035612 - DNA, 22 bp, Homo sapiens
agtgggagggccatatggtgaa

SEQ ID NO: 7035613 - DNA, 22 bp, Homo sapiens
agtgggggccaacgagggcagc

SEQ ID NO: 7035614 - DNA, 22 bp, Homo sapiens
agtgtctttcatatcctccatc

SEQ ID NO: 7035615 - DNA, 22 bp, Homo sapiens
agtgtgtactcatatacttcca

SEQ ID NO: 7035616 - DNA, 22 bp, Homo sapiens
actggggtgaaattggagtgtc

SEQ ID NO: 7035617 - DNA, 22 bp, Homo sapiens
atagtgtcagaaaatcataaga

SEQ ID NO: 7035618 - DNA, 22 bp, Homo sapiens
atcctgggaagctgacattgaa

SEQ ID NO: 7035619 - DNA, 22 bp, Homo sapiens
atcctgggaatgggagggtcat

SEQ ID NO: 7035620 - DNA, 22 bp, Homo sapiens
atgccaggccccacgctgggca

SEQ ID NO: 7035621 - DNA, 18 bp, Homo sapiens
atgctgccctctgagggt

SEQ ID NO: 7035622 - DNA, 22 bp, Homo sapiens
agagccagccttctcagcttac

SEQ ID NO: 7035623 - DNA, 22 bp, Homo sapiens
agaggccggccgagcccatggg

SEQ ID NO: 7035624 - DNA, 22 bp, Homo sapiens
cacaggaaaataaaagatctaa

SEQ ID NO: 7035625 - DNA, 22 bp, Homo sapiens
cacaggaaatgattctgcagca

SEQ ID NO: 7035626 - DNA, 22 bp, Homo sapiens
cactgcaacctccacctcctgg

SEQ ID NO: 7035627 - DNA, 22 bp, Homo sapiens
cactggggaaaacaggcttctt

SEQ ID NO: 7035628 - DNA, 22 bp, Homo sapiens
cagaaactagatttagacacaa

SEQ ID NO: 7035629 - DNA, 22 bp, Homo sapiens
cagaaactatgtaagaaagtga

SEQ ID NO: 7035630 - DNA, 22 bp, Homo sapiens
cagaaactgctcccctggtagg

SEQ ID NO: 7035631 - DNA, 22 bp, Homo sapiens
cagaaactgcttgtggtcatct

SEQ ID NO: 7035632 - DNA, 22 bp, Homo sapiens
cagaaactgtggattcattaaa

SEQ ID NO: 7035633 - DNA, 22 bp, Homo sapiens
cagaaactgtttgttaatattt

SEQ ID NO: 7035634 - DNA, 22 bp, Homo sapiens
cagaaacttctggtgtcaaata

SEQ ID NO: 7035635 - DNA, 21 bp, Homo sapiens
cagaaacttgctttgccttct

SEQ ID NO: 7035636 - DNA, 22 bp, Homo sapiens
cagaaactttctttactgagca

SEQ ID NO: 7035637 - DNA, 22 bp, Homo sapiens
cagaaactttggccctcaagcc

SEQ ID NO: 7035638 - DNA, 22 bp, Homo sapiens
cagaaacttttgatgagtgtat

SEQ ID NO: 7035639 - DNA, 22 bp, Homo sapiens
agcccttcaagagctctgtcct

SEQ ID NO: 7035640 - DNA, 22 bp, Homo sapiens
agcctgcttggcagccctccca

SEQ ID NO: 7035641 - DNA, 21 bp, Homo sapiens
agctgagcccagaagactggt

SEQ ID NO: 7035642 - DNA, 22 bp, Homo sapiens
agctgagctagtagttccagtg

SEQ ID NO: 7035643 - DNA, 22 bp, Homo sapiens
agctgagctgcagatgactgta

SEQ ID NO: 7035644 - DNA, 17 bp, Homo sapiens
agctgagctggccaggg

SEQ ID NO: 7035645 - DNA, 22 bp, Homo sapiens
cagctgttactctgagtaaatg

SEQ ID NO: 7035646 - DNA, 22 bp, Homo sapiens
cagctgttcacatttccaaaac

SEQ ID NO: 7035647 - DNA, 22 bp, Homo sapiens
cagctgttcggggctggcatgt

SEQ ID NO: 7035648 - DNA, 22 bp, Homo sapiens
cagctgttcttgggacagacag

SEQ ID NO: 7035649 - DNA, 22 bp, Homo sapiens
agcttcctgatgcaagagggct

SEQ ID NO: 7035650 - DNA, 22 bp, Homo sapiens
agcttcctgttgagagagggag

SEQ ID NO: 7035651 - DNA, 22 bp, Homo sapiens
cagggctgttagctgctgctct

SEQ ID NO: 7035652 - DNA, 22 bp, Homo sapiens
aggagccacttaggtgagataa

SEQ ID NO: 7035653 - DNA, 21 bp, Homo sapiens
aggagccagcctgtcagtcta

SEQ ID NO: 7035654 - DNA, 22 bp, Homo sapiens
ccaggaggtctgagtgtggaca

SEQ ID NO: 7035655 - DNA, 22 bp, Homo sapiens
ccagggcagaaaaagagggaat

SEQ ID NO: 7035656 - DNA, 22 bp, Homo sapiens
aggctgtgcattttggagggcc

SEQ ID NO: 7035657 - DNA, 22 bp, Homo sapiens
aggctgtggtgctgaaggaggg

SEQ ID NO: 7035658 - DNA, 22 bp, Homo sapiens
agggaccagcctgcccagggct

SEQ ID NO: 7035659 - DNA, 22 bp, Homo sapiens
agggaccaggggtagctgagat

SEQ ID NO: 7035660 - DNA, 22 bp, Homo sapiens
agggagctgagctgtgagcagc

SEQ ID NO: 7035661 - DNA, 22 bp, Homo sapiens
agggccaccagggagtctcagg

SEQ ID NO: 7035662 - DNA, 23 bp, Homo sapiens
agggccaggtgcggaaacagctc

SEQ ID NO: 7035663 - DNA, 22 bp, Homo sapiens
agggcccatgtgggagcacttg

SEQ ID NO: 7035664 - DNA, 22 bp, Homo sapiens
agggggagacatgtgtgtgttt

SEQ ID NO: 7035665 - DNA, 22 bp, Homo sapiens
agggggagcttggctactcctg

SEQ ID NO: 7035666 - DNA, 22 bp, Homo sapiens
agggggtgtctctgattgggtt

SEQ ID NO: 7035667 - DNA, 22 bp, Homo sapiens
ctcatggagggagtgctcttcc

SEQ ID NO: 7035668 - DNA, 18 bp, Homo sapiens
ctcatgtgtggtcccagc

SEQ ID NO: 7035669 - DNA, 22 bp, Homo sapiens
ctcattgcaacctccgcctccc

SEQ ID NO: 7035670 - DNA, 22 bp, Homo sapiens
ctcattgcccagatccccacag

SEQ ID NO: 7035671 - DNA, 22 bp, Homo sapiens
ctctggctttgctcatgcatcc

SEQ ID NO: 7035672 - DNA, 22 bp, Homo sapiens
ctgcagggtgacgttgcccacc

SEQ ID NO: 7035673 - DNA, 20 bp, Homo sapiens
ctgcagggtgagtgggcgat

SEQ ID NO: 7035674 - DNA, 22 bp, Homo sapiens
ctgcagggtttcgccagttgtg

SEQ ID NO: 7035675 - DNA, 22 bp, Homo sapiens
ctgcagggttttaacaatggac

SEQ ID NO: 7035676 - DNA, 22 bp, Homo sapiens
ctgcatcctaacctccatgcag

SEQ ID NO: 7035677 - DNA, 22 bp, Homo sapiens
ctgcatcctggaaatagctaag

SEQ ID NO: 7035678 - DNA, 22 bp, Homo sapiens
ctggaatgcctccctgtcagag

SEQ ID NO: 7035679 - DNA, 22 bp, Homo sapiens
atacagtgaatacttacagtgt

SEQ ID NO: 7035680 - DNA, 22 bp, Homo sapiens
atacagtgccccttttcacatg

SEQ ID NO: 7035681 - DNA, 22 bp, Homo sapiens
atacagtgtactatttagcagt

SEQ ID NO: 7035682 - DNA, 22 bp, Homo sapiens
ctggctggccggagcgaggcgg

SEQ ID NO: 7035683 - DNA, 22 bp, Homo sapiens
ctggctgggaagtagagtaggt

SEQ ID NO: 7035684 - DNA, 22 bp, Homo sapiens
atattcatcgtgtagaaatact

SEQ ID NO: 7035685 - DNA, 22 bp, Homo sapiens
atattgtactagggttacatgt

SEQ ID NO: 7035686 - DNA, 22 bp, Homo sapiens
atatttaaacagggtaccaata

SEQ ID NO: 7035687 - DNA, 22 bp, Homo sapiens
atatttaactggtcccaatata

SEQ ID NO: 7035688 - DNA, 18 bp, Homo sapiens
ctgtgggaaggctttcta

SEQ ID NO: 7035689 - DNA, 21 bp, Homo sapiens
ctgtgggaccaagcactggga

SEQ ID NO: 7035690 - DNA, 22 bp, Homo sapiens
cttccaggtgctggcctggcct

SEQ ID NO: 7035691 - DNA, 22 bp, Homo sapiens
cttcttgtcaatttgccattgt

SEQ ID NO: 7035692 - DNA, 22 bp, Homo sapiens
atgacagctctagcacacagta

SEQ ID NO: 7035693 - DNA, 22 bp, Homo sapiens
atgatgctgtttatcatatact

SEQ ID NO: 7035694 - DNA, 22 bp, Homo sapiens
gacggagctggttgctgcggct

SEQ ID NO: 7035695 - DNA, 22 bp, Homo sapiens
atggagggaaaagtggagagcc

SEQ ID NO: 7035696 - DNA, 21 bp, Homo sapiens
atggagggaccagggaagcag

SEQ ID NO: 7035697 - DNA, 22 bp, Homo sapiens
gaggtggcctcaagcagtcttc

SEQ ID NO: 7035698 - DNA, 22 bp, Homo sapiens
attaggcttcctcaagaggagt

SEQ ID NO: 7035699 - DNA, 22 bp, Homo sapiens
attagtgtacatctcacacgca

SEQ ID NO: 7035700 - DNA, 22 bp, Homo sapiens
attagtgtctgtgaataattct

SEQ ID NO: 7035701 - DNA, 22 bp, Homo sapiens
attagtgttcttatcttctagg

SEQ ID NO: 7035702 - DNA, 22 bp, Homo sapiens
attccttgcacatcagatagtt

SEQ ID NO: 7035703 - DNA, 22 bp, Homo sapiens
attccttgctctcatcaacctt

SEQ ID NO: 7035704 - DNA, 22 bp, Homo sapiens
attccttggaacagatgcgaag

SEQ ID NO: 7035705 - DNA, 22 bp, Homo sapiens
attccttggcattctggacttg

SEQ ID NO: 7035706 - DNA, 22 bp, Homo sapiens
attccttgggaattattgaatg

SEQ ID NO: 7035707 - DNA, 22 bp, Homo sapiens
attccttgggctgccttattat

SEQ ID NO: 7035708 - DNA, 22 bp, Homo sapiens
attccttgtatatctacatgca

SEQ ID NO: 7035709 - DNA, 22 bp, Homo sapiens
attccttgtttcactgaaaagg

SEQ ID NO: 7035710 - DNA, 18 bp, Homo sapiens
gcagggctgcacacgcat

SEQ ID NO: 7035711 - DNA, 18 bp, Homo sapiens
gcagggctggacaagtca

SEQ ID NO: 7035712 - DNA, 22 bp, Homo sapiens
gcagtgttaaacaactgctgct

SEQ ID NO: 7035713 - DNA, 22 bp, Homo sapiens
gcagtgttaatgcgagtgttca

SEQ ID NO: 7035714 - DNA, 22 bp, Homo sapiens
gcagtgttacctcttcagtggg

SEQ ID NO: 7035715 - DNA, 22 bp, Homo sapiens
gcagtgttaccttgggctggtt

SEQ ID NO: 7035716 - DNA, 22 bp, Homo sapiens
gcagtgttacttggagtactaa

SEQ ID NO: 7035717 - DNA, 22 bp, Homo sapiens
gcagtgttacttggtttgcaga

SEQ ID NO: 7035718 - DNA, 22 bp, Homo sapiens
caaatgcatgagaaataagagg

SEQ ID NO: 7035719 - DNA, 22 bp, Homo sapiens
ggaagggcctcgggcgtgggac

SEQ ID NO: 7035720 - DNA, 21 bp, Homo sapiens
ggaagggctctgaggacggct

SEQ ID NO: 7035721 - DNA, 22 bp, Homo sapiens
ggactgggccaggggttggact

SEQ ID NO: 7035722 - DNA, 22 bp, Homo sapiens
ggactggggccaacacctccct

SEQ ID NO: 7035723 - DNA, 22 bp, Homo sapiens
ggactgggtaggagcccagggc

SEQ ID NO: 7035724 - DNA, 23 bp, Homo sapiens
ggagctggacccttacacctttc

SEQ ID NO: 7035725 - DNA, 20 bp, Homo sapiens
ggagctggcatccagcctct

SEQ ID NO: 7035726 - DNA, 22 bp, Homo sapiens
cacaggaatataagtttgagtt

SEQ ID NO: 7035727 - DNA, 22 bp, Homo sapiens
ggaggtggaggttgcaatgagc

SEQ ID NO: 7035728 - DNA, 22 bp, Homo sapiens
ggaggtggaggttgcagtgagc

SEQ ID NO: 7035729 - DNA, 22 bp, Homo sapiens
cacagtgttccagagcagtggt

SEQ ID NO: 7035730 - DNA, 22 bp, Homo sapiens
ggcagggcaggaaagtcaggaa

SEQ ID NO: 7035731 - DNA, 22 bp, Homo sapiens
ggcaggtgccttctgtgctagc

SEQ ID NO: 7035732 - DNA, 22 bp, Homo sapiens
ggctctggtcagtgaggggcct

SEQ ID NO: 7035733 - DNA, 22 bp, Homo sapiens
ggctgccccagtgctcatggct

SEQ ID NO: 7035734 - DNA, 22 bp, Homo sapiens
ggctgccctagagctggcaagg

SEQ ID NO: 7035735 - DNA, 22 bp, Homo sapiens
ggctgccctgggaggcaagggt

SEQ ID NO: 7035736 - DNA, 22 bp, Homo sapiens
gggccagcctactgctagaccc

SEQ ID NO: 7035737 - DNA, 22 bp, Homo sapiens
cagagctgggatcccatgggcg

SEQ ID NO: 7035738 - DNA, 22 bp, Homo sapiens
ggtgctggttcagggtggctgt

SEQ ID NO: 7035739 - DNA, 22 bp, Homo sapiens
cagcaggctctgagtggctgcc

SEQ ID NO: 7035740 - DNA, 22 bp, Homo sapiens
gtgcttcctctgccaacactct

SEQ ID NO: 7035741 - DNA, 20 bp, Homo sapiens
tacaaacctccacactggtg

SEQ ID NO: 7035742 - DNA, 22 bp, Homo sapiens
cagggaatccatggtcataagg

SEQ ID NO: 7035743 - DNA, 22 bp, Homo sapiens
cagggagcactgcgagcggcag

SEQ ID NO: 7035744 - DNA, 22 bp, Homo sapiens
cagggagcagcgctggggcctc

SEQ ID NO: 7035745 - DNA, 22 bp, Homo sapiens
cagggccagggacacgctgtca

SEQ ID NO: 7035746 - DNA, 22 bp, Homo sapiens
cagggccatgaggcacagggtc

SEQ ID NO: 7035747 - DNA, 22 bp, Homo sapiens
cagggccattggcgtggctgtc

SEQ ID NO: 7035748 - DNA, 17 bp, Homo sapiens
cagggctgtctgcctag

SEQ ID NO: 7035749 - DNA, 22 bp, Homo sapiens
cagggctgtgcccatcttcccc

SEQ ID NO: 7035750 - DNA, 22 bp, Homo sapiens
caggggtggctgcagcagaggt

SEQ ID NO: 7035751 - DNA, 22 bp, Homo sapiens
caggtggagctgactgagggca

SEQ ID NO: 7035752 - DNA, 22 bp, Homo sapiens
tcagggagggacctgaggctgg

SEQ ID NO: 7035753 - DNA, 22 bp, Homo sapiens
catgcaggcgcaacttctacaa

SEQ ID NO: 7035754 - DNA, 22 bp, Homo sapiens
catgcagggactagagaacagg

SEQ ID NO: 7035755 - DNA, 22 bp, Homo sapiens
catgcagggacttgtgctccat

SEQ ID NO: 7035756 - DNA, 22 bp, Homo sapiens
catgcagggagcagaggagaca

SEQ ID NO: 7035757 - DNA, 22 bp, Homo sapiens
catgcaggtctggagcttgggg

SEQ ID NO: 7035758 - DNA, 22 bp, Homo sapiens
catgcagggagtgctcctatta

SEQ ID NO: 7035759 - DNA, 22 bp, Homo sapiens
catgcaggtgaccaggtgtggg

SEQ ID NO: 7035760 - DNA, 22 bp, Homo sapiens
catgcaggttatatgtgcttct

SEQ ID NO: 7035761 - DNA, 22 bp, Homo sapiens
catggcagagcctgcaggtggg

SEQ ID NO: 7035762 - DNA, 22 bp, Homo sapiens
catggcaggaggctgctggcag

SEQ ID NO: 7035763 - DNA, 22 bp, Homo sapiens
catggcagggctgtgggcaggt

SEQ ID NO: 7035764 - DNA, 22 bp, Homo sapiens
catgggaggttggcttggcatg

SEQ ID NO: 7035765 - DNA, 23 bp, Homo sapiens
catgggagtgagaatgccagctc

SEQ ID NO: 7035766 - DNA, 22 bp, Homo sapiens
cattaggcccttgtcagctagt

SEQ ID NO: 7035767 - DNA, 22 bp, Homo sapiens
ccactgtggaaagcagttcaga

SEQ ID NO: 7035768 - DNA, 22 bp, Homo sapiens
ccagctctctgcagaaaggact

SEQ ID NO: 7035769 - DNA, 22 bp, Homo sapiens
ccagctctctttgaagcataaa

SEQ ID NO: 7035770 - DNA, 22 bp, Homo sapiens
ccagctctgcatgtttcccttg

SEQ ID NO: 7035771 - DNA, 22 bp, Homo sapiens
tctggcagctatcctctggcca

SEQ ID NO: 7035772 - DNA, 22 bp, Homo sapiens
tctggcagctctcctcggcgga

SEQ ID NO: 7035773 - DNA, 22 bp, Homo sapiens
tctggcaggacatgctgaccat

SEQ ID NO: 7035774 - DNA, 22 bp, Homo sapiens
tctggcaggggttctgcacttg

SEQ ID NO: 7035775 - DNA, 22 bp, Homo sapiens
tctggtgtcagtattctttgaa

SEQ ID NO: 7035776 - DNA, 22 bp, Homo sapiens
ccaggagtctggatgaggtgtc

SEQ ID NO: 7035777 - DNA, 19 bp, Homo sapiens
ccaggagtggtggggtgag

SEQ ID NO: 7035778 - DNA, 22 bp, Homo sapiens
ccaggccagagtgcagtggcac

SEQ ID NO: 7035779 - DNA, 22 bp, Homo sapiens
ccaggccagcctggagcatggc

SEQ ID NO: 7035780 - DNA, 22 bp, Homo sapiens
ccaggccaggagagcgaggttt

SEQ ID NO: 7035781 - DNA, 22 bp, Homo sapiens
tctttggggcatctgggagatt

SEQ ID NO: 7035782 - DNA, 21 bp, Homo sapiens
tgaatgcttcgtcatcctggc

SEQ ID NO: 7035783 - DNA, 22 bp, Homo sapiens
ccaggggaaacagggagcactc

SEQ ID NO: 7035784 - DNA, 21 bp, Homo sapiens
ccaggggcaaattgtcgtttc

SEQ ID NO: 7035785 - DNA, 22 bp, Homo sapiens
ccaggggctgcagatccatggt

SEQ ID NO: 7035786 - DNA, 22 bp, Homo sapiens
ccagggggcttggtgaggccat

SEQ ID NO: 7035787 - DNA, 22 bp, Homo sapiens
ccaggggggcgtagatgctggg

SEQ ID NO: 7035788 - DNA, 22 bp, Homo sapiens
tgagggccgaggagctgtgggt

SEQ ID NO: 7035789 - DNA, 22 bp, Homo sapiens
ccagtgttccatggagtgatta

SEQ ID NO: 7035790 - DNA, 22 bp, Homo sapiens
ccagtgttccctcgggttcatg

SEQ ID NO: 7035791 - DNA, 22 bp, Homo sapiens
ccagtgttctggtgttcatttc

SEQ ID NO: 7035792 - DNA, 22 bp, Homo sapiens
ccagtgttgaacagtatttgga

SEQ ID NO: 7035793 - DNA, 22 bp, Homo sapiens
ccagtgttgcataggatgggga

SEQ ID NO: 7035794 - DNA, 22 bp, Homo sapiens
ccagtgttggaggatggcttgc

SEQ ID NO: 7035795 - DNA, 22 bp, Homo sapiens
ccagtgtttacagttgaacaaa

SEQ ID NO: 7035796 - DNA, 22 bp, Homo sapiens
ccagtgtttaggaataaaatgt

SEQ ID NO: 7035797 - DNA, 22 bp, Homo sapiens
ccagtgtttccccagaagagag

SEQ ID NO: 7035798 - DNA, 22 bp, Homo sapiens
ccagtgtttccgtcagtacacg

SEQ ID NO: 7035799 - DNA, 22 bp, Homo sapiens
ccagtgtttgatgggattttca

SEQ ID NO: 7035800 - DNA, 22 bp, Homo sapiens
ccagtgttttcatcctcccttg

SEQ ID NO: 7035801 - DNA, 22 bp, Homo sapiens
tgccagcttttgactatcttag

SEQ ID NO: 7035802 - DNA, 22 bp, Homo sapiens
tgccatattgcaaagtgtctgc

SEQ ID NO: 7035803 - DNA, 22 bp, Homo sapiens
cccattccctttactgttgcat

SEQ ID NO: 7035804 - DNA, 23 bp, Homo sapiens
tgctggctaagaatctgcatttt

SEQ ID NO: 7035805 - DNA, 22 bp, Homo sapiens
tgctgtgctctttaaggtgctg

SEQ ID NO: 7035806 - DNA, 22 bp, Homo sapiens
tgctgtgctggcggcagaggcc

SEQ ID NO: 7035807 - DNA, 21 bp, Homo sapiens
cccttcttgggtcaaagtata

SEQ ID NO: 7035808 - DNA, 22 bp, Homo sapiens
tggcagggttggccaccttacc

SEQ ID NO: 7035809 - DNA, 22 bp, Homo sapiens
tggcaggtacccattggctgta

SEQ ID NO: 7035810 - DNA, 17 bp, Homo sapiens
cctcagcttctttcctc

SEQ ID NO: 7035811 - DNA, 22 bp, Homo sapiens
tggctgagaccatcagggtgta

SEQ ID NO: 7035812 - DNA, 22 bp, Homo sapiens
tggctgagagaagacggggaag

SEQ ID NO: 7035813 - DNA, 16 bp, Homo sapiens
tggctgagagagggtt

SEQ ID NO: 7035814 - DNA, 22 bp, Homo sapiens
tggctggctgtcagtaggctgt

SEQ ID NO: 7035815 - DNA, 22 bp, Homo sapiens
tgggaaggacgtgtcagtggca

SEQ ID NO: 7035816 - DNA, 22 bp, Homo sapiens
cctcttctaggacgtccttgtg

SEQ ID NO: 7035817 - DNA, 22 bp, Homo sapiens
tgggagtggggcatagaaggta

SEQ ID NO: 7035818 - DNA, 22 bp, Homo sapiens
tgggagtgttcttggcttgctt

SEQ ID NO: 7035819 - DNA, 22 bp, Homo sapiens
tgggcccaagagagtctccaac

SEQ ID NO: 7035820 - DNA, 22 bp, Homo sapiens
tgggccccttggtttcctgagc

SEQ ID NO: 7035821 - DNA, 22 bp, Homo sapiens
tggggaggaagtcagatttcag

SEQ ID NO: 7035822 - DNA, 21 bp, Homo sapiens
tgggggagaattggttgcttt

SEQ ID NO: 7035823 - DNA, 22 bp, Homo sapiens
tgtgttctgaaggagaagagtg

SEQ ID NO: 7035824 - DNA, 22 bp, Homo sapiens
cctgtgtggaaggcaggaggcc

SEQ ID NO: 7035825 - DNA, 22 bp, Homo sapiens
cctgtgtggtagccagcggtgc

SEQ ID NO: 7035826 - DNA, 22 bp, Homo sapiens
cctgtgtgtaggccaggggagt

SEQ ID NO: 7035827 - DNA, 22 bp, Homo sapiens
ccttccttgagaagcaattcct

SEQ ID NO: 7035828 - DNA, 22 bp, Homo sapiens
ccttcctttcagggctatgcct

SEQ ID NO: 7035829 - DNA, 22 bp, Homo sapiens
ttagaaaaatgttcagtagttt

SEQ ID NO: 7035830 - DNA, 22 bp, Homo sapiens
ttaggctgggctacaacaactg

SEQ ID NO: 7035831 - DNA, 22 bp, Homo sapiens
ttaggctgttcttgtgttgtta

SEQ ID NO: 7035832 - DNA, 22 bp, Homo sapiens
cgggggagttgaggcacatggg

SEQ ID NO: 7035833 - DNA, 22 bp, Homo sapiens
ttcatgaatgttccatgtgagt

SEQ ID NO: 7035834 - DNA, 22 bp, Homo sapiens
ttccaggaccaggaagagggga

SEQ ID NO: 7035835 - DNA, 22 bp, Homo sapiens
ttccaggactcgttctggctca

SEQ ID NO: 7035836 - DNA, 22 bp, Homo sapiens
ttccaggacttcatggctctga

SEQ ID NO: 7035837 - DNA, 22 bp, Homo sapiens
ttccaggagaggaaacctgatt

SEQ ID NO: 7035838 - DNA, 22 bp, Homo sapiens
ttccaggagccacacaggggcg

SEQ ID NO: 7035839 - DNA, 22 bp, Homo sapiens
ttccaggaggaaagtttgggtg

SEQ ID NO: 7035840 - DNA, 22 bp, Homo sapiens
ttccaggaggaggtactagagg

SEQ ID NO: 7035841 - DNA, 22 bp, Homo sapiens
ttccaggaggcactgacagagg

SEQ ID NO: 7035842 - DNA, 22 bp, Homo sapiens
ttccaggaggcttggcgggagg

SEQ ID NO: 7035843 - DNA, 22 bp, Homo sapiens
ttccaggaggtcaaaggcctgt

SEQ ID NO: 7035844 - DNA, 22 bp, Homo sapiens
ttccaggatggagacactagta

SEQ ID NO: 7035845 - DNA, 22 bp, Homo sapiens
ttccaggatggcaataatgaat

SEQ ID NO: 7035846 - DNA, 22 bp, Homo sapiens
ttctcggctcagtctcagcgaa

SEQ ID NO: 7035847 - DNA, 21 bp, Homo sapiens
ttctctggataggccagtcct

SEQ ID NO: 7035848 - DNA, 22 bp, Homo sapiens
tttccttgggtctcttagtggc

SEQ ID NO: 7035849 - DNA, 18 bp, Homo sapiens
tttccttgtatgaacata

SEQ ID NO: 7035850 - DNA, 22 bp, Homo sapiens
tttccttgttattatttgtcct

SEQ ID NO: 7035851 - DNA, 22 bp, Homo sapiens
tttccttgttcatttgccctat

SEQ ID NO: 7035852 - DNA, 22 bp, Homo sapiens
ctctgccctcgcacatctgcca

SEQ ID NO: 7035853 - DNA, 21 bp, Homo sapiens
tttgggactctgatgggagct

SEQ ID NO: 7035854 - DNA, 22 bp, Homo sapiens
tttgggactggagcttggagag

SEQ ID NO: 7035855 - DNA, 22 bp, Homo sapiens
tttgggcaggcttttccctaga

SEQ ID NO: 7035856 - DNA, 22 bp, Homo sapiens
ttttcaggtgcagtaatcatat

SEQ ID NO: 7035857 - DNA, 22 bp, Homo sapiens
ttttcagttactgtttatgtga

SEQ ID NO: 7035858 - DNA, 19 bp, Homo sapiens
ctgcagggatgtgcagagt

SEQ ID NO: 7035859 - DNA, 19 bp, Homo sapiens
ctgcagggatgtgcagagt

SEQ ID NO: 7035860 - DNA, 22 bp, Homo sapiens
ctgcagggcagaagggcataga

SEQ ID NO: 7035861 - DNA, 22 bp, Homo sapiens
ctgcagggcagggcctcctggc

SEQ ID NO: 7035862 - DNA, 22 bp, Homo sapiens
ctgcagggcccaaggtcaacgg

SEQ ID NO: 7035863 - DNA, 22 bp, Homo sapiens
ctgcaggggcagtccacttcct

SEQ ID NO: 7035864 - DNA, 22 bp, Homo sapiens
ctgcaggggcctcgagcacagg

SEQ ID NO: 7035865 - DNA, 22 bp, Homo sapiens
ctggcaggagcattcacagagg

SEQ ID NO: 7035866 - DNA, 20 bp, Homo sapiens
ctggcaggagcgagtctacc

SEQ ID NO: 7035867 - DNA, 22 bp, Homo sapiens
ctggcaggagctgtggccgtag

SEQ ID NO: 7035868 - DNA, 22 bp, Homo sapiens
ctggcaggatctaaccagggaa

SEQ ID NO: 7035869 - DNA, 22 bp, Homo sapiens
ctggcaggcaaattggtgggag

SEQ ID NO: 7035870 - DNA, 22 bp, Homo sapiens
ctggcaggcagacttctgcaag

SEQ ID NO: 7035871 - DNA, 22 bp, Homo sapiens
ctggcaggcggaggttgcagtg

SEQ ID NO: 7035872 - DNA, 22 bp, Homo sapiens
ctggcaggcggcagagcccagg

SEQ ID NO: 7035873 - DNA, 22 bp, Homo sapiens
ctggcaggctctctggtcggtt

SEQ ID NO: 7035874 - DNA, 22 bp, Homo sapiens
ctggccagcctcccaggtaccc

SEQ ID NO: 7035875 - DNA, 22 bp, Homo sapiens
ctggctcatagagcagctccaa

SEQ ID NO: 7035876 - DNA, 22 bp, Homo sapiens
ctggctggaacgccgaggcggc

SEQ ID NO: 7035877 - DNA, 22 bp, Homo sapiens
ctggctggacttgtgcatgtca

SEQ ID NO: 7035878 - DNA, 22 bp, Homo sapiens
ctggctggagctgttgtaggct

SEQ ID NO: 7035879 - DNA, 22 bp, Homo sapiens
ctgggaggcactattcaggagg

SEQ ID NO: 7035880 - DNA, 22 bp, Homo sapiens
ctgggaggcagtctctctagaa

SEQ ID NO: 7035881 - DNA, 22 bp, Homo sapiens
ctgggaggcggagcttgcagtg

SEQ ID NO: 7035882 - DNA, 22 bp, Homo sapiens
ctgggaggcggagcttgcagtg

SEQ ID NO: 7035883 - DNA, 20 bp, Homo sapiens
ctgggctgcccagctatggg

SEQ ID NO: 7035884 - DNA, 22 bp, Homo sapiens
gaaatgcagaacctgagaccat

SEQ ID NO: 7035885 - DNA, 22 bp, Homo sapiens
gaagagctgacagtgtcatcct

SEQ ID NO: 7035886 - DNA, 22 bp, Homo sapiens
gaagagcttagttgtcctagaa

SEQ ID NO: 7035887 - DNA, 22 bp, Homo sapiens
gaagcctcaacatctctgcgtc

SEQ ID NO: 7035888 - DNA, 22 bp, Homo sapiens
gacagggctgtgggaggagcag

SEQ ID NO: 7035889 - DNA, 22 bp, Homo sapiens
gacagggtccaaaggcagggga

SEQ ID NO: 7035890 - DNA, 22 bp, Homo sapiens
gacagggtacgggctaggcaca

SEQ ID NO: 7035891 - DNA, 22 bp, Homo sapiens
gagaagggggctcgagtgtcct

SEQ ID NO: 7035892 - DNA, 18 bp, Homo sapiens
gagaggcccggctgtgcc

SEQ ID NO: 7035893 - DNA, 22 bp, Homo sapiens
gagcctggattgtcaccgactt

SEQ ID NO: 7035894 - DNA, 21 bp, Homo sapiens
gagctctctacttgcacattt

SEQ ID NO: 7035895 - DNA, 22 bp, Homo sapiens
gagctctgaaaaagcttgcctt

SEQ ID NO: 7035896 - DNA, 19 bp, Homo sapiens
gagctgagagtagcactgg

SEQ ID NO: 7035897 - DNA, 22 bp, Homo sapiens
gagctgagatcatgtacactag

SEQ ID NO: 7035898 - DNA, 18 bp, Homo sapiens
gaggagccgtccctacta

SEQ ID NO: 7035899 - DNA, 22 bp, Homo sapiens
gaggagcttgtgagaagatgtc

SEQ ID NO: 7035900 - DNA, 22 bp, Homo sapiens
gcagggacctatgacgatggaa

SEQ ID NO: 7035901 - DNA, 22 bp, Homo sapiens
gcagggctgactcagccaccct

SEQ ID NO: 7035902 - DNA, 22 bp, Homo sapiens
gcaggggagtccactctatgca

SEQ ID NO: 7035903 - DNA, 22 bp, Homo sapiens
gcaggggagtggatgatggatt

SEQ ID NO: 7035904 - DNA, 22 bp, Homo sapiens
gcatgcaggaagggcttgggga

SEQ ID NO: 7035905 - DNA, 22 bp, Homo sapiens
gcatgcaggataggttgagctc

SEQ ID NO: 7035906 - DNA, 22 bp, Homo sapiens
gcatgcagggagggtctggctg

SEQ ID NO: 7035907 - DNA, 22 bp, Homo sapiens
gccagggagtctgggccacaga

SEQ ID NO: 7035908 - DNA, 22 bp, Homo sapiens
gctccagggtcagctcagaact

SEQ ID NO: 7035909 - DNA, 22 bp, Homo sapiens
gctgcccaattacagggccgtg

SEQ ID NO: 7035910 - DNA, 22 bp, Homo sapiens
gctgcccagggctgagtgtcct

SEQ ID NO: 7035911 - DNA, 22 bp, Homo sapiens
gctgcccagggtggagccggct

SEQ ID NO: 7035912 - DNA, 22 bp, Homo sapiens
gctgcccattgctctcccactc

SEQ ID NO: 7035913 - DNA, 22 bp, Homo sapiens
gctgccttccaaagagttttat

SEQ ID NO: 7035914 - DNA, 23 bp, Homo sapiens
gctggctggcagtaaaggttgtt

SEQ ID NO: 7035915 - DNA, 22 bp, Homo sapiens
gctggctgtgtttcatctctga

SEQ ID NO: 7035916 - DNA, 22 bp, Homo sapiens
gctggctgttgaataatggcat

SEQ ID NO: 7035917 - DNA, 22 bp, Homo sapiens
gctgtgctgattcattccctgc

SEQ ID NO: 7035918 - DNA, 19 bp, Homo sapiens
gctgtgggacagcagggtg

SEQ ID NO: 7035919 - DNA, 22 bp, Homo sapiens
gctgtgggacaggtccagccag

SEQ ID NO: 7035920 - DNA, 22 bp, Homo sapiens
gctgtgggtaaacgctgagggt

SEQ ID NO: 7035921 - DNA, 22 bp, Homo sapiens
gctgtgggtccggaccccacgg

SEQ ID NO: 7035922 - DNA, 22 bp, Homo sapiens
gctgtgggtgctggctccaccc

SEQ ID NO: 7035923 - DNA, 20 bp, Homo sapiens
gctttctatgagatggactg

SEQ ID NO: 7035924 - DNA, 22 bp, Homo sapiens
ggaatcctgccagctctgcccc

SEQ ID NO: 7035925 - DNA, 22 bp, Homo sapiens
ggacagggttggggcatataaa

SEQ ID NO: 7035926 - DNA, 22 bp, Homo sapiens
ggagccagagcactggggagcc

SEQ ID NO: 7035927 - DNA, 22 bp, Homo sapiens
ggagccagagtttaatgtggag

SEQ ID NO: 7035928 - DNA, 22 bp, Homo sapiens
ggagccagcagggtgacactga

SEQ ID NO: 7035929 - DNA, 23 bp, Homo sapiens
ggagccagcctgtggggagcggg

SEQ ID NO: 7035930 - DNA, 23 bp, Homo sapiens
ggagtgcaatggcgccatctcgg

SEQ ID NO: 7035931 - DNA, 22 bp, Homo sapiens
ggcacagccctctctgtggaca

SEQ ID NO: 7035932 - DNA, 20 bp, Homo sapiens
ggcagagggcctgggagaag

SEQ ID NO: 7035933 - DNA, 21 bp, Homo sapiens
ggcaggtgggtctctgttgct

SEQ ID NO: 7035934 - DNA, 21 bp, Homo sapiens
ggcatggcacctctgggcagg

SEQ ID NO: 7035935 - DNA, 19 bp, Homo sapiens
ggcatggggtccggggacc

SEQ ID NO: 7035936 - DNA, 22 bp, Homo sapiens
ggcatggggtgtatgtggcacg

SEQ ID NO: 7035937 - DNA, 21 bp, Homo sapiens
ggcctcagccacctggctctg

SEQ ID NO: 7035938 - DNA, 22 bp, Homo sapiens
ggctccaccctgcttccagaag

SEQ ID NO: 7035939 - DNA, 22 bp, Homo sapiens
ggctctggcaaggggaggctac

SEQ ID NO: 7035940 - DNA, 22 bp, Homo sapiens
ggctggcttgcggagtcacaga

SEQ ID NO: 7035941 - DNA, 22 bp, Homo sapiens
ggcttggctacaagccatgggc

SEQ ID NO: 7035942 - DNA, 22 bp, Homo sapiens
ggcttggcttgggctcagaggc

SEQ ID NO: 7035943 - DNA, 22 bp, Homo sapiens
gggacaggcaaaggtatgcttc

SEQ ID NO: 7035944 - DNA, 22 bp, Homo sapiens
gggacaggctgagacttgagct

SEQ ID NO: 7035945 - DNA, 22 bp, Homo sapiens
gggacatctttctagtcagggt

SEQ ID NO: 7035946 - DNA, 17 bp, Homo sapiens
gggagatgaagggatat

SEQ ID NO: 7035947 - DNA, 22 bp, Homo sapiens
gggagatgaatcagaagtgatc

SEQ ID NO: 7035948 - DNA, 17 bp, Homo sapiens
gggcagggactcctggg

SEQ ID NO: 7035949 - DNA, 19 bp, Homo sapiens
gggcatgctggctctagag

SEQ ID NO: 7035950 - DNA, 18 bp, Homo sapiens
gggcatggatgcagcatc

SEQ ID NO: 7035951 - DNA, 22 bp, Homo sapiens
gggtagggtgacttaggctggc

SEQ ID NO: 7035952 - DNA, 22 bp, Homo sapiens
gggtggcacaggtgcagagggt

SEQ ID NO: 7035953 - DNA, 22 bp, Homo sapiens
gggtggcaggattggcaggagt

SEQ ID NO: 7035954 - DNA, 22 bp, Homo sapiens
ggtggcctagggcccagcctgt

SEQ ID NO: 7035955 - DNA, 18 bp, Homo sapiens
ggtggccttgacttctct

SEQ ID NO: 7035956 - DNA, 23 bp, Homo sapiens
gtaaaatacgcagtgcagtgtga

SEQ ID NO: 7035957 - DNA, 22 bp, Homo sapiens
gtgaccttggcaatctctcaga

SEQ ID NO: 7035958 - DNA, 22 bp, Homo sapiens
gtgtgggaaggctaggatgctg

SEQ ID NO: 7035959 - DNA, 22 bp, Homo sapiens
gtgtgggacgggtgagtggcca

SEQ ID NO: 7035960 - DNA, 22 bp, Homo sapiens
gttgagtgggttaggatgctga

SEQ ID NO: 7035961 - DNA, 22 bp, Homo sapiens
tacaggagcatggggaagggat

SEQ ID NO: 7035962 - DNA, 20 bp, Homo sapiens
tacaggagtgagtgggtggg

SEQ ID NO: 7035963 - DNA, 22 bp, Homo sapiens
tacatttgctttgattttcagc

SEQ ID NO: 7035964 - DNA, 22 bp, Homo sapiens
tagaaacattcagttgcagtcc

SEQ ID NO: 7035965 - DNA, 22 bp, Homo sapiens
tagaaactactagaataagaga

SEQ ID NO: 7035966 - DNA, 22 bp, Homo sapiens
tagaaactagattgatagcgga

SEQ ID NO: 7035967 - DNA, 22 bp, Homo sapiens
tagaaactcacgttatcattgc

SEQ ID NO: 7035968 - DNA, 22 bp, Homo sapiens
tagaaactcaggatactcttcc

SEQ ID NO: 7035969 - DNA, 22 bp, Homo sapiens
tagaaactctcaatctgggatg

SEQ ID NO: 7035970 - DNA, 22 bp, Homo sapiens
tagaaactctcacgagtgaaac

SEQ ID NO: 7035971 - DNA, 22 bp, Homo sapiens
tagaaactgatagtcttgtgct

SEQ ID NO: 7035972 - DNA, 22 bp, Homo sapiens
tagaattgggcctaacttccat

SEQ ID NO: 7035973 - DNA, 22 bp, Homo sapiens
taggagggggaacaaggcatac

SEQ ID NO: 7035974 - DNA, 22 bp, Homo sapiens
taggagggttagagggaaatat

SEQ ID NO: 7035975 - DNA, 22 bp, Homo sapiens
tatgtacataacatgaaatgca

SEQ ID NO: 7035976 - DNA, 22 bp, Homo sapiens
tatgtcctgctactctctcatg

SEQ ID NO: 7035977 - DNA, 22 bp, Homo sapiens
tattgaattagaccctaaaatg

SEQ ID NO: 7035978 - DNA, 22 bp, Homo sapiens
tcacaggagtcataattacagt

SEQ ID NO: 7035979 - DNA, 18 bp, Homo sapiens
tcactgtgtgtcttgggt

SEQ ID NO: 7035980 - DNA, 22 bp, Homo sapiens
tcagctctacctgggagctgtc

SEQ ID NO: 7035981 - DNA, 22 bp, Homo sapiens
tcagctctcacagatctcaacc

SEQ ID NO: 7035982 - DNA, 22 bp, Homo sapiens
tcagctctctgggctcgaacct

SEQ ID NO: 7035983 - DNA, 17 bp, Homo sapiens
tcaggctgggtgcagtg

SEQ ID NO: 7035984 - DNA, 22 bp, Homo sapiens
tcagggaaatagcagggctgaa

SEQ ID NO: 7035985 - DNA, 22 bp, Homo sapiens
tcagggaaattcaagggagatt

SEQ ID NO: 7035986 - DNA, 22 bp, Homo sapiens
tcagtgttaatcagtggtacct

SEQ ID NO: 7035987 - DNA, 22 bp, Homo sapiens
tcagtgttacattatatagaac

SEQ ID NO: 7035988 - DNA, 22 bp, Homo sapiens
tcagtgttagacaagtttggaa

SEQ ID NO: 7035989 - DNA, 22 bp, Homo sapiens
tcagtgttattagatgaggttt

SEQ ID NO: 7035990 - DNA, 22 bp, Homo sapiens
tcagtgttcagcggtgtgtgca

SEQ ID NO: 7035991 - DNA, 22 bp, Homo sapiens
tcagtgttcagggaccaggtcc

SEQ ID NO: 7035992 - DNA, 16 bp, Homo sapiens
tcagtgttccagaata

SEQ ID NO: 7035993 - DNA, 22 bp, Homo sapiens
tcagtgttcgctcagggactcc

SEQ ID NO: 7035994 - DNA, 22 bp, Homo sapiens
tcagtgttctggatttggggca

SEQ ID NO: 7035995 - DNA, 23 bp, Homo sapiens
tcatggaactgggcaatcttgaa

SEQ ID NO: 7035996 - DNA, 21 bp, Homo sapiens
tccaggagtggctgggcaggg

SEQ ID NO: 7035997 - DNA, 22 bp, Homo sapiens
tccaggcatgtctgagtccttc

SEQ ID NO: 7035998 - DNA, 22 bp, Homo sapiens
tccaggcatgtggccagtactc

SEQ ID NO: 7035999 - DNA, 22 bp, Homo sapiens
tccaggccactgcagaggctct

SEQ ID NO: 7036000 - DNA, 21 bp, Homo sapiens
tcccagggtcttatgggatgt

SEQ ID NO: 7036001 - DNA, 22 bp, Homo sapiens
tcccagggttacagccagggca

SEQ ID NO: 7036002 - DNA, 22 bp, Homo sapiens
tgtggaggattctgatgccagc

SEQ ID NO: 7036003 - DNA, 21 bp, Homo sapiens
tgtgttcttctaggtcagcta

SEQ ID NO: 7036004 - DNA, 20 bp, Homo sapiens
ttaagaaaagcacatcctgc

SEQ ID NO: 7036005 - DNA, 22 bp, Homo sapiens
ttaagaatgtgccttttggttg

SEQ ID NO: 7036006 - DNA, 22 bp, Homo sapiens
ttacaggggacattggggacat

SEQ ID NO: 7036007 - DNA, 22 bp, Homo sapiens
ttcatggatcatgccttttgtg

SEQ ID NO: 7036008 - DNA, 22 bp, Homo sapiens
ttgcaagatgttaccattgtta

SEQ ID NO: 7036009 - DNA, 22 bp, Homo sapiens
ttgtgtttcccttgcatattcc

SEQ ID NO: 7036010 - DNA, 22 bp, Homo sapiens
tttaaaaaactagtctgagtct

SEQ ID NO: 7036011 - DNA, 19 bp, Homo sapiens
tttcaggagctatgcaggg

SEQ ID NO: 7036012 - DNA, 22 bp, Homo sapiens
tttcaggattagtttaagcagg

SEQ ID NO: 7036013 - DNA, 19 bp, Homo sapiens
tttggcaggagataggatg

SEQ ID NO: 7036014 - DNA, 23 bp, Homo sapiens
ttttcctttggacaggctgtatt

SEQ ID NO: 7036015 - DNA, 22 bp, Homo sapiens
ttttggcaagctgggagatatt

SEQ ID NO: 7036016 - DNA, 21 bp, Homo sapiens
ttttggcaaggtgcatgtttc

SEQ ID NO: 7036017 - DNA, 22 bp, Homo sapiens
ttttggcagattacttaatatg

SEQ ID NO: 7036018 - DNA, 22 bp, Homo sapiens
cagccccttcctggcatctgga

SEQ ID NO: 7036019 - DNA, 22 bp, Homo sapiens
cagccccttgtccggtagccac

SEQ ID NO: 7036020 - DNA, 22 bp, Homo sapiens
cagccctcaaaccacttccagg

SEQ ID NO: 7036021 - DNA, 22 bp, Homo sapiens
ggagctggcagcgcaacccaga

SEQ ID NO: 7036022 - DNA, 22 bp, Homo sapiens
ggagctggagagctagcctagg

SEQ ID NO: 7036023 - DNA, 22 bp, Homo sapiens
gcttggggagctcagtgtcctt

SEQ ID NO: 7036024 - DNA, 22 bp, Homo sapiens
gaggtggcgcgccatccctgcc

SEQ ID NO: 7036025 - DNA, 22 bp, Homo sapiens
gacactccagcttttggctcaa

SEQ ID NO: 7036026 - DNA, 19 bp, Homo sapiens
atcctgggtcctccagctg

SEQ ID NO: 7036027 - DNA, 20 bp, Homo sapiens
ctgggctcaagtgatcctcc

SEQ ID NO: 7036028 - DNA, 22 bp, Homo sapiens
ctgggctcagatgagaggaagg

SEQ ID NO: 7036029 - DNA, 22 bp, Homo sapiens
cctgggctttcggcggcttcct

SEQ ID NO: 7036030 - DNA, 22 bp, Homo sapiens
cctgtcagggtttgcctcagaa

SEQ ID NO: 7036031 - DNA, 22 bp, Homo sapiens
cctgtccagggactgagggaga

SEQ ID NO: 7036032 - DNA, 22 bp, Homo sapiens
cccctgccagctatccctgaac

SEQ ID NO: 7036033 - DNA, 22 bp, Homo sapiens
cccactccctgcacgcctgccg

SEQ ID NO: 7036034 - DNA, 22 bp, Homo sapiens
ccactcccttccggtccagggc

SEQ ID NO: 7036035 - DNA, 23 bp, Homo sapiens
ccagccctccaccagctctaggc

SEQ ID NO: 7036036 - DNA, 22 bp, Homo sapiens
ccagccctcggtagtcccatag

SEQ ID NO: 7036037 - DNA, 22 bp, Homo sapiens
ccagccctgaaccctgctgcat

SEQ ID NO: 7036038 - DNA, 22 bp, Homo sapiens
cagcccactgcctctgtggtag

SEQ ID NO: 7036039 - DNA, 21 bp, Homo sapiens
cagagctgtccaaaccctgac

SEQ ID NO: 7036040 - DNA, 22 bp, Homo sapiens
cagagctgtccaaaccctgaca

SEQ ID NO: 7036041 - DNA, 22 bp, Homo sapiens
cactgcacttcagcctgggtga

SEQ ID NO: 7036042 - DNA, 21 bp, Homo sapiens
agagctggtaggtaggtaggt

SEQ ID NO: 7036043 - DNA, 22 bp, Homo sapiens
agagctggaaaagttgttttaa

SEQ ID NO: 7036044 - DNA, 22 bp, Homo sapiens
agagctggaagctgctcttaga

SEQ ID NO: 7036045 - DNA, 22 bp, Homo sapiens
agagctggaatcagacctcagg

SEQ ID NO: 7036046 - DNA, 22 bp, Homo sapiens
gtgcaccccggggccctgctcc

SEQ ID NO: 7036047 - DNA, 22 bp, Homo sapiens
ggcaccaggacatgactcccag

SEQ ID NO: 7036048 - DNA, 22 bp, Homo sapiens
ggcaccaggatcagtctgtcat

SEQ ID NO: 7036049 - DNA, 20 bp, Homo sapiens
ggcaccaggctaggattgga

SEQ ID NO: 7036050 - DNA, 22 bp, Homo sapiens
ggcaccaggctgggcataggcc

SEQ ID NO: 7036051 - DNA, 17 bp, Homo sapiens
ggcaccagacggagagt

SEQ ID NO: 7036052 - DNA, 22 bp, Homo sapiens
ggcaccagcacttgggatggct

SEQ ID NO: 7036053 - DNA, 22 bp, Homo sapiens
ggcaccagcaggcaccgatgcc

SEQ ID NO: 7036054 - DNA, 22 bp, Homo sapiens
gctgggcttggtttccctgctt

SEQ ID NO: 7036055 - DNA, 22 bp, Homo sapiens
gctgggcttcacagagccttta

SEQ ID NO: 7036056 - DNA, 22 bp, Homo sapiens
gctgcctcaggcacctcctggc

SEQ ID NO: 7036057 - DNA, 22 bp, Homo sapiens
gcatgctgcaccagagcctctc

SEQ ID NO: 7036058 - DNA, 22 bp, Homo sapiens
gcccagccctgaggtcacagct

SEQ ID NO: 7036059 - DNA, 22 bp, Homo sapiens
gcccatggttacttttctggct

SEQ ID NO: 7036060 - DNA, 22 bp, Homo sapiens
gccctgtgctcatgggaacatc

SEQ ID NO: 7036061 - DNA, 22 bp, Homo sapiens
gccctgtgcttggatggcagat

SEQ ID NO: 7036062 - DNA, 22 bp, Homo sapiens
gccctgtgtgtttgcactgatt

SEQ ID NO: 7036063 - DNA, 22 bp, Homo sapiens
ctggggttggccagggccctag

SEQ ID NO: 7036064 - DNA, 22 bp, Homo sapiens
ctgggtgagctggccagagggt

SEQ ID NO: 7036065 - DNA, 22 bp, Homo sapiens
ctgtgcccaggcccctggggat

SEQ ID NO: 7036066 - DNA, 22 bp, Homo sapiens
ctgcaggggcagtccacttcct

SEQ ID NO: 7036067 - DNA, 22 bp, Homo sapiens
ctctctgaggaaggagcatctg

SEQ ID NO: 7036068 - DNA, 22 bp, Homo sapiens
cctggtggacagcagccagcag

SEQ ID NO: 7036069 - DNA, 22 bp, Homo sapiens
cctggtggccttcagcccacaa

SEQ ID NO: 7036070 - DNA, 22 bp, Homo sapiens
ccctgtggggtccgcctgtccg

SEQ ID NO: 7036071 - DNA, 22 bp, Homo sapiens
ccctgcagccttgcatgccttc

SEQ ID NO: 7036072 - DNA, 22 bp, Homo sapiens
ccaggccccagggctggctttc

SEQ ID NO: 7036073 - DNA, 22 bp, Homo sapiens
cagggagcagcgctggggcctc

SEQ ID NO: 7036074 - DNA, 22 bp, Homo sapiens
tgtggcacttctctccttgtaa

SEQ ID NO: 7036075 - DNA, 17 bp, Homo sapiens
gtcctggtgtgtgagga

SEQ ID NO: 7036076 - DNA, 19 bp, Homo sapiens
cagccctcttaccactgtg

SEQ ID NO: 7036077 - DNA, 22 bp, Homo sapiens
cactgcactccagcctgggcaa

SEQ ID NO: 7036078 - DNA, 22 bp, Homo sapiens
cactgcactccagcctgggtca

SEQ ID NO: 7036079 - DNA, 22 bp, Homo sapiens
cactgcactccagcctgggtga

SEQ ID NO: 7036080 - DNA, 22 bp, Homo sapiens
cactgcactccagcttgggtga

SEQ ID NO: 7036081 - DNA, 22 bp, Homo sapiens
cactgcactccagcctgggaga

SEQ ID NO: 7036082 - DNA, 22 bp, Homo sapiens
caccaggctggagtgcagaggt

SEQ ID NO: 7036083 - DNA, 22 bp, Homo sapiens
caccaggctgcccaggacaggg

SEQ ID NO: 7036084 - DNA, 22 bp, Homo sapiens
caccaggctgaaccagagggga

SEQ ID NO: 7036085 - DNA, 22 bp, Homo sapiens
caccaggcacatagtaggcact

SEQ ID NO: 7036086 - DNA, 22 bp, Homo sapiens
gctggggagctagacctcagca

SEQ ID NO: 7036087 - DNA, 22 bp, Homo sapiens
gccctgtgagtcatgcggcaga

SEQ ID NO: 7036088 - DNA, 22 bp, Homo sapiens
gccctgtgcaggtgtgcagcag

SEQ ID NO: 7036089 - DNA, 22 bp, Homo sapiens
gccctgtgccagtcacgctgtg

SEQ ID NO: 7036090 - DNA, 22 bp, Homo sapiens
gcaccaggcagctgagcaggcc

SEQ ID NO: 7036091 - DNA, 22 bp, Homo sapiens
gcaccaggcttagagccccagg

SEQ ID NO: 7036092 - DNA, 22 bp, Homo sapiens
atgctgggaagtcctaaccaca

SEQ ID NO: 7036093 - DNA, 22 bp, Homo sapiens
atgctgggacgtacttgttcat

SEQ ID NO: 7036094 - DNA, 22 bp, Homo sapiens
atgctgggagtgaagcccctgg

SEQ ID NO: 7036095 - DNA, 22 bp, Homo sapiens
ctggtggagatgcctggcccct

SEQ ID NO: 7036096 - DNA, 22 bp, Homo sapiens
cctgggcagggagaccaggctc

SEQ ID NO: 7036097 - DNA, 22 bp, Homo sapiens
cctggtgaatgttcatggactg

SEQ ID NO: 7036098 - DNA, 22 bp, Homo sapiens
aggccctgggttagggcccact

SEQ ID NO: 7036099 - DNA, 22 bp, Homo sapiens
ccagcctcatcgcctgcctgtc

SEQ ID NO: 7036100 - DNA, 22 bp, Homo sapiens
ccagggagcggggctgggtctc

SEQ ID NO: 7036101 - DNA, 17 bp, Homo sapiens
ccagggaggggccgcgc

SEQ ID NO: 7036102 - DNA, 20 bp, Homo sapiens
aggctcctgtacctgaggaa

SEQ ID NO: 7036103 - DNA, 22 bp, Homo sapiens
cagggagctggtgccagccgac

SEQ ID NO: 7036104 - DNA, 22 bp, Homo sapiens
cagggagctctgggccggactc

SEQ ID NO: 7036105 - DNA, 22 bp, Homo sapiens
agctggggcatttatccactaa

SEQ ID NO: 7036106 - DNA, 18 bp, Homo sapiens
agctggggcctctggtcc

SEQ ID NO: 7036107 - DNA, 19 bp, Homo sapiens
agctggggcggtgtgtgtt

SEQ ID NO: 7036108 - DNA, 22 bp, Homo sapiens
caggctcagcaggagcctgacc

SEQ ID NO: 7036109 - DNA, 22 bp, Homo sapiens
caccaggttccgggcagagctg

SEQ ID NO: 7036110 - DNA, 22 bp, Homo sapiens
agaggaggccaggcccacacct

SEQ ID NO: 7036111 - DNA, 22 bp, Homo sapiens
agagctgggacttggactcaat

SEQ ID NO: 7036112 - DNA, 22 bp, Homo sapiens
agagctggtgcatattcagaaa

SEQ ID NO: 7036113 - DNA, 22 bp, Homo sapiens
agagctggtttactcaggaatt

SEQ ID NO: 7036114 - DNA, 22 bp, Homo sapiens
agtaaaattgtattggaaaaca

SEQ ID NO: 7036115 - DNA, 19 bp, Homo sapiens
agctcctgttcagcagctc

SEQ ID NO: 7036116 - DNA, 22 bp, Homo sapiens
agagctgggtggtggtgactca

SEQ ID NO: 7036117 - DNA, 22 bp, Homo sapiens
agagctgggtggacttgtagtt

SEQ ID NO: 7036118 - DNA, 22 bp, Homo sapiens
agagctggggcccgtaaagcca

SEQ ID NO: 7036119 - DNA, 22 bp, Homo sapiens
agagctggggctctgggtttaa

SEQ ID NO: 7036120 - DNA, 22 bp, Homo sapiens
agagctgggtgaagtgccatca

SEQ ID NO: 7036121 - DNA, 22 bp, Homo sapiens
agagctggggcataaatgccac

SEQ ID NO: 7036122 - DNA, 22 bp, Homo sapiens
agagctggggccagagtcaagg

SEQ ID NO: 7036123 - DNA, 22 bp, Homo sapiens
tcccagccttccagtctggttt

SEQ ID NO: 7036124 - DNA, 23 bp, Homo sapiens
tcctgaggaatggcatctcacat

SEQ ID NO: 7036125 - DNA, 22 bp, Homo sapiens
tcctgaggagaagagtgctagg

SEQ ID NO: 7036126 - DNA, 22 bp, Homo sapiens
tcctgaggcacaatcctagaat

SEQ ID NO: 7036127 - DNA, 22 bp, Homo sapiens
tcctgaggctaaagtgcagtgg

SEQ ID NO: 7036128 - DNA, 22 bp, Homo sapiens
tcctgcagacctcagtcaggtc

SEQ ID NO: 7036129 - DNA, 22 bp, Homo sapiens
tcctgcagagacagaggcctca

SEQ ID NO: 7036130 - DNA, 22 bp, Homo sapiens
tcctgcagagccgccctcaggt

SEQ ID NO: 7036131 - DNA, 22 bp, Homo sapiens
tcctgcagccactgcaggcaga

SEQ ID NO: 7036132 - DNA, 22 bp, Homo sapiens
tcctgcagccattagaggtcaa

SEQ ID NO: 7036133 - DNA, 22 bp, Homo sapiens
tcctgcaggccagaggggtgag

SEQ ID NO: 7036134 - DNA, 22 bp, Homo sapiens
tcctgcaggggctgaggaacca

SEQ ID NO: 7036135 - DNA, 22 bp, Homo sapiens
tagctgggaattatctggttgc

SEQ ID NO: 7036136 - DNA, 22 bp, Homo sapiens
tagctggggctttcattcttgc

SEQ ID NO: 7036137 - DNA, 22 bp, Homo sapiens
tagctgggtctctgttttctca

SEQ ID NO: 7036138 - DNA, 22 bp, Homo sapiens
tagctgggttgaggtcatctac

SEQ ID NO: 7036139 - DNA, 22 bp, Homo sapiens
gtcaaatgcacagaaccattaa

SEQ ID NO: 7036140 - DNA, 21 bp, Homo sapiens
ggtgacacgtggccccgctct

SEQ ID NO: 7036141 - DNA, 22 bp, Homo sapiens
gggcccctgggaattctgtgat

SEQ ID NO: 7036142 - DNA, 22 bp, Homo sapiens
gggccctgtgatttcttgagga

SEQ ID NO: 7036143 - DNA, 22 bp, Homo sapiens
ggcaccagggaaggaaggctgg

SEQ ID NO: 7036144 - DNA, 22 bp, Homo sapiens
ggcaccagggacaatcctcttc

SEQ ID NO: 7036145 - DNA, 22 bp, Homo sapiens
ggcaccagggcaagggtctttc

SEQ ID NO: 7036146 - DNA, 16 bp, Homo sapiens
ggcaccagtgaacaca

SEQ ID NO: 7036147 - DNA, 22 bp, Homo sapiens
ggagctggtcagccttgagcat

SEQ ID NO: 7036148 - DNA, 21 bp, Homo sapiens
ggagctggggagctggcccca

SEQ ID NO: 7036149 - DNA, 18 bp, Homo sapiens
ggagctgggccccactcc

SEQ ID NO: 7036150 - DNA, 22 bp, Homo sapiens
ggagctgggaactatgtagtat

SEQ ID NO: 7036151 - DNA, 22 bp, Homo sapiens
gcccctggctggccagctcctc

SEQ ID NO: 7036152 - DNA, 22 bp, Homo sapiens
gaggcctggaccagccacagag

SEQ ID NO: 7036153 - DNA, 22 bp, Homo sapiens
gagctgggtgtttatttgccaa

SEQ ID NO: 7036154 - DNA, 22 bp, Homo sapiens
gagctgggtatatggctttatg

SEQ ID NO: 7036155 - DNA, 22 bp, Homo sapiens
gagctgggtctccaccttggca

SEQ ID NO: 7036156 - DNA, 22 bp, Homo sapiens
gagctcctcccagggtagcact

SEQ ID NO: 7036157 - DNA, 22 bp, Homo sapiens
gagctgggatttgaacctggga

SEQ ID NO: 7036158 - DNA, 22 bp, Homo sapiens
gagctgggcacacgccacttga

SEQ ID NO: 7036159 - DNA, 22 bp, Homo sapiens
gagctgggcctcagaacacagt

SEQ ID NO: 7036160 - DNA, 22 bp, Homo sapiens
ctgtccctcagttctgggcaaa

SEQ ID NO: 7036161 - DNA, 22 bp, Homo sapiens
ctgtccctcatcacctctgggt

SEQ ID NO: 7036162 - DNA, 22 bp, Homo sapiens
ctgggctcctaaccatccaggt

SEQ ID NO: 7036163 - DNA, 20 bp, Homo sapiens
ctgggctcggtggccctggc

SEQ ID NO: 7036164 - DNA, 22 bp, Homo sapiens
ctgggctctaagggagcaccgt

SEQ ID NO: 7036165 - DNA, 22 bp, Homo sapiens
ctgggatccacgggctcccaag

SEQ ID NO: 7036166 - DNA, 22 bp, Homo sapiens
ctgggctcaaatcctggccctg

SEQ ID NO: 7036167 - DNA, 22 bp, Homo sapiens
ctgggctcaagaagtcttccct

SEQ ID NO: 7036168 - DNA, 22 bp, Homo sapiens
ctgggctcagtggctcatggct

SEQ ID NO: 7036169 - DNA, 22 bp, Homo sapiens
ctgcaggagtgaaagcaggcct

SEQ ID NO: 7036170 - DNA, 22 bp, Homo sapiens
ctgcagcctcaacctcctgagc

SEQ ID NO: 7036171 - DNA, 22 bp, Homo sapiens
ctgcaggacgaccgcctcatct

SEQ ID NO: 7036172 - DNA, 22 bp, Homo sapiens
ctccaggatgttagacgtccag

SEQ ID NO: 7036173 - DNA, 22 bp, Homo sapiens
ttcaaatgcaagttactacttt

SEQ ID NO: 7036174 - DNA, 22 bp, Homo sapiens
cctggagcttggtcacgctgcg

SEQ ID NO: 7036175 - DNA, 22 bp, Homo sapiens
cctggagcttttccatcctgga

SEQ ID NO: 7036176 - DNA, 22 bp, Homo sapiens
cctgctggccactgctccacct

SEQ ID NO: 7036177 - DNA, 22 bp, Homo sapiens
cctgacagcgtgtccctggccc

SEQ ID NO: 7036178 - DNA, 23 bp, Homo sapiens
cctgaagggtcagggtcctcagc

SEQ ID NO: 7036179 - DNA, 22 bp, Homo sapiens
ccctgccttgttggagcctatg

SEQ ID NO: 7036180 - DNA, 22 bp, Homo sapiens
ccctgcctgtgggcatcaacat

SEQ ID NO: 7036181 - DNA, 22 bp, Homo sapiens
cccgtcccttttgcccgctggt

SEQ ID NO: 7036182 - DNA, 22 bp, Homo sapiens
ccctggtcagggaaggcgcctg

SEQ ID NO: 7036183 - DNA, 22 bp, Homo sapiens
ccctggtgtccactggaggaag

SEQ ID NO: 7036184 - DNA, 22 bp, Homo sapiens
ccctgtcctgctaggccctggt

SEQ ID NO: 7036185 - DNA, 22 bp, Homo sapiens
ccctgtcctggatgggagcact

SEQ ID NO: 7036186 - DNA, 22 bp, Homo sapiens
ccctgtccttggctgtgaggct

SEQ ID NO: 7036187 - DNA, 22 bp, Homo sapiens
ccctgtggaggcagcatcctgc

SEQ ID NO: 7036188 - DNA, 22 bp, Homo sapiens
ccctgtggcaggaggaggagca

SEQ ID NO: 7036189 - DNA, 22 bp, Homo sapiens
ccctgtgggaactcctgagttg

SEQ ID NO: 7036190 - DNA, 22 bp, Homo sapiens
cctcagccttggccccaggcag

SEQ ID NO: 7036191 - DNA, 22 bp, Homo sapiens
cccagcccacggtcctgggtgg

SEQ ID NO: 7036192 - DNA, 22 bp, Homo sapiens
cccagcccagcgttcgaggggt

SEQ ID NO: 7036193 - DNA, 20 bp, Homo sapiens
cccagcccgggccgcgctcg

SEQ ID NO: 7036194 - DNA, 22 bp, Homo sapiens
ccatggccaattgcaccttgct

SEQ ID NO: 7036195 - DNA, 22 bp, Homo sapiens
tgagctggggtcagctcccctg

SEQ ID NO: 7036196 - DNA, 21 bp, Homo sapiens
ccagcctcagatcagggagct

SEQ ID NO: 7036197 - DNA, 22 bp, Homo sapiens
ttcctggtaaattatgtccagg

SEQ ID NO: 7036198 - DNA, 22 bp, Homo sapiens
cagctcctgcagctggctccca

SEQ ID NO: 7036199 - DNA, 19 bp, Homo sapiens
cagcctcaatccctcgggc

SEQ ID NO: 7036200 - DNA, 22 bp, Homo sapiens
gtgcatccactagggctctccc

SEQ ID NO: 7036201 - DNA, 22 bp, Homo sapiens
cacagctgaagtagccatgtgg

SEQ ID NO: 7036202 - DNA, 22 bp, Homo sapiens
ggagctggccgcctatgtgcag

SEQ ID NO: 7036203 - DNA, 20 bp, Homo sapiens
gctgggctaccactggccct

SEQ ID NO: 7036204 - DNA, 19 bp, Homo sapiens
gctgggagcagaccctccc

SEQ ID NO: 7036205 - DNA, 22 bp, Homo sapiens
gagggcacgaaacaaccacttc

SEQ ID NO: 7036206 - DNA, 22 bp, Homo sapiens
gagggcactcgagactacggca

SEQ ID NO: 7036207 - DNA, 22 bp, Homo sapiens
gagggcactgggtttcaatgtc

SEQ ID NO: 7036208 - DNA, 22 bp, Homo sapiens
gagggcacaaaggcaacattca

SEQ ID NO: 7036209 - DNA, 22 bp, Homo sapiens
gagctggggcggatactcagct

SEQ ID NO: 7036210 - DNA, 22 bp, Homo sapiens
gagcctggcctcctgcctcagc

SEQ ID NO: 7036211 - DNA, 22 bp, Homo sapiens
ctgtctccagggcaggtgcagg

SEQ ID NO: 7036212 - DNA, 22 bp, Homo sapiens
ctgtctcctccactgcatggga

SEQ ID NO: 7036213 - DNA, 22 bp, Homo sapiens
aggtggcagagtgacaggctga

SEQ ID NO: 7036214 - DNA, 22 bp, Homo sapiens
cctggggtcacttgcagccgca

SEQ ID NO: 7036215 - DNA, 22 bp, Homo sapiens
cctggggtcagggacgctgtgc

SEQ ID NO: 7036216 - DNA, 22 bp, Homo sapiens
cctgggtacccttggcggcctt

SEQ ID NO: 7036217 - DNA, 22 bp, Homo sapiens
ccctcagctccaccctcagcag

SEQ ID NO: 7036218 - DNA, 22 bp, Homo sapiens
ccctgccccaggcggcttcact

SEQ ID NO: 7036219 - DNA, 22 bp, Homo sapiens
agcctgggccctgcctcttctc

SEQ ID NO: 7036220 - DNA, 20 bp, Homo sapiens
agctcctggtataggtgcct

SEQ ID NO: 7036221 - DNA, 22 bp, Homo sapiens
agctcctgtctcaagggagcct

SEQ ID NO: 7036222 - DNA, 22 bp, Homo sapiens
agctcctgtgtgaagcctccct

SEQ ID NO: 7036223 - DNA, 21 bp, Homo sapiens
agagctgggacttgcctgaga

SEQ ID NO: 7036224 - DNA, 20 bp, Homo sapiens
agagctgggaagctccctat

SEQ ID NO: 7036225 - DNA, 22 bp, Homo sapiens
agagctgggaccgtctggaagt

SEQ ID NO: 7036226 - DNA, 22 bp, Homo sapiens
agagctggctgtgggtgacttt

SEQ ID NO: 7036227 - DNA, 22 bp, Homo sapiens
agagctggctggtagccctgat

SEQ ID NO: 7036228 - DNA, 22 bp, Homo sapiens
agagctggctgctgcggtgctt

SEQ ID NO: 7036229 - DNA, 22 bp, Homo sapiens
agagctggccagggatcactct

SEQ ID NO: 7036230 - DNA, 21 bp, Homo sapiens
agagctggcctgccaggccct

SEQ ID NO: 7036231 - DNA, 22 bp, Homo sapiens
agagctggacgtctgagcccta

SEQ ID NO: 7036232 - DNA, 22 bp, Homo sapiens
agagctggagatgcaggtttcg

SEQ ID NO: 7036233 - DNA, 22 bp, Homo sapiens
agagctggagcagccccactgg

SEQ ID NO: 7036234 - DNA, 22 bp, Homo sapiens
agagctggatggtcaagatggc

SEQ ID NO: 7036235 - DNA, 22 bp, Homo sapiens
agagctggcactgaccctcacc

SEQ ID NO: 7036236 - DNA, 22 bp, Homo sapiens
agagctggcagcagcttctcct

SEQ ID NO: 7036237 - DNA, 22 bp, Homo sapiens
agactttaatgtgcaaatgaaa

SEQ ID NO: 7036238 - DNA, 22 bp, Homo sapiens
atgcctggtcccacctctaggt

SEQ ID NO: 7036239 - DNA, 22 bp, Homo sapiens
acccatccagtgtccctgctag

SEQ ID NO: 7036240 - DNA, 22 bp, Homo sapiens
agccctgtagatttaggagagt

SEQ ID NO: 7036241 - DNA, 22 bp, Homo sapiens
agccctgtctctcactccaggt

SEQ ID NO: 7036242 - DNA, 17 bp, Homo sapiens
agccctgtgctcttttt

SEQ ID NO: 7036243 - DNA, 22 bp, Homo sapiens
agccctgtgggccttgtggcac

SEQ ID NO: 7036244 - DNA, 21 bp, Homo sapiens
accaggccaggaggctggcac

SEQ ID NO: 7036245 - DNA, 18 bp, Homo sapiens
aagctgggaaggagacag

SEQ ID NO: 7036246 - DNA, 22 bp, Homo sapiens
aagctgggacttagcgcagata

SEQ ID NO: 7036247 - DNA, 22 bp, Homo sapiens
aagctgggagggagcccagagt

SEQ ID NO: 7036248 - DNA, 20 bp, Homo sapiens
aagctgggtaggagaggagc

SEQ ID NO: 7036249 - DNA, 22 bp, Homo sapiens
aaaatagttaacgttcagagta

SEQ ID NO: 7036250 - DNA, 22 bp, Homo sapiens
aaatatgtatggagttcatgaa

SEQ ID NO: 7036251 - DNA, 22 bp, Homo sapiens
aaatatgttttccagttgtcat

SEQ ID NO: 7036252 - DNA, 19 bp, Homo sapiens
tccagcccctctgtgtgtg

SEQ ID NO: 7036253 - DNA, 22 bp, Homo sapiens
tccactggaacaactctgaggc

SEQ ID NO: 7036254 - DNA, 22 bp, Homo sapiens
tccactggcccacctcctcagt

SEQ ID NO: 7036255 - DNA, 22 bp, Homo sapiens
tccctgagctcacatggcagga

SEQ ID NO: 7036256 - DNA, 22 bp, Homo sapiens
tccctgaggaaggggtgtggtg

SEQ ID NO: 7036257 - DNA, 22 bp, Homo sapiens
tccctgtctaatatgccatgaa

SEQ ID NO: 7036258 - DNA, 22 bp, Homo sapiens
tagtcaaacctcagaatacccc

SEQ ID NO: 7036259 - DNA, 22 bp, Homo sapiens
gtgctgggctccaccccagagg

SEQ ID NO: 7036260 - DNA, 19 bp, Homo sapiens
gggctccttgggcctctct

SEQ ID NO: 7036261 - DNA, 22 bp, Homo sapiens
gggctcctcctctgactgtggc

SEQ ID NO: 7036262 - DNA, 21 bp, Homo sapiens
ggcatcccaggccagtgactg

SEQ ID NO: 7036263 - DNA, 22 bp, Homo sapiens
ggcatccctagaatagccaggt

SEQ ID NO: 7036264 - DNA, 22 bp, Homo sapiens
ggcatcccttcttccagtgtca

SEQ ID NO: 7036265 - DNA, 22 bp, Homo sapiens
ggcatcctgggactggcttctt

SEQ ID NO: 7036266 - DNA, 22 bp, Homo sapiens
gctgggaggatctctccctgtc

SEQ ID NO: 7036267 - DNA, 22 bp, Homo sapiens
gcccatggcagaactgtgagca

SEQ ID NO: 7036268 - DNA, 22 bp, Homo sapiens
gcagagctgcagcgaggcctgg

SEQ ID NO: 7036269 - DNA, 22 bp, Homo sapiens
ctgtcacccacccagcctgtca

SEQ ID NO: 7036270 - DNA, 22 bp, Homo sapiens
ctgggcttgtgttagctgacaa

SEQ ID NO: 7036271 - DNA, 22 bp, Homo sapiens
ctggtgcacattcgctctcata

SEQ ID NO: 7036272 - DNA, 22 bp, Homo sapiens
ctgggctagaaggaccaggatg

SEQ ID NO: 7036273 - DNA, 19 bp, Homo sapiens
ctgctccctccttctggca

SEQ ID NO: 7036274 - DNA, 22 bp, Homo sapiens
cctgtggagctttcagcagctc

SEQ ID NO: 7036275 - DNA, 20 bp, Homo sapiens
cctgtggagctgcctcctcc

SEQ ID NO: 7036276 - DNA, 22 bp, Homo sapiens
cctggggagagaaagcccagcc

SEQ ID NO: 7036277 - DNA, 22 bp, Homo sapiens
cctggggagccgcctgagcccc

SEQ ID NO: 7036278 - DNA, 22 bp, Homo sapiens
cctgcagggtgctgccacagat

SEQ ID NO: 7036279 - DNA, 22 bp, Homo sapiens
cctgcaggtccccggatgcgca

SEQ ID NO: 7036280 - DNA, 22 bp, Homo sapiens
cctgcaggttgcagaggcggaa

SEQ ID NO: 7036281 - DNA, 22 bp, Homo sapiens
cctgcaggtttcccccggacgg

SEQ ID NO: 7036282 - DNA, 22 bp, Homo sapiens
tgggctccggcggcctcaggct

SEQ ID NO: 7036283 - DNA, 22 bp, Homo sapiens
cctgcaggctgcaggccagttc

SEQ ID NO: 7036284 - DNA, 22 bp, Homo sapiens
cctgcagggaatcgaggcagaa

SEQ ID NO: 7036285 - DNA, 22 bp, Homo sapiens
cctctcccgggtgccgctgggc

SEQ ID NO: 7036286 - DNA, 22 bp, Homo sapiens
tgctgggggtgtctcaccaggc

SEQ ID NO: 7036287 - DNA, 18 bp, Homo sapiens
tgctggggtagaatccac

SEQ ID NO: 7036288 - DNA, 22 bp, Homo sapiens
tcctgagggctcggggctcatg

SEQ ID NO: 7036289 - DNA, 22 bp, Homo sapiens
cagagctgcaaatgcccctccg

SEQ ID NO: 7036290 - DNA, 22 bp, Homo sapiens
cagagctggtgtgtcctggcat

SEQ ID NO: 7036291 - DNA, 22 bp, Homo sapiens
cactgcactccatcctgggaaa

SEQ ID NO: 7036292 - DNA, 22 bp, Homo sapiens
caccaggctggagtgcagtggc

SEQ ID NO: 7036293 - DNA, 20 bp, Homo sapiens
ggcagagctatgtctgttgc

SEQ ID NO: 7036294 - DNA, 19 bp, Homo sapiens
ggcagagctcctgctttct

SEQ ID NO: 7036295 - DNA, 17 bp, Homo sapiens
ggcagagctgacagggc

SEQ ID NO: 7036296 - DNA, 22 bp, Homo sapiens
ggcagagctgcatgagcactca

SEQ ID NO: 7036297 - DNA, 22 bp, Homo sapiens
ggcagagccttctggagctcgc

SEQ ID NO: 7036298 - DNA, 22 bp, Homo sapiens
ggcacagggggctgaggactag

SEQ ID NO: 7036299 - DNA, 22 bp, Homo sapiens
cacagctgtcagctgacctagg

SEQ ID NO: 7036300 - DNA, 21 bp, Homo sapiens
gcagagctggaaccaggaccc

SEQ ID NO: 7036301 - DNA, 22 bp, Homo sapiens
gcagagctgggatatgaaccca

SEQ ID NO: 7036302 - DNA, 18 bp, Homo sapiens
gcagagctgggattccca

SEQ ID NO: 7036303 - DNA, 22 bp, Homo sapiens
gcagagcttctgtccttcagga

SEQ ID NO: 7036304 - DNA, 22 bp, Homo sapiens
gcagcaggcttttcataccttg

SEQ ID NO: 7036305 - DNA, 21 bp, Homo sapiens
gagctgggcgaggctccgggg

SEQ ID NO: 7036306 - DNA, 22 bp, Homo sapiens
gagctgggctggcttcctccct

SEQ ID NO: 7036307 - DNA, 22 bp, Homo sapiens
gagctggggcagcttaggagtg

SEQ ID NO: 7036308 - DNA, 22 bp, Homo sapiens
gagctgggcgagccggggaagt

SEQ ID NO: 7036309 - DNA, 22 bp, Homo sapiens
gagctgggcctgcgagtgctgc

SEQ ID NO: 7036310 - DNA, 22 bp, Homo sapiens
ctgcagagcagccagtccccca

SEQ ID NO: 7036311 - DNA, 22 bp, Homo sapiens
ctcagcctgtgaagagcagagg

SEQ ID NO: 7036312 - DNA, 22 bp, Homo sapiens
cctgggacctcgcgggaagcgg

SEQ ID NO: 7036313 - DNA, 22 bp, Homo sapiens
ccctgtggttgctagggcacag

SEQ ID NO: 7036314 - DNA, 22 bp, Homo sapiens
ccaggccctgcctgtggttcct

SEQ ID NO: 7036315 - DNA, 22 bp, Homo sapiens
ccaggcccttgcaagtcccacc

SEQ ID NO: 7036316 - DNA, 21 bp, Homo sapiens
caggccccaggcctggggtgc

SEQ ID NO: 7036317 - DNA, 23 bp, Homo sapiens
agctggaggctgtctactcccaa

SEQ ID NO: 7036318 - DNA, 22 bp, Homo sapiens
cagctcctgcctgggcagctgt

SEQ ID NO: 7036319 - DNA, 22 bp, Homo sapiens
cagagctggagggaaccctggc

SEQ ID NO: 7036320 - DNA, 20 bp, Homo sapiens
agggcagcttgaggagccgg

SEQ ID NO: 7036321 - DNA, 22 bp, Homo sapiens
agctggggctgcagagaacagg

SEQ ID NO: 7036322 - DNA, 22 bp, Homo sapiens
agctggggctgtggttgtgatt

SEQ ID NO: 7036323 - DNA, 22 bp, Homo sapiens
agctgggggtagtgagaaataa

SEQ ID NO: 7036324 - DNA, 22 bp, Homo sapiens
agctgggggttggataagggta

SEQ ID NO: 7036325 - DNA, 22 bp, Homo sapiens
agctggggttgcacacattttg

SEQ ID NO: 7036326 - DNA, 22 bp, Homo sapiens
agccctgtttatgccacatcat

SEQ ID NO: 7036327 - DNA, 20 bp, Homo sapiens
agccctgtttcctggagaga

SEQ ID NO: 7036328 - DNA, 22 bp, Homo sapiens
agctcctgcaccaggggcccct

SEQ ID NO: 7036329 - DNA, 22 bp, Homo sapiens
agctcctgcgcacggtgcacac

SEQ ID NO: 7036330 - DNA, 22 bp, Homo sapiens
aatgattgtcattccaaaaagt

SEQ ID NO: 7036331 - DNA, 22 bp, Homo sapiens
gtctggggtactttcatctgat

SEQ ID NO: 7036332 - DNA, 22 bp, Homo sapiens
ggaggccacctgacctgctgtt

SEQ ID NO: 7036333 - DNA, 22 bp, Homo sapiens
ggaggccacggtttagcaccga

SEQ ID NO: 7036334 - DNA, 22 bp, Homo sapiens
ggaggccaggaagagccgccct

SEQ ID NO: 7036335 - DNA, 22 bp, Homo sapiens
gcttcctggagggagagagctg

SEQ ID NO: 7036336 - DNA, 22 bp, Homo sapiens
gctgggctcttatcacctgtac

SEQ ID NO: 7036337 - DNA, 22 bp, Homo sapiens
gctgggctctttacccctgtac

SEQ ID NO: 7036338 - DNA, 22 bp, Homo sapiens
gcctgtggggctgaggctgcct

SEQ ID NO: 7036339 - DNA, 22 bp, Homo sapiens
gcccttggaacagcctcctgct

SEQ ID NO: 7036340 - DNA, 22 bp, Homo sapiens
gcccttgggaggttccactggg

SEQ ID NO: 7036341 - DNA, 16 bp, Homo sapiens
gcagagctcagggact

SEQ ID NO: 7036342 - DNA, 22 bp, Homo sapiens
gcagagctcatgcctgcacctc

SEQ ID NO: 7036343 - DNA, 22 bp, Homo sapiens
gcagagctccccaagacaccaa

SEQ ID NO: 7036344 - DNA, 22 bp, Homo sapiens
gcaggagctcgtttccaggctg

SEQ ID NO: 7036345 - DNA, 22 bp, Homo sapiens
gcaggagctgctctcctgacga

SEQ ID NO: 7036346 - DNA, 22 bp, Homo sapiens
gcaccgagaaggaagcatgcct

SEQ ID NO: 7036347 - DNA, 22 bp, Homo sapiens
gatgctggaagtgctgatcttg

SEQ ID NO: 7036348 - DNA, 22 bp, Homo sapiens
gagctgggaggactgggaactt

SEQ ID NO: 7036349 - DNA, 22 bp, Homo sapiens
gagctgggagttatagcatgtt

SEQ ID NO: 7036350 - DNA, 22 bp, Homo sapiens
gagctgggacttggaatccaca

SEQ ID NO: 7036351 - DNA, 18 bp, Homo sapiens
gagctgggagaaggaagg

SEQ ID NO: 7036352 - DNA, 22 bp, Homo sapiens
gagctgggagctgggatttgga

SEQ ID NO: 7036353 - DNA, 23 bp, Homo sapiens
gagctgggatacaggcttactgc

SEQ ID NO: 7036354 - DNA, 22 bp, Homo sapiens
gagctgggattcatctatgtct

SEQ ID NO: 7036355 - DNA, 22 bp, Homo sapiens
gagctgggacatgggtcctctc

SEQ ID NO: 7036356 - DNA, 22 bp, Homo sapiens
gagctgggaagatagcttgagc

SEQ ID NO: 7036357 - DNA, 22 bp, Homo sapiens
gaccaggcttccccagacctca

SEQ ID NO: 7036358 - DNA, 22 bp, Homo sapiens
ctgcagaggcctcgcctcctct

SEQ ID NO: 7036359 - DNA, 22 bp, Homo sapiens
ctgcagagtggagcctcggctg

SEQ ID NO: 7036360 - DNA, 19 bp, Homo sapiens
cctggccctgctgcgcggg

SEQ ID NO: 7036361 - DNA, 22 bp, Homo sapiens
cctggcagcaggtgggcccgtg

SEQ ID NO: 7036362 - DNA, 22 bp, Homo sapiens
cctggagcaaaaatctaaggag

SEQ ID NO: 7036363 - DNA, 22 bp, Homo sapiens
cctggagcacatggcaggaggc

SEQ ID NO: 7036364 - DNA, 23 bp, Homo sapiens
tcctggtgacatgcctgagcatc

SEQ ID NO: 7036365 - DNA, 22 bp, Homo sapiens
tcctgcagttacatcccagcca

SEQ ID NO: 7036366 - DNA, 20 bp, Homo sapiens
tccctgccttttactgctgg

SEQ ID NO: 7036367 - DNA, 22 bp, Homo sapiens
ccagcccctatcctcgctccac

SEQ ID NO: 7036368 - DNA, 21 bp, Homo sapiens
tgggcaccaaaacctaggagt

SEQ ID NO: 7036369 - DNA, 22 bp, Homo sapiens
tgggcacctagcaacccttctc

SEQ ID NO: 7036370 - DNA, 22 bp, Homo sapiens
tgggcacctgaggcctggcagg

SEQ ID NO: 7036371 - DNA, 23 bp, Homo sapiens
tggcaccaggcattctaggggta

SEQ ID NO: 7036372 - DNA, 22 bp, Homo sapiens
tggcaccaggcggggtggctgt

SEQ ID NO: 7036373 - DNA, 20 bp, Homo sapiens
tggcaccaggtggtggcccc

SEQ ID NO: 7036374 - DNA, 17 bp, Homo sapiens
tggcacagaggtgctat

SEQ ID NO: 7036375 - DNA, 20 bp, Homo sapiens
tgctggggacatacagggtg

SEQ ID NO: 7036376 - DNA, 22 bp, Homo sapiens
tgctggggcagaagagccaaga

SEQ ID NO: 7036377 - DNA, 22 bp, Homo sapiens
tgctggggctctgaccactcca

SEQ ID NO: 7036378 - DNA, 22 bp, Homo sapiens
tgctgggctggagctgccaggg

SEQ ID NO: 7036379 - DNA, 22 bp, Homo sapiens
tgctgaggcccaggagcacttt

SEQ ID NO: 7036380 - DNA, 22 bp, Homo sapiens
tgcaggagcaccagctcaccct

SEQ ID NO: 7036381 - DNA, 20 bp, Homo sapiens
tgcagagctgacattacctg

SEQ ID NO: 7036382 - DNA, 22 bp, Homo sapiens
tgcagagcttcattgcataggc

SEQ ID NO: 7036383 - DNA, 22 bp, Homo sapiens
tctggggttttcacgctgtctc

SEQ ID NO: 7036384 - DNA, 22 bp, Homo sapiens
tctgcaggtcacgctccagcct

SEQ ID NO: 7036385 - DNA, 22 bp, Homo sapiens
tctcagcctcacctctatggag

SEQ ID NO: 7036386 - DNA, 22 bp, Homo sapiens
tcctgtggcgttatcatgtgat

SEQ ID NO: 7036387 - DNA, 22 bp, Homo sapiens
tcctgtggctctgtggaacctt

SEQ ID NO: 7036388 - DNA, 22 bp, Homo sapiens
tcctgtggggaaaagcctatct

SEQ ID NO: 7036389 - DNA, 22 bp, Homo sapiens
tcctggtggtgccggtgcccgg

SEQ ID NO: 7036390 - DNA, 22 bp, Homo sapiens
aatcagttgtccaaagttcaca

SEQ ID NO: 7036391 - DNA, 22 bp, Homo sapiens
actgggctgcttgagtgccttc

SEQ ID NO: 7036392 - DNA, 22 bp, Homo sapiens
actgggcttcacttggcacatc

SEQ ID NO: 7036393 - DNA, 22 bp, Homo sapiens
aatatagaatcactttccttca

SEQ ID NO: 7036394 - DNA, 22 bp, Homo sapiens
aatatagaatcactttccttca

SEQ ID NO: 7036395 - DNA, 22 bp, Homo sapiens
aatatagttctagaaatatttt

SEQ ID NO: 7036396 - DNA, 22 bp, Homo sapiens
actgttcatattcttagaaatt

SEQ ID NO: 7036397 - DNA, 22 bp, Homo sapiens
actgttcatcctttttgaacaa

SEQ ID NO: 7036398 - DNA, 21 bp, Homo sapiens
actgttcatctgttcagaagc

SEQ ID NO: 7036399 - DNA, 22 bp, Homo sapiens
actttaaaactgatcatcagag

SEQ ID NO: 7036400 - DNA, 21 bp, Homo sapiens
actttatgacctacccttttt

SEQ ID NO: 7036401 - DNA, 20 bp, Homo sapiens
actttatgagttcaattttg

SEQ ID NO: 7036402 - DNA, 22 bp, Homo sapiens
actttatgatacagggaagggt

SEQ ID NO: 7036403 - DNA, 22 bp, Homo sapiens
actttatgctaaactttactct

SEQ ID NO: 7036404 - DNA, 22 bp, Homo sapiens
actttatgtgcttgctctttcc

SEQ ID NO: 7036405 - DNA, 22 bp, Homo sapiens
actttatgtttgatatctatgg

SEQ ID NO: 7036406 - DNA, 23 bp, Homo sapiens
actttattgaccccaggtcagtt

SEQ ID NO: 7036407 - DNA, 22 bp, Homo sapiens
actttatttcctattgcatcca

SEQ ID NO: 7036408 - DNA, 22 bp, Homo sapiens
actttcttcttatgcattaagg

SEQ ID NO: 7036409 - DNA, 22 bp, Homo sapiens
actttcttggtcccatgtttga

SEQ ID NO: 7036410 - DNA, 22 bp, Homo sapiens
acctacagagatctgcattttt

SEQ ID NO: 7036411 - DNA, 22 bp, Homo sapiens
acctacagatctttgaatgtgt

SEQ ID NO: 7036412 - DNA, 22 bp, Homo sapiens
aagtctctaagactgtgccatc

SEQ ID NO: 7036413 - DNA, 22 bp, Homo sapiens
aagtctctcacatatctggtcc

SEQ ID NO: 7036414 - DNA, 22 bp, Homo sapiens
aagtctctcatggctgacagca

SEQ ID NO: 7036415 - DNA, 22 bp, Homo sapiens
aagtctctctgtgtgggataag

SEQ ID NO: 7036416 - DNA, 18 bp, Homo sapiens
aagtctctgaaagctttt

SEQ ID NO: 7036417 - DNA, 22 bp, Homo sapiens
aagtctctgactcacacaatgt

SEQ ID NO: 7036418 - DNA, 22 bp, Homo sapiens
aagtctctgatgtgtgttaggt

SEQ ID NO: 7036419 - DNA, 22 bp, Homo sapiens
aagtctctggcaaatgatcttg

SEQ ID NO: 7036420 - DNA, 22 bp, Homo sapiens
aagtctctggtgatgcaggaaa

SEQ ID NO: 7036421 - DNA, 22 bp, Homo sapiens
aagtctctggttgcttgcatgg

SEQ ID NO: 7036422 - DNA, 22 bp, Homo sapiens
aagtctcttagtaatatccaac

SEQ ID NO: 7036423 - DNA, 22 bp, Homo sapiens
aagtctcttcctctgccaaaga

SEQ ID NO: 7036424 - DNA, 22 bp, Homo sapiens
aagtctctttacctctccaggc

SEQ ID NO: 7036425 - DNA, 22 bp, Homo sapiens
aagtctctttgggtactttatt

SEQ ID NO: 7036426 - DNA, 22 bp, Homo sapiens
actagttttccataatatagga

SEQ ID NO: 7036427 - DNA, 22 bp, Homo sapiens
actataacctgttagaatagat

SEQ ID NO: 7036428 - DNA, 22 bp, Homo sapiens
actatacaccaaaatattaagg

SEQ ID NO: 7036429 - DNA, 22 bp, Homo sapiens
actctcaaaaagagtagcagtt

SEQ ID NO: 7036430 - DNA, 22 bp, Homo sapiens
actctgcttgggccatatctgg

SEQ ID NO: 7036431 - DNA, 22 bp, Homo sapiens
actgagactttgttgagttctt

SEQ ID NO: 7036432 - DNA, 22 bp, Homo sapiens
actgcactccagcctcggggtc

SEQ ID NO: 7036433 - DNA, 22 bp, Homo sapiens
actgcactccagcctgggtaac

SEQ ID NO: 7036434 - DNA, 22 bp, Homo sapiens
actgcactccagcctgggtgac

SEQ ID NO: 7036435 - DNA, 22 bp, Homo sapiens
actggacagaggaaatatggag

SEQ ID NO: 7036436 - DNA, 22 bp, Homo sapiens
acatttctcttgatgtctctat

SEQ ID NO: 7036437 - DNA, 22 bp, Homo sapiens
acattgttctacttctagttag

SEQ ID NO: 7036438 - DNA, 22 bp, Homo sapiens
acattgttgtgcaattatagtt

SEQ ID NO: 7036439 - DNA, 22 bp, Homo sapiens
aaggctcaattaactaagaagt

SEQ ID NO: 7036440 - DNA, 22 bp, Homo sapiens
aaggctcagctactcagcctgc

SEQ ID NO: 7036441 - DNA, 22 bp, Homo sapiens
acatttgtttctctagagtagg

SEQ ID NO: 7036442 - DNA, 22 bp, Homo sapiens
acattttacagttgtctggcta

SEQ ID NO: 7036443 - DNA, 22 bp, Homo sapiens
acccagagtaacagatggattc

SEQ ID NO: 7036444 - DNA, 22 bp, Homo sapiens
acatatgagtactatacagtgc

SEQ ID NO: 7036445 - DNA, 22 bp, Homo sapiens
acatatgatattgaggatctca

SEQ ID NO: 7036446 - DNA, 22 bp, Homo sapiens
acatatgtatatgtacacagtc

SEQ ID NO: 7036447 - DNA, 22 bp, Homo sapiens
aaggcagagattagcagaatga

SEQ ID NO: 7036448 - DNA, 22 bp, Homo sapiens
acagtgtttggcaatgcatgca

SEQ ID NO: 7036449 - DNA, 22 bp, Homo sapiens
aaggaggaatgtagccagctcc

SEQ ID NO: 7036450 - DNA, 22 bp, Homo sapiens
acagtgtttatgtacagattgt

SEQ ID NO: 7036451 - DNA, 20 bp, Homo sapiens
acatatgaatgatagagcca

SEQ ID NO: 7036452 - DNA, 22 bp, Homo sapiens
acagtctttctacattctgtgc

SEQ ID NO: 7036453 - DNA, 22 bp, Homo sapiens
acagtctttagagtattgtcct

SEQ ID NO: 7036454 - DNA, 22 bp, Homo sapiens
acagtcttcagaagggattggg

SEQ ID NO: 7036455 - DNA, 22 bp, Homo sapiens
acagtcttgcacttctatcagc

SEQ ID NO: 7036456 - DNA, 22 bp, Homo sapiens
acagtctttaatttctttgtgg

SEQ ID NO: 7036457 - DNA, 22 bp, Homo sapiens
aaggagagtacaggagttggta

SEQ ID NO: 7036458 - DNA, 21 bp, Homo sapiens
aaggagcctaggaggctcagg

SEQ ID NO: 7036459 - DNA, 22 bp, Homo sapiens
aagctcaggaaagagtctggtt

SEQ ID NO: 7036460 - DNA, 23 bp, Homo sapiens
acagggaaaagtcatcagtgtga

SEQ ID NO: 7036461 - DNA, 22 bp, Homo sapiens
aagctaagtggaagtcttatca

SEQ ID NO: 7036462 - DNA, 22 bp, Homo sapiens
aagctaggcctcagtttcctga

SEQ ID NO: 7036463 - DNA, 22 bp, Homo sapiens
aagcatttgtgaaattcagatg

SEQ ID NO: 7036464 - DNA, 22 bp, Homo sapiens
aagcattttgccacttgaagtt

SEQ ID NO: 7036465 - DNA, 22 bp, Homo sapiens
acagatgtaccttagtgatggg

SEQ ID NO: 7036466 - DNA, 22 bp, Homo sapiens
acagatgtggagtttgcatgat

SEQ ID NO: 7036467 - DNA, 22 bp, Homo sapiens
agcctcctggagtttctgggat

SEQ ID NO: 7036468 - DNA, 22 bp, Homo sapiens
agcctctctccagcttggcaga

SEQ ID NO: 7036469 - DNA, 22 bp, Homo sapiens
agcctctctgatgtgacagcta

SEQ ID NO: 7036470 - DNA, 22 bp, Homo sapiens
agcctctgatgatcacaggggg

SEQ ID NO: 7036471 - DNA, 22 bp, Homo sapiens
acagatgagttaaagcagagtg

SEQ ID NO: 7036472 - DNA, 22 bp, Homo sapiens
acacttttgtgtatatccagtt

SEQ ID NO: 7036473 - DNA, 22 bp, Homo sapiens
acacttttgtttgaagtctcca

SEQ ID NO: 7036474 - DNA, 22 bp, Homo sapiens
acagaaaaatgagggagctgga

SEQ ID NO: 7036475 - DNA, 22 bp, Homo sapiens
acagaaaagtttacttttgctc

SEQ ID NO: 7036476 - DNA, 22 bp, Homo sapiens
acagaaaatgccagaagggtgg

SEQ ID NO: 7036477 - DNA, 22 bp, Homo sapiens
acagagaaactaaggagtttgg

SEQ ID NO: 7036478 - DNA, 22 bp, Homo sapiens
acactttagaaaaaagaatggt

SEQ ID NO: 7036479 - DNA, 22 bp, Homo sapiens
acacattataggcaatcaaaag

SEQ ID NO: 7036480 - DNA, 22 bp, Homo sapiens
acactcagtaaacgacaatggg

SEQ ID NO: 7036481 - DNA, 23 bp, Homo sapiens
acactcttcccagaaggttctga

SEQ ID NO: 7036482 - DNA, 22 bp, Homo sapiens
acactcttctcacagtcagttt

SEQ ID NO: 7036483 - DNA, 22 bp, Homo sapiens
acactcttgcattacctgaata

SEQ ID NO: 7036484 - DNA, 22 bp, Homo sapiens
acactctttcactaccttaatt

SEQ ID NO: 7036485 - DNA, 22 bp, Homo sapiens
acactctttctgtgggtcacat

SEQ ID NO: 7036486 - DNA, 22 bp, Homo sapiens
acactctttttgtggttgtcta

SEQ ID NO: 7036487 - DNA, 22 bp, Homo sapiens
acacatgtatgttttgtatttg

SEQ ID NO: 7036488 - DNA, 22 bp, Homo sapiens
agcagcaaaagagaatagtttg

SEQ ID NO: 7036489 - DNA, 22 bp, Homo sapiens
acacagaagatctcttaatgct

SEQ ID NO: 7036490 - DNA, 22 bp, Homo sapiens
acacagagcttctcaactggga

SEQ ID NO: 7036491 - DNA, 22 bp, Homo sapiens
acacagaggcatgacagtggct

SEQ ID NO: 7036492 - DNA, 22 bp, Homo sapiens
acacagagtttgacacatggga

SEQ ID NO: 7036493 - DNA, 22 bp, Homo sapiens
agagccagttgttaagcactta

SEQ ID NO: 7036494 - DNA, 22 bp, Homo sapiens
aattctgatccagaacctgtca

SEQ ID NO: 7036495 - DNA, 22 bp, Homo sapiens
agagccaggtgtagtctcggag

SEQ ID NO: 7036496 - DNA, 22 bp, Homo sapiens
agagccagttaagcacttacag

SEQ ID NO: 7036497 - DNA, 22 bp, Homo sapiens
agagccagttacaactgtggag

SEQ ID NO: 7036498 - DNA, 22 bp, Homo sapiens
agaccctctccatgcccactgc

SEQ ID NO: 7036499 - DNA, 22 bp, Homo sapiens
agacaaaccttgttttatgatg

SEQ ID NO: 7036500 - DNA, 22 bp, Homo sapiens
agacaattaaaaaattatgctt

SEQ ID NO: 7036501 - DNA, 22 bp, Homo sapiens
agacaattgttctaagtaaaaa

SEQ ID NO: 7036502 - DNA, 22 bp, Homo sapiens
aatggcagaatgggccagaagc

SEQ ID NO: 7036503 - DNA, 22 bp, Homo sapiens
aatggcagaggcaaagatggta

SEQ ID NO: 7036504 - DNA, 22 bp, Homo sapiens
aatgggcacacttagagagtaa

SEQ ID NO: 7036505 - DNA, 22 bp, Homo sapiens
aatgggcatttgtttgtggtac

SEQ ID NO: 7036506 - DNA, 20 bp, Homo sapiens
aattctgtcttttctgctgc

SEQ ID NO: 7036507 - DNA, 22 bp, Homo sapiens
aattcttgttgttagtatattt

SEQ ID NO: 7036508 - DNA, 22 bp, Homo sapiens
aattgcataaaattcaactctg

SEQ ID NO: 7036509 - DNA, 22 bp, Homo sapiens
aattgcataaatttcatagcat

SEQ ID NO: 7036510 - DNA, 22 bp, Homo sapiens
aattgcatatatatgaggccat

SEQ ID NO: 7036511 - DNA, 22 bp, Homo sapiens
aattgcatgttaatgactaagt

SEQ ID NO: 7036512 - DNA, 22 bp, Homo sapiens
aattgcattacagaaactttca

SEQ ID NO: 7036513 - DNA, 22 bp, Homo sapiens
agaggccctctctctcctgatg

SEQ ID NO: 7036514 - DNA, 22 bp, Homo sapiens
agaggccctctctgctcagtct

SEQ ID NO: 7036515 - DNA, 18 bp, Homo sapiens
agaggctcgatactagaa

SEQ ID NO: 7036516 - DNA, 22 bp, Homo sapiens
agaggctctaatcccctccaca

SEQ ID NO: 7036517 - DNA, 22 bp, Homo sapiens
acaaagcttagacctaagagat

SEQ ID NO: 7036518 - DNA, 22 bp, Homo sapiens
acaaaggttgggtcaattgtcc

SEQ ID NO: 7036519 - DNA, 22 bp, Homo sapiens
agagggggaaaatagaggtgtt

SEQ ID NO: 7036520 - DNA, 22 bp, Homo sapiens
agataatgattctgcatttcta

SEQ ID NO: 7036521 - DNA, 22 bp, Homo sapiens
agataatggagggatttgcatt

SEQ ID NO: 7036522 - DNA, 22 bp, Homo sapiens
acaagactgtgctctaagagtg

SEQ ID NO: 7036523 - DNA, 23 bp, Homo sapiens
acaagatagggataaaaagataa

SEQ ID NO: 7036524 - DNA, 21 bp, Homo sapiens
acacaaacctcctcagcctgg

SEQ ID NO: 7036525 - DNA, 22 bp, Homo sapiens
acacaaagttggatgacaaaat

SEQ ID NO: 7036526 - DNA, 22 bp, Homo sapiens
acacaaagttggatgacaaaat

SEQ ID NO: 7036527 - DNA, 22 bp, Homo sapiens
aagagcaacttggaaacactca

SEQ ID NO: 7036528 - DNA, 22 bp, Homo sapiens
acacaaaatcaaagtcctaggc

SEQ ID NO: 7036529 - DNA, 22 bp, Homo sapiens
aattttaagcatatgactggtt

SEQ ID NO: 7036530 - DNA, 22 bp, Homo sapiens
aattttaatcagtggtgctgag

SEQ ID NO: 7036531 - DNA, 22 bp, Homo sapiens
aattttaatcagtggtgctgag

SEQ ID NO: 7036532 - DNA, 22 bp, Homo sapiens
aattttacttccctcagtgtag

SEQ ID NO: 7036533 - DNA, 20 bp, Homo sapiens
aattttatctccatcctttg

SEQ ID NO: 7036534 - DNA, 20 bp, Homo sapiens
aattttatctccatcctttg

SEQ ID NO: 7036535 - DNA, 22 bp, Homo sapiens
aattttatctctaagcaggctt

SEQ ID NO: 7036536 - DNA, 22 bp, Homo sapiens
aagaaacaaccactgctctcct

SEQ ID NO: 7036537 - DNA, 22 bp, Homo sapiens
aagaaaacatgatctaatttaa

SEQ ID NO: 7036538 - DNA, 22 bp, Homo sapiens
aagaaaacatgatctaatttaa

SEQ ID NO: 7036539 - DNA, 22 bp, Homo sapiens
aagaaaagaaacctgaggcttt

SEQ ID NO: 7036540 - DNA, 22 bp, Homo sapiens
aactggtagctgattaagtata

SEQ ID NO: 7036541 - DNA, 22 bp, Homo sapiens
aactttcttggatgtctcaaca

SEQ ID NO: 7036542 - DNA, 20 bp, Homo sapiens
aagaaacttgaaagtacaag

SEQ ID NO: 7036543 - DNA, 22 bp, Homo sapiens
aattcctttggatcttctggag

SEQ ID NO: 7036544 - DNA, 22 bp, Homo sapiens
aatttcactggaaaagataatt

SEQ ID NO: 7036545 - DNA, 22 bp, Homo sapiens
acacatttacatgtttacgtat

SEQ ID NO: 7036546 - DNA, 22 bp, Homo sapiens
acacatttattacatgcatgtg

SEQ ID NO: 7036547 - DNA, 22 bp, Homo sapiens
aagatgcggttgaccatggtgt

SEQ ID NO: 7036548 - DNA, 22 bp, Homo sapiens
aagcaataaataatttttagta

SEQ ID NO: 7036549 - DNA, 22 bp, Homo sapiens
aagcaataatcccaaagtgctg

SEQ ID NO: 7036550 - DNA, 22 bp, Homo sapiens
aagcaatagggtaatctactca

SEQ ID NO: 7036551 - DNA, 22 bp, Homo sapiens
aagcaatatactgatatgatta

SEQ ID NO: 7036552 - DNA, 20 bp, Homo sapiens
aagcaatatagtgcaaatgt

SEQ ID NO: 7036553 - DNA, 22 bp, Homo sapiens
aagcaatttgacagtacatatc

SEQ ID NO: 7036554 - DNA, 22 bp, Homo sapiens
aagcagaggtagggtgtgcagt

SEQ ID NO: 7036555 - DNA, 22 bp, Homo sapiens
acagcaaaagacaagaacttaa

SEQ ID NO: 7036556 - DNA, 22 bp, Homo sapiens
aaattattctcatgtgtttctt

SEQ ID NO: 7036557 - DNA, 18 bp, Homo sapiens
aaattattcttccttttc

SEQ ID NO: 7036558 - DNA, 18 bp, Homo sapiens
aaattattcttccttttc

SEQ ID NO: 7036559 - DNA, 23 bp, Homo sapiens
aaattattgctcttcaattgcct

SEQ ID NO: 7036560 - DNA, 23 bp, Homo sapiens
aaattattgctcttcaattgcct

SEQ ID NO: 7036561 - DNA, 22 bp, Homo sapiens
aaattattgggtcccaccccag

SEQ ID NO: 7036562 - DNA, 22 bp, Homo sapiens
aaattattttcagaatggagaa

SEQ ID NO: 7036563 - DNA, 22 bp, Homo sapiens
aaattattttcagaatggagaa

SEQ ID NO: 7036564 - DNA, 22 bp, Homo sapiens
aaattcaattaactttcatgct

SEQ ID NO: 7036565 - DNA, 22 bp, Homo sapiens
aaattattcaaaaagctgtgtt

SEQ ID NO: 7036566 - DNA, 22 bp, Homo sapiens
aaattattcaaaaagctgtgtt

SEQ ID NO: 7036567 - DNA, 22 bp, Homo sapiens
aaatgcattctgttttcactag

SEQ ID NO: 7036568 - DNA, 22 bp, Homo sapiens
aaatgcatttcactaatgtttc

SEQ ID NO: 7036569 - DNA, 22 bp, Homo sapiens
aaatgcatttttaattagaccc

SEQ ID NO: 7036570 - DNA, 22 bp, Homo sapiens
aaatgtcaaggtgatagatgca

SEQ ID NO: 7036571 - DNA, 22 bp, Homo sapiens
aaatgtcagaaaacatggagtg

SEQ ID NO: 7036572 - DNA, 22 bp, Homo sapiens
aaatgtcagaagctttacttct

SEQ ID NO: 7036573 - DNA, 22 bp, Homo sapiens
aaatgtcagaggaacatattga

SEQ ID NO: 7036574 - DNA, 22 bp, Homo sapiens
aaatgtcagaggaacatattga

SEQ ID NO: 7036575 - DNA, 22 bp, Homo sapiens
aaatttcttgaggctctctagc

SEQ ID NO: 7036576 - DNA, 22 bp, Homo sapiens
aaatttgtcaacttcatatgtt

SEQ ID NO: 7036577 - DNA, 22 bp, Homo sapiens
aaatttgtattccttttccgta

SEQ ID NO: 7036578 - DNA, 22 bp, Homo sapiens
aaattttaaggctggaacttaa

SEQ ID NO: 7036579 - DNA, 22 bp, Homo sapiens
aacacaggaggctatgttttct

SEQ ID NO: 7036580 - DNA, 22 bp, Homo sapiens
aacacaggcatactggctccag

SEQ ID NO: 7036581 - DNA, 22 bp, Homo sapiens
aacagaatagttgatgtacagt

SEQ ID NO: 7036582 - DNA, 22 bp, Homo sapiens
aacagaatagttgatgtacagt

SEQ ID NO: 7036583 - DNA, 22 bp, Homo sapiens
aacagaatatcaaaagattatg

SEQ ID NO: 7036584 - DNA, 22 bp, Homo sapiens
aagtgtcaatatttttgtaggt

SEQ ID NO: 7036585 - DNA, 22 bp, Homo sapiens
aatagactttgtataatttccc

SEQ ID NO: 7036586 - DNA, 22 bp, Homo sapiens
aatagatactacttagatgtag

SEQ ID NO: 7036587 - DNA, 22 bp, Homo sapiens
aacatgtatcgctttttaatat

SEQ ID NO: 7036588 - DNA, 22 bp, Homo sapiens
aacatgttgctttaataatatt

SEQ ID NO: 7036589 - DNA, 22 bp, Homo sapiens
aacctcaggctctctggacaat

SEQ ID NO: 7036590 - DNA, 22 bp, Homo sapiens
aacctgctttctcagagaaggg

SEQ ID NO: 7036591 - DNA, 22 bp, Homo sapiens
aaccttgaatacttaaatacat

SEQ ID NO: 7036592 - DNA, 22 bp, Homo sapiens
aatgaacaacactgaaggaaga

SEQ ID NO: 7036593 - DNA, 22 bp, Homo sapiens
aaatgcatggctgttttaaagc

SEQ ID NO: 7036594 - DNA, 22 bp, Homo sapiens
aaatgcatggtaaatgattgcc

SEQ ID NO: 7036595 - DNA, 22 bp, Homo sapiens
aaatgcatgtagaataatagag

SEQ ID NO: 7036596 - DNA, 22 bp, Homo sapiens
aagcaggcattccagagacaat

SEQ ID NO: 7036597 - DNA, 22 bp, Homo sapiens
aagcaggccctgggccagggga

SEQ ID NO: 7036598 - DNA, 22 bp, Homo sapiens
aaatctgtttcaggtatatttg

SEQ ID NO: 7036599 - DNA, 22 bp, Homo sapiens
aagattctcactgctcaacttt

SEQ ID NO: 7036600 - DNA, 22 bp, Homo sapiens
aagcaggcagggtggagagttt

SEQ ID NO: 7036601 - DNA, 22 bp, Homo sapiens
aagcaggcatcttggaggtcaa

SEQ ID NO: 7036602 - DNA, 22 bp, Homo sapiens
aagaacatggtaggataacaaa

SEQ ID NO: 7036603 - DNA, 22 bp, Homo sapiens
aaagtgattatgctgtcaaaga

SEQ ID NO: 7036604 - DNA, 22 bp, Homo sapiens
aagactagggtgtgtttaatct

SEQ ID NO: 7036605 - DNA, 22 bp, Homo sapiens
aagactcttgcctaatacatct

SEQ ID NO: 7036606 - DNA, 22 bp, Homo sapiens
aagactgtcttttctgagtgac

SEQ ID NO: 7036607 - DNA, 22 bp, Homo sapiens
aaagttttagaactaggaagca

SEQ ID NO: 7036608 - DNA, 22 bp, Homo sapiens
aagaggaggattgatgtgggag

SEQ ID NO: 7036609 - DNA, 22 bp, Homo sapiens
aagaggaggatgctttacagct

SEQ ID NO: 7036610 - DNA, 22 bp, Homo sapiens
aaagatgttttataagttatgg

SEQ ID NO: 7036611 - DNA, 22 bp, Homo sapiens
aaagattatggcattgaaatac

SEQ ID NO: 7036612 - DNA, 22 bp, Homo sapiens
aacacttctgttgataataagc

SEQ ID NO: 7036613 - DNA, 22 bp, Homo sapiens
aaagcactcgttagtatttctg

SEQ ID NO: 7036614 - DNA, 22 bp, Homo sapiens
aaagcactgcacatatatttgc

SEQ ID NO: 7036615 - DNA, 22 bp, Homo sapiens
aaagcagactgatttgcatcac

SEQ ID NO: 7036616 - DNA, 22 bp, Homo sapiens
aaagcagaggtgatatgactta

SEQ ID NO: 7036617 - DNA, 23 bp, Homo sapiens
aacatactgtttaatattcacag

SEQ ID NO: 7036618 - DNA, 22 bp, Homo sapiens
aacatacttatactaaataatg

SEQ ID NO: 7036619 - DNA, 22 bp, Homo sapiens
aaagcccccctgatctgagatg

SEQ ID NO: 7036620 - DNA, 22 bp, Homo sapiens
aaccccaggctggaggagtctc

SEQ ID NO: 7036621 - DNA, 22 bp, Homo sapiens
aaaggcagagttgttggaggca

SEQ ID NO: 7036622 - DNA, 22 bp, Homo sapiens
aaaggcagtgggtatgtggatc

SEQ ID NO: 7036623 - DNA, 22 bp, Homo sapiens
aagaacataaacagaaggacag

SEQ ID NO: 7036624 - DNA, 22 bp, Homo sapiens
aagaacatgagttatgatgatt

SEQ ID NO: 7036625 - DNA, 22 bp, Homo sapiens
aaacttctctccctactttgtg

SEQ ID NO: 7036626 - DNA, 22 bp, Homo sapiens
aaactttcatgtatctctttca

SEQ ID NO: 7036627 - DNA, 22 bp, Homo sapiens
aaacttttcctgctcttgtcct

SEQ ID NO: 7036628 - DNA, 22 bp, Homo sapiens
aaatagttcagcttgtaaaccc

SEQ ID NO: 7036629 - DNA, 22 bp, Homo sapiens
aaacttttttaggttcataggc

SEQ ID NO: 7036630 - DNA, 22 bp, Homo sapiens
aaacatgatgcctgtactaaga

SEQ ID NO: 7036631 - DNA, 22 bp, Homo sapiens
aaacagataatgctataaatgg

SEQ ID NO: 7036632 - DNA, 22 bp, Homo sapiens
aaacagataatgctataaatgg

SEQ ID NO: 7036633 - DNA, 22 bp, Homo sapiens
aaacatgtaagttcagatcacc

SEQ ID NO: 7036634 - DNA, 22 bp, Homo sapiens
aaacatgttttctgaatatttt

SEQ ID NO: 7036635 - DNA, 22 bp, Homo sapiens
aaacattcactctcaattttag

SEQ ID NO: 7036636 - DNA, 22 bp, Homo sapiens
aaactgtatgttgagatgacag

SEQ ID NO: 7036637 - DNA, 22 bp, Homo sapiens
aaagagccgctgatgtcagccc

SEQ ID NO: 7036638 - DNA, 22 bp, Homo sapiens
aaagagcctatattcagctgca

SEQ ID NO: 7036639 - DNA, 22 bp, Homo sapiens
aaaattctgtcattaaattgtg

SEQ ID NO: 7036640 - DNA, 22 bp, Homo sapiens
aaacagtattatcaatatattt

SEQ ID NO: 7036641 - DNA, 22 bp, Homo sapiens
aaaatatgaagttgtcagtatg

SEQ ID NO: 7036642 - DNA, 22 bp, Homo sapiens
aaaaactgcaattacttttgtc

SEQ ID NO: 7036643 - DNA, 22 bp, Homo sapiens
aaaaagggatttgtgatccagg

SEQ ID NO: 7036644 - DNA, 22 bp, Homo sapiens
aaaaggcagtgcaagagagggt

SEQ ID NO: 7036645 - DNA, 22 bp, Homo sapiens
aaaacctcagttctgctcttaa

SEQ ID NO: 7036646 - DNA, 22 bp, Homo sapiens
aaaacgttatgcattgtttatc

SEQ ID NO: 7036647 - DNA, 22 bp, Homo sapiens
aaaactctgcagttagtttcta

SEQ ID NO: 7036648 - DNA, 22 bp, Homo sapiens
aaaactttcagggatacagaaa

SEQ ID NO: 7036649 - DNA, 22 bp, Homo sapiens
aaaattatagatctagtgcctg

SEQ ID NO: 7036650 - DNA, 22 bp, Homo sapiens
aaaattatggagtatcccaaag

SEQ ID NO: 7036651 - DNA, 22 bp, Homo sapiens
aaaattatggagtatcccaaag

SEQ ID NO: 7036652 - DNA, 22 bp, Homo sapiens
aaaattattcatggcttttgga

SEQ ID NO: 7036653 - DNA, 22 bp, Homo sapiens
agctgggggttggataagggta

SEQ ID NO: 7036654 - DNA, 22 bp, Homo sapiens
agctggggctgcagagaacagg

SEQ ID NO: 7036655 - DNA, 22 bp, Homo sapiens
aggaatgtaaatctagatttta

SEQ ID NO: 7036656 - DNA, 21 bp, Homo sapiens
acagttttaaggagcacatgg

SEQ ID NO: 7036657 - DNA, 22 bp, Homo sapiens
acagttttttcaacattggaat

SEQ ID NO: 7036658 - DNA, 19 bp, Homo sapiens
acagtttgggaaatgagca

SEQ ID NO: 7036659 - DNA, 22 bp, Homo sapiens
acagtgatgagggaattttgtg

SEQ ID NO: 7036660 - DNA, 22 bp, Homo sapiens
acagttacattccagcaacatc

SEQ ID NO: 7036661 - DNA, 23 bp, Homo sapiens
acagttatagctgtgaataacat

SEQ ID NO: 7036662 - DNA, 22 bp, Homo sapiens
acagttatatacatgtagctgt

SEQ ID NO: 7036663 - DNA, 22 bp, Homo sapiens
acagttatctttgaaatagaga

SEQ ID NO: 7036664 - DNA, 22 bp, Homo sapiens
acagttattctttatgcaacca

SEQ ID NO: 7036665 - DNA, 22 bp, Homo sapiens
acagttattttcccagcattta

SEQ ID NO: 7036666 - DNA, 22 bp, Homo sapiens
acagttcaagacatcagtatga

SEQ ID NO: 7036667 - DNA, 22 bp, Homo sapiens
acagttcaagcaagtttctgtt

SEQ ID NO: 7036668 - DNA, 22 bp, Homo sapiens
acagttcaagtcttagacaaca

SEQ ID NO: 7036669 - DNA, 22 bp, Homo sapiens
acagttcactttttatatcaaa

SEQ ID NO: 7036670 - DNA, 22 bp, Homo sapiens
acagttcagacaagtgttccat

SEQ ID NO: 7036671 - DNA, 21 bp, Homo sapiens
acagtaaattccctgcaaaga

SEQ ID NO: 7036672 - DNA, 22 bp, Homo sapiens
acagggagtctgaggggatagt

SEQ ID NO: 7036673 - DNA, 18 bp, Homo sapiens
acagggatggggtaagtg

SEQ ID NO: 7036674 - DNA, 22 bp, Homo sapiens
acaggtggacacagcagcagtc

SEQ ID NO: 7036675 - DNA, 22 bp, Homo sapiens
acaggtggcactgctgttactc

SEQ ID NO: 7036676 - DNA, 22 bp, Homo sapiens
acaggtggccccgagggagtgg

SEQ ID NO: 7036677 - DNA, 22 bp, Homo sapiens
acaggtggcttccattttctaa

SEQ ID NO: 7036678 - DNA, 22 bp, Homo sapiens
agggcatctctaacagtctcct

SEQ ID NO: 7036679 - DNA, 17 bp, Homo sapiens
accattctttttactgc

SEQ ID NO: 7036680 - DNA, 22 bp, Homo sapiens
accctcaacaaattcactctat

SEQ ID NO: 7036681 - DNA, 22 bp, Homo sapiens
acatttttattcatcaaagcag

SEQ ID NO: 7036682 - DNA, 22 bp, Homo sapiens
accaaaaagatatgttgaagcc

SEQ ID NO: 7036683 - DNA, 22 bp, Homo sapiens
aggctggatttatggggacttc

SEQ ID NO: 7036684 - DNA, 22 bp, Homo sapiens
agggaatgtgaaaacacctctc

SEQ ID NO: 7036685 - DNA, 22 bp, Homo sapiens
accaggagttgggggtgggacc

SEQ ID NO: 7036686 - DNA, 22 bp, Homo sapiens
accaggagttttgaccaggggc

SEQ ID NO: 7036687 - DNA, 22 bp, Homo sapiens
accaggcccatgtggattacta

SEQ ID NO: 7036688 - DNA, 20 bp, Homo sapiens
accaggccccgggccctgca

SEQ ID NO: 7036689 - DNA, 22 bp, Homo sapiens
accaggcccgctgctatggtgg

SEQ ID NO: 7036690 - DNA, 22 bp, Homo sapiens
accaggcctagcaagtacatta

SEQ ID NO: 7036691 - DNA, 22 bp, Homo sapiens
acatgaaagttattctgagttg

SEQ ID NO: 7036692 - DNA, 22 bp, Homo sapiens
acatgaaatgcagcctgtaacc

SEQ ID NO: 7036693 - DNA, 22 bp, Homo sapiens
acatgagaagctgcaacatgac

SEQ ID NO: 7036694 - DNA, 22 bp, Homo sapiens
aggcaggggagctggaagggta

SEQ ID NO: 7036695 - DNA, 22 bp, Homo sapiens
aggcagggctgggattagactc

SEQ ID NO: 7036696 - DNA, 22 bp, Homo sapiens
aggcagggctcatttcttaggc

SEQ ID NO: 7036697 - DNA, 22 bp, Homo sapiens
aggcagggaccagttgttttct

SEQ ID NO: 7036698 - DNA, 22 bp, Homo sapiens
aggctatttccactcttctcat

SEQ ID NO: 7036699 - DNA, 22 bp, Homo sapiens
aggctgaggctttccttggaga

SEQ ID NO: 7036700 - DNA, 22 bp, Homo sapiens
aggctgagggctcctgagggca

SEQ ID NO: 7036701 - DNA, 22 bp, Homo sapiens
aggctgaggggcgagggaccct

SEQ ID NO: 7036702 - DNA, 22 bp, Homo sapiens
aggctgagtttctcattctcgc

SEQ ID NO: 7036703 - DNA, 22 bp, Homo sapiens
aggctgcaaagtgcttgggtgc

SEQ ID NO: 7036704 - DNA, 19 bp, Homo sapiens
aggctgcaaggtggtgggc

SEQ ID NO: 7036705 - DNA, 22 bp, Homo sapiens
atcattggaggcactgtgcagt

SEQ ID NO: 7036706 - DNA, 22 bp, Homo sapiens
atcacgtgaagtccataatagt

SEQ ID NO: 7036707 - DNA, 22 bp, Homo sapiens
atcacgtgctgagagtgttatt

SEQ ID NO: 7036708 - DNA, 22 bp, Homo sapiens
atcacgtggtttgagagtacgc

SEQ ID NO: 7036709 - DNA, 22 bp, Homo sapiens
actttgtataagacaataaaga

SEQ ID NO: 7036710 - DNA, 22 bp, Homo sapiens
atatataacctggataaggctt

SEQ ID NO: 7036711 - DNA, 22 bp, Homo sapiens
atataatagtttcataaaggct

SEQ ID NO: 7036712 - DNA, 22 bp, Homo sapiens
atatacacagagcttatggtga

SEQ ID NO: 7036713 - DNA, 22 bp, Homo sapiens
atatacacatctttttaaatat

SEQ ID NO: 7036714 - DNA, 22 bp, Homo sapiens
atatatttgagaatattcatga

SEQ ID NO: 7036715 - DNA, 22 bp, Homo sapiens
atatatttgagaatattcatga

SEQ ID NO: 7036716 - DNA, 22 bp, Homo sapiens
atatatttgagaatattcatga

SEQ ID NO: 7036717 - DNA, 21 bp, Homo sapiens
atatcctgtaactttgctgca

SEQ ID NO: 7036718 - DNA, 22 bp, Homo sapiens
atatcctttactgtgtcacaga

SEQ ID NO: 7036719 - DNA, 22 bp, Homo sapiens
atatcctttgtgtaggcaattt

SEQ ID NO: 7036720 - DNA, 22 bp, Homo sapiens
atatctcattaccttgctgttc

SEQ ID NO: 7036721 - DNA, 22 bp, Homo sapiens
atatctttcaaagccaaaagta

SEQ ID NO: 7036722 - DNA, 22 bp, Homo sapiens
atatcttttagagcaagcttgt

SEQ ID NO: 7036723 - DNA, 22 bp, Homo sapiens
atatcttttagagcaagcttgt

SEQ ID NO: 7036724 - DNA, 22 bp, Homo sapiens
agtttcctcatctgtaaaatga

SEQ ID NO: 7036725 - DNA, 22 bp, Homo sapiens
agtttcctcatgttaatatgga

SEQ ID NO: 7036726 - DNA, 22 bp, Homo sapiens
actgtaaagaggtgtatcttta

SEQ ID NO: 7036727 - DNA, 22 bp, Homo sapiens
actgtaaagcttttctcatgcg

SEQ ID NO: 7036728 - DNA, 22 bp, Homo sapiens
actgtaaaggtgattagaagtt

SEQ ID NO: 7036729 - DNA, 22 bp, Homo sapiens
actgtaaattacataagaacag

SEQ ID NO: 7036730 - DNA, 22 bp, Homo sapiens
actgtaaattttggttgcaggt

SEQ ID NO: 7036731 - DNA, 22 bp, Homo sapiens
actgtgaacggactgaagccca

SEQ ID NO: 7036732 - DNA, 22 bp, Homo sapiens
agtttacagatgctacaggagc

SEQ ID NO: 7036733 - DNA, 22 bp, Homo sapiens
agtttacatcttcaatctcatt

SEQ ID NO: 7036734 - DNA, 22 bp, Homo sapiens
agtttatagcccagattcatgg

SEQ ID NO: 7036735 - DNA, 22 bp, Homo sapiens
actggtttttctcatgaaaatg

SEQ ID NO: 7036736 - DNA, 22 bp, Homo sapiens
actgtaaaacaggtttcatcat

SEQ ID NO: 7036737 - DNA, 22 bp, Homo sapiens
actgtaaaactgctttggaaac

SEQ ID NO: 7036738 - DNA, 22 bp, Homo sapiens
actgtaaaagaaggtctttgca

SEQ ID NO: 7036739 - DNA, 22 bp, Homo sapiens
actgtaaaatacataagtattg

SEQ ID NO: 7036740 - DNA, 22 bp, Homo sapiens
actgtaaaatacataagtattg

SEQ ID NO: 7036741 - DNA, 22 bp, Homo sapiens
actgtaaaatgagatatgtata

SEQ ID NO: 7036742 - DNA, 22 bp, Homo sapiens
actgttatgggtgtcagcttaa

SEQ ID NO: 7036743 - DNA, 22 bp, Homo sapiens
acttcaaacaattaacagagaa

SEQ ID NO: 7036744 - DNA, 22 bp, Homo sapiens
acttcaaattttcagaagaaat

SEQ ID NO: 7036745 - DNA, 22 bp, Homo sapiens
acttcagtgtggtataaaacgt

SEQ ID NO: 7036746 - DNA, 22 bp, Homo sapiens
acttcagtttccctcaacaaga

SEQ ID NO: 7036747 - DNA, 22 bp, Homo sapiens
acttcatgaacatgtggcctgt

SEQ ID NO: 7036748 - DNA, 22 bp, Homo sapiens
acttcatgaactaagggatcgg

SEQ ID NO: 7036749 - DNA, 22 bp, Homo sapiens
acttcatgtagtccatcaggtt

SEQ ID NO: 7036750 - DNA, 22 bp, Homo sapiens
acttcttttcaaatcatgcaaa

SEQ ID NO: 7036751 - DNA, 22 bp, Homo sapiens
acttgcatgtcaggaaattaac

SEQ ID NO: 7036752 - DNA, 22 bp, Homo sapiens
acttgcatttaaatattgaata

SEQ ID NO: 7036753 - DNA, 22 bp, Homo sapiens
acttggaaccgaggacctttat

SEQ ID NO: 7036754 - DNA, 22 bp, Homo sapiens
acttgggaaagaagtttcaccg

SEQ ID NO: 7036755 - DNA, 22 bp, Homo sapiens
actgcaaaaatgggtgcattca

SEQ ID NO: 7036756 - DNA, 22 bp, Homo sapiens
actgcaaacatagtacttgagc

SEQ ID NO: 7036757 - DNA, 22 bp, Homo sapiens
actgcaaagggaagccctttct

SEQ ID NO: 7036758 - DNA, 22 bp, Homo sapiens
actgatttcagggatgagaaga

SEQ ID NO: 7036759 - DNA, 22 bp, Homo sapiens
actgatttcagggatgagaaga

SEQ ID NO: 7036760 - DNA, 22 bp, Homo sapiens
agtctcttaaagacagtgttga

SEQ ID NO: 7036761 - DNA, 22 bp, Homo sapiens
agtctcttccttcaaggctggt

SEQ ID NO: 7036762 - DNA, 22 bp, Homo sapiens
agtctcttcgagccgcagggct

SEQ ID NO: 7036763 - DNA, 19 bp, Homo sapiens
agtctcttcggaggaggtt

SEQ ID NO: 7036764 - DNA, 22 bp, Homo sapiens
agtctcttgcacattgtattaa

SEQ ID NO: 7036765 - DNA, 22 bp, Homo sapiens
agtctcttggcattctgaaaca

SEQ ID NO: 7036766 - DNA, 22 bp, Homo sapiens
actgaagaacgcatcagtggtt

SEQ ID NO: 7036767 - DNA, 22 bp, Homo sapiens
actgaagacattactggtctaa

SEQ ID NO: 7036768 - DNA, 22 bp, Homo sapiens
actgaagacctcctgtcagcgg

SEQ ID NO: 7036769 - DNA, 22 bp, Homo sapiens
actgaagagaagcattttctgc

SEQ ID NO: 7036770 - DNA, 22 bp, Homo sapiens
actgaagagcgtgctatgctca

SEQ ID NO: 7036771 - DNA, 18 bp, Homo sapiens
actgaagatgcaagacct

SEQ ID NO: 7036772 - DNA, 23 bp, Homo sapiens
actgaagatgtcttagtggccct

SEQ ID NO: 7036773 - DNA, 19 bp, Homo sapiens
accttcagagtggcacaaa

SEQ ID NO: 7036774 - DNA, 22 bp, Homo sapiens
acgttttattcccatgcagcat

SEQ ID NO: 7036775 - DNA, 22 bp, Homo sapiens
actaaactgaagcatgaaaagg

SEQ ID NO: 7036776 - DNA, 22 bp, Homo sapiens
actatacattgaatgttaaggt

SEQ ID NO: 7036777 - DNA, 22 bp, Homo sapiens
actatatgtgaaggtagaattt

SEQ ID NO: 7036778 - DNA, 22 bp, Homo sapiens
aggtagaggcctccaggcagca

SEQ ID NO: 7036779 - DNA, 20 bp, Homo sapiens
agggtggggacgttctgact

SEQ ID NO: 7036780 - DNA, 22 bp, Homo sapiens
agggtggggtgctacatcttta

SEQ ID NO: 7036781 - DNA, 22 bp, Homo sapiens
agggctgtcagactgaggaggc

SEQ ID NO: 7036782 - DNA, 22 bp, Homo sapiens
agggctgtgtccctaggggagc

SEQ ID NO: 7036783 - DNA, 22 bp, Homo sapiens
agggctgtttttcagtgtgtga

SEQ ID NO: 7036784 - DNA, 22 bp, Homo sapiens
agggtgcgttctatgagaatct

SEQ ID NO: 7036785 - DNA, 20 bp, Homo sapiens
agggtggggacgttctgact

SEQ ID NO: 7036786 - DNA, 22 bp, Homo sapiens
agccctcatggaacagctccta

SEQ ID NO: 7036787 - DNA, 22 bp, Homo sapiens
agcccaggagtttgaggctgtg

SEQ ID NO: 7036788 - DNA, 22 bp, Homo sapiens
cagacagcaggcctggatgtgt

SEQ ID NO: 7036789 - DNA, 22 bp, Homo sapiens
agccaggggagtcagctgctgg

SEQ ID NO: 7036790 - DNA, 23 bp, Homo sapiens
agccaggggatcttgggccctgg

SEQ ID NO: 7036791 - DNA, 22 bp, Homo sapiens
agccacagcctgacttaactgt

SEQ ID NO: 7036792 - DNA, 22 bp, Homo sapiens
agccaaggacacggagcctcct

SEQ ID NO: 7036793 - DNA, 22 bp, Homo sapiens
agccaggatggtctcgatcggc

SEQ ID NO: 7036794 - DNA, 22 bp, Homo sapiens
agccaggatggtctcgatcggc

SEQ ID NO: 7036795 - DNA, 22 bp, Homo sapiens
agccctccatctgtgctcaggc

SEQ ID NO: 7036796 - DNA, 22 bp, Homo sapiens
cagaggctaagatgagtgggtg

SEQ ID NO: 7036797 - DNA, 22 bp, Homo sapiens
cagaggctaagggtagcttggg

SEQ ID NO: 7036798 - DNA, 22 bp, Homo sapiens
cagaggctagactgtgcttcct

SEQ ID NO: 7036799 - DNA, 22 bp, Homo sapiens
cagaggctcagatggccctggc

SEQ ID NO: 7036800 - DNA, 22 bp, Homo sapiens
cagaggctcttcctcactgccc

SEQ ID NO: 7036801 - DNA, 22 bp, Homo sapiens
cagcagaggcacgtctgtgaat

SEQ ID NO: 7036802 - DNA, 22 bp, Homo sapiens
agccttttggagttattctggg

SEQ ID NO: 7036803 - DNA, 20 bp, Homo sapiens
agctcctcatcactggaggt

SEQ ID NO: 7036804 - DNA, 22 bp, Homo sapiens
agctcctctagatctgccactt

SEQ ID NO: 7036805 - DNA, 22 bp, Homo sapiens
cacagtatttgtttttctgagt

SEQ ID NO: 7036806 - DNA, 22 bp, Homo sapiens
agcagtggctgaagatgttcct

SEQ ID NO: 7036807 - DNA, 22 bp, Homo sapiens
agcagtggctgacagacttacc

SEQ ID NO: 7036808 - DNA, 22 bp, Homo sapiens
agcataacacccgacactcagg

SEQ ID NO: 7036809 - DNA, 22 bp, Homo sapiens
cacagggcttctcatggggtgc

SEQ ID NO: 7036810 - DNA, 22 bp, Homo sapiens
cacaggaggaggccagagcgta

SEQ ID NO: 7036811 - DNA, 22 bp, Homo sapiens
cacaggagggagcgggcagcca

SEQ ID NO: 7036812 - DNA, 22 bp, Homo sapiens
caatgataatggctgtatttat

SEQ ID NO: 7036813 - DNA, 22 bp, Homo sapiens
cacaggagccctgaggcctccc

SEQ ID NO: 7036814 - DNA, 22 bp, Homo sapiens
cacaggagctgtggggcagtgt

SEQ ID NO: 7036815 - DNA, 22 bp, Homo sapiens
caacttcagggaaacatgaagc

SEQ ID NO: 7036816 - DNA, 22 bp, Homo sapiens
agcagcaattttcactgtcaat

SEQ ID NO: 7036817 - DNA, 22 bp, Homo sapiens
agcaaacattcagcagattggc

SEQ ID NO: 7036818 - DNA, 22 bp, Homo sapiens
attttctatgttgtaattgtta

SEQ ID NO: 7036819 - DNA, 22 bp, Homo sapiens
attttctctcaaaccttaaaat

SEQ ID NO: 7036820 - DNA, 22 bp, Homo sapiens
caaatgcaaaatataaccctgt

SEQ ID NO: 7036821 - DNA, 22 bp, Homo sapiens
caaatgcaggtcagcaggtgtc

SEQ ID NO: 7036822 - DNA, 22 bp, Homo sapiens
caaatgcaggtcataacctgag

SEQ ID NO: 7036823 - DNA, 22 bp, Homo sapiens
caaatgcagtccctttgttgct

SEQ ID NO: 7036824 - DNA, 22 bp, Homo sapiens
caaatgcatagaaagatgaaac

SEQ ID NO: 7036825 - DNA, 22 bp, Homo sapiens
attataaatattttctaggggt

SEQ ID NO: 7036826 - DNA, 22 bp, Homo sapiens
attatacattttgtgtagagat

SEQ ID NO: 7036827 - DNA, 22 bp, Homo sapiens
attatacattttgtgtagagat

SEQ ID NO: 7036828 - DNA, 22 bp, Homo sapiens
attcacactttacttctttcca

SEQ ID NO: 7036829 - DNA, 22 bp, Homo sapiens
attcacagttcattagctgtaa

SEQ ID NO: 7036830 - DNA, 22 bp, Homo sapiens
attaaagtgaagttctcagatg

SEQ ID NO: 7036831 - DNA, 22 bp, Homo sapiens
atgttttaccctttgcacaaac

SEQ ID NO: 7036832 - DNA, 22 bp, Homo sapiens
attaaactgagcaaattaacat

SEQ ID NO: 7036833 - DNA, 22 bp, Homo sapiens
atgtttgttgatcatttatgaa

SEQ ID NO: 7036834 - DNA, 22 bp, Homo sapiens
attaaagttgaaattgaactga

SEQ ID NO: 7036835 - DNA, 22 bp, Homo sapiens
attagcaaaacaacttttctat

SEQ ID NO: 7036836 - DNA, 22 bp, Homo sapiens
attagcaaattctaattcacta

SEQ ID NO: 7036837 - DNA, 22 bp, Homo sapiens
attagcaacatggtgaatatgt

SEQ ID NO: 7036838 - DNA, 22 bp, Homo sapiens
attagcaactgtcttgaaaaca

SEQ ID NO: 7036839 - DNA, 22 bp, Homo sapiens
attagcaagttgttatcctttg

SEQ ID NO: 7036840 - DNA, 22 bp, Homo sapiens
attagcaagttttccagctaat

SEQ ID NO: 7036841 - DNA, 22 bp, Homo sapiens
attagcaatcacgcagtcattt

SEQ ID NO: 7036842 - DNA, 22 bp, Homo sapiens
attagcaatctgaaaattgcgg

SEQ ID NO: 7036843 - DNA, 22 bp, Homo sapiens
attagcagctttctggtctcta

SEQ ID NO: 7036844 - DNA, 22 bp, Homo sapiens
atgttacaattcaaaatgctgc

SEQ ID NO: 7036845 - DNA, 22 bp, Homo sapiens
atgtttctgaagtttacagata

SEQ ID NO: 7036846 - DNA, 22 bp, Homo sapiens
atgtttctgagtgtatatacat

SEQ ID NO: 7036847 - DNA, 22 bp, Homo sapiens
atgtttctgtcctacgagataa

SEQ ID NO: 7036848 - DNA, 22 bp, Homo sapiens
attcttcattgttgattcatgt

SEQ ID NO: 7036849 - DNA, 22 bp, Homo sapiens
attcttcatttactgttacttg

SEQ ID NO: 7036850 - DNA, 22 bp, Homo sapiens
atttaatgggtagacattgtta

SEQ ID NO: 7036851 - DNA, 22 bp, Homo sapiens
atttagcaagagtacaaaataa

SEQ ID NO: 7036852 - DNA, 17 bp, Homo sapiens
atttagcaagtagacag

SEQ ID NO: 7036853 - DNA, 22 bp, Homo sapiens
agatgaaagatttttatagaga

SEQ ID NO: 7036854 - DNA, 19 bp, Homo sapiens
agatggggaagagtgtgag

SEQ ID NO: 7036855 - DNA, 22 bp, Homo sapiens
agcaaaataaggtaatttattg

SEQ ID NO: 7036856 - DNA, 22 bp, Homo sapiens
agcaaacacaagaggtaatttc

SEQ ID NO: 7036857 - DNA, 22 bp, Homo sapiens
agcaaacagatgtctcctttag

SEQ ID NO: 7036858 - DNA, 22 bp, Homo sapiens
atggaaatatctttagagctta

SEQ ID NO: 7036859 - DNA, 22 bp, Homo sapiens
atggctggtgatactggagtga

SEQ ID NO: 7036860 - DNA, 22 bp, Homo sapiens
atggctggtttgagctttagca

SEQ ID NO: 7036861 - DNA, 20 bp, Homo sapiens
atgtaaaagacagggagtag

SEQ ID NO: 7036862 - DNA, 20 bp, Homo sapiens
atgtaaaattataaggctga

SEQ ID NO: 7036863 - DNA, 20 bp, Homo sapiens
atgtaaaattataaggctga

SEQ ID NO: 7036864 - DNA, 21 bp, Homo sapiens
atgtcaaatgctttattttat

SEQ ID NO: 7036865 - DNA, 22 bp, Homo sapiens
agaatacatcaatctattttct

SEQ ID NO: 7036866 - DNA, 22 bp, Homo sapiens
agaatgaattaatcaactggaa

SEQ ID NO: 7036867 - DNA, 21 bp, Homo sapiens
agaattaaattggatttgtgt

SEQ ID NO: 7036868 - DNA, 22 bp, Homo sapiens
agacacagtgagtttctttccc

SEQ ID NO: 7036869 - DNA, 23 bp, Homo sapiens
agacacataggagcagctattgg

SEQ ID NO: 7036870 - DNA, 22 bp, Homo sapiens
agacacattttacattaactgt

SEQ ID NO: 7036871 - DNA, 22 bp, Homo sapiens
agctctgacaaggattttctgc

SEQ ID NO: 7036872 - DNA, 22 bp, Homo sapiens
agctgaggctctgagagggaag

SEQ ID NO: 7036873 - DNA, 21 bp, Homo sapiens
agctgcagcccaaaggcctgt

SEQ ID NO: 7036874 - DNA, 22 bp, Homo sapiens
agctgcagccctcctgcatggc

SEQ ID NO: 7036875 - DNA, 22 bp, Homo sapiens
agctgcaggcccatgctcagtc

SEQ ID NO: 7036876 - DNA, 21 bp, Homo sapiens
agctgcaggcctcccagggat

SEQ ID NO: 7036877 - DNA, 21 bp, Homo sapiens
agctgcaggcctcccagggat

SEQ ID NO: 7036878 - DNA, 22 bp, Homo sapiens
agctgcaggcctctcctgggga

SEQ ID NO: 7036879 - DNA, 22 bp, Homo sapiens
agctgcaggcgccggggccgat

SEQ ID NO: 7036880 - DNA, 22 bp, Homo sapiens
agctgcagggcttgggtttccc

SEQ ID NO: 7036881 - DNA, 22 bp, Homo sapiens
agctgcaggtggacccgtaccg

SEQ ID NO: 7036882 - DNA, 22 bp, Homo sapiens
agctgcaggttcagcattccac

SEQ ID NO: 7036883 - DNA, 22 bp, Homo sapiens
agctgcagtaaagctctccagg

SEQ ID NO: 7036884 - DNA, 22 bp, Homo sapiens
agctgcagtatgaggctggtgg

SEQ ID NO: 7036885 - DNA, 21 bp, Homo sapiens
agctgcagtcaagccagaggt

SEQ ID NO: 7036886 - DNA, 21 bp, Homo sapiens
agctgcagtcaagccagaggt

SEQ ID NO: 7036887 - DNA, 22 bp, Homo sapiens
agctgcagtcaagctgggccac

SEQ ID NO: 7036888 - DNA, 22 bp, Homo sapiens
cagcttttgcagacttcttgcc

SEQ ID NO: 7036889 - DNA, 22 bp, Homo sapiens
caggagtccatctggcctggtg

SEQ ID NO: 7036890 - DNA, 22 bp, Homo sapiens
caggagtcccaggggtgggcca

SEQ ID NO: 7036891 - DNA, 22 bp, Homo sapiens
caggagtcccccataccgcgtc

SEQ ID NO: 7036892 - DNA, 22 bp, Homo sapiens
caggagtccctctggccagcat

SEQ ID NO: 7036893 - DNA, 22 bp, Homo sapiens
caggagtctctcttgagcccag

SEQ ID NO: 7036894 - DNA, 22 bp, Homo sapiens
caggagtccagagtgtcatttt

SEQ ID NO: 7036895 - DNA, 22 bp, Homo sapiens
caggcctcaccagcggagctgc

SEQ ID NO: 7036896 - DNA, 22 bp, Homo sapiens
caggcctcaggggctcaggctg

SEQ ID NO: 7036897 - DNA, 22 bp, Homo sapiens
caggcctcatggtgtgtccttc

SEQ ID NO: 7036898 - DNA, 22 bp, Homo sapiens
caggcctccactccacgcagac

SEQ ID NO: 7036899 - DNA, 22 bp, Homo sapiens
caggcctcccggtgcacactga

SEQ ID NO: 7036900 - DNA, 22 bp, Homo sapiens
agctgtggcagcagccgtggca

SEQ ID NO: 7036901 - DNA, 22 bp, Homo sapiens
agctgtttaaatgacttacttt

SEQ ID NO: 7036902 - DNA, 22 bp, Homo sapiens
agctgtttaataaatgtctgtt

SEQ ID NO: 7036903 - DNA, 20 bp, Homo sapiens
agctgtttacatggatttct

SEQ ID NO: 7036904 - DNA, 22 bp, Homo sapiens
agctgtttatgcactcctgcct

SEQ ID NO: 7036905 - DNA, 23 bp, Homo sapiens
agctgtttcattattacaacacc

SEQ ID NO: 7036906 - DNA, 22 bp, Homo sapiens
agctgtttccataaatgagaca

SEQ ID NO: 7036907 - DNA, 22 bp, Homo sapiens
agctgtttccattcttgagtag

SEQ ID NO: 7036908 - DNA, 22 bp, Homo sapiens
agctgtttccattcttgagtag

SEQ ID NO: 7036909 - DNA, 23 bp, Homo sapiens
agctgtttcttgtgagttgagtg

SEQ ID NO: 7036910 - DNA, 21 bp, Homo sapiens
agctgtttgaagctatattgg

SEQ ID NO: 7036911 - DNA, 22 bp, Homo sapiens
agctgtttgtacttagatagta

SEQ ID NO: 7036912 - DNA, 22 bp, Homo sapiens
agctgttttactcagaaacata

SEQ ID NO: 7036913 - DNA, 22 bp, Homo sapiens
agctgttttactggttgtataa

SEQ ID NO: 7036914 - DNA, 22 bp, Homo sapiens
agctgttttctaatgcatttga

SEQ ID NO: 7036915 - DNA, 22 bp, Homo sapiens
agctgttttcctggttagagac

SEQ ID NO: 7036916 - DNA, 22 bp, Homo sapiens
agctgttttcttctaggaagac

SEQ ID NO: 7036917 - DNA, 22 bp, Homo sapiens
agctgttttcttgccgtcctag

SEQ ID NO: 7036918 - DNA, 22 bp, Homo sapiens
agctgtttttccagtctctgga

SEQ ID NO: 7036919 - DNA, 22 bp, Homo sapiens
agctgtttttgtctgctgatcc

SEQ ID NO: 7036920 - DNA, 22 bp, Homo sapiens
agctgtttttgtgggcatgtga

SEQ ID NO: 7036921 - DNA, 22 bp, Homo sapiens
agctgttttttcctcaccactt

SEQ ID NO: 7036922 - DNA, 17 bp, Homo sapiens
agcttggagcagcatga

SEQ ID NO: 7036923 - DNA, 22 bp, Homo sapiens
agctttaaaaatccaatatcca

SEQ ID NO: 7036924 - DNA, 22 bp, Homo sapiens
cagggccactgtagatgaggag

SEQ ID NO: 7036925 - DNA, 22 bp, Homo sapiens
cagggccagagagggctggctg

SEQ ID NO: 7036926 - DNA, 22 bp, Homo sapiens
cagggccagagagggctggctg

SEQ ID NO: 7036927 - DNA, 22 bp, Homo sapiens
cagggccagccatcctgctggg

SEQ ID NO: 7036928 - DNA, 22 bp, Homo sapiens
cagggccagcccactagcgagg

SEQ ID NO: 7036929 - DNA, 22 bp, Homo sapiens
cagggccagcccactagcgagg

SEQ ID NO: 7036930 - DNA, 22 bp, Homo sapiens
cagggccagcccgacgtggtgc

SEQ ID NO: 7036931 - DNA, 22 bp, Homo sapiens
cagggccagcccgacgtggtgc

SEQ ID NO: 7036932 - DNA, 22 bp, Homo sapiens
cagggccagccgcagcatccac

SEQ ID NO: 7036933 - DNA, 22 bp, Homo sapiens
cagggccagcgcccaggcccag

SEQ ID NO: 7036934 - DNA, 22 bp, Homo sapiens
cagggccagcgtctcgggctat

SEQ ID NO: 7036935 - DNA, 22 bp, Homo sapiens
aggaagaaaactaattagatgg

SEQ ID NO: 7036936 - DNA, 22 bp, Homo sapiens
catgccaggattaggacccagc

SEQ ID NO: 7036937 - DNA, 22 bp, Homo sapiens
catgcagatgtcatgaggcatg

SEQ ID NO: 7036938 - DNA, 20 bp, Homo sapiens
catgccatgtctactgaggc

SEQ ID NO: 7036939 - DNA, 22 bp, Homo sapiens
catgccatgtgtgaggagagga

SEQ ID NO: 7036940 - DNA, 22 bp, Homo sapiens
catgccatttggtggattgaga

SEQ ID NO: 7036941 - DNA, 22 bp, Homo sapiens
catgcggctctttccaaaccgg

SEQ ID NO: 7036942 - DNA, 22 bp, Homo sapiens
aggaggcactcactctcagggt

SEQ ID NO: 7036943 - DNA, 22 bp, Homo sapiens
cattatctcttctatatgctag

SEQ ID NO: 7036944 - DNA, 22 bp, Homo sapiens
cattcaaaagctccatgtttgt

SEQ ID NO: 7036945 - DNA, 22 bp, Homo sapiens
cattcaaacattaatttattca

SEQ ID NO: 7036946 - DNA, 22 bp, Homo sapiens
cattccacactgcaggaaatat

SEQ ID NO: 7036947 - DNA, 20 bp, Homo sapiens
cattcctgaggaattcatgt

SEQ ID NO: 7036948 - DNA, 21 bp, Homo sapiens
aggcagcaggatccagggaca

SEQ ID NO: 7036949 - DNA, 22 bp, Homo sapiens
aggaggactctctgagccagcc

SEQ ID NO: 7036950 - DNA, 22 bp, Homo sapiens
aggaggaggctggagtacaccc

SEQ ID NO: 7036951 - DNA, 22 bp, Homo sapiens
aggaggcaaaggtctctgataa

SEQ ID NO: 7036952 - DNA, 22 bp, Homo sapiens
aggaggcaactgagatttagaa

SEQ ID NO: 7036953 - DNA, 22 bp, Homo sapiens
aggagccatgagcaggaggcaa

SEQ ID NO: 7036954 - DNA, 22 bp, Homo sapiens
cagtccatatgccataattctt

SEQ ID NO: 7036955 - DNA, 22 bp, Homo sapiens
cagtcctctgcaacaccccttc

SEQ ID NO: 7036956 - DNA, 17 bp, Homo sapiens
cagtcctctgctctaag

SEQ ID NO: 7036957 - DNA, 22 bp, Homo sapiens
aggacagcaaccgttattcaca

SEQ ID NO: 7036958 - DNA, 22 bp, Homo sapiens
aggacagcccccaacagcaaca

SEQ ID NO: 7036959 - DNA, 22 bp, Homo sapiens
aggagaaagactggacagccaa

SEQ ID NO: 7036960 - DNA, 18 bp, Homo sapiens
aggagaaagggaccaggg

SEQ ID NO: 7036961 - DNA, 22 bp, Homo sapiens
aggagaaatccatcgagaatgg

SEQ ID NO: 7036962 - DNA, 22 bp, Homo sapiens
aggagaaatccatcgagaatgg

SEQ ID NO: 7036963 - DNA, 22 bp, Homo sapiens
cagtctctctgaagtattaaga

SEQ ID NO: 7036964 - DNA, 22 bp, Homo sapiens
cagtctctcttgtagtgcagct

SEQ ID NO: 7036965 - DNA, 22 bp, Homo sapiens
cagtctctgccacttctaagct

SEQ ID NO: 7036966 - DNA, 22 bp, Homo sapiens
cagtctctggcagctgctggcc

SEQ ID NO: 7036967 - DNA, 22 bp, Homo sapiens
cagtctctgggaaagaggacag

SEQ ID NO: 7036968 - DNA, 22 bp, Homo sapiens
cagtctctggtgagttgacagt

SEQ ID NO: 7036969 - DNA, 22 bp, Homo sapiens
cagtctctgtcatctcatggga

SEQ ID NO: 7036970 - DNA, 22 bp, Homo sapiens
cagtctctgtgccagatcctgg

SEQ ID NO: 7036971 - DNA, 22 bp, Homo sapiens
cagtctcttgcttcattagttg

SEQ ID NO: 7036972 - DNA, 22 bp, Homo sapiens
cagtctctttatccaccaagcc

SEQ ID NO: 7036973 - DNA, 22 bp, Homo sapiens
cagtctcttttcagctccatcc

SEQ ID NO: 7036974 - DNA, 22 bp, Homo sapiens
aggcctcacacaacagatgcat

SEQ ID NO: 7036975 - DNA, 22 bp, Homo sapiens
aggcctcacacaacagatgcat

SEQ ID NO: 7036976 - DNA, 22 bp, Homo sapiens
aggcctcacattgggcttcaag

SEQ ID NO: 7036977 - DNA, 22 bp, Homo sapiens
aggcctcactctcagagcttct

SEQ ID NO: 7036978 - DNA, 22 bp, Homo sapiens
aggcctcagcctgccaggcctg

SEQ ID NO: 7036979 - DNA, 22 bp, Homo sapiens
aggcctcagctcagtgtgacag

SEQ ID NO: 7036980 - DNA, 22 bp, Homo sapiens
aggcctcaggaaggtaaagaag

SEQ ID NO: 7036981 - DNA, 17 bp, Homo sapiens
aggcctcaggtgaaacc

SEQ ID NO: 7036982 - DNA, 22 bp, Homo sapiens
aggcctcagtgatcatcatcag

SEQ ID NO: 7036983 - DNA, 22 bp, Homo sapiens
aggcctcagtgatcatcatcag

SEQ ID NO: 7036984 - DNA, 22 bp, Homo sapiens
aggcctcagttcttgccaggtg

SEQ ID NO: 7036985 - DNA, 22 bp, Homo sapiens
aggcctcagtttccccagttgt

SEQ ID NO: 7036986 - DNA, 22 bp, Homo sapiens
aggcctcagtttgtcatctgta

SEQ ID NO: 7036987 - DNA, 22 bp, Homo sapiens
aggcctcagtttgtcatctgta

SEQ ID NO: 7036988 - DNA, 22 bp, Homo sapiens
aggcctcatagtagacctgccc

SEQ ID NO: 7036989 - DNA, 22 bp, Homo sapiens
aggcctcatgtcaaagcagcaa

SEQ ID NO: 7036990 - DNA, 22 bp, Homo sapiens
aggcctcattgcccacctgtgg

SEQ ID NO: 7036991 - DNA, 22 bp, Homo sapiens
aggcctcattgcccacctgtgg

SEQ ID NO: 7036992 - DNA, 22 bp, Homo sapiens
aggcctcattgcccacctgtgg

SEQ ID NO: 7036993 - DNA, 22 bp, Homo sapiens
aggcctcattttcactttatgc

SEQ ID NO: 7036994 - DNA, 22 bp, Homo sapiens
aggcctccagccacatgccagt

SEQ ID NO: 7036995 - DNA, 17 bp, Homo sapiens
aggcctccctccaggcc

SEQ ID NO: 7036996 - DNA, 17 bp, Homo sapiens
aggcctccctccaggcc

SEQ ID NO: 7036997 - DNA, 22 bp, Homo sapiens
aggcctcctggctccaggcctt

SEQ ID NO: 7036998 - DNA, 22 bp, Homo sapiens
aggcctctctccttggcttgta

SEQ ID NO: 7036999 - DNA, 22 bp, Homo sapiens
aggcctctctgcttagcttgta

SEQ ID NO: 7037000 - DNA, 22 bp, Homo sapiens
aggctctgcaggtatttcttga

SEQ ID NO: 7037001 - DNA, 22 bp, Homo sapiens
aggctgagccacggggctggct

SEQ ID NO: 7037002 - DNA, 23 bp, Homo sapiens
aggctgagctctcccagcttcag

SEQ ID NO: 7037003 - DNA, 22 bp, Homo sapiens
ccagtctgttctcacctctgag

SEQ ID NO: 7037004 - DNA, 22 bp, Homo sapiens
ccagttcatacacttagaaatt

SEQ ID NO: 7037005 - DNA, 22 bp, Homo sapiens
ccactgggcgtttctgtccaat

SEQ ID NO: 7037006 - DNA, 19 bp, Homo sapiens
ccactggggctccacatta

SEQ ID NO: 7037007 - DNA, 22 bp, Homo sapiens
aggccaagctcccagagaagct

SEQ ID NO: 7037008 - DNA, 22 bp, Homo sapiens
aggccaagggcaaagcggagag

SEQ ID NO: 7037009 - DNA, 22 bp, Homo sapiens
aggcccagctgggccaggaaca

SEQ ID NO: 7037010 - DNA, 22 bp, Homo sapiens
aggcccagtcctctgccgtctg

SEQ ID NO: 7037011 - DNA, 20 bp, Homo sapiens
aggcccagtgaatatattgc

SEQ ID NO: 7037012 - DNA, 22 bp, Homo sapiens
aggcccagtgccattagttttg

SEQ ID NO: 7037013 - DNA, 22 bp, Homo sapiens
aggcccagtgtggcttcctgga

SEQ ID NO: 7037014 - DNA, 20 bp, Homo sapiens
aggccccaggtggacactag

SEQ ID NO: 7037015 - DNA, 22 bp, Homo sapiens
aggccccatcaggaaggaggcc

SEQ ID NO: 7037016 - DNA, 22 bp, Homo sapiens
aggccctgaagtcggcccctca

SEQ ID NO: 7037017 - DNA, 22 bp, Homo sapiens
agggccagggaaacgatcagca

SEQ ID NO: 7037018 - DNA, 22 bp, Homo sapiens
agggccaggctcccatgtcagg

SEQ ID NO: 7037019 - DNA, 22 bp, Homo sapiens
agggccagggaagctgtatttt

SEQ ID NO: 7037020 - DNA, 22 bp, Homo sapiens
agggccagggaagctgtatttt

SEQ ID NO: 7037021 - DNA, 22 bp, Homo sapiens
ccctgggcaagccctattttcc

SEQ ID NO: 7037022 - DNA, 22 bp, Homo sapiens
ccctgggcaagccctattttcc

SEQ ID NO: 7037023 - DNA, 22 bp, Homo sapiens
ccctgggcaccaggcctggtaa

SEQ ID NO: 7037024 - DNA, 22 bp, Homo sapiens
ccctgggcaccaggcctggtaa

SEQ ID NO: 7037025 - DNA, 22 bp, Homo sapiens
ccctgggcagtctgcacttcag

SEQ ID NO: 7037026 - DNA, 22 bp, Homo sapiens
ccctgggcagtctgcacttcag

SEQ ID NO: 7037027 - DNA, 22 bp, Homo sapiens
ccctgggctcagagcaggtagc

SEQ ID NO: 7037028 - DNA, 22 bp, Homo sapiens
ccctgggctcagagcaggtagc

SEQ ID NO: 7037029 - DNA, 22 bp, Homo sapiens
ccctggggagcaggcgaaggag

SEQ ID NO: 7037030 - DNA, 22 bp, Homo sapiens
ccctggggctgagggatggccg

SEQ ID NO: 7037031 - DNA, 22 bp, Homo sapiens
agggccagctgcagaattagca

SEQ ID NO: 7037032 - DNA, 22 bp, Homo sapiens
agggccagctgatgagaatgag

SEQ ID NO: 7037033 - DNA, 22 bp, Homo sapiens
agggccagccgacttccagcct

SEQ ID NO: 7037034 - DNA, 22 bp, Homo sapiens
agggccagctagagccctcgcc

SEQ ID NO: 7037035 - DNA, 18 bp, Homo sapiens
agggccagctgtgagtag

SEQ ID NO: 7037036 - DNA, 22 bp, Homo sapiens
agggccaggaacacctgaaggg

SEQ ID NO: 7037037 - DNA, 22 bp, Homo sapiens
agggccaggatcacagccaaga

SEQ ID NO: 7037038 - DNA, 19 bp, Homo sapiens
agggccaggattctggaac

SEQ ID NO: 7037039 - DNA, 22 bp, Homo sapiens
agggccagagtggcaaaagcct

SEQ ID NO: 7037040 - DNA, 21 bp, Homo sapiens
agggccagatcaccaaggagc

SEQ ID NO: 7037041 - DNA, 22 bp, Homo sapiens
agggagcaaaggtttcagggtt

SEQ ID NO: 7037042 - DNA, 22 bp, Homo sapiens
ccccatcccacctgagtgtcac

SEQ ID NO: 7037043 - DNA, 21 bp, Homo sapiens
ccccatggagtacagttgggc

SEQ ID NO: 7037044 - DNA, 22 bp, Homo sapiens
ccccatggcaactgctgggggt

SEQ ID NO: 7037045 - DNA, 22 bp, Homo sapiens
ccccatgggtgtagggaggtgg

SEQ ID NO: 7037046 - DNA, 22 bp, Homo sapiens
agggagaaggtttagctgtgag

SEQ ID NO: 7037047 - DNA, 19 bp, Homo sapiens
agggaatccggctgaggga

SEQ ID NO: 7037048 - DNA, 22 bp, Homo sapiens
agggaatccatctatcttcatt

SEQ ID NO: 7037049 - DNA, 22 bp, Homo sapiens
aggctgtgtggtcatggtggct

SEQ ID NO: 7037050 - DNA, 22 bp, Homo sapiens
aggctgtgtttaagtggtaatg

SEQ ID NO: 7037051 - DNA, 22 bp, Homo sapiens
cccagctctcgcacttactagc

SEQ ID NO: 7037052 - DNA, 19 bp, Homo sapiens
cccagctctcgtggtgtgc

SEQ ID NO: 7037053 - DNA, 22 bp, Homo sapiens
cccagctctctcagttctgctt

SEQ ID NO: 7037054 - DNA, 22 bp, Homo sapiens
cccagctctctgctcttagcct

SEQ ID NO: 7037055 - DNA, 22 bp, Homo sapiens
cccagctctgcagacctgccct

SEQ ID NO: 7037056 - DNA, 22 bp, Homo sapiens
cccagctctgccatctacccac

SEQ ID NO: 7037057 - DNA, 22 bp, Homo sapiens
cccagctctggaaggtggggga

SEQ ID NO: 7037058 - DNA, 22 bp, Homo sapiens
cccagcctctgtttgctcctct

SEQ ID NO: 7037059 - DNA, 22 bp, Homo sapiens
cccagcctgatctcggccagct

SEQ ID NO: 7037060 - DNA, 22 bp, Homo sapiens
cccagctccttggatgggcagg

SEQ ID NO: 7037061 - DNA, 22 bp, Homo sapiens
cccagctccttgtttgcatctc

SEQ ID NO: 7037062 - DNA, 22 bp, Homo sapiens
cccagctcgccgccgatgtgcg

SEQ ID NO: 7037063 - DNA, 22 bp, Homo sapiens
cccagctctaggagtggtggca

SEQ ID NO: 7037064 - DNA, 22 bp, Homo sapiens
ccagttttgccatggtaacact

SEQ ID NO: 7037065 - DNA, 22 bp, Homo sapiens
ccagtttttccagtgctttctg

SEQ ID NO: 7037066 - DNA, 22 bp, Homo sapiens
cctgggactcggccaggacaga

SEQ ID NO: 7037067 - DNA, 22 bp, Homo sapiens
aggtgggaacccagcagggccc

SEQ ID NO: 7037068 - DNA, 21 bp, Homo sapiens
aggtggggctgcacctctgct

SEQ ID NO: 7037069 - DNA, 22 bp, Homo sapiens
aggtggggctgggaaagattcc

SEQ ID NO: 7037070 - DNA, 22 bp, Homo sapiens
cggagcctgcttgttgcagctg

SEQ ID NO: 7037071 - DNA, 20 bp, Homo sapiens
cggcctcacggtggcggtgc

SEQ ID NO: 7037072 - DNA, 22 bp, Homo sapiens
cggctcactgcagctccgcctc

SEQ ID NO: 7037073 - DNA, 22 bp, Homo sapiens
agtatatcacatgtagtaatgg

SEQ ID NO: 7037074 - DNA, 22 bp, Homo sapiens
aggtgggggctgtgtccttgac

SEQ ID NO: 7037075 - DNA, 22 bp, Homo sapiens
aggtggggtgagctgcagacta

SEQ ID NO: 7037076 - DNA, 22 bp, Homo sapiens
aggtggggtgttggatgtttat

SEQ ID NO: 7037077 - DNA, 22 bp, Homo sapiens
cctggacacccattccttggct

SEQ ID NO: 7037078 - DNA, 22 bp, Homo sapiens
cctgctctgccaagtcctcttt

SEQ ID NO: 7037079 - DNA, 22 bp, Homo sapiens
cctgctgagaaatcaagggagt

SEQ ID NO: 7037080 - DNA, 22 bp, Homo sapiens
cctgctgagaaatcaagggagt

SEQ ID NO: 7037081 - DNA, 22 bp, Homo sapiens
cctgctgagacttccaagggag

SEQ ID NO: 7037082 - DNA, 22 bp, Homo sapiens
cctctctctcctgcacacacac

SEQ ID NO: 7037083 - DNA, 22 bp, Homo sapiens
cctctctctgcatctggagggc

SEQ ID NO: 7037084 - DNA, 22 bp, Homo sapiens
cctctgagtgctttgagggaga

SEQ ID NO: 7037085 - DNA, 22 bp, Homo sapiens
cctgcccagcttcccgagtgca

SEQ ID NO: 7037086 - DNA, 22 bp, Homo sapiens
cctgcccaggagtctctctgtg

SEQ ID NO: 7037087 - DNA, 22 bp, Homo sapiens
cctgcccatcccgtccttggcc

SEQ ID NO: 7037088 - DNA, 22 bp, Homo sapiens
cctgccctatgaccagcttcac

SEQ ID NO: 7037089 - DNA, 22 bp, Homo sapiens
agggtcagagtcaggtgcagta

SEQ ID NO: 7037090 - DNA, 21 bp, Homo sapiens
agggtcaggaaccagggtacc

SEQ ID NO: 7037091 - DNA, 19 bp, Homo sapiens
agggtcaggacaaggactt

SEQ ID NO: 7037092 - DNA, 22 bp, Homo sapiens
agggtcaggttaagggagtcat

SEQ ID NO: 7037093 - DNA, 23 bp, Homo sapiens
agggtgagcaagctatggagacc

SEQ ID NO: 7037094 - DNA, 22 bp, Homo sapiens
agtctccttaaatatttcccag

SEQ ID NO: 7037095 - DNA, 22 bp, Homo sapiens
agtctctagtcatttcacctct

SEQ ID NO: 7037096 - DNA, 23 bp, Homo sapiens
agtctctatggcaattcctttac

SEQ ID NO: 7037097 - DNA, 17 bp, Homo sapiens
agtgaaatttacattgc

SEQ ID NO: 7037098 - DNA, 22 bp, Homo sapiens
agtatcagcagagcttaaaaga

SEQ ID NO: 7037099 - DNA, 22 bp, Homo sapiens
agtgggagaatgaataagggcc

SEQ ID NO: 7037100 - DNA, 22 bp, Homo sapiens
ctctggagcaccgggctatcca

SEQ ID NO: 7037101 - DNA, 22 bp, Homo sapiens
ctctgtctatcccattctgtgc

SEQ ID NO: 7037102 - DNA, 22 bp, Homo sapiens
agtggtggagccaggaaatgtg

SEQ ID NO: 7037103 - DNA, 22 bp, Homo sapiens
ctcttctttagtccagaccatc

SEQ ID NO: 7037104 - DNA, 22 bp, Homo sapiens
ctcttgggagtgctctggagaa

SEQ ID NO: 7037105 - DNA, 22 bp, Homo sapiens
ctcttgggtgggcagtgggcct

SEQ ID NO: 7037106 - DNA, 18 bp, Homo sapiens
ctccttggagaagaggcc

SEQ ID NO: 7037107 - DNA, 22 bp, Homo sapiens
ctccttggccgttaatgtcaca

SEQ ID NO: 7037108 - DNA, 22 bp, Homo sapiens
ctccttggccgttaatgtcaca

SEQ ID NO: 7037109 - DNA, 22 bp, Homo sapiens
ctccttggggtaaattgatgtg

SEQ ID NO: 7037110 - DNA, 23 bp, Homo sapiens
ctccttggtatgccatgcccagc

SEQ ID NO: 7037111 - DNA, 22 bp, Homo sapiens
ctccttggttcaaatgataaaa

SEQ ID NO: 7037112 - DNA, 22 bp, Homo sapiens
ctccttggttcaaatgataaaa

SEQ ID NO: 7037113 - DNA, 22 bp, Homo sapiens
ctcgagtttccacagtttgcat

SEQ ID NO: 7037114 - DNA, 17 bp, Homo sapiens
ctctccttcctctgagg

SEQ ID NO: 7037115 - DNA, 22 bp, Homo sapiens
ctctccttgcagatggctgcct

SEQ ID NO: 7037116 - DNA, 22 bp, Homo sapiens
ctgcagagcagccagtccccca

SEQ ID NO: 7037117 - DNA, 22 bp, Homo sapiens
ctgcagcgagacatagaggatg

SEQ ID NO: 7037118 - DNA, 22 bp, Homo sapiens
agtttggaagagaaaaatattt

SEQ ID NO: 7037119 - DNA, 22 bp, Homo sapiens
agtttggacaaaagactcctta

SEQ ID NO: 7037120 - DNA, 22 bp, Homo sapiens
agtttgtaacctaagattcagg

SEQ ID NO: 7037121 - DNA, 22 bp, Homo sapiens
agtttgtaataatgaaggaagt

SEQ ID NO: 7037122 - DNA, 22 bp, Homo sapiens
agtttgtatcaatttgctttat

SEQ ID NO: 7037123 - DNA, 22 bp, Homo sapiens
agtttgtatgccaacagcaaag

SEQ ID NO: 7037124 - DNA, 22 bp, Homo sapiens
ataaaagtctgcttatttgggc

SEQ ID NO: 7037125 - DNA, 20 bp, Homo sapiens
ataaaataactgccacaaga

SEQ ID NO: 7037126 - DNA, 23 bp, Homo sapiens
agttctttccaatgtcctcctct

SEQ ID NO: 7037127 - DNA, 22 bp, Homo sapiens
agttgtaacagattctaacata

SEQ ID NO: 7037128 - DNA, 22 bp, Homo sapiens
ctgaggcctctgttcaccagaa

SEQ ID NO: 7037129 - DNA, 22 bp, Homo sapiens
ataatattgagtcaggacctga

SEQ ID NO: 7037130 - DNA, 22 bp, Homo sapiens
ataatacatggttgatcttttc

SEQ ID NO: 7037131 - DNA, 17 bp, Homo sapiens
ctggagccaagagggcc

SEQ ID NO: 7037132 - DNA, 22 bp, Homo sapiens
ctggagccactttttatccttt

SEQ ID NO: 7037133 - DNA, 22 bp, Homo sapiens
ctggagccagccagggccctct

SEQ ID NO: 7037134 - DNA, 22 bp, Homo sapiens
ctggagccccagacagggagag

SEQ ID NO: 7037135 - DNA, 22 bp, Homo sapiens
atacagaattcactacagtttc

SEQ ID NO: 7037136 - DNA, 22 bp, Homo sapiens
atacagagggtttcatgggcag

SEQ ID NO: 7037137 - DNA, 22 bp, Homo sapiens
atactgaaaaagaagtgttgaa

SEQ ID NO: 7037138 - DNA, 22 bp, Homo sapiens
atactgaaaaatgatttgctgt

SEQ ID NO: 7037139 - DNA, 22 bp, Homo sapiens
atacttatgataaataattgct

SEQ ID NO: 7037140 - DNA, 22 bp, Homo sapiens
atacttctggtgacaaagtctt

SEQ ID NO: 7037141 - DNA, 22 bp, Homo sapiens
atactttagagctagattgcct

SEQ ID NO: 7037142 - DNA, 22 bp, Homo sapiens
atccacagagaggaagaatagt

SEQ ID NO: 7037143 - DNA, 22 bp, Homo sapiens
atccacaggagggtttggaaaa

SEQ ID NO: 7037144 - DNA, 22 bp, Homo sapiens
atccacagggtgtgttaagatg

SEQ ID NO: 7037145 - DNA, 22 bp, Homo sapiens
atccacagtcttagccatcaaa

SEQ ID NO: 7037146 - DNA, 22 bp, Homo sapiens
atccctggacggcgcctcccca

SEQ ID NO: 7037147 - DNA, 22 bp, Homo sapiens
atcctttaagttaataaaattc

SEQ ID NO: 7037148 - DNA, 22 bp, Homo sapiens
atcatgttggctctgacaaaaa

SEQ ID NO: 7037149 - DNA, 22 bp, Homo sapiens
atcatgttgtatgtaatctttt

SEQ ID NO: 7037150 - DNA, 22 bp, Homo sapiens
atcattaaatataagcttcaca

SEQ ID NO: 7037151 - DNA, 22 bp, Homo sapiens
ctgtggagatgcagaccaggcc

SEQ ID NO: 7037152 - DNA, 22 bp, Homo sapiens
ctgtggagcagggcagggtcac

SEQ ID NO: 7037153 - DNA, 23 bp, Homo sapiens
ctgtggagccctttgttgggaga

SEQ ID NO: 7037154 - DNA, 22 bp, Homo sapiens
ctgtggagcttgtggcagtggg

SEQ ID NO: 7037155 - DNA, 22 bp, Homo sapiens
ctgtggagcttgtggcagtggg

SEQ ID NO: 7037156 - DNA, 22 bp, Homo sapiens
ctgtggagtcctggggaatgga

SEQ ID NO: 7037157 - DNA, 22 bp, Homo sapiens
ctgtggagtcctggggaatgga

SEQ ID NO: 7037158 - DNA, 22 bp, Homo sapiens
ctgtggagtgcttggctcagtg

SEQ ID NO: 7037159 - DNA, 22 bp, Homo sapiens
atcattttgtgacaatgcctgt

SEQ ID NO: 7037160 - DNA, 22 bp, Homo sapiens
atcattttgtgacaatgcctgt

SEQ ID NO: 7037161 - DNA, 22 bp, Homo sapiens
atcatttttaagagactcttct

SEQ ID NO: 7037162 - DNA, 22 bp, Homo sapiens
atccaaggggaaagacgtctgg

SEQ ID NO: 7037163 - DNA, 22 bp, Homo sapiens
atatttgtcaattcactgttca

SEQ ID NO: 7037164 - DNA, 22 bp, Homo sapiens
ctgtccagtgactttgggccat

SEQ ID NO: 7037165 - DNA, 22 bp, Homo sapiens
atcacagtctttttcttaagta

SEQ ID NO: 7037166 - DNA, 22 bp, Homo sapiens
atcacagtgtagaccttttaaa

SEQ ID NO: 7037167 - DNA, 22 bp, Homo sapiens
ctgtcttctaccttcaacctcc

SEQ ID NO: 7037168 - DNA, 22 bp, Homo sapiens
atcatgttaaatatttcaatct

SEQ ID NO: 7037169 - DNA, 22 bp, Homo sapiens
atcatgttcatcgtatttaggc

SEQ ID NO: 7037170 - DNA, 22 bp, Homo sapiens
atatgtatgtacgcacatattc

SEQ ID NO: 7037171 - DNA, 22 bp, Homo sapiens
atatgtttttcacaggtttaag

SEQ ID NO: 7037172 - DNA, 22 bp, Homo sapiens
atatttctgggggtgtgtttct

SEQ ID NO: 7037173 - DNA, 20 bp, Homo sapiens
atatttcttaagaactttca

SEQ ID NO: 7037174 - DNA, 22 bp, Homo sapiens
atatttgtaaaattctgtgtct

SEQ ID NO: 7037175 - DNA, 22 bp, Homo sapiens
atatgcaagcacatagaatact

SEQ ID NO: 7037176 - DNA, 22 bp, Homo sapiens
ctgggcaggatacttcatggga

SEQ ID NO: 7037177 - DNA, 22 bp, Homo sapiens
atatgattgtccttagcaaatt

SEQ ID NO: 7037178 - DNA, 22 bp, Homo sapiens
ctgggcaggtatacaaaaaatg

SEQ ID NO: 7037179 - DNA, 20 bp, Homo sapiens
ctgggcaggtgtttgatctc

SEQ ID NO: 7037180 - DNA, 22 bp, Homo sapiens
ctgggcagtatgaatattcaaa

SEQ ID NO: 7037181 - DNA, 22 bp, Homo sapiens
ctgggcagtatgaatattcaaa

SEQ ID NO: 7037182 - DNA, 22 bp, Homo sapiens
ctgggcagtgcagctatagaac

SEQ ID NO: 7037183 - DNA, 22 bp, Homo sapiens
ctgggcagtgggcaagttgtat

SEQ ID NO: 7037184 - DNA, 22 bp, Homo sapiens
ctgggcagtggtggcatctttg

SEQ ID NO: 7037185 - DNA, 22 bp, Homo sapiens
ctgggcagtggtggcccttccc

SEQ ID NO: 7037186 - DNA, 22 bp, Homo sapiens
ctgggcagttcgctttcgtttt

SEQ ID NO: 7037187 - DNA, 22 bp, Homo sapiens
atatatcatgagtaaaacttga

SEQ ID NO: 7037188 - DNA, 22 bp, Homo sapiens
atatccaagaaacaattaattc

SEQ ID NO: 7037189 - DNA, 22 bp, Homo sapiens
atatgaaagtaagcatgtgtgt

SEQ ID NO: 7037190 - DNA, 22 bp, Homo sapiens
atatgacagcggattcacatat

SEQ ID NO: 7037191 - DNA, 22 bp, Homo sapiens
ctgggaagcttcgagcaggaaa

SEQ ID NO: 7037192 - DNA, 22 bp, Homo sapiens
atataacatacatacagaaaag

SEQ ID NO: 7037193 - DNA, 22 bp, Homo sapiens
atataacatacatacagaaaag

SEQ ID NO: 7037194 - DNA, 22 bp, Homo sapiens
atataactcttgttcttatagt

SEQ ID NO: 7037195 - DNA, 20 bp, Homo sapiens
atataataaattttggttac

SEQ ID NO: 7037196 - DNA, 20 bp, Homo sapiens
atataataaattttggttac

SEQ ID NO: 7037197 - DNA, 22 bp, Homo sapiens
atatacttggagactatcattg

SEQ ID NO: 7037198 - DNA, 22 bp, Homo sapiens
atatataacctggataaggctt

SEQ ID NO: 7037199 - DNA, 22 bp, Homo sapiens
atatatactttgacacattctg

SEQ ID NO: 7037200 - DNA, 22 bp, Homo sapiens
ctgggactttgtaggccagttg

SEQ ID NO: 7037201 - DNA, 22 bp, Homo sapiens
ctgggcacaggggagcagagtc

SEQ ID NO: 7037202 - DNA, 22 bp, Homo sapiens
ctgggcacaggggagcagagtc

SEQ ID NO: 7037203 - DNA, 22 bp, Homo sapiens
ctgggcacagtggctcacgcct

SEQ ID NO: 7037204 - DNA, 22 bp, Homo sapiens
atggctggcactggcctgggtt

SEQ ID NO: 7037205 - DNA, 23 bp, Homo sapiens
atggggctcaacacttagtagct

SEQ ID NO: 7037206 - DNA, 22 bp, Homo sapiens
atggggctctgcggctgctccc

SEQ ID NO: 7037207 - DNA, 22 bp, Homo sapiens
atggggctgaaacatggaagag

SEQ ID NO: 7037208 - DNA, 22 bp, Homo sapiens
atggggctgggattctcctcgg

SEQ ID NO: 7037209 - DNA, 22 bp, Homo sapiens
atggtattctctaactcagctt

SEQ ID NO: 7037210 - DNA, 22 bp, Homo sapiens
gaggccagggatgcaatgagag

SEQ ID NO: 7037211 - DNA, 22 bp, Homo sapiens
gaggccaggggcctggagatga

SEQ ID NO: 7037212 - DNA, 22 bp, Homo sapiens
gaggccaggggtcagcaattgg

SEQ ID NO: 7037213 - DNA, 22 bp, Homo sapiens
gaggccaggggtcagcaattgg

SEQ ID NO: 7037214 - DNA, 22 bp, Homo sapiens
gaggccagggtaccatcaacat

SEQ ID NO: 7037215 - DNA, 22 bp, Homo sapiens
atgtactaaagaaatttgcagg

SEQ ID NO: 7037216 - DNA, 22 bp, Homo sapiens
gaggctgctttgatgacaggag

SEQ ID NO: 7037217 - DNA, 22 bp, Homo sapiens
gaggctgctgccatcattaggt

SEQ ID NO: 7037218 - DNA, 22 bp, Homo sapiens
atggcagggcacagctctagtt

SEQ ID NO: 7037219 - DNA, 22 bp, Homo sapiens
gagccagcctccgcctctctcc

SEQ ID NO: 7037220 - DNA, 22 bp, Homo sapiens
gagccagccttcttctgaggtc

SEQ ID NO: 7037221 - DNA, 22 bp, Homo sapiens
gagccagcgccttgcctctggg

SEQ ID NO: 7037222 - DNA, 22 bp, Homo sapiens
gagccagctacatggtctgcaa

SEQ ID NO: 7037223 - DNA, 22 bp, Homo sapiens
gagccagctgagctgcactgtc

SEQ ID NO: 7037224 - DNA, 22 bp, Homo sapiens
gagccaggagatacctaagggg

SEQ ID NO: 7037225 - DNA, 22 bp, Homo sapiens
gagccaggaggcagagactgca

SEQ ID NO: 7037226 - DNA, 22 bp, Homo sapiens
atgccactgcgctccagcctgg

SEQ ID NO: 7037227 - DNA, 22 bp, Homo sapiens
atgccacttcattccagcctcg

SEQ ID NO: 7037228 - DNA, 22 bp, Homo sapiens
atggaaatgtaacttctgattc

SEQ ID NO: 7037229 - DNA, 22 bp, Homo sapiens
atggaaatgttccatatattga

SEQ ID NO: 7037230 - DNA, 22 bp, Homo sapiens
atggaacaggctcagagatgct

SEQ ID NO: 7037231 - DNA, 22 bp, Homo sapiens
atggaatatagtcttatatctc

SEQ ID NO: 7037232 - DNA, 22 bp, Homo sapiens
atgcacttaaataacataactt

SEQ ID NO: 7037233 - DNA, 22 bp, Homo sapiens
atgcacttcaagcatctctctg

SEQ ID NO: 7037234 - DNA, 22 bp, Homo sapiens
atgcacttgcgtgtttgcaaat

SEQ ID NO: 7037235 - DNA, 22 bp, Homo sapiens
atgcactttctagagattctga

SEQ ID NO: 7037236 - DNA, 22 bp, Homo sapiens
atgcaaacattcgcttgtctct

SEQ ID NO: 7037237 - DNA, 22 bp, Homo sapiens
atgcaaataaacagtctagttg

SEQ ID NO: 7037238 - DNA, 20 bp, Homo sapiens
atgcaaatcccaaaatcagg

SEQ ID NO: 7037239 - DNA, 22 bp, Homo sapiens
atgcaaatcttaagtatgtgtg

SEQ ID NO: 7037240 - DNA, 22 bp, Homo sapiens
atgcattgtcaggcaatttcat

SEQ ID NO: 7037241 - DNA, 22 bp, Homo sapiens
atgcattgtctggtttcatttt

SEQ ID NO: 7037242 - DNA, 22 bp, Homo sapiens
atgcatttatgtgtgtacattg

SEQ ID NO: 7037243 - DNA, 22 bp, Homo sapiens
atgattcaagaaaataggatgg

SEQ ID NO: 7037244 - DNA, 20 bp, Homo sapiens
atgattttgcactaacttca

SEQ ID NO: 7037245 - DNA, 22 bp, Homo sapiens
atgattttttctaacacagtcg

SEQ ID NO: 7037246 - DNA, 22 bp, Homo sapiens
atgattttttctaacacagtcg

SEQ ID NO: 7037247 - DNA, 22 bp, Homo sapiens
atgcaaaagactatttgttgct

SEQ ID NO: 7037248 - DNA, 22 bp, Homo sapiens
atgaagataatagcattggttg

SEQ ID NO: 7037249 - DNA, 22 bp, Homo sapiens
atgaagatacaggcagggccat

SEQ ID NO: 7037250 - DNA, 22 bp, Homo sapiens
atgaagatttcccagagacatg

SEQ ID NO: 7037251 - DNA, 22 bp, Homo sapiens
atgaggcagctgctggagaacg

SEQ ID NO: 7037252 - DNA, 22 bp, Homo sapiens
atgaggcaggagtgcagtggca

SEQ ID NO: 7037253 - DNA, 22 bp, Homo sapiens
atgaggcaggtggaggctgcca

SEQ ID NO: 7037254 - DNA, 22 bp, Homo sapiens
atgaggcagtctggcctgaggg

SEQ ID NO: 7037255 - DNA, 22 bp, Homo sapiens
cttgtaaaaggtacattatgct

SEQ ID NO: 7037256 - DNA, 19 bp, Homo sapiens
cttgtaaagggctgtttct

SEQ ID NO: 7037257 - DNA, 22 bp, Homo sapiens
cttgtaaatgcagattctgatt

SEQ ID NO: 7037258 - DNA, 22 bp, Homo sapiens
cttgtaactcctatttactatg

SEQ ID NO: 7037259 - DNA, 20 bp, Homo sapiens
atcttcttggccagcttgct

SEQ ID NO: 7037260 - DNA, 22 bp, Homo sapiens
atctagattaggtataagagct

SEQ ID NO: 7037261 - DNA, 22 bp, Homo sapiens
atcttgatcaaggctatcatga

SEQ ID NO: 7037262 - DNA, 22 bp, Homo sapiens
atcttgattccattatctttgt

SEQ ID NO: 7037263 - DNA, 22 bp, Homo sapiens
atcttttactacaaatcaggtg

SEQ ID NO: 7037264 - DNA, 22 bp, Homo sapiens
atctttttactaacactgctta

SEQ ID NO: 7037265 - DNA, 22 bp, Homo sapiens
atctttttatctgtttggaaca

SEQ ID NO: 7037266 - DNA, 22 bp, Homo sapiens
atctttttgacatggtgatggt

SEQ ID NO: 7037267 - DNA, 22 bp, Homo sapiens
atcttttttgtcttggtcactg

SEQ ID NO: 7037268 - DNA, 22 bp, Homo sapiens
cttgttatctgaaccaaaatta

SEQ ID NO: 7037269 - DNA, 23 bp, Homo sapiens
atgaaacatcacaatggtaccat

SEQ ID NO: 7037270 - DNA, 22 bp, Homo sapiens
atgaaattaatcaacacataca

SEQ ID NO: 7037271 - DNA, 22 bp, Homo sapiens
cttttagctgcaagtgttcaca

SEQ ID NO: 7037272 - DNA, 22 bp, Homo sapiens
cttttagctgtttccatggcaa

SEQ ID NO: 7037273 - DNA, 22 bp, Homo sapiens
cttttattttgaattaagggct

SEQ ID NO: 7037274 - DNA, 22 bp, Homo sapiens
cttttcatgagtctgttatggg

SEQ ID NO: 7037275 - DNA, 22 bp, Homo sapiens
cttttcatgagtctgttatggg

SEQ ID NO: 7037276 - DNA, 22 bp, Homo sapiens
attcctgaagaaggtatgttgc

SEQ ID NO: 7037277 - DNA, 22 bp, Homo sapiens
attcctgagacttatctgtttc

SEQ ID NO: 7037278 - DNA, 22 bp, Homo sapiens
attccttgtttcactgaaaagg

SEQ ID NO: 7037279 - DNA, 22 bp, Homo sapiens
attctacacaacatgatgatgg

SEQ ID NO: 7037280 - DNA, 22 bp, Homo sapiens
attcagttccttgtgattgtag

SEQ ID NO: 7037281 - DNA, 22 bp, Homo sapiens
attcagttaaaaactgtacttc

SEQ ID NO: 7037282 - DNA, 22 bp, Homo sapiens
attcagttaagggtcttgagat

SEQ ID NO: 7037283 - DNA, 22 bp, Homo sapiens
attcagttactctagacacttc

SEQ ID NO: 7037284 - DNA, 22 bp, Homo sapiens
attcagttagatcatcctaatt

SEQ ID NO: 7037285 - DNA, 22 bp, Homo sapiens
attcagttagccacagctattc

SEQ ID NO: 7037286 - DNA, 22 bp, Homo sapiens
attcagttagtagatttggtca

SEQ ID NO: 7037287 - DNA, 22 bp, Homo sapiens
attcagttattcagagaaggga

SEQ ID NO: 7037288 - DNA, 22 bp, Homo sapiens
attcagttatttactttgctat

SEQ ID NO: 7037289 - DNA, 22 bp, Homo sapiens
attcagttccttgagggtatag

SEQ ID NO: 7037290 - DNA, 22 bp, Homo sapiens
attatttacagtgtgctcgaag

SEQ ID NO: 7037291 - DNA, 22 bp, Homo sapiens
attatttagaaatcgattgaaa

SEQ ID NO: 7037292 - DNA, 22 bp, Homo sapiens
attatttatcctcttggtctat

SEQ ID NO: 7037293 - DNA, 22 bp, Homo sapiens
attgaatagatgcattatacta

SEQ ID NO: 7037294 - DNA, 22 bp, Homo sapiens
attcttcagcaggggacactat

SEQ ID NO: 7037295 - DNA, 22 bp, Homo sapiens
attctatctctatatttctgca

SEQ ID NO: 7037296 - DNA, 22 bp, Homo sapiens
attctattaatatttctaggaa

SEQ ID NO: 7037297 - DNA, 22 bp, Homo sapiens
attctattttttaagaagtagt

SEQ ID NO: 7037298 - DNA, 22 bp, Homo sapiens
attctgtcattacaaaaggcag

SEQ ID NO: 7037299 - DNA, 22 bp, Homo sapiens
attctgtcatttcaagaaaaac

SEQ ID NO: 7037300 - DNA, 22 bp, Homo sapiens
attctgtctttttaaaataata

SEQ ID NO: 7037301 - DNA, 22 bp, Homo sapiens
attcttaattccaaagactgag

SEQ ID NO: 7037302 - DNA, 22 bp, Homo sapiens
attcttaattgccatgctgtat

SEQ ID NO: 7037303 - DNA, 22 bp, Homo sapiens
attcttaattgccatgctgtat

SEQ ID NO: 7037304 - DNA, 22 bp, Homo sapiens
attcttattatagtaaaacagt

SEQ ID NO: 7037305 - DNA, 22 bp, Homo sapiens
attattcatggtcttccacaat

SEQ ID NO: 7037306 - DNA, 22 bp, Homo sapiens
attattcttgaggtgtttattg

SEQ ID NO: 7037307 - DNA, 22 bp, Homo sapiens
attattctttgataaatggcag

SEQ ID NO: 7037308 - DNA, 22 bp, Homo sapiens
attattcaatcatattaaaagt

SEQ ID NO: 7037309 - DNA, 22 bp, Homo sapiens
attattcaatgttatttcagtg

SEQ ID NO: 7037310 - DNA, 17 bp, Homo sapiens
gcaagggatgggagatt

SEQ ID NO: 7037311 - DNA, 22 bp, Homo sapiens
attaatttccaggcactgtgct

SEQ ID NO: 7037312 - DNA, 22 bp, Homo sapiens
attacaaaagaagggagaaggt

SEQ ID NO: 7037313 - DNA, 22 bp, Homo sapiens
attacaagtagactaactttca

SEQ ID NO: 7037314 - DNA, 22 bp, Homo sapiens
gcaagaaaaaggcttcatgaac

SEQ ID NO: 7037315 - DNA, 22 bp, Homo sapiens
atgtgtttggttatatggtatt

SEQ ID NO: 7037316 - DNA, 22 bp, Homo sapiens
atgtgtttgtacctttaaatat

SEQ ID NO: 7037317 - DNA, 22 bp, Homo sapiens
atgtttctcactgtttctctat

SEQ ID NO: 7037318 - DNA, 20 bp, Homo sapiens
atgtttctctgtcgtgattt

SEQ ID NO: 7037319 - DNA, 20 bp, Homo sapiens
atgtttctctgtcgtgattt

SEQ ID NO: 7037320 - DNA, 18 bp, Homo sapiens
atgtttctcttggctctg

SEQ ID NO: 7037321 - DNA, 18 bp, Homo sapiens
atgtttctcttggctctg

SEQ ID NO: 7037322 - DNA, 22 bp, Homo sapiens
atgtttctgaagtttacagata

SEQ ID NO: 7037323 - DNA, 22 bp, Homo sapiens
atgttttatattttgcagcagt

SEQ ID NO: 7037324 - DNA, 22 bp, Homo sapiens
atgttttatgttccactcaagg

SEQ ID NO: 7037325 - DNA, 22 bp, Homo sapiens
atgttttcaaagtaaacttgta

SEQ ID NO: 7037326 - DNA, 22 bp, Homo sapiens
atgttttcctgggagagcactc

SEQ ID NO: 7037327 - DNA, 22 bp, Homo sapiens
atgttttctccatgttatgctt

SEQ ID NO: 7037328 - DNA, 22 bp, Homo sapiens
atgttttctttcagacttccct

SEQ ID NO: 7037329 - DNA, 22 bp, Homo sapiens
atgttttgattggttaggtctg

SEQ ID NO: 7037330 - DNA, 22 bp, Homo sapiens
atgtttttcataccagtgttgg

SEQ ID NO: 7037331 - DNA, 22 bp, Homo sapiens
atgtttttgagatacaaacaga

SEQ ID NO: 7037332 - DNA, 22 bp, Homo sapiens
atgtttttggcttcaagtttct

SEQ ID NO: 7037333 - DNA, 22 bp, Homo sapiens
atgtttttggcttcaagtttct

SEQ ID NO: 7037334 - DNA, 22 bp, Homo sapiens
attaaaagcttcccaagagtta

SEQ ID NO: 7037335 - DNA, 22 bp, Homo sapiens
attaaaattccaaggtatgcca

SEQ ID NO: 7037336 - DNA, 22 bp, Homo sapiens
attaaatgttccttaaattata

SEQ ID NO: 7037337 - DNA, 22 bp, Homo sapiens
attaaatgttggcatattttgt

SEQ ID NO: 7037338 - DNA, 22 bp, Homo sapiens
caaaccttgttccagtcaactc

SEQ ID NO: 7037339 - DNA, 22 bp, Homo sapiens
caaactctgtaggacagttcaa

SEQ ID NO: 7037340 - DNA, 22 bp, Homo sapiens
gcgaggaggggtgctgggcccc

SEQ ID NO: 7037341 - DNA, 22 bp, Homo sapiens
caaacttacgtagtcttactac

SEQ ID NO: 7037342 - DNA, 22 bp, Homo sapiens
caaactttcagttataacatga

SEQ ID NO: 7037343 - DNA, 22 bp, Homo sapiens
gctcaggagctgacagcctcaa

SEQ ID NO: 7037344 - DNA, 22 bp, Homo sapiens
gctcaggagctgacagcctcaa

SEQ ID NO: 7037345 - DNA, 22 bp, Homo sapiens
gcctgggagggcagcagtgtgg

SEQ ID NO: 7037346 - DNA, 22 bp, Homo sapiens
gcctgggagtgcacagtgaggt

SEQ ID NO: 7037347 - DNA, 22 bp, Homo sapiens
attttttagaacctggcctgat

SEQ ID NO: 7037348 - DNA, 22 bp, Homo sapiens
caaaaactgcaattacttttac

SEQ ID NO: 7037349 - DNA, 22 bp, Homo sapiens
gcctggagctcatgtgggcatt

SEQ ID NO: 7037350 - DNA, 22 bp, Homo sapiens
gcctggagctctccacttgggg

SEQ ID NO: 7037351 - DNA, 22 bp, Homo sapiens
gcctgggagcacatcggggtcc

SEQ ID NO: 7037352 - DNA, 22 bp, Homo sapiens
attggaaagttcttaagggata

SEQ ID NO: 7037353 - DNA, 22 bp, Homo sapiens
attggaaatacagtagaaaaat

SEQ ID NO: 7037354 - DNA, 22 bp, Homo sapiens
attggaaatactgagagataaa

SEQ ID NO: 7037355 - DNA, 22 bp, Homo sapiens
attggaaatactgagagataaa

SEQ ID NO: 7037356 - DNA, 22 bp, Homo sapiens
attggagaaatggggctttagg

SEQ ID NO: 7037357 - DNA, 22 bp, Homo sapiens
atttaatgtcgagctattgtag

SEQ ID NO: 7037358 - DNA, 22 bp, Homo sapiens
atttaattaatcatggtgaatt

SEQ ID NO: 7037359 - DNA, 22 bp, Homo sapiens
atttaattgttcttctggctat

SEQ ID NO: 7037360 - DNA, 22 bp, Homo sapiens
atttaatttgtgtctttagctg

SEQ ID NO: 7037361 - DNA, 22 bp, Homo sapiens
atttaatttgtgtctttagctg

SEQ ID NO: 7037362 - DNA, 22 bp, Homo sapiens
atttacacattcataagatttc

SEQ ID NO: 7037363 - DNA, 22 bp, Homo sapiens
atttacaccttcttcgattctc

SEQ ID NO: 7037364 - DNA, 22 bp, Homo sapiens
atttacactaaaggaaggagga

SEQ ID NO: 7037365 - DNA, 22 bp, Homo sapiens
atttacactggttctcagagct

SEQ ID NO: 7037366 - DNA, 22 bp, Homo sapiens
atttacacttggtttactagag

SEQ ID NO: 7037367 - DNA, 22 bp, Homo sapiens
gccaggaggctgctgtgtaggc

SEQ ID NO: 7037368 - DNA, 22 bp, Homo sapiens
gccaggaggcttaactggacag

SEQ ID NO: 7037369 - DNA, 22 bp, Homo sapiens
gccaggaggcttaactggacag

SEQ ID NO: 7037370 - DNA, 22 bp, Homo sapiens
gccaggagggaaaggacaattt

SEQ ID NO: 7037371 - DNA, 19 bp, Homo sapiens
gccaggagggctctggctg

SEQ ID NO: 7037372 - DNA, 22 bp, Homo sapiens
gccaggaggggagagtgtgtca

SEQ ID NO: 7037373 - DNA, 20 bp, Homo sapiens
gccaggagggtgtgatgagc

SEQ ID NO: 7037374 - DNA, 22 bp, Homo sapiens
gccaggaggtcagcccctcaac

SEQ ID NO: 7037375 - DNA, 17 bp, Homo sapiens
gccaggaggtttgagct

SEQ ID NO: 7037376 - DNA, 21 bp, Homo sapiens
gccaggagtagattacattta

SEQ ID NO: 7037377 - DNA, 23 bp, Homo sapiens
gccaggagtgggtagactaatgc

SEQ ID NO: 7037378 - DNA, 22 bp, Homo sapiens
gccaggagtgtcccactcattt

SEQ ID NO: 7037379 - DNA, 22 bp, Homo sapiens
gccaggagtgtgtggctatgtt

SEQ ID NO: 7037380 - DNA, 22 bp, Homo sapiens
atttcaggaatctgtatgaaag

SEQ ID NO: 7037381 - DNA, 22 bp, Homo sapiens
atttcaggagcagtttcagtgg

SEQ ID NO: 7037382 - DNA, 22 bp, Homo sapiens
atttcaggatagcctagttttg

SEQ ID NO: 7037383 - DNA, 22 bp, Homo sapiens
atttcaggatggaaagaggcca

SEQ ID NO: 7037384 - DNA, 22 bp, Homo sapiens
atttcaggccaccagatgtctt

SEQ ID NO: 7037385 - DNA, 22 bp, Homo sapiens
atttcagggagtcatttacaca

SEQ ID NO: 7037386 - DNA, 22 bp, Homo sapiens
atttcagggatgtctgtaaatt

SEQ ID NO: 7037387 - DNA, 22 bp, Homo sapiens
atttcagggtaaaaagtgttca

SEQ ID NO: 7037388 - DNA, 22 bp, Homo sapiens
atttcagggtgtcttccaactg

SEQ ID NO: 7037389 - DNA, 22 bp, Homo sapiens
atttcaggtacctgtgggatcc

SEQ ID NO: 7037390 - DNA, 20 bp, Homo sapiens
atttcaggttgtgttctgtt

SEQ ID NO: 7037391 - DNA, 22 bp, Homo sapiens
atttcatagattgtaaatccct

SEQ ID NO: 7037392 - DNA, 22 bp, Homo sapiens
atttcatggcagactttaaccc

SEQ ID NO: 7037393 - DNA, 21 bp, Homo sapiens
atttcatggtgcttttaagaa

SEQ ID NO: 7037394 - DNA, 22 bp, Homo sapiens
atttccttgcaacttaggcatg

SEQ ID NO: 7037395 - DNA, 22 bp, Homo sapiens
cacagcttagaaaagaagccat

SEQ ID NO: 7037396 - DNA, 22 bp, Homo sapiens
cacagcttgggctctgacaata

SEQ ID NO: 7037397 - DNA, 20 bp, Homo sapiens
caccagtcatgagtcaatac

SEQ ID NO: 7037398 - DNA, 16 bp, Homo sapiens
caccagtccttcctgc

SEQ ID NO: 7037399 - DNA, 22 bp, Homo sapiens
ggcagccagagggcagctggat

SEQ ID NO: 7037400 - DNA, 22 bp, Homo sapiens
caccatctagcagagagatgga

SEQ ID NO: 7037401 - DNA, 22 bp, Homo sapiens
cacccagtgaaggagcaagagg

SEQ ID NO: 7037402 - DNA, 22 bp, Homo sapiens
caccccagcttctcaggataga

SEQ ID NO: 7037403 - DNA, 19 bp, Homo sapiens
caccccagtcctctttccc

SEQ ID NO: 7037404 - DNA, 22 bp, Homo sapiens
caccccagtctaaaaccagcct

SEQ ID NO: 7037405 - DNA, 22 bp, Homo sapiens
ggcctctcattctccctggtcc

SEQ ID NO: 7037406 - DNA, 22 bp, Homo sapiens
ggcctcctcaccctgctcaggc

SEQ ID NO: 7037407 - DNA, 23 bp, Homo sapiens
ggcctcctggtctaggctagact

SEQ ID NO: 7037408 - DNA, 22 bp, Homo sapiens
ggcctcctgttggctagtgtga

SEQ ID NO: 7037409 - DNA, 22 bp, Homo sapiens
cactgagaggtctcatttccaa

SEQ ID NO: 7037410 - DNA, 22 bp, Homo sapiens
ggctagggagacagagggcatg

SEQ ID NO: 7037411 - DNA, 22 bp, Homo sapiens
ggctagggagacagagggcatg

SEQ ID NO: 7037412 - DNA, 22 bp, Homo sapiens
gctgtaaataagcttacttgaa

SEQ ID NO: 7037413 - DNA, 22 bp, Homo sapiens
cacaatattggccgggctggtc

SEQ ID NO: 7037414 - DNA, 22 bp, Homo sapiens
cacaattagcagctctttattt

SEQ ID NO: 7037415 - DNA, 19 bp, Homo sapiens
cacaattatgagacactta

SEQ ID NO: 7037416 - DNA, 22 bp, Homo sapiens
cacaattattatctctttctac

SEQ ID NO: 7037417 - DNA, 22 bp, Homo sapiens
caagaggagcaggcaggtgtgc

SEQ ID NO: 7037418 - DNA, 22 bp, Homo sapiens
caagatatcaatgacatagtat

SEQ ID NO: 7037419 - DNA, 22 bp, Homo sapiens
caaggagataaaatgttgagct

SEQ ID NO: 7037420 - DNA, 22 bp, Homo sapiens
gctgcagagacagctgccgatg

SEQ ID NO: 7037421 - DNA, 22 bp, Homo sapiens
gctgcagagcctggagccctgg

SEQ ID NO: 7037422 - DNA, 19 bp, Homo sapiens
gctgcagagtattcttggg

SEQ ID NO: 7037423 - DNA, 22 bp, Homo sapiens
gctgcagatcccacccattccc

SEQ ID NO: 7037424 - DNA, 22 bp, Homo sapiens
gctgcagccaaattcattgtca

SEQ ID NO: 7037425 - DNA, 22 bp, Homo sapiens
gctgcagcccggcgcgcctgag

SEQ ID NO: 7037426 - DNA, 22 bp, Homo sapiens
gctgcagccttcttgccattaa

SEQ ID NO: 7037427 - DNA, 17 bp, Homo sapiens
gctgcagcggtaggcag

SEQ ID NO: 7037428 - DNA, 22 bp, Homo sapiens
gctgcagtgagccaagatcgtg

SEQ ID NO: 7037429 - DNA, 22 bp, Homo sapiens
gctgcagtgagccaagatcgtg

SEQ ID NO: 7037430 - DNA, 22 bp, Homo sapiens
caacagtttatagtgttatctt

SEQ ID NO: 7037431 - DNA, 22 bp, Homo sapiens
caacatatgattttgtatataa

SEQ ID NO: 7037432 - DNA, 22 bp, Homo sapiens
caacatatgctttcatgaggta

SEQ ID NO: 7037433 - DNA, 22 bp, Homo sapiens
cagagctggtaagtggtagagg

SEQ ID NO: 7037434 - DNA, 22 bp, Homo sapiens
cagaggctgtgtaggcagactg

SEQ ID NO: 7037435 - DNA, 22 bp, Homo sapiens
cagaggcttcaagtcattctcc

SEQ ID NO: 7037436 - DNA, 22 bp, Homo sapiens
cagaggcttggcattatcatgc

SEQ ID NO: 7037437 - DNA, 22 bp, Homo sapiens
cagaggctttgccctggaaacc

SEQ ID NO: 7037438 - DNA, 22 bp, Homo sapiens
cagaggtggggagtatttcaag

SEQ ID NO: 7037439 - DNA, 22 bp, Homo sapiens
gggctgtgtactatgaggaggg

SEQ ID NO: 7037440 - DNA, 22 bp, Homo sapiens
ggggaacaccgggcagaggcgc

SEQ ID NO: 7037441 - DNA, 22 bp, Homo sapiens
gggcgagggcgaaagcgagagc

SEQ ID NO: 7037442 - DNA, 22 bp, Homo sapiens
cagagcccttggctggagccca

SEQ ID NO: 7037443 - DNA, 22 bp, Homo sapiens
cagagcccctcgtctccaccac

SEQ ID NO: 7037444 - DNA, 22 bp, Homo sapiens
gggcacttctaagcatggggct

SEQ ID NO: 7037445 - DNA, 22 bp, Homo sapiens
gggacacaggtatctcaaatga

SEQ ID NO: 7037446 - DNA, 22 bp, Homo sapiens
ggcttttgctgtgttttccaga

SEQ ID NO: 7037447 - DNA, 22 bp, Homo sapiens
cagacaggaattctggcgtggt

SEQ ID NO: 7037448 - DNA, 22 bp, Homo sapiens
cagacaggagactggatcatgg

SEQ ID NO: 7037449 - DNA, 22 bp, Homo sapiens
cagacaggcaggtgagagctcc

SEQ ID NO: 7037450 - DNA, 22 bp, Homo sapiens
cagacaggctagccagactcac

SEQ ID NO: 7037451 - DNA, 23 bp, Homo sapiens
gggagcacagcctggtgggcgcg

SEQ ID NO: 7037452 - DNA, 17 bp, Homo sapiens
cagacaggctgtcaccc

SEQ ID NO: 7037453 - DNA, 22 bp, Homo sapiens
cagacagggacctcgctccaga

SEQ ID NO: 7037454 - DNA, 22 bp, Homo sapiens
cagacagggccctgtgatggta

SEQ ID NO: 7037455 - DNA, 22 bp, Homo sapiens
cagacagggtcctgtccgtcac

SEQ ID NO: 7037456 - DNA, 22 bp, Homo sapiens
gtaaaattgcaattacttttgc

SEQ ID NO: 7037457 - DNA, 22 bp, Homo sapiens
gtaaacaggaatgtggtcatgg

SEQ ID NO: 7037458 - DNA, 22 bp, Homo sapiens
cagcaatagtgtgtttgtttca

SEQ ID NO: 7037459 - DNA, 22 bp, Homo sapiens
ggtgggtatagttagggcctct

SEQ ID NO: 7037460 - DNA, 22 bp, Homo sapiens
ggtggggctaggacctcaggat

SEQ ID NO: 7037461 - DNA, 21 bp, Homo sapiens
gggtgggaggacacagcaggc

SEQ ID NO: 7037462 - DNA, 21 bp, Homo sapiens
gggtgggaggacacagcaggc

SEQ ID NO: 7037463 - DNA, 22 bp, Homo sapiens
cagcaggatttgaaaggaagag

SEQ ID NO: 7037464 - DNA, 22 bp, Homo sapiens
cagcaggcaggtgggccaagtc

SEQ ID NO: 7037465 - DNA, 22 bp, Homo sapiens
gtattttaagtgactactaggt

SEQ ID NO: 7037466 - DNA, 22 bp, Homo sapiens
gtattttactgctcaaagctct

SEQ ID NO: 7037467 - DNA, 22 bp, Homo sapiens
gtattttacttacgcatgactt

SEQ ID NO: 7037468 - DNA, 22 bp, Homo sapiens
gtattttacttacgcatgactt

SEQ ID NO: 7037469 - DNA, 22 bp, Homo sapiens
cagcattgccctttttctcaga

SEQ ID NO: 7037470 - DNA, 22 bp, Homo sapiens
cagcccagcactaagtagattt

SEQ ID NO: 7037471 - DNA, 22 bp, Homo sapiens
tctctcttcaacccttaactag

SEQ ID NO: 7037472 - DNA, 22 bp, Homo sapiens
tctctcttcagagataccttgc

SEQ ID NO: 7037473 - DNA, 22 bp, Homo sapiens
tctctcttcatgcttttagaat

SEQ ID NO: 7037474 - DNA, 22 bp, Homo sapiens
tctctcttctttgttaagaatg

SEQ ID NO: 7037475 - DNA, 22 bp, Homo sapiens
tctctcttgtcaccccatctgc

SEQ ID NO: 7037476 - DNA, 20 bp, Homo sapiens
tctcttggcttgggggacac

SEQ ID NO: 7037477 - DNA, 20 bp, Homo sapiens
tctcttggcttgggggacac

SEQ ID NO: 7037478 - DNA, 22 bp, Homo sapiens
tctcttgtaatttaaaaaatct

SEQ ID NO: 7037479 - DNA, 22 bp, Homo sapiens
ccagctccaagtttgggcatca

SEQ ID NO: 7037480 - DNA, 22 bp, Homo sapiens
ccagctcctcttcccagtgtca

SEQ ID NO: 7037481 - DNA, 22 bp, Homo sapiens
ccagctccttctgtctgtggag

SEQ ID NO: 7037482 - DNA, 22 bp, Homo sapiens
tctgcctgaaccactcttggag

SEQ ID NO: 7037483 - DNA, 22 bp, Homo sapiens
tctgctaaatagatttggcaat

SEQ ID NO: 7037484 - DNA, 22 bp, Homo sapiens
tctgctaacaatattgcagact

SEQ ID NO: 7037485 - DNA, 22 bp, Homo sapiens
ccagcttcggcaagcagacttt

SEQ ID NO: 7037486 - DNA, 22 bp, Homo sapiens
ccagcttctccttatgtcctca

SEQ ID NO: 7037487 - DNA, 22 bp, Homo sapiens
ccaggaaagaggaagaacgcat

SEQ ID NO: 7037488 - DNA, 23 bp, Homo sapiens
ccaggaaagatccaggaagaggc

SEQ ID NO: 7037489 - DNA, 22 bp, Homo sapiens
ccaggaggcagaggttacagtg

SEQ ID NO: 7037490 - DNA, 22 bp, Homo sapiens
tctgtcttggccagccatctgg

SEQ ID NO: 7037491 - DNA, 22 bp, Homo sapiens
tccctgcctgacagcacccacc

SEQ ID NO: 7037492 - DNA, 22 bp, Homo sapiens
catttgctgtaatgacaataag

SEQ ID NO: 7037493 - DNA, 22 bp, Homo sapiens
catttgaacctggatgttctta

SEQ ID NO: 7037494 - DNA, 22 bp, Homo sapiens
catttgatctcctgaataaaca

SEQ ID NO: 7037495 - DNA, 22 bp, Homo sapiens
ccacacagggggatgagttatt

SEQ ID NO: 7037496 - DNA, 21 bp, Homo sapiens
ccacaattctagttacatatg

SEQ ID NO: 7037497 - DNA, 22 bp, Homo sapiens
ccaagggccatcctatcacttg

SEQ ID NO: 7037498 - DNA, 22 bp, Homo sapiens
ccaagggcccttctaaaattct

SEQ ID NO: 7037499 - DNA, 22 bp, Homo sapiens
ccaagggcgcctccgttccccc

SEQ ID NO: 7037500 - DNA, 22 bp, Homo sapiens
ccaagggctatttacagaacag

SEQ ID NO: 7037501 - DNA, 22 bp, Homo sapiens
ccaattcacctcctatgcacat

SEQ ID NO: 7037502 - DNA, 22 bp, Homo sapiens
ccaattcacttccaaccccttc

SEQ ID NO: 7037503 - DNA, 23 bp, Homo sapiens
ccaattcagatattggcttgtgc

SEQ ID NO: 7037504 - DNA, 23 bp, Homo sapiens
ccaattcatggcagatttgaaga

SEQ ID NO: 7037505 - DNA, 22 bp, Homo sapiens
ccaagggcatcttgcatgctgg

SEQ ID NO: 7037506 - DNA, 22 bp, Homo sapiens
ccacagattatttctaaacagg

SEQ ID NO: 7037507 - DNA, 20 bp, Homo sapiens
tcctgcagttcctaggaggg

SEQ ID NO: 7037508 - DNA, 16 bp, Homo sapiens
ccacctgcagctctca

SEQ ID NO: 7037509 - DNA, 22 bp, Homo sapiens
ccagaagggctattgcagtgac

SEQ ID NO: 7037510 - DNA, 22 bp, Homo sapiens
ccagaatagaatgaaagaaggg

SEQ ID NO: 7037511 - DNA, 22 bp, Homo sapiens
ccagaggaaaaatatctcccta

SEQ ID NO: 7037512 - DNA, 22 bp, Homo sapiens
tctccattttatagataatgaa

SEQ ID NO: 7037513 - DNA, 22 bp, Homo sapiens
ccagaggacttgggggctgaat

SEQ ID NO: 7037514 - DNA, 22 bp, Homo sapiens
ccagaggagatgcctcctctgt

SEQ ID NO: 7037515 - DNA, 22 bp, Homo sapiens
ccagaggagcaggctggctcca

SEQ ID NO: 7037516 - DNA, 22 bp, Homo sapiens
ccagaggaggggggtctttctg

SEQ ID NO: 7037517 - DNA, 22 bp, Homo sapiens
ccagaggtgccacagaaagagc

SEQ ID NO: 7037518 - DNA, 22 bp, Homo sapiens
ccagaggtgctctttggaagtg

SEQ ID NO: 7037519 - DNA, 22 bp, Homo sapiens
ccagaggtgctgggagaggtct

SEQ ID NO: 7037520 - DNA, 22 bp, Homo sapiens
ccagatatcactgccgtgttgt

SEQ ID NO: 7037521 - DNA, 22 bp, Homo sapiens
ccagatgtccctctcaggtttg

SEQ ID NO: 7037522 - DNA, 22 bp, Homo sapiens
tcatttttagcgcgcaaaagtt

SEQ ID NO: 7037523 - DNA, 22 bp, Homo sapiens
catgcaaaatgtattttattag

SEQ ID NO: 7037524 - DNA, 22 bp, Homo sapiens
tcaggtggcttcggggagtggc

SEQ ID NO: 7037525 - DNA, 22 bp, Homo sapiens
tcaggtgggacctgctaggaca

SEQ ID NO: 7037526 - DNA, 22 bp, Homo sapiens
tcaggtgggacctgctaggaca

SEQ ID NO: 7037527 - DNA, 22 bp, Homo sapiens
tcaggtgggcgttccggtgcgg

SEQ ID NO: 7037528 - DNA, 22 bp, Homo sapiens
catctttagttattgaatatag

SEQ ID NO: 7037529 - DNA, 22 bp, Homo sapiens
tcagttctgctagaaaaacagt

SEQ ID NO: 7037530 - DNA, 20 bp, Homo sapiens
tcagtttaaatcctggcttt

SEQ ID NO: 7037531 - DNA, 22 bp, Homo sapiens
tcagtttaagatgactaacaat

SEQ ID NO: 7037532 - DNA, 22 bp, Homo sapiens
catgatataaagtagtagataa

SEQ ID NO: 7037533 - DNA, 22 bp, Homo sapiens
tcatgggcagctactggttccc

SEQ ID NO: 7037534 - DNA, 21 bp, Homo sapiens
tcatgggcaggtcacttcttt

SEQ ID NO: 7037535 - DNA, 22 bp, Homo sapiens
tcatggggctcttcaagtggag

SEQ ID NO: 7037536 - DNA, 22 bp, Homo sapiens
tcatgtattgaaaagcatttta

SEQ ID NO: 7037537 - DNA, 22 bp, Homo sapiens
catactttttagatctgccttc

SEQ ID NO: 7037538 - DNA, 22 bp, Homo sapiens
catactttttagatctgccttc

SEQ ID NO: 7037539 - DNA, 22 bp, Homo sapiens
cagtttatatgtcagagctgta

SEQ ID NO: 7037540 - DNA, 22 bp, Homo sapiens
cagtttctctcatacatatttg

SEQ ID NO: 7037541 - DNA, 22 bp, Homo sapiens
cagtttctgggaggaaaggaag

SEQ ID NO: 7037542 - DNA, 22 bp, Homo sapiens
cagtttctgttttaaatagcag

SEQ ID NO: 7037543 - DNA, 22 bp, Homo sapiens
cagtttcttaagactgagatct

SEQ ID NO: 7037544 - DNA, 22 bp, Homo sapiens
cagtttcttagtgacacaaatc

SEQ ID NO: 7037545 - DNA, 22 bp, Homo sapiens
cagtttcttatcttcaaaattg

SEQ ID NO: 7037546 - DNA, 22 bp, Homo sapiens
cagtttcttcaattcagacact

SEQ ID NO: 7037547 - DNA, 22 bp, Homo sapiens
cagtttcttcatcagttaagca

SEQ ID NO: 7037548 - DNA, 22 bp, Homo sapiens
cagtttcttcatctgcagaatc

SEQ ID NO: 7037549 - DNA, 22 bp, Homo sapiens
cagtttcttcatctgcagaatc

SEQ ID NO: 7037550 - DNA, 22 bp, Homo sapiens
catataaatacaacatgtgtta

SEQ ID NO: 7037551 - DNA, 22 bp, Homo sapiens
catatacacttccacctctgtg

SEQ ID NO: 7037552 - DNA, 22 bp, Homo sapiens
catatactgcatacatatgtgt

SEQ ID NO: 7037553 - DNA, 22 bp, Homo sapiens
catatacttttctatagctttc

SEQ ID NO: 7037554 - DNA, 20 bp, Homo sapiens
catatatacctagaagtgga

SEQ ID NO: 7037555 - DNA, 22 bp, Homo sapiens
catatcaaagagaaggatagga

SEQ ID NO: 7037556 - DNA, 22 bp, Homo sapiens
catatcccattggccaggacat

SEQ ID NO: 7037557 - DNA, 22 bp, Homo sapiens
catatcttctgacatgatcagg

SEQ ID NO: 7037558 - DNA, 21 bp, Homo sapiens
catatgaaagaagtatctgac

SEQ ID NO: 7037559 - DNA, 22 bp, Homo sapiens
tattgcatttcccacgttcact

SEQ ID NO: 7037560 - DNA, 22 bp, Homo sapiens
tattggaaggaagcaagagagg

SEQ ID NO: 7037561 - DNA, 22 bp, Homo sapiens
tattggaaggaagcaagagagg

SEQ ID NO: 7037562 - DNA, 22 bp, Homo sapiens
tagttttataatgttaacatct

SEQ ID NO: 7037563 - DNA, 22 bp, Homo sapiens
tataagtgacagattatccaaa

SEQ ID NO: 7037564 - DNA, 22 bp, Homo sapiens
caggggcaagaatgctgtcagc

SEQ ID NO: 7037565 - DNA, 22 bp, Homo sapiens
caggggcaggtgtgagatcatc

SEQ ID NO: 7037566 - DNA, 22 bp, Homo sapiens
caggggcagtctgtgtgcgtgg

SEQ ID NO: 7037567 - DNA, 22 bp, Homo sapiens
cagggtggaagctgtagagtgg

SEQ ID NO: 7037568 - DNA, 22 bp, Homo sapiens
tatacagatggaaagatacaca

SEQ ID NO: 7037569 - DNA, 22 bp, Homo sapiens
tatacagattaacagatttaaa

SEQ ID NO: 7037570 - DNA, 21 bp, Homo sapiens
tatacagtaattaagtggtat

SEQ ID NO: 7037571 - DNA, 22 bp, Homo sapiens
tatacagtcttttgctatattc

SEQ ID NO: 7037572 - DNA, 22 bp, Homo sapiens
tatacagtgcctcttccattag

SEQ ID NO: 7037573 - DNA, 22 bp, Homo sapiens
tattggaaggcattagtgaata

SEQ ID NO: 7037574 - DNA, 22 bp, Homo sapiens
tattgggacttaaaggtaaaga

SEQ ID NO: 7037575 - DNA, 22 bp, Homo sapiens
cagtcctctcactcaggccttt

SEQ ID NO: 7037576 - DNA, 22 bp, Homo sapiens
cagtccttagattttactgcca

SEQ ID NO: 7037577 - DNA, 22 bp, Homo sapiens
cagtccttattcctatattcct

SEQ ID NO: 7037578 - DNA, 22 bp, Homo sapiens
cagtctacctttcagacattga

SEQ ID NO: 7037579 - DNA, 22 bp, Homo sapiens
cagtctcatagttgtttcttat

SEQ ID NO: 7037580 - DNA, 22 bp, Homo sapiens
cagtctctaaatcaatctgaat

SEQ ID NO: 7037581 - DNA, 22 bp, Homo sapiens
cagtgctgggcagaggagagcg

SEQ ID NO: 7037582 - DNA, 22 bp, Homo sapiens
tacagggtattcaagggtagtt

SEQ ID NO: 7037583 - DNA, 21 bp, Homo sapiens
tacaagttgcttttgaagtcc

SEQ ID NO: 7037584 - DNA, 22 bp, Homo sapiens
tacaaactaacatgtctcatcc

SEQ ID NO: 7037585 - DNA, 22 bp, Homo sapiens
tacaaatgaaccaactttgatg

SEQ ID NO: 7037586 - DNA, 22 bp, Homo sapiens
tacaaatgagttgtatgaacca

SEQ ID NO: 7037587 - DNA, 22 bp, Homo sapiens
tacaaatgggttaaaatatagt

SEQ ID NO: 7037588 - DNA, 22 bp, Homo sapiens
caggccctttcctgggcatagg

SEQ ID NO: 7037589 - DNA, 22 bp, Homo sapiens
tacagtttgttacattgttagt

SEQ ID NO: 7037590 - DNA, 22 bp, Homo sapiens
tacatatagacagttactctag

SEQ ID NO: 7037591 - DNA, 22 bp, Homo sapiens
caggcagaaggaagtaccaggc

SEQ ID NO: 7037592 - DNA, 22 bp, Homo sapiens
taattgtcctcggtccaaatga

SEQ ID NO: 7037593 - DNA, 22 bp, Homo sapiens
taatttactcagatgttcaatc

SEQ ID NO: 7037594 - DNA, 22 bp, Homo sapiens
taatttacttgcaaataacaat

SEQ ID NO: 7037595 - DNA, 22 bp, Homo sapiens
taacatttaaatttttcacata

SEQ ID NO: 7037596 - DNA, 22 bp, Homo sapiens
taactttaggaataggtaatct

SEQ ID NO: 7037597 - DNA, 22 bp, Homo sapiens
taactttagtgtatgaggtaag

SEQ ID NO: 7037598 - DNA, 22 bp, Homo sapiens
taacttttctaggtgtgataat

SEQ ID NO: 7037599 - DNA, 21 bp, Homo sapiens
taacttttgtgcctatcttgt

SEQ ID NO: 7037600 - DNA, 22 bp, Homo sapiens
caggatattacctaatatttga

SEQ ID NO: 7037601 - DNA, 22 bp, Homo sapiens
caggatgagaggcccagggaag

SEQ ID NO: 7037602 - DNA, 22 bp, Homo sapiens
caggatgaggtagaggcagata

SEQ ID NO: 7037603 - DNA, 18 bp, Homo sapiens
caggatgagtgatgggga

SEQ ID NO: 7037604 - DNA, 21 bp, Homo sapiens
caggatgatgggaaggtggtg

SEQ ID NO: 7037605 - DNA, 22 bp, Homo sapiens
taagacacaaatatcttttaca

SEQ ID NO: 7037606 - DNA, 19 bp, Homo sapiens
taagacacaaatgcaagcc

SEQ ID NO: 7037607 - DNA, 22 bp, Homo sapiens
taagacacagtccgcactctct

SEQ ID NO: 7037608 - DNA, 22 bp, Homo sapiens
taagacacatgcgtacaagata

SEQ ID NO: 7037609 - DNA, 22 bp, Homo sapiens
taagacacattcatatctgtct

SEQ ID NO: 7037610 - DNA, 22 bp, Homo sapiens
taagacacattgagaaacacaa

SEQ ID NO: 7037611 - DNA, 22 bp, Homo sapiens
taagacacattggagtagatga

SEQ ID NO: 7037612 - DNA, 23 bp, Homo sapiens
taagacacccgactccagagatg

SEQ ID NO: 7037613 - DNA, 22 bp, Homo sapiens
taagacacctctctgcccttca

SEQ ID NO: 7037614 - DNA, 22 bp, Homo sapiens
taagacacgggctgatctaaag

SEQ ID NO: 7037615 - DNA, 22 bp, Homo sapiens
taagacacgggctgatctaaag

SEQ ID NO: 7037616 - DNA, 22 bp, Homo sapiens
caggaggcccaaagggcgcaga

SEQ ID NO: 7037617 - DNA, 22 bp, Homo sapiens
caggaggcccaaagggcgcaga

SEQ ID NO: 7037618 - DNA, 22 bp, Homo sapiens
caggaggccaactgtgggactt

SEQ ID NO: 7037619 - DNA, 22 bp, Homo sapiens
caggaggcccggccacagccca

SEQ ID NO: 7037620 - DNA, 22 bp, Homo sapiens
caggaggcgtcttcagtttgtt

SEQ ID NO: 7037621 - DNA, 22 bp, Homo sapiens
caggaggctcctagggctctgt

SEQ ID NO: 7037622 - DNA, 22 bp, Homo sapiens
caggagtgcaggtggtgaggca

SEQ ID NO: 7037623 - DNA, 22 bp, Homo sapiens
taaatgtataggcactaaacct

SEQ ID NO: 7037624 - DNA, 22 bp, Homo sapiens
caggaggaaactggattcactt

SEQ ID NO: 7037625 - DNA, 22 bp, Homo sapiens
caggaggaaatgtgaccctgct

SEQ ID NO: 7037626 - DNA, 22 bp, Homo sapiens
caggaggattgcttgaggccag

SEQ ID NO: 7037627 - DNA, 20 bp, Homo sapiens
caggaggcaaggtcaaggtc

SEQ ID NO: 7037628 - DNA, 22 bp, Homo sapiens
caggaggcagaggttgcagtga

SEQ ID NO: 7037629 - DNA, 22 bp, Homo sapiens
caggaggcagcgctctcaggac

SEQ ID NO: 7037630 - DNA, 22 bp, Homo sapiens
caggaggcagcgctctcaggac

SEQ ID NO: 7037631 - DNA, 22 bp, Homo sapiens
caggaggcaggtgcattttgag

SEQ ID NO: 7037632 - DNA, 22 bp, Homo sapiens
caggaggcagtgggtgttgtct

SEQ ID NO: 7037633 - DNA, 22 bp, Homo sapiens
caggagagatatgagtccccac

SEQ ID NO: 7037634 - DNA, 22 bp, Homo sapiens
caggagagcccgggtccgggct

SEQ ID NO: 7037635 - DNA, 22 bp, Homo sapiens
caggagagcccgggtccgggct

SEQ ID NO: 7037636 - DNA, 22 bp, Homo sapiens
taaatatcagtccagctcttcc

SEQ ID NO: 7037637 - DNA, 22 bp, Homo sapiens
taaatatcagtccagctcttcc

SEQ ID NO: 7037638 - DNA, 22 bp, Homo sapiens
taaatatgcatgtatccttatc

SEQ ID NO: 7037639 - DNA, 22 bp, Homo sapiens
taaatcaagaatatcagcttgt

SEQ ID NO: 7037640 - DNA, 21 bp, Homo sapiens
gtttggaacagaccctgggga

SEQ ID NO: 7037641 - DNA, 22 bp, Homo sapiens
gtttggaagttaagtgcagcag

SEQ ID NO: 7037642 - DNA, 22 bp, Homo sapiens
gtttggaatagcagtaaacatt

SEQ ID NO: 7037643 - DNA, 22 bp, Homo sapiens
gtttggaatgagtcctgccatt

SEQ ID NO: 7037644 - DNA, 22 bp, Homo sapiens
gtttgtaaccagaacagagagt

SEQ ID NO: 7037645 - DNA, 22 bp, Homo sapiens
caggacaaagccctttgagaaa

SEQ ID NO: 7037646 - DNA, 22 bp, Homo sapiens
taaaaagtagtgagaatggcgc

SEQ ID NO: 7037647 - DNA, 22 bp, Homo sapiens
taaaaatcttatgaatggcaag

SEQ ID NO: 7037648 - DNA, 22 bp, Homo sapiens
taaaccttatttgaataccaac

SEQ ID NO: 7037649 - DNA, 22 bp, Homo sapiens
taaactcttctgtagaatcaga

SEQ ID NO: 7037650 - DNA, 22 bp, Homo sapiens
caggagaaggtttggagtgcag

SEQ ID NO: 7037651 - DNA, 22 bp, Homo sapiens
caggagacaagttagcagctga

SEQ ID NO: 7037652 - DNA, 22 bp, Homo sapiens
caggagactatggcccaaggcc

SEQ ID NO: 7037653 - DNA, 22 bp, Homo sapiens
caggaaatggctgaataaattc

SEQ ID NO: 7037654 - DNA, 22 bp, Homo sapiens
gttcttaaagattcatcaagca

SEQ ID NO: 7037655 - DNA, 22 bp, Homo sapiens
caggaagagaacatggaggctg

SEQ ID NO: 7037656 - DNA, 22 bp, Homo sapiens
gtttacatgtactcattatact

SEQ ID NO: 7037657 - DNA, 22 bp, Homo sapiens
gtttattattcaacttcatgtt

SEQ ID NO: 7037658 - DNA, 22 bp, Homo sapiens
gtttcctttaatagtgatattg

SEQ ID NO: 7037659 - DNA, 22 bp, Homo sapiens
cagcttcagaagaagccgtgag

SEQ ID NO: 7037660 - DNA, 22 bp, Homo sapiens
cagcttcagggacagcttcttt

SEQ ID NO: 7037661 - DNA, 22 bp, Homo sapiens
cagcttcatgtccaggtactgt

SEQ ID NO: 7037662 - DNA, 22 bp, Homo sapiens
cagcttcattgcctgatgtctt

SEQ ID NO: 7037663 - DNA, 22 bp, Homo sapiens
gttactcctggttgagcttggt

SEQ ID NO: 7037664 - DNA, 22 bp, Homo sapiens
gttattatttctctccttgcta

SEQ ID NO: 7037665 - DNA, 22 bp, Homo sapiens
cagcttctcagaaagctgaggt

SEQ ID NO: 7037666 - DNA, 22 bp, Homo sapiens
cagcttctcgggagcgcatgtg

SEQ ID NO: 7037667 - DNA, 18 bp, Homo sapiens
cagctcttctccagtaac

SEQ ID NO: 7037668 - DNA, 22 bp, Homo sapiens
cagctctttttcacacaacatg

SEQ ID NO: 7037669 - DNA, 22 bp, Homo sapiens
gtgggcaggagtgagcaacagg

SEQ ID NO: 7037670 - DNA, 22 bp, Homo sapiens
gtgggcaggccccaaagcaggg

SEQ ID NO: 7037671 - DNA, 22 bp, Homo sapiens
gtggcaggttccgtagacagca

SEQ ID NO: 7037672 - DNA, 22 bp, Homo sapiens
cagctctgctgggaggatgcag

SEQ ID NO: 7037673 - DNA, 22 bp, Homo sapiens
gtggggctaaaaactgtgcagt

SEQ ID NO: 7037674 - DNA, 22 bp, Homo sapiens
gtggggctcccatctcctggct

SEQ ID NO: 7037675 - DNA, 22 bp, Homo sapiens
gtggggctgagtggagccagaa

SEQ ID NO: 7037676 - DNA, 22 bp, Homo sapiens
gtggggctgcttaggctgcgca

SEQ ID NO: 7037677 - DNA, 22 bp, Homo sapiens
gtggggctgcttaggctgcgca

SEQ ID NO: 7037678 - DNA, 22 bp, Homo sapiens
gtgggtggaggcgtcgagggca

SEQ ID NO: 7037679 - DNA, 22 bp, Homo sapiens
gtgggtggatcacctgaggtca

SEQ ID NO: 7037680 - DNA, 22 bp, Homo sapiens
gtgggtggatcatgaggtcagg

SEQ ID NO: 7037681 - DNA, 22 bp, Homo sapiens
gtgggtggatggctcacctcca

SEQ ID NO: 7037682 - DNA, 22 bp, Homo sapiens
gtgggtggattccagcaacgct

SEQ ID NO: 7037683 - DNA, 22 bp, Homo sapiens
gtgtctttattcctctatgttt

SEQ ID NO: 7037684 - DNA, 22 bp, Homo sapiens
tgtaaactgagggtagctgatt

SEQ ID NO: 7037685 - DNA, 22 bp, Homo sapiens
tgtaaactgtagaaaatacttt

SEQ ID NO: 7037686 - DNA, 22 bp, Homo sapiens
tgtaaacttttgcatactgctt

SEQ ID NO: 7037687 - DNA, 22 bp, Homo sapiens
tgtaggaattccagtgacttca

SEQ ID NO: 7037688 - DNA, 22 bp, Homo sapiens
tgtcatgggtctaaacattgat

SEQ ID NO: 7037689 - DNA, 22 bp, Homo sapiens
tgtcatggtatttgtgagctgc

SEQ ID NO: 7037690 - DNA, 22 bp, Homo sapiens
tgtcatggtgctatttaattag

SEQ ID NO: 7037691 - DNA, 17 bp, Homo sapiens
tgtcatggctatggttg

SEQ ID NO: 7037692 - DNA, 22 bp, Homo sapiens
tgtcatggactggatttctgct

SEQ ID NO: 7037693 - DNA, 22 bp, Homo sapiens
tgtcatggagcttatattccag

SEQ ID NO: 7037694 - DNA, 22 bp, Homo sapiens
tgtcatggacagattagatgag

SEQ ID NO: 7037695 - DNA, 17 bp, Homo sapiens
tggtggctggagtcagg

SEQ ID NO: 7037696 - DNA, 22 bp, Homo sapiens
cctggagaccagaggatacttc

SEQ ID NO: 7037697 - DNA, 22 bp, Homo sapiens
cctggagacccacttctgccaa

SEQ ID NO: 7037698 - DNA, 22 bp, Homo sapiens
cctggagagagaggccaactgc

SEQ ID NO: 7037699 - DNA, 22 bp, Homo sapiens
tgtaaacagtaggactaaagag

SEQ ID NO: 7037700 - DNA, 22 bp, Homo sapiens
cctggcctcgtgctcacggctc

SEQ ID NO: 7037701 - DNA, 22 bp, Homo sapiens
tgtctcaggtacatgcgtcctg

SEQ ID NO: 7037702 - DNA, 19 bp, Homo sapiens
tgtctcagtgtcccttcct

SEQ ID NO: 7037703 - DNA, 22 bp, Homo sapiens
tgtctcttactttgattcttgg

SEQ ID NO: 7037704 - DNA, 22 bp, Homo sapiens
tgtcctctgttaggggatagcg

SEQ ID NO: 7037705 - DNA, 22 bp, Homo sapiens
tgtctattaacacaagaaagga

SEQ ID NO: 7037706 - DNA, 22 bp, Homo sapiens
tgtctcagagtatccctgaact

SEQ ID NO: 7037707 - DNA, 22 bp, Homo sapiens
tgtctgtaggtgtaatagagct

SEQ ID NO: 7037708 - DNA, 22 bp, Homo sapiens
tgtgccaggccggggcaggaca

SEQ ID NO: 7037709 - DNA, 22 bp, Homo sapiens
tgtgccagggcctccaaaagcc

SEQ ID NO: 7037710 - DNA, 22 bp, Homo sapiens
tgtgcccattacacagaggcat

SEQ ID NO: 7037711 - DNA, 22 bp, Homo sapiens
cctgggcatcaacaagcagaga

SEQ ID NO: 7037712 - DNA, 21 bp, Homo sapiens
cctgggccaaattccctggac

SEQ ID NO: 7037713 - DNA, 22 bp, Homo sapiens
cctgggccaggcttgggaatgc

SEQ ID NO: 7037714 - DNA, 22 bp, Homo sapiens
cctgggccctcaccgccggtgg

SEQ ID NO: 7037715 - DNA, 22 bp, Homo sapiens
cctgggcctatcctagaaccaa

SEQ ID NO: 7037716 - DNA, 22 bp, Homo sapiens
cctgggcctatcctagaaccaa

SEQ ID NO: 7037717 - DNA, 22 bp, Homo sapiens
cctgggcctcacccagctcttg

SEQ ID NO: 7037718 - DNA, 22 bp, Homo sapiens
tgtggggcttacaaaggcagat

SEQ ID NO: 7037719 - DNA, 19 bp, Homo sapiens
cctgggcctccatcacccc

SEQ ID NO: 7037720 - DNA, 19 bp, Homo sapiens
cctgggcctccatcacccc

SEQ ID NO: 7037721 - DNA, 22 bp, Homo sapiens
cctgggcctctcaaagtgctgg

SEQ ID NO: 7037722 - DNA, 22 bp, Homo sapiens
cctgggcctgaaaacatttctc

SEQ ID NO: 7037723 - DNA, 22 bp, Homo sapiens
cctgggcctggcgggtcggctc

SEQ ID NO: 7037724 - DNA, 22 bp, Homo sapiens
cctgggccttgacctcgtgggc

SEQ ID NO: 7037725 - DNA, 20 bp, Homo sapiens
cctgggctcaaagcatcctc

SEQ ID NO: 7037726 - DNA, 22 bp, Homo sapiens
cctgggctcaagcgatcttgtc

SEQ ID NO: 7037727 - DNA, 22 bp, Homo sapiens
cctgggctcaagtgatcctcct

SEQ ID NO: 7037728 - DNA, 22 bp, Homo sapiens
cctgggctttgctggcaaggcc

SEQ ID NO: 7037729 - DNA, 22 bp, Homo sapiens
cctgggctttggaacagtactt

SEQ ID NO: 7037730 - DNA, 22 bp, Homo sapiens
tgtgttcaatccctagtctcag

SEQ ID NO: 7037731 - DNA, 22 bp, Homo sapiens
cctggggacctgcctcagccct

SEQ ID NO: 7037732 - DNA, 22 bp, Homo sapiens
tgtgttcattagcattgccttg

SEQ ID NO: 7037733 - DNA, 22 bp, Homo sapiens
tgtgttcatttaactgttcttt

SEQ ID NO: 7037734 - DNA, 22 bp, Homo sapiens
cctctctcttgtagtccctgcc

SEQ ID NO: 7037735 - DNA, 22 bp, Homo sapiens
cctctctgtaagggtccctccc

SEQ ID NO: 7037736 - DNA, 22 bp, Homo sapiens
cctctgggggtcctcagagtct

SEQ ID NO: 7037737 - DNA, 22 bp, Homo sapiens
cctctgggtgggaggccgggcg

SEQ ID NO: 7037738 - DNA, 22 bp, Homo sapiens
tggcccagccctgctctagggc

SEQ ID NO: 7037739 - DNA, 22 bp, Homo sapiens
tggcccagtgcttatgctctga

SEQ ID NO: 7037740 - DNA, 20 bp, Homo sapiens
tggcccagtggggcagggtg

SEQ ID NO: 7037741 - DNA, 22 bp, Homo sapiens
tggcccgaagatccgagggtca

SEQ ID NO: 7037742 - DNA, 22 bp, Homo sapiens
tggctgagggggctctgctcag

SEQ ID NO: 7037743 - DNA, 22 bp, Homo sapiens
tggctgaggtaactatgaataa

SEQ ID NO: 7037744 - DNA, 23 bp, Homo sapiens
tggctgaggtccaggtagtttca

SEQ ID NO: 7037745 - DNA, 22 bp, Homo sapiens
cctccctgggtgacgggctcct

SEQ ID NO: 7037746 - DNA, 22 bp, Homo sapiens
cctcctccttatggtggcccag

SEQ ID NO: 7037747 - DNA, 23 bp, Homo sapiens
tggccaggcataaaggtgggtgg

SEQ ID NO: 7037748 - DNA, 22 bp, Homo sapiens
cctagggaaacagagtccacac

SEQ ID NO: 7037749 - DNA, 22 bp, Homo sapiens
cctagggaccaggatccccacc

SEQ ID NO: 7037750 - DNA, 20 bp, Homo sapiens
cctatcagactttttaaata

SEQ ID NO: 7037751 - DNA, 22 bp, Homo sapiens
ccctggcctccaggcagtcctg

SEQ ID NO: 7037752 - DNA, 23 bp, Homo sapiens
ccctggccttggggcacaggctg

SEQ ID NO: 7037753 - DNA, 20 bp, Homo sapiens
tgctgcagacagggccattg

SEQ ID NO: 7037754 - DNA, 17 bp, Homo sapiens
tgctgcagacccacccc

SEQ ID NO: 7037755 - DNA, 22 bp, Homo sapiens
tgctgcagacgaagcccatgcc

SEQ ID NO: 7037756 - DNA, 22 bp, Homo sapiens
tgctgcagagaatgttttggcc

SEQ ID NO: 7037757 - DNA, 22 bp, Homo sapiens
tgctgcagatcagctgagtcct

SEQ ID NO: 7037758 - DNA, 22 bp, Homo sapiens
tgctgcagattgcagattaact

SEQ ID NO: 7037759 - DNA, 22 bp, Homo sapiens
tgctgcagcagtgcgggcagct

SEQ ID NO: 7037760 - DNA, 22 bp, Homo sapiens
tgctgcagcggcatggtctttg

SEQ ID NO: 7037761 - DNA, 22 bp, Homo sapiens
tgctgcagctaaggtgaggtgc

SEQ ID NO: 7037762 - DNA, 22 bp, Homo sapiens
tgctgcagctttgtcacatgca

SEQ ID NO: 7037763 - DNA, 22 bp, Homo sapiens
tgctgcaggaacttaagaagct

SEQ ID NO: 7037764 - DNA, 22 bp, Homo sapiens
tgctgcaggaattctcaaggga

SEQ ID NO: 7037765 - DNA, 19 bp, Homo sapiens
tgctgcaggatgctgctgg

SEQ ID NO: 7037766 - DNA, 22 bp, Homo sapiens
tgcctgggacatgctgtggact

SEQ ID NO: 7037767 - DNA, 22 bp, Homo sapiens
cccaggctgagttagaggtgtc

SEQ ID NO: 7037768 - DNA, 20 bp, Homo sapiens
cccagggacctgagctccat

SEQ ID NO: 7037769 - DNA, 22 bp, Homo sapiens
cccagggaggcccaggctctgc

SEQ ID NO: 7037770 - DNA, 21 bp, Homo sapiens
tgctgaatctgccatattttc

SEQ ID NO: 7037771 - DNA, 22 bp, Homo sapiens
tgctgaatgctgcatgccgtat

SEQ ID NO: 7037772 - DNA, 22 bp, Homo sapiens
tgctgaatgggatatgttgagc

SEQ ID NO: 7037773 - DNA, 22 bp, Homo sapiens
tgctgaattaaactctatgtgg

SEQ ID NO: 7037774 - DNA, 22 bp, Homo sapiens
tgctgcagaaattctgtgagga

SEQ ID NO: 7037775 - DNA, 22 bp, Homo sapiens
cccagctccttacagggccgaa

SEQ ID NO: 7037776 - DNA, 22 bp, Homo sapiens
cccagctcttcaagtcaccccc

SEQ ID NO: 7037777 - DNA, 22 bp, Homo sapiens
cccagcgagtttgccggtgaac

SEQ ID NO: 7037778 - DNA, 22 bp, Homo sapiens
cccagctacctctgctaggaga

SEQ ID NO: 7037779 - DNA, 22 bp, Homo sapiens
cccagctcaagcagagagctaa

SEQ ID NO: 7037780 - DNA, 22 bp, Homo sapiens
cccagctcttcaagtcaccccc

SEQ ID NO: 7037781 - DNA, 22 bp, Homo sapiens
cccagctcttcctgggagctaa

SEQ ID NO: 7037782 - DNA, 22 bp, Homo sapiens
cccagctcttttagcggcatct

SEQ ID NO: 7037783 - DNA, 18 bp, Homo sapiens
cccagctggtgggtcagt

SEQ ID NO: 7037784 - DNA, 22 bp, Homo sapiens
tgccaaggagctggatcagggc

SEQ ID NO: 7037785 - DNA, 22 bp, Homo sapiens
cccaggagggtggcctctgccc

SEQ ID NO: 7037786 - DNA, 22 bp, Homo sapiens
cccaggaggtggaggctgcagt

SEQ ID NO: 7037787 - DNA, 22 bp, Homo sapiens
cccaggaggtggaggttgcagc

SEQ ID NO: 7037788 - DNA, 22 bp, Homo sapiens
cccaggaggtggaggttgcagt

SEQ ID NO: 7037789 - DNA, 22 bp, Homo sapiens
cccaggaggtggaggttgcggt

SEQ ID NO: 7037790 - DNA, 22 bp, Homo sapiens
cccaggaggtggagttcacagt

SEQ ID NO: 7037791 - DNA, 22 bp, Homo sapiens
cccaggaggtgtagctgcgtgg

SEQ ID NO: 7037792 - DNA, 22 bp, Homo sapiens
cccaggaggtgtgcccaactcg

SEQ ID NO: 7037793 - DNA, 22 bp, Homo sapiens
cccaggaggttgaggctgcagt

SEQ ID NO: 7037794 - DNA, 15 bp, Homo sapiens
cccaggagttcgaga

SEQ ID NO: 7037795 - DNA, 22 bp, Homo sapiens
cccaggagttcgaggctgtagt

SEQ ID NO: 7037796 - DNA, 22 bp, Homo sapiens
cccaggcagcctgcagggaagg

SEQ ID NO: 7037797 - DNA, 22 bp, Homo sapiens
ctgcagcaagagaagtgctgac

SEQ ID NO: 7037798 - DNA, 22 bp, Homo sapiens
ctgcagcaggaggctcctgcag

SEQ ID NO: 7037799 - DNA, 22 bp, Homo sapiens
ctgcagagggtttgagcatcct

SEQ ID NO: 7037800 - DNA, 22 bp, Homo sapiens
ctgagacacagtggctgaaaag

SEQ ID NO: 7037801 - DNA, 22 bp, Homo sapiens
ctgagacacggagaggctgtgt

SEQ ID NO: 7037802 - DNA, 22 bp, Homo sapiens
ctgagacaggagaatggcgtga

SEQ ID NO: 7037803 - DNA, 22 bp, Homo sapiens
tttgtcttggcctcagttttct

SEQ ID NO: 7037804 - DNA, 22 bp, Homo sapiens
tttgtgaacttaggcaattagg

SEQ ID NO: 7037805 - DNA, 19 bp, Homo sapiens
tttgtgaagaaaatgatgc

SEQ ID NO: 7037806 - DNA, 22 bp, Homo sapiens
tttgtgaatgccttataagcat

SEQ ID NO: 7037807 - DNA, 22 bp, Homo sapiens
tttgtgaattcttggaagattg

SEQ ID NO: 7037808 - DNA, 22 bp, Homo sapiens
ctctgggcaaagatgcctcatc

SEQ ID NO: 7037809 - DNA, 22 bp, Homo sapiens
ctctgggcaggaccagtggacc

SEQ ID NO: 7037810 - DNA, 22 bp, Homo sapiens
ctctgggcaggacgccaggcct

SEQ ID NO: 7037811 - DNA, 22 bp, Homo sapiens
ctcttttaattgtcataacaac

SEQ ID NO: 7037812 - DNA, 22 bp, Homo sapiens
ctcttttagagatgaaaattgg

SEQ ID NO: 7037813 - DNA, 22 bp, Homo sapiens
ctcttttcaaacctgtttatgg

SEQ ID NO: 7037814 - DNA, 22 bp, Homo sapiens
ctctttttcacctctgtcagcg

SEQ ID NO: 7037815 - DNA, 22 bp, Homo sapiens
ctctttttcagccttaccaaag

SEQ ID NO: 7037816 - DNA, 22 bp, Homo sapiens
ctctttttcagccttaccaaag

SEQ ID NO: 7037817 - DNA, 22 bp, Homo sapiens
ttttgttttcttagaaacctgg

SEQ ID NO: 7037818 - DNA, 22 bp, Homo sapiens
tttttaacctaccttaagagca

SEQ ID NO: 7037819 - DNA, 22 bp, Homo sapiens
tttttaagagattctccagtct

SEQ ID NO: 7037820 - DNA, 22 bp, Homo sapiens
tttttaagagtctggaaatagt

SEQ ID NO: 7037821 - DNA, 22 bp, Homo sapiens
tttttaagctcctttgatgtca

SEQ ID NO: 7037822 - DNA, 22 bp, Homo sapiens
tttttaatgcagtctgagacat

SEQ ID NO: 7037823 - DNA, 19 bp, Homo sapiens
tttttaatgggctggagca

SEQ ID NO: 7037824 - DNA, 17 bp, Homo sapiens
ctgaagataatggcaac

SEQ ID NO: 7037825 - DNA, 22 bp, Homo sapiens
ctgaagatagtgtctgatcatg

SEQ ID NO: 7037826 - DNA, 22 bp, Homo sapiens
ctgaagatgaggctgctggggg

SEQ ID NO: 7037827 - DNA, 22 bp, Homo sapiens
ctgaagatgatgatactaagga

SEQ ID NO: 7037828 - DNA, 22 bp, Homo sapiens
ctgaagatgctggagcatgggt

SEQ ID NO: 7037829 - DNA, 22 bp, Homo sapiens
ctgaagatgtctgagatgctca

SEQ ID NO: 7037830 - DNA, 22 bp, Homo sapiens
ctgagaaatacccaagtctggt

SEQ ID NO: 7037831 - DNA, 22 bp, Homo sapiens
ctgagaaattctttctttcact

SEQ ID NO: 7037832 - DNA, 23 bp, Homo sapiens
ctggatttggaagcttaaataac

SEQ ID NO: 7037833 - DNA, 22 bp, Homo sapiens
ctggacagaagtggctgggcag

SEQ ID NO: 7037834 - DNA, 22 bp, Homo sapiens
ctggacagtgggcagaggagac

SEQ ID NO: 7037835 - DNA, 22 bp, Homo sapiens
ctgctttgcatagctgccagag

SEQ ID NO: 7037836 - DNA, 22 bp, Homo sapiens
ctgcctggaatgccagcttctc

SEQ ID NO: 7037837 - DNA, 22 bp, Homo sapiens
ctgcctggaccggcagccctcc

SEQ ID NO: 7037838 - DNA, 22 bp, Homo sapiens
ctgcctggcatagtctggtcga

SEQ ID NO: 7037839 - DNA, 22 bp, Homo sapiens
ctgcctggcccagggatgggcc

SEQ ID NO: 7037840 - DNA, 22 bp, Homo sapiens
ctgcctggctaaactcaagtcg

SEQ ID NO: 7037841 - DNA, 22 bp, Homo sapiens
ctgcctgggccatgcccagtcc

SEQ ID NO: 7037842 - DNA, 22 bp, Homo sapiens
ctggaggcaaagcagaggcatg

SEQ ID NO: 7037843 - DNA, 22 bp, Homo sapiens
ctggaggcacccttagagaggc

SEQ ID NO: 7037844 - DNA, 22 bp, Homo sapiens
ctcctgggagcagggatggatg

SEQ ID NO: 7037845 - DNA, 22 bp, Homo sapiens
tttcagtgtgctcctgagggct

SEQ ID NO: 7037846 - DNA, 22 bp, Homo sapiens
tttcagttaagtggctagtccc

SEQ ID NO: 7037847 - DNA, 22 bp, Homo sapiens
tttcagttactgctatatcatt

SEQ ID NO: 7037848 - DNA, 22 bp, Homo sapiens
tttcagttagctgagacccagg

SEQ ID NO: 7037849 - DNA, 20 bp, Homo sapiens
tttcagttatcttgaccttc

SEQ ID NO: 7037850 - DNA, 22 bp, Homo sapiens
tttcagttcacctgggaacccg

SEQ ID NO: 7037851 - DNA, 22 bp, Homo sapiens
tttcagttcagtttattatatc

SEQ ID NO: 7037852 - DNA, 22 bp, Homo sapiens
tttcagttcatctgtgaagatt

SEQ ID NO: 7037853 - DNA, 22 bp, Homo sapiens
tttcagttcatgtattccgagt

SEQ ID NO: 7037854 - DNA, 23 bp, Homo sapiens
tttcagttccagaaaaggggagc

SEQ ID NO: 7037855 - DNA, 22 bp, Homo sapiens
tttcagttctgtacaagtccag

SEQ ID NO: 7037856 - DNA, 23 bp, Homo sapiens
tttcagttgagaatgcacggacc

SEQ ID NO: 7037857 - DNA, 22 bp, Homo sapiens
tttcagttgattgcttgggtta

SEQ ID NO: 7037858 - DNA, 22 bp, Homo sapiens
tttcagttgcagtggttgtcta

SEQ ID NO: 7037859 - DNA, 22 bp, Homo sapiens
tttcagttgccaagctaattct

SEQ ID NO: 7037860 - DNA, 20 bp, Homo sapiens
tttcagttggttaatggcat

SEQ ID NO: 7037861 - DNA, 22 bp, Homo sapiens
tttcagttgtcctgttaatagc

SEQ ID NO: 7037862 - DNA, 22 bp, Homo sapiens
tttcagttgtgccggcccctct

SEQ ID NO: 7037863 - DNA, 22 bp, Homo sapiens
tttcagttgttttagctctgtg

SEQ ID NO: 7037864 - DNA, 22 bp, Homo sapiens
tttcagtttaagtaactgctat

SEQ ID NO: 7037865 - DNA, 22 bp, Homo sapiens
ctcctctgggtcctggtggcca

SEQ ID NO: 7037866 - DNA, 22 bp, Homo sapiens
tttagacaggggcaaaataagg

SEQ ID NO: 7037867 - DNA, 22 bp, Homo sapiens
tttagacatagctgaaatcatt

SEQ ID NO: 7037868 - DNA, 22 bp, Homo sapiens
ctcctcccaattgccaagtgct

SEQ ID NO: 7037869 - DNA, 22 bp, Homo sapiens
tttacatgagtagcagatgttc

SEQ ID NO: 7037870 - DNA, 22 bp, Homo sapiens
tttaacagatgctatgtctacc

SEQ ID NO: 7037871 - DNA, 22 bp, Homo sapiens
tttacagttaagaaatgttacc

SEQ ID NO: 7037872 - DNA, 22 bp, Homo sapiens
tttacatgtaatgttatacaaa

SEQ ID NO: 7037873 - DNA, 22 bp, Homo sapiens
tttaaaaggggtattaagtcca

SEQ ID NO: 7037874 - DNA, 22 bp, Homo sapiens
tttaaaagttatcatctgtcca

SEQ ID NO: 7037875 - DNA, 22 bp, Homo sapiens
tttaaatttagaagaaacactg

SEQ ID NO: 7037876 - DNA, 22 bp, Homo sapiens
ttgtatttgggtagtatagaga

SEQ ID NO: 7037877 - DNA, 22 bp, Homo sapiens
ttgttaaaggcaaaacaagcac

SEQ ID NO: 7037878 - DNA, 21 bp, Homo sapiens
ttgttacaatgcaagagtatg

SEQ ID NO: 7037879 - DNA, 22 bp, Homo sapiens
tttaaaaaactagtctgagtct

SEQ ID NO: 7037880 - DNA, 22 bp, Homo sapiens
ttgggcagaggccaggaggatg

SEQ ID NO: 7037881 - DNA, 22 bp, Homo sapiens
ttgggcagaggctgtgcagagg

SEQ ID NO: 7037882 - DNA, 22 bp, Homo sapiens
ttgggcaggaacagatgcttga

SEQ ID NO: 7037883 - DNA, 23 bp, Homo sapiens
ttgggcaggagagtaatgtgatc

SEQ ID NO: 7037884 - DNA, 22 bp, Homo sapiens
ttgggcaggatgacaccacttg

SEQ ID NO: 7037885 - DNA, 22 bp, Homo sapiens
ttgggcaggctggcagactgct

SEQ ID NO: 7037886 - DNA, 22 bp, Homo sapiens
ttgggcaggctggcagactgct

SEQ ID NO: 7037887 - DNA, 22 bp, Homo sapiens
ttgggcagggaaaggacaggca

SEQ ID NO: 7037888 - DNA, 22 bp, Homo sapiens
ttgggcagggaaaggacaggca

SEQ ID NO: 7037889 - DNA, 22 bp, Homo sapiens
ctcataaagtgagaatatgacc

SEQ ID NO: 7037890 - DNA, 22 bp, Homo sapiens
ctcatatatttctgcattcaat

SEQ ID NO: 7037891 - DNA, 22 bp, Homo sapiens
ttgcttttaatctttgtacatc

SEQ ID NO: 7037892 - DNA, 22 bp, Homo sapiens
ctcagtttccccggcctgggcg

SEQ ID NO: 7037893 - DNA, 20 bp, Homo sapiens
ctcagtttcctcatggctca

SEQ ID NO: 7037894 - DNA, 22 bp, Homo sapiens
ctcagtttcctcaactgcaaaa

SEQ ID NO: 7037895 - DNA, 22 bp, Homo sapiens
ctcagtttctgaagtggacagg

SEQ ID NO: 7037896 - DNA, 22 bp, Homo sapiens
ctcagtttctgacattaaaatc

SEQ ID NO: 7037897 - DNA, 22 bp, Homo sapiens
ctcagtttctggataagctggg

SEQ ID NO: 7037898 - DNA, 22 bp, Homo sapiens
ctcagtttctggataagctggg

SEQ ID NO: 7037899 - DNA, 22 bp, Homo sapiens
ctcagtttcttactctgtataa

SEQ ID NO: 7037900 - DNA, 22 bp, Homo sapiens
ctcagtttcttcatattgtagg

SEQ ID NO: 7037901 - DNA, 22 bp, Homo sapiens
ctcagttttaagactactcttt

SEQ ID NO: 7037902 - DNA, 22 bp, Homo sapiens
ctcagttttcccttgggagcgt

SEQ ID NO: 7037903 - DNA, 22 bp, Homo sapiens
ctcagttttgaaaaggtaagct

SEQ ID NO: 7037904 - DNA, 22 bp, Homo sapiens
ctcagttttgaaaaggtaagct

SEQ ID NO: 7037905 - DNA, 22 bp, Homo sapiens
ctcagttttgctagctggagtt

SEQ ID NO: 7037906 - DNA, 22 bp, Homo sapiens
ctcagtttttgtgggcatcagc

SEQ ID NO: 7037907 - DNA, 22 bp, Homo sapiens
ctcagtttttttaagagccatg

SEQ ID NO: 7037908 - DNA, 22 bp, Homo sapiens
ttgactttaaagctttgtctct

SEQ ID NO: 7037909 - DNA, 22 bp, Homo sapiens
ttgactttatgtcaacttgcct

SEQ ID NO: 7037910 - DNA, 22 bp, Homo sapiens
ttgactttatgtgtatgtttac

SEQ ID NO: 7037911 - DNA, 22 bp, Homo sapiens
ttgagaaaatagttcgaatgtt

SEQ ID NO: 7037912 - DNA, 22 bp, Homo sapiens
ttctttaaaatagtgagaaaga

SEQ ID NO: 7037913 - DNA, 22 bp, Homo sapiens
ctattttaagaggccattaggt

SEQ ID NO: 7037914 - DNA, 22 bp, Homo sapiens
ctattttaagaggccattaggt

SEQ ID NO: 7037915 - DNA, 22 bp, Homo sapiens
ctattttctgtctctatagagt

SEQ ID NO: 7037916 - DNA, 22 bp, Homo sapiens
ctatttttctgtaccctaattt

SEQ ID NO: 7037917 - DNA, 23 bp, Homo sapiens
ctatttctcatagttcaggtctt

SEQ ID NO: 7037918 - DNA, 22 bp, Homo sapiens
ctattttaacttgattacctct

SEQ ID NO: 7037919 - DNA, 22 bp, Homo sapiens
ctattttaacttgattacctct

SEQ ID NO: 7037920 - DNA, 22 bp, Homo sapiens
ttcttcctcacactctcaccca

SEQ ID NO: 7037921 - DNA, 22 bp, Homo sapiens
ttcttggagataaattcttaca

SEQ ID NO: 7037922 - DNA, 22 bp, Homo sapiens
ttcctttctgtcagcctgagtg

SEQ ID NO: 7037923 - DNA, 22 bp, Homo sapiens
ttcctttgggaaatcactaagg

SEQ ID NO: 7037924 - DNA, 22 bp, Homo sapiens
ttcctttcccttgcttctgtgc

SEQ ID NO: 7037925 - DNA, 22 bp, Homo sapiens
ttcctttccctcacagcctcgg

SEQ ID NO: 7037926 - DNA, 20 bp, Homo sapiens
ttccttttcgcctctctccc

SEQ ID NO: 7037927 - DNA, 22 bp, Homo sapiens
ttccttttgcaaggtcctctag

SEQ ID NO: 7037928 - DNA, 22 bp, Homo sapiens
cgctgggcatggtgccttattt

SEQ ID NO: 7037929 - DNA, 22 bp, Homo sapiens
cgctgggcgccgacctgctggc

SEQ ID NO: 7037930 - DNA, 22 bp, Homo sapiens
cggcatgggcgtccccctcact

SEQ ID NO: 7037931 - DNA, 21 bp, Homo sapiens
cggctcagtgcctgctccttc

SEQ ID NO: 7037932 - DNA, 19 bp, Homo sapiens
ttcattctcttattgttgt

SEQ ID NO: 7037933 - DNA, 19 bp, Homo sapiens
ttcattctcttattgttgt

SEQ ID NO: 7037934 - DNA, 22 bp, Homo sapiens
ttcattctgcagttctcagctc

SEQ ID NO: 7037935 - DNA, 22 bp, Homo sapiens
ttccaaagctgctttatttagt

SEQ ID NO: 7037936 - DNA, 22 bp, Homo sapiens
ttccaaatgttggacaactgta

SEQ ID NO: 7037937 - DNA, 22 bp, Homo sapiens
ctaattctcagcatgaactggt

SEQ ID NO: 7037938 - DNA, 22 bp, Homo sapiens
ctaattctgaaacagtgtcaat

SEQ ID NO: 7037939 - DNA, 22 bp, Homo sapiens
ctacaaaagtaattgtggtttt

SEQ ID NO: 7037940 - DNA, 22 bp, Homo sapiens
ctacaaagaaagctgaggggaa

SEQ ID NO: 7037941 - DNA, 22 bp, Homo sapiens
ctacaaagaaagtatactggac

SEQ ID NO: 7037942 - DNA, 22 bp, Homo sapiens
ctacaaagaatttctctagctc

SEQ ID NO: 7037943 - DNA, 22 bp, Homo sapiens
ctacaaagctcttctacaggca

SEQ ID NO: 7037944 - DNA, 22 bp, Homo sapiens
ctacaaagtaccacagactggg

SEQ ID NO: 7037945 - DNA, 23 bp, Homo sapiens
ctacaaagtatgagaagacccct

SEQ ID NO: 7037946 - DNA, 22 bp, Homo sapiens
ttccttcagcaagtcctgagca

SEQ ID NO: 7037947 - DNA, 22 bp, Homo sapiens
gaccagtcattactcatgccct

SEQ ID NO: 7037948 - DNA, 20 bp, Homo sapiens
gacaggagagttaggtaggt

SEQ ID NO: 7037949 - DNA, 22 bp, Homo sapiens
gacaggaggcagagctcaggtg

SEQ ID NO: 7037950 - DNA, 18 bp, Homo sapiens
gacccagcagatgggctt

SEQ ID NO: 7037951 - DNA, 22 bp, Homo sapiens
gactttaaaatgctagaacagg

SEQ ID NO: 7037952 - DNA, 22 bp, Homo sapiens
gactttaaaggttctgctgctt

SEQ ID NO: 7037953 - DNA, 22 bp, Homo sapiens
gacttctccagactgcctggta

SEQ ID NO: 7037954 - DNA, 22 bp, Homo sapiens
gacttctcatgaggggaggtca

SEQ ID NO: 7037955 - DNA, 22 bp, Homo sapiens
gacttctcccaaccatcagagg

SEQ ID NO: 7037956 - DNA, 22 bp, Homo sapiens
gacttctccgtcatctccagtg

SEQ ID NO: 7037957 - DNA, 22 bp, Homo sapiens
gacttctcggcaccctttggca

SEQ ID NO: 7037958 - DNA, 22 bp, Homo sapiens
gacttctctgcatgagataagt

SEQ ID NO: 7037959 - DNA, 22 bp, Homo sapiens
gacttaatgcttcattacctta

SEQ ID NO: 7037960 - DNA, 22 bp, Homo sapiens
gacttaatttccactttctgct

SEQ ID NO: 7037961 - DNA, 22 bp, Homo sapiens
gagagctccttcaggaagcttc

SEQ ID NO: 7037962 - DNA, 22 bp, Homo sapiens
gactttataaatgagaggcgga

SEQ ID NO: 7037963 - DNA, 22 bp, Homo sapiens
gactttatcctgcctgaccacg

SEQ ID NO: 7037964 - DNA, 22 bp, Homo sapiens
gactttatcttgtccttcctgc

SEQ ID NO: 7037965 - DNA, 22 bp, Homo sapiens
gactttatgaagagatgaccaa

SEQ ID NO: 7037966 - DNA, 22 bp, Homo sapiens
gactttattactaaccctgtga

SEQ ID NO: 7037967 - DNA, 22 bp, Homo sapiens
gactttattatagtggcaatag

SEQ ID NO: 7037968 - DNA, 22 bp, Homo sapiens
gactttattcgttaactgttaa

SEQ ID NO: 7037969 - DNA, 22 bp, Homo sapiens
gactttatttccttatttgtga

SEQ ID NO: 7037970 - DNA, 22 bp, Homo sapiens
gactttattttaacggagattc

SEQ ID NO: 7037971 - DNA, 22 bp, Homo sapiens
gactttgtgccaaacgccagaa

SEQ ID NO: 7037972 - DNA, 22 bp, Homo sapiens
gaagttcaactgccatgcttgg

SEQ ID NO: 7037973 - DNA, 22 bp, Homo sapiens
gaagttcaatgtcagcatctat

SEQ ID NO: 7037974 - DNA, 22 bp, Homo sapiens
gaagttcactggctacattcca

SEQ ID NO: 7037975 - DNA, 21 bp, Homo sapiens
gaagttcatgatctttctgct

SEQ ID NO: 7037976 - DNA, 22 bp, Homo sapiens
gaattcaaatattaaacacgac

SEQ ID NO: 7037977 - DNA, 22 bp, Homo sapiens
gaattcaagtgcaatggtatat

SEQ ID NO: 7037978 - DNA, 22 bp, Homo sapiens
gaattcaatttcttggtctttg

SEQ ID NO: 7037979 - DNA, 22 bp, Homo sapiens
gaattcttctgtctttaactga

SEQ ID NO: 7037980 - DNA, 22 bp, Homo sapiens
gaattctttaggtgaatttcta

SEQ ID NO: 7037981 - DNA, 22 bp, Homo sapiens
gaattctttgatcttaatcttg

SEQ ID NO: 7037982 - DNA, 22 bp, Homo sapiens
gaactcttgcagtgaaagctta

SEQ ID NO: 7037983 - DNA, 22 bp, Homo sapiens
gaacagagaagctttactaaag

SEQ ID NO: 7037984 - DNA, 22 bp, Homo sapiens
gaacagatgcctgattcatagg

SEQ ID NO: 7037985 - DNA, 22 bp, Homo sapiens
gaacacagcagggataaccact

SEQ ID NO: 7037986 - DNA, 22 bp, Homo sapiens
gaacacagtttagaaaatgctg

SEQ ID NO: 7037987 - DNA, 22 bp, Homo sapiens
ctttgttatctgtaaatggtta

SEQ ID NO: 7037988 - DNA, 22 bp, Homo sapiens
ctttgttttactcagaggcatg

SEQ ID NO: 7037989 - DNA, 22 bp, Homo sapiens
cttttaagggataataagatgt

SEQ ID NO: 7037990 - DNA, 22 bp, Homo sapiens
cttttaatgagcattgctgtct

SEQ ID NO: 7037991 - DNA, 22 bp, Homo sapiens
cttttaatgggagcagtatttg

SEQ ID NO: 7037992 - DNA, 17 bp, Homo sapiens
cttttaatttacttccc

SEQ ID NO: 7037993 - DNA, 22 bp, Homo sapiens
gaaagttcacacatccacatgg

SEQ ID NO: 7037994 - DNA, 22 bp, Homo sapiens
cttgggaaaccaatgggctcct

SEQ ID NO: 7037995 - DNA, 23 bp, Homo sapiens
cttgggctagagacttagcagtg

SEQ ID NO: 7037996 - DNA, 22 bp, Homo sapiens
cttggggcagcccaggctgagc

SEQ ID NO: 7037997 - DNA, 22 bp, Homo sapiens
cttggggcagtgcttggcacat

SEQ ID NO: 7037998 - DNA, 22 bp, Homo sapiens
cttggggctgtcactctggcat

SEQ ID NO: 7037999 - DNA, 22 bp, Homo sapiens
cttggggctttgtgtgtaggat

SEQ ID NO: 7038000 - DNA, 22 bp, Homo sapiens
ctttacaattcaagggaactct

SEQ ID NO: 7038001 - DNA, 22 bp, Homo sapiens
ctttagatgttgctttaactat

SEQ ID NO: 7038002 - DNA, 22 bp, Homo sapiens
ctttatgaacctgttcagcttg

SEQ ID NO: 7038003 - DNA, 22 bp, Homo sapiens
ctggctggttactatttctggt

SEQ ID NO: 7038004 - DNA, 22 bp, Homo sapiens
cttctcggggttcccgcgccct

SEQ ID NO: 7038005 - DNA, 22 bp, Homo sapiens
cttctcttcccagggacacagg

SEQ ID NO: 7038006 - DNA, 22 bp, Homo sapiens
cttctcttcctttgtcaactga

SEQ ID NO: 7038007 - DNA, 22 bp, Homo sapiens
cttctcttggtagttcttgttg

SEQ ID NO: 7038008 - DNA, 22 bp, Homo sapiens
cttctttcccaggcatgtttta

SEQ ID NO: 7038009 - DNA, 22 bp, Homo sapiens
cttcttttcatggcttgggaag

SEQ ID NO: 7038010 - DNA, 22 bp, Homo sapiens
cttcttttgaagggcgttgtgt

SEQ ID NO: 7038011 - DNA, 22 bp, Homo sapiens
gagataaagctaccatgttgat

SEQ ID NO: 7038012 - DNA, 22 bp, Homo sapiens
gaggaatgttattaaaggagct

SEQ ID NO: 7038013 - DNA, 22 bp, Homo sapiens
gaggacagctctaactaaagtc

SEQ ID NO: 7038014 - DNA, 22 bp, Homo sapiens
gaggagggagctggaagctctt

SEQ ID NO: 7038015 - DNA, 22 bp, Homo sapiens
gaggagggagctggaagctctt

SEQ ID NO: 7038016 - DNA, 22 bp, Homo sapiens
gaggaggctgtttctctgcatt

SEQ ID NO: 7038017 - DNA, 21 bp, Homo sapiens
gaggcctcagcctcagctcct

SEQ ID NO: 7038018 - DNA, 22 bp, Homo sapiens
gaggcctcaggcgtgggaaggg

SEQ ID NO: 7038019 - DNA, 22 bp, Homo sapiens
gaggcctcctctgagacatctg

SEQ ID NO: 7038020 - DNA, 22 bp, Homo sapiens
gaggcctctgtcccaccaggga

SEQ ID NO: 7038021 - DNA, 22 bp, Homo sapiens
gaggcctctgtcccgccaggga

SEQ ID NO: 7038022 - DNA, 18 bp, Homo sapiens
gaggcctgagaaccaggt

SEQ ID NO: 7038023 - DNA, 22 bp, Homo sapiens
gaggtggggttttgttcttgaa

SEQ ID NO: 7038024 - DNA, 22 bp, Homo sapiens
gaggtggtggtggaggcatagc

SEQ ID NO: 7038025 - DNA, 22 bp, Homo sapiens
gagtcctcaacggggagaggcg

SEQ ID NO: 7038026 - DNA, 22 bp, Homo sapiens
gaggtgggatgtgtgtgctact

SEQ ID NO: 7038027 - DNA, 22 bp, Homo sapiens
gaggtcaggctcaagctgggcc

SEQ ID NO: 7038028 - DNA, 22 bp, Homo sapiens
gaggggcaggattattgggatt

SEQ ID NO: 7038029 - DNA, 22 bp, Homo sapiens
gaggggcagtgcacccgggccc

SEQ ID NO: 7038030 - DNA, 22 bp, Homo sapiens
gaggggcagttgattgtgctat

SEQ ID NO: 7038031 - DNA, 21 bp, Homo sapiens
gaggggcagctcttagcatta

SEQ ID NO: 7038032 - DNA, 22 bp, Homo sapiens
gaggggcagaggtagagaacaa

SEQ ID NO: 7038033 - DNA, 22 bp, Homo sapiens
gaggggcacagcagctgttgca

SEQ ID NO: 7038034 - DNA, 22 bp, Homo sapiens
gaggggcacagtaaagggtccc

SEQ ID NO: 7038035 - DNA, 22 bp, Homo sapiens
gaggggcagaatgtgatcaggg

SEQ ID NO: 7038036 - DNA, 22 bp, Homo sapiens
gaggggcaagaagttggcctct

SEQ ID NO: 7038037 - DNA, 22 bp, Homo sapiens
gaggggcaatgagggaaagagt

SEQ ID NO: 7038038 - DNA, 22 bp, Homo sapiens
gagggccaaagagcaagagcct

SEQ ID NO: 7038039 - DNA, 22 bp, Homo sapiens
gagggccaactagcaccacttt

SEQ ID NO: 7038040 - DNA, 22 bp, Homo sapiens
gagggccaatgtgtccctgagc

SEQ ID NO: 7038041 - DNA, 22 bp, Homo sapiens
gaggctgccccttcctcagctg

SEQ ID NO: 7038042 - DNA, 22 bp, Homo sapiens
gatgcagaaagtagacaccatc

SEQ ID NO: 7038043 - DNA, 22 bp, Homo sapiens
gatgacagtgagtaaccccaac

SEQ ID NO: 7038044 - DNA, 22 bp, Homo sapiens
gatgaggaatgctcagctcaat

SEQ ID NO: 7038045 - DNA, 22 bp, Homo sapiens
gatgaaatccagatcacaggtg

SEQ ID NO: 7038046 - DNA, 22 bp, Homo sapiens
gataatatctggtttattcacc

SEQ ID NO: 7038047 - DNA, 21 bp, Homo sapiens
gatacagagggccactgattg

SEQ ID NO: 7038048 - DNA, 22 bp, Homo sapiens
gataccagagcccaaagcagca

SEQ ID NO: 7038049 - DNA, 22 bp, Homo sapiens
gatagataaaactatattttca

SEQ ID NO: 7038050 - DNA, 19 bp, Homo sapiens
gatataaagagatggtgaa

SEQ ID NO: 7038051 - DNA, 22 bp, Homo sapiens
gatatacaatccacagttgatt

SEQ ID NO: 7038052 - DNA, 22 bp, Homo sapiens
gatatacaatccacagttgatt

SEQ ID NO: 7038053 - DNA, 22 bp, Homo sapiens
gatatacagagcattctttgat

SEQ ID NO: 7038054 - DNA, 22 bp, Homo sapiens
gatatacataggtttctatgca

SEQ ID NO: 7038055 - DNA, 22 bp, Homo sapiens
gatatacataggtttctatgca

SEQ ID NO: 7038056 - DNA, 22 bp, Homo sapiens
gatattttcagtctcctttcaa

SEQ ID NO: 7038057 - DNA, 22 bp, Homo sapiens
gatattttcagtctcctttcaa

SEQ ID NO: 7038058 - DNA, 22 bp, Homo sapiens
gatattttcattcggatgctca

SEQ ID NO: 7038059 - DNA, 22 bp, Homo sapiens
gatattttcattcggatgctca

SEQ ID NO: 7038060 - DNA, 22 bp, Homo sapiens
gatattttcgcagggagaattc

SEQ ID NO: 7038061 - DNA, 22 bp, Homo sapiens
gatattttcgcagggagaattc

SEQ ID NO: 7038062 - DNA, 22 bp, Homo sapiens
gatattttgagaaatcctatga

SEQ ID NO: 7038063 - DNA, 22 bp, Homo sapiens
gatattttgagaaatcctatga

SEQ ID NO: 7038064 - DNA, 22 bp, Homo sapiens
gatatttttaggtgatgcaggc

SEQ ID NO: 7038065 - DNA, 22 bp, Homo sapiens
gatatttttagtatttctgcct

SEQ ID NO: 7038066 - DNA, 22 bp, Homo sapiens
gatatttttagtatttctgcct

SEQ ID NO: 7038067 - DNA, 22 bp, Homo sapiens
gatatttttgcagacacctggg

SEQ ID NO: 7038068 - DNA, 22 bp, Homo sapiens
gatatttttgcagacacctggg

SEQ ID NO: 7038069 - DNA, 22 bp, Homo sapiens
gatcattagcttttcaaaggag

SEQ ID NO: 7038070 - DNA, 22 bp, Homo sapiens
gagttttaaagctggggaagag

SEQ ID NO: 7038071 - DNA, 22 bp, Homo sapiens
gagttttaacctcagctctctg

SEQ ID NO: 7038072 - DNA, 22 bp, Homo sapiens
gagttttaatgagctgctgtgg

SEQ ID NO: 7038073 - DNA, 22 bp, Homo sapiens
gagttttatttggtgctaagta

SEQ ID NO: 7038074 - DNA, 22 bp, Homo sapiens
gataaagtagatttgttctaga

SEQ ID NO: 7038075 - DNA, 22 bp, Homo sapiens
gataaatggctgaagaaatagt

SEQ ID NO: 7038076 - DNA, 22 bp, Homo sapiens
gagtctctgggagggaaagaag

SEQ ID NO: 7038077 - DNA, 22 bp, Homo sapiens
gagtctctttgccagtcctaag

SEQ ID NO: 7038078 - DNA, 18 bp, Homo sapiens
gagtctttgttactgctg

SEQ ID NO: 7038079 - DNA, 21 bp, Homo sapiens
gagtccttccaatgtcctcag

SEQ ID NO: 7038080 - DNA, 22 bp, Homo sapiens
gagtccttccagcaggcattta

SEQ ID NO: 7038081 - DNA, 22 bp, Homo sapiens
gagtcctttgttccttgccaca

SEQ ID NO: 7038082 - DNA, 22 bp, Homo sapiens
gagtccttttctctgtccactg

SEQ ID NO: 7038083 - DNA, 22 bp, Homo sapiens
gagtccttttgtgccacaggga

SEQ ID NO: 7038084 - DNA, 22 bp, Homo sapiens
gagtctctagtctggtcctggc

SEQ ID NO: 7038085 - DNA, 22 bp, Homo sapiens
gagtctctcatgcagttacagt

SEQ ID NO: 7038086 - DNA, 22 bp, Homo sapiens
gagtctctgaccagggtgccaa

SEQ ID NO: 7038087 - DNA, 22 bp, Homo sapiens
gagtctctgctatgttttctct

SEQ ID NO: 7038088 - DNA, 22 bp, Homo sapiens
gagtctctggaggggtcagacc

SEQ ID NO: 7038089 - DNA, 21 bp, Homo sapiens
gagtggaacgctcttcacacc

SEQ ID NO: 7038090 - DNA, 21 bp, Homo sapiens
gagtgggacatgggagtggtt

SEQ ID NO: 7038091 - DNA, 22 bp, Homo sapiens
gatgctgaccagctgtttcctt

SEQ ID NO: 7038092 - DNA, 22 bp, Homo sapiens
gatgctgactggtgtttgcctt

SEQ ID NO: 7038093 - DNA, 22 bp, Homo sapiens
gatgctgactttccgctgccac

SEQ ID NO: 7038094 - DNA, 22 bp, Homo sapiens
gatggggttttgccaggctggt

SEQ ID NO: 7038095 - DNA, 22 bp, Homo sapiens
gattattttgtgcaataatcgg

SEQ ID NO: 7038096 - DNA, 22 bp, Homo sapiens
gattcaaagttaatgaagatgc

SEQ ID NO: 7038097 - DNA, 22 bp, Homo sapiens
gattgcaaatcattacaaagga

SEQ ID NO: 7038098 - DNA, 22 bp, Homo sapiens
gatttataaaggttgcactgga

SEQ ID NO: 7038099 - DNA, 21 bp, Homo sapiens
gatttataagccttaagccta

SEQ ID NO: 7038100 - DNA, 19 bp, Homo sapiens
gcaccccatcttcctcctg

SEQ ID NO: 7038101 - DNA, 23 bp, Homo sapiens
gcaccccagatgtgattagttag

SEQ ID NO: 7038102 - DNA, 22 bp, Homo sapiens
gcacttttcaaagcttcctgtg

SEQ ID NO: 7038103 - DNA, 22 bp, Homo sapiens
gattttatcgtcatccttctgg

SEQ ID NO: 7038104 - DNA, 22 bp, Homo sapiens
gattttatctttgtgtgcagta

SEQ ID NO: 7038105 - DNA, 22 bp, Homo sapiens
gattttattagcccaaactttg

SEQ ID NO: 7038106 - DNA, 21 bp, Homo sapiens
gattttaaagagactgccaca

SEQ ID NO: 7038107 - DNA, 22 bp, Homo sapiens
gattttaattataggaggtcct

SEQ ID NO: 7038108 - DNA, 22 bp, Homo sapiens
gattttatagtcaggaaaaaga

SEQ ID NO: 7038109 - DNA, 22 bp, Homo sapiens
gattttatatggcatactgtgg

SEQ ID NO: 7038110 - DNA, 22 bp, Homo sapiens
gatttttatataaagtgagaaa

SEQ ID NO: 7038111 - DNA, 22 bp, Homo sapiens
gatttttatataaagtgagaaa

SEQ ID NO: 7038112 - DNA, 22 bp, Homo sapiens
gcaaaaaatgcttgttgcttag

SEQ ID NO: 7038113 - DNA, 22 bp, Homo sapiens
gcaaacatgtgctcattttgtg

SEQ ID NO: 7038114 - DNA, 22 bp, Homo sapiens
gcaatataaccagttgtcatgc

SEQ ID NO: 7038115 - DNA, 22 bp, Homo sapiens
gcaatataaccagttgtcatgc

SEQ ID NO: 7038116 - DNA, 22 bp, Homo sapiens
gcaatataatttgtgggatatc

SEQ ID NO: 7038117 - DNA, 22 bp, Homo sapiens
gcaatatactttctggcagtga

SEQ ID NO: 7038118 - DNA, 20 bp, Homo sapiens
gcaatatatgagtgcaataa

SEQ ID NO: 7038119 - DNA, 22 bp, Homo sapiens
gcaatcaatgatttatatttgt

SEQ ID NO: 7038120 - DNA, 22 bp, Homo sapiens
gcaattatatcaccagagatct

SEQ ID NO: 7038121 - DNA, 19 bp, Homo sapiens
gcaattcagaagcacctgt

SEQ ID NO: 7038122 - DNA, 19 bp, Homo sapiens
gcaattcagtagtacaaaa

SEQ ID NO: 7038123 - DNA, 22 bp, Homo sapiens
gcaggagccacttcagggatgc

SEQ ID NO: 7038124 - DNA, 22 bp, Homo sapiens
gcaggagaaatgaagattgggt

SEQ ID NO: 7038125 - DNA, 22 bp, Homo sapiens
gcaggagaacaaagcaagctgc

SEQ ID NO: 7038126 - DNA, 22 bp, Homo sapiens
gcaggagacaactgtaaggaga

SEQ ID NO: 7038127 - DNA, 22 bp, Homo sapiens
gcaggagactggctgtggtagt

SEQ ID NO: 7038128 - DNA, 22 bp, Homo sapiens
gcagggaaacaggtgctaagga

SEQ ID NO: 7038129 - DNA, 22 bp, Homo sapiens
gcagggcacagacagtgccaag

SEQ ID NO: 7038130 - DNA, 22 bp, Homo sapiens
gcaggggcaggagatctcaggc

SEQ ID NO: 7038131 - DNA, 22 bp, Homo sapiens
gcaggggcggctgggtttccag

SEQ ID NO: 7038132 - DNA, 22 bp, Homo sapiens
gcaggggctaaggacacagaga

SEQ ID NO: 7038133 - DNA, 22 bp, Homo sapiens
gcaggggctactctgagcttcc

SEQ ID NO: 7038134 - DNA, 22 bp, Homo sapiens
gcaggggctgagcaccagcggg

SEQ ID NO: 7038135 - DNA, 22 bp, Homo sapiens
gcaggggctgctgggaactcgg

SEQ ID NO: 7038136 - DNA, 22 bp, Homo sapiens
gcatgggcaagaggactggggg

SEQ ID NO: 7038137 - DNA, 22 bp, Homo sapiens
gccagatttacagatttgccct

SEQ ID NO: 7038138 - DNA, 22 bp, Homo sapiens
gccagcaaagcaagttgtcagc

SEQ ID NO: 7038139 - DNA, 22 bp, Homo sapiens
gcaggtgtcagtccccaaggtg

SEQ ID NO: 7038140 - DNA, 22 bp, Homo sapiens
gcagtgggcaacaagagctgga

SEQ ID NO: 7038141 - DNA, 22 bp, Homo sapiens
gcaggtgggagccgctgcctga

SEQ ID NO: 7038142 - DNA, 22 bp, Homo sapiens
gcagggtgatagtgaggctcag

SEQ ID NO: 7038143 - DNA, 22 bp, Homo sapiens
gcagggtgatagtgaggctcag

SEQ ID NO: 7038144 - DNA, 22 bp, Homo sapiens
gcagggtgccgacttcagggat

SEQ ID NO: 7038145 - DNA, 22 bp, Homo sapiens
gcagggtggatggcagggccag

SEQ ID NO: 7038146 - DNA, 22 bp, Homo sapiens
gcaggtggggctgctaccagaa

SEQ ID NO: 7038147 - DNA, 22 bp, Homo sapiens
gcaggtggtcactcatccccag

SEQ ID NO: 7038148 - DNA, 22 bp, Homo sapiens
gcaggtggtggcgcgcgccctg

SEQ ID NO: 7038149 - DNA, 22 bp, Homo sapiens
gcaggtggttaaggtcccatgt

SEQ ID NO: 7038150 - DNA, 22 bp, Homo sapiens
gcccaggctggagtgcagtggt

SEQ ID NO: 7038151 - DNA, 22 bp, Homo sapiens
gccgaggaagcattcctaggag

SEQ ID NO: 7038152 - DNA, 22 bp, Homo sapiens
gcctcctgtcccaggctgagga

SEQ ID NO: 7038153 - DNA, 22 bp, Homo sapiens
gccagtgggtagttggagctgg

SEQ ID NO: 7038154 - DNA, 22 bp, Homo sapiens
gccatgggcaaatgcagagctg

SEQ ID NO: 7038155 - DNA, 19 bp, Homo sapiens
gccatgggctggcagcaga

SEQ ID NO: 7038156 - DNA, 22 bp, Homo sapiens
gccatggggacttcatggattt

SEQ ID NO: 7038157 - DNA, 22 bp, Homo sapiens
gccatggggagggcagcgcctg

SEQ ID NO: 7038158 - DNA, 22 bp, Homo sapiens
gccatggggctcagctgcacta

SEQ ID NO: 7038159 - DNA, 22 bp, Homo sapiens
gccatgggtctgctggctcagc

SEQ ID NO: 7038160 - DNA, 22 bp, Homo sapiens
gcccaggaggtcaagtagctat

SEQ ID NO: 7038161 - DNA, 22 bp, Homo sapiens
gcccaggagttggaggctgcag

SEQ ID NO: 7038162 - DNA, 22 bp, Homo sapiens
gcccaggataatgctgtccctg

SEQ ID NO: 7038163 - DNA, 20 bp, Homo sapiens
gcccaggatctctgaggcat

SEQ ID NO: 7038164 - DNA, 22 bp, Homo sapiens
gcccaggatggctggaggtgct

SEQ ID NO: 7038165 - DNA, 22 bp, Homo sapiens
gcccaggattctttcttcctta

SEQ ID NO: 7038166 - DNA, 22 bp, Homo sapiens
gcccaggctggagtgcagtagc

SEQ ID NO: 7038167 - DNA, 22 bp, Homo sapiens
gcccaggctggagtgcagtggc

SEQ ID NO: 7038168 - DNA, 21 bp, Homo sapiens
gcctgggaagagaaaggtaag

SEQ ID NO: 7038169 - DNA, 22 bp, Homo sapiens
gcctgggacccttagctcttgg

SEQ ID NO: 7038170 - DNA, 22 bp, Homo sapiens
gcctgggactggatgtgtttgt

SEQ ID NO: 7038171 - DNA, 18 bp, Homo sapiens
gcctgggagaagtttcac

SEQ ID NO: 7038172 - DNA, 22 bp, Homo sapiens
gcctgggatagaggcaatgcat

SEQ ID NO: 7038173 - DNA, 21 bp, Homo sapiens
gcctgggatagtggcctccgg

SEQ ID NO: 7038174 - DNA, 19 bp, Homo sapiens
gcctgggatgggcagaact

SEQ ID NO: 7038175 - DNA, 22 bp, Homo sapiens
gcctgggattcccagaggggca

SEQ ID NO: 7038176 - DNA, 22 bp, Homo sapiens
gcctctggaagtgggaaggggt

SEQ ID NO: 7038177 - DNA, 20 bp, Homo sapiens
gcctctggagccaaggacca

SEQ ID NO: 7038178 - DNA, 23 bp, Homo sapiens
gcctctggagccccagtgctcag

SEQ ID NO: 7038179 - DNA, 22 bp, Homo sapiens
gcctggagggtccctctctgga

SEQ ID NO: 7038180 - DNA, 22 bp, Homo sapiens
gctgggcaggcctcgtgagggc

SEQ ID NO: 7038181 - DNA, 22 bp, Homo sapiens
gctgggcagtgagtgagtcctt

SEQ ID NO: 7038182 - DNA, 22 bp, Homo sapiens
gctgggcagcccctacagagag

SEQ ID NO: 7038183 - DNA, 22 bp, Homo sapiens
gctgggcagcctggccgctgcc

SEQ ID NO: 7038184 - DNA, 22 bp, Homo sapiens
gctgggcagctgaggcctctca

SEQ ID NO: 7038185 - DNA, 22 bp, Homo sapiens
gctgggcaacgggcagaaagat

SEQ ID NO: 7038186 - DNA, 22 bp, Homo sapiens
gctgggcaaggctgaagctacc

SEQ ID NO: 7038187 - DNA, 22 bp, Homo sapiens
gctgggcaagtgccttgggttt

SEQ ID NO: 7038188 - DNA, 22 bp, Homo sapiens
gctgggcaatgccagagaggag

SEQ ID NO: 7038189 - DNA, 22 bp, Homo sapiens
gctgggcaccggagagacccca

SEQ ID NO: 7038190 - DNA, 22 bp, Homo sapiens
gctgggcacctctcccagattg

SEQ ID NO: 7038191 - DNA, 22 bp, Homo sapiens
gctgggcactgtcccataggct

SEQ ID NO: 7038192 - DNA, 22 bp, Homo sapiens
gctgggcagcaggctctccggg

SEQ ID NO: 7038193 - DNA, 22 bp, Homo sapiens
gctgggcaacggaagagagaaa

SEQ ID NO: 7038194 - DNA, 22 bp, Homo sapiens
gctgagccacaggcagtgcact

SEQ ID NO: 7038195 - DNA, 21 bp, Homo sapiens
gctggagagccaggcaggggc

SEQ ID NO: 7038196 - DNA, 20 bp, Homo sapiens
gctgaagaagtagcatgtac

SEQ ID NO: 7038197 - DNA, 22 bp, Homo sapiens
gctgaagaccccagctccccag

SEQ ID NO: 7038198 - DNA, 22 bp, Homo sapiens
gctcagacctgtaatcttagca

SEQ ID NO: 7038199 - DNA, 22 bp, Homo sapiens
gctgggctgagaagttaagcaa

SEQ ID NO: 7038200 - DNA, 21 bp, Homo sapiens
gctgggctccagtctgccgct

SEQ ID NO: 7038201 - DNA, 22 bp, Homo sapiens
gctgggcatgtgaccaacagaa

SEQ ID NO: 7038202 - DNA, 22 bp, Homo sapiens
gctgggccagactttcaatgtc

SEQ ID NO: 7038203 - DNA, 22 bp, Homo sapiens
gctgggccagagcagcagcact

SEQ ID NO: 7038204 - DNA, 22 bp, Homo sapiens
gctgggctccaccctcaactgt

SEQ ID NO: 7038205 - DNA, 22 bp, Homo sapiens
gctgggctccaggccagggtga

SEQ ID NO: 7038206 - DNA, 22 bp, Homo sapiens
gctgggctgcccaacctctgac

SEQ ID NO: 7038207 - DNA, 22 bp, Homo sapiens
gctgggctggaaggccaaggca

SEQ ID NO: 7038208 - DNA, 17 bp, Homo sapiens
ggaagaaaaggatcatc

SEQ ID NO: 7038209 - DNA, 22 bp, Homo sapiens
ggaaaactgaggctctcagcag

SEQ ID NO: 7038210 - DNA, 22 bp, Homo sapiens
ggaggcagaatagagtgtgggt

SEQ ID NO: 7038211 - DNA, 23 bp, Homo sapiens
ggagaggggtgtgggcatcttta

SEQ ID NO: 7038212 - DNA, 22 bp, Homo sapiens
ggagaggtgaatggctgctcta

SEQ ID NO: 7038213 - DNA, 22 bp, Homo sapiens
ggagaggtgcaggtcagtggca

SEQ ID NO: 7038214 - DNA, 22 bp, Homo sapiens
ggaataaaaattgtttactgta

SEQ ID NO: 7038215 - DNA, 22 bp, Homo sapiens
ggaatactaaaggaagcaattg

SEQ ID NO: 7038216 - DNA, 22 bp, Homo sapiens
ggaatactatgacacacaggtg

SEQ ID NO: 7038217 - DNA, 17 bp, Homo sapiens
ggagacagggtctttaa

SEQ ID NO: 7038218 - DNA, 22 bp, Homo sapiens
ggagtgggaacaatgacatggt

SEQ ID NO: 7038219 - DNA, 22 bp, Homo sapiens
ggagtggcactctgaggcgggg

SEQ ID NO: 7038220 - DNA, 23 bp, Homo sapiens
ggcagagagcatggctggggccc

SEQ ID NO: 7038221 - DNA, 22 bp, Homo sapiens
ggcagaggaagctggaagtggg

SEQ ID NO: 7038222 - DNA, 22 bp, Homo sapiens
ggcagaggaagctggaagtggg

SEQ ID NO: 7038223 - DNA, 22 bp, Homo sapiens
ggcaggcagatggctgcaccaa

SEQ ID NO: 7038224 - DNA, 22 bp, Homo sapiens
ggcaggcagcctccatccacag

SEQ ID NO: 7038225 - DNA, 22 bp, Homo sapiens
ggaggtggtggcagtgacaatt

SEQ ID NO: 7038226 - DNA, 22 bp, Homo sapiens
ggagtaggccccgggagagagt

SEQ ID NO: 7038227 - DNA, 22 bp, Homo sapiens
ggaggtggcctgaaaatgtggc

SEQ ID NO: 7038228 - DNA, 22 bp, Homo sapiens
ggaggtggaggttgcagtgagc

SEQ ID NO: 7038229 - DNA, 22 bp, Homo sapiens
ggaggtcacgactgggatgcct

SEQ ID NO: 7038230 - DNA, 22 bp, Homo sapiens
ggagggggaaactttggctgcc

SEQ ID NO: 7038231 - DNA, 22 bp, Homo sapiens
ggagggggaagaagctaaagac

SEQ ID NO: 7038232 - DNA, 22 bp, Homo sapiens
ggaggctgaggcccctcacagg

SEQ ID NO: 7038233 - DNA, 22 bp, Homo sapiens
ggaggctgaggcccctcacagg

SEQ ID NO: 7038234 - DNA, 22 bp, Homo sapiens
ggaggctctgccatctgtcaca

SEQ ID NO: 7038235 - DNA, 22 bp, Homo sapiens
ggaggctctgctccgtgtgttc

SEQ ID NO: 7038236 - DNA, 22 bp, Homo sapiens
ggaggctgagaagtccaagatc

SEQ ID NO: 7038237 - DNA, 22 bp, Homo sapiens
ggagggcagagtcccctgctga

SEQ ID NO: 7038238 - DNA, 22 bp, Homo sapiens
ggagggccctgggtgcagctct

SEQ ID NO: 7038239 - DNA, 22 bp, Homo sapiens
ggagggctcgtcatccaccact

SEQ ID NO: 7038240 - DNA, 20 bp, Homo sapiens
gggtgagatgtaggagaggg

SEQ ID NO: 7038241 - DNA, 22 bp, Homo sapiens
gggggtgacgatggcagctggt

SEQ ID NO: 7038242 - DNA, 22 bp, Homo sapiens
gggggtgaggacaggagcactg

SEQ ID NO: 7038243 - DNA, 22 bp, Homo sapiens
gggtccaggcgtggcccagatg

SEQ ID NO: 7038244 - DNA, 22 bp, Homo sapiens
ggggactgaggcactgaaggtg

SEQ ID NO: 7038245 - DNA, 22 bp, Homo sapiens
gggggctgaggctgttctgagg

SEQ ID NO: 7038246 - DNA, 22 bp, Homo sapiens
gggggctgaggctgttctgagg

SEQ ID NO: 7038247 - DNA, 22 bp, Homo sapiens
gggggctgatcatttactgggc

SEQ ID NO: 7038248 - DNA, 22 bp, Homo sapiens
gggggctgatcatttactgggc

SEQ ID NO: 7038249 - DNA, 16 bp, Homo sapiens
gggggctgcaagcttc

SEQ ID NO: 7038250 - DNA, 16 bp, Homo sapiens
gggggctgcaagcttc

SEQ ID NO: 7038251 - DNA, 22 bp, Homo sapiens
gggggctggaatatccatcaac

SEQ ID NO: 7038252 - DNA, 22 bp, Homo sapiens
gggggctggaatatccatcaac

SEQ ID NO: 7038253 - DNA, 22 bp, Homo sapiens
gggggctggactttcccacaca

SEQ ID NO: 7038254 - DNA, 22 bp, Homo sapiens
gggggctggactttcccacaca

SEQ ID NO: 7038255 - DNA, 23 bp, Homo sapiens
gggggctggttgactctctgcag

SEQ ID NO: 7038256 - DNA, 22 bp, Homo sapiens
gggggctgtcctgtgcattgta

SEQ ID NO: 7038257 - DNA, 23 bp, Homo sapiens
gggggctggttgactctctgcag

SEQ ID NO: 7038258 - DNA, 22 bp, Homo sapiens
gggggctgtcctgtgcattgta

SEQ ID NO: 7038259 - DNA, 22 bp, Homo sapiens
gggggctgtcctgtgcattgta

SEQ ID NO: 7038260 - DNA, 22 bp, Homo sapiens
gggctgagaattcagctttcct

SEQ ID NO: 7038261 - DNA, 22 bp, Homo sapiens
gggctgagagctggaatctgag

SEQ ID NO: 7038262 - DNA, 22 bp, Homo sapiens
gggctgagacgatggggtcttc

SEQ ID NO: 7038263 - DNA, 22 bp, Homo sapiens
gggctgcttttaagggtctcag

SEQ ID NO: 7038264 - DNA, 23 bp, Homo sapiens
gggcccagcacaggacctggcag

SEQ ID NO: 7038265 - DNA, 22 bp, Homo sapiens
gggcccagcactggctgggatc

SEQ ID NO: 7038266 - DNA, 22 bp, Homo sapiens
gggcccagcactggctgggatc

SEQ ID NO: 7038267 - DNA, 19 bp, Homo sapiens
gggcccagcatggagggtt

SEQ ID NO: 7038268 - DNA, 19 bp, Homo sapiens
gggcccagcatggagggtt

SEQ ID NO: 7038269 - DNA, 22 bp, Homo sapiens
gggcccagccctctgctcactg

SEQ ID NO: 7038270 - DNA, 22 bp, Homo sapiens
gggcccagcgtggttccatctg

SEQ ID NO: 7038271 - DNA, 22 bp, Homo sapiens
gggcccaggcctccttccttcc

SEQ ID NO: 7038272 - DNA, 18 bp, Homo sapiens
gggcagcacagcagcctc

SEQ ID NO: 7038273 - DNA, 22 bp, Homo sapiens
gggatggggagctggaaagggg

SEQ ID NO: 7038274 - DNA, 22 bp, Homo sapiens
gggatggctcaaaggagtcagg

SEQ ID NO: 7038275 - DNA, 22 bp, Homo sapiens
gggatggctgcctgcatcagga

SEQ ID NO: 7038276 - DNA, 22 bp, Homo sapiens
gggatgcagactacagggctta

SEQ ID NO: 7038277 - DNA, 22 bp, Homo sapiens
gggaggctcagtggtgtcctct

SEQ ID NO: 7038278 - DNA, 22 bp, Homo sapiens
gggaggctctgctcagcccccg

SEQ ID NO: 7038279 - DNA, 22 bp, Homo sapiens
gggaggctgccatccttcagga

SEQ ID NO: 7038280 - DNA, 22 bp, Homo sapiens
gggaggctggctctggccacag

SEQ ID NO: 7038281 - DNA, 22 bp, Homo sapiens
gggactccagggccactgggcc

SEQ ID NO: 7038282 - DNA, 22 bp, Homo sapiens
ggcttcaggggcccagtcagca

SEQ ID NO: 7038283 - DNA, 19 bp, Homo sapiens
ggctgtggtggtgccttgc

SEQ ID NO: 7038284 - DNA, 23 bp, Homo sapiens
ggcttcagtgagagtccctgctg

SEQ ID NO: 7038285 - DNA, 19 bp, Homo sapiens
ggcttcagtttagcaggct

SEQ ID NO: 7038286 - DNA, 22 bp, Homo sapiens
ggctgtggtggcatccctgagc

SEQ ID NO: 7038287 - DNA, 22 bp, Homo sapiens
gggaaaggatttacagtttgat

SEQ ID NO: 7038288 - DNA, 22 bp, Homo sapiens
gggaacagcatatctgaagggt

SEQ ID NO: 7038289 - DNA, 22 bp, Homo sapiens
gggaacagcttgggctctgcca

SEQ ID NO: 7038290 - DNA, 22 bp, Homo sapiens
ggctgcaggaacgacggagggg

SEQ ID NO: 7038291 - DNA, 22 bp, Homo sapiens
ggctgcagaggcccccagtggg

SEQ ID NO: 7038292 - DNA, 22 bp, Homo sapiens
ggctgcagaggcgatctgaggt

SEQ ID NO: 7038293 - DNA, 22 bp, Homo sapiens
ggctgcagaggcccccagtggg

SEQ ID NO: 7038294 - DNA, 22 bp, Homo sapiens
ggctgcagagctgggtgggcct

SEQ ID NO: 7038295 - DNA, 22 bp, Homo sapiens
ggctgcagagctggtgccctgg

SEQ ID NO: 7038296 - DNA, 22 bp, Homo sapiens
ggctgcagaagtacttccggat

SEQ ID NO: 7038297 - DNA, 19 bp, Homo sapiens
ggctgcagagccccggcgc

SEQ ID NO: 7038298 - DNA, 22 bp, Homo sapiens
ggctgatgagcttagctagaga

SEQ ID NO: 7038299 - DNA, 20 bp, Homo sapiens
ggctgcaggactcattggct

SEQ ID NO: 7038300 - DNA, 22 bp, Homo sapiens
ggctgcaggatgcccagccgtg

SEQ ID NO: 7038301 - DNA, 22 bp, Homo sapiens
ggctgcaggatgcccagccgtg

SEQ ID NO: 7038302 - DNA, 22 bp, Homo sapiens
ggctgcaggcagaggctgtctg

SEQ ID NO: 7038303 - DNA, 22 bp, Homo sapiens
ggctgcaggcagggtatccact

SEQ ID NO: 7038304 - DNA, 22 bp, Homo sapiens
ggctgcctgggagccctcctct

SEQ ID NO: 7038305 - DNA, 22 bp, Homo sapiens
ggctgccttcagactccagctt

SEQ ID NO: 7038306 - DNA, 22 bp, Homo sapiens
ggctcagtgggaacaagctgag

SEQ ID NO: 7038307 - DNA, 22 bp, Homo sapiens
ggctcaggtttccttcccagct

SEQ ID NO: 7038308 - DNA, 22 bp, Homo sapiens
ggccccagcagaccctcctctg

SEQ ID NO: 7038309 - DNA, 22 bp, Homo sapiens
ggcccagcctcagacatgccct

SEQ ID NO: 7038310 - DNA, 22 bp, Homo sapiens
ggcccagcctggcaacaatgac

SEQ ID NO: 7038311 - DNA, 22 bp, Homo sapiens
ggcccagccttggggtttcttt

SEQ ID NO: 7038312 - DNA, 22 bp, Homo sapiens
ggcccagcgaggccacctacag

SEQ ID NO: 7038313 - DNA, 22 bp, Homo sapiens
ggccccagttcactcctggccg

SEQ ID NO: 7038314 - DNA, 17 bp, Homo sapiens
ggccatggtgcaaggtt

SEQ ID NO: 7038315 - DNA, 22 bp, Homo sapiens
ggcccagccggcgagtctcgcg

SEQ ID NO: 7038316 - DNA, 22 bp, Homo sapiens
ggccagaggccatcctcctgct

SEQ ID NO: 7038317 - DNA, 22 bp, Homo sapiens
gtgcctggaatgcgcctcggcg

SEQ ID NO: 7038318 - DNA, 22 bp, Homo sapiens
gtggaaatgcccccaaatagtg

SEQ ID NO: 7038319 - DNA, 22 bp, Homo sapiens
gtggaaattttaggatcatctt

SEQ ID NO: 7038320 - DNA, 20 bp, Homo sapiens
gtgcctggagaagaggctgt

SEQ ID NO: 7038321 - DNA, 22 bp, Homo sapiens
gtgcctggcagggtcagctgct

SEQ ID NO: 7038322 - DNA, 22 bp, Homo sapiens
gtgcctttgagaagtttctctg

SEQ ID NO: 7038323 - DNA, 22 bp, Homo sapiens
gtggagggaatgaatcttctct

SEQ ID NO: 7038324 - DNA, 22 bp, Homo sapiens
gtggagggtgattgccggctgt

SEQ ID NO: 7038325 - DNA, 22 bp, Homo sapiens
gtggaggtcccgggcaggagca

SEQ ID NO: 7038326 - DNA, 22 bp, Homo sapiens
gtggaattgctggataatatca

SEQ ID NO: 7038327 - DNA, 22 bp, Homo sapiens
gtggacagagctagaaaatgtg

SEQ ID NO: 7038328 - DNA, 22 bp, Homo sapiens
gtggctggtttcctgcatgcaa

SEQ ID NO: 7038329 - DNA, 22 bp, Homo sapiens
gtggctgggctccgagcggctt

SEQ ID NO: 7038330 - DNA, 22 bp, Homo sapiens
gtgggactcttctttggcagtg

SEQ ID NO: 7038331 - DNA, 22 bp, Homo sapiens
gtgggagcatggtcccagtgcc

SEQ ID NO: 7038332 - DNA, 22 bp, Homo sapiens
gtgggagccctcagggaggtgc

SEQ ID NO: 7038333 - DNA, 22 bp, Homo sapiens
gtgggagctttggcatcaggct

SEQ ID NO: 7038334 - DNA, 22 bp, Homo sapiens
gtggcctgcaggcaccttgggg

SEQ ID NO: 7038335 - DNA, 22 bp, Homo sapiens
gtggcctgccagcagatggcgc

SEQ ID NO: 7038336 - DNA, 22 bp, Homo sapiens
gtggctctctggtcccctgcca

SEQ ID NO: 7038337 - DNA, 22 bp, Homo sapiens
gtggcaggatcacggctcactg

SEQ ID NO: 7038338 - DNA, 22 bp, Homo sapiens
gtggcaggatcacggctcactg

SEQ ID NO: 7038339 - DNA, 20 bp, Homo sapiens
gtggcaggcagtgaaggagc

SEQ ID NO: 7038340 - DNA, 22 bp, Homo sapiens
gtctgccagcaccataaattag

SEQ ID NO: 7038341 - DNA, 22 bp, Homo sapiens
gtctgcagacaacttagaagca

SEQ ID NO: 7038342 - DNA, 22 bp, Homo sapiens
gtatgtctatagtttttaaata

SEQ ID NO: 7038343 - DNA, 22 bp, Homo sapiens
gtattacatttagtaattaggc

SEQ ID NO: 7038344 - DNA, 22 bp, Homo sapiens
gtcaggagaggccatcagcttt

SEQ ID NO: 7038345 - DNA, 22 bp, Homo sapiens
gtaaactgaattggatactgtg

SEQ ID NO: 7038346 - DNA, 22 bp, Homo sapiens
gtatatcaggcagaatgttctc

SEQ ID NO: 7038347 - DNA, 22 bp, Homo sapiens
ggtgagggtaaatataggcaaa

SEQ ID NO: 7038348 - DNA, 22 bp, Homo sapiens
ggtgaggggagagtgaaagaaa

SEQ ID NO: 7038349 - DNA, 22 bp, Homo sapiens
gggtggggccaggcaatttgca

SEQ ID NO: 7038350 - DNA, 22 bp, Homo sapiens
gggtggggcccaggaaatctat

SEQ ID NO: 7038351 - DNA, 22 bp, Homo sapiens
gggtggggtgtatcggatccta

SEQ ID NO: 7038352 - DNA, 22 bp, Homo sapiens
gggtggggttcaggaatcttca

SEQ ID NO: 7038353 - DNA, 22 bp, Homo sapiens
ggtgcaggagcggggtgctcgg

SEQ ID NO: 7038354 - DNA, 22 bp, Homo sapiens
ggtgcaggcggtggggcaagta

SEQ ID NO: 7038355 - DNA, 23 bp, Homo sapiens
ggtggtggtgagtcacgggctca

SEQ ID NO: 7038356 - DNA, 22 bp, Homo sapiens
gttctcctcttagctgtgccac

SEQ ID NO: 7038357 - DNA, 21 bp, Homo sapiens
gttctattttgcaaacttctg

SEQ ID NO: 7038358 - DNA, 22 bp, Homo sapiens
gttgtatttgcctgaatgcagt

SEQ ID NO: 7038359 - DNA, 22 bp, Homo sapiens
gttgtttgtaatgacaggagac

SEQ ID NO: 7038360 - DNA, 22 bp, Homo sapiens
gttattttaacttctcagtaat

SEQ ID NO: 7038361 - DNA, 21 bp, Homo sapiens
gttattttaagtgagctttgc

SEQ ID NO: 7038362 - DNA, 21 bp, Homo sapiens
gttattttaagtgagctttgc

SEQ ID NO: 7038363 - DNA, 22 bp, Homo sapiens
gttattttatctctgagaggtt

SEQ ID NO: 7038364 - DNA, 22 bp, Homo sapiens
gttattttcattggctcagact

SEQ ID NO: 7038365 - DNA, 22 bp, Homo sapiens
gttctattactccctgcttctt

SEQ ID NO: 7038366 - DNA, 21 bp, Homo sapiens
gtgtcatggttgactttggca

SEQ ID NO: 7038367 - DNA, 22 bp, Homo sapiens
gtgtccagagaaactcacagct

SEQ ID NO: 7038368 - DNA, 22 bp, Homo sapiens
gtgtccagagccgggctgaatg

SEQ ID NO: 7038369 - DNA, 22 bp, Homo sapiens
gtgtccagcctgcacagggtgc

SEQ ID NO: 7038370 - DNA, 22 bp, Homo sapiens
gtgtccagcgtggaatgagggt

SEQ ID NO: 7038371 - DNA, 22 bp, Homo sapiens
gtgtaagtatctttgtatcttt

SEQ ID NO: 7038372 - DNA, 18 bp, Homo sapiens
gtggggtgttgtgaggat

SEQ ID NO: 7038373 - DNA, 22 bp, Homo sapiens
gtgggtgcggggagccgaggcg

SEQ ID NO: 7038374 - DNA, 22 bp, Homo sapiens
gtgggtgctgtcaggcagggaa

SEQ ID NO: 7038375 - DNA, 22 bp, Homo sapiens
gtgggtggagactgggtgcaag

SEQ ID NO: 7038376 - DNA, 22 bp, Homo sapiens
gtggtatttatgacagtgcccg

SEQ ID NO: 7038377 - DNA, 22 bp, Homo sapiens
gtggggctggaagatgggtact

SEQ ID NO: 7038378 - DNA, 22 bp, Homo sapiens
gtggggcttcctggggcaagtt

SEQ ID NO: 7038379 - DNA, 22 bp, Homo sapiens
gtgggggcagtgggcttcgagc

SEQ ID NO: 7038380 - DNA, 22 bp, Homo sapiens
gtgggccttcaaccctgtctgg

SEQ ID NO: 7038381 - DNA, 22 bp, Homo sapiens
gtgggctgcccttgaggtcagc

SEQ ID NO: 7038382 - DNA, 22 bp, Homo sapiens
gtgggctggaccctcctgctcc

SEQ ID NO: 7038383 - DNA, 22 bp, Homo sapiens
gtgggctgttgttccctgttct

SEQ ID NO: 7038384 - DNA, 22 bp, Homo sapiens
gtgggcagacatgatagaagga

SEQ ID NO: 7038385 - DNA, 22 bp, Homo sapiens
gtgggcagagcaagggaactca

SEQ ID NO: 7038386 - DNA, 22 bp, Homo sapiens
gtgggcagagcaagggaactca

SEQ ID NO: 7038387 - DNA, 22 bp, Homo sapiens
gtgggcagaggagagaacatta

SEQ ID NO: 7038388 - DNA, 20 bp, Homo sapiens
gtgggcagcaggcatactgg

SEQ ID NO: 7038389 - DNA, 22 bp, Homo sapiens
gtgggcaggaggccctgccctg

SEQ ID NO: 7038390 - DNA, 22 bp, Homo sapiens
gtgggcagtgtgtcagtatctt

SEQ ID NO: 7038391 - DNA, 22 bp, Homo sapiens
gtgggcagttcaattctgggag

SEQ ID NO: 7038392 - DNA, 22 bp, Homo sapiens
gtgggccactgggaggcaaggg

SEQ ID NO: 7038393 - DNA, 22 bp, Homo sapiens
gtgggccagcattttgaagagt

SEQ ID NO: 7038394 - DNA, 22 bp, Homo sapiens
taaatacttttactccactgat

SEQ ID NO: 7038395 - DNA, 22 bp, Homo sapiens
taaatccttatcttctttgaat

SEQ ID NO: 7038396 - DNA, 22 bp, Homo sapiens
tcctggggaggtcgaggctgag

SEQ ID NO: 7038397 - DNA, 19 bp, Homo sapiens
tcctgggctgggccaggtc

SEQ ID NO: 7038398 - DNA, 22 bp, Homo sapiens
tcctgggcagcgggacgctcag

SEQ ID NO: 7038399 - DNA, 22 bp, Homo sapiens
tcctgggcccaggctgccaggg

SEQ ID NO: 7038400 - DNA, 22 bp, Homo sapiens
tcctgggcccaggctgccaggg

SEQ ID NO: 7038401 - DNA, 22 bp, Homo sapiens
tcctgggcctgtactccatccg

SEQ ID NO: 7038402 - DNA, 22 bp, Homo sapiens
tcctgggcctgtactccatccg

SEQ ID NO: 7038403 - DNA, 22 bp, Homo sapiens
tcctgggcgaggtactggggct

SEQ ID NO: 7038404 - DNA, 22 bp, Homo sapiens
tcctgggagtaaaagctgccct

SEQ ID NO: 7038405 - DNA, 21 bp, Homo sapiens
tcctgggagtctgagatcctg

SEQ ID NO: 7038406 - DNA, 21 bp, Homo sapiens
tcctgggaagcactggggtgg

SEQ ID NO: 7038407 - DNA, 22 bp, Homo sapiens
tcctgggaagcgccggcctgcg

SEQ ID NO: 7038408 - DNA, 22 bp, Homo sapiens
tcctgggaagtggctggctgag

SEQ ID NO: 7038409 - DNA, 22 bp, Homo sapiens
tcctgggaccctgggtgcagag

SEQ ID NO: 7038410 - DNA, 22 bp, Homo sapiens
tcctggagagtgggcgagcaca

SEQ ID NO: 7038411 - DNA, 22 bp, Homo sapiens
tcctggaggggacagcatgggc

SEQ ID NO: 7038412 - DNA, 22 bp, Homo sapiens
taagaatattgggaatggatgg

SEQ ID NO: 7038413 - DNA, 22 bp, Homo sapiens
tcctggcctcgctgtccacctt

SEQ ID NO: 7038414 - DNA, 22 bp, Homo sapiens
tcgaaccacgtagtaaacaaca

SEQ ID NO: 7038415 - DNA, 22 bp, Homo sapiens
tccttttttatgaagctttgag

SEQ ID NO: 7038416 - DNA, 22 bp, Homo sapiens
tcctttttaagtcgttgtggta

SEQ ID NO: 7038417 - DNA, 21 bp, Homo sapiens
tcgacctgctgggctcgggct

SEQ ID NO: 7038418 - DNA, 22 bp, Homo sapiens
tccttttccctgaaggtattta

SEQ ID NO: 7038419 - DNA, 22 bp, Homo sapiens
tccttggctctttgataaatac

SEQ ID NO: 7038420 - DNA, 22 bp, Homo sapiens
tcctttctccttccgacttcat

SEQ ID NO: 7038421 - DNA, 19 bp, Homo sapiens
tcctttctgttcctgagat

SEQ ID NO: 7038422 - DNA, 22 bp, Homo sapiens
tcctttcttgtgtatcaaatgg

SEQ ID NO: 7038423 - DNA, 22 bp, Homo sapiens
tctaaagacactttttacaggg

SEQ ID NO: 7038424 - DNA, 22 bp, Homo sapiens
tccttggcaagacacagcacag

SEQ ID NO: 7038425 - DNA, 22 bp, Homo sapiens
tccttgcagcaggaacccactt

SEQ ID NO: 7038426 - DNA, 22 bp, Homo sapiens
tccttggaagagcattcccagg

SEQ ID NO: 7038427 - DNA, 22 bp, Homo sapiens
tccttcttcatgaagatatatg

SEQ ID NO: 7038428 - DNA, 22 bp, Homo sapiens
tccttctctggtttttactgta

SEQ ID NO: 7038429 - DNA, 22 bp, Homo sapiens
tccttaggcaatttgggagagt

SEQ ID NO: 7038430 - DNA, 22 bp, Homo sapiens
tccttaggcaatttgggagagt

SEQ ID NO: 7038431 - DNA, 22 bp, Homo sapiens
tctaatgggtaaatatttttat

SEQ ID NO: 7038432 - DNA, 22 bp, Homo sapiens
tctacaaagaagaattaatgtc

SEQ ID NO: 7038433 - DNA, 22 bp, Homo sapiens
tctactttataagtatataagt

SEQ ID NO: 7038434 - DNA, 22 bp, Homo sapiens
tctattcattcaatttagctct

SEQ ID NO: 7038435 - DNA, 22 bp, Homo sapiens
tctatttctgggtttgtgtggt

SEQ ID NO: 7038436 - DNA, 22 bp, Homo sapiens
tctcagggagagctgctggcat

SEQ ID NO: 7038437 - DNA, 22 bp, Homo sapiens
tctccaagaaaagatctcagct

SEQ ID NO: 7038438 - DNA, 22 bp, Homo sapiens
tctccaagcagggctgcaaggc

SEQ ID NO: 7038439 - DNA, 22 bp, Homo sapiens
tctccacaagctttctcctttt

SEQ ID NO: 7038440 - DNA, 22 bp, Homo sapiens
tctcattgttagtgtgggagca

SEQ ID NO: 7038441 - DNA, 20 bp, Homo sapiens
tctcagggtcttagatggaa

SEQ ID NO: 7038442 - DNA, 22 bp, Homo sapiens
tctcagggtttcctgggggctg

SEQ ID NO: 7038443 - DNA, 22 bp, Homo sapiens
tctcatctcggatcagaagtga

SEQ ID NO: 7038444 - DNA, 22 bp, Homo sapiens
tctcatggagtcaggagcagaa

SEQ ID NO: 7038445 - DNA, 22 bp, Homo sapiens
tctcctttcttttaaaatgtca

SEQ ID NO: 7038446 - DNA, 22 bp, Homo sapiens
tctcctttgaaagttaggactg

SEQ ID NO: 7038447 - DNA, 22 bp, Homo sapiens
tctcctgggtaaaagggttgat

SEQ ID NO: 7038448 - DNA, 18 bp, Homo sapiens
tctcctgggtaggggcct

SEQ ID NO: 7038449 - DNA, 22 bp, Homo sapiens
tctcctggtacccttcctagca

SEQ ID NO: 7038450 - DNA, 20 bp, Homo sapiens
tctcctggtctggtccgtgc

SEQ ID NO: 7038451 - DNA, 18 bp, Homo sapiens
tctccttccaaatcttca

SEQ ID NO: 7038452 - DNA, 22 bp, Homo sapiens
tctccttccaacaaaaggtcac

SEQ ID NO: 7038453 - DNA, 22 bp, Homo sapiens
tctcctccagaggctgtgggga

SEQ ID NO: 7038454 - DNA, 22 bp, Homo sapiens
tctcctcccaggctcttccagg

SEQ ID NO: 7038455 - DNA, 21 bp, Homo sapiens
tctcctcccggggagaggccg

SEQ ID NO: 7038456 - DNA, 23 bp, Homo sapiens
tctcctcctagatacagtcatgg

SEQ ID NO: 7038457 - DNA, 22 bp, Homo sapiens
tctcctccttttttcaacatag

SEQ ID NO: 7038458 - DNA, 22 bp, Homo sapiens
tctcctggagcaggaaggtggg

SEQ ID NO: 7038459 - DNA, 22 bp, Homo sapiens
tctcctggatggaccttctctt

SEQ ID NO: 7038460 - DNA, 22 bp, Homo sapiens
tctcctggcatgtgggtcatct

SEQ ID NO: 7038461 - DNA, 22 bp, Homo sapiens
tctcctggcatttggttgagta

SEQ ID NO: 7038462 - DNA, 22 bp, Homo sapiens
tctcttcttgtgttttcctgcc

SEQ ID NO: 7038463 - DNA, 22 bp, Homo sapiens
tctctttaagtataatcttata

SEQ ID NO: 7038464 - DNA, 22 bp, Homo sapiens
tctctttctcaaaatgtaagca

SEQ ID NO: 7038465 - DNA, 22 bp, Homo sapiens
tctctttctttgtatgtctatt

SEQ ID NO: 7038466 - DNA, 20 bp, Homo sapiens
tctcttttagcttacagctg

SEQ ID NO: 7038467 - DNA, 22 bp, Homo sapiens
tctcttttctttctggataaaa

SEQ ID NO: 7038468 - DNA, 22 bp, Homo sapiens
tctgaaataaatgcactgttag

SEQ ID NO: 7038469 - DNA, 22 bp, Homo sapiens
tctgaaattttagttatagaaa

SEQ ID NO: 7038470 - DNA, 20 bp, Homo sapiens
tctgaagaaagacagggact

SEQ ID NO: 7038471 - DNA, 22 bp, Homo sapiens
tctgaagaactgtctagagaac

SEQ ID NO: 7038472 - DNA, 19 bp, Homo sapiens
tctgaagaattagagagca

SEQ ID NO: 7038473 - DNA, 22 bp, Homo sapiens
tctgaagagaacaccagtagtt

SEQ ID NO: 7038474 - DNA, 22 bp, Homo sapiens
tctgaagagaatgctgctgaac

SEQ ID NO: 7038475 - DNA, 22 bp, Homo sapiens
tctgaagagtcttgcaagaaag

SEQ ID NO: 7038476 - DNA, 22 bp, Homo sapiens
tctgaagcactgcaatgcttta

SEQ ID NO: 7038477 - DNA, 22 bp, Homo sapiens
tctcttcttgattttcactgga

SEQ ID NO: 7038478 - DNA, 22 bp, Homo sapiens
tctcttctgaaacctgtcttta

SEQ ID NO: 7038479 - DNA, 19 bp, Homo sapiens
tctcttctccctggtttta

SEQ ID NO: 7038480 - DNA, 22 bp, Homo sapiens
tctcttctaacactagaaattc

SEQ ID NO: 7038481 - DNA, 22 bp, Homo sapiens
tctctgggtttttgtcctgtac

SEQ ID NO: 7038482 - DNA, 23 bp, Homo sapiens
tctctgagccatagcagtcccaa

SEQ ID NO: 7038483 - DNA, 22 bp, Homo sapiens
tctctatattatatgtagtttg

SEQ ID NO: 7038484 - DNA, 22 bp, Homo sapiens
tctctcctctagtcagggtggt

SEQ ID NO: 7038485 - DNA, 22 bp, Homo sapiens
tctctctcctagtttttagtgg

SEQ ID NO: 7038486 - DNA, 22 bp, Homo sapiens
tctctggaattggctgaggcaa

SEQ ID NO: 7038487 - DNA, 22 bp, Homo sapiens
tctctggcagactggctgggct

SEQ ID NO: 7038488 - DNA, 22 bp, Homo sapiens
tctctgggatcaggtggcccag

SEQ ID NO: 7038489 - DNA, 21 bp, Homo sapiens
tctctgggccctcctgtgggg

SEQ ID NO: 7038490 - DNA, 22 bp, Homo sapiens
tctctgggctcaggagcccggc

SEQ ID NO: 7038491 - DNA, 22 bp, Homo sapiens
tctctggggatggacctgggag

SEQ ID NO: 7038492 - DNA, 22 bp, Homo sapiens
tctctggggcctttctacatca

SEQ ID NO: 7038493 - DNA, 22 bp, Homo sapiens
tctctgggggtagaactcaggc

SEQ ID NO: 7038494 - DNA, 22 bp, Homo sapiens
tctctggggtagggcccaggac

SEQ ID NO: 7038495 - DNA, 22 bp, Homo sapiens
tctctgggtgatggcagggcac

SEQ ID NO: 7038496 - DNA, 22 bp, Homo sapiens
tctgcatgatgaacaaatgagc

SEQ ID NO: 7038497 - DNA, 19 bp, Homo sapiens
tctgcatggcaggaagaga

SEQ ID NO: 7038498 - DNA, 22 bp, Homo sapiens
tctgcaagtagatgacagtgag

SEQ ID NO: 7038499 - DNA, 22 bp, Homo sapiens
tctgcaagtttatcacttggga

SEQ ID NO: 7038500 - DNA, 22 bp, Homo sapiens
tctgcaggaaaaaagtgcctgg

SEQ ID NO: 7038501 - DNA, 22 bp, Homo sapiens
tctgcaggagagtgccctagag

SEQ ID NO: 7038502 - DNA, 22 bp, Homo sapiens
tctgcaggcctcgacaaggcca

SEQ ID NO: 7038503 - DNA, 21 bp, Homo sapiens
tctgcctgagactttgctggt

SEQ ID NO: 7038504 - DNA, 22 bp, Homo sapiens
tctgcctgaggactgacaccag

SEQ ID NO: 7038505 - DNA, 22 bp, Homo sapiens
tctgcctgagggagctgaggaa

SEQ ID NO: 7038506 - DNA, 22 bp, Homo sapiens
tctgcctgccagtctggtcctc

SEQ ID NO: 7038507 - DNA, 22 bp, Homo sapiens
tctgcctgctaactcctgcacc

SEQ ID NO: 7038508 - DNA, 22 bp, Homo sapiens
tctgcctggattccattctcca

SEQ ID NO: 7038509 - DNA, 22 bp, Homo sapiens
tctgcctggcggactcccggaa

SEQ ID NO: 7038510 - DNA, 22 bp, Homo sapiens
tctgcctgtggatacatgctct

SEQ ID NO: 7038511 - DNA, 22 bp, Homo sapiens
tctgccttctatcttttgtctg

SEQ ID NO: 7038512 - DNA, 22 bp, Homo sapiens
tctgagaaaataggaaacttga

SEQ ID NO: 7038513 - DNA, 22 bp, Homo sapiens
tctgagaacatgctttgatcat

SEQ ID NO: 7038514 - DNA, 22 bp, Homo sapiens
tctgatttgtagctacatgtct

SEQ ID NO: 7038515 - DNA, 22 bp, Homo sapiens
tctgcaagagcttcaaggtaga

SEQ ID NO: 7038516 - DNA, 22 bp, Homo sapiens
tctgcaagctcagttctgactt

SEQ ID NO: 7038517 - DNA, 22 bp, Homo sapiens
tctgggcatgtctgtgaacacg

SEQ ID NO: 7038518 - DNA, 22 bp, Homo sapiens
tctgggcactgctgagcctgta

SEQ ID NO: 7038519 - DNA, 22 bp, Homo sapiens
tctgggcagcagcagctagtag

SEQ ID NO: 7038520 - DNA, 22 bp, Homo sapiens
tctgggcagcctcaggccaggg

SEQ ID NO: 7038521 - DNA, 19 bp, Homo sapiens
tctgggcagggccagcacc

SEQ ID NO: 7038522 - DNA, 22 bp, Homo sapiens
tctgggagggagcctcagaatc

SEQ ID NO: 7038523 - DNA, 22 bp, Homo sapiens
tctgggaggtggcagggtgcat

SEQ ID NO: 7038524 - DNA, 22 bp, Homo sapiens
tctgggagtaaggcctaggcat

SEQ ID NO: 7038525 - DNA, 22 bp, Homo sapiens
tctgggaagcctgtatgcagaa

SEQ ID NO: 7038526 - DNA, 22 bp, Homo sapiens
tctgtaaaacaatattgtattc

SEQ ID NO: 7038527 - DNA, 22 bp, Homo sapiens
tctgtaaaacttctttgtaaat

SEQ ID NO: 7038528 - DNA, 22 bp, Homo sapiens
tctgtaaaattagtataattgt

SEQ ID NO: 7038529 - DNA, 22 bp, Homo sapiens
tctgtaaacaccatgttagagt

SEQ ID NO: 7038530 - DNA, 22 bp, Homo sapiens
tctggggcagttactggggcct

SEQ ID NO: 7038531 - DNA, 22 bp, Homo sapiens
tctgtaaacacccgtaagcttt

SEQ ID NO: 7038532 - DNA, 20 bp, Homo sapiens
tctgtaaagactccagaagc

SEQ ID NO: 7038533 - DNA, 22 bp, Homo sapiens
tctgtaaagccctggtacctgg

SEQ ID NO: 7038534 - DNA, 22 bp, Homo sapiens
tctgtaaagtctgtgtaaagtc

SEQ ID NO: 7038535 - DNA, 22 bp, Homo sapiens
tctgtaaatcctgctcagcaac

SEQ ID NO: 7038536 - DNA, 22 bp, Homo sapiens
tctgtaaatcctgctcagcaac

SEQ ID NO: 7038537 - DNA, 22 bp, Homo sapiens
tctgtaaatctactaagagctc

SEQ ID NO: 7038538 - DNA, 22 bp, Homo sapiens
tctgtgcagaatcaaggagctt

SEQ ID NO: 7038539 - DNA, 22 bp, Homo sapiens
tctgtgcagacatggggaagcc

SEQ ID NO: 7038540 - DNA, 22 bp, Homo sapiens
tctgtgcaggatttgaggaacc

SEQ ID NO: 7038541 - DNA, 20 bp, Homo sapiens
tctgtgcagtggaggggcag

SEQ ID NO: 7038542 - DNA, 22 bp, Homo sapiens
tctgtggaagattccaggcgtt

SEQ ID NO: 7038543 - DNA, 22 bp, Homo sapiens
tctgtggactcaagggatcaca

SEQ ID NO: 7038544 - DNA, 18 bp, Homo sapiens
tctgtggagagggcagtt

SEQ ID NO: 7038545 - DNA, 22 bp, Homo sapiens
tctgtgggttttgcagagttgc

SEQ ID NO: 7038546 - DNA, 22 bp, Homo sapiens
tctgtgtctggttgggccagta

SEQ ID NO: 7038547 - DNA, 22 bp, Homo sapiens
tctgttttgcataatgttcttt

SEQ ID NO: 7038548 - DNA, 22 bp, Homo sapiens
tcttaaaagtatgccaattgga

SEQ ID NO: 7038549 - DNA, 22 bp, Homo sapiens
tcttaacagtgctacagagcag

SEQ ID NO: 7038550 - DNA, 22 bp, Homo sapiens
tctttaatgtactttctttcac

SEQ ID NO: 7038551 - DNA, 22 bp, Homo sapiens
tcttggaatctccatagagtga

SEQ ID NO: 7038552 - DNA, 22 bp, Homo sapiens
tcttggactcaaaattgcctta

SEQ ID NO: 7038553 - DNA, 22 bp, Homo sapiens
tcttggaagcctcaagatactc

SEQ ID NO: 7038554 - DNA, 22 bp, Homo sapiens
tcttgattacttattttgtgcc

SEQ ID NO: 7038555 - DNA, 22 bp, Homo sapiens
tcttgattggttgtatagctac

SEQ ID NO: 7038556 - DNA, 22 bp, Homo sapiens
tctttagctagaaatactctaa

SEQ ID NO: 7038557 - DNA, 21 bp, Homo sapiens
tctttatgacttgcccatttg

SEQ ID NO: 7038558 - DNA, 22 bp, Homo sapiens
tctttatgagaaaaagattgta

SEQ ID NO: 7038559 - DNA, 22 bp, Homo sapiens
tctttatgcacataaagaaact

SEQ ID NO: 7038560 - DNA, 22 bp, Homo sapiens
tctttatgcctacctgggaaga

SEQ ID NO: 7038561 - DNA, 22 bp, Homo sapiens
tctttatggaaaatgaatggca

SEQ ID NO: 7038562 - DNA, 22 bp, Homo sapiens
tctttatgtaagactgggcttg

SEQ ID NO: 7038563 - DNA, 22 bp, Homo sapiens
tctttatgttgatttcctcagg

SEQ ID NO: 7038564 - DNA, 22 bp, Homo sapiens
tctttatgtttactccagctga

SEQ ID NO: 7038565 - DNA, 22 bp, Homo sapiens
tctttatgtttgaaagtacaat

SEQ ID NO: 7038566 - DNA, 22 bp, Homo sapiens
tctttattgctactggtttgtc

SEQ ID NO: 7038567 - DNA, 22 bp, Homo sapiens
tctttcattctagtctgaggtt

SEQ ID NO: 7038568 - DNA, 22 bp, Homo sapiens
tctttcccagtagctctcccag

SEQ ID NO: 7038569 - DNA, 23 bp, Homo sapiens
tctttcctaatgaaacagtgaaa

SEQ ID NO: 7038570 - DNA, 22 bp, Homo sapiens
tctttcctactttattgtgaac

SEQ ID NO: 7038571 - DNA, 22 bp, Homo sapiens
tctttcctactttattgtgaac

SEQ ID NO: 7038572 - DNA, 22 bp, Homo sapiens
tctttcctagaggctgatgagt

SEQ ID NO: 7038573 - DNA, 22 bp, Homo sapiens
tctttcctaggtgatatgcaat

SEQ ID NO: 7038574 - DNA, 22 bp, Homo sapiens
tctttcctaggtgatatgcaat

SEQ ID NO: 7038575 - DNA, 23 bp, Homo sapiens
tctttcctcagcacacaccaaga

SEQ ID NO: 7038576 - DNA, 22 bp, Homo sapiens
tctttcctctgagctcctgtag

SEQ ID NO: 7038577 - DNA, 17 bp, Homo sapiens
tctttcctgccatgctc

SEQ ID NO: 7038578 - DNA, 21 bp, Homo sapiens
tctttcctgcccagttgccct

SEQ ID NO: 7038579 - DNA, 22 bp, Homo sapiens
tctttcctgtaactgctgttca

SEQ ID NO: 7038580 - DNA, 22 bp, Homo sapiens
tctttccttagaataattcttt

SEQ ID NO: 7038581 - DNA, 22 bp, Homo sapiens
tctttcttacaaagaaaacggt

SEQ ID NO: 7038582 - DNA, 22 bp, Homo sapiens
tctttgatcagcctttcactga

SEQ ID NO: 7038583 - DNA, 22 bp, Homo sapiens
tcttctgttttagattgcatac

SEQ ID NO: 7038584 - DNA, 22 bp, Homo sapiens
tcttctttttgtcccacagaat

SEQ ID NO: 7038585 - DNA, 22 bp, Homo sapiens
tcttcctctctaattgatcaga

SEQ ID NO: 7038586 - DNA, 22 bp, Homo sapiens
tcttccttaaatgtttggtaga

SEQ ID NO: 7038587 - DNA, 22 bp, Homo sapiens
tcttccttctttgatgacaagg

SEQ ID NO: 7038588 - DNA, 22 bp, Homo sapiens
tcttccttgctccttgtcactt

SEQ ID NO: 7038589 - DNA, 22 bp, Homo sapiens
tcttcaggtagtgagtggggtg

SEQ ID NO: 7038590 - DNA, 22 bp, Homo sapiens
tgcagaggaccattgtcctgga

SEQ ID NO: 7038591 - DNA, 22 bp, Homo sapiens
tgcagaggagctggaaggctgg

SEQ ID NO: 7038592 - DNA, 22 bp, Homo sapiens
tgcagaggcgccgtgggtgggg

SEQ ID NO: 7038593 - DNA, 22 bp, Homo sapiens
tgcagaggctggctcgccgggt

SEQ ID NO: 7038594 - DNA, 22 bp, Homo sapiens
tgcagagggaaaaggtgctcct

SEQ ID NO: 7038595 - DNA, 23 bp, Homo sapiens
tgcagaggcatgatcactgctca

SEQ ID NO: 7038596 - DNA, 22 bp, Homo sapiens
tgcagaggagtcagcctgggca

SEQ ID NO: 7038597 - DNA, 19 bp, Homo sapiens
tgcagagggtaggaaggcc

SEQ ID NO: 7038598 - DNA, 22 bp, Homo sapiens
tgcagcaccgtcccactggcta

SEQ ID NO: 7038599 - DNA, 22 bp, Homo sapiens
tgcagcagaatatggctgcagg

SEQ ID NO: 7038600 - DNA, 22 bp, Homo sapiens
tgcaccacccgtgggaggactg

SEQ ID NO: 7038601 - DNA, 22 bp, Homo sapiens
tgcaccccattttacatttaca

SEQ ID NO: 7038602 - DNA, 22 bp, Homo sapiens
tgcaccttccacaagaactacc

SEQ ID NO: 7038603 - DNA, 22 bp, Homo sapiens
tgcactactgtgatacacagcc

SEQ ID NO: 7038604 - DNA, 22 bp, Homo sapiens
tgcaggagcagagatggctgga

SEQ ID NO: 7038605 - DNA, 22 bp, Homo sapiens
tgcagcttcactcctgaagcca

SEQ ID NO: 7038606 - DNA, 22 bp, Homo sapiens
tgcagcttcttgtcctgtgatt

SEQ ID NO: 7038607 - DNA, 22 bp, Homo sapiens
tgcaggagtccaatcaggagac

SEQ ID NO: 7038608 - DNA, 21 bp, Homo sapiens
tgcagcagagtaagcagggga

SEQ ID NO: 7038609 - DNA, 22 bp, Homo sapiens
tgcagcagagtgggcctgggtg

SEQ ID NO: 7038610 - DNA, 22 bp, Homo sapiens
tgcagcagcagggaggaggctc

SEQ ID NO: 7038611 - DNA, 22 bp, Homo sapiens
tgcagcaggagccaggcctggt

SEQ ID NO: 7038612 - DNA, 22 bp, Homo sapiens
tgcagcagggcccaggcacaga

SEQ ID NO: 7038613 - DNA, 22 bp, Homo sapiens
tgattctttggagagctatata

SEQ ID NO: 7038614 - DNA, 22 bp, Homo sapiens
tgattctaggtccattatttgc

SEQ ID NO: 7038615 - DNA, 22 bp, Homo sapiens
tgattctgatcatcatcatggt

SEQ ID NO: 7038616 - DNA, 22 bp, Homo sapiens
tgattacaaaagattgtttgaa

SEQ ID NO: 7038617 - DNA, 22 bp, Homo sapiens
tgattacaacagagtcatccat

SEQ ID NO: 7038618 - DNA, 23 bp, Homo sapiens
tgattacaagggccaaagaaagg

SEQ ID NO: 7038619 - DNA, 22 bp, Homo sapiens
tgattacaattgtcttagattt

SEQ ID NO: 7038620 - DNA, 22 bp, Homo sapiens
tgattacacaccacagtgctcc

SEQ ID NO: 7038621 - DNA, 22 bp, Homo sapiens
tgattcaagctactgttactgg

SEQ ID NO: 7038622 - DNA, 22 bp, Homo sapiens
tgatgcctaatatacttcaatt

SEQ ID NO: 7038623 - DNA, 22 bp, Homo sapiens
tgatcacaagtctgaagaatga

SEQ ID NO: 7038624 - DNA, 22 bp, Homo sapiens
tgatcacaagtctgaagaatga

SEQ ID NO: 7038625 - DNA, 22 bp, Homo sapiens
tgatatgtaactactccttata

SEQ ID NO: 7038626 - DNA, 22 bp, Homo sapiens
tgatatttgctgactgcattgt

SEQ ID NO: 7038627 - DNA, 22 bp, Homo sapiens
tgagtgggattaaatgaggtga

SEQ ID NO: 7038628 - DNA, 22 bp, Homo sapiens
tgagtgggttatcaggaaaggt

SEQ ID NO: 7038629 - DNA, 22 bp, Homo sapiens
tgatttcaagccagggggcgtt

SEQ ID NO: 7038630 - DNA, 22 bp, Homo sapiens
tgattttcatgggtgatctttg

SEQ ID NO: 7038631 - DNA, 22 bp, Homo sapiens
tgcaaacaactgtttaatgctg

SEQ ID NO: 7038632 - DNA, 20 bp, Homo sapiens
tgcaaacacagagtgtatga

SEQ ID NO: 7038633 - DNA, 22 bp, Homo sapiens
tgcaaacagaaagtttattgtg

SEQ ID NO: 7038634 - DNA, 22 bp, Homo sapiens
tgcaaacagaaagtttattgtg

SEQ ID NO: 7038635 - DNA, 22 bp, Homo sapiens
tgcaaactgggacactattcaa

SEQ ID NO: 7038636 - DNA, 22 bp, Homo sapiens
tgcaaactgggatactattcaa

SEQ ID NO: 7038637 - DNA, 22 bp, Homo sapiens
tgcaaactattggtagagatgg

SEQ ID NO: 7038638 - DNA, 22 bp, Homo sapiens
tgcaaatatttccttatagcca

SEQ ID NO: 7038639 - DNA, 22 bp, Homo sapiens
tgcaaatgggaaacccagcagt

SEQ ID NO: 7038640 - DNA, 19 bp, Homo sapiens
tgcaaattctaaaaactga

SEQ ID NO: 7038641 - DNA, 22 bp, Homo sapiens
tgcaaattgcgatttttattag

SEQ ID NO: 7038642 - DNA, 22 bp, Homo sapiens
tgcaaatttaatgaaactatgt

SEQ ID NO: 7038643 - DNA, 22 bp, Homo sapiens
tgcaaatttctttagtacataa

SEQ ID NO: 7038644 - DNA, 22 bp, Homo sapiens
tgcaagatattatctttgctgc

SEQ ID NO: 7038645 - DNA, 22 bp, Homo sapiens
tgcaaggcagcaccagctcttg

SEQ ID NO: 7038646 - DNA, 22 bp, Homo sapiens
tgccccctggtggccagagccg

SEQ ID NO: 7038647 - DNA, 20 bp, Homo sapiens
tgcccagcaagagtgcagtt

SEQ ID NO: 7038648 - DNA, 22 bp, Homo sapiens
tgcccagcacccagcatgatgc

SEQ ID NO: 7038649 - DNA, 22 bp, Homo sapiens
tgccatttgctggttttctgat

SEQ ID NO: 7038650 - DNA, 23 bp, Homo sapiens
tgccagggtttgtttgtggttca

SEQ ID NO: 7038651 - DNA, 23 bp, Homo sapiens
tgccagggccctgtgtgcaatgc

SEQ ID NO: 7038652 - DNA, 22 bp, Homo sapiens
tgccagggtcagctgcagctct

SEQ ID NO: 7038653 - DNA, 22 bp, Homo sapiens
tgccagggtcctgagggccttg

SEQ ID NO: 7038654 - DNA, 22 bp, Homo sapiens
tgccagggaccctgtcggccct

SEQ ID NO: 7038655 - DNA, 20 bp, Homo sapiens
tgccagggccagcagaggct

SEQ ID NO: 7038656 - DNA, 22 bp, Homo sapiens
tgccctggaaatgagaggtgtg

SEQ ID NO: 7038657 - DNA, 22 bp, Homo sapiens
tgccctggagtcagtggctatt

SEQ ID NO: 7038658 - DNA, 22 bp, Homo sapiens
tgccctggatgctgcaggtgtg

SEQ ID NO: 7038659 - DNA, 22 bp, Homo sapiens
tgccctggcattgggttggata

SEQ ID NO: 7038660 - DNA, 22 bp, Homo sapiens
tgccctggcttcagctttggct

SEQ ID NO: 7038661 - DNA, 22 bp, Homo sapiens
tgccctgggacatgcagcggag

SEQ ID NO: 7038662 - DNA, 22 bp, Homo sapiens
tgccctgggagttggagctgct

SEQ ID NO: 7038663 - DNA, 22 bp, Homo sapiens
tgccgcagtgcggggagggccc

SEQ ID NO: 7038664 - DNA, 22 bp, Homo sapiens
tgcctcagtcagcttccctggg

SEQ ID NO: 7038665 - DNA, 22 bp, Homo sapiens
tgcctctgggtgaccaaggagc

SEQ ID NO: 7038666 - DNA, 22 bp, Homo sapiens
tgcctgaggagtcagggcaggt

SEQ ID NO: 7038667 - DNA, 22 bp, Homo sapiens
tgcattctgaacgtaaatgtga

SEQ ID NO: 7038668 - DNA, 22 bp, Homo sapiens
tgcattctgacttagttaatat

SEQ ID NO: 7038669 - DNA, 22 bp, Homo sapiens
tgcattgggttgacatactaaa

SEQ ID NO: 7038670 - DNA, 22 bp, Homo sapiens
tgcatttcagaagaaaattcgg

SEQ ID NO: 7038671 - DNA, 22 bp, Homo sapiens
tgcatttttgataactgtgtac

SEQ ID NO: 7038672 - DNA, 22 bp, Homo sapiens
tgcatgaacacatgtgcatgta

SEQ ID NO: 7038673 - DNA, 22 bp, Homo sapiens
tgcatgatagagatggtattag

SEQ ID NO: 7038674 - DNA, 22 bp, Homo sapiens
tgcatgcaatgtgaagaaagct

SEQ ID NO: 7038675 - DNA, 21 bp, Homo sapiens
tgcagttttgcttgatctctg

SEQ ID NO: 7038676 - DNA, 22 bp, Homo sapiens
tgcatagggaacctcatgcatt

SEQ ID NO: 7038677 - DNA, 23 bp, Homo sapiens
tgcaggggaggcttaaagcaggt

SEQ ID NO: 7038678 - DNA, 22 bp, Homo sapiens
tgcaggggcttgtctgggcctg

SEQ ID NO: 7038679 - DNA, 22 bp, Homo sapiens
tgcaggggcttgtctgggcctg

SEQ ID NO: 7038680 - DNA, 22 bp, Homo sapiens
tgcagggtggtttgaagggtct

SEQ ID NO: 7038681 - DNA, 22 bp, Homo sapiens
tgaggtggtgctaatctctgct

SEQ ID NO: 7038682 - DNA, 22 bp, Homo sapiens
tgaggtgggtgtcaggtcagag

SEQ ID NO: 7038683 - DNA, 22 bp, Homo sapiens
tgaggtggccgaggagcaggac

SEQ ID NO: 7038684 - DNA, 17 bp, Homo sapiens
tgagtagggaagaggag

SEQ ID NO: 7038685 - DNA, 22 bp, Homo sapiens
tgaggctcaagaatagacagta

SEQ ID NO: 7038686 - DNA, 22 bp, Homo sapiens
tgaggctcaaggtctggtggag

SEQ ID NO: 7038687 - DNA, 22 bp, Homo sapiens
tgaggctcacgaacagaagact

SEQ ID NO: 7038688 - DNA, 22 bp, Homo sapiens
tgaggctcagaagtgccaagtg

SEQ ID NO: 7038689 - DNA, 22 bp, Homo sapiens
tgaggctcagagaagtgctgtt

SEQ ID NO: 7038690 - DNA, 18 bp, Homo sapiens
tgaggctcagagacggtg

SEQ ID NO: 7038691 - DNA, 22 bp, Homo sapiens
tgaggctcattctgcatgccaa

SEQ ID NO: 7038692 - DNA, 22 bp, Homo sapiens
tgaggctccagccaggccagca

SEQ ID NO: 7038693 - DNA, 22 bp, Homo sapiens
tgaggctccttgtagagagtgg

SEQ ID NO: 7038694 - DNA, 17 bp, Homo sapiens
tgaggctcggtgaggag

SEQ ID NO: 7038695 - DNA, 22 bp, Homo sapiens
tgaggctctatgtggtagatta

SEQ ID NO: 7038696 - DNA, 22 bp, Homo sapiens
tgaggctctccaagcagatgag

SEQ ID NO: 7038697 - DNA, 22 bp, Homo sapiens
tgaggatgagatgagataacac

SEQ ID NO: 7038698 - DNA, 22 bp, Homo sapiens
tgaggatggtcccgaggacact

SEQ ID NO: 7038699 - DNA, 22 bp, Homo sapiens
tgaggcaggacatggacaactg

SEQ ID NO: 7038700 - DNA, 22 bp, Homo sapiens
tgaggcaggacatggacaactg

SEQ ID NO: 7038701 - DNA, 22 bp, Homo sapiens
tgaggcaggactgagcgggatg

SEQ ID NO: 7038702 - DNA, 22 bp, Homo sapiens
tgaggcaggacttgcataaagt

SEQ ID NO: 7038703 - DNA, 22 bp, Homo sapiens
tgaggcaggagaatcacatgaa

SEQ ID NO: 7038704 - DNA, 22 bp, Homo sapiens
tgaggcaggagaatggcgggaa

SEQ ID NO: 7038705 - DNA, 22 bp, Homo sapiens
tgaggcaggaggattgcaggat

SEQ ID NO: 7038706 - DNA, 22 bp, Homo sapiens
tgaggcaggaggttgagaactg

SEQ ID NO: 7038707 - DNA, 22 bp, Homo sapiens
tgaggcaggagttcaggctgcg

SEQ ID NO: 7038708 - DNA, 22 bp, Homo sapiens
tgaggcaggatgcttgcacagg

SEQ ID NO: 7038709 - DNA, 23 bp, Homo sapiens
tgaggcaggcggatcacgaggtc

SEQ ID NO: 7038710 - DNA, 23 bp, Homo sapiens
tgaggcaggcggatcacgaggtc

SEQ ID NO: 7038711 - DNA, 22 bp, Homo sapiens
tgagcttagagcctccaagttc

SEQ ID NO: 7038712 - DNA, 22 bp, Homo sapiens
tgagccagtctctcagaaccct

SEQ ID NO: 7038713 - DNA, 22 bp, Homo sapiens
tgagccagtctgtctgggtgaa

SEQ ID NO: 7038714 - DNA, 21 bp, Homo sapiens
tgagcccttgcctcagagccc

SEQ ID NO: 7038715 - DNA, 22 bp, Homo sapiens
tgagccagagaggttgaggcta

SEQ ID NO: 7038716 - DNA, 22 bp, Homo sapiens
tgagccagaggaggctgtgtgg

SEQ ID NO: 7038717 - DNA, 22 bp, Homo sapiens
tgagccagagtggagtgtgcct

SEQ ID NO: 7038718 - DNA, 22 bp, Homo sapiens
tgagccaggagtttgaggctgt

SEQ ID NO: 7038719 - DNA, 22 bp, Homo sapiens
tgagccaggcccagtggggtca

SEQ ID NO: 7038720 - DNA, 21 bp, Homo sapiens
tgagccaggctgacggctgtg

SEQ ID NO: 7038721 - DNA, 22 bp, Homo sapiens
tgagacaatatcctttgtaacc

SEQ ID NO: 7038722 - DNA, 19 bp, Homo sapiens
tgagacagaagatgagcct

SEQ ID NO: 7038723 - DNA, 19 bp, Homo sapiens
tgagacagaagatgagcct

SEQ ID NO: 7038724 - DNA, 19 bp, Homo sapiens
tgagacagaagatgagcct

SEQ ID NO: 7038725 - DNA, 22 bp, Homo sapiens
tgagacagcagattagcaatga

SEQ ID NO: 7038726 - DNA, 22 bp, Homo sapiens
tgagacagcagtcagggaaata

SEQ ID NO: 7038727 - DNA, 22 bp, Homo sapiens
tgagacagcagtcagggaaata

SEQ ID NO: 7038728 - DNA, 22 bp, Homo sapiens
tgagacagcccttctgcacagg

SEQ ID NO: 7038729 - DNA, 22 bp, Homo sapiens
tgagacagcccttctgcacagg

SEQ ID NO: 7038730 - DNA, 22 bp, Homo sapiens
tgagacagcctctgcactcatg

SEQ ID NO: 7038731 - DNA, 17 bp, Homo sapiens
tgagacagggcaggccc

SEQ ID NO: 7038732 - DNA, 22 bp, Homo sapiens
tgagacagggtcttgctctgtt

SEQ ID NO: 7038733 - DNA, 22 bp, Homo sapiens
tgagacagtaattgtatagttt

SEQ ID NO: 7038734 - DNA, 22 bp, Homo sapiens
tgagacagtcaccaggcaggcc

SEQ ID NO: 7038735 - DNA, 22 bp, Homo sapiens
tgagacagtcaccaggcaggcc

SEQ ID NO: 7038736 - DNA, 22 bp, Homo sapiens
tgagacagttctgcagctgggt

SEQ ID NO: 7038737 - DNA, 18 bp, Homo sapiens
tgagagaatgttcatgct

SEQ ID NO: 7038738 - DNA, 22 bp, Homo sapiens
tgagagcacacagaaatatttt

SEQ ID NO: 7038739 - DNA, 21 bp, Homo sapiens
tgagagcctccaaccggctac

SEQ ID NO: 7038740 - DNA, 22 bp, Homo sapiens
tgagatatctgttaattttctt

SEQ ID NO: 7038741 - DNA, 19 bp, Homo sapiens
tgagatttcttaggtgatt

SEQ ID NO: 7038742 - DNA, 22 bp, Homo sapiens
tgactttaaaataacaagttta

SEQ ID NO: 7038743 - DNA, 22 bp, Homo sapiens
tgactaattatgttactaatca

SEQ ID NO: 7038744 - DNA, 22 bp, Homo sapiens
tgacatttgagagagatataca

SEQ ID NO: 7038745 - DNA, 22 bp, Homo sapiens
tgacattccgcagtaaggttaa

SEQ ID NO: 7038746 - DNA, 22 bp, Homo sapiens
tgacattctgttaagtctcata

SEQ ID NO: 7038747 - DNA, 22 bp, Homo sapiens
tgacaggggctggtggataaat

SEQ ID NO: 7038748 - DNA, 22 bp, Homo sapiens
tgacagggacagtggagatgga

SEQ ID NO: 7038749 - DNA, 22 bp, Homo sapiens
tgacagaaagagtattaaagat

SEQ ID NO: 7038750 - DNA, 22 bp, Homo sapiens
tgacaaaactgcaattactttt

SEQ ID NO: 7038751 - DNA, 22 bp, Homo sapiens
tgacaaagaccttcaacaagat

SEQ ID NO: 7038752 - DNA, 22 bp, Homo sapiens
tgaattcaggggctattatatt

SEQ ID NO: 7038753 - DNA, 22 bp, Homo sapiens
tgaattctggccctctcactta

SEQ ID NO: 7038754 - DNA, 22 bp, Homo sapiens
tgaattctggctcttctgttta

SEQ ID NO: 7038755 - DNA, 20 bp, Homo sapiens
tgaattctgggtttatctgc

SEQ ID NO: 7038756 - DNA, 21 bp, Homo sapiens
tgaatttccctctatcattct

SEQ ID NO: 7038757 - DNA, 23 bp, Homo sapiens
tgaattttggcatattctgaaat

SEQ ID NO: 7038758 - DNA, 22 bp, Homo sapiens
tgaatgtgatgctaaacatatg

SEQ ID NO: 7038759 - DNA, 22 bp, Homo sapiens
tgaatgtttgatgagaaataga

SEQ ID NO: 7038760 - DNA, 22 bp, Homo sapiens
tgaattcaaattgtgcctatta

SEQ ID NO: 7038761 - DNA, 22 bp, Homo sapiens
tgaatacaggaaaatatactga

SEQ ID NO: 7038762 - DNA, 22 bp, Homo sapiens
tgaaggaggaatgtggcctcca

SEQ ID NO: 7038763 - DNA, 22 bp, Homo sapiens
tgaaggtggcataggagagatg

SEQ ID NO: 7038764 - DNA, 22 bp, Homo sapiens
tctttgtacaggaaggcactgt

SEQ ID NO: 7038765 - DNA, 18 bp, Homo sapiens
tctttgtttccttcttgc

SEQ ID NO: 7038766 - DNA, 22 bp, Homo sapiens
tcttttaaaagccctgctgtct

SEQ ID NO: 7038767 - DNA, 21 bp, Homo sapiens
tcttttaacaccaggaattcc

SEQ ID NO: 7038768 - DNA, 22 bp, Homo sapiens
tcttttaacctaactagcttgg

SEQ ID NO: 7038769 - DNA, 22 bp, Homo sapiens
tcttttaagcctctggcatagg

SEQ ID NO: 7038770 - DNA, 22 bp, Homo sapiens
tcttttagaaaagttgaatgta

SEQ ID NO: 7038771 - DNA, 22 bp, Homo sapiens
tcttttagagcatttctgattc

SEQ ID NO: 7038772 - DNA, 22 bp, Homo sapiens
tcttttagctctgcaaggaaag

SEQ ID NO: 7038773 - DNA, 22 bp, Homo sapiens
tcttttagtaataaatatttgt

SEQ ID NO: 7038774 - DNA, 22 bp, Homo sapiens
tcttttatctgttgtgtaacaa

SEQ ID NO: 7038775 - DNA, 22 bp, Homo sapiens
tcttttattaggctgaaatggg

SEQ ID NO: 7038776 - DNA, 22 bp, Homo sapiens
tcttttattaggctgaaatggg

SEQ ID NO: 7038777 - DNA, 23 bp, Homo sapiens
tctttttaagagatctagtgacg

SEQ ID NO: 7038778 - DNA, 22 bp, Homo sapiens
tctttttatattgacaaaaggt

SEQ ID NO: 7038779 - DNA, 22 bp, Homo sapiens
tctttttcttattcccacactg

SEQ ID NO: 7038780 - DNA, 22 bp, Homo sapiens
tgaaaagtcttatattgtctga

SEQ ID NO: 7038781 - DNA, 22 bp, Homo sapiens
tgaaactgaaaggtatttatag

SEQ ID NO: 7038782 - DNA, 22 bp, Homo sapiens
tgaaacttataagaatatgaat

SEQ ID NO: 7038783 - DNA, 22 bp, Homo sapiens
tgaaacttctaatatgaatagt

SEQ ID NO: 7038784 - DNA, 22 bp, Homo sapiens
tgaaagttacaggaaaacagat

SEQ ID NO: 7038785 - DNA, 22 bp, Homo sapiens
tgaaagttaggatgtagtaatt

SEQ ID NO: 7038786 - DNA, 22 bp, Homo sapiens
tgaaagttattactgatgatgt

SEQ ID NO: 7038787 - DNA, 22 bp, Homo sapiens
tgaaagttcaataccaatttgg

SEQ ID NO: 7038788 - DNA, 23 bp, Homo sapiens
tgaaagttctgaagagatcatgc

SEQ ID NO: 7038789 - DNA, 22 bp, Homo sapiens
tgaaatagacttgcactatatg

SEQ ID NO: 7038790 - DNA, 22 bp, Homo sapiens
tgctgagtcgtattatttttta

SEQ ID NO: 7038791 - DNA, 22 bp, Homo sapiens
tgctgcaggccaggtcgttgtc

SEQ ID NO: 7038792 - DNA, 22 bp, Homo sapiens
tgctgcaggccttggctgggaa

SEQ ID NO: 7038793 - DNA, 22 bp, Homo sapiens
tgctgcagggaagtcggggggt

SEQ ID NO: 7038794 - DNA, 22 bp, Homo sapiens
tgctgcagggatttcagagaca

SEQ ID NO: 7038795 - DNA, 22 bp, Homo sapiens
tgctgcagggccttccctgcat

SEQ ID NO: 7038796 - DNA, 22 bp, Homo sapiens
tgctgcaggtgtgttcagtgag

SEQ ID NO: 7038797 - DNA, 22 bp, Homo sapiens
tgctgcagtatatatttcttgg

SEQ ID NO: 7038798 - DNA, 22 bp, Homo sapiens
tgctgcagtcacacggctatct

SEQ ID NO: 7038799 - DNA, 19 bp, Homo sapiens
tgctgcagtcaggcgaggg

SEQ ID NO: 7038800 - DNA, 22 bp, Homo sapiens
tgctgcagtgggattagcctga

SEQ ID NO: 7038801 - DNA, 22 bp, Homo sapiens
tgctgcagtgtttgctgaagtt

SEQ ID NO: 7038802 - DNA, 22 bp, Homo sapiens
tgctgcagttattgaaactatg

SEQ ID NO: 7038803 - DNA, 22 bp, Homo sapiens
tgctgcagttcaccctgccgtc

SEQ ID NO: 7038804 - DNA, 20 bp, Homo sapiens
tgctgcagtttcatgggact

SEQ ID NO: 7038805 - DNA, 22 bp, Homo sapiens
tgctctggtaactcacttccat

SEQ ID NO: 7038806 - DNA, 22 bp, Homo sapiens
tgctgagcgcatccggcggccg

SEQ ID NO: 7038807 - DNA, 22 bp, Homo sapiens
tgctctcctgctcctcagccca

SEQ ID NO: 7038808 - DNA, 22 bp, Homo sapiens
tgcctgggtgctggctggtcac

SEQ ID NO: 7038809 - DNA, 22 bp, Homo sapiens
tgcctgtctctgactgccatta

SEQ ID NO: 7038810 - DNA, 22 bp, Homo sapiens
tgccttcttgaatatggttctt

SEQ ID NO: 7038811 - DNA, 20 bp, Homo sapiens
tgcctttcctgtttcatctt

SEQ ID NO: 7038812 - DNA, 22 bp, Homo sapiens
tgccttttaccttgtaattctg

SEQ ID NO: 7038813 - DNA, 22 bp, Homo sapiens
tgccttttagtgctcaataaag

SEQ ID NO: 7038814 - DNA, 20 bp, Homo sapiens
tgccttttatacctttaaac

SEQ ID NO: 7038815 - DNA, 22 bp, Homo sapiens
tgccttttatggctagcctcag

SEQ ID NO: 7038816 - DNA, 22 bp, Homo sapiens
tgccttttccagcttccagagg

SEQ ID NO: 7038817 - DNA, 22 bp, Homo sapiens
tgccttttccagcttccaggag

SEQ ID NO: 7038818 - DNA, 22 bp, Homo sapiens
tgccttttccagttcctagaag

SEQ ID NO: 7038819 - DNA, 22 bp, Homo sapiens
tgccttttccagtttctagggg

SEQ ID NO: 7038820 - DNA, 22 bp, Homo sapiens
tgccttttctgtagctctggaa

SEQ ID NO: 7038821 - DNA, 22 bp, Homo sapiens
tgccttttgaagcctcacaggt

SEQ ID NO: 7038822 - DNA, 22 bp, Homo sapiens
tgccttttgtatgcaggccatg

SEQ ID NO: 7038823 - DNA, 22 bp, Homo sapiens
tgccttttgttagggctgccag

SEQ ID NO: 7038824 - DNA, 22 bp, Homo sapiens
tgctaaattcattattgattta

SEQ ID NO: 7038825 - DNA, 22 bp, Homo sapiens
tgctatttgtgtaatggtaaat

SEQ ID NO: 7038826 - DNA, 22 bp, Homo sapiens
tgctattttgttttcagtccat

SEQ ID NO: 7038827 - DNA, 22 bp, Homo sapiens
tgctgggctagaagctgaggcc

SEQ ID NO: 7038828 - DNA, 20 bp, Homo sapiens
tgctggggacatacagggtg

SEQ ID NO: 7038829 - DNA, 23 bp, Homo sapiens
tgctggggtagtttgtggcacag

SEQ ID NO: 7038830 - DNA, 22 bp, Homo sapiens
tgcttacgagctattttcactt

SEQ ID NO: 7038831 - DNA, 22 bp, Homo sapiens
tgcttctgactgggtcagttga

SEQ ID NO: 7038832 - DNA, 22 bp, Homo sapiens
tggaggctggtttctgctgagg

SEQ ID NO: 7038833 - DNA, 22 bp, Homo sapiens
tggaggctgtgtgcatgagacc

SEQ ID NO: 7038834 - DNA, 22 bp, Homo sapiens
tggagggcatctgtggtcaggc

SEQ ID NO: 7038835 - DNA, 22 bp, Homo sapiens
tggagggcgcttagatggaggg

SEQ ID NO: 7038836 - DNA, 22 bp, Homo sapiens
tggatacagaagccttggctgt

SEQ ID NO: 7038837 - DNA, 20 bp, Homo sapiens
tggaggcagagccagaggga

SEQ ID NO: 7038838 - DNA, 22 bp, Homo sapiens
tggaggcaggagacagggcaaa

SEQ ID NO: 7038839 - DNA, 22 bp, Homo sapiens
tggaggcaggtggaggagtgaa

SEQ ID NO: 7038840 - DNA, 22 bp, Homo sapiens
tggagaggttgaataacttgtc

SEQ ID NO: 7038841 - DNA, 22 bp, Homo sapiens
tggagcagccatgatgacagag

SEQ ID NO: 7038842 - DNA, 22 bp, Homo sapiens
tggagaggaaagtgcagttttg

SEQ ID NO: 7038843 - DNA, 19 bp, Homo sapiens
tggagaggaaatgctgctc

SEQ ID NO: 7038844 - DNA, 22 bp, Homo sapiens
tggagaagattggtcaccattc

SEQ ID NO: 7038845 - DNA, 22 bp, Homo sapiens
tggagccaagagtcaaggggag

SEQ ID NO: 7038846 - DNA, 22 bp, Homo sapiens
tggagccaaaaagggaaggaga

SEQ ID NO: 7038847 - DNA, 22 bp, Homo sapiens
tggagccaaggccagttctcag

SEQ ID NO: 7038848 - DNA, 22 bp, Homo sapiens
tggagccaatgaacatttgctg

SEQ ID NO: 7038849 - DNA, 20 bp, Homo sapiens
tggagccacagtcaggttcc

SEQ ID NO: 7038850 - DNA, 20 bp, Homo sapiens
tggagccagaggttatagca

SEQ ID NO: 7038851 - DNA, 18 bp, Homo sapiens
tggagccagctctaggat

SEQ ID NO: 7038852 - DNA, 22 bp, Homo sapiens
tggagccaggctggccctgcca

SEQ ID NO: 7038853 - DNA, 22 bp, Homo sapiens
tggagccagggtagaagcagag

SEQ ID NO: 7038854 - DNA, 22 bp, Homo sapiens
tggacccaccccagggcctgct

SEQ ID NO: 7038855 - DNA, 22 bp, Homo sapiens
tggacccaggcaggtctgtcct

SEQ ID NO: 7038856 - DNA, 22 bp, Homo sapiens
tggacacaaagatcaaatattg

SEQ ID NO: 7038857 - DNA, 22 bp, Homo sapiens
tggacacatcactgcagccact

SEQ ID NO: 7038858 - DNA, 22 bp, Homo sapiens
tggacagaaacccgagtgatct

SEQ ID NO: 7038859 - DNA, 22 bp, Homo sapiens
tggacaacatagtgagacctca

SEQ ID NO: 7038860 - DNA, 23 bp, Homo sapiens
tggaataataaggtacattaaca

SEQ ID NO: 7038861 - DNA, 22 bp, Homo sapiens
tggaagccaaggtcagaaggag

SEQ ID NO: 7038862 - DNA, 22 bp, Homo sapiens
tggaaatacttgccataaaact

SEQ ID NO: 7038863 - DNA, 23 bp, Homo sapiens
tggaaatctgggtgaggacagaa

SEQ ID NO: 7038864 - DNA, 22 bp, Homo sapiens
tggaaattaaaattcctcttaa

SEQ ID NO: 7038865 - DNA, 22 bp, Homo sapiens
tggaaattaacttggtacatat

SEQ ID NO: 7038866 - DNA, 22 bp, Homo sapiens
tggaaattaacttggtacatat

SEQ ID NO: 7038867 - DNA, 22 bp, Homo sapiens
tggaaattactaacacttagag

SEQ ID NO: 7038868 - DNA, 18 bp, Homo sapiens
tggaaattgaaacagaaa

SEQ ID NO: 7038869 - DNA, 22 bp, Homo sapiens
tggaaattgctattaccgatga

SEQ ID NO: 7038870 - DNA, 22 bp, Homo sapiens
tggaaatttattcatcattcat

SEQ ID NO: 7038871 - DNA, 22 bp, Homo sapiens
tggaaattttgaacagtttcta

SEQ ID NO: 7038872 - DNA, 22 bp, Homo sapiens
tggaacaaattacaattaactt

SEQ ID NO: 7038873 - DNA, 22 bp, Homo sapiens
tggaaaatcaggggacattgat

SEQ ID NO: 7038874 - DNA, 17 bp, Homo sapiens
tggaaacaaaacttatt

SEQ ID NO: 7038875 - DNA, 22 bp, Homo sapiens
tggaaacaaagtcataagctca

SEQ ID NO: 7038876 - DNA, 22 bp, Homo sapiens
tggaaagagatgttgtttctga

SEQ ID NO: 7038877 - DNA, 22 bp, Homo sapiens
tgctttttagtactgtcttatt

SEQ ID NO: 7038878 - DNA, 22 bp, Homo sapiens
tgctttttgcaccctttgccgt

SEQ ID NO: 7038879 - DNA, 22 bp, Homo sapiens
tggaaaaaacccagactctaga

SEQ ID NO: 7038880 - DNA, 22 bp, Homo sapiens
tgcttgttcatggcctagtggc

SEQ ID NO: 7038881 - DNA, 22 bp, Homo sapiens
tggcacagcccattcagagaag

SEQ ID NO: 7038882 - DNA, 22 bp, Homo sapiens
tggcaaatattttgttttgtaa

SEQ ID NO: 7038883 - DNA, 22 bp, Homo sapiens
tggcaaattcatctttagttct

SEQ ID NO: 7038884 - DNA, 22 bp, Homo sapiens
tggcaatatccacaattacttt

SEQ ID NO: 7038885 - DNA, 22 bp, Homo sapiens
tggcagagcaaaaagatagaat

SEQ ID NO: 7038886 - DNA, 18 bp, Homo sapiens
tggcaggggcagtacgcc

SEQ ID NO: 7038887 - DNA, 21 bp, Homo sapiens
tggcaggggtagtagtacagc

SEQ ID NO: 7038888 - DNA, 22 bp, Homo sapiens
tggcaggggaggtgcttgctta

SEQ ID NO: 7038889 - DNA, 22 bp, Homo sapiens
tggcagggcctgctcatcatcc

SEQ ID NO: 7038890 - DNA, 22 bp, Homo sapiens
tggcagggcctgaatcttatac

SEQ ID NO: 7038891 - DNA, 22 bp, Homo sapiens
tggcagggcctaccccaatatc

SEQ ID NO: 7038892 - DNA, 22 bp, Homo sapiens
tggcagggagttcgttcacaac

SEQ ID NO: 7038893 - DNA, 22 bp, Homo sapiens
tggcagggagttgcaggatttc

SEQ ID NO: 7038894 - DNA, 22 bp, Homo sapiens
tggcagggagttcgttcacaac

SEQ ID NO: 7038895 - DNA, 19 bp, Homo sapiens
tggcagggagtgatattag

SEQ ID NO: 7038896 - DNA, 18 bp, Homo sapiens
tggcagggaggaaatata

SEQ ID NO: 7038897 - DNA, 22 bp, Homo sapiens
tggcagggagccaccggtcatg

SEQ ID NO: 7038898 - DNA, 23 bp, Homo sapiens
tggcaggaaatgagaatgttcct

SEQ ID NO: 7038899 - DNA, 20 bp, Homo sapiens
tggcaggaatagggccagag

SEQ ID NO: 7038900 - DNA, 20 bp, Homo sapiens
tggcaggaggcagcagtgga

SEQ ID NO: 7038901 - DNA, 22 bp, Homo sapiens
tggcaggatctttgagagtgaa

SEQ ID NO: 7038902 - DNA, 22 bp, Homo sapiens
tggcctctctaccaggcagcct

SEQ ID NO: 7038903 - DNA, 22 bp, Homo sapiens
tggcctctgcaatggattcacc

SEQ ID NO: 7038904 - DNA, 22 bp, Homo sapiens
tggcctctggctgaggactaac

SEQ ID NO: 7038905 - DNA, 22 bp, Homo sapiens
tggcctctgggaaagcagattc

SEQ ID NO: 7038906 - DNA, 20 bp, Homo sapiens
tggcctctgtagaggccaag

SEQ ID NO: 7038907 - DNA, 22 bp, Homo sapiens
tggcctcttaaggatgacacaa

SEQ ID NO: 7038908 - DNA, 22 bp, Homo sapiens
tggcctgcaaagtcttcttgct

SEQ ID NO: 7038909 - DNA, 22 bp, Homo sapiens
tggcctggaagagaggtcgagg

SEQ ID NO: 7038910 - DNA, 22 bp, Homo sapiens
tggcccaggtgcacccagaggc

SEQ ID NO: 7038911 - DNA, 22 bp, Homo sapiens
tggcccagtatgtataatctta

SEQ ID NO: 7038912 - DNA, 22 bp, Homo sapiens
tggcccagtcagcaggagaggg

SEQ ID NO: 7038913 - DNA, 22 bp, Homo sapiens
tggcccagtgcttatgctctga

SEQ ID NO: 7038914 - DNA, 22 bp, Homo sapiens
tggccctcagtcttgctcctgc

SEQ ID NO: 7038915 - DNA, 22 bp, Homo sapiens
tggcccagggcacagcagggag

SEQ ID NO: 7038916 - DNA, 22 bp, Homo sapiens
tggcccagggtctacagcctca

SEQ ID NO: 7038917 - DNA, 22 bp, Homo sapiens
tggcccaggtctctctgagccc

SEQ ID NO: 7038918 - DNA, 22 bp, Homo sapiens
tggcccaggtgcaagagacaga

SEQ ID NO: 7038919 - DNA, 22 bp, Homo sapiens
tggcccaggcgaggtgggcaga

SEQ ID NO: 7038920 - DNA, 22 bp, Homo sapiens
tggcccaggcgaggtgggcaga

SEQ ID NO: 7038921 - DNA, 22 bp, Homo sapiens
tggcccagggagttcatggtgt

SEQ ID NO: 7038922 - DNA, 22 bp, Homo sapiens
tggcccaggccaaagccctgga

SEQ ID NO: 7038923 - DNA, 22 bp, Homo sapiens
tggcccagactctgctcttatc

SEQ ID NO: 7038924 - DNA, 15 bp, Homo sapiens
tggcccacccgttga

SEQ ID NO: 7038925 - DNA, 22 bp, Homo sapiens
tggcccagctcagggtgggcgg

SEQ ID NO: 7038926 - DNA, 22 bp, Homo sapiens
tggccaggcctcttggtgccca

SEQ ID NO: 7038927 - DNA, 22 bp, Homo sapiens
tggcagggtgccagttgcgagt

SEQ ID NO: 7038928 - DNA, 22 bp, Homo sapiens
tggcagggtgccagttgcgagt

SEQ ID NO: 7038929 - DNA, 22 bp, Homo sapiens
tggcagggtcttgctgtgttgc

SEQ ID NO: 7038930 - DNA, 22 bp, Homo sapiens
tggcagggtacaccttaacacc

SEQ ID NO: 7038931 - DNA, 22 bp, Homo sapiens
tgggaggcaggtaggtgatgat

SEQ ID NO: 7038932 - DNA, 22 bp, Homo sapiens
tgggagctcctggagggcagga

SEQ ID NO: 7038933 - DNA, 20 bp, Homo sapiens
tgggagctggtgaggtctca

SEQ ID NO: 7038934 - DNA, 22 bp, Homo sapiens
tgggagaagcatggggtgcaga

SEQ ID NO: 7038935 - DNA, 22 bp, Homo sapiens
tggctgggggtgctatagctgc

SEQ ID NO: 7038936 - DNA, 22 bp, Homo sapiens
tggctggggccacagttttcct

SEQ ID NO: 7038937 - DNA, 22 bp, Homo sapiens
tggctgaggagggtcttctggt

SEQ ID NO: 7038938 - DNA, 22 bp, Homo sapiens
tggctgaggcacagctgccgcc

SEQ ID NO: 7038939 - DNA, 22 bp, Homo sapiens
tggctgagctgcagcgtggctt

SEQ ID NO: 7038940 - DNA, 22 bp, Homo sapiens
tggctgagggcactatgaagcc

SEQ ID NO: 7038941 - DNA, 22 bp, Homo sapiens
tggctgagggggcagttcagga

SEQ ID NO: 7038942 - DNA, 22 bp, Homo sapiens
tggctgaggttatgctggttgt

SEQ ID NO: 7038943 - DNA, 23 bp, Homo sapiens
tggctgagcccactatcttggcc

SEQ ID NO: 7038944 - DNA, 22 bp, Homo sapiens
tggctgagagcaattgactctg

SEQ ID NO: 7038945 - DNA, 22 bp, Homo sapiens
tggctgagagtcatcctgtgtg

SEQ ID NO: 7038946 - DNA, 22 bp, Homo sapiens
tggctgagccacttgttcagat

SEQ ID NO: 7038947 - DNA, 22 bp, Homo sapiens
tggctgagaagttctggtggga

SEQ ID NO: 7038948 - DNA, 22 bp, Homo sapiens
tggctgcagatctgtgggacac

SEQ ID NO: 7038949 - DNA, 22 bp, Homo sapiens
tggctgcagtgcttgagatgtc

SEQ ID NO: 7038950 - DNA, 22 bp, Homo sapiens
tggctgcagttgggccctcaga

SEQ ID NO: 7038951 - DNA, 22 bp, Homo sapiens
tggcctggtaccacatagattt

SEQ ID NO: 7038952 - DNA, 22 bp, Homo sapiens
tggcctggtccttgtcaaggca

SEQ ID NO: 7038953 - DNA, 22 bp, Homo sapiens
tggcctggtccttgtcaaggca

SEQ ID NO: 7038954 - DNA, 22 bp, Homo sapiens
tggcctggtgtctgcgaggcct

SEQ ID NO: 7038955 - DNA, 22 bp, Homo sapiens
tggcggctcaggaggggcagtt

SEQ ID NO: 7038956 - DNA, 22 bp, Homo sapiens
tgggcactatggctctgtgcac

SEQ ID NO: 7038957 - DNA, 22 bp, Homo sapiens
tgggcactcagagttttcaaga

SEQ ID NO: 7038958 - DNA, 22 bp, Homo sapiens
tgggcactcaggctgaggccgt

SEQ ID NO: 7038959 - DNA, 22 bp, Homo sapiens
tgggcagagtcatacaggagac

SEQ ID NO: 7038960 - DNA, 21 bp, Homo sapiens
tgggatgggtctgggaccagc

SEQ ID NO: 7038961 - DNA, 22 bp, Homo sapiens
tgggcaagtatcggactctgag

SEQ ID NO: 7038962 - DNA, 22 bp, Homo sapiens
tgggatagattgatggatagag

SEQ ID NO: 7038963 - DNA, 23 bp, Homo sapiens
tgggatggattcaccagtgtgct

SEQ ID NO: 7038964 - DNA, 22 bp, Homo sapiens
tgggaggccgaggcaggtggat

SEQ ID NO: 7038965 - DNA, 22 bp, Homo sapiens
tgggaggccaaggcaggcggat

SEQ ID NO: 7038966 - DNA, 22 bp, Homo sapiens
tgggccagctccctgcccctgg

SEQ ID NO: 7038967 - DNA, 22 bp, Homo sapiens
tgggccagcactgggtgctcat

SEQ ID NO: 7038968 - DNA, 22 bp, Homo sapiens
tgggccagcactgggtgctcat

SEQ ID NO: 7038969 - DNA, 22 bp, Homo sapiens
tgggccacgtgacccttaccct

SEQ ID NO: 7038970 - DNA, 22 bp, Homo sapiens
tgggcaggtgctattttccatg

SEQ ID NO: 7038971 - DNA, 22 bp, Homo sapiens
tgggcagggtctctgttatcag

SEQ ID NO: 7038972 - DNA, 22 bp, Homo sapiens
tgggcatcatggacagcagagg

SEQ ID NO: 7038973 - DNA, 22 bp, Homo sapiens
tgggctcagtctgcttggtcct

SEQ ID NO: 7038974 - DNA, 22 bp, Homo sapiens
tgggctcagtgggagaaagggc

SEQ ID NO: 7038975 - DNA, 22 bp, Homo sapiens
tgggctctgcatcagtgcccat

SEQ ID NO: 7038976 - DNA, 22 bp, Homo sapiens
tgggctctggagggcctaggat

SEQ ID NO: 7038977 - DNA, 22 bp, Homo sapiens
tgggctctgggtggcctgagca

SEQ ID NO: 7038978 - DNA, 21 bp, Homo sapiens
tgggctctttaacccaggcac

SEQ ID NO: 7038979 - DNA, 22 bp, Homo sapiens
tgggctgaaatgctgtggacta

SEQ ID NO: 7038980 - DNA, 22 bp, Homo sapiens
tgggctgcccaaggtggccatg

SEQ ID NO: 7038981 - DNA, 22 bp, Homo sapiens
tgggcctgggttcctcctgggc

SEQ ID NO: 7038982 - DNA, 22 bp, Homo sapiens
tgggcctgtgatgctgggctat

SEQ ID NO: 7038983 - DNA, 22 bp, Homo sapiens
tgggcctgtggcttggctctag

SEQ ID NO: 7038984 - DNA, 22 bp, Homo sapiens
tgggcctgttgcctgagtccat

SEQ ID NO: 7038985 - DNA, 22 bp, Homo sapiens
tgggcctgtttcccttcagggc

SEQ ID NO: 7038986 - DNA, 22 bp, Homo sapiens
tgggctagcagggaagagagac

SEQ ID NO: 7038987 - DNA, 22 bp, Homo sapiens
tgggctatgtaggagtggagtt

SEQ ID NO: 7038988 - DNA, 22 bp, Homo sapiens
tgggctcaaactggaggttgtt

SEQ ID NO: 7038989 - DNA, 18 bp, Homo sapiens
tgggctcaaaggatcctc

SEQ ID NO: 7038990 - DNA, 22 bp, Homo sapiens
tgggctcaagtgatgctcctgt

SEQ ID NO: 7038991 - DNA, 22 bp, Homo sapiens
tgggctcaatctgcttctgttt

SEQ ID NO: 7038992 - DNA, 22 bp, Homo sapiens
tgggctcactggggcagggacc

SEQ ID NO: 7038993 - DNA, 22 bp, Homo sapiens
tgggctcagaagatagtttcca

SEQ ID NO: 7038994 - DNA, 22 bp, Homo sapiens
tgggctcagccatgacctccac

SEQ ID NO: 7038995 - DNA, 21 bp, Homo sapiens
tgggctcagccccagccctgc

SEQ ID NO: 7038996 - DNA, 22 bp, Homo sapiens
tgggctcagcctcagtctgtgg

SEQ ID NO: 7038997 - DNA, 22 bp, Homo sapiens
tgggctcagccttcatgtggcc

SEQ ID NO: 7038998 - DNA, 22 bp, Homo sapiens
tgggctcagctcccaagggaag

SEQ ID NO: 7038999 - DNA, 23 bp, Homo sapiens
tgggctcagcttccagtggggag

SEQ ID NO: 7039000 - DNA, 22 bp, Homo sapiens
tgggctcaggaccccagaggcc

SEQ ID NO: 7039001 - DNA, 22 bp, Homo sapiens
tgggctcagggaagcttggcct

SEQ ID NO: 7039002 - DNA, 22 bp, Homo sapiens
tgggctcagggtcgaggacttt

SEQ ID NO: 7039003 - DNA, 22 bp, Homo sapiens
tgggctcagtctgcacctgcgg

SEQ ID NO: 7039004 - DNA, 22 bp, Homo sapiens
tgggccagtccagccccaggga

SEQ ID NO: 7039005 - DNA, 21 bp, Homo sapiens
tgggccagtagaaaggaaggc

SEQ ID NO: 7039006 - DNA, 17 bp, Homo sapiens
tgggccagtagaaggga

SEQ ID NO: 7039007 - DNA, 22 bp, Homo sapiens
tgggccaggggcctcttctgat

SEQ ID NO: 7039008 - DNA, 22 bp, Homo sapiens
tgggccagtcctgcctaaggtg

SEQ ID NO: 7039009 - DNA, 22 bp, Homo sapiens
tgggccagttatttcacctctg

SEQ ID NO: 7039010 - DNA, 22 bp, Homo sapiens
tgggccagttggaatggatact

SEQ ID NO: 7039011 - DNA, 22 bp, Homo sapiens
tgggccagttggtgactacaaa

SEQ ID NO: 7039012 - DNA, 22 bp, Homo sapiens
tgggcctcaccttcttggcagc

SEQ ID NO: 7039013 - DNA, 21 bp, Homo sapiens
tgggcctcaggcagctgtgac

SEQ ID NO: 7039014 - DNA, 21 bp, Homo sapiens
tgggcctcaggcagctgtgac

SEQ ID NO: 7039015 - DNA, 22 bp, Homo sapiens
tgggcctcagtttccttaggat

SEQ ID NO: 7039016 - DNA, 22 bp, Homo sapiens
tgggcctcatcttcaatgagtc

SEQ ID NO: 7039017 - DNA, 22 bp, Homo sapiens
tgggcctcatgcccagccaccc

SEQ ID NO: 7039018 - DNA, 22 bp, Homo sapiens
tgggcctcatgcccagccaccc

SEQ ID NO: 7039019 - DNA, 22 bp, Homo sapiens
tgggcctccaattccagcggga

SEQ ID NO: 7039020 - DNA, 22 bp, Homo sapiens
tgggcctccaattccagcggga

SEQ ID NO: 7039021 - DNA, 22 bp, Homo sapiens
tgggcctccgcatggcccagcg

SEQ ID NO: 7039022 - DNA, 22 bp, Homo sapiens
tgggcctcctgccctggcctag

SEQ ID NO: 7039023 - DNA, 22 bp, Homo sapiens
tgggcctcggagcacaggagac

SEQ ID NO: 7039024 - DNA, 22 bp, Homo sapiens
tgggcctctgtttcctcatctg

SEQ ID NO: 7039025 - DNA, 22 bp, Homo sapiens
tgggcctgacacttactaggga

SEQ ID NO: 7039026 - DNA, 22 bp, Homo sapiens
tgggcctgactcacctgcctcc

SEQ ID NO: 7039027 - DNA, 20 bp, Homo sapiens
tgggcctgagcctgtgggct

SEQ ID NO: 7039028 - DNA, 22 bp, Homo sapiens
tgggcctgagctcaccaggggc

SEQ ID NO: 7039029 - DNA, 21 bp, Homo sapiens
tgggcctgattcccagggtca

SEQ ID NO: 7039030 - DNA, 22 bp, Homo sapiens
tgggcctgattcttgaatcctg

SEQ ID NO: 7039031 - DNA, 18 bp, Homo sapiens
tgggcctgcatcctagtc

SEQ ID NO: 7039032 - DNA, 19 bp, Homo sapiens
tgggcctgcatctgggtct

SEQ ID NO: 7039033 - DNA, 22 bp, Homo sapiens
tgggcctgccccaggcttcagc

SEQ ID NO: 7039034 - DNA, 22 bp, Homo sapiens
tgggcctgggctcctgtcctct

SEQ ID NO: 7039035 - DNA, 21 bp, Homo sapiens
tggtaggtactggcttcaggc

SEQ ID NO: 7039036 - DNA, 22 bp, Homo sapiens
tggtatgaccgtggtgcaagca

SEQ ID NO: 7039037 - DNA, 22 bp, Homo sapiens
tggtatttgtcattcgagttct

SEQ ID NO: 7039038 - DNA, 22 bp, Homo sapiens
tgggtgctgctttagggggtca

SEQ ID NO: 7039039 - DNA, 17 bp, Homo sapiens
tgggtgctgggatgagg

SEQ ID NO: 7039040 - DNA, 22 bp, Homo sapiens
tgggtgaggatgatgaggcagc

SEQ ID NO: 7039041 - DNA, 16 bp, Homo sapiens
tgggtgggaggagcgg

SEQ ID NO: 7039042 - DNA, 21 bp, Homo sapiens
tgggtgggcagagtctcttca

SEQ ID NO: 7039043 - DNA, 22 bp, Homo sapiens
tgggtcctcgtcttccaaggca

SEQ ID NO: 7039044 - DNA, 22 bp, Homo sapiens
tgggtagagtggagggataaga

SEQ ID NO: 7039045 - DNA, 22 bp, Homo sapiens
tgggggctttatgtaatgcaca

SEQ ID NO: 7039046 - DNA, 22 bp, Homo sapiens
tgggggctttatgtaatgcaca

SEQ ID NO: 7039047 - DNA, 22 bp, Homo sapiens
tgggggctgtgcacaggctcac

SEQ ID NO: 7039048 - DNA, 22 bp, Homo sapiens
tggggtggaacccttctgctgg

SEQ ID NO: 7039049 - DNA, 22 bp, Homo sapiens
tggggtgggcatgcgctgtcct

SEQ ID NO: 7039050 - DNA, 22 bp, Homo sapiens
tggggtggggttactcattctg

SEQ ID NO: 7039051 - DNA, 22 bp, Homo sapiens
tggggtggtgggaaccaagtag

SEQ ID NO: 7039052 - DNA, 22 bp, Homo sapiens
tgggggctgggatgtcactttc

SEQ ID NO: 7039053 - DNA, 22 bp, Homo sapiens
tgggggctgagtaagatgagat

SEQ ID NO: 7039054 - DNA, 22 bp, Homo sapiens
tgggggctccaggctccaggga

SEQ ID NO: 7039055 - DNA, 22 bp, Homo sapiens
tgggggctccaggctccaggga

SEQ ID NO: 7039056 - DNA, 17 bp, Homo sapiens
tgggggcgccagggtct

SEQ ID NO: 7039057 - DNA, 22 bp, Homo sapiens
tgggggctagaacccagggatt

SEQ ID NO: 7039058 - DNA, 22 bp, Homo sapiens
tggggctggctattgtctccct

SEQ ID NO: 7039059 - DNA, 22 bp, Homo sapiens
tggggctggggatcttgagcct

SEQ ID NO: 7039060 - DNA, 22 bp, Homo sapiens
tggggctggcacagtctctatt

SEQ ID NO: 7039061 - DNA, 22 bp, Homo sapiens
tggggctggctattgtctccct

SEQ ID NO: 7039062 - DNA, 22 bp, Homo sapiens
tggggctggggatcttgagcct

SEQ ID NO: 7039063 - DNA, 22 bp, Homo sapiens
tggggctgtcccggtttggcga

SEQ ID NO: 7039064 - DNA, 22 bp, Homo sapiens
tggggctgtcccggtttggcga

SEQ ID NO: 7039065 - DNA, 22 bp, Homo sapiens
tggggctgtccttagtctgaga

SEQ ID NO: 7039066 - DNA, 22 bp, Homo sapiens
tggggcctgtgacgggtccaga

SEQ ID NO: 7039067 - DNA, 22 bp, Homo sapiens
tggggcctgcacaggctgaatg

SEQ ID NO: 7039068 - DNA, 22 bp, Homo sapiens
tggggccttggcctcattagat

SEQ ID NO: 7039069 - DNA, 22 bp, Homo sapiens
tggggctagaatcctgcaggaa

SEQ ID NO: 7039070 - DNA, 22 bp, Homo sapiens
tggggctcacctaggctggaag

SEQ ID NO: 7039071 - DNA, 22 bp, Homo sapiens
tggggctcctcctggcaggagg

SEQ ID NO: 7039072 - DNA, 22 bp, Homo sapiens
tggggctctccacagtgtctca

SEQ ID NO: 7039073 - DNA, 22 bp, Homo sapiens
tggggctgaggagcctcactct

SEQ ID NO: 7039074 - DNA, 22 bp, Homo sapiens
tggggctgaggagcctcactct

SEQ ID NO: 7039075 - DNA, 23 bp, Homo sapiens
tggggctgatggagacggaccag

SEQ ID NO: 7039076 - DNA, 23 bp, Homo sapiens
tggggctgatggagacggaccag

SEQ ID NO: 7039077 - DNA, 22 bp, Homo sapiens
tggggctggcacagtctctatt

SEQ ID NO: 7039078 - DNA, 22 bp, Homo sapiens
tggggcacagctgagaaagcac

SEQ ID NO: 7039079 - DNA, 22 bp, Homo sapiens
tggggcacagtctgaatgtttc

SEQ ID NO: 7039080 - DNA, 20 bp, Homo sapiens
tggggcacatgcagattggt

SEQ ID NO: 7039081 - DNA, 22 bp, Homo sapiens
tggggcaccttgtatctctaag

SEQ ID NO: 7039082 - DNA, 22 bp, Homo sapiens
tggggaggtaacaatttcaggc

SEQ ID NO: 7039083 - DNA, 22 bp, Homo sapiens
tggggaggttcgggaatcttgt

SEQ ID NO: 7039084 - DNA, 22 bp, Homo sapiens
tggggatgtaaatgaggtgata

SEQ ID NO: 7039085 - DNA, 23 bp, Homo sapiens
tggggagggaagtcatttctgta

SEQ ID NO: 7039086 - DNA, 22 bp, Homo sapiens
tggggaggatatgtgagttatt

SEQ ID NO: 7039087 - DNA, 22 bp, Homo sapiens
tgggctggctgaggcattcact

SEQ ID NO: 7039088 - DNA, 19 bp, Homo sapiens
tgggcttccccagggcaga

SEQ ID NO: 7039089 - DNA, 22 bp, Homo sapiens
tgtatacaggattactcatagc

SEQ ID NO: 7039090 - DNA, 22 bp, Homo sapiens
tgtatacaggcataagagatac

SEQ ID NO: 7039091 - DNA, 22 bp, Homo sapiens
tgtataacttgtggttatgaat

SEQ ID NO: 7039092 - DNA, 21 bp, Homo sapiens
tgtatacacacatatatgtac

SEQ ID NO: 7039093 - DNA, 22 bp, Homo sapiens
tgtatacacgtaccttttcttt

SEQ ID NO: 7039094 - DNA, 21 bp, Homo sapiens
tgtatacacgtgttgaaaaca

SEQ ID NO: 7039095 - DNA, 21 bp, Homo sapiens
tgtatacacgtgttgaaaaca

SEQ ID NO: 7039096 - DNA, 22 bp, Homo sapiens
tgtatatacatacacacatgaa

SEQ ID NO: 7039097 - DNA, 22 bp, Homo sapiens
tgtagaaaattggagcattcat

SEQ ID NO: 7039098 - DNA, 22 bp, Homo sapiens
tgtagaaagaatatgtttcata

SEQ ID NO: 7039099 - DNA, 22 bp, Homo sapiens
tgtagaaagaatatgtttcata

SEQ ID NO: 7039100 - DNA, 22 bp, Homo sapiens
tgtagaaagctcttctgaaatc

SEQ ID NO: 7039101 - DNA, 22 bp, Homo sapiens
tgtagaaagctcttctgaaatc

SEQ ID NO: 7039102 - DNA, 22 bp, Homo sapiens
tgtagaaattagtaagatcaac

SEQ ID NO: 7039103 - DNA, 22 bp, Homo sapiens
tgtagaaattagtaagatcaac

SEQ ID NO: 7039104 - DNA, 22 bp, Homo sapiens
tgtagatagtgatttatgacca

SEQ ID NO: 7039105 - DNA, 22 bp, Homo sapiens
tgtagatattaattattccttt

SEQ ID NO: 7039106 - DNA, 22 bp, Homo sapiens
tgtagcattttatgtaataagt

SEQ ID NO: 7039107 - DNA, 22 bp, Homo sapiens
tgtaggaaaaacaatgatctgc

SEQ ID NO: 7039108 - DNA, 22 bp, Homo sapiens
tgtaggaactcacagatattct

SEQ ID NO: 7039109 - DNA, 22 bp, Homo sapiens
tgtattctctcaatatttcata

SEQ ID NO: 7039110 - DNA, 22 bp, Homo sapiens
tgtattttcagagtggcatttc

SEQ ID NO: 7039111 - DNA, 22 bp, Homo sapiens
tgtattttctgaagataatcaa

SEQ ID NO: 7039112 - DNA, 22 bp, Homo sapiens
tgtattttcttctggaagctta

SEQ ID NO: 7039113 - DNA, 22 bp, Homo sapiens
tgtattttgtgaggatcactct

SEQ ID NO: 7039114 - DNA, 22 bp, Homo sapiens
tgtatttttagacctttagacc

SEQ ID NO: 7039115 - DNA, 22 bp, Homo sapiens
tgtatttttaggaatgcgctat

SEQ ID NO: 7039116 - DNA, 22 bp, Homo sapiens
tgtcacaaaaatcagtaattgc

SEQ ID NO: 7039117 - DNA, 22 bp, Homo sapiens
tgtcactttggccaagccattg

SEQ ID NO: 7039118 - DNA, 22 bp, Homo sapiens
tgtcagggctggacacagctgc

SEQ ID NO: 7039119 - DNA, 22 bp, Homo sapiens
tgtcagttcagtgattacaaaa

SEQ ID NO: 7039120 - DNA, 22 bp, Homo sapiens
tgtcagttctcacttacataaa

SEQ ID NO: 7039121 - DNA, 22 bp, Homo sapiens
tgtcatctcactgatatagatg

SEQ ID NO: 7039122 - DNA, 18 bp, Homo sapiens
tgtcatctgtttaaaacc

SEQ ID NO: 7039123 - DNA, 20 bp, Homo sapiens
tgtcattggcgtggttggct

SEQ ID NO: 7039124 - DNA, 22 bp, Homo sapiens
tgtcatttcctgaatgctgagt

SEQ ID NO: 7039125 - DNA, 22 bp, Homo sapiens
tgtccaatgccctttccacatg

SEQ ID NO: 7039126 - DNA, 22 bp, Homo sapiens
tgtcctggggcgacttggggcc

SEQ ID NO: 7039127 - DNA, 22 bp, Homo sapiens
tgtcctttgtgtatctatagta

SEQ ID NO: 7039128 - DNA, 16 bp, Homo sapiens
tggtggggaggacagc

SEQ ID NO: 7039129 - DNA, 22 bp, Homo sapiens
tggtggggattccctccctggc

SEQ ID NO: 7039130 - DNA, 22 bp, Homo sapiens
tggtggggccagacttcagctc

SEQ ID NO: 7039131 - DNA, 22 bp, Homo sapiens
tggtggggctttccttctgctt

SEQ ID NO: 7039132 - DNA, 22 bp, Homo sapiens
tggtgggggaggctgtctagca

SEQ ID NO: 7039133 - DNA, 22 bp, Homo sapiens
tggtgccaagcatgaggactct

SEQ ID NO: 7039134 - DNA, 22 bp, Homo sapiens
tggtggggtcatcgtcagatgc

SEQ ID NO: 7039135 - DNA, 23 bp, Homo sapiens
tggtggggtcttggagacagcac

SEQ ID NO: 7039136 - DNA, 22 bp, Homo sapiens
tggtgtgggcagcagcaggtac

SEQ ID NO: 7039137 - DNA, 22 bp, Homo sapiens
tggttctaggctttgtcttttg

SEQ ID NO: 7039138 - DNA, 21 bp, Homo sapiens
tggtttgcggccaaagttaaa

SEQ ID NO: 7039139 - DNA, 22 bp, Homo sapiens
tgtaaaataccattccttgtca

SEQ ID NO: 7039140 - DNA, 22 bp, Homo sapiens
tgtaaacaaatgcattcttgct

SEQ ID NO: 7039141 - DNA, 18 bp, Homo sapiens
tgtaaacactttcattct

SEQ ID NO: 7039142 - DNA, 18 bp, Homo sapiens
tgtaaacactttcattct

SEQ ID NO: 7039143 - DNA, 22 bp, Homo sapiens
tgtaaagattagattacatgaa

SEQ ID NO: 7039144 - DNA, 22 bp, Homo sapiens
tgtaaagtccaagatcaaagag

SEQ ID NO: 7039145 - DNA, 22 bp, Homo sapiens
tgtaaagttttattgttccttc

SEQ ID NO: 7039146 - DNA, 22 bp, Homo sapiens
tgtaaataattcctaggctttt

SEQ ID NO: 7039147 - DNA, 20 bp, Homo sapiens
tgtaaataggcattgtagtt

SEQ ID NO: 7039148 - DNA, 22 bp, Homo sapiens
tgtaaatagttagcttgcctct

SEQ ID NO: 7039149 - DNA, 22 bp, Homo sapiens
tgtaaatgaaacagctaaatcc

SEQ ID NO: 7039150 - DNA, 22 bp, Homo sapiens
tgtaaattgaaggaaatttgtg

SEQ ID NO: 7039151 - DNA, 22 bp, Homo sapiens
tgtaacaatgaatatagtgact

SEQ ID NO: 7039152 - DNA, 23 bp, Homo sapiens
tgtaacaattcccagcctttgcc

SEQ ID NO: 7039153 - DNA, 22 bp, Homo sapiens
tgtacaaagagtatagctttga

SEQ ID NO: 7039154 - DNA, 22 bp, Homo sapiens
tgtacaaagttaaacctatata

SEQ ID NO: 7039155 - DNA, 22 bp, Homo sapiens
tgtacaaattcattgaactgta

SEQ ID NO: 7039156 - DNA, 22 bp, Homo sapiens
tgtacaatagctattatctcca

SEQ ID NO: 7039157 - DNA, 22 bp, Homo sapiens
tgtacacaatgataaattatta

SEQ ID NO: 7039158 - DNA, 22 bp, Homo sapiens
tgtacacatttttatgttaaca

SEQ ID NO: 7039159 - DNA, 22 bp, Homo sapiens
ttcattactgcggtagtcacac

SEQ ID NO: 7039160 - DNA, 22 bp, Homo sapiens
ttcattcttgtctttgtatagt

SEQ ID NO: 7039161 - DNA, 22 bp, Homo sapiens
ttcattctttgaatctgaggta

SEQ ID NO: 7039162 - DNA, 22 bp, Homo sapiens
ttatttctactattttgcctga

SEQ ID NO: 7039163 - DNA, 22 bp, Homo sapiens
ttatttcttgtctatgtagcca

SEQ ID NO: 7039164 - DNA, 22 bp, Homo sapiens
ttaaagagaaagtgtttgtctt

SEQ ID NO: 7039165 - DNA, 22 bp, Homo sapiens
ttaaagagaactcaatgaatga

SEQ ID NO: 7039166 - DNA, 22 bp, Homo sapiens
ttaaagaggcatgggaatgtat

SEQ ID NO: 7039167 - DNA, 22 bp, Homo sapiens
ttaaagaggtagttaggtttaa

SEQ ID NO: 7039168 - DNA, 22 bp, Homo sapiens
ttaaagagtctactgcacatcc

SEQ ID NO: 7039169 - DNA, 22 bp, Homo sapiens
ttaataacattgtgtatcaccc

SEQ ID NO: 7039170 - DNA, 22 bp, Homo sapiens
ttaatacaagcatatgcacaca

SEQ ID NO: 7039171 - DNA, 22 bp, Homo sapiens
ttaatacagtctccagaagtaa

SEQ ID NO: 7039172 - DNA, 22 bp, Homo sapiens
ttaatacatttcagactgttat

SEQ ID NO: 7039173 - DNA, 22 bp, Homo sapiens
ttaatgcttgtctagatcttct

SEQ ID NO: 7039174 - DNA, 22 bp, Homo sapiens
ttaatggaaatatgtttatacc

SEQ ID NO: 7039175 - DNA, 22 bp, Homo sapiens
ttaatggactaggcagttgtaa

SEQ ID NO: 7039176 - DNA, 22 bp, Homo sapiens
ttaatggattggaggtttcaat

SEQ ID NO: 7039177 - DNA, 22 bp, Homo sapiens
ttaatgtcaacatttctgaaga

SEQ ID NO: 7039178 - DNA, 22 bp, Homo sapiens
ttaatgttttaagttatagaga

SEQ ID NO: 7039179 - DNA, 22 bp, Homo sapiens
ttacaaagagaagttgtagaat

SEQ ID NO: 7039180 - DNA, 22 bp, Homo sapiens
ttacaaagagaagttgtagaat

SEQ ID NO: 7039181 - DNA, 20 bp, Homo sapiens
ttacaaagaggcatcgcttt

SEQ ID NO: 7039182 - DNA, 21 bp, Homo sapiens
ttacaaagctacagatgttgc

SEQ ID NO: 7039183 - DNA, 22 bp, Homo sapiens
ttacaaaggtagttttgtctat

SEQ ID NO: 7039184 - DNA, 22 bp, Homo sapiens
ttacaaaggtagttttgtctat

SEQ ID NO: 7039185 - DNA, 22 bp, Homo sapiens
ttacaaaggtagttttgtctat

SEQ ID NO: 7039186 - DNA, 22 bp, Homo sapiens
ttacaaagtgctgcaccatttt

SEQ ID NO: 7039187 - DNA, 22 bp, Homo sapiens
ttacaaagtgctgcaccatttt

SEQ ID NO: 7039188 - DNA, 22 bp, Homo sapiens
ttacaaagtgttatgataaaca

SEQ ID NO: 7039189 - DNA, 22 bp, Homo sapiens
ttacaaagtgttatgataaaca

SEQ ID NO: 7039190 - DNA, 22 bp, Homo sapiens
ttacaaagttctgagttcaaac

SEQ ID NO: 7039191 - DNA, 22 bp, Homo sapiens
ttacaaagttctgagttcaaac

SEQ ID NO: 7039192 - DNA, 22 bp, Homo sapiens
ttacaaagtttaaggtggcact

SEQ ID NO: 7039193 - DNA, 22 bp, Homo sapiens
ttacaattgagtctattgtatg

SEQ ID NO: 7039194 - DNA, 20 bp, Homo sapiens
ttacactttgtagcattttt

SEQ ID NO: 7039195 - DNA, 22 bp, Homo sapiens
ttacacttttgacaaacctgag

SEQ ID NO: 7039196 - DNA, 22 bp, Homo sapiens
ttacagaaaagggctttaagag

SEQ ID NO: 7039197 - DNA, 22 bp, Homo sapiens
ttacagaaaatgtgttttaact

SEQ ID NO: 7039198 - DNA, 22 bp, Homo sapiens
ttagaacatagcaacagaatta

SEQ ID NO: 7039199 - DNA, 22 bp, Homo sapiens
ttagaaccataatgaatcaatg

SEQ ID NO: 7039200 - DNA, 22 bp, Homo sapiens
ttagatatgtttttgctaatgc

SEQ ID NO: 7039201 - DNA, 22 bp, Homo sapiens
ttagatcattttgaactaattt

SEQ ID NO: 7039202 - DNA, 22 bp, Homo sapiens
ttagatttacaagcactgttta

SEQ ID NO: 7039203 - DNA, 22 bp, Homo sapiens
ttagatttatatgtgagaatgg

SEQ ID NO: 7039204 - DNA, 17 bp, Homo sapiens
ttagcaaaatagcactt

SEQ ID NO: 7039205 - DNA, 22 bp, Homo sapiens
ttagcaaacatcttcgtgtgag

SEQ ID NO: 7039206 - DNA, 22 bp, Homo sapiens
ttagcaaacctggactacagat

SEQ ID NO: 7039207 - DNA, 22 bp, Homo sapiens
ttagcaaacctggactacagat

SEQ ID NO: 7039208 - DNA, 22 bp, Homo sapiens
ttagcagatttcatgtacattt

SEQ ID NO: 7039209 - DNA, 22 bp, Homo sapiens
ttagtgatgaagaattactagg

SEQ ID NO: 7039210 - DNA, 22 bp, Homo sapiens
ttagtgattacagatatataaa

SEQ ID NO: 7039211 - DNA, 22 bp, Homo sapiens
ttatatgtttctgtttggaggc

SEQ ID NO: 7039212 - DNA, 22 bp, Homo sapiens
ttatgaaaacaatcagtaggca

SEQ ID NO: 7039213 - DNA, 22 bp, Homo sapiens
ttatgaaaacaatcagtaggca

SEQ ID NO: 7039214 - DNA, 22 bp, Homo sapiens
ttatgagactgttttacacact

SEQ ID NO: 7039215 - DNA, 22 bp, Homo sapiens
ttatgagatatttatactgctg

SEQ ID NO: 7039216 - DNA, 18 bp, Homo sapiens
ttatgcaaaactgttttc

SEQ ID NO: 7039217 - DNA, 22 bp, Homo sapiens
ttattattccccaagtcattat

SEQ ID NO: 7039218 - DNA, 22 bp, Homo sapiens
ttattcatcagtgcattaattt

SEQ ID NO: 7039219 - DNA, 22 bp, Homo sapiens
ttattcattaacagggaccaaa

SEQ ID NO: 7039220 - DNA, 22 bp, Homo sapiens
ttattccaaatcatggttgcat

SEQ ID NO: 7039221 - DNA, 22 bp, Homo sapiens
ttattccaagataggatagcat

SEQ ID NO: 7039222 - DNA, 22 bp, Homo sapiens
ttattccaatttctcctacaaa

SEQ ID NO: 7039223 - DNA, 22 bp, Homo sapiens
ttattccacagctcagaatttt

SEQ ID NO: 7039224 - DNA, 22 bp, Homo sapiens
ttattccacctccattttccta

SEQ ID NO: 7039225 - DNA, 22 bp, Homo sapiens
ttattccagctaagagtcctgg

SEQ ID NO: 7039226 - DNA, 22 bp, Homo sapiens
ttattccaggcacagaaggagg

SEQ ID NO: 7039227 - DNA, 22 bp, Homo sapiens
ttattccaggtacttggtttct

SEQ ID NO: 7039228 - DNA, 22 bp, Homo sapiens
ttattccagtaatctctgtaat

SEQ ID NO: 7039229 - DNA, 22 bp, Homo sapiens
ttattccagtgggtggtttctc

SEQ ID NO: 7039230 - DNA, 22 bp, Homo sapiens
ttattccatagaagtcaaggaa

SEQ ID NO: 7039231 - DNA, 22 bp, Homo sapiens
ttattccattatttcacttagg

SEQ ID NO: 7039232 - DNA, 22 bp, Homo sapiens
ttattccattcagttcaacaag

SEQ ID NO: 7039233 - DNA, 22 bp, Homo sapiens
ttattccattgtcttttgactt

SEQ ID NO: 7039234 - DNA, 19 bp, Homo sapiens
ttattcttaaagtagctta

SEQ ID NO: 7039235 - DNA, 18 bp, Homo sapiens
ttattcttccaggccacc

SEQ ID NO: 7039236 - DNA, 22 bp, Homo sapiens
ttattcttcttctcttgccagg

SEQ ID NO: 7039237 - DNA, 22 bp, Homo sapiens
ttattcttggatctgagtctct

SEQ ID NO: 7039238 - DNA, 22 bp, Homo sapiens
ttattctttaaacatatatgtt

SEQ ID NO: 7039239 - DNA, 22 bp, Homo sapiens
ttaaaatttccccaccatgtat

SEQ ID NO: 7039240 - DNA, 22 bp, Homo sapiens
ttaaaatgtacaggggaaagtg

SEQ ID NO: 7039241 - DNA, 22 bp, Homo sapiens
ttaaaattatggcccatttgga

SEQ ID NO: 7039242 - DNA, 22 bp, Homo sapiens
ttaaacagacagtaaatgaaac

SEQ ID NO: 7039243 - DNA, 22 bp, Homo sapiens
ttaaacagagtctgaaatgtaa

SEQ ID NO: 7039244 - DNA, 22 bp, Homo sapiens
ttaaacagtatatctgagcaag

SEQ ID NO: 7039245 - DNA, 22 bp, Homo sapiens
ttaaacagtcccagaggctgac

SEQ ID NO: 7039246 - DNA, 18 bp, Homo sapiens
tgtttatttttctcttac

SEQ ID NO: 7039247 - DNA, 22 bp, Homo sapiens
tgttttaagagcgcactttata

SEQ ID NO: 7039248 - DNA, 22 bp, Homo sapiens
tgttttaagggtcaactgtcac

SEQ ID NO: 7039249 - DNA, 22 bp, Homo sapiens
tgttttaatctcccattgctct

SEQ ID NO: 7039250 - DNA, 22 bp, Homo sapiens
tgttttatgagccatataacct

SEQ ID NO: 7039251 - DNA, 22 bp, Homo sapiens
tgttttatgagccatataacct

SEQ ID NO: 7039252 - DNA, 22 bp, Homo sapiens
tgttcttaagactggaagttac

SEQ ID NO: 7039253 - DNA, 22 bp, Homo sapiens
tgttctttggcttcctttccgt

SEQ ID NO: 7039254 - DNA, 22 bp, Homo sapiens
tgtttatcttaaatccactggg

SEQ ID NO: 7039255 - DNA, 22 bp, Homo sapiens
tgtttattacagttcttggaat

SEQ ID NO: 7039256 - DNA, 22 bp, Homo sapiens
tgtttattcatggctaatgaaa

SEQ ID NO: 7039257 - DNA, 18 bp, Homo sapiens
tgtttattctcctgacag

SEQ ID NO: 7039258 - DNA, 22 bp, Homo sapiens
tgtttattgagtgcctactata

SEQ ID NO: 7039259 - DNA, 22 bp, Homo sapiens
tgtttattgcagtgctgggctg

SEQ ID NO: 7039260 - DNA, 22 bp, Homo sapiens
tgtttattgctgcaattgtgcc

SEQ ID NO: 7039261 - DNA, 22 bp, Homo sapiens
tgtttattttcaggatggattg

SEQ ID NO: 7039262 - DNA, 22 bp, Homo sapiens
tgtgtacagcaggatttctcaa

SEQ ID NO: 7039263 - DNA, 22 bp, Homo sapiens
tgtgggctttggagtcaggaag

SEQ ID NO: 7039264 - DNA, 22 bp, Homo sapiens
tgtgggctctaatggcagcaga

SEQ ID NO: 7039265 - DNA, 22 bp, Homo sapiens
tgtgcaatcatattttaaaatg

SEQ ID NO: 7039266 - DNA, 22 bp, Homo sapiens
tgtgcctgctagatggttgtcg

SEQ ID NO: 7039267 - DNA, 22 bp, Homo sapiens
tgtgcctggcccagtggtgtca

SEQ ID NO: 7039268 - DNA, 22 bp, Homo sapiens
tgtgccttatgaattctttctg

SEQ ID NO: 7039269 - DNA, 22 bp, Homo sapiens
tgtgcctttcatcatgcttttg

SEQ ID NO: 7039270 - DNA, 22 bp, Homo sapiens
tgtggaaaattggaacgttcct

SEQ ID NO: 7039271 - DNA, 22 bp, Homo sapiens
tgtgactggttgtcccgctttc

SEQ ID NO: 7039272 - DNA, 22 bp, Homo sapiens
tgtgagtctaggtcagggtgtt

SEQ ID NO: 7039273 - DNA, 22 bp, Homo sapiens
tgtgagttgctcttttgctact

SEQ ID NO: 7039274 - DNA, 22 bp, Homo sapiens
tgtgaaatgagtatatttgaat

SEQ ID NO: 7039275 - DNA, 22 bp, Homo sapiens
tgtgaaatgtgtgtataattaa

SEQ ID NO: 7039276 - DNA, 22 bp, Homo sapiens
tgtcttaacataaaaggaaatc

SEQ ID NO: 7039277 - DNA, 22 bp, Homo sapiens
tgtcttggccactaggagtgcc

SEQ ID NO: 7039278 - DNA, 22 bp, Homo sapiens
tgtcttggctctggagggggat

SEQ ID NO: 7039279 - DNA, 22 bp, Homo sapiens
tgtcttttctactgtaagcata

SEQ ID NO: 7039280 - DNA, 22 bp, Homo sapiens
tgtctttttactatgttcaatc

SEQ ID NO: 7039281 - DNA, 22 bp, Homo sapiens
aaatgcagctgggcatgagagg

SEQ ID NO: 7039282 - DNA, 22 bp, Homo sapiens
aaatgctaaatgcagcaagtag

SEQ ID NO: 7039283 - DNA, 22 bp, Homo sapiens
aaatatgtgatcagtgaataaa

SEQ ID NO: 7039284 - DNA, 22 bp, Homo sapiens
aaatactgttttattccatgat

SEQ ID NO: 7039285 - DNA, 22 bp, Homo sapiens
aaagatgtcagtttgaaataac

SEQ ID NO: 7039286 - DNA, 22 bp, Homo sapiens
aaagatgtccaagtaaagttaa

SEQ ID NO: 7039287 - DNA, 22 bp, Homo sapiens
aaagatgtgcctgtttcatagt

SEQ ID NO: 7039288 - DNA, 22 bp, Homo sapiens
aaagcaatggatgagaatctgt

SEQ ID NO: 7039289 - DNA, 22 bp, Homo sapiens
aaacagttttctcatttagtgt

SEQ ID NO: 7039290 - DNA, 22 bp, Homo sapiens
aaacagttttttaagtctctag

SEQ ID NO: 7039291 - DNA, 22 bp, Homo sapiens
aaaattcattcctcagactgcc

SEQ ID NO: 7039292 - DNA, 22 bp, Homo sapiens
aaaatagctatggaatgtcact

SEQ ID NO: 7039293 - DNA, 22 bp, Homo sapiens
aaaatagatgaaaggaagtctg

SEQ ID NO: 7039294 - DNA, 22 bp, Homo sapiens
aaaatagattctaggatgtctt

SEQ ID NO: 7039295 - DNA, 22 bp, Homo sapiens
aaacacacctttggaactgtga

SEQ ID NO: 7039296 - DNA, 22 bp, Homo sapiens
aaaaactgtaattacttttgca

SEQ ID NO: 7039297 - DNA, 20 bp, Homo sapiens
aaaaagacaaaacgagttgg

SEQ ID NO: 7039298 - DNA, 22 bp, Homo sapiens
aaaaagacagaggatgaggcag

SEQ ID NO: 7039299 - DNA, 22 bp, Homo sapiens
aaaaagatgtcctgaagtttag

SEQ ID NO: 7039300 - DNA, 22 bp, Homo sapiens
aaaaatgcttggacttaataaa

SEQ ID NO: 7039301 - DNA, 22 bp, Homo sapiens
aaaagtctgctctcatttcaga

SEQ ID NO: 7039302 - DNA, 22 bp, Homo sapiens
aaaagtctgctttctattatca

SEQ ID NO: 7039303 - DNA, 20 bp, Homo sapiens
aaacacagcctctctttaca

SEQ ID NO: 7039304 - DNA, 22 bp, Homo sapiens
aaacacagggatatatattcca

SEQ ID NO: 7039305 - DNA, 22 bp, Homo sapiens
aaaccattgcatctttcttaat

SEQ ID NO: 7039306 - DNA, 22 bp, Homo sapiens
aaacttcttgctgcattttctg

SEQ ID NO: 7039307 - DNA, 22 bp, Homo sapiens
aaacttgaaaggtactgttggt

SEQ ID NO: 7039308 - DNA, 22 bp, Homo sapiens
aaacttgagcagtcagatgaag

SEQ ID NO: 7039309 - DNA, 22 bp, Homo sapiens
aaacttgatctgtgaccttgct

SEQ ID NO: 7039310 - DNA, 23 bp, Homo sapiens
aaacttgctatggctgaaatcat

SEQ ID NO: 7039311 - DNA, 22 bp, Homo sapiens
aaacttgtggtggagaagccta

SEQ ID NO: 7039312 - DNA, 22 bp, Homo sapiens
aaagaactattaacgaggaagc

SEQ ID NO: 7039313 - DNA, 22 bp, Homo sapiens
aaagaactattaacgaggaagc

SEQ ID NO: 7039314 - DNA, 22 bp, Homo sapiens
aaagaagcataggctagacttc

SEQ ID NO: 7039315 - DNA, 22 bp, Homo sapiens
aaagatgtcacaagatgtgatg

SEQ ID NO: 7039316 - DNA, 22 bp, Homo sapiens
aagaaagtgtggagagcctagc

SEQ ID NO: 7039317 - DNA, 22 bp, Homo sapiens
aagaatgtcgttggtattttaa

SEQ ID NO: 7039318 - DNA, 22 bp, Homo sapiens
aagaatgtggcatttatttata

SEQ ID NO: 7039319 - DNA, 22 bp, Homo sapiens
aactttctttcacagaagtatc

SEQ ID NO: 7039320 - DNA, 22 bp, Homo sapiens
aactttgaggtcactgaattcc

SEQ ID NO: 7039321 - DNA, 22 bp, Homo sapiens
aactttgtcttttatgcttaca

SEQ ID NO: 7039322 - DNA, 22 bp, Homo sapiens
aacttttaaaatacacagacaa

SEQ ID NO: 7039323 - DNA, 22 bp, Homo sapiens
aacttttacaaattgtcatcat

SEQ ID NO: 7039324 - DNA, 22 bp, Homo sapiens
aagagcatatatgtatgtttgt

SEQ ID NO: 7039325 - DNA, 22 bp, Homo sapiens
aagagcccagggcttgatgctg

SEQ ID NO: 7039326 - DNA, 20 bp, Homo sapiens
aagagcccgcagggcagtgc

SEQ ID NO: 7039327 - DNA, 22 bp, Homo sapiens
aagagccctcagtgcttgaaat

SEQ ID NO: 7039328 - DNA, 22 bp, Homo sapiens
aagagccctctgtgtttctgag

SEQ ID NO: 7039329 - DNA, 22 bp, Homo sapiens
aagagccctggttgaaaataac

SEQ ID NO: 7039330 - DNA, 22 bp, Homo sapiens
aagagcccttttcagtctagtt

SEQ ID NO: 7039331 - DNA, 22 bp, Homo sapiens
aagagcccttgttcataattat

SEQ ID NO: 7039332 - DNA, 22 bp, Homo sapiens
aagaggagaaaggctggctttg

SEQ ID NO: 7039333 - DNA, 22 bp, Homo sapiens
aagaggagacttcagcaacttg

SEQ ID NO: 7039334 - DNA, 18 bp, Homo sapiens
aagaggaggaaacccagg

SEQ ID NO: 7039335 - DNA, 22 bp, Homo sapiens
aagaggaggacggttcccagaa

SEQ ID NO: 7039336 - DNA, 18 bp, Homo sapiens
aagaggaggagcaggttg

SEQ ID NO: 7039337 - DNA, 22 bp, Homo sapiens
aagcaactaaggcaaggaaatg

SEQ ID NO: 7039338 - DNA, 22 bp, Homo sapiens
aagcaactcctaggaggaaagg

SEQ ID NO: 7039339 - DNA, 22 bp, Homo sapiens
aagcaactgccttcaatattta

SEQ ID NO: 7039340 - DNA, 22 bp, Homo sapiens
aagcaactggctcattgtctca

SEQ ID NO: 7039341 - DNA, 22 bp, Homo sapiens
aaatatccataagcacatctat

SEQ ID NO: 7039342 - DNA, 22 bp, Homo sapiens
aagccactgagatttcactgca

SEQ ID NO: 7039343 - DNA, 22 bp, Homo sapiens
aactgattgttggatgatagtg

SEQ ID NO: 7039344 - DNA, 22 bp, Homo sapiens
aacatttgtgaagtacttagat

SEQ ID NO: 7039345 - DNA, 22 bp, Homo sapiens
aactatcacaaacagagtgtct

SEQ ID NO: 7039346 - DNA, 22 bp, Homo sapiens
aactatgtgatatcatccttgc

SEQ ID NO: 7039347 - DNA, 22 bp, Homo sapiens
aacagtatatgaaatgttagga

SEQ ID NO: 7039348 - DNA, 22 bp, Homo sapiens
aacagtatgtgagatttacaca

SEQ ID NO: 7039349 - DNA, 22 bp, Homo sapiens
aacagtcctgtgctctttcatt

SEQ ID NO: 7039350 - DNA, 22 bp, Homo sapiens
aacacaaagaagctgcaggatc

SEQ ID NO: 7039351 - DNA, 23 bp, Homo sapiens
aacacaaagctgattccagtggc

SEQ ID NO: 7039352 - DNA, 22 bp, Homo sapiens
aacaattactaccaaggcctgt

SEQ ID NO: 7039353 - DNA, 22 bp, Homo sapiens
aacaattatcatatacattgca

SEQ ID NO: 7039354 - DNA, 22 bp, Homo sapiens
aacacattggaagccaagaatg

SEQ ID NO: 7039355 - DNA, 22 bp, Homo sapiens
aacagcagcatgacagctgggt

SEQ ID NO: 7039356 - DNA, 22 bp, Homo sapiens
aaatgggcctggaaagaggatg

SEQ ID NO: 7039357 - DNA, 22 bp, Homo sapiens
aaagcacatagtagaaggattt

SEQ ID NO: 7039358 - DNA, 22 bp, Homo sapiens
aaattataggtgccaccttgga

SEQ ID NO: 7039359 - DNA, 22 bp, Homo sapiens
aaattattaaacagtgggatgc

SEQ ID NO: 7039360 - DNA, 22 bp, Homo sapiens
aaattattaaacagtgggatgc

SEQ ID NO: 7039361 - DNA, 22 bp, Homo sapiens
aaattattacaagctagttggc

SEQ ID NO: 7039362 - DNA, 22 bp, Homo sapiens
aaattattacaagctagttggc

SEQ ID NO: 7039363 - DNA, 22 bp, Homo sapiens
aaattattagttaagttgggca

SEQ ID NO: 7039364 - DNA, 22 bp, Homo sapiens
aaattattagttaagttgggca

SEQ ID NO: 7039365 - DNA, 22 bp, Homo sapiens
aaattattataggcagagctga

SEQ ID NO: 7039366 - DNA, 22 bp, Homo sapiens
aaattattataggcagagctga

SEQ ID NO: 7039367 - DNA, 22 bp, Homo sapiens
aaattattatgcccctctataa

SEQ ID NO: 7039368 - DNA, 22 bp, Homo sapiens
aaattattatgcccctctataa

SEQ ID NO: 7039369 - DNA, 22 bp, Homo sapiens
aaattgcattgagctgcttatt

SEQ ID NO: 7039370 - DNA, 22 bp, Homo sapiens
aacaagttgttgaaaataatta

SEQ ID NO: 7039371 - DNA, 22 bp, Homo sapiens
aagggagaggagggtcttgttg

SEQ ID NO: 7039372 - DNA, 21 bp, Homo sapiens
aaggggcaaacccaggacacc

SEQ ID NO: 7039373 - DNA, 22 bp, Homo sapiens
aaggggcacaattgtacccaag

SEQ ID NO: 7039374 - DNA, 22 bp, Homo sapiens
aaggggcatgcttttgccagga

SEQ ID NO: 7039375 - DNA, 22 bp, Homo sapiens
aacaatcaagtttctaaatgac

SEQ ID NO: 7039376 - DNA, 22 bp, Homo sapiens
aacaatctccaagaccaatgtg

SEQ ID NO: 7039377 - DNA, 22 bp, Homo sapiens
aacaatctgttcgatagaaaat

SEQ ID NO: 7039378 - DNA, 22 bp, Homo sapiens
aagtatttcgttctgaaaaagt

SEQ ID NO: 7039379 - DNA, 20 bp, Homo sapiens
aagttacattgtattgtacc

SEQ ID NO: 7039380 - DNA, 22 bp, Homo sapiens
aagttcttgagccctattctag

SEQ ID NO: 7039381 - DNA, 22 bp, Homo sapiens
aagttcttgtatttgcctttct

SEQ ID NO: 7039382 - DNA, 22 bp, Homo sapiens
aagttctttcatatcttaatta

SEQ ID NO: 7039383 - DNA, 22 bp, Homo sapiens
aagttctttgccagacacgtgt

SEQ ID NO: 7039384 - DNA, 23 bp, Homo sapiens
aagttcttttagatgtcttcgtg

SEQ ID NO: 7039385 - DNA, 22 bp, Homo sapiens
aagttgatttaaactactagtc

SEQ ID NO: 7039386 - DNA, 22 bp, Homo sapiens
aagtttgcggggaaagaacaca

SEQ ID NO: 7039387 - DNA, 22 bp, Homo sapiens
aagtttgcgtgtcctatttgat

SEQ ID NO: 7039388 - DNA, 22 bp, Homo sapiens
aacagtttcagttactgatgag

SEQ ID NO: 7039389 - DNA, 18 bp, Homo sapiens
aacagtttccagattctc

SEQ ID NO: 7039390 - DNA, 22 bp, Homo sapiens
aacagtttcctgactcctatga

SEQ ID NO: 7039391 - DNA, 22 bp, Homo sapiens
aacagtttctatgttagtggtt

SEQ ID NO: 7039392 - DNA, 22 bp, Homo sapiens
aacagtttgcctgaaatgtatt

SEQ ID NO: 7039393 - DNA, 22 bp, Homo sapiens
aacagtttgggtaggtatgtag

SEQ ID NO: 7039394 - DNA, 22 bp, Homo sapiens
aacagtttgtggatagcttgta

SEQ ID NO: 7039395 - DNA, 22 bp, Homo sapiens
aactcagttttctgtggcctca

SEQ ID NO: 7039396 - DNA, 22 bp, Homo sapiens
aagatacattttcttcagagaa

SEQ ID NO: 7039397 - DNA, 22 bp, Homo sapiens
aagatactttgcatgcatgaag

SEQ ID NO: 7039398 - DNA, 22 bp, Homo sapiens
aagatataataactgttgtcat

SEQ ID NO: 7039399 - DNA, 22 bp, Homo sapiens
aagatatagataaaactatgca

SEQ ID NO: 7039400 - DNA, 19 bp, Homo sapiens
acagaaatgtaagtgagac

SEQ ID NO: 7039401 - DNA, 22 bp, Homo sapiens
aagattttcagtgcctaaaaca

SEQ ID NO: 7039402 - DNA, 22 bp, Homo sapiens
aagattttctcaactgtatttg

SEQ ID NO: 7039403 - DNA, 22 bp, Homo sapiens
aagatttttttccacagactca

SEQ ID NO: 7039404 - DNA, 22 bp, Homo sapiens
aagcaaacaggagaagagctgt

SEQ ID NO: 7039405 - DNA, 18 bp, Homo sapiens
acagaggcagacatgtat

SEQ ID NO: 7039406 - DNA, 17 bp, Homo sapiens
acagaggcaggagtgga

SEQ ID NO: 7039407 - DNA, 23 bp, Homo sapiens
aagaggaggccctgctcccgtcc

SEQ ID NO: 7039408 - DNA, 22 bp, Homo sapiens
aagaggagggcagattcaaggc

SEQ ID NO: 7039409 - DNA, 22 bp, Homo sapiens
aagaggagtagatgtggttggt

SEQ ID NO: 7039410 - DNA, 22 bp, Homo sapiens
acacacagaaggaagccccact

SEQ ID NO: 7039411 - DNA, 22 bp, Homo sapiens
acacacagagtttatacaggca

SEQ ID NO: 7039412 - DNA, 22 bp, Homo sapiens
acacacaggtaaaggagcctgg

SEQ ID NO: 7039413 - DNA, 22 bp, Homo sapiens
acacgcatgatgatgcacgtac

SEQ ID NO: 7039414 - DNA, 22 bp, Homo sapiens
acactacagggagaagactcac

SEQ ID NO: 7039415 - DNA, 22 bp, Homo sapiens
acactacagggagaagactcac

SEQ ID NO: 7039416 - DNA, 22 bp, Homo sapiens
aattagcatttcccatataaat

SEQ ID NO: 7039417 - DNA, 22 bp, Homo sapiens
aattatttaactcctttggaga

SEQ ID NO: 7039418 - DNA, 22 bp, Homo sapiens
aattatttaactcctttggaga

SEQ ID NO: 7039419 - DNA, 22 bp, Homo sapiens
aattcaaagactagaattttgc

SEQ ID NO: 7039420 - DNA, 22 bp, Homo sapiens
aattcaaagccgcttgggaatc

SEQ ID NO: 7039421 - DNA, 22 bp, Homo sapiens
aattcaaattacaatagttgtt

SEQ ID NO: 7039422 - DNA, 23 bp, Homo sapiens
aattcaaattcagtgtgactagg

SEQ ID NO: 7039423 - DNA, 22 bp, Homo sapiens
aattcaaatttgagtttgtgat

SEQ ID NO: 7039424 - DNA, 22 bp, Homo sapiens
aattcaacagtcagttatctca

SEQ ID NO: 7039425 - DNA, 22 bp, Homo sapiens
aattcaaggatctgttaaatct

SEQ ID NO: 7039426 - DNA, 22 bp, Homo sapiens
aactcttaattttcatgaaatg

SEQ ID NO: 7039427 - DNA, 22 bp, Homo sapiens
aatgtcttttcccttactttcc

SEQ ID NO: 7039428 - DNA, 22 bp, Homo sapiens
aatgttattacacttgtgaaat

SEQ ID NO: 7039429 - DNA, 22 bp, Homo sapiens
aactttatcggaacaggtactc

SEQ ID NO: 7039430 - DNA, 22 bp, Homo sapiens
aactttatcggaacaggtactc

SEQ ID NO: 7039431 - DNA, 22 bp, Homo sapiens
aactttattgttaggggctaaa

SEQ ID NO: 7039432 - DNA, 22 bp, Homo sapiens
aactttattgttaggggctaaa

SEQ ID NO: 7039433 - DNA, 22 bp, Homo sapiens
aactttcagaatcctatgcatt

SEQ ID NO: 7039434 - DNA, 22 bp, Homo sapiens
aactttcaggcaatgaatattt

SEQ ID NO: 7039435 - DNA, 22 bp, Homo sapiens
aactttctctggatggcttcct

SEQ ID NO: 7039436 - DNA, 22 bp, Homo sapiens
accaggagttttgaccaggggc

SEQ ID NO: 7039437 - DNA, 22 bp, Homo sapiens
acattcttaacagttaaaaact

SEQ ID NO: 7039438 - DNA, 17 bp, Homo sapiens
acatgggctgagactcc

SEQ ID NO: 7039439 - DNA, 22 bp, Homo sapiens
acatgggcatctatgaggctct

SEQ ID NO: 7039440 - DNA, 22 bp, Homo sapiens
acatacttaacattaaagtcat

SEQ ID NO: 7039441 - DNA, 22 bp, Homo sapiens
acatacttagagtaaacaagta

SEQ ID NO: 7039442 - DNA, 22 bp, Homo sapiens
acatacttctttacattccata

SEQ ID NO: 7039443 - DNA, 22 bp, Homo sapiens
acatactttttaaaagattgct

SEQ ID NO: 7039444 - DNA, 18 bp, Homo sapiens
acatacattctgtctgca

SEQ ID NO: 7039445 - DNA, 22 bp, Homo sapiens
acatgtaaaagataaattaaca

SEQ ID NO: 7039446 - DNA, 22 bp, Homo sapiens
acattagaacattaatattggg

SEQ ID NO: 7039447 - DNA, 22 bp, Homo sapiens
acattagagaagcttggagatg

SEQ ID NO: 7039448 - DNA, 22 bp, Homo sapiens
acattagatgactctttctttc

SEQ ID NO: 7039449 - DNA, 22 bp, Homo sapiens
acattctgggtgatgttcttca

SEQ ID NO: 7039450 - DNA, 22 bp, Homo sapiens
acaggagaattatctggaacaa

SEQ ID NO: 7039451 - DNA, 22 bp, Homo sapiens
acaggagaccctgctggttctg

SEQ ID NO: 7039452 - DNA, 21 bp, Homo sapiens
acaggagaccgcctggcagtc

SEQ ID NO: 7039453 - DNA, 20 bp, Homo sapiens
acaggagatctgaggaaagg

SEQ ID NO: 7039454 - DNA, 23 bp, Homo sapiens
acagggcttatctgtcactcatc

SEQ ID NO: 7039455 - DNA, 22 bp, Homo sapiens
acaggtacaagggattaggatg

SEQ ID NO: 7039456 - DNA, 22 bp, Homo sapiens
acagtgtcatcagtttctcaac

SEQ ID NO: 7039457 - DNA, 22 bp, Homo sapiens
aatatgatccttaaccttcatg

SEQ ID NO: 7039458 - DNA, 22 bp, Homo sapiens
aatatgatccttaaccttcatg

SEQ ID NO: 7039459 - DNA, 22 bp, Homo sapiens
aatatgatgccaaattgctaca

SEQ ID NO: 7039460 - DNA, 22 bp, Homo sapiens
aatatgttgagtctatctttat

SEQ ID NO: 7039461 - DNA, 22 bp, Homo sapiens
aatcttttaggggatcctgagg

SEQ ID NO: 7039462 - DNA, 22 bp, Homo sapiens
aatctttttcacaagaaagcac

SEQ ID NO: 7039463 - DNA, 22 bp, Homo sapiens
aatactttcctatataaggtgc

SEQ ID NO: 7039464 - DNA, 22 bp, Homo sapiens
aatactttgccaagttcgaaga

SEQ ID NO: 7039465 - DNA, 22 bp, Homo sapiens
aatactttgccaagttcgaaga

SEQ ID NO: 7039466 - DNA, 22 bp, Homo sapiens
aatacttttgaactgaaaggca

SEQ ID NO: 7039467 - DNA, 20 bp, Homo sapiens
acttagtttttctcacagga

SEQ ID NO: 7039468 - DNA, 22 bp, Homo sapiens
acttatactaaagtattatttg

SEQ ID NO: 7039469 - DNA, 22 bp, Homo sapiens
acttatatttgctttatgcttc

SEQ ID NO: 7039470 - DNA, 22 bp, Homo sapiens
acttatttcatggatcataatg

SEQ ID NO: 7039471 - DNA, 22 bp, Homo sapiens
aatatcttctaaggatagaact

SEQ ID NO: 7039472 - DNA, 22 bp, Homo sapiens
aagtaaacttacacatagtaaa

SEQ ID NO: 7039473 - DNA, 22 bp, Homo sapiens
acctgggagtatgcagtggtga

SEQ ID NO: 7039474 - DNA, 22 bp, Homo sapiens
acctgggcattttggatgatta

SEQ ID NO: 7039475 - DNA, 22 bp, Homo sapiens
aagtctcttttcttcctgtatt

SEQ ID NO: 7039476 - DNA, 22 bp, Homo sapiens
actcagttccatattggtaagt

SEQ ID NO: 7039477 - DNA, 22 bp, Homo sapiens
aagtggctgctatcaactcctt

SEQ ID NO: 7039478 - DNA, 22 bp, Homo sapiens
aagtggctttgagcttctgcca

SEQ ID NO: 7039479 - DNA, 22 bp, Homo sapiens
aagttttaacaagtacttacta

SEQ ID NO: 7039480 - DNA, 22 bp, Homo sapiens
aagttttactgaggacacatgt

SEQ ID NO: 7039481 - DNA, 22 bp, Homo sapiens
aagttttactgaggacacatgt

SEQ ID NO: 7039482 - DNA, 22 bp, Homo sapiens
aagttttatgggaagatgtgca

SEQ ID NO: 7039483 - DNA, 21 bp, Homo sapiens
aagttttatgttgccatttgt

SEQ ID NO: 7039484 - DNA, 22 bp, Homo sapiens
aagttttattggaacatagcca

SEQ ID NO: 7039485 - DNA, 22 bp, Homo sapiens
aagttttattggctatagcact

SEQ ID NO: 7039486 - DNA, 22 bp, Homo sapiens
actgagacaactgtgtttctaa

SEQ ID NO: 7039487 - DNA, 22 bp, Homo sapiens
actgagactgagaatgtttctt

SEQ ID NO: 7039488 - DNA, 22 bp, Homo sapiens
agccctggtagcctgctgccat

SEQ ID NO: 7039489 - DNA, 22 bp, Homo sapiens
agctcaagtatttgggatttgt

SEQ ID NO: 7039490 - DNA, 22 bp, Homo sapiens
agcatcttgaaatataaagtca

SEQ ID NO: 7039491 - DNA, 22 bp, Homo sapiens
agcattgaggtgggtttctctt

SEQ ID NO: 7039492 - DNA, 22 bp, Homo sapiens
agcattgcctgcctattgctaa

SEQ ID NO: 7039493 - DNA, 22 bp, Homo sapiens
agcattgctaaagctaattttt

SEQ ID NO: 7039494 - DNA, 22 bp, Homo sapiens
agccaggaattggacaacacat

SEQ ID NO: 7039495 - DNA, 22 bp, Homo sapiens
acagaacagagggttttagaat

SEQ ID NO: 7039496 - DNA, 22 bp, Homo sapiens
acagaacatggatttttgaagt

SEQ ID NO: 7039497 - DNA, 22 bp, Homo sapiens
acagaactggaattggaactca

SEQ ID NO: 7039498 - DNA, 22 bp, Homo sapiens
acagaactgtgatctcataaat

SEQ ID NO: 7039499 - DNA, 22 bp, Homo sapiens
agcccaggtctggcccagcctg

SEQ ID NO: 7039500 - DNA, 23 bp, Homo sapiens
agcaggcatctgtggcacaaggc

SEQ ID NO: 7039501 - DNA, 21 bp, Homo sapiens
agcagccatggatggtatgta

SEQ ID NO: 7039502 - DNA, 22 bp, Homo sapiens
agcaggagctgtgggaagatgg

SEQ ID NO: 7039503 - DNA, 22 bp, Homo sapiens
agcaggcaggctgccagtgaat

SEQ ID NO: 7039504 - DNA, 22 bp, Homo sapiens
agcagaaccacagcactgttga

SEQ ID NO: 7039505 - DNA, 19 bp, Homo sapiens
agcagcagcaccagggatt

SEQ ID NO: 7039506 - DNA, 22 bp, Homo sapiens
acacagaacctcatagcctctc

SEQ ID NO: 7039507 - DNA, 23 bp, Homo sapiens
acacagaagaagacccaaggaag

SEQ ID NO: 7039508 - DNA, 22 bp, Homo sapiens
agaggtggccatgggcgctgga

SEQ ID NO: 7039509 - DNA, 22 bp, Homo sapiens
acaaaaagctccattactgtcc

SEQ ID NO: 7039510 - DNA, 22 bp, Homo sapiens
acaaaaaccgtggattcagcat

SEQ ID NO: 7039511 - DNA, 22 bp, Homo sapiens
agaggtggccatgggcgctgga

SEQ ID NO: 7039512 - DNA, 22 bp, Homo sapiens
agataatgttctgatccatttc

SEQ ID NO: 7039513 - DNA, 22 bp, Homo sapiens
agatataataatttacaagtgt

SEQ ID NO: 7039514 - DNA, 22 bp, Homo sapiens
agatatcaccagttttacatac

SEQ ID NO: 7039515 - DNA, 22 bp, Homo sapiens
agatatcttacactttgaagtt

SEQ ID NO: 7039516 - DNA, 22 bp, Homo sapiens
agatatgagattttcaaacaag

SEQ ID NO: 7039517 - DNA, 22 bp, Homo sapiens
agatatgtccctgtctaatatt

SEQ ID NO: 7039518 - DNA, 22 bp, Homo sapiens
agatatgtttgtatatatttgt

SEQ ID NO: 7039519 - DNA, 22 bp, Homo sapiens
agattatctcctgattttaagg

SEQ ID NO: 7039520 - DNA, 22 bp, Homo sapiens
agattcaaagtgaagaacttaa

SEQ ID NO: 7039521 - DNA, 22 bp, Homo sapiens
aattcacaggaggtatttgtcc

SEQ ID NO: 7039522 - DNA, 22 bp, Homo sapiens
aatttcaagtcttgaagaagta

SEQ ID NO: 7039523 - DNA, 22 bp, Homo sapiens
aatttcaagtggcatctttgat

SEQ ID NO: 7039524 - DNA, 22 bp, Homo sapiens
agagggcatgcttggtggcctg

SEQ ID NO: 7039525 - DNA, 22 bp, Homo sapiens
agagggctaactgggaagcagg

SEQ ID NO: 7039526 - DNA, 22 bp, Homo sapiens
agagacagggttttgccatgtt

SEQ ID NO: 7039527 - DNA, 22 bp, Homo sapiens
agagatatatatttgtttacca

SEQ ID NO: 7039528 - DNA, 22 bp, Homo sapiens
agagatatgagtagttgtgaca

SEQ ID NO: 7039529 - DNA, 22 bp, Homo sapiens
aatgaaacatatttaggaataa

SEQ ID NO: 7039530 - DNA, 22 bp, Homo sapiens
aatgaaactagtagaatctttg

SEQ ID NO: 7039531 - DNA, 22 bp, Homo sapiens
aatggaacttgtaattatgtcc

SEQ ID NO: 7039532 - DNA, 21 bp, Homo sapiens
agaataatggtatcatttgct

SEQ ID NO: 7039533 - DNA, 22 bp, Homo sapiens
aatgtaaacagcaagagaaggg

SEQ ID NO: 7039534 - DNA, 22 bp, Homo sapiens
aatgtaaacagcaagagaaggg

SEQ ID NO: 7039535 - DNA, 22 bp, Homo sapiens
aatgtataaagtgttaataact

SEQ ID NO: 7039536 - DNA, 22 bp, Homo sapiens
acccatccagtgtccctgctag

SEQ ID NO: 7039537 - DNA, 22 bp, Homo sapiens
acccatggtctggtggggccct

SEQ ID NO: 7039538 - DNA, 22 bp, Homo sapiens
accctgggcacaccatttcccc

SEQ ID NO: 7039539 - DNA, 22 bp, Homo sapiens
accctgggcttggcctgctcag

SEQ ID NO: 7039540 - DNA, 22 bp, Homo sapiens
accctgggggtggccagtgcca

SEQ ID NO: 7039541 - DNA, 22 bp, Homo sapiens
accctggggtcacccttctctg

SEQ ID NO: 7039542 - DNA, 22 bp, Homo sapiens
accctgggtctcaatcatccta

SEQ ID NO: 7039543 - DNA, 21 bp, Homo sapiens
accctgggttctccataccct

SEQ ID NO: 7039544 - DNA, 22 bp, Homo sapiens
acccagagcactgggtgtgggc

SEQ ID NO: 7039545 - DNA, 18 bp, Homo sapiens
acccagtttgaaggaaag

SEQ ID NO: 7039546 - DNA, 23 bp, Homo sapiens
accaggagaaaagctttgcggga

SEQ ID NO: 7039547 - DNA, 22 bp, Homo sapiens
accaggagacatgaccaatgag

SEQ ID NO: 7039548 - DNA, 20 bp, Homo sapiens
accaggagatggaggcaggg

SEQ ID NO: 7039549 - DNA, 22 bp, Homo sapiens
accaggagcattttttattagt

SEQ ID NO: 7039550 - DNA, 23 bp, Homo sapiens
accaggagccaagatctccctgg

SEQ ID NO: 7039551 - DNA, 22 bp, Homo sapiens
accaggagccacaggaggagcc

SEQ ID NO: 7039552 - DNA, 22 bp, Homo sapiens
accaggagccacaggaggagcc

SEQ ID NO: 7039553 - DNA, 22 bp, Homo sapiens
accaggaggaagtgttaatgat

SEQ ID NO: 7039554 - DNA, 22 bp, Homo sapiens
accaggaggccttggttctgag

SEQ ID NO: 7039555 - DNA, 22 bp, Homo sapiens
accaggaggctacactgtccca

SEQ ID NO: 7039556 - DNA, 19 bp, Homo sapiens
accaggagtatcagagctg

SEQ ID NO: 7039557 - DNA, 22 bp, Homo sapiens
accaggagtctagcctagtcaa

SEQ ID NO: 7039558 - DNA, 22 bp, Homo sapiens
accaggagttgggggtgggacc

SEQ ID NO: 7039559 - DNA, 21 bp, Homo sapiens
accagtccctagtcttatcct

SEQ ID NO: 7039560 - DNA, 22 bp, Homo sapiens
accagtctaggcaatgggggct

SEQ ID NO: 7039561 - DNA, 22 bp, Homo sapiens
accagtctgttgttgcagagtg

SEQ ID NO: 7039562 - DNA, 22 bp, Homo sapiens
accagtcttgttgccatgtctg

SEQ ID NO: 7039563 - DNA, 22 bp, Homo sapiens
accagttctttctctgtttctg

SEQ ID NO: 7039564 - DNA, 22 bp, Homo sapiens
acatgaaaagactatctgatta

SEQ ID NO: 7039565 - DNA, 22 bp, Homo sapiens
acatgaaacccagccgtggtcc

SEQ ID NO: 7039566 - DNA, 22 bp, Homo sapiens
acatgaaaaatgtttgcagttt

SEQ ID NO: 7039567 - DNA, 22 bp, Homo sapiens
acatgaaaactggttccttcag

SEQ ID NO: 7039568 - DNA, 22 bp, Homo sapiens
acatgaaactgttgcattagaa

SEQ ID NO: 7039569 - DNA, 22 bp, Homo sapiens
acatgaaacctgagtctaactc

SEQ ID NO: 7039570 - DNA, 20 bp, Homo sapiens
acatgaaaggaaacaggaaa

SEQ ID NO: 7039571 - DNA, 22 bp, Homo sapiens
aggcccagcttgaagtgggaag

SEQ ID NO: 7039572 - DNA, 23 bp, Homo sapiens
aggcccaggtatgtttgttttgg

SEQ ID NO: 7039573 - DNA, 22 bp, Homo sapiens
aggcccagtagtcgacggcgct

SEQ ID NO: 7039574 - DNA, 22 bp, Homo sapiens
acattcctgaggaaatacattc

SEQ ID NO: 7039575 - DNA, 22 bp, Homo sapiens
acattctttcaccttgtgtcca

SEQ ID NO: 7039576 - DNA, 22 bp, Homo sapiens
acattctttcgatgtctgattt

SEQ ID NO: 7039577 - DNA, 22 bp, Homo sapiens
acattctttgagttttgttaaa

SEQ ID NO: 7039578 - DNA, 22 bp, Homo sapiens
aggctccagtctcctctggcag

SEQ ID NO: 7039579 - DNA, 23 bp, Homo sapiens
aggagcccctaattctgggcagc

SEQ ID NO: 7039580 - DNA, 22 bp, Homo sapiens
aggagcccctcttcagtcctgg

SEQ ID NO: 7039581 - DNA, 22 bp, Homo sapiens
aggagccctccgttgcttcatc

SEQ ID NO: 7039582 - DNA, 22 bp, Homo sapiens
acaggggctccgaaggtgaggg

SEQ ID NO: 7039583 - DNA, 22 bp, Homo sapiens
acagggtgactttgtgacagat

SEQ ID NO: 7039584 - DNA, 22 bp, Homo sapiens
acagggtggggatggtgagctt

SEQ ID NO: 7039585 - DNA, 22 bp, Homo sapiens
aggagccatgagtgacatcaca

SEQ ID NO: 7039586 - DNA, 23 bp, Homo sapiens
aggagccatgagttggatatgtt

SEQ ID NO: 7039587 - DNA, 22 bp, Homo sapiens
aggagccatggaggtgaggcgg

SEQ ID NO: 7039588 - DNA, 22 bp, Homo sapiens
aggagccatggaggtgaggcgg

SEQ ID NO: 7039589 - DNA, 20 bp, Homo sapiens
aggagccattgactgcagca

SEQ ID NO: 7039590 - DNA, 22 bp, Homo sapiens
aggagccattttccaagggcga

SEQ ID NO: 7039591 - DNA, 20 bp, Homo sapiens
aggagaccaagccaagtgga

SEQ ID NO: 7039592 - DNA, 18 bp, Homo sapiens
aggagacagcctcacctg

SEQ ID NO: 7039593 - DNA, 23 bp, Homo sapiens
aggagacagggaagtgcctggct

SEQ ID NO: 7039594 - DNA, 22 bp, Homo sapiens
acataacaatcataggacatag

SEQ ID NO: 7039595 - DNA, 23 bp, Homo sapiens
acatacataagcaccacattttg

SEQ ID NO: 7039596 - DNA, 22 bp, Homo sapiens
agctgtgggagaatctctgggt

SEQ ID NO: 7039597 - DNA, 22 bp, Homo sapiens
agctgtgggcctgggagagctg

SEQ ID NO: 7039598 - DNA, 22 bp, Homo sapiens
agctgtggggaggaggctagca

SEQ ID NO: 7039599 - DNA, 22 bp, Homo sapiens
agctgtggggcaggcagcgagg

SEQ ID NO: 7039600 - DNA, 22 bp, Homo sapiens
agctgtggttctgggcagcgac

SEQ ID NO: 7039601 - DNA, 22 bp, Homo sapiens
agcttcagatttatctttctgt

SEQ ID NO: 7039602 - DNA, 22 bp, Homo sapiens
agcttcagatttatctttctgt

SEQ ID NO: 7039603 - DNA, 22 bp, Homo sapiens
agcttcagcttgcagctgtgat

SEQ ID NO: 7039604 - DNA, 22 bp, Homo sapiens
agcttcagggacttgtggcaga

SEQ ID NO: 7039605 - DNA, 22 bp, Homo sapiens
agcttcaggtggtcttgtttct

SEQ ID NO: 7039606 - DNA, 22 bp, Homo sapiens
agcttcagttttctattgttaa

SEQ ID NO: 7039607 - DNA, 22 bp, Homo sapiens
agcttttacataatgatcttga

SEQ ID NO: 7039608 - DNA, 22 bp, Homo sapiens
agcttttattggctgtcatttg

SEQ ID NO: 7039609 - DNA, 22 bp, Homo sapiens
aggaaaaacctgttaatggtag

SEQ ID NO: 7039610 - DNA, 22 bp, Homo sapiens
aggaaactgggcctcaggttag

SEQ ID NO: 7039611 - DNA, 22 bp, Homo sapiens
acagccagaggtggtcctgggt

SEQ ID NO: 7039612 - DNA, 22 bp, Homo sapiens
acagccagtaatctacccctgt

SEQ ID NO: 7039613 - DNA, 22 bp, Homo sapiens
acagccagtcctcccacagggt

SEQ ID NO: 7039614 - DNA, 23 bp, Homo sapiens
acagccagttcacctctccttgg

SEQ ID NO: 7039615 - DNA, 22 bp, Homo sapiens
agctgcagccgcagctgtggcc

SEQ ID NO: 7039616 - DNA, 22 bp, Homo sapiens
agctgcagcctcatgattcggt

SEQ ID NO: 7039617 - DNA, 22 bp, Homo sapiens
agctgcagcgttcatttttcca

SEQ ID NO: 7039618 - DNA, 22 bp, Homo sapiens
agctgcagctacagtgttggtt

SEQ ID NO: 7039619 - DNA, 22 bp, Homo sapiens
agctgcagctgttttctgagtg

SEQ ID NO: 7039620 - DNA, 22 bp, Homo sapiens
agctgcagcttcctagtccagc

SEQ ID NO: 7039621 - DNA, 22 bp, Homo sapiens
agctgcaggaagtagaagcgga

SEQ ID NO: 7039622 - DNA, 22 bp, Homo sapiens
agctgcaggagtcgcctaggat

SEQ ID NO: 7039623 - DNA, 22 bp, Homo sapiens
agctgcaggagtcgcctaggat

SEQ ID NO: 7039624 - DNA, 22 bp, Homo sapiens
agctgcaggattatggaatgga

SEQ ID NO: 7039625 - DNA, 22 bp, Homo sapiens
agctgcaggcccatgctcagtc

SEQ ID NO: 7039626 - DNA, 21 bp, Homo sapiens
actttacaatttacatagtga

SEQ ID NO: 7039627 - DNA, 22 bp, Homo sapiens
atacaaaaattagccgggagta

SEQ ID NO: 7039628 - DNA, 22 bp, Homo sapiens
atacaaaatatatactggagac

SEQ ID NO: 7039629 - DNA, 22 bp, Homo sapiens
atacatcatgctccatatattt

SEQ ID NO: 7039630 - DNA, 22 bp, Homo sapiens
atacatctagagtcataaaaac

SEQ ID NO: 7039631 - DNA, 22 bp, Homo sapiens
atagatacattgttatatttgt

SEQ ID NO: 7039632 - DNA, 20 bp, Homo sapiens
atagatatcatctttagaag

SEQ ID NO: 7039633 - DNA, 22 bp, Homo sapiens
atagatattagcaaaattttat

SEQ ID NO: 7039634 - DNA, 22 bp, Homo sapiens
atagatatttgagttgtttcca

SEQ ID NO: 7039635 - DNA, 22 bp, Homo sapiens
acttttcaaatgggaaactcag

SEQ ID NO: 7039636 - DNA, 23 bp, Homo sapiens
acttttcaattagctatgcttaa

SEQ ID NO: 7039637 - DNA, 22 bp, Homo sapiens
acttccttttcaaccatacagc

SEQ ID NO: 7039638 - DNA, 22 bp, Homo sapiens
acttaaaaacagatccagcagg

SEQ ID NO: 7039639 - DNA, 22 bp, Homo sapiens
acttaaaaagaatcttttcacg

SEQ ID NO: 7039640 - DNA, 19 bp, Homo sapiens
acttaaacctagaaaatgc

SEQ ID NO: 7039641 - DNA, 22 bp, Homo sapiens
actgggccttgtgtgtctcatc

SEQ ID NO: 7039642 - DNA, 22 bp, Homo sapiens
actgggctcataatgtcataga

SEQ ID NO: 7039643 - DNA, 22 bp, Homo sapiens
agtttctagcaaggattgttga

SEQ ID NO: 7039644 - DNA, 21 bp, Homo sapiens
agttttatattataagctaaa

SEQ ID NO: 7039645 - DNA, 21 bp, Homo sapiens
agttttatattataagctaaa

SEQ ID NO: 7039646 - DNA, 22 bp, Homo sapiens
agttttatctgtaagctgttca

SEQ ID NO: 7039647 - DNA, 22 bp, Homo sapiens
agttttatggctcaacctaata

SEQ ID NO: 7039648 - DNA, 22 bp, Homo sapiens
agttttatggctcaacctaata

SEQ ID NO: 7039649 - DNA, 22 bp, Homo sapiens
agttttatgtagacaattcatt

SEQ ID NO: 7039650 - DNA, 23 bp, Homo sapiens
agtttttaatggtcatagctgag

SEQ ID NO: 7039651 - DNA, 21 bp, Homo sapiens
agtttttactcttaactgtgg

SEQ ID NO: 7039652 - DNA, 18 bp, Homo sapiens
agtttttaggaagaaatg

SEQ ID NO: 7039653 - DNA, 22 bp, Homo sapiens
actgtttagtaaattgaaatgg

SEQ ID NO: 7039654 - DNA, 22 bp, Homo sapiens
acttttcccttggtagagttgc

SEQ ID NO: 7039655 - DNA, 22 bp, Homo sapiens
acttttgaagaattatgcaaaa

SEQ ID NO: 7039656 - DNA, 22 bp, Homo sapiens
actttttacagggtgtatacca

SEQ ID NO: 7039657 - DNA, 22 bp, Homo sapiens
actttttagtttcctcaaacat

SEQ ID NO: 7039658 - DNA, 22 bp, Homo sapiens
acttttttataaggaagaagat

SEQ ID NO: 7039659 - DNA, 22 bp, Homo sapiens
atatttttccatgtgggactct

SEQ ID NO: 7039660 - DNA, 21 bp, Homo sapiens
atatttttgtttggactgtca

SEQ ID NO: 7039661 - DNA, 22 bp, Homo sapiens
agaacagtcgtggtgagagaaa

SEQ ID NO: 7039662 - DNA, 22 bp, Homo sapiens
agaacatatctgttttctaact

SEQ ID NO: 7039663 - DNA, 22 bp, Homo sapiens
actgggcagggaaggagaccga

SEQ ID NO: 7039664 - DNA, 22 bp, Homo sapiens
actgggcatcccatggcagagc

SEQ ID NO: 7039665 - DNA, 22 bp, Homo sapiens
actgggccagatcagagcaact

SEQ ID NO: 7039666 - DNA, 22 bp, Homo sapiens
actgggcctgtacagagaaaac

SEQ ID NO: 7039667 - DNA, 22 bp, Homo sapiens
actgcactccaacctgggtgac

SEQ ID NO: 7039668 - DNA, 22 bp, Homo sapiens
actgcactccagcctgggtgat

SEQ ID NO: 7039669 - DNA, 22 bp, Homo sapiens
actgcactcctgcctgggtaac

SEQ ID NO: 7039670 - DNA, 22 bp, Homo sapiens
actgcacttcaccctgggtgac

SEQ ID NO: 7039671 - DNA, 22 bp, Homo sapiens
actgcacttcagcctgggtgac

SEQ ID NO: 7039672 - DNA, 22 bp, Homo sapiens
aggtccagtgaaactttatttg

SEQ ID NO: 7039673 - DNA, 22 bp, Homo sapiens
accttttatgtaaatatatgtt

SEQ ID NO: 7039674 - DNA, 22 bp, Homo sapiens
acgatatctgtaatattttatt

SEQ ID NO: 7039675 - DNA, 22 bp, Homo sapiens
aggtcttggtaggccagagtct

SEQ ID NO: 7039676 - DNA, 22 bp, Homo sapiens
aggtgaagttgaggaggcagaa

SEQ ID NO: 7039677 - DNA, 22 bp, Homo sapiens
aggtgagaaaacgagggttgca

SEQ ID NO: 7039678 - DNA, 22 bp, Homo sapiens
actactttgggccatttgttta

SEQ ID NO: 7039679 - DNA, 22 bp, Homo sapiens
aggtgggcaccaggcttgtggt

SEQ ID NO: 7039680 - DNA, 21 bp, Homo sapiens
aggtgggcaggtggagtggcc

SEQ ID NO: 7039681 - DNA, 22 bp, Homo sapiens
aggtggggaaaccagcgatccc

SEQ ID NO: 7039682 - DNA, 23 bp, Homo sapiens
agtacattcgaaaaattctgtga

SEQ ID NO: 7039683 - DNA, 22 bp, Homo sapiens
agtagaaagaaggcactgggcc

SEQ ID NO: 7039684 - DNA, 21 bp, Homo sapiens
agtagtttagcacagggtttg

SEQ ID NO: 7039685 - DNA, 22 bp, Homo sapiens
agtatacaaataaatgtgtaat

SEQ ID NO: 7039686 - DNA, 22 bp, Homo sapiens
agtatacaaataaatgtgtaat

SEQ ID NO: 7039687 - DNA, 22 bp, Homo sapiens
agtatacagtaatgacatatct

SEQ ID NO: 7039688 - DNA, 22 bp, Homo sapiens
actccctgtacttgcctctctt

SEQ ID NO: 7039689 - DNA, 22 bp, Homo sapiens
agtcactgctttgtccctgtgt

SEQ ID NO: 7039690 - DNA, 22 bp, Homo sapiens
actctccttttgatcttcagaa

SEQ ID NO: 7039691 - DNA, 22 bp, Homo sapiens
atgcctttaagagatactgagg

SEQ ID NO: 7039692 - DNA, 22 bp, Homo sapiens
atgcctttatcaggaggtaaat

SEQ ID NO: 7039693 - DNA, 22 bp, Homo sapiens
atgcctttctctgtagaaagaa

SEQ ID NO: 7039694 - DNA, 22 bp, Homo sapiens
atgcctttctggtgttcttcct

SEQ ID NO: 7039695 - DNA, 20 bp, Homo sapiens
atgcctttgatagtcaggct

SEQ ID NO: 7039696 - DNA, 22 bp, Homo sapiens
atgcctttgccacagattagga

SEQ ID NO: 7039697 - DNA, 22 bp, Homo sapiens
atgcctttggcattatttcttg

SEQ ID NO: 7039698 - DNA, 22 bp, Homo sapiens
atgcctttgttgaccactataa

SEQ ID NO: 7039699 - DNA, 22 bp, Homo sapiens
atgccttttcgggtacttctct

SEQ ID NO: 7039700 - DNA, 22 bp, Homo sapiens
atgcatttgtaaaatataatcg

SEQ ID NO: 7039701 - DNA, 22 bp, Homo sapiens
atgcatttttgagtatgaatga

SEQ ID NO: 7039702 - DNA, 22 bp, Homo sapiens
atgatacatcttgtttatttca

SEQ ID NO: 7039703 - DNA, 22 bp, Homo sapiens
atgatacattgcaaaattttaa

SEQ ID NO: 7039704 - DNA, 22 bp, Homo sapiens
atgatatacttcctagaacagt

SEQ ID NO: 7039705 - DNA, 22 bp, Homo sapiens
atgatatagagagtagattaaa

SEQ ID NO: 7039706 - DNA, 22 bp, Homo sapiens
agaatatagttaccaaattctg

SEQ ID NO: 7039707 - DNA, 22 bp, Homo sapiens
agaatatatgactgcaagacta

SEQ ID NO: 7039708 - DNA, 22 bp, Homo sapiens
agaatatatgactgcaagacta

SEQ ID NO: 7039709 - DNA, 22 bp, Homo sapiens
agaatatcgtagcatattatct

SEQ ID NO: 7039710 - DNA, 22 bp, Homo sapiens
atgaggctatgaatggggagat

SEQ ID NO: 7039711 - DNA, 22 bp, Homo sapiens
atgaggctgaaacacagaggct

SEQ ID NO: 7039712 - DNA, 22 bp, Homo sapiens
agacaactagaaaactagacag

SEQ ID NO: 7039713 - DNA, 22 bp, Homo sapiens
agagagggaatatttggggtat

SEQ ID NO: 7039714 - DNA, 22 bp, Homo sapiens
agagccaggcggctgggcacct

SEQ ID NO: 7039715 - DNA, 22 bp, Homo sapiens
attacacagcggttactactag

SEQ ID NO: 7039716 - DNA, 22 bp, Homo sapiens
attacacaggctggctctttga

SEQ ID NO: 7039717 - DNA, 22 bp, Homo sapiens
agaggctgcaggctggaaatca

SEQ ID NO: 7039718 - DNA, 22 bp, Homo sapiens
agaggctccttcactctggcac

SEQ ID NO: 7039719 - DNA, 22 bp, Homo sapiens
agaggctgcacttgctcatgat

SEQ ID NO: 7039720 - DNA, 22 bp, Homo sapiens
agaggctgggtacgggccacct

SEQ ID NO: 7039721 - DNA, 22 bp, Homo sapiens
agagggcagggcggtaagtcct

SEQ ID NO: 7039722 - DNA, 18 bp, Homo sapiens
agagtatacagacaacaa

SEQ ID NO: 7039723 - DNA, 23 bp, Homo sapiens
attttagctgaatgacttcttta

SEQ ID NO: 7039724 - DNA, 22 bp, Homo sapiens
agcaaatattttgttgaagtgc

SEQ ID NO: 7039725 - DNA, 22 bp, Homo sapiens
agcaaatgggtttatatttgac

SEQ ID NO: 7039726 - DNA, 20 bp, Homo sapiens
agcaagagtaaggacagcga

SEQ ID NO: 7039727 - DNA, 22 bp, Homo sapiens
caaaccagtaggaagtctatta

SEQ ID NO: 7039728 - DNA, 22 bp, Homo sapiens
agatattaatcgtacataaggt

SEQ ID NO: 7039729 - DNA, 22 bp, Homo sapiens
agatattaccagcagtctatgc

SEQ ID NO: 7039730 - DNA, 22 bp, Homo sapiens
agatattaggaggattcataat

SEQ ID NO: 7039731 - DNA, 22 bp, Homo sapiens
agatcagagatgctaaaagagc

SEQ ID NO: 7039732 - DNA, 22 bp, Homo sapiens
agatcatactacttgtactaaa

SEQ ID NO: 7039733 - DNA, 22 bp, Homo sapiens
agatcatagcacaaaagtgaca

SEQ ID NO: 7039734 - DNA, 22 bp, Homo sapiens
agatcatatgaaaaatttcaag

SEQ ID NO: 7039735 - DNA, 22 bp, Homo sapiens
agatcatattgtaactttattg

SEQ ID NO: 7039736 - DNA, 22 bp, Homo sapiens
agctaagtggaaaatgcagtta

SEQ ID NO: 7039737 - DNA, 22 bp, Homo sapiens
agctacatgaaattgctgatat

SEQ ID NO: 7039738 - DNA, 22 bp, Homo sapiens
cagcaaatactactagttttta

SEQ ID NO: 7039739 - DNA, 22 bp, Homo sapiens
cagcaacatgtggtagtgtagg

SEQ ID NO: 7039740 - DNA, 22 bp, Homo sapiens
cagcaactggtcattgctctcc

SEQ ID NO: 7039741 - DNA, 20 bp, Homo sapiens
cagcaactttggactgagtt

SEQ ID NO: 7039742 - DNA, 20 bp, Homo sapiens
cagcaactttggactgagtt

SEQ ID NO: 7039743 - DNA, 22 bp, Homo sapiens
cactttataaaattggtgtgag

SEQ ID NO: 7039744 - DNA, 22 bp, Homo sapiens
cactttatatgcattacctcat

SEQ ID NO: 7039745 - DNA, 22 bp, Homo sapiens
cactttatattctaagacggcc

SEQ ID NO: 7039746 - DNA, 22 bp, Homo sapiens
cactttatgggaagcaaaaatt

SEQ ID NO: 7039747 - DNA, 22 bp, Homo sapiens
cactttattataaatttgagag

SEQ ID NO: 7039748 - DNA, 19 bp, Homo sapiens
cactttatttctgttttgt

SEQ ID NO: 7039749 - DNA, 22 bp, Homo sapiens
agccagcacggcgccatggagt

SEQ ID NO: 7039750 - DNA, 22 bp, Homo sapiens
agccagcagggcttagaggaca

SEQ ID NO: 7039751 - DNA, 22 bp, Homo sapiens
agccagcatgaagacagaggcc

SEQ ID NO: 7039752 - DNA, 22 bp, Homo sapiens
agccagcatgaagacagaggcc

SEQ ID NO: 7039753 - DNA, 22 bp, Homo sapiens
agccagctaccggggctcctgg

SEQ ID NO: 7039754 - DNA, 22 bp, Homo sapiens
agccctggaccttagcccccac

SEQ ID NO: 7039755 - DNA, 22 bp, Homo sapiens
agccctggcccggctgtgcttt

SEQ ID NO: 7039756 - DNA, 22 bp, Homo sapiens
agccctgggctgtagataagca

SEQ ID NO: 7039757 - DNA, 22 bp, Homo sapiens
cactgttttattccaacatagg

SEQ ID NO: 7039758 - DNA, 22 bp, Homo sapiens
agcagtggacctcagtgctatt

SEQ ID NO: 7039759 - DNA, 22 bp, Homo sapiens
agcatgaaaggcgtgccaactt

SEQ ID NO: 7039760 - DNA, 18 bp, Homo sapiens
agcatgagtcaggggtgc

SEQ ID NO: 7039761 - DNA, 22 bp, Homo sapiens
agcagggctctgccatgggccc

SEQ ID NO: 7039762 - DNA, 22 bp, Homo sapiens
cacagcaagagctaaatgacca

SEQ ID NO: 7039763 - DNA, 22 bp, Homo sapiens
agcactgatttaaactggattt

SEQ ID NO: 7039764 - DNA, 22 bp, Homo sapiens
caaaggctggtagaatgagcca

SEQ ID NO: 7039765 - DNA, 22 bp, Homo sapiens
caaaggcttccactgcatcctt

SEQ ID NO: 7039766 - DNA, 22 bp, Homo sapiens
agcagaggacagttcttaggaa

SEQ ID NO: 7039767 - DNA, 22 bp, Homo sapiens
agcagaggacagttcttaggaa

SEQ ID NO: 7039768 - DNA, 22 bp, Homo sapiens
agcagaggaggatttagttagg

SEQ ID NO: 7039769 - DNA, 21 bp, Homo sapiens
agcagaggctgcctggtgact

SEQ ID NO: 7039770 - DNA, 21 bp, Homo sapiens
agcagaggctgcctggtgact

SEQ ID NO: 7039771 - DNA, 20 bp, Homo sapiens
caataatttacttccctatt

SEQ ID NO: 7039772 - DNA, 22 bp, Homo sapiens
caatacaattaccagttaatca

SEQ ID NO: 7039773 - DNA, 22 bp, Homo sapiens
ccctgccccaggcggcttcact

SEQ ID NO: 7039774 - DNA, 22 bp, Homo sapiens
ccctgccctggagacacttaaa

SEQ ID NO: 7039775 - DNA, 22 bp, Homo sapiens
ccctgcccatcggggcggcctg

SEQ ID NO: 7039776 - DNA, 22 bp, Homo sapiens
ccctgctgccttcacccaggac

SEQ ID NO: 7039777 - DNA, 22 bp, Homo sapiens
cccatgcaccctctaagaagga

SEQ ID NO: 7039778 - DNA, 22 bp, Homo sapiens
cccatggggacaccatgaagga

SEQ ID NO: 7039779 - DNA, 22 bp, Homo sapiens
cccatgggttttcctccctgcc

SEQ ID NO: 7039780 - DNA, 16 bp, Homo sapiens
cccatgtgtagatgag

SEQ ID NO: 7039781 - DNA, 22 bp, Homo sapiens
cccattcatcctcgcttccttc

SEQ ID NO: 7039782 - DNA, 22 bp, Homo sapiens
ccccagcacaggctcctcagat

SEQ ID NO: 7039783 - DNA, 22 bp, Homo sapiens
ccctaggctgaggccagggtgc

SEQ ID NO: 7039784 - DNA, 22 bp, Homo sapiens
cccaggagatgcactccattgg

SEQ ID NO: 7039785 - DNA, 22 bp, Homo sapiens
cccaggagatggaggttgcagt

SEQ ID NO: 7039786 - DNA, 22 bp, Homo sapiens
cccaggagatggtgcgtggtct

SEQ ID NO: 7039787 - DNA, 19 bp, Homo sapiens
cccaggagcagtattgatg

SEQ ID NO: 7039788 - DNA, 22 bp, Homo sapiens
cccaggagccatctgtcttggc

SEQ ID NO: 7039789 - DNA, 23 bp, Homo sapiens
cccaggagcctgagtcctctctg

SEQ ID NO: 7039790 - DNA, 20 bp, Homo sapiens
cccaggagctgtgccccatc

SEQ ID NO: 7039791 - DNA, 22 bp, Homo sapiens
cccaggagcttctctctgcctc

SEQ ID NO: 7039792 - DNA, 22 bp, Homo sapiens
cccaggaggtagaggttgcagt

SEQ ID NO: 7039793 - DNA, 22 bp, Homo sapiens
cccaggaggtcaaggctgcagt

SEQ ID NO: 7039794 - DNA, 22 bp, Homo sapiens
cccaggaggtcgaagctgcagt

SEQ ID NO: 7039795 - DNA, 22 bp, Homo sapiens
cccaggaggtggagcttgcagt

SEQ ID NO: 7039796 - DNA, 22 bp, Homo sapiens
cccagttttctgattgaagagc

SEQ ID NO: 7039797 - DNA, 19 bp, Homo sapiens
aggggcactgtctctagag

SEQ ID NO: 7039798 - DNA, 22 bp, Homo sapiens
aggggcacttctcaggctgtgg

SEQ ID NO: 7039799 - DNA, 22 bp, Homo sapiens
aggggcactagaatgggagact

SEQ ID NO: 7039800 - DNA, 22 bp, Homo sapiens
aggggaggcagcgataaacctg

SEQ ID NO: 7039801 - DNA, 22 bp, Homo sapiens
cctgaagaaaattccacgagaa

SEQ ID NO: 7039802 - DNA, 22 bp, Homo sapiens
cctgaagagcactctagagttg

SEQ ID NO: 7039803 - DNA, 22 bp, Homo sapiens
cctgaagatccattatagacac

SEQ ID NO: 7039804 - DNA, 22 bp, Homo sapiens
aggggtgacacatatcagtgca

SEQ ID NO: 7039805 - DNA, 22 bp, Homo sapiens
agggtagtacagagagtgtcct

SEQ ID NO: 7039806 - DNA, 18 bp, Homo sapiens
agggcctccatcccctcc

SEQ ID NO: 7039807 - DNA, 22 bp, Homo sapiens
agggctagagttgagatgggga

SEQ ID NO: 7039808 - DNA, 22 bp, Homo sapiens
aggctggagcaagggggcatat

SEQ ID NO: 7039809 - DNA, 22 bp, Homo sapiens
aggctggagtgcaatggcgtga

SEQ ID NO: 7039810 - DNA, 22 bp, Homo sapiens
aggctggagtgctggagtgctg

SEQ ID NO: 7039811 - DNA, 22 bp, Homo sapiens
aggctgggctccgcccaactcc

SEQ ID NO: 7039812 - DNA, 20 bp, Homo sapiens
aggctggggtgttttgccca

SEQ ID NO: 7039813 - DNA, 23 bp, Homo sapiens
ccagggctacgggcaccgtcctg

SEQ ID NO: 7039814 - DNA, 22 bp, Homo sapiens
ccagggctcaggctcccagtgg

SEQ ID NO: 7039815 - DNA, 19 bp, Homo sapiens
ccagggctccaagctgagt

SEQ ID NO: 7039816 - DNA, 22 bp, Homo sapiens
ccagggctggaccagtgcttgg

SEQ ID NO: 7039817 - DNA, 20 bp, Homo sapiens
ccagggctggctcctgggat

SEQ ID NO: 7039818 - DNA, 22 bp, Homo sapiens
ccagggctgggtttgtcggtgt

SEQ ID NO: 7039819 - DNA, 22 bp, Homo sapiens
ccagggctggtggctgcagagg

SEQ ID NO: 7039820 - DNA, 22 bp, Homo sapiens
aggctgaggatcgtactttcca

SEQ ID NO: 7039821 - DNA, 22 bp, Homo sapiens
ccagctctgcttgcccagtcag

SEQ ID NO: 7039822 - DNA, 22 bp, Homo sapiens
ccagcaggagatgcctgtgtct

SEQ ID NO: 7039823 - DNA, 22 bp, Homo sapiens
ccagctcttttggctgagtgag

SEQ ID NO: 7039824 - DNA, 22 bp, Homo sapiens
ccagctgacgatgcctggtctc

SEQ ID NO: 7039825 - DNA, 22 bp, Homo sapiens
ccagctggcactgtggctgccc

SEQ ID NO: 7039826 - DNA, 22 bp, Homo sapiens
ccactgggggctgctcccaggt

SEQ ID NO: 7039827 - DNA, 22 bp, Homo sapiens
aggccaccaccctatctcctgg

SEQ ID NO: 7039828 - DNA, 22 bp, Homo sapiens
aggccagaaatgtcagggagtg

SEQ ID NO: 7039829 - DNA, 22 bp, Homo sapiens
ccaaactgggccagtcagctgt

SEQ ID NO: 7039830 - DNA, 22 bp, Homo sapiens
ccaaactgtttcgtatttatgc

SEQ ID NO: 7039831 - DNA, 22 bp, Homo sapiens
ccaaagcaagtcacatgatcaa

SEQ ID NO: 7039832 - DNA, 21 bp, Homo sapiens
aggcaggattcaaacacagag

SEQ ID NO: 7039833 - DNA, 22 bp, Homo sapiens
aggcagagagcagtggccgtct

SEQ ID NO: 7039834 - DNA, 22 bp, Homo sapiens
catcatttgtttgcatgcagga

SEQ ID NO: 7039835 - DNA, 22 bp, Homo sapiens
cagttattatcttagagagaca

SEQ ID NO: 7039836 - DNA, 22 bp, Homo sapiens
cagttcaagagaaatactactg

SEQ ID NO: 7039837 - DNA, 22 bp, Homo sapiens
cagttcacactgtgctatctgc

SEQ ID NO: 7039838 - DNA, 22 bp, Homo sapiens
cagttcaggtgcattagtaatc

SEQ ID NO: 7039839 - DNA, 22 bp, Homo sapiens
cagttcatagtcttcatgtctc

SEQ ID NO: 7039840 - DNA, 22 bp, Homo sapiens
cagttcatccccatgttttcaa

SEQ ID NO: 7039841 - DNA, 19 bp, Homo sapiens
cagttccagcttcttgacc

SEQ ID NO: 7039842 - DNA, 22 bp, Homo sapiens
cagttccatcttcatctttccc

SEQ ID NO: 7039843 - DNA, 22 bp, Homo sapiens
cagttcctcaaaggttaaatgt

SEQ ID NO: 7039844 - DNA, 22 bp, Homo sapiens
catattttagttgctgaacagc

SEQ ID NO: 7039845 - DNA, 19 bp, Homo sapiens
catatttttgggctggcat

SEQ ID NO: 7039846 - DNA, 22 bp, Homo sapiens
aggaggctggttcaggccatat

SEQ ID NO: 7039847 - DNA, 22 bp, Homo sapiens
aggagccaaaagctgaacaaga

SEQ ID NO: 7039848 - DNA, 22 bp, Homo sapiens
aggagccaaacatattgagaga

SEQ ID NO: 7039849 - DNA, 22 bp, Homo sapiens
aggagccaaattactagctctg

SEQ ID NO: 7039850 - DNA, 22 bp, Homo sapiens
aggagccaagatggggcaagta

SEQ ID NO: 7039851 - DNA, 22 bp, Homo sapiens
aggagccaagcagaactaagga

SEQ ID NO: 7039852 - DNA, 22 bp, Homo sapiens
aggagccaaggaaaacagtatt

SEQ ID NO: 7039853 - DNA, 22 bp, Homo sapiens
aggagccaatctgataaagcca

SEQ ID NO: 7039854 - DNA, 22 bp, Homo sapiens
caggctggagttcagtggtgtg

SEQ ID NO: 7039855 - DNA, 22 bp, Homo sapiens
caggctgtgaaactgagatgcg

SEQ ID NO: 7039856 - DNA, 20 bp, Homo sapiens
agcttctgctgcctttcggc

SEQ ID NO: 7039857 - DNA, 22 bp, Homo sapiens
agcttctgttcatcttccaggc

SEQ ID NO: 7039858 - DNA, 22 bp, Homo sapiens
agctttctggttacagtcttca

SEQ ID NO: 7039859 - DNA, 22 bp, Homo sapiens
cagggacccgcacaggtagcat

SEQ ID NO: 7039860 - DNA, 22 bp, Homo sapiens
cagggaccctactagctcacac

SEQ ID NO: 7039861 - DNA, 22 bp, Homo sapiens
cagggagaaatctccaggaggt

SEQ ID NO: 7039862 - DNA, 22 bp, Homo sapiens
aggaaaattatcatgagagcca

SEQ ID NO: 7039863 - DNA, 22 bp, Homo sapiens
agctgggcaccccgctgcgtct

SEQ ID NO: 7039864 - DNA, 22 bp, Homo sapiens
agctgggcagactgcagtggtt

SEQ ID NO: 7039865 - DNA, 21 bp, Homo sapiens
agctgggcctcagcctgcagt

SEQ ID NO: 7039866 - DNA, 22 bp, Homo sapiens
agctgggcctgagctggaagct

SEQ ID NO: 7039867 - DNA, 22 bp, Homo sapiens
agctgccagatgacagtgctat

SEQ ID NO: 7039868 - DNA, 22 bp, Homo sapiens
caggaaatatctcaacacttta

SEQ ID NO: 7039869 - DNA, 22 bp, Homo sapiens
aggtgcagcatgagtccaacgg

SEQ ID NO: 7039870 - DNA, 22 bp, Homo sapiens
cctgtgccagctgggccctgcc

SEQ ID NO: 7039871 - DNA, 22 bp, Homo sapiens
aggtggcagagctggcccagcg

SEQ ID NO: 7039872 - DNA, 22 bp, Homo sapiens
cctgtggggctgaaagaggctt

SEQ ID NO: 7039873 - DNA, 22 bp, Homo sapiens
cctgtgggagcccaggcagata

SEQ ID NO: 7039874 - DNA, 22 bp, Homo sapiens
cctgtgggagggagcggctgga

SEQ ID NO: 7039875 - DNA, 22 bp, Homo sapiens
cctgtgggagggagcggctgga

SEQ ID NO: 7039876 - DNA, 22 bp, Homo sapiens
cctgtgggccaaggacctgcca

SEQ ID NO: 7039877 - DNA, 22 bp, Homo sapiens
cctgtgggccctggacagagac

SEQ ID NO: 7039878 - DNA, 22 bp, Homo sapiens
cctgtgggcctgcacgtgggga

SEQ ID NO: 7039879 - DNA, 22 bp, Homo sapiens
aggtggcagatgggggtgctcg

SEQ ID NO: 7039880 - DNA, 22 bp, Homo sapiens
agggtgggctagactcttcccc

SEQ ID NO: 7039881 - DNA, 22 bp, Homo sapiens
agggttttggctgaagttcagc

SEQ ID NO: 7039882 - DNA, 22 bp, Homo sapiens
aggtacaaaagagtatatgaga

SEQ ID NO: 7039883 - DNA, 22 bp, Homo sapiens
aggtcacttggtgttattcagc

SEQ ID NO: 7039884 - DNA, 22 bp, Homo sapiens
agtaaactgtgggtacagatgt

SEQ ID NO: 7039885 - DNA, 22 bp, Homo sapiens
ccttctctactcctgatgcatg

SEQ ID NO: 7039886 - DNA, 22 bp, Homo sapiens
ccttctcctgccttgggttcat

SEQ ID NO: 7039887 - DNA, 22 bp, Homo sapiens
agtaaacagtaggaactgagaa

SEQ ID NO: 7039888 - DNA, 22 bp, Homo sapiens
ccttctcccctctgcagggtgt

SEQ ID NO: 7039889 - DNA, 22 bp, Homo sapiens
agtacatacttcaaatgtactt

SEQ ID NO: 7039890 - DNA, 22 bp, Homo sapiens
agtagaaagttgcaggaggaat

SEQ ID NO: 7039891 - DNA, 22 bp, Homo sapiens
agtagaaatgtaagaaggatta

SEQ ID NO: 7039892 - DNA, 22 bp, Homo sapiens
agtagaaatgtagtgtagagaa

SEQ ID NO: 7039893 - DNA, 20 bp, Homo sapiens
agtagcagtgtgacattgac

SEQ ID NO: 7039894 - DNA, 22 bp, Homo sapiens
agtagccattcttttatttctt

SEQ ID NO: 7039895 - DNA, 22 bp, Homo sapiens
agtagcttggccctttgttctt

SEQ ID NO: 7039896 - DNA, 22 bp, Homo sapiens
ctatatttcttggctttaaaca

SEQ ID NO: 7039897 - DNA, 22 bp, Homo sapiens
ctatcaaacagccattaatata

SEQ ID NO: 7039898 - DNA, 22 bp, Homo sapiens
ctatctcagataacctgcacca

SEQ ID NO: 7039899 - DNA, 22 bp, Homo sapiens
ctatcttggtccagtctacacc

SEQ ID NO: 7039900 - DNA, 22 bp, Homo sapiens
ctattctagtctgtcatgtcca

SEQ ID NO: 7039901 - DNA, 19 bp, Homo sapiens
agttatttctaaatttacc

SEQ ID NO: 7039902 - DNA, 19 bp, Homo sapiens
agttatttctaaatttacc

SEQ ID NO: 7039903 - DNA, 19 bp, Homo sapiens
agttatttctaaatttacc

SEQ ID NO: 7039904 - DNA, 22 bp, Homo sapiens
agttccttacatgtactgttaa

SEQ ID NO: 7039905 - DNA, 22 bp, Homo sapiens
ctgagccagctggcatgtgcta

SEQ ID NO: 7039906 - DNA, 22 bp, Homo sapiens
agtgtttatggaatcttagtta

SEQ ID NO: 7039907 - DNA, 22 bp, Homo sapiens
agtgtttattgtgtgccacaca

SEQ ID NO: 7039908 - DNA, 21 bp, Homo sapiens
ctctggagtttgaaggctggg

SEQ ID NO: 7039909 - DNA, 22 bp, Homo sapiens
agtgtacaaaatgatagataaa

SEQ ID NO: 7039910 - DNA, 21 bp, Homo sapiens
agtggggtctctgtggaggcc

SEQ ID NO: 7039911 - DNA, 22 bp, Homo sapiens
ctctggagtgggtggccgggag

SEQ ID NO: 7039912 - DNA, 22 bp, Homo sapiens
ctctggagtgtctggccagggt

SEQ ID NO: 7039913 - DNA, 22 bp, Homo sapiens
agtgcattgcatctctgcttca

SEQ ID NO: 7039914 - DNA, 19 bp, Homo sapiens
agtgcattttatgtttcaa

SEQ ID NO: 7039915 - DNA, 22 bp, Homo sapiens
agtgatgtaggtggattctggc

SEQ ID NO: 7039916 - DNA, 22 bp, Homo sapiens
agtgatgttgactagctataag

SEQ ID NO: 7039917 - DNA, 22 bp, Homo sapiens
agtgccctggacggcggcccca

SEQ ID NO: 7039918 - DNA, 22 bp, Homo sapiens
agtggaatggtgtcctgagctc

SEQ ID NO: 7039919 - DNA, 22 bp, Homo sapiens
agtcttttattcaaggctaagt

SEQ ID NO: 7039920 - DNA, 22 bp, Homo sapiens
agtgaaatagcatttatgaagc

SEQ ID NO: 7039921 - DNA, 22 bp, Homo sapiens
agtctatttccccttctcttga

SEQ ID NO: 7039922 - DNA, 22 bp, Homo sapiens
agtctattttgcttattctatg

SEQ ID NO: 7039923 - DNA, 22 bp, Homo sapiens
agtctatttttggttcttcggg

SEQ ID NO: 7039924 - DNA, 21 bp, Homo sapiens
ctcacagtctgttttccttgc

SEQ ID NO: 7039925 - DNA, 22 bp, Homo sapiens
agtctttattcactattgataa

SEQ ID NO: 7039926 - DNA, 18 bp, Homo sapiens
agtctttatttctttcat

SEQ ID NO: 7039927 - DNA, 22 bp, Homo sapiens
atcaggggagctgcgacctcag

SEQ ID NO: 7039928 - DNA, 22 bp, Homo sapiens
atcagtttaactgtcaagagcc

SEQ ID NO: 7039929 - DNA, 22 bp, Homo sapiens
atcagtttcacttgcttgcaaa

SEQ ID NO: 7039930 - DNA, 22 bp, Homo sapiens
atcagtttctgtgaagaacaca

SEQ ID NO: 7039931 - DNA, 22 bp, Homo sapiens
atcagtttttattaatgtagct

SEQ ID NO: 7039932 - DNA, 22 bp, Homo sapiens
atcataaagtgctatctgattg

SEQ ID NO: 7039933 - DNA, 22 bp, Homo sapiens
atcacaaaggtctcagagcaca

SEQ ID NO: 7039934 - DNA, 22 bp, Homo sapiens
ctgtaaataatgacagttgact

SEQ ID NO: 7039935 - DNA, 22 bp, Homo sapiens
ctgtaaatggaactatgtagta

SEQ ID NO: 7039936 - DNA, 22 bp, Homo sapiens
ctgtaacagatatcatttagca

SEQ ID NO: 7039937 - DNA, 22 bp, Homo sapiens
ctgggagcttgttaggaatgca

SEQ ID NO: 7039938 - DNA, 22 bp, Homo sapiens
ctggggctgtaggaggacttat

SEQ ID NO: 7039939 - DNA, 22 bp, Homo sapiens
ctggggctgtgggagacaaggc

SEQ ID NO: 7039940 - DNA, 22 bp, Homo sapiens
ctggggcttcaatgcttcggtg

SEQ ID NO: 7039941 - DNA, 23 bp, Homo sapiens
ctggggctttcaaatctgggcag

SEQ ID NO: 7039942 - DNA, 19 bp, Homo sapiens
ctggggctttggtactgcc

SEQ ID NO: 7039943 - DNA, 19 bp, Homo sapiens
ctggggctttggtactgcc

SEQ ID NO: 7039944 - DNA, 22 bp, Homo sapiens
ctgggggcaagcagacagctgt

SEQ ID NO: 7039945 - DNA, 22 bp, Homo sapiens
atattattctagctcttgtgtg

SEQ ID NO: 7039946 - DNA, 22 bp, Homo sapiens
atattcaaattacatttactaa

SEQ ID NO: 7039947 - DNA, 18 bp, Homo sapiens
atattcaagaagacagag

SEQ ID NO: 7039948 - DNA, 22 bp, Homo sapiens
ctgggtggatcgcagccccagg

SEQ ID NO: 7039949 - DNA, 22 bp, Homo sapiens
atctccttggatcacgtttagt

SEQ ID NO: 7039950 - DNA, 22 bp, Homo sapiens
atctctatctttattgaaatct

SEQ ID NO: 7039951 - DNA, 23 bp, Homo sapiens
cttctgtgcaagagggagggaaa

SEQ ID NO: 7039952 - DNA, 22 bp, Homo sapiens
cttcttaaattggattgctatt

SEQ ID NO: 7039953 - DNA, 22 bp, Homo sapiens
cttcttaatcccttatatattt

SEQ ID NO: 7039954 - DNA, 22 bp, Homo sapiens
cttcttaatgacagattaaaat

SEQ ID NO: 7039955 - DNA, 22 bp, Homo sapiens
cttatgatctagaactaggtat

SEQ ID NO: 7039956 - DNA, 22 bp, Homo sapiens
cttattataaaatcctgtttga

SEQ ID NO: 7039957 - DNA, 22 bp, Homo sapiens
cttattatggcatgtaagtggg

SEQ ID NO: 7039958 - DNA, 22 bp, Homo sapiens
cttcaaattcgaggagtagatg

SEQ ID NO: 7039959 - DNA, 22 bp, Homo sapiens
ctgtttctcccaacgccctagt

SEQ ID NO: 7039960 - DNA, 22 bp, Homo sapiens
ctgtttctcccatgtccaagtg

SEQ ID NO: 7039961 - DNA, 22 bp, Homo sapiens
atccattctatgtgaaatgtcc

SEQ ID NO: 7039962 - DNA, 22 bp, Homo sapiens
atatacacatgtgtatacattt

SEQ ID NO: 7039963 - DNA, 22 bp, Homo sapiens
atatacactccactgatacagg

SEQ ID NO: 7039964 - DNA, 22 bp, Homo sapiens
atatacatgggaatatgtggag

SEQ ID NO: 7039965 - DNA, 22 bp, Homo sapiens
atatacctcattctttgagtgc

SEQ ID NO: 7039966 - DNA, 22 bp, Homo sapiens
atatactgatagctgcacttct

SEQ ID NO: 7039967 - DNA, 22 bp, Homo sapiens
atatacttgatttaactgagca

SEQ ID NO: 7039968 - DNA, 22 bp, Homo sapiens
atatacttggagactatcattg

SEQ ID NO: 7039969 - DNA, 22 bp, Homo sapiens
ctgggagctggaatgggagaag

SEQ ID NO: 7039970 - DNA, 21 bp, Homo sapiens
atacacatacacataaatgtg

SEQ ID NO: 7039971 - DNA, 22 bp, Homo sapiens
atacacatatgtgtgtatatgt

SEQ ID NO: 7039972 - DNA, 22 bp, Homo sapiens
atacacatctatttaagagaca

SEQ ID NO: 7039973 - DNA, 22 bp, Homo sapiens
ctgcctggtctcaggcatgggg

SEQ ID NO: 7039974 - DNA, 22 bp, Homo sapiens
ataaacttgagtctcagagtat

SEQ ID NO: 7039975 - DNA, 19 bp, Homo sapiens
gagcgcagagggcagggga

SEQ ID NO: 7039976 - DNA, 22 bp, Homo sapiens
gagaggctctgaggactggggt

SEQ ID NO: 7039977 - DNA, 22 bp, Homo sapiens
gagaggagaagcctgcgcttca

SEQ ID NO: 7039978 - DNA, 22 bp, Homo sapiens
gagaggctgatcctgcagagaa

SEQ ID NO: 7039979 - DNA, 22 bp, Homo sapiens
gagaggctgggttggagatcga

SEQ ID NO: 7039980 - DNA, 22 bp, Homo sapiens
gagaggtgaatgtggatgccac

SEQ ID NO: 7039981 - DNA, 22 bp, Homo sapiens
atgtacaaaatgttttgaaatg

SEQ ID NO: 7039982 - DNA, 22 bp, Homo sapiens
atgtatttgaaatttgagacat

SEQ ID NO: 7039983 - DNA, 22 bp, Homo sapiens
atgtaacacccacttttatagc

SEQ ID NO: 7039984 - DNA, 22 bp, Homo sapiens
atgtaacacccacttttatagc

SEQ ID NO: 7039985 - DNA, 22 bp, Homo sapiens
gagggaaacagatgggttgtgg

SEQ ID NO: 7039986 - DNA, 22 bp, Homo sapiens
gaggtacatgaggatacacagg

SEQ ID NO: 7039987 - DNA, 22 bp, Homo sapiens
gagtccaggatttgagctctgt

SEQ ID NO: 7039988 - DNA, 22 bp, Homo sapiens
atgtttcaagagaaaaagagac

SEQ ID NO: 7039989 - DNA, 22 bp, Homo sapiens
atgtttcaccagcaaattacct

SEQ ID NO: 7039990 - DNA, 22 bp, Homo sapiens
atgtttcaccagttttataaga

SEQ ID NO: 7039991 - DNA, 22 bp, Homo sapiens
atgtttcaggcgaactaacatg

SEQ ID NO: 7039992 - DNA, 22 bp, Homo sapiens
atgtttcatcagtaaggttttg

SEQ ID NO: 7039993 - DNA, 22 bp, Homo sapiens
atgtttctaaaacttgcatggc

SEQ ID NO: 7039994 - DNA, 22 bp, Homo sapiens
gacagtggagccacgttgggag

SEQ ID NO: 7039995 - DNA, 22 bp, Homo sapiens
gacagtggttccaaggcagctt

SEQ ID NO: 7039996 - DNA, 22 bp, Homo sapiens
gaccccatctggctgccccagg

SEQ ID NO: 7039997 - DNA, 22 bp, Homo sapiens
atgctttctcttagttcattga

SEQ ID NO: 7039998 - DNA, 22 bp, Homo sapiens
atgcccaggcccatacctagat

SEQ ID NO: 7039999 - DNA, 22 bp, Homo sapiens
atgcaagggtaaccccagacat

SEQ ID NO: 7040000 - DNA, 22 bp, Homo sapiens
atgcaaatgaacatgttgctag

SEQ ID NO: 7040001 - DNA, 22 bp, Homo sapiens
atgcaaatgcagccattgcaga

SEQ ID NO: 7040002 - DNA, 22 bp, Homo sapiens
atgcaaatgctagagaatgttg

SEQ ID NO: 7040003 - DNA, 22 bp, Homo sapiens
gaacatttatgatgcaatacct

SEQ ID NO: 7040004 - DNA, 22 bp, Homo sapiens
gaactttataactgtaaatgtc

SEQ ID NO: 7040005 - DNA, 22 bp, Homo sapiens
gaaaatgtgcctttgggtattg

SEQ ID NO: 7040006 - DNA, 22 bp, Homo sapiens
atgaggcatagcagggatcgga

SEQ ID NO: 7040007 - DNA, 22 bp, Homo sapiens
atgaggcatgtgaggagaaggg

SEQ ID NO: 7040008 - DNA, 22 bp, Homo sapiens
atgaggcattcacagaaggcac

SEQ ID NO: 7040009 - DNA, 19 bp, Homo sapiens
gaacaatttgttagctctc

SEQ ID NO: 7040010 - DNA, 22 bp, Homo sapiens
gctcaggggaatgggctgccgt

SEQ ID NO: 7040011 - DNA, 22 bp, Homo sapiens
gctcggtggccagcctgaggcc

SEQ ID NO: 7040012 - DNA, 22 bp, Homo sapiens
gctattcatggagcatgtactg

SEQ ID NO: 7040013 - DNA, 22 bp, Homo sapiens
gctctgggtgaatggcagattg

SEQ ID NO: 7040014 - DNA, 22 bp, Homo sapiens
caaatgtgttttttcttctaca

SEQ ID NO: 7040015 - DNA, 22 bp, Homo sapiens
gccagagggattcctggtgtgt

SEQ ID NO: 7040016 - DNA, 18 bp, Homo sapiens
gccagagggcccaaggtc

SEQ ID NO: 7040017 - DNA, 18 bp, Homo sapiens
gccagagggcccaaggtc

SEQ ID NO: 7040018 - DNA, 22 bp, Homo sapiens
gccagaggggctcgaaggcgcg

SEQ ID NO: 7040019 - DNA, 22 bp, Homo sapiens
gcccactccagcttctcccaca

SEQ ID NO: 7040020 - DNA, 22 bp, Homo sapiens
gcccaggaggttgggctgtgca

SEQ ID NO: 7040021 - DNA, 22 bp, Homo sapiens
gcccaggagttcaaggctgcag

SEQ ID NO: 7040022 - DNA, 22 bp, Homo sapiens
gcccaggagttcaagtctagtg

SEQ ID NO: 7040023 - DNA, 22 bp, Homo sapiens
atttgcatgacctttgcaagtg

SEQ ID NO: 7040024 - DNA, 22 bp, Homo sapiens
atttgccttggtgatttgtaaa

SEQ ID NO: 7040025 - DNA, 22 bp, Homo sapiens
atttgccttgtgatttgtaagt

SEQ ID NO: 7040026 - DNA, 22 bp, Homo sapiens
atttgcctttcgaatcaacagg

SEQ ID NO: 7040027 - DNA, 22 bp, Homo sapiens
attttaataagatccatttggt

SEQ ID NO: 7040028 - DNA, 22 bp, Homo sapiens
attttaataagattcccaagta

SEQ ID NO: 7040029 - DNA, 22 bp, Homo sapiens
attttaataagattcccaagta

SEQ ID NO: 7040030 - DNA, 23 bp, Homo sapiens
attttacaggtcagttccttgaa

SEQ ID NO: 7040031 - DNA, 23 bp, Homo sapiens
attttacaggtcagttccttgaa

SEQ ID NO: 7040032 - DNA, 22 bp, Homo sapiens
attttacataaggaaggtttaa

SEQ ID NO: 7040033 - DNA, 22 bp, Homo sapiens
attttactaagtggatatctgt

SEQ ID NO: 7040034 - DNA, 22 bp, Homo sapiens
attttactaagtggatatctgt

SEQ ID NO: 7040035 - DNA, 22 bp, Homo sapiens
gcagggctgggatttgagccca

SEQ ID NO: 7040036 - DNA, 16 bp, Homo sapiens
gcaggggtgggtggag

SEQ ID NO: 7040037 - DNA, 22 bp, Homo sapiens
gcaggtggatattgctacttga

SEQ ID NO: 7040038 - DNA, 22 bp, Homo sapiens
attggcagttagtgacgaggct

SEQ ID NO: 7040039 - DNA, 22 bp, Homo sapiens
attgtaaaagtattctaagatt

SEQ ID NO: 7040040 - DNA, 18 bp, Homo sapiens
gcaggagatgggtggggt

SEQ ID NO: 7040041 - DNA, 22 bp, Homo sapiens
gcaggatgccagggcagcagcg

SEQ ID NO: 7040042 - DNA, 22 bp, Homo sapiens
gcagggactttggcaacaggtg

SEQ ID NO: 7040043 - DNA, 22 bp, Homo sapiens
gcattcactgggtgttcatggg

SEQ ID NO: 7040044 - DNA, 22 bp, Homo sapiens
gcaaacaaggacatacatcctg

SEQ ID NO: 7040045 - DNA, 22 bp, Homo sapiens
gcaacacagatcttctttgttg

SEQ ID NO: 7040046 - DNA, 22 bp, Homo sapiens
atgtttctaaaacttgcatggc

SEQ ID NO: 7040047 - DNA, 22 bp, Homo sapiens
atgtttctacagcgtccactga

SEQ ID NO: 7040048 - DNA, 22 bp, Homo sapiens
atgtttctacagcgtccactga

SEQ ID NO: 7040049 - DNA, 22 bp, Homo sapiens
atgtttctagagctttgtccca

SEQ ID NO: 7040050 - DNA, 22 bp, Homo sapiens
atgtttctagttgtatgtcact

SEQ ID NO: 7040051 - DNA, 22 bp, Homo sapiens
atgtttctataaagaagtttgg

SEQ ID NO: 7040052 - DNA, 22 bp, Homo sapiens
atgtttctataaagaagtttgg

SEQ ID NO: 7040053 - DNA, 22 bp, Homo sapiens
atgtttctcactgtttctctat

SEQ ID NO: 7040054 - DNA, 22 bp, Homo sapiens
gatttctgggctttatttcaga

SEQ ID NO: 7040055 - DNA, 22 bp, Homo sapiens
gatttctgtggcttgtacatat

SEQ ID NO: 7040056 - DNA, 22 bp, Homo sapiens
gcaaaaattccagggacgactc

SEQ ID NO: 7040057 - DNA, 22 bp, Homo sapiens
gcaaaagtacagccggatttct

SEQ ID NO: 7040058 - DNA, 22 bp, Homo sapiens
gcagaatacattttgttttcct

SEQ ID NO: 7040059 - DNA, 22 bp, Homo sapiens
gcagaatactgagagctgattg

SEQ ID NO: 7040060 - DNA, 22 bp, Homo sapiens
gcagaatagggcataactttgc

SEQ ID NO: 7040061 - DNA, 22 bp, Homo sapiens
gcagaggctgggtgtcccagtc

SEQ ID NO: 7040062 - DNA, 22 bp, Homo sapiens
gcagaggctgtagggaaggttg

SEQ ID NO: 7040063 - DNA, 22 bp, Homo sapiens
gcagcaggtccgcatcatcatc

SEQ ID NO: 7040064 - DNA, 22 bp, Homo sapiens
gcagccaggctacagcgggctt

SEQ ID NO: 7040065 - DNA, 22 bp, Homo sapiens
gcagccagggctaagctgggga

SEQ ID NO: 7040066 - DNA, 22 bp, Homo sapiens
gcagccaggggctgtgacctgt

SEQ ID NO: 7040067 - DNA, 22 bp, Homo sapiens
gcaggagagccagcaggcttcc

SEQ ID NO: 7040068 - DNA, 22 bp, Homo sapiens
gcaggagagtctgtgccaggtt

SEQ ID NO: 7040069 - DNA, 21 bp, Homo sapiens
gctgggcctgtacttgccctg

SEQ ID NO: 7040070 - DNA, 22 bp, Homo sapiens
gctgggccctgggtgccctagc

SEQ ID NO: 7040071 - DNA, 22 bp, Homo sapiens
gctgggccgacctgggctgcag

SEQ ID NO: 7040072 - DNA, 22 bp, Homo sapiens
gctgggccccatccctcgagca

SEQ ID NO: 7040073 - DNA, 23 bp, Homo sapiens
caaattctaggcaggctcttttg

SEQ ID NO: 7040074 - DNA, 22 bp, Homo sapiens
caaattctcaccctgtttgatt

SEQ ID NO: 7040075 - DNA, 22 bp, Homo sapiens
caaattctcttactgtttgaca

SEQ ID NO: 7040076 - DNA, 20 bp, Homo sapiens
gctgaggtccctgtggtttt

SEQ ID NO: 7040077 - DNA, 22 bp, Homo sapiens
caagttcacgttgctttttgag

SEQ ID NO: 7040078 - DNA, 22 bp, Homo sapiens
caagttcacttgtctacaaggg

SEQ ID NO: 7040079 - DNA, 22 bp, Homo sapiens
caagttcattgtagcattattg

SEQ ID NO: 7040080 - DNA, 22 bp, Homo sapiens
caatgggcctggagagagctgg

SEQ ID NO: 7040081 - DNA, 22 bp, Homo sapiens
caatgggcggaatcgggaggcg

SEQ ID NO: 7040082 - DNA, 22 bp, Homo sapiens
caatgtatcaaccagaaagttc

SEQ ID NO: 7040083 - DNA, 22 bp, Homo sapiens
gcttccagcaccagcagagggg

SEQ ID NO: 7040084 - DNA, 22 bp, Homo sapiens
ggaacacagtgccttacaaact

SEQ ID NO: 7040085 - DNA, 22 bp, Homo sapiens
cacaggagaaaggggaagctcg

SEQ ID NO: 7040086 - DNA, 22 bp, Homo sapiens
cacaggagagctgggaggtgcc

SEQ ID NO: 7040087 - DNA, 18 bp, Homo sapiens
cacaggagatgacctgac

SEQ ID NO: 7040088 - DNA, 22 bp, Homo sapiens
ggaacagactgacttcttgaat

SEQ ID NO: 7040089 - DNA, 22 bp, Homo sapiens
ggacaattcagtgatttgggga

SEQ ID NO: 7040090 - DNA, 22 bp, Homo sapiens
ggacagcacagctcttgacaac

SEQ ID NO: 7040091 - DNA, 22 bp, Homo sapiens
ggagatatttgtattctgtctc

SEQ ID NO: 7040092 - DNA, 22 bp, Homo sapiens
cacagagacagatctattttgc

SEQ ID NO: 7040093 - DNA, 17 bp, Homo sapiens
ggcttcagggagctggg

SEQ ID NO: 7040094 - DNA, 22 bp, Homo sapiens
ggctgcagcggattggggattg

SEQ ID NO: 7040095 - DNA, 22 bp, Homo sapiens
ggctgcagcagagggactcacg

SEQ ID NO: 7040096 - DNA, 22 bp, Homo sapiens
ggctgcagccctcgcctagcca

SEQ ID NO: 7040097 - DNA, 22 bp, Homo sapiens
ggctgcagaggtcactttatag

SEQ ID NO: 7040098 - DNA, 22 bp, Homo sapiens
ggctgcagatagccagccacca

SEQ ID NO: 7040099 - DNA, 22 bp, Homo sapiens
ggctgcagattgtagtctgtta

SEQ ID NO: 7040100 - DNA, 22 bp, Homo sapiens
ggctgcggccgcgggtctgtgc

SEQ ID NO: 7040101 - DNA, 22 bp, Homo sapiens
ggctgctcacgcagccctccct

SEQ ID NO: 7040102 - DNA, 22 bp, Homo sapiens
ggcgcccatcggtgcagagggc

SEQ ID NO: 7040103 - DNA, 22 bp, Homo sapiens
ggccccagcctcagtcccctga

SEQ ID NO: 7040104 - DNA, 22 bp, Homo sapiens
ggcccagcacagtgcttggggg

SEQ ID NO: 7040105 - DNA, 22 bp, Homo sapiens
ggcccagcatcttgtgaagttt

SEQ ID NO: 7040106 - DNA, 22 bp, Homo sapiens
ggcccagcccgagtcagccttc

SEQ ID NO: 7040107 - DNA, 22 bp, Homo sapiens
ggccagggccaaggctttccca

SEQ ID NO: 7040108 - DNA, 18 bp, Homo sapiens
ggccagctcctgaggcag

SEQ ID NO: 7040109 - DNA, 18 bp, Homo sapiens
ggccagctcctgaggcag

SEQ ID NO: 7040110 - DNA, 21 bp, Homo sapiens
ggagtttttctggaagggact

SEQ ID NO: 7040111 - DNA, 22 bp, Homo sapiens
cacatttctggaattgacttgg

SEQ ID NO: 7040112 - DNA, 22 bp, Homo sapiens
gtgcctgggggtaatgtaggat

SEQ ID NO: 7040113 - DNA, 22 bp, Homo sapiens
cagctcaggaaggaaggccggc

SEQ ID NO: 7040114 - DNA, 22 bp, Homo sapiens
gtctttctgccatgtgaagaga

SEQ ID NO: 7040115 - DNA, 20 bp, Homo sapiens
gtctccactgggggttaacc

SEQ ID NO: 7040116 - DNA, 22 bp, Homo sapiens
cagcaggttctacgggtgagat

SEQ ID NO: 7040117 - DNA, 22 bp, Homo sapiens
cagcagtgatgtgtgagggttc

SEQ ID NO: 7040118 - DNA, 22 bp, Homo sapiens
cagcagtgcttcagtgtgagat

SEQ ID NO: 7040119 - DNA, 22 bp, Homo sapiens
cagcagtggccatctgtgtggt

SEQ ID NO: 7040120 - DNA, 22 bp, Homo sapiens
ggtggctggaggagctgatgga

SEQ ID NO: 7040121 - DNA, 22 bp, Homo sapiens
gtaagaaaaccttctttctaat

SEQ ID NO: 7040122 - DNA, 21 bp, Homo sapiens
cagaggctgagagggcaatct

SEQ ID NO: 7040123 - DNA, 22 bp, Homo sapiens
cagaggctgatggctgtagcca

SEQ ID NO: 7040124 - DNA, 22 bp, Homo sapiens
cagaggctgccagccatgtgca

SEQ ID NO: 7040125 - DNA, 22 bp, Homo sapiens
cagaggctgctctgggtggcat

SEQ ID NO: 7040126 - DNA, 22 bp, Homo sapiens
ggggtgagctgggcctgtgcct

SEQ ID NO: 7040127 - DNA, 18 bp, Homo sapiens
cagagtgggccaagagac

SEQ ID NO: 7040128 - DNA, 22 bp, Homo sapiens
cagatacaggtttttgttagat

SEQ ID NO: 7040129 - DNA, 22 bp, Homo sapiens
cagatacattaaaatgatgatt

SEQ ID NO: 7040130 - DNA, 22 bp, Homo sapiens
cagatactgtaaaatttcagta

SEQ ID NO: 7040131 - DNA, 22 bp, Homo sapiens
cagatataaatggatgtggtag

SEQ ID NO: 7040132 - DNA, 22 bp, Homo sapiens
cagatatattcatttgcagtgc

SEQ ID NO: 7040133 - DNA, 22 bp, Homo sapiens
ggtgagaggcagaggacagctt

SEQ ID NO: 7040134 - DNA, 22 bp, Homo sapiens
gggggaggtgaatgcaataagg

SEQ ID NO: 7040135 - DNA, 22 bp, Homo sapiens
gggctcaggtcagggcatcagc

SEQ ID NO: 7040136 - DNA, 22 bp, Homo sapiens
ccaaaaattagatacacatata

SEQ ID NO: 7040137 - DNA, 22 bp, Homo sapiens
cattttaagatgacctggtttc

SEQ ID NO: 7040138 - DNA, 19 bp, Homo sapiens
cattttaagcatccccagt

SEQ ID NO: 7040139 - DNA, 22 bp, Homo sapiens
cattttatcctctgggaagcta

SEQ ID NO: 7040140 - DNA, 22 bp, Homo sapiens
cattttatgtttatggagtgct

SEQ ID NO: 7040141 - DNA, 22 bp, Homo sapiens
catttcacgcacactcattact

SEQ ID NO: 7040142 - DNA, 22 bp, Homo sapiens
catttcatagttgtcacaataa

SEQ ID NO: 7040143 - DNA, 22 bp, Homo sapiens
catttcattcctttgaaagtgg

SEQ ID NO: 7040144 - DNA, 22 bp, Homo sapiens
ccaagaggaccttgccagggca

SEQ ID NO: 7040145 - DNA, 22 bp, Homo sapiens
ccaagaggcagaatgcagagaa

SEQ ID NO: 7040146 - DNA, 19 bp, Homo sapiens
tcctgcccaccagccaggg

SEQ ID NO: 7040147 - DNA, 22 bp, Homo sapiens
ccacagggaacatgacagcctt

SEQ ID NO: 7040148 - DNA, 22 bp, Homo sapiens
ccagagagggcgccacctggag

SEQ ID NO: 7040149 - DNA, 22 bp, Homo sapiens
ccagagggaactgggcctcatt

SEQ ID NO: 7040150 - DNA, 22 bp, Homo sapiens
ccagagggccctggtctcagct

SEQ ID NO: 7040151 - DNA, 22 bp, Homo sapiens
ccagaggggctgagcaggtcac

SEQ ID NO: 7040152 - DNA, 22 bp, Homo sapiens
ccagaggtcccctgccaggagg

SEQ ID NO: 7040153 - DNA, 22 bp, Homo sapiens
ccagaggtcctgctcactggtg

SEQ ID NO: 7040154 - DNA, 22 bp, Homo sapiens
ccagaggtcctgtgatgctgca

SEQ ID NO: 7040155 - DNA, 22 bp, Homo sapiens
ccagaggtctcctgcacgggat

SEQ ID NO: 7040156 - DNA, 22 bp, Homo sapiens
ccagaggtctctctatactggg

SEQ ID NO: 7040157 - DNA, 22 bp, Homo sapiens
ccagaggtgaacaggaggctgt

SEQ ID NO: 7040158 - DNA, 22 bp, Homo sapiens
ccagaggtgagggggattcttg

SEQ ID NO: 7040159 - DNA, 22 bp, Homo sapiens
tctctgggataaactgggccag

SEQ ID NO: 7040160 - DNA, 22 bp, Homo sapiens
tctctgtaaggaagaattagat

SEQ ID NO: 7040161 - DNA, 22 bp, Homo sapiens
catgtggctttggcatgtgccc

SEQ ID NO: 7040162 - DNA, 22 bp, Homo sapiens
catgtggctttggcatgtgccc

SEQ ID NO: 7040163 - DNA, 22 bp, Homo sapiens
cattacaaacatgttaagattt

SEQ ID NO: 7040164 - DNA, 22 bp, Homo sapiens
cattacaaccccaaattacaaa

SEQ ID NO: 7040165 - DNA, 22 bp, Homo sapiens
catgcttgctgcctcattgttc

SEQ ID NO: 7040166 - DNA, 22 bp, Homo sapiens
tccagaggtgaacacccaggca

SEQ ID NO: 7040167 - DNA, 19 bp, Homo sapiens
catatttttgggctggcat

SEQ ID NO: 7040168 - DNA, 22 bp, Homo sapiens
catcagttcccaggcccagaca

SEQ ID NO: 7040169 - DNA, 22 bp, Homo sapiens
catccctgtctgccactctgaa

SEQ ID NO: 7040170 - DNA, 22 bp, Homo sapiens
tcataacactggtgattaagaa

SEQ ID NO: 7040171 - DNA, 22 bp, Homo sapiens
tagttttacatcagccattgtt

SEQ ID NO: 7040172 - DNA, 22 bp, Homo sapiens
tagttttacttgcgatgataat

SEQ ID NO: 7040173 - DNA, 22 bp, Homo sapiens
tagttttagcagcaatgggatg

SEQ ID NO: 7040174 - DNA, 22 bp, Homo sapiens
tagttttagtcccattttacag

SEQ ID NO: 7040175 - DNA, 22 bp, Homo sapiens
tatataactactattttgctca

SEQ ID NO: 7040176 - DNA, 22 bp, Homo sapiens
tatatacaaggtaggtttaggt

SEQ ID NO: 7040177 - DNA, 22 bp, Homo sapiens
tatatacaaggtaggtttaggt

SEQ ID NO: 7040178 - DNA, 22 bp, Homo sapiens
cagggccacacggaagggaaca

SEQ ID NO: 7040179 - DNA, 22 bp, Homo sapiens
cagggccaagttggtgcctttt

SEQ ID NO: 7040180 - DNA, 20 bp, Homo sapiens
cagggccacgctccaaggca

SEQ ID NO: 7040181 - DNA, 22 bp, Homo sapiens
tatattctgattccatctgtgt

SEQ ID NO: 7040182 - DNA, 22 bp, Homo sapiens
tatgatattctaaattgacacc

SEQ ID NO: 7040183 - DNA, 22 bp, Homo sapiens
tatgcaaactaagttgtttcct

SEQ ID NO: 7040184 - DNA, 22 bp, Homo sapiens
tatgcaaatgactggtatgttt

SEQ ID NO: 7040185 - DNA, 22 bp, Homo sapiens
caggtgggcgtggcgagaaggc

SEQ ID NO: 7040186 - DNA, 22 bp, Homo sapiens
caggtgggctgcctctccagct

SEQ ID NO: 7040187 - DNA, 22 bp, Homo sapiens
caggtggggagagtgtggagca

SEQ ID NO: 7040188 - DNA, 22 bp, Homo sapiens
caggtggggcagctgtgggagc

SEQ ID NO: 7040189 - DNA, 22 bp, Homo sapiens
caggtggggcgccctcaggcag

SEQ ID NO: 7040190 - DNA, 22 bp, Homo sapiens
caggtggggggcttccgagcct

SEQ ID NO: 7040191 - DNA, 22 bp, Homo sapiens
tattccaacttcactattgtct

SEQ ID NO: 7040192 - DNA, 22 bp, Homo sapiens
tattccaagcacagcaacccag

SEQ ID NO: 7040193 - DNA, 20 bp, Homo sapiens
tattccaagggtagagaaaa

SEQ ID NO: 7040194 - DNA, 22 bp, Homo sapiens
tattccaagtcactgtgtcctg

SEQ ID NO: 7040195 - DNA, 22 bp, Homo sapiens
tattccaagtgcctagaagagt

SEQ ID NO: 7040196 - DNA, 22 bp, Homo sapiens
tattccaatgtcagttatatca

SEQ ID NO: 7040197 - DNA, 22 bp, Homo sapiens
tattccaattggttgtaaagaa

SEQ ID NO: 7040198 - DNA, 22 bp, Homo sapiens
tcaaagcacacttagtggtaga

SEQ ID NO: 7040199 - DNA, 22 bp, Homo sapiens
cagtcctcagtgagtgatcctg

SEQ ID NO: 7040200 - DNA, 22 bp, Homo sapiens
cagtctctcagctttcagctgt

SEQ ID NO: 7040201 - DNA, 23 bp, Homo sapiens
cagtctctccccggacagcaaaa

SEQ ID NO: 7040202 - DNA, 22 bp, Homo sapiens
cagtctctctccttgcaggcgt

SEQ ID NO: 7040203 - DNA, 22 bp, Homo sapiens
cagtctttgacaagccctttca

SEQ ID NO: 7040204 - DNA, 22 bp, Homo sapiens
cagtctttgatgcatcctagcc

SEQ ID NO: 7040205 - DNA, 22 bp, Homo sapiens
cagtctttgttcccattactga

SEQ ID NO: 7040206 - DNA, 22 bp, Homo sapiens
cagtcttttgtatattagcaga

SEQ ID NO: 7040207 - DNA, 19 bp, Homo sapiens
tcaaattcctaagttctgg

SEQ ID NO: 7040208 - DNA, 22 bp, Homo sapiens
cagtggaggccttgggaccttt

SEQ ID NO: 7040209 - DNA, 22 bp, Homo sapiens
cagtggaggctcaagtgtgctt

SEQ ID NO: 7040210 - DNA, 22 bp, Homo sapiens
tcacatggcgagctttaaaata

SEQ ID NO: 7040211 - DNA, 22 bp, Homo sapiens
tcacattcatggtgctaataaa

SEQ ID NO: 7040212 - DNA, 22 bp, Homo sapiens
cagtggcacccacgggctgggc

SEQ ID NO: 7040213 - DNA, 22 bp, Homo sapiens
cagtggcacgatctcagctcac

SEQ ID NO: 7040214 - DNA, 22 bp, Homo sapiens
cagtggcagagccgttgccatc

SEQ ID NO: 7040215 - DNA, 22 bp, Homo sapiens
cagtggcaggatttcagctcag

SEQ ID NO: 7040216 - DNA, 22 bp, Homo sapiens
cagggatgagagatggcacaga

SEQ ID NO: 7040217 - DNA, 22 bp, Homo sapiens
tagcagcaaaatgaccttctaa

SEQ ID NO: 7040218 - DNA, 22 bp, Homo sapiens
tagcagcaaagcaggatctgct

SEQ ID NO: 7040219 - DNA, 22 bp, Homo sapiens
tagcagcacaaatggactatga

SEQ ID NO: 7040220 - DNA, 22 bp, Homo sapiens
cagggagcggagtcccatgcct

SEQ ID NO: 7040221 - DNA, 22 bp, Homo sapiens
cagggagctttgtcttctcatt

SEQ ID NO: 7040222 - DNA, 22 bp, Homo sapiens
tagcagcacctacacgtcagag

SEQ ID NO: 7040223 - DNA, 22 bp, Homo sapiens
tagcagcacctttctaatctga

SEQ ID NO: 7040224 - DNA, 20 bp, Homo sapiens
tagcagcagaaagaacttag

SEQ ID NO: 7040225 - DNA, 22 bp, Homo sapiens
tagcagcaggggaaacagctgt

SEQ ID NO: 7040226 - DNA, 22 bp, Homo sapiens
cagggccaagcccctttggctg

SEQ ID NO: 7040227 - DNA, 22 bp, Homo sapiens
cagggccaagctgcagcatctg

SEQ ID NO: 7040228 - DNA, 22 bp, Homo sapiens
tacctcaagttccaggaaagcg

SEQ ID NO: 7040229 - DNA, 22 bp, Homo sapiens
tagaaatgttggtattaacatt

SEQ ID NO: 7040230 - DNA, 22 bp, Homo sapiens
cagggagaggcctctgttgccc

SEQ ID NO: 7040231 - DNA, 22 bp, Homo sapiens
cagggagaggctggtggagtaa

SEQ ID NO: 7040232 - DNA, 22 bp, Homo sapiens
cagggagaggcctctgttgccc

SEQ ID NO: 7040233 - DNA, 22 bp, Homo sapiens
cagggagatcttggctcctggt

SEQ ID NO: 7040234 - DNA, 22 bp, Homo sapiens
tagacatagtttttatgactta

SEQ ID NO: 7040235 - DNA, 22 bp, Homo sapiens
tagacatattgtatttacttaa

SEQ ID NO: 7040236 - DNA, 22 bp, Homo sapiens
tacaatatgtgaactttggtgt

SEQ ID NO: 7040237 - DNA, 22 bp, Homo sapiens
tacacagactcttcaattcaga

SEQ ID NO: 7040238 - DNA, 22 bp, Homo sapiens
tacacagatttaaaagcaggga

SEQ ID NO: 7040239 - DNA, 22 bp, Homo sapiens
tacacaggctgcctctttgcat

SEQ ID NO: 7040240 - DNA, 22 bp, Homo sapiens
tacacagggagagattggaaac

SEQ ID NO: 7040241 - DNA, 22 bp, Homo sapiens
caggccctctgcaccctcgtct

SEQ ID NO: 7040242 - DNA, 22 bp, Homo sapiens
caggccctgcacagtggtcctg

SEQ ID NO: 7040243 - DNA, 22 bp, Homo sapiens
caggccctgcactaggccctgg

SEQ ID NO: 7040244 - DNA, 22 bp, Homo sapiens
tacagagaggtgacccttgggc

SEQ ID NO: 7040245 - DNA, 22 bp, Homo sapiens
tacagcctcttccctggagtgg

SEQ ID NO: 7040246 - DNA, 22 bp, Homo sapiens
caggcctgtgagttgaggcccc

SEQ ID NO: 7040247 - DNA, 22 bp, Homo sapiens
tacagttcacagtatcataaat

SEQ ID NO: 7040248 - DNA, 22 bp, Homo sapiens
tacagtttaacactttggagaa

SEQ ID NO: 7040249 - DNA, 22 bp, Homo sapiens
tacagtttagaaccatagatgg

SEQ ID NO: 7040250 - DNA, 22 bp, Homo sapiens
tacagtttcccagcagatgcaa

SEQ ID NO: 7040251 - DNA, 22 bp, Homo sapiens
tacagtttctcattatgctctc

SEQ ID NO: 7040252 - DNA, 22 bp, Homo sapiens
tacagtttctgtccttgtggag

SEQ ID NO: 7040253 - DNA, 22 bp, Homo sapiens
tacagtttgtatggtcaggaat

SEQ ID NO: 7040254 - DNA, 22 bp, Homo sapiens
ccccagctgagatttgaggaga

SEQ ID NO: 7040255 - DNA, 22 bp, Homo sapiens
cccagtgtctgggcctgcaggg

SEQ ID NO: 7040256 - DNA, 22 bp, Homo sapiens
cccagtgtctgggcctgcaggg

SEQ ID NO: 7040257 - DNA, 22 bp, Homo sapiens
tgctgtttcattttcctcatcc

SEQ ID NO: 7040258 - DNA, 22 bp, Homo sapiens
tgctgtttgagcttattttcag

SEQ ID NO: 7040259 - DNA, 22 bp, Homo sapiens
tgctgcaggcagcccctctact

SEQ ID NO: 7040260 - DNA, 22 bp, Homo sapiens
tgctgcaggcaatagaaaacct

SEQ ID NO: 7040261 - DNA, 19 bp, Homo sapiens
cccagtctaggtcctagga

SEQ ID NO: 7040262 - DNA, 20 bp, Homo sapiens
cccagtgaagcatggaagag

SEQ ID NO: 7040263 - DNA, 22 bp, Homo sapiens
cccagtggctgtccccatgggc

SEQ ID NO: 7040264 - DNA, 21 bp, Homo sapiens
tgctaagtgtcacatgtctgc

SEQ ID NO: 7040265 - DNA, 22 bp, Homo sapiens
tgctaattcaaagggtagttag

SEQ ID NO: 7040266 - DNA, 22 bp, Homo sapiens
tgctacttttgaaatcttcctt

SEQ ID NO: 7040267 - DNA, 22 bp, Homo sapiens
tgctagggatacagtggtgaat

SEQ ID NO: 7040268 - DNA, 19 bp, Homo sapiens
tggcagggagagtttgaag

SEQ ID NO: 7040269 - DNA, 22 bp, Homo sapiens
tggcagggaatacagatgttta

SEQ ID NO: 7040270 - DNA, 22 bp, Homo sapiens
tggcaggaaaaacattggagat

SEQ ID NO: 7040271 - DNA, 22 bp, Homo sapiens
ccctgggagaagttgagggctg

SEQ ID NO: 7040272 - DNA, 22 bp, Homo sapiens
tggcagagaacacacatgattc

SEQ ID NO: 7040273 - DNA, 22 bp, Homo sapiens
ccctccctgtgtgcctcatttg

SEQ ID NO: 7040274 - DNA, 22 bp, Homo sapiens
tggaaactaagactagagagac

SEQ ID NO: 7040275 - DNA, 22 bp, Homo sapiens
tggaaactaggatggaagaaat

SEQ ID NO: 7040276 - DNA, 22 bp, Homo sapiens
tggaaactatagtcacaataga

SEQ ID NO: 7040277 - DNA, 22 bp, Homo sapiens
tggaggagaactccctggctac

SEQ ID NO: 7040278 - DNA, 22 bp, Homo sapiens
cctcctggggtgaaggatggga

SEQ ID NO: 7040279 - DNA, 20 bp, Homo sapiens
cctcctggtcaggtgtgcag

SEQ ID NO: 7040280 - DNA, 22 bp, Homo sapiens
tgggacaggaggcctctggaga

SEQ ID NO: 7040281 - DNA, 22 bp, Homo sapiens
tgggcactcctggggacagctg

SEQ ID NO: 7040282 - DNA, 22 bp, Homo sapiens
tgggcactcttctgtgcaaaca

SEQ ID NO: 7040283 - DNA, 22 bp, Homo sapiens
tgggcactgaagctttgagcag

SEQ ID NO: 7040284 - DNA, 22 bp, Homo sapiens
tgggcactgactgttagtgatg

SEQ ID NO: 7040285 - DNA, 21 bp, Homo sapiens
tgggcactgagggtgctgctc

SEQ ID NO: 7040286 - DNA, 22 bp, Homo sapiens
tgggcactggaagcctgctgtg

SEQ ID NO: 7040287 - DNA, 22 bp, Homo sapiens
tgggcactggggctccagaggt

SEQ ID NO: 7040288 - DNA, 22 bp, Homo sapiens
tgggcactgtagctggtgctgg

SEQ ID NO: 7040289 - DNA, 22 bp, Homo sapiens
tgggcactgtgtgtggtaaaat

SEQ ID NO: 7040290 - DNA, 22 bp, Homo sapiens
tgggcacttatcgaaattgagg

SEQ ID NO: 7040291 - DNA, 22 bp, Homo sapiens
cctcctgggacaggctggcaca

SEQ ID NO: 7040292 - DNA, 22 bp, Homo sapiens
cctcctggccctgggcctggaa

SEQ ID NO: 7040293 - DNA, 22 bp, Homo sapiens
cctcctgggagagcacggaggg

SEQ ID NO: 7040294 - DNA, 22 bp, Homo sapiens
cctgcagctttgcctcctgaac

SEQ ID NO: 7040295 - DNA, 22 bp, Homo sapiens
tggggagagattgaggagtttt

SEQ ID NO: 7040296 - DNA, 22 bp, Homo sapiens
tggggagagttacaaggaatct

SEQ ID NO: 7040297 - DNA, 22 bp, Homo sapiens
tgggctcatgtttatacatatc

SEQ ID NO: 7040298 - DNA, 22 bp, Homo sapiens
tgggctcatgtttctttgagga

SEQ ID NO: 7040299 - DNA, 19 bp, Homo sapiens
tgggctcattcaggtggtt

SEQ ID NO: 7040300 - DNA, 23 bp, Homo sapiens
tgggcctggcctcccagtccagc

SEQ ID NO: 7040301 - DNA, 22 bp, Homo sapiens
tgggctcatgctggagatgaga

SEQ ID NO: 7040302 - DNA, 22 bp, Homo sapiens
tgggctcatggcccagcactgg

SEQ ID NO: 7040303 - DNA, 22 bp, Homo sapiens
tgggcaggatgcgttgattctt

SEQ ID NO: 7040304 - DNA, 19 bp, Homo sapiens
tgggcctcacaatgctccc

SEQ ID NO: 7040305 - DNA, 22 bp, Homo sapiens
tgggcctggacatctgtatttt

SEQ ID NO: 7040306 - DNA, 22 bp, Homo sapiens
tgggcctggagtttgtccagag

SEQ ID NO: 7040307 - DNA, 22 bp, Homo sapiens
tgggtcagtttgggggccagcc

SEQ ID NO: 7040308 - DNA, 18 bp, Homo sapiens
tgggtggctagggagttt

SEQ ID NO: 7040309 - DNA, 22 bp, Homo sapiens
tgggtgggagcaccctgtctgg

SEQ ID NO: 7040310 - DNA, 22 bp, Homo sapiens
tgggtgggagcgccctgtctgg

SEQ ID NO: 7040311 - DNA, 22 bp, Homo sapiens
cctgcccagagcccctttcact

SEQ ID NO: 7040312 - DNA, 22 bp, Homo sapiens
cctgcctcaggactctgcatat

SEQ ID NO: 7040313 - DNA, 22 bp, Homo sapiens
tgcactttatttcctctcacac

SEQ ID NO: 7040314 - DNA, 22 bp, Homo sapiens
tgcactgttgctttatatgatt

SEQ ID NO: 7040315 - DNA, 22 bp, Homo sapiens
tgcactccaggctgggtgacag

SEQ ID NO: 7040316 - DNA, 22 bp, Homo sapiens
tgcaaatattgggacagtctag

SEQ ID NO: 7040317 - DNA, 22 bp, Homo sapiens
tgcaatatcagattcaacacat

SEQ ID NO: 7040318 - DNA, 22 bp, Homo sapiens
tgcaatatttggcactgagatg

SEQ ID NO: 7040319 - DNA, 22 bp, Homo sapiens
cccagaggaggatctcggcccg

SEQ ID NO: 7040320 - DNA, 22 bp, Homo sapiens
cccagaggggtcgtctgagggg

SEQ ID NO: 7040321 - DNA, 22 bp, Homo sapiens
cccagagggtggaggttgcagt

SEQ ID NO: 7040322 - DNA, 19 bp, Homo sapiens
tgcagccacgtgagagact

SEQ ID NO: 7040323 - DNA, 22 bp, Homo sapiens
tgcaggccagggtagggactag

SEQ ID NO: 7040324 - DNA, 23 bp, Homo sapiens
ccatatctctgtactgaatgtgg

SEQ ID NO: 7040325 - DNA, 22 bp, Homo sapiens
ccatcctgcaggacctccatat

SEQ ID NO: 7040326 - DNA, 22 bp, Homo sapiens
tgagtcctgctctgggcagggt

SEQ ID NO: 7040327 - DNA, 22 bp, Homo sapiens
tgagtcctggctttgggatgta

SEQ ID NO: 7040328 - DNA, 22 bp, Homo sapiens
tgagtcctgtctttgtcactta

SEQ ID NO: 7040329 - DNA, 22 bp, Homo sapiens
tgagtctcaactgggaattgat

SEQ ID NO: 7040330 - DNA, 22 bp, Homo sapiens
tgagtctccagcgaagtaggat

SEQ ID NO: 7040331 - DNA, 22 bp, Homo sapiens
tgagtctcccaagtagttggaa

SEQ ID NO: 7040332 - DNA, 21 bp, Homo sapiens
tgagtctctcagcttcaggta

SEQ ID NO: 7040333 - DNA, 22 bp, Homo sapiens
tgagtctctgcactaaggagag

SEQ ID NO: 7040334 - DNA, 22 bp, Homo sapiens
tgataaatccatgtaaatggta

SEQ ID NO: 7040335 - DNA, 22 bp, Homo sapiens
ccagggctgcctggccgtgtgt

SEQ ID NO: 7040336 - DNA, 22 bp, Homo sapiens
ccagggctgctcattggctggt

SEQ ID NO: 7040337 - DNA, 22 bp, Homo sapiens
ccagggctgctgggggagttga

SEQ ID NO: 7040338 - DNA, 22 bp, Homo sapiens
tgagcccagagatctgagctat

SEQ ID NO: 7040339 - DNA, 22 bp, Homo sapiens
ccagtgcccagctgcccaggca

SEQ ID NO: 7040340 - DNA, 22 bp, Homo sapiens
tgaggcagtgctgggaagcctg

SEQ ID NO: 7040341 - DNA, 22 bp, Homo sapiens
ccagggctccattgctcatcct

SEQ ID NO: 7040342 - DNA, 22 bp, Homo sapiens
ccagggctccccagaagtaccc

SEQ ID NO: 7040343 - DNA, 22 bp, Homo sapiens
ccagggctcgggtgcttagtca

SEQ ID NO: 7040344 - DNA, 22 bp, Homo sapiens
ccagggctctatgagggtggag

SEQ ID NO: 7040345 - DNA, 22 bp, Homo sapiens
ccagggctctgcttctgccatg

SEQ ID NO: 7040346 - DNA, 22 bp, Homo sapiens
ccagggctgagactgtattggg

SEQ ID NO: 7040347 - DNA, 22 bp, Homo sapiens
ccagggctgagctgtgaccatg

SEQ ID NO: 7040348 - DNA, 22 bp, Homo sapiens
ccagggctgccgcatccctggt

SEQ ID NO: 7040349 - DNA, 17 bp, Homo sapiens
ccagggaggggccgcgc

SEQ ID NO: 7040350 - DNA, 22 bp, Homo sapiens
tcttgatttgaattgcagttgt

SEQ ID NO: 7040351 - DNA, 21 bp, Homo sapiens
tcttgattttggacttcttcc

SEQ ID NO: 7040352 - DNA, 22 bp, Homo sapiens
tcttgcagaaataagtttaaat

SEQ ID NO: 7040353 - DNA, 22 bp, Homo sapiens
tcttttcttgcattattgcact

SEQ ID NO: 7040354 - DNA, 22 bp, Homo sapiens
tcttttcttgcattattgcact

SEQ ID NO: 7040355 - DNA, 17 bp, Homo sapiens
ccaggagagatgcttgt

SEQ ID NO: 7040356 - DNA, 22 bp, Homo sapiens
ccaggagagcaaaggtcactct

SEQ ID NO: 7040357 - DNA, 22 bp, Homo sapiens
ccaggagagcaaaggtcactct

SEQ ID NO: 7040358 - DNA, 22 bp, Homo sapiens
tctgttcttaaagcattcttgc

SEQ ID NO: 7040359 - DNA, 22 bp, Homo sapiens
tctgttcttctccactgtatgt

SEQ ID NO: 7040360 - DNA, 22 bp, Homo sapiens
ccaggaggctctgactggaccc

SEQ ID NO: 7040361 - DNA, 22 bp, Homo sapiens
ccaggaggctctgcccatccca

SEQ ID NO: 7040362 - DNA, 22 bp, Homo sapiens
ccaggaggctcttgtccctggt

SEQ ID NO: 7040363 - DNA, 22 bp, Homo sapiens
ccaggaggcttcgtccgtggag

SEQ ID NO: 7040364 - DNA, 22 bp, Homo sapiens
tcttcctcatgaattctcgtat

SEQ ID NO: 7040365 - DNA, 22 bp, Homo sapiens
ccaggcaggcgatggtgcagtg

SEQ ID NO: 7040366 - DNA, 22 bp, Homo sapiens
cctggggctcaagatggcgccg

SEQ ID NO: 7040367 - DNA, 22 bp, Homo sapiens
tgtttcttacgtttttagaggc

SEQ ID NO: 7040368 - DNA, 19 bp, Homo sapiens
tgtttcttcctccatctga

SEQ ID NO: 7040369 - DNA, 19 bp, Homo sapiens
tgtttcttcctccatctga

SEQ ID NO: 7040370 - DNA, 22 bp, Homo sapiens
tgtttcttctcacacaaactca

SEQ ID NO: 7040371 - DNA, 22 bp, Homo sapiens
tgtttcttctcacacaaactca

SEQ ID NO: 7040372 - DNA, 22 bp, Homo sapiens
tgtttcttgagagtattaccct

SEQ ID NO: 7040373 - DNA, 22 bp, Homo sapiens
cctgctcagctgtcctcacgct

SEQ ID NO: 7040374 - DNA, 22 bp, Homo sapiens
ttaatgcagctctaccacacag

SEQ ID NO: 7040375 - DNA, 22 bp, Homo sapiens
ttaatgaatgtgtgctaacgtt

SEQ ID NO: 7040376 - DNA, 21 bp, Homo sapiens
ttacaaagctacagatgttgc

SEQ ID NO: 7040377 - DNA, 20 bp, Homo sapiens
ttacaagtttctaataacca

SEQ ID NO: 7040378 - DNA, 22 bp, Homo sapiens
ttacaataccacatcacctcat

SEQ ID NO: 7040379 - DNA, 22 bp, Homo sapiens
ttacaatagttccttcttttgt

SEQ ID NO: 7040380 - DNA, 20 bp, Homo sapiens
ttacagaaatgatgttattt

SEQ ID NO: 7040381 - DNA, 22 bp, Homo sapiens
ttacagaactgtcttgaaattt

SEQ ID NO: 7040382 - DNA, 22 bp, Homo sapiens
ttacagaagagaaagaattcag

SEQ ID NO: 7040383 - DNA, 22 bp, Homo sapiens
ttacagaagtattgagagatcc

SEQ ID NO: 7040384 - DNA, 22 bp, Homo sapiens
ccttctgtctccctcatattga

SEQ ID NO: 7040385 - DNA, 22 bp, Homo sapiens
ccttctgtgtgcccacgtttat

SEQ ID NO: 7040386 - DNA, 23 bp, Homo sapiens
ccttctgttaaccatctgggggg

SEQ ID NO: 7040387 - DNA, 22 bp, Homo sapiens
ccttcttcaccagtttacctga

SEQ ID NO: 7040388 - DNA, 22 bp, Homo sapiens
cctttcttgctaagagtttatg

SEQ ID NO: 7040389 - DNA, 22 bp, Homo sapiens
cgagtgtccctaccatttccta

SEQ ID NO: 7040390 - DNA, 22 bp, Homo sapiens
cgatgggggcagtgttacattg

SEQ ID NO: 7040391 - DNA, 22 bp, Homo sapiens
ttattattgtgacctgagaatg

SEQ ID NO: 7040392 - DNA, 22 bp, Homo sapiens
ttattattttgtgtacagcaaa

SEQ ID NO: 7040393 - DNA, 22 bp, Homo sapiens
ttatttttaaaagttcacacag

SEQ ID NO: 7040394 - DNA, 22 bp, Homo sapiens
ttatttttaaaagttcacacag

SEQ ID NO: 7040395 - DNA, 17 bp, Homo sapiens
ttattttttgggctgag

SEQ ID NO: 7040396 - DNA, 17 bp, Homo sapiens
ttattttttgggctgag

SEQ ID NO: 7040397 - DNA, 22 bp, Homo sapiens
ttcaaaaaggtatgttcaagtc

SEQ ID NO: 7040398 - DNA, 22 bp, Homo sapiens
ctcaggagtagttcagcagctg

SEQ ID NO: 7040399 - DNA, 22 bp, Homo sapiens
ttgatttttttctactatgcgc

SEQ ID NO: 7040400 - DNA, 22 bp, Homo sapiens
ttgcaaaaaccacaattacttt

SEQ ID NO: 7040401 - DNA, 22 bp, Homo sapiens
ttgcaaaaactgcaattacttt

SEQ ID NO: 7040402 - DNA, 22 bp, Homo sapiens
ttgcacagaatgacaatatgta

SEQ ID NO: 7040403 - DNA, 22 bp, Homo sapiens
ttgcacagagtggatattcagt

SEQ ID NO: 7040404 - DNA, 22 bp, Homo sapiens
ttgcacagggctggaatgtcct

SEQ ID NO: 7040405 - DNA, 23 bp, Homo sapiens
ttgcacagtgtatacacatattt

SEQ ID NO: 7040406 - DNA, 22 bp, Homo sapiens
ttgcacttatcctagcaaaagg

SEQ ID NO: 7040407 - DNA, 22 bp, Homo sapiens
ttgcacttatcctagcaaaagg

SEQ ID NO: 7040408 - DNA, 22 bp, Homo sapiens
ttgcactttatagaaacttttg

SEQ ID NO: 7040409 - DNA, 22 bp, Homo sapiens
ttgcctatgtaactttatattt

SEQ ID NO: 7040410 - DNA, 22 bp, Homo sapiens
ctataaatctacccagcattgg

SEQ ID NO: 7040411 - DNA, 22 bp, Homo sapiens
ttctcttttgtgatgtgagatg

SEQ ID NO: 7040412 - DNA, 22 bp, Homo sapiens
ttctctttttgcatctcaacct

SEQ ID NO: 7040413 - DNA, 22 bp, Homo sapiens
ttctctttttgcatctcaacct

SEQ ID NO: 7040414 - DNA, 22 bp, Homo sapiens
ttctgaaagccaattcattgaa

SEQ ID NO: 7040415 - DNA, 22 bp, Homo sapiens
ttctgaaagccaattcattgaa

SEQ ID NO: 7040416 - DNA, 22 bp, Homo sapiens
ttctgaaagtctttttaagtta

SEQ ID NO: 7040417 - DNA, 22 bp, Homo sapiens
ttctgaaatttcaactttacta

SEQ ID NO: 7040418 - DNA, 22 bp, Homo sapiens
ttctgtcccactggtctgtttg

SEQ ID NO: 7040419 - DNA, 22 bp, Homo sapiens
ttctgtccgcttgtttgttaga

SEQ ID NO: 7040420 - DNA, 22 bp, Homo sapiens
ttcttaaaattcaagctaggtt

SEQ ID NO: 7040421 - DNA, 20 bp, Homo sapiens
ttcttaaagacctcactttg

SEQ ID NO: 7040422 - DNA, 20 bp, Homo sapiens
ttcttaaagacctcactttg

SEQ ID NO: 7040423 - DNA, 22 bp, Homo sapiens
ttcttaactggaaaatgtcaga

SEQ ID NO: 7040424 - DNA, 22 bp, Homo sapiens
ttcttaagaggaacatttttgt

SEQ ID NO: 7040425 - DNA, 22 bp, Homo sapiens
ttcttaagagggttaagtgaag

SEQ ID NO: 7040426 - DNA, 22 bp, Homo sapiens
ttcttaagtatttcagagactg

SEQ ID NO: 7040427 - DNA, 22 bp, Homo sapiens
ttcttaatacctattttctacc

SEQ ID NO: 7040428 - DNA, 22 bp, Homo sapiens
ttcttaatcccacaaatcttca

SEQ ID NO: 7040429 - DNA, 22 bp, Homo sapiens
ttcttaatggcaaaggatttta

SEQ ID NO: 7040430 - DNA, 22 bp, Homo sapiens
ttcttacaaacaagatcattga

SEQ ID NO: 7040431 - DNA, 21 bp, Homo sapiens
ttcttcagtttaatataaaat

SEQ ID NO: 7040432 - DNA, 22 bp, Homo sapiens
ttcttcagtttggtaaatgtaa

SEQ ID NO: 7040433 - DNA, 21 bp, Homo sapiens
ttctccttcttgatccaagca

SEQ ID NO: 7040434 - DNA, 22 bp, Homo sapiens
ttctccttcctggttttcaggc

SEQ ID NO: 7040435 - DNA, 22 bp, Homo sapiens
ttctcctttgtaattctcatcc

SEQ ID NO: 7040436 - DNA, 22 bp, Homo sapiens
ctagtgtttggaagtcatagcc

SEQ ID NO: 7040437 - DNA, 22 bp, Homo sapiens
ctagttctagatccctgaggaa

SEQ ID NO: 7040438 - DNA, 22 bp, Homo sapiens
ctagttctagatccctgaggaa

SEQ ID NO: 7040439 - DNA, 22 bp, Homo sapiens
ttctcaggtcaccagggtgcca

SEQ ID NO: 7040440 - DNA, 22 bp, Homo sapiens
ttctcaggtgaggctgaggctg

SEQ ID NO: 7040441 - DNA, 22 bp, Homo sapiens
ttctcatagatgctatagacag

SEQ ID NO: 7040442 - DNA, 22 bp, Homo sapiens
ttcctttttacataatcacatt

SEQ ID NO: 7040443 - DNA, 22 bp, Homo sapiens
ctacagttcttaattaagtagt

SEQ ID NO: 7040444 - DNA, 22 bp, Homo sapiens
ttcagggccctgagagggcagt

SEQ ID NO: 7040445 - DNA, 23 bp, Homo sapiens
ttcagggcctcagaggtgaagct

SEQ ID NO: 7040446 - DNA, 22 bp, Homo sapiens
ttcagggcgttgtggctgactg

SEQ ID NO: 7040447 - DNA, 22 bp, Homo sapiens
ttcagtttcaagtccctctggg

SEQ ID NO: 7040448 - DNA, 22 bp, Homo sapiens
ttcagtttcagtcttgcaaaaa

SEQ ID NO: 7040449 - DNA, 22 bp, Homo sapiens
ttcagtttccacttacatttaa

SEQ ID NO: 7040450 - DNA, 19 bp, Homo sapiens
ttcagtttcctcatctgga

SEQ ID NO: 7040451 - DNA, 22 bp, Homo sapiens
ttcagtttcgttatctatgaga

SEQ ID NO: 7040452 - DNA, 18 bp, Homo sapiens
ttcagtttctagttcctt

SEQ ID NO: 7040453 - DNA, 22 bp, Homo sapiens
ttcagtttcttccctgtgaaat

SEQ ID NO: 7040454 - DNA, 22 bp, Homo sapiens
ttcagtttgaattctgtagaac

SEQ ID NO: 7040455 - DNA, 22 bp, Homo sapiens
ttcagtttgctacaagcaacat

SEQ ID NO: 7040456 - DNA, 22 bp, Homo sapiens
ttccaaattaaaatgtacaatg

SEQ ID NO: 7040457 - DNA, 22 bp, Homo sapiens
ttccaccaggagatatttcaaa

SEQ ID NO: 7040458 - DNA, 22 bp, Homo sapiens
ttccactctccagtcaatttca

SEQ ID NO: 7040459 - DNA, 22 bp, Homo sapiens
ctgcagtaacgatcatggtgcc

SEQ ID NO: 7040460 - DNA, 22 bp, Homo sapiens
ctgcagtagcagagctgagtag

SEQ ID NO: 7040461 - DNA, 22 bp, Homo sapiens
ctgagcttggcttatctccagc

SEQ ID NO: 7040462 - DNA, 22 bp, Homo sapiens
ctgagctaggagttaggaagct

SEQ ID NO: 7040463 - DNA, 22 bp, Homo sapiens
ctgaagatgttctttttggttc

SEQ ID NO: 7040464 - DNA, 22 bp, Homo sapiens
ctgaagattataaacagacata

SEQ ID NO: 7040465 - DNA, 22 bp, Homo sapiens
ctgaagattcgcctttgtttat

SEQ ID NO: 7040466 - DNA, 22 bp, Homo sapiens
ctgaagatttggctgtaaagca

SEQ ID NO: 7040467 - DNA, 22 bp, Homo sapiens
ctgaagatttttggtaatcatg

SEQ ID NO: 7040468 - DNA, 22 bp, Homo sapiens
ctgaaggagaaggccactgttc

SEQ ID NO: 7040469 - DNA, 22 bp, Homo sapiens
ctgaaggaggtagagtgacata

SEQ ID NO: 7040470 - DNA, 18 bp, Homo sapiens
ctgaaggatccaggtgta

SEQ ID NO: 7040471 - DNA, 22 bp, Homo sapiens
ctgaaggattagagagcactta

SEQ ID NO: 7040472 - DNA, 19 bp, Homo sapiens
ctgaaacacagagagggct

SEQ ID NO: 7040473 - DNA, 22 bp, Homo sapiens
ttttctcccgctggctgctctt

SEQ ID NO: 7040474 - DNA, 22 bp, Homo sapiens
tttttctagctcaaagattcta

SEQ ID NO: 7040475 - DNA, 22 bp, Homo sapiens
tttatattacctggaatagctt

SEQ ID NO: 7040476 - DNA, 22 bp, Homo sapiens
tttcaaataccataaacctaat

SEQ ID NO: 7040477 - DNA, 22 bp, Homo sapiens
ctctaaatccaaataagtgtcc

SEQ ID NO: 7040478 - DNA, 22 bp, Homo sapiens
ctctaaatccacggtatagttg

SEQ ID NO: 7040479 - DNA, 22 bp, Homo sapiens
ctctaagtgtcaaacagatatg

SEQ ID NO: 7040480 - DNA, 22 bp, Homo sapiens
ctctaatactgaccaagtcacc

SEQ ID NO: 7040481 - DNA, 22 bp, Homo sapiens
tttacaattggttttctctaat

SEQ ID NO: 7040482 - DNA, 23 bp, Homo sapiens
ctccctggagtttctggaagatg

SEQ ID NO: 7040483 - DNA, 23 bp, Homo sapiens
ctccctggagtttctggaagatg

SEQ ID NO: 7040484 - DNA, 22 bp, Homo sapiens
ctccctggggctcctcctattt

SEQ ID NO: 7040485 - DNA, 22 bp, Homo sapiens
ctccctggggctcctcctattt

SEQ ID NO: 7040486 - DNA, 22 bp, Homo sapiens
ctccctggtgtcccctccagga

SEQ ID NO: 7040487 - DNA, 22 bp, Homo sapiens
ttgtttaatgcctcatacatct

SEQ ID NO: 7040488 - DNA, 22 bp, Homo sapiens
ttgtttatcgcttgctcacata

SEQ ID NO: 7040489 - DNA, 22 bp, Homo sapiens
ttgtttatggattgtagaaact

SEQ ID NO: 7040490 - DNA, 22 bp, Homo sapiens
ttgtttatgtgttgtctatggc

SEQ ID NO: 7040491 - DNA, 22 bp, Homo sapiens
ctctatattctgaaacagttag

SEQ ID NO: 7040492 - DNA, 22 bp, Homo sapiens
ctctctggaagggggagctgat

SEQ ID NO: 7040493 - DNA, 20 bp, Homo sapiens
ctctctggaaggtgggagcc

SEQ ID NO: 7040494 - DNA, 22 bp, Homo sapiens
tttctgcaaacttccacgtctc

SEQ ID NO: 7040495 - DNA, 22 bp, Homo sapiens
tttcttaaatatttgcaggaca

SEQ ID NO: 7040496 - DNA, 22 bp, Homo sapiens
tttcttaatttgagttccacta

SEQ ID NO: 7040497 - DNA, 22 bp, Homo sapiens
tttcttatactatattgtcatc

SEQ ID NO: 7040498 - DNA, 22 bp, Homo sapiens
tttgaagtgtatgaaaatacag

SEQ ID NO: 7040499 - DNA, 22 bp, Homo sapiens
ctctggaattgacctgggaggg

SEQ ID NO: 7040500 - DNA, 22 bp, Homo sapiens
ctctggaggccgttggccctta

SEQ ID NO: 7040501 - DNA, 22 bp, Homo sapiens
ctctggaggcctaaggaagtgg

SEQ ID NO: 7040502 - DNA, 22 bp, Homo sapiens
ctgggctagaaggaccaggatg

SEQ ID NO: 7040503 - DNA, 18 bp, Homo sapiens
ctgggcctttgtattttt

SEQ ID NO: 7040504 - DNA, 22 bp, Homo sapiens
ctgggcgcgtcccctgaggcgg

SEQ ID NO: 7040505 - DNA, 22 bp, Homo sapiens
ctgggcgtgtcttccagctggc

SEQ ID NO: 7040506 - DNA, 22 bp, Homo sapiens
ctgggccttggattgacactgt

SEQ ID NO: 7040507 - DNA, 22 bp, Homo sapiens
ctgggcctttacctacggagtt

SEQ ID NO: 7040508 - DNA, 22 bp, Homo sapiens
ctgggcctttgcttattaattt

SEQ ID NO: 7040509 - DNA, 22 bp, Homo sapiens
ctgggcctttgggagttcggtg

SEQ ID NO: 7040510 - DNA, 22 bp, Homo sapiens
ctgggctggagtgcaatggcgc

SEQ ID NO: 7040511 - DNA, 22 bp, Homo sapiens
ctgggctggataattctttgct

SEQ ID NO: 7040512 - DNA, 21 bp, Homo sapiens
ctgggctggcaggcattacct

SEQ ID NO: 7040513 - DNA, 22 bp, Homo sapiens
ctgggctggcgcatccgacacg

SEQ ID NO: 7040514 - DNA, 22 bp, Homo sapiens
ctgggctgtttgttctggtctc

SEQ ID NO: 7040515 - DNA, 22 bp, Homo sapiens
ctgggctgtttgtttagaatgg

SEQ ID NO: 7040516 - DNA, 17 bp, Homo sapiens
ctgggcctcccctgtcc

SEQ ID NO: 7040517 - DNA, 22 bp, Homo sapiens
ctgggcctcctctgcccaagct

SEQ ID NO: 7040518 - DNA, 22 bp, Homo sapiens
ctgggcctggtgtggcacctgc

SEQ ID NO: 7040519 - DNA, 22 bp, Homo sapiens
ctgggcctgtcagggctttttg

SEQ ID NO: 7040520 - DNA, 22 bp, Homo sapiens
ctgggcctgtccctgattgagg

SEQ ID NO: 7040521 - DNA, 22 bp, Homo sapiens
ctgggcctgtgactcccatcct

SEQ ID NO: 7040522 - DNA, 22 bp, Homo sapiens
ctgggcctgtgggcacacggac

SEQ ID NO: 7040523 - DNA, 22 bp, Homo sapiens
ctgggccttagggcactccctt

SEQ ID NO: 7040524 - DNA, 22 bp, Homo sapiens
ctgggccttatgagtacctgga

SEQ ID NO: 7040525 - DNA, 22 bp, Homo sapiens
ctgggccttcattgctctccca

SEQ ID NO: 7040526 - DNA, 22 bp, Homo sapiens
ctgggccttgagaatcatgttt

SEQ ID NO: 7040527 - DNA, 22 bp, Homo sapiens
ctgggccttgatcacacaggtg

SEQ ID NO: 7040528 - DNA, 22 bp, Homo sapiens
ctgggccttgatcacacaggtg

SEQ ID NO: 7040529 - DNA, 22 bp, Homo sapiens
ctgggccttgcatcccagagcc

SEQ ID NO: 7040530 - DNA, 22 bp, Homo sapiens
ctgggccttgccaggggtgtct

SEQ ID NO: 7040531 - DNA, 22 bp, Homo sapiens
ctgggccttgccttgcccacag

SEQ ID NO: 7040532 - DNA, 22 bp, Homo sapiens
ctgggagcggctgtcactggtt

SEQ ID NO: 7040533 - DNA, 22 bp, Homo sapiens
ctgggcagaattttaggatggc

SEQ ID NO: 7040534 - DNA, 22 bp, Homo sapiens
ctgggcagagctaacacctgag

SEQ ID NO: 7040535 - DNA, 22 bp, Homo sapiens
ctgggcagagctaacacctgag

SEQ ID NO: 7040536 - DNA, 22 bp, Homo sapiens
ctgggcagagtccggaagatgg

SEQ ID NO: 7040537 - DNA, 22 bp, Homo sapiens
ctgggcagcacatcatcgtatc

SEQ ID NO: 7040538 - DNA, 22 bp, Homo sapiens
ctgggcagcctcacacaatgtt

SEQ ID NO: 7040539 - DNA, 22 bp, Homo sapiens
ctgggcagctaccaccactgct

SEQ ID NO: 7040540 - DNA, 22 bp, Homo sapiens
ctgggcagctaccaccactgct

SEQ ID NO: 7040541 - DNA, 22 bp, Homo sapiens
ctgggcagctccataccaccca

SEQ ID NO: 7040542 - DNA, 22 bp, Homo sapiens
ctgggcagctgtatcagggagt

SEQ ID NO: 7040543 - DNA, 22 bp, Homo sapiens
ctgggcagctgtatcagggagt

SEQ ID NO: 7040544 - DNA, 22 bp, Homo sapiens
ctgggcagctgtgcaaacaata

SEQ ID NO: 7040545 - DNA, 22 bp, Homo sapiens
ctgctgttgccacctgcatgga

SEQ ID NO: 7040546 - DNA, 22 bp, Homo sapiens
ctgggaagatggtgacagaatt

SEQ ID NO: 7040547 - DNA, 22 bp, Homo sapiens
ctgggacatagatcagcctttt

SEQ ID NO: 7040548 - DNA, 22 bp, Homo sapiens
ctgtaaaactgcttaagtatgc

SEQ ID NO: 7040549 - DNA, 22 bp, Homo sapiens
ctgggcttctccccctggcaga

SEQ ID NO: 7040550 - DNA, 22 bp, Homo sapiens
ctgggcttgagttcctgctcgt

SEQ ID NO: 7040551 - DNA, 22 bp, Homo sapiens
ctgggctttgaagccaggctgc

SEQ ID NO: 7040552 - DNA, 22 bp, Homo sapiens
ctgtatacatggtccatgttat

SEQ ID NO: 7040553 - DNA, 22 bp, Homo sapiens
ctgtgccctggccaggcctctc

SEQ ID NO: 7040554 - DNA, 22 bp, Homo sapiens
cttatacaccctcttcccaggc

SEQ ID NO: 7040555 - DNA, 22 bp, Homo sapiens
cttatacagatcaagggaaaag

SEQ ID NO: 7040556 - DNA, 22 bp, Homo sapiens
cttcagttagagtttacaaagt

SEQ ID NO: 7040557 - DNA, 22 bp, Homo sapiens
cttcagttagccaattcaggtc

SEQ ID NO: 7040558 - DNA, 22 bp, Homo sapiens
cttcagttagtttcatgtgagc

SEQ ID NO: 7040559 - DNA, 22 bp, Homo sapiens
cttcattacttgctcgtagcac

SEQ ID NO: 7040560 - DNA, 22 bp, Homo sapiens
cttcatttccatccaactggga

SEQ ID NO: 7040561 - DNA, 22 bp, Homo sapiens
cttcatttggagaactgtgctt

SEQ ID NO: 7040562 - DNA, 22 bp, Homo sapiens
ctgtggaaagagcctttggagg

SEQ ID NO: 7040563 - DNA, 22 bp, Homo sapiens
ctgtttataaaccaccagttta

SEQ ID NO: 7040564 - DNA, 22 bp, Homo sapiens
ctgtttataaatagaggggagt

SEQ ID NO: 7040565 - DNA, 22 bp, Homo sapiens
ctgtttatacgacaggtggagg

SEQ ID NO: 7040566 - DNA, 22 bp, Homo sapiens
ctgtttatactcaaaagataca

SEQ ID NO: 7040567 - DNA, 22 bp, Homo sapiens
ctgtttatagcagagcaagcct

SEQ ID NO: 7040568 - DNA, 22 bp, Homo sapiens
ctgtttatcatgtacatttcca

SEQ ID NO: 7040569 - DNA, 22 bp, Homo sapiens
ctgtttatccctttggtcagca

SEQ ID NO: 7040570 - DNA, 19 bp, Homo sapiens
ctgtttctgagcttgcttt

SEQ ID NO: 7040571 - DNA, 21 bp, Homo sapiens
ctgtttcttgtgaagtgacac

SEQ ID NO: 7040572 - DNA, 22 bp, Homo sapiens
ctgtttctttgctgtcagagag

SEQ ID NO: 7040573 - DNA, 22 bp, Homo sapiens
ctgtttgcccacatttttatta

SEQ ID NO: 7040574 - DNA, 22 bp, Homo sapiens
ctgttttataaagtccaaaagt

SEQ ID NO: 7040575 - DNA, 22 bp, Homo sapiens
cttaaaatctggcagttagcta

SEQ ID NO: 7040576 - DNA, 20 bp, Homo sapiens
cttaaacacagagatagatt

SEQ ID NO: 7040577 - DNA, 18 bp, Homo sapiens
cttaaactgtccccagta

SEQ ID NO: 7040578 - DNA, 22 bp, Homo sapiens
cttaaagtattggtttaaccaa

SEQ ID NO: 7040579 - DNA, 22 bp, Homo sapiens
cttaaagtctatcctttctaga

SEQ ID NO: 7040580 - DNA, 22 bp, Homo sapiens
cttacaaaggagaggagatagg

SEQ ID NO: 7040581 - DNA, 22 bp, Homo sapiens
cttacaaatacacttaggagag

SEQ ID NO: 7040582 - DNA, 22 bp, Homo sapiens
cttacagtgatcaacacaaaga

SEQ ID NO: 7040583 - DNA, 22 bp, Homo sapiens
cttacatactgagaaaatatcc

SEQ ID NO: 7040584 - DNA, 22 bp, Homo sapiens
cttacattaagtaagagattga

SEQ ID NO: 7040585 - DNA, 22 bp, Homo sapiens
cttacattgtctcttgctgagc

SEQ ID NO: 7040586 - DNA, 22 bp, Homo sapiens
cttacattgtcttagttttcaa

SEQ ID NO: 7040587 - DNA, 22 bp, Homo sapiens
cttacatttaatcatgtgtcat

SEQ ID NO: 7040588 - DNA, 22 bp, Homo sapiens
cttctgaaatgtgagcaaaatc

SEQ ID NO: 7040589 - DNA, 22 bp, Homo sapiens
ctttaagagatcaccaatcaca

SEQ ID NO: 7040590 - DNA, 22 bp, Homo sapiens
ctttaattaggaagtataatga

SEQ ID NO: 7040591 - DNA, 22 bp, Homo sapiens
ctttacaaatagggagggagtg

SEQ ID NO: 7040592 - DNA, 22 bp, Homo sapiens
ctttgaaaacacacgaatagac

SEQ ID NO: 7040593 - DNA, 22 bp, Homo sapiens
ctttgaaaacttaaataacagc

SEQ ID NO: 7040594 - DNA, 22 bp, Homo sapiens
cttttcttactcccgcaaggca

SEQ ID NO: 7040595 - DNA, 22 bp, Homo sapiens
gaaaatgttagcttcatagtca

SEQ ID NO: 7040596 - DNA, 22 bp, Homo sapiens
gagggctgatgttgccacctca

SEQ ID NO: 7040597 - DNA, 18 bp, Homo sapiens
gagggagtagctgaggtt

SEQ ID NO: 7040598 - DNA, 22 bp, Homo sapiens
gagggctgcaatgagacagaga

SEQ ID NO: 7040599 - DNA, 22 bp, Homo sapiens
gagggctgctgccagatatgcc

SEQ ID NO: 7040600 - DNA, 22 bp, Homo sapiens
gagggctggggcttaggcttag

SEQ ID NO: 7040601 - DNA, 22 bp, Homo sapiens
gagggctgtggggcatgaccag

SEQ ID NO: 7040602 - DNA, 22 bp, Homo sapiens
gaggggctggcacgatggctgc

SEQ ID NO: 7040603 - DNA, 22 bp, Homo sapiens
gaggctgcattcttcccactgc

SEQ ID NO: 7040604 - DNA, 22 bp, Homo sapiens
gaggctcacctagggagcactg

SEQ ID NO: 7040605 - DNA, 22 bp, Homo sapiens
gaggctcacgacgggacgaact

SEQ ID NO: 7040606 - DNA, 22 bp, Homo sapiens
gaggctcactaggcatcctggg

SEQ ID NO: 7040607 - DNA, 22 bp, Homo sapiens
gaggctcactttcatcctcttc

SEQ ID NO: 7040608 - DNA, 22 bp, Homo sapiens
gaggctcagagggagcatggtc

SEQ ID NO: 7040609 - DNA, 22 bp, Homo sapiens
gaggctcagggaaacagcgcag

SEQ ID NO: 7040610 - DNA, 22 bp, Homo sapiens
gaggctgaagtgtacatgggtg

SEQ ID NO: 7040611 - DNA, 22 bp, Homo sapiens
gaggaagaagcaaaccagctaa

SEQ ID NO: 7040612 - DNA, 22 bp, Homo sapiens
gagcccaggagtttgatgctgc

SEQ ID NO: 7040613 - DNA, 22 bp, Homo sapiens
gagagggctgcctggtgtgagg

SEQ ID NO: 7040614 - DNA, 22 bp, Homo sapiens
gagagggctggaaacttcctgg

SEQ ID NO: 7040615 - DNA, 22 bp, Homo sapiens
gagaaactgctctgattctgca

SEQ ID NO: 7040616 - DNA, 22 bp, Homo sapiens
gagaaactgaatatttaacggg

SEQ ID NO: 7040617 - DNA, 22 bp, Homo sapiens
gactgcagtaagcctcatgact

SEQ ID NO: 7040618 - DNA, 22 bp, Homo sapiens
gactgcagtgaaggcacatggg

SEQ ID NO: 7040619 - DNA, 22 bp, Homo sapiens
gagaaagggaacttacagagtg

SEQ ID NO: 7040620 - DNA, 22 bp, Homo sapiens
gagagggcaaggtagatgctac

SEQ ID NO: 7040621 - DNA, 22 bp, Homo sapiens
gagagggctctgtgtgggtact

SEQ ID NO: 7040622 - DNA, 22 bp, Homo sapiens
gaccacagtccagtcatcatgg

SEQ ID NO: 7040623 - DNA, 22 bp, Homo sapiens
gaaaggagagggttaaggagct

SEQ ID NO: 7040624 - DNA, 22 bp, Homo sapiens
gaagcaaagagctagtgccgct

SEQ ID NO: 7040625 - DNA, 22 bp, Homo sapiens
gaagccactatagatattctaa

SEQ ID NO: 7040626 - DNA, 22 bp, Homo sapiens
gaagggctgcaggtctgggccc

SEQ ID NO: 7040627 - DNA, 22 bp, Homo sapiens
gaagggctttctgggagaagag

SEQ ID NO: 7040628 - DNA, 18 bp, Homo sapiens
gaagggctttgaagtaga

SEQ ID NO: 7040629 - DNA, 22 bp, Homo sapiens
gaatatttgtaattactgttga

SEQ ID NO: 7040630 - DNA, 22 bp, Homo sapiens
gaatattttcagtacagatggt

SEQ ID NO: 7040631 - DNA, 22 bp, Homo sapiens
gaatgaaaaccttggctcaaat

SEQ ID NO: 7040632 - DNA, 22 bp, Homo sapiens
gaatgataaatggaagcagcat

SEQ ID NO: 7040633 - DNA, 22 bp, Homo sapiens
gaatgatagagctgccttcgga

SEQ ID NO: 7040634 - DNA, 22 bp, Homo sapiens
gaatgatatattagcagatttt

SEQ ID NO: 7040635 - DNA, 22 bp, Homo sapiens
gacacagtaatgtgtttcatct

SEQ ID NO: 7040636 - DNA, 22 bp, Homo sapiens
gacacagtagccagtgcagtga

SEQ ID NO: 7040637 - DNA, 22 bp, Homo sapiens
gacacagttacttattttgcct

SEQ ID NO: 7040638 - DNA, 19 bp, Homo sapiens
gacacagttggttcctttg

SEQ ID NO: 7040639 - DNA, 22 bp, Homo sapiens
gacacagttctgttctagtagg

SEQ ID NO: 7040640 - DNA, 22 bp, Homo sapiens
gcagaggacacaggagggcaag

SEQ ID NO: 7040641 - DNA, 22 bp, Homo sapiens
gcagaggacacaggagggcaag

SEQ ID NO: 7040642 - DNA, 23 bp, Homo sapiens
gcagaggagcaagctggacacca

SEQ ID NO: 7040643 - DNA, 22 bp, Homo sapiens
gcacttctatttttttcagtgg

SEQ ID NO: 7040644 - DNA, 22 bp, Homo sapiens
gcacttctcgggggcgctgtct

SEQ ID NO: 7040645 - DNA, 21 bp, Homo sapiens
gcacttctgcagggctgctgg

SEQ ID NO: 7040646 - DNA, 22 bp, Homo sapiens
gcacttctggcctggcctgtgt

SEQ ID NO: 7040647 - DNA, 22 bp, Homo sapiens
gcactgaaaatgttggattcca

SEQ ID NO: 7040648 - DNA, 22 bp, Homo sapiens
gcagggctaggtcttctagggc

SEQ ID NO: 7040649 - DNA, 22 bp, Homo sapiens
gcagggctagatatttgcaagt

SEQ ID NO: 7040650 - DNA, 22 bp, Homo sapiens
gcagggctaatggggcaagtag

SEQ ID NO: 7040651 - DNA, 22 bp, Homo sapiens
gcaggaggatcacttgagccca

SEQ ID NO: 7040652 - DNA, 22 bp, Homo sapiens
gcaggagtggagaccatgggga

SEQ ID NO: 7040653 - DNA, 22 bp, Homo sapiens
gcagaggagcaagttgctacag

SEQ ID NO: 7040654 - DNA, 22 bp, Homo sapiens
gcagcaggaataggataagcaa

SEQ ID NO: 7040655 - DNA, 22 bp, Homo sapiens
gcagcaggagagtaatagcggt

SEQ ID NO: 7040656 - DNA, 22 bp, Homo sapiens
gcagcaggatggccaattgcca

SEQ ID NO: 7040657 - DNA, 22 bp, Homo sapiens
gcagcaggtctgtcaatgtcat

SEQ ID NO: 7040658 - DNA, 20 bp, Homo sapiens
gcagcagtgcaagtcctctt

SEQ ID NO: 7040659 - DNA, 22 bp, Homo sapiens
gcagcagtggctgcaggtccca

SEQ ID NO: 7040660 - DNA, 22 bp, Homo sapiens
gcccatggcagaactgtgagca

SEQ ID NO: 7040661 - DNA, 22 bp, Homo sapiens
gcccataattcaaatataacac

SEQ ID NO: 7040662 - DNA, 22 bp, Homo sapiens
gcctcagagctacacacacgca

SEQ ID NO: 7040663 - DNA, 22 bp, Homo sapiens
gccaggagaaaaggcgaatgat

SEQ ID NO: 7040664 - DNA, 22 bp, Homo sapiens
gccaggagaatgctagcagagg

SEQ ID NO: 7040665 - DNA, 22 bp, Homo sapiens
gccaggagactccattcatttg

SEQ ID NO: 7040666 - DNA, 22 bp, Homo sapiens
gccaggagagctccttcaggtt

SEQ ID NO: 7040667 - DNA, 22 bp, Homo sapiens
gccaggagcatgtcattgttga

SEQ ID NO: 7040668 - DNA, 22 bp, Homo sapiens
gccaggagcatgtcattgttga

SEQ ID NO: 7040669 - DNA, 22 bp, Homo sapiens
gccaggagccagcttcttagca

SEQ ID NO: 7040670 - DNA, 22 bp, Homo sapiens
gccaggagccctgggcaagttc

SEQ ID NO: 7040671 - DNA, 22 bp, Homo sapiens
gccaggaggctgctgtgtaggc

SEQ ID NO: 7040672 - DNA, 22 bp, Homo sapiens
gccaggagtgtgtggctatgtt

SEQ ID NO: 7040673 - DNA, 22 bp, Homo sapiens
gccaggagttcagatgcatgtt

SEQ ID NO: 7040674 - DNA, 22 bp, Homo sapiens
gccaggatgactatacaacagc

SEQ ID NO: 7040675 - DNA, 22 bp, Homo sapiens
gccagtctccctcagtcctctg

SEQ ID NO: 7040676 - DNA, 22 bp, Homo sapiens
gccagtctgataggggagaagt

SEQ ID NO: 7040677 - DNA, 22 bp, Homo sapiens
gccagtctgctcccacaagttc

SEQ ID NO: 7040678 - DNA, 22 bp, Homo sapiens
gccagtcttcatattcatggtg

SEQ ID NO: 7040679 - DNA, 22 bp, Homo sapiens
gccagtggaggacccatggaga

SEQ ID NO: 7040680 - DNA, 22 bp, Homo sapiens
gcagggctcattctagtacaat

SEQ ID NO: 7040681 - DNA, 22 bp, Homo sapiens
gcagggctcagccgctcccacc

SEQ ID NO: 7040682 - DNA, 22 bp, Homo sapiens
gcagggctattggaaggagatg

SEQ ID NO: 7040683 - DNA, 22 bp, Homo sapiens
gcagggctcaacaggacacccc

SEQ ID NO: 7040684 - DNA, 22 bp, Homo sapiens
gcagggctcattgccaggcatt

SEQ ID NO: 7040685 - DNA, 22 bp, Homo sapiens
gcagggctccactgtggccaag

SEQ ID NO: 7040686 - DNA, 22 bp, Homo sapiens
gcagggctccccaggcccgagg

SEQ ID NO: 7040687 - DNA, 19 bp, Homo sapiens
gcagggctctcccagatgc

SEQ ID NO: 7040688 - DNA, 21 bp, Homo sapiens
gcatgaaaacagcctgtgctc

SEQ ID NO: 7040689 - DNA, 22 bp, Homo sapiens
gcatgaaatgagcgaatataat

SEQ ID NO: 7040690 - DNA, 22 bp, Homo sapiens
gcatttctgtgcatacacatga

SEQ ID NO: 7040691 - DNA, 22 bp, Homo sapiens
gcattttaatgaggtttatgag

SEQ ID NO: 7040692 - DNA, 22 bp, Homo sapiens
gcattttataaagagttatttg

SEQ ID NO: 7040693 - DNA, 22 bp, Homo sapiens
gccaagggaactgagccggagg

SEQ ID NO: 7040694 - DNA, 22 bp, Homo sapiens
gccaagggggcagtgcatgggt

SEQ ID NO: 7040695 - DNA, 22 bp, Homo sapiens
gccaaggggttcaaaatgtata

SEQ ID NO: 7040696 - DNA, 22 bp, Homo sapiens
gccaagggtagtggaggcccct

SEQ ID NO: 7040697 - DNA, 22 bp, Homo sapiens
gccagaggaacgctgcgcgccc

SEQ ID NO: 7040698 - DNA, 22 bp, Homo sapiens
gccagaggcccaaggacagctg

SEQ ID NO: 7040699 - DNA, 22 bp, Homo sapiens
gccagaggcccaaggacagctg

SEQ ID NO: 7040700 - DNA, 22 bp, Homo sapiens
gccagcagggcggagccatcta

SEQ ID NO: 7040701 - DNA, 22 bp, Homo sapiens
gccagcaggtggagagatcaag

SEQ ID NO: 7040702 - DNA, 22 bp, Homo sapiens
gctgggaggaatttggggaata

SEQ ID NO: 7040703 - DNA, 22 bp, Homo sapiens
gctggcagggacagctgcgtgt

SEQ ID NO: 7040704 - DNA, 22 bp, Homo sapiens
gctggcagagagctggtgagga

SEQ ID NO: 7040705 - DNA, 22 bp, Homo sapiens
gctgggagtcgcgtctgtggcc

SEQ ID NO: 7040706 - DNA, 22 bp, Homo sapiens
gctggggctgggctgaggaaga

SEQ ID NO: 7040707 - DNA, 18 bp, Homo sapiens
gctggggttgagctctcc

SEQ ID NO: 7040708 - DNA, 22 bp, Homo sapiens
gctgggtattttaagaaaggaa

SEQ ID NO: 7040709 - DNA, 22 bp, Homo sapiens
gctgtgagtacaaggccctggg

SEQ ID NO: 7040710 - DNA, 22 bp, Homo sapiens
ggaaaggagatattggagagtg

SEQ ID NO: 7040711 - DNA, 22 bp, Homo sapiens
gcttccgcgatgtcctaggtgg

SEQ ID NO: 7040712 - DNA, 22 bp, Homo sapiens
ggaacataccgaaaatacttaa

SEQ ID NO: 7040713 - DNA, 22 bp, Homo sapiens
ggacagagcagacgagcagcgg

SEQ ID NO: 7040714 - DNA, 21 bp, Homo sapiens
ggacagaggagaaggcaccct

SEQ ID NO: 7040715 - DNA, 22 bp, Homo sapiens
ggagagcttggagtgcgatttt

SEQ ID NO: 7040716 - DNA, 22 bp, Homo sapiens
ggagaggaaatgccagcacttc

SEQ ID NO: 7040717 - DNA, 22 bp, Homo sapiens
ggagaggcgatgagtcacagcc

SEQ ID NO: 7040718 - DNA, 22 bp, Homo sapiens
gctgaagacctccctctccatg

SEQ ID NO: 7040719 - DNA, 22 bp, Homo sapiens
gctgaagagagatgcgtccagc

SEQ ID NO: 7040720 - DNA, 22 bp, Homo sapiens
gctgaagagaggccttgagcac

SEQ ID NO: 7040721 - DNA, 22 bp, Homo sapiens
gctgaagataagtgaagaggct

SEQ ID NO: 7040722 - DNA, 22 bp, Homo sapiens
gctcagggaaagagctcctgtc

SEQ ID NO: 7040723 - DNA, 22 bp, Homo sapiens
gctgaagatgcatcccttctct

SEQ ID NO: 7040724 - DNA, 20 bp, Homo sapiens
gctgaagattcccatgcaag

SEQ ID NO: 7040725 - DNA, 22 bp, Homo sapiens
gctgaagatttttgctagcccc

SEQ ID NO: 7040726 - DNA, 22 bp, Homo sapiens
gctgaagttgaatattctggga

SEQ ID NO: 7040727 - DNA, 23 bp, Homo sapiens
gctgatggagacttgtggcctcc

SEQ ID NO: 7040728 - DNA, 22 bp, Homo sapiens
gctgcagaatttccttctcatt

SEQ ID NO: 7040729 - DNA, 22 bp, Homo sapiens
gctgcaggtttgtctagtctgg

SEQ ID NO: 7040730 - DNA, 22 bp, Homo sapiens
gctgccagagctcacttaatgc

SEQ ID NO: 7040731 - DNA, 22 bp, Homo sapiens
gctgccagcgtcagacctgggg

SEQ ID NO: 7040732 - DNA, 22 bp, Homo sapiens
gctgccagtagttggagctcca

SEQ ID NO: 7040733 - DNA, 20 bp, Homo sapiens
gctgccagtgcctgatgctt

SEQ ID NO: 7040734 - DNA, 22 bp, Homo sapiens
gccttttttgttgctctgtcac

SEQ ID NO: 7040735 - DNA, 22 bp, Homo sapiens
gctcaagactgttagcctggca

SEQ ID NO: 7040736 - DNA, 22 bp, Homo sapiens
gctcactgcaacctccacctcc

SEQ ID NO: 7040737 - DNA, 22 bp, Homo sapiens
gcctggggccagcttgggctga

SEQ ID NO: 7040738 - DNA, 22 bp, Homo sapiens
ggcatcgtcctgggcataggga

SEQ ID NO: 7040739 - DNA, 22 bp, Homo sapiens
ggcagtgggttccccaaggcac

SEQ ID NO: 7040740 - DNA, 22 bp, Homo sapiens
ggcagtggttagaaacatgagc

SEQ ID NO: 7040741 - DNA, 19 bp, Homo sapiens
ggccagctgtctcctgcta

SEQ ID NO: 7040742 - DNA, 22 bp, Homo sapiens
ggccagcttattagctcagagg

SEQ ID NO: 7040743 - DNA, 22 bp, Homo sapiens
ggccagctttgagctgcaggaa

SEQ ID NO: 7040744 - DNA, 22 bp, Homo sapiens
ggccaggaacgatcctaccctt

SEQ ID NO: 7040745 - DNA, 22 bp, Homo sapiens
ggccaggaacttttgggatggg

SEQ ID NO: 7040746 - DNA, 22 bp, Homo sapiens
ggcagggtggccctccagtgag

SEQ ID NO: 7040747 - DNA, 17 bp, Homo sapiens
ggcagggtgctgggtat

SEQ ID NO: 7040748 - DNA, 22 bp, Homo sapiens
ggcagggtggcagaggctcaga

SEQ ID NO: 7040749 - DNA, 22 bp, Homo sapiens
ggcagtgggtggatctcaggga

SEQ ID NO: 7040750 - DNA, 22 bp, Homo sapiens
ggcagtgggttccccaaggcac

SEQ ID NO: 7040751 - DNA, 22 bp, Homo sapiens
ggcagggtgcctggctcctgtt

SEQ ID NO: 7040752 - DNA, 22 bp, Homo sapiens
ggcaggggttcattttgtctta

SEQ ID NO: 7040753 - DNA, 22 bp, Homo sapiens
ggcaggggtgaggccactctga

SEQ ID NO: 7040754 - DNA, 22 bp, Homo sapiens
ggcaggggtggccttcctttgg

SEQ ID NO: 7040755 - DNA, 18 bp, Homo sapiens
ggcaggggtgaaccacag

SEQ ID NO: 7040756 - DNA, 22 bp, Homo sapiens
ggccaggagaggagggcactga

SEQ ID NO: 7040757 - DNA, 22 bp, Homo sapiens
ggccaggagaggagggcactga

SEQ ID NO: 7040758 - DNA, 22 bp, Homo sapiens
ggccaggagctgcacagggctc

SEQ ID NO: 7040759 - DNA, 22 bp, Homo sapiens
ggccaggaggcaggggctcaat

SEQ ID NO: 7040760 - DNA, 22 bp, Homo sapiens
ggccaggaggcaggggctcaat

SEQ ID NO: 7040761 - DNA, 22 bp, Homo sapiens
ggccctgggatgctcagcagtg

SEQ ID NO: 7040762 - DNA, 21 bp, Homo sapiens
ggccctggttacgcctcctct

SEQ ID NO: 7040763 - DNA, 22 bp, Homo sapiens
ggcctgctctggctgtggtcag

SEQ ID NO: 7040764 - DNA, 22 bp, Homo sapiens
ggatggaggttctcagatgctc

SEQ ID NO: 7040765 - DNA, 22 bp, Homo sapiens
ggattagcttttgttcttgact

SEQ ID NO: 7040766 - DNA, 22 bp, Homo sapiens
ggatgaggtagatgaacaaggg

SEQ ID NO: 7040767 - DNA, 22 bp, Homo sapiens
ggatgcacgaaggcgcctcgga

SEQ ID NO: 7040768 - DNA, 22 bp, Homo sapiens
ggagatggctggcaggtagatg

SEQ ID NO: 7040769 - DNA, 22 bp, Homo sapiens
ggagaggcttggcccagcctgg

SEQ ID NO: 7040770 - DNA, 22 bp, Homo sapiens
ggatttgggcttgcagcagagc

SEQ ID NO: 7040771 - DNA, 22 bp, Homo sapiens
ggcagcagggtctagattgatg

SEQ ID NO: 7040772 - DNA, 22 bp, Homo sapiens
gggcactggaggccaaggagct

SEQ ID NO: 7040773 - DNA, 18 bp, Homo sapiens
gggcactggggactggag

SEQ ID NO: 7040774 - DNA, 22 bp, Homo sapiens
gggagctgagctggaagagaat

SEQ ID NO: 7040775 - DNA, 22 bp, Homo sapiens
gggagctgagctctgagccacg

SEQ ID NO: 7040776 - DNA, 22 bp, Homo sapiens
ggctttgcagtcatgttttgct

SEQ ID NO: 7040777 - DNA, 22 bp, Homo sapiens
ggctgtgcgggcagccgtggga

SEQ ID NO: 7040778 - DNA, 22 bp, Homo sapiens
ggctaattttcagtgttcatag

SEQ ID NO: 7040779 - DNA, 17 bp, Homo sapiens
ggctctgggtgtcacat

SEQ ID NO: 7040780 - DNA, 22 bp, Homo sapiens
ggctgagggccagggctagtct

SEQ ID NO: 7040781 - DNA, 22 bp, Homo sapiens
ggctgaggggcccagaggaaca

SEQ ID NO: 7040782 - DNA, 22 bp, Homo sapiens
ggctgagggtatagctgtccca

SEQ ID NO: 7040783 - DNA, 22 bp, Homo sapiens
ggctgagggttaagatcagaca

SEQ ID NO: 7040784 - DNA, 22 bp, Homo sapiens
ggctgagttgagaggattactt

SEQ ID NO: 7040785 - DNA, 22 bp, Homo sapiens
ggctgagttgagaggattactt

SEQ ID NO: 7040786 - DNA, 22 bp, Homo sapiens
ggctggacatgagcttggcagt

SEQ ID NO: 7040787 - DNA, 22 bp, Homo sapiens
ggctggactttctgctgggctc

SEQ ID NO: 7040788 - DNA, 17 bp, Homo sapiens
ggctgtgccaggtgaga

SEQ ID NO: 7040789 - DNA, 22 bp, Homo sapiens
gggctccagtttggccaggaag

SEQ ID NO: 7040790 - DNA, 22 bp, Homo sapiens
gggctctagaggacagcctgct

SEQ ID NO: 7040791 - DNA, 22 bp, Homo sapiens
gggctctaggatggctccagcc

SEQ ID NO: 7040792 - DNA, 22 bp, Homo sapiens
gggctctaggccaagagtcccg

SEQ ID NO: 7040793 - DNA, 22 bp, Homo sapiens
gggctctcatgagtgtgtggta

SEQ ID NO: 7040794 - DNA, 22 bp, Homo sapiens
gggcctcagctctgctctgcaa

SEQ ID NO: 7040795 - DNA, 22 bp, Homo sapiens
gggcctcagctgccaacaggat

SEQ ID NO: 7040796 - DNA, 22 bp, Homo sapiens
gggcctcagctggagtctgcct

SEQ ID NO: 7040797 - DNA, 22 bp, Homo sapiens
gggcctcaggccttgctctgtg

SEQ ID NO: 7040798 - DNA, 22 bp, Homo sapiens
gggcctcaggttctggagaagg

SEQ ID NO: 7040799 - DNA, 22 bp, Homo sapiens
gggcctcatgatggctcaggaa

SEQ ID NO: 7040800 - DNA, 22 bp, Homo sapiens
gggcctcatgatggctcaggaa

SEQ ID NO: 7040801 - DNA, 22 bp, Homo sapiens
gggcctccgtgtgctggtgctc

SEQ ID NO: 7040802 - DNA, 22 bp, Homo sapiens
gggcctgcaggttctgagaggc

SEQ ID NO: 7040803 - DNA, 22 bp, Homo sapiens
gggcctgctgcaggttcaggat

SEQ ID NO: 7040804 - DNA, 22 bp, Homo sapiens
ggggctgttgaagttagttgag

SEQ ID NO: 7040805 - DNA, 22 bp, Homo sapiens
ggggctgtttttggaatggctg

SEQ ID NO: 7040806 - DNA, 22 bp, Homo sapiens
ggggcagctcccgagggcagga

SEQ ID NO: 7040807 - DNA, 23 bp, Homo sapiens
gggggccgtcctggggattatag

SEQ ID NO: 7040808 - DNA, 22 bp, Homo sapiens
ggggatggtgggaaggcaatct

SEQ ID NO: 7040809 - DNA, 22 bp, Homo sapiens
ggggcacttccaggctgaggct

SEQ ID NO: 7040810 - DNA, 22 bp, Homo sapiens
ggggcacttggcacctctgcag

SEQ ID NO: 7040811 - DNA, 22 bp, Homo sapiens
ggggcactttactgcctcatct

SEQ ID NO: 7040812 - DNA, 22 bp, Homo sapiens
gggctgggaatggctaagtatg

SEQ ID NO: 7040813 - DNA, 22 bp, Homo sapiens
gggctgggaatggctaagtatg

SEQ ID NO: 7040814 - DNA, 22 bp, Homo sapiens
gggctgggatggcttgaagatt

SEQ ID NO: 7040815 - DNA, 22 bp, Homo sapiens
gggctgggattgcttgctgtga

SEQ ID NO: 7040816 - DNA, 22 bp, Homo sapiens
gggctgggattgcttgctgtga

SEQ ID NO: 7040817 - DNA, 22 bp, Homo sapiens
gggctgggcatggtgttccctc

SEQ ID NO: 7040818 - DNA, 22 bp, Homo sapiens
gggctggggctcaataatttgt

SEQ ID NO: 7040819 - DNA, 22 bp, Homo sapiens
gggctggggctcaataatttgt

SEQ ID NO: 7040820 - DNA, 22 bp, Homo sapiens
gggctggggctcaataatttgt

SEQ ID NO: 7040821 - DNA, 22 bp, Homo sapiens
ggtgggatgcctctggagaagt

SEQ ID NO: 7040822 - DNA, 22 bp, Homo sapiens
gggtccagacactccagaggaa

SEQ ID NO: 7040823 - DNA, 22 bp, Homo sapiens
gggtccagatggtgagagttaa

SEQ ID NO: 7040824 - DNA, 22 bp, Homo sapiens
gtgattctgcacgtcattcctg

SEQ ID NO: 7040825 - DNA, 20 bp, Homo sapiens
gtcttcataatgaccttatt

SEQ ID NO: 7040826 - DNA, 22 bp, Homo sapiens
gtcttcttgtgttgcctgtctt

SEQ ID NO: 7040827 - DNA, 22 bp, Homo sapiens
gtcttcttttcagtctgcttgt

SEQ ID NO: 7040828 - DNA, 22 bp, Homo sapiens
gtgatcttgtaattgggcaatg

SEQ ID NO: 7040829 - DNA, 22 bp, Homo sapiens
gtagagttgagtagtggtaaca

SEQ ID NO: 7040830 - DNA, 22 bp, Homo sapiens
gtagagtttaatgaaaaatctg

SEQ ID NO: 7040831 - DNA, 22 bp, Homo sapiens
gtagatattaaaaatggcagtg

SEQ ID NO: 7040832 - DNA, 22 bp, Homo sapiens
gtcaacttatctctttatctgt

SEQ ID NO: 7040833 - DNA, 20 bp, Homo sapiens
gtaatgaatgtaaacagtaa

SEQ ID NO: 7040834 - DNA, 22 bp, Homo sapiens
gtcaattagctaaaatttggta

SEQ ID NO: 7040835 - DNA, 22 bp, Homo sapiens
gtcaggggatgtgctggtggcc

SEQ ID NO: 7040836 - DNA, 22 bp, Homo sapiens
gtcaggggccatgggccaagga

SEQ ID NO: 7040837 - DNA, 22 bp, Homo sapiens
gtcctctgcccaggtcaaggtt

SEQ ID NO: 7040838 - DNA, 22 bp, Homo sapiens
tagtatttataatcatgcttaa

SEQ ID NO: 7040839 - DNA, 22 bp, Homo sapiens
tagtctctaggaggggaaaaga

SEQ ID NO: 7040840 - DNA, 22 bp, Homo sapiens
tagtggctgcagggctgtttga

SEQ ID NO: 7040841 - DNA, 22 bp, Homo sapiens
tagtaaaagtttagttgaaagt

SEQ ID NO: 7040842 - DNA, 22 bp, Homo sapiens
tagtatatctttagtacatagt

SEQ ID NO: 7040843 - DNA, 23 bp, Homo sapiens
taggaagacagcaaaagaatgga

SEQ ID NO: 7040844 - DNA, 22 bp, Homo sapiens
taggaatgataatagtaaagag

SEQ ID NO: 7040845 - DNA, 22 bp, Homo sapiens
taggctcagggtctcagaggct

SEQ ID NO: 7040846 - DNA, 22 bp, Homo sapiens
taggctcagtgagtagggagtt

SEQ ID NO: 7040847 - DNA, 22 bp, Homo sapiens
tagcacttgtgttatgccttgt

SEQ ID NO: 7040848 - DNA, 22 bp, Homo sapiens
tagcagaaccagtcagtgagcc

SEQ ID NO: 7040849 - DNA, 22 bp, Homo sapiens
tagatgtaaaattgagactatt

SEQ ID NO: 7040850 - DNA, 22 bp, Homo sapiens
tagatgtagccactgctaaaag

SEQ ID NO: 7040851 - DNA, 22 bp, Homo sapiens
tagatgtgtagggctccagcta

SEQ ID NO: 7040852 - DNA, 22 bp, Homo sapiens
tagatgtgttgcctggagttgt

SEQ ID NO: 7040853 - DNA, 22 bp, Homo sapiens
tagattttaggagattttactg

SEQ ID NO: 7040854 - DNA, 22 bp, Homo sapiens
tagattttaggagattttactg

SEQ ID NO: 7040855 - DNA, 22 bp, Homo sapiens
tagattttgcatttctaacaag

SEQ ID NO: 7040856 - DNA, 22 bp, Homo sapiens
tagattttgcatttctaacaag

SEQ ID NO: 7040857 - DNA, 22 bp, Homo sapiens
tagcaaaaactgcagttacttt

SEQ ID NO: 7040858 - DNA, 22 bp, Homo sapiens
tagcaaaagccacgattacttt

SEQ ID NO: 7040859 - DNA, 22 bp, Homo sapiens
tacttgtagcaggtggcattta

SEQ ID NO: 7040860 - DNA, 22 bp, Homo sapiens
tactttcatgggttttctttat

SEQ ID NO: 7040861 - DNA, 22 bp, Homo sapiens
tactttctaagacatacaactt

SEQ ID NO: 7040862 - DNA, 22 bp, Homo sapiens
tactttctgtccttctgttaaa

SEQ ID NO: 7040863 - DNA, 22 bp, Homo sapiens
tactttctgtccttctgttaaa

SEQ ID NO: 7040864 - DNA, 22 bp, Homo sapiens
tactttcttgttcctttcataa

SEQ ID NO: 7040865 - DNA, 22 bp, Homo sapiens
tagaatcagaagatttgactgt

SEQ ID NO: 7040866 - DNA, 22 bp, Homo sapiens
tagaatctggaaggggctattc

SEQ ID NO: 7040867 - DNA, 23 bp, Homo sapiens
tagaatctgtatttctgcagttc

SEQ ID NO: 7040868 - DNA, 22 bp, Homo sapiens
tagaggagcggcgagctgagct

SEQ ID NO: 7040869 - DNA, 22 bp, Homo sapiens
tagaggaggcaaggccctccct

SEQ ID NO: 7040870 - DNA, 22 bp, Homo sapiens
tagaggaggtgattcttgagct

SEQ ID NO: 7040871 - DNA, 22 bp, Homo sapiens
tattttcattctgtgtgactgt

SEQ ID NO: 7040872 - DNA, 22 bp, Homo sapiens
tattttcatcttgtccttggat

SEQ ID NO: 7040873 - DNA, 22 bp, Homo sapiens
tattttcaccttctctggatat

SEQ ID NO: 7040874 - DNA, 22 bp, Homo sapiens
tatttgtccaggtaaatttcag

SEQ ID NO: 7040875 - DNA, 22 bp, Homo sapiens
tatttctaagagatatctgtac

SEQ ID NO: 7040876 - DNA, 23 bp, Homo sapiens
tattgcacacatagaaacataga

SEQ ID NO: 7040877 - DNA, 22 bp, Homo sapiens
tattgcataaaatcaggttaga

SEQ ID NO: 7040878 - DNA, 21 bp, Homo sapiens
tattgcataacaaattaccct

SEQ ID NO: 7040879 - DNA, 21 bp, Homo sapiens
tattgcataccatgaatctga

SEQ ID NO: 7040880 - DNA, 22 bp, Homo sapiens
tattgcatacttaaatttccgg

SEQ ID NO: 7040881 - DNA, 22 bp, Homo sapiens
tattgcatagaaggaaggagtt

SEQ ID NO: 7040882 - DNA, 22 bp, Homo sapiens
tattgcatattattctagtggc

SEQ ID NO: 7040883 - DNA, 22 bp, Homo sapiens
tattgcatattgtacttgaatg

SEQ ID NO: 7040884 - DNA, 22 bp, Homo sapiens
tattgcatcagtaatttagtgt

SEQ ID NO: 7040885 - DNA, 22 bp, Homo sapiens
tattgcatcatcctgcaggggt

SEQ ID NO: 7040886 - DNA, 22 bp, Homo sapiens
tattgcatccccattgtgcccc

SEQ ID NO: 7040887 - DNA, 22 bp, Homo sapiens
tattgcatctcttcatatctgt

SEQ ID NO: 7040888 - DNA, 22 bp, Homo sapiens
tattgcatcttagtgtaagtca

SEQ ID NO: 7040889 - DNA, 22 bp, Homo sapiens
tattgcatgtgatagaggcagg

SEQ ID NO: 7040890 - DNA, 22 bp, Homo sapiens
tattgcattatggtaggaaagg

SEQ ID NO: 7040891 - DNA, 22 bp, Homo sapiens
tatttcaagaacttctatccat

SEQ ID NO: 7040892 - DNA, 22 bp, Homo sapiens
tatttcagcacatgggataggt

SEQ ID NO: 7040893 - DNA, 22 bp, Homo sapiens
tattcatattgtaaaagaagtg

SEQ ID NO: 7040894 - DNA, 22 bp, Homo sapiens
tattcaaagtgcgaggtcaggg

SEQ ID NO: 7040895 - DNA, 22 bp, Homo sapiens
tatgcatacaatgagatattcc

SEQ ID NO: 7040896 - DNA, 22 bp, Homo sapiens
tatctttagaggaagagaatct

SEQ ID NO: 7040897 - DNA, 22 bp, Homo sapiens
tatctttctgtcctagattctg

SEQ ID NO: 7040898 - DNA, 22 bp, Homo sapiens
tatattcaacaggctaatgtca

SEQ ID NO: 7040899 - DNA, 22 bp, Homo sapiens
tatattttagacaccctcacgc

SEQ ID NO: 7040900 - DNA, 22 bp, Homo sapiens
tatattttagacaccctcacgc

SEQ ID NO: 7040901 - DNA, 22 bp, Homo sapiens
tatattttagacaccctcacgc

SEQ ID NO: 7040902 - DNA, 20 bp, Homo sapiens
tatattttctctttggcctt

SEQ ID NO: 7040903 - DNA, 20 bp, Homo sapiens
tatattttctctttggcctt

SEQ ID NO: 7040904 - DNA, 20 bp, Homo sapiens
tatattttctctttggcctt

SEQ ID NO: 7040905 - DNA, 22 bp, Homo sapiens
tatcaaaaggagttgaaagggg

SEQ ID NO: 7040906 - DNA, 22 bp, Homo sapiens
tatcaactgagattaaatattt

SEQ ID NO: 7040907 - DNA, 22 bp, Homo sapiens
tatcaagagtctctacattaat

SEQ ID NO: 7040908 - DNA, 22 bp, Homo sapiens
tatacagataatgaagaccaag

SEQ ID NO: 7040909 - DNA, 22 bp, Homo sapiens
tatacagatatctaagatgtaa

SEQ ID NO: 7040910 - DNA, 22 bp, Homo sapiens
tatactgagtgtgttaatgatg

SEQ ID NO: 7040911 - DNA, 22 bp, Homo sapiens
tatacttatgctaaaaaatgtt

SEQ ID NO: 7040912 - DNA, 22 bp, Homo sapiens
tatactttcctgcaactttgat

SEQ ID NO: 7040913 - DNA, 22 bp, Homo sapiens
tatactttcctgcaactttgat

SEQ ID NO: 7040914 - DNA, 22 bp, Homo sapiens
tatagatagtcacttgttgcta

SEQ ID NO: 7040915 - DNA, 22 bp, Homo sapiens
tatagcaagcaggacagtctca

SEQ ID NO: 7040916 - DNA, 22 bp, Homo sapiens
tatagcaagctctttgtaacca

SEQ ID NO: 7040917 - DNA, 22 bp, Homo sapiens
tatagcaaggacataatatgct

SEQ ID NO: 7040918 - DNA, 22 bp, Homo sapiens
tatatgatgccaaataacctgt

SEQ ID NO: 7040919 - DNA, 22 bp, Homo sapiens
tatatgatgccaaataacctgt

SEQ ID NO: 7040920 - DNA, 22 bp, Homo sapiens
tatatgcagtgtgtcattcaag

SEQ ID NO: 7040921 - DNA, 22 bp, Homo sapiens
tatattaaatgaccagttttaa

SEQ ID NO: 7040922 - DNA, 22 bp, Homo sapiens
tatattaaatgaccagttttaa

SEQ ID NO: 7040923 - DNA, 22 bp, Homo sapiens
tactgcatgaaggcacctattt

SEQ ID NO: 7040924 - DNA, 22 bp, Homo sapiens
tactgtaagtcaaatgaaacat

SEQ ID NO: 7040925 - DNA, 22 bp, Homo sapiens
tactgtaatgagattagcttcc

SEQ ID NO: 7040926 - DNA, 22 bp, Homo sapiens
tacttctctccgcctcgtgctt

SEQ ID NO: 7040927 - DNA, 22 bp, Homo sapiens
tacttctctgcgatcacttgat

SEQ ID NO: 7040928 - DNA, 22 bp, Homo sapiens
tacattccacaagcattgcttt

SEQ ID NO: 7040929 - DNA, 22 bp, Homo sapiens
taccttcaggctgccctttgat

SEQ ID NO: 7040930 - DNA, 22 bp, Homo sapiens
taccttgaaccccaagctttgc

SEQ ID NO: 7040931 - DNA, 22 bp, Homo sapiens
taccttgtgagctttctaacat

SEQ ID NO: 7040932 - DNA, 22 bp, Homo sapiens
taccttttgcttattatgacac

SEQ ID NO: 7040933 - DNA, 22 bp, Homo sapiens
tactaattgttcacacttgttt

SEQ ID NO: 7040934 - DNA, 22 bp, Homo sapiens
tactgaatatgttttcaagtct

SEQ ID NO: 7040935 - DNA, 22 bp, Homo sapiens
tacatacagtggatgctttagg

SEQ ID NO: 7040936 - DNA, 22 bp, Homo sapiens
tacatacaagcattcaatttta

SEQ ID NO: 7040937 - DNA, 22 bp, Homo sapiens
tacatacagagatgctagttaa

SEQ ID NO: 7040938 - DNA, 22 bp, Homo sapiens
tacattatcttgttatctttca

SEQ ID NO: 7040939 - DNA, 22 bp, Homo sapiens
tacagtttgttacattgttagt

SEQ ID NO: 7040940 - DNA, 22 bp, Homo sapiens
tacagtttttattcatgacaag

SEQ ID NO: 7040941 - DNA, 22 bp, Homo sapiens
tacagtttttattcatgacaag

SEQ ID NO: 7040942 - DNA, 22 bp, Homo sapiens
tacagtttttcactgaagatgt

SEQ ID NO: 7040943 - DNA, 22 bp, Homo sapiens
tacagtttttcactgaagatgt

SEQ ID NO: 7040944 - DNA, 22 bp, Homo sapiens
tacatacaagatgtgtttaaaa

SEQ ID NO: 7040945 - DNA, 22 bp, Homo sapiens
taagttacctgttttgtcatca

SEQ ID NO: 7040946 - DNA, 22 bp, Homo sapiens
taagttcagagttctcatttgt

SEQ ID NO: 7040947 - DNA, 21 bp, Homo sapiens
taagttctgatccctatcaac

SEQ ID NO: 7040948 - DNA, 22 bp, Homo sapiens
taagttgtattcccttgctttt

SEQ ID NO: 7040949 - DNA, 22 bp, Homo sapiens
taagtttaagtcatgtttgatg

SEQ ID NO: 7040950 - DNA, 22 bp, Homo sapiens
taagtttaccactttcagaatt

SEQ ID NO: 7040951 - DNA, 22 bp, Homo sapiens
taagtttgaagtccatctgtac

SEQ ID NO: 7040952 - DNA, 22 bp, Homo sapiens
taagttttctggaataacttgg

SEQ ID NO: 7040953 - DNA, 22 bp, Homo sapiens
taatgcaaggaattccaagtag

SEQ ID NO: 7040954 - DNA, 22 bp, Homo sapiens
taatttctaattcattttcagt

SEQ ID NO: 7040955 - DNA, 22 bp, Homo sapiens
taattttaactgtgctgtttgg

SEQ ID NO: 7040956 - DNA, 22 bp, Homo sapiens
taattttacttcctgagcacct

SEQ ID NO: 7040957 - DNA, 22 bp, Homo sapiens
taattttccactctgtttatct

SEQ ID NO: 7040958 - DNA, 22 bp, Homo sapiens
taattttgctgtgaccattgaa

SEQ ID NO: 7040959 - DNA, 22 bp, Homo sapiens
taattttgtattgccattgtag

SEQ ID NO: 7040960 - DNA, 22 bp, Homo sapiens
taattttgtcacagtgacatgc

SEQ ID NO: 7040961 - DNA, 22 bp, Homo sapiens
taattttgtccccctgcacata

SEQ ID NO: 7040962 - DNA, 22 bp, Homo sapiens
tacaaaaaattgatactgacga

SEQ ID NO: 7040963 - DNA, 22 bp, Homo sapiens
tacaatatgtggccttttgtga

SEQ ID NO: 7040964 - DNA, 22 bp, Homo sapiens
tacaatatgtggccttttgtga

SEQ ID NO: 7040965 - DNA, 20 bp, Homo sapiens
tacaatattcccactttgct

SEQ ID NO: 7040966 - DNA, 21 bp, Homo sapiens
tacacaaagcgtggtccagag

SEQ ID NO: 7040967 - DNA, 22 bp, Homo sapiens
tacacaaaggcactctgttgtt

SEQ ID NO: 7040968 - DNA, 22 bp, Homo sapiens
tacacattacataatactatct

SEQ ID NO: 7040969 - DNA, 22 bp, Homo sapiens
tacacccacattgagcatggga

SEQ ID NO: 7040970 - DNA, 22 bp, Homo sapiens
taagaaatttagttatagaatg

SEQ ID NO: 7040971 - DNA, 22 bp, Homo sapiens
taagaaatttagttatagaatg

SEQ ID NO: 7040972 - DNA, 22 bp, Homo sapiens
taacttctgcacagaaaatttg

SEQ ID NO: 7040973 - DNA, 22 bp, Homo sapiens
taagatgaccttataaagagca

SEQ ID NO: 7040974 - DNA, 22 bp, Homo sapiens
taagatgcattataccacagag

SEQ ID NO: 7040975 - DNA, 22 bp, Homo sapiens
taacaaaggttgccaaactaag

SEQ ID NO: 7040976 - DNA, 22 bp, Homo sapiens
taacaattctcaaaagagggga

SEQ ID NO: 7040977 - DNA, 22 bp, Homo sapiens
taacaatttgcttcatttgttt

SEQ ID NO: 7040978 - DNA, 22 bp, Homo sapiens
gttttataattgcttcataaga

SEQ ID NO: 7040979 - DNA, 22 bp, Homo sapiens
gttttataggctgttgctatat

SEQ ID NO: 7040980 - DNA, 22 bp, Homo sapiens
gttttataggtgaaatattact

SEQ ID NO: 7040981 - DNA, 22 bp, Homo sapiens
gttttatatgtctctgctgaca

SEQ ID NO: 7040982 - DNA, 22 bp, Homo sapiens
gttttattggaacacagccatg

SEQ ID NO: 7040983 - DNA, 22 bp, Homo sapiens
gttttatttccatgagagaccg

SEQ ID NO: 7040984 - DNA, 22 bp, Homo sapiens
taaacagttaacatgccagaat

SEQ ID NO: 7040985 - DNA, 22 bp, Homo sapiens
gtttcctttgccagtaaatggg

SEQ ID NO: 7040986 - DNA, 22 bp, Homo sapiens
gtttccttttggaattagagct

SEQ ID NO: 7040987 - DNA, 22 bp, Homo sapiens
gtttctctttgaagcctggctg

SEQ ID NO: 7040988 - DNA, 22 bp, Homo sapiens
gtttcttaaaagaggagttaga

SEQ ID NO: 7040989 - DNA, 22 bp, Homo sapiens
gtttcttaaaagaggagttaga

SEQ ID NO: 7040990 - DNA, 22 bp, Homo sapiens
gtttcttaaatgtagcaggacc

SEQ ID NO: 7040991 - DNA, 22 bp, Homo sapiens
gtttcttaaatgtagcaggacc

SEQ ID NO: 7040992 - DNA, 22 bp, Homo sapiens
gtttcttaagttacaaaatctt

SEQ ID NO: 7040993 - DNA, 22 bp, Homo sapiens
gtttcttaagttacaaaatctt

SEQ ID NO: 7040994 - DNA, 22 bp, Homo sapiens
gtttcttaatagcaggggccaa

SEQ ID NO: 7040995 - DNA, 22 bp, Homo sapiens
gtttcttagacagacattatct

SEQ ID NO: 7040996 - DNA, 22 bp, Homo sapiens
gtttaattttaggttgtcaagc

SEQ ID NO: 7040997 - DNA, 22 bp, Homo sapiens
gtttaattttaggttgtcaagc

SEQ ID NO: 7040998 - DNA, 22 bp, Homo sapiens
gtttagcaataaaaacacatga

SEQ ID NO: 7040999 - DNA, 22 bp, Homo sapiens
gttacaaaggtcataaaagtgt

SEQ ID NO: 7041000 - DNA, 23 bp, Homo sapiens
gttcattttattgtctgattgct

SEQ ID NO: 7041001 - DNA, 22 bp, Homo sapiens
gttcatttttactttgatctac

SEQ ID NO: 7041002 - DNA, 22 bp, Homo sapiens
gttcatttttagaatgctagta

SEQ ID NO: 7041003 - DNA, 20 bp, Homo sapiens
tccctggggccctacttcct

SEQ ID NO: 7041004 - DNA, 22 bp, Homo sapiens
tccctgtggaagactgccagag

SEQ ID NO: 7041005 - DNA, 22 bp, Homo sapiens
tccctgtggatatctgcagctg

SEQ ID NO: 7041006 - DNA, 22 bp, Homo sapiens
tccctgggcctatcttagctcc

SEQ ID NO: 7041007 - DNA, 22 bp, Homo sapiens
tccctgggcctcctgctatgca

SEQ ID NO: 7041008 - DNA, 22 bp, Homo sapiens
tccctgggcggacattctccca

SEQ ID NO: 7041009 - DNA, 22 bp, Homo sapiens
tccctggggaagggcaagcaag

SEQ ID NO: 7041010 - DNA, 22 bp, Homo sapiens
tccctggggatgttggcctgcc

SEQ ID NO: 7041011 - DNA, 23 bp, Homo sapiens
tccctgtgtacagcctgcatgag

SEQ ID NO: 7041012 - DNA, 19 bp, Homo sapiens
tcccttctatagtaataaa

SEQ ID NO: 7041013 - DNA, 22 bp, Homo sapiens
tccctgggcacaatctgctggc

SEQ ID NO: 7041014 - DNA, 22 bp, Homo sapiens
tccctgggcatcacgttgcttc

SEQ ID NO: 7041015 - DNA, 22 bp, Homo sapiens
tccctgggccacagctgtgagc

SEQ ID NO: 7041016 - DNA, 23 bp, Homo sapiens
tccctgggcccgtgccagcggtg

SEQ ID NO: 7041017 - DNA, 22 bp, Homo sapiens
tccgggaggcagaggttgcagt

SEQ ID NO: 7041018 - DNA, 22 bp, Homo sapiens
tcctcctcctcacagtcacctg

SEQ ID NO: 7041019 - DNA, 22 bp, Homo sapiens
tcctcctctatcagacagtgcc

SEQ ID NO: 7041020 - DNA, 23 bp, Homo sapiens
tcctcctgacacagcctgagtga

SEQ ID NO: 7041021 - DNA, 22 bp, Homo sapiens
tcattaaatgtttgttgtgcca

SEQ ID NO: 7041022 - DNA, 22 bp, Homo sapiens
tcattaaaatgcagattctgac

SEQ ID NO: 7041023 - DNA, 22 bp, Homo sapiens
tcattaaatgtttgttgtgcca

SEQ ID NO: 7041024 - DNA, 22 bp, Homo sapiens
tcatgtgtgtttcatgtatgga

SEQ ID NO: 7041025 - DNA, 22 bp, Homo sapiens
tcatgtttggagtttgctcact

SEQ ID NO: 7041026 - DNA, 22 bp, Homo sapiens
tcatgttttaatgcctttttct

SEQ ID NO: 7041027 - DNA, 23 bp, Homo sapiens
tccaggagaacccctgtctgtcc

SEQ ID NO: 7041028 - DNA, 20 bp, Homo sapiens
tccaggagaactgggagccg

SEQ ID NO: 7041029 - DNA, 22 bp, Homo sapiens
tccaggagctcatccacgtcaa

SEQ ID NO: 7041030 - DNA, 22 bp, Homo sapiens
tccagggatgtcctgtagcact

SEQ ID NO: 7041031 - DNA, 23 bp, Homo sapiens
tccagggattaatgaagtcagtc

SEQ ID NO: 7041032 - DNA, 22 bp, Homo sapiens
tccagggatctttagagtcttt

SEQ ID NO: 7041033 - DNA, 22 bp, Homo sapiens
tccagggatgccagccatgttg

SEQ ID NO: 7041034 - DNA, 22 bp, Homo sapiens
tccagggatggtaatgagcagt

SEQ ID NO: 7041035 - DNA, 22 bp, Homo sapiens
tccagggagttggctggatagt

SEQ ID NO: 7041036 - DNA, 22 bp, Homo sapiens
tccagggagatggcagaggctg

SEQ ID NO: 7041037 - DNA, 22 bp, Homo sapiens
tccagggagcaagtcaggccgg

SEQ ID NO: 7041038 - DNA, 22 bp, Homo sapiens
tccagggagtcaaatgaactac

SEQ ID NO: 7041039 - DNA, 22 bp, Homo sapiens
tccagtctaatgagtcagagtg

SEQ ID NO: 7041040 - DNA, 22 bp, Homo sapiens
tccagtctcccagggctgggac

SEQ ID NO: 7041041 - DNA, 23 bp, Homo sapiens
tccagtctcctgaaaggcagcgt

SEQ ID NO: 7041042 - DNA, 22 bp, Homo sapiens
tccagtctctactctgagataa

SEQ ID NO: 7041043 - DNA, 22 bp, Homo sapiens
tccagtctctggctgtttgtga

SEQ ID NO: 7041044 - DNA, 22 bp, Homo sapiens
tccagtctggagccttctggtt

SEQ ID NO: 7041045 - DNA, 22 bp, Homo sapiens
tccagtctggtatgaatcctag

SEQ ID NO: 7041046 - DNA, 22 bp, Homo sapiens
tccagtctgtagtgcacagtga

SEQ ID NO: 7041047 - DNA, 18 bp, Homo sapiens
tccagtcttattaccatt

SEQ ID NO: 7041048 - DNA, 22 bp, Homo sapiens
tccagtcttcttgcagctacat

SEQ ID NO: 7041049 - DNA, 22 bp, Homo sapiens
tccaggccctgggatgggagca

SEQ ID NO: 7041050 - DNA, 22 bp, Homo sapiens
tccaggccgcaggggcagcccc

SEQ ID NO: 7041051 - DNA, 22 bp, Homo sapiens
tccagggacagcgctggagcta

SEQ ID NO: 7041052 - DNA, 22 bp, Homo sapiens
tccagggacagtatagaggatc

SEQ ID NO: 7041053 - DNA, 22 bp, Homo sapiens
tccagggacctccctgagagct

SEQ ID NO: 7041054 - DNA, 22 bp, Homo sapiens
tccagggagatactggctgcca

SEQ ID NO: 7041055 - DNA, 22 bp, Homo sapiens
tccaggccagggtaagaggaga

SEQ ID NO: 7041056 - DNA, 21 bp, Homo sapiens
tccaggccatggtggggaggc

SEQ ID NO: 7041057 - DNA, 22 bp, Homo sapiens
tccaggccattgactgcatcct

SEQ ID NO: 7041058 - DNA, 20 bp, Homo sapiens
tccaggcccactcagctgaa

SEQ ID NO: 7041059 - DNA, 22 bp, Homo sapiens
tccaggcccactcggtggggct

SEQ ID NO: 7041060 - DNA, 22 bp, Homo sapiens
tccaggcccagacggggtgagg

SEQ ID NO: 7041061 - DNA, 22 bp, Homo sapiens
tcccagctactctagaggctga

SEQ ID NO: 7041062 - DNA, 22 bp, Homo sapiens
tcccagctcacatatggtaact

SEQ ID NO: 7041063 - DNA, 22 bp, Homo sapiens
tcccagctgagattgagcaagg

SEQ ID NO: 7041064 - DNA, 22 bp, Homo sapiens
tcccagctgctgagatagtgct

SEQ ID NO: 7041065 - DNA, 22 bp, Homo sapiens
tcccagctgtgtggaggagatg

SEQ ID NO: 7041066 - DNA, 22 bp, Homo sapiens
tcccagctgtgtggaggagatg

SEQ ID NO: 7041067 - DNA, 22 bp, Homo sapiens
tcaggggacagccagctggagg

SEQ ID NO: 7041068 - DNA, 22 bp, Homo sapiens
tcaggggcagccggggaagcca

SEQ ID NO: 7041069 - DNA, 22 bp, Homo sapiens
tcaggggcagctgtgctttgtg

SEQ ID NO: 7041070 - DNA, 22 bp, Homo sapiens
tcaggggcccttccctcagcag

SEQ ID NO: 7041071 - DNA, 22 bp, Homo sapiens
tcaggggctgtgcatttcccag

SEQ ID NO: 7041072 - DNA, 21 bp, Homo sapiens
tcaggggctgtgttttccatc

SEQ ID NO: 7041073 - DNA, 22 bp, Homo sapiens
tcaggggcttgaggtgcatgtc

SEQ ID NO: 7041074 - DNA, 22 bp, Homo sapiens
tcagggctgccgggcagaccgt

SEQ ID NO: 7041075 - DNA, 22 bp, Homo sapiens
tcagggctggcttttgcagagc

SEQ ID NO: 7041076 - DNA, 22 bp, Homo sapiens
tcagggctgtggttccttttct

SEQ ID NO: 7041077 - DNA, 22 bp, Homo sapiens
tcagggctttggcttttactct

SEQ ID NO: 7041078 - DNA, 22 bp, Homo sapiens
tcagggtgaaattgggtcctgg

SEQ ID NO: 7041079 - DNA, 22 bp, Homo sapiens
tcaggtggagacctccttggcc

SEQ ID NO: 7041080 - DNA, 22 bp, Homo sapiens
tcagggcacaggcctgtgggtt

SEQ ID NO: 7041081 - DNA, 21 bp, Homo sapiens
tcagtggctcctggtgacgtc

SEQ ID NO: 7041082 - DNA, 20 bp, Homo sapiens
tcagtgggaaagtgagagtg

SEQ ID NO: 7041083 - DNA, 22 bp, Homo sapiens
tcagtggggtcgatgtgaggga

SEQ ID NO: 7041084 - DNA, 22 bp, Homo sapiens
tcagttatcattgctgtaaatt

SEQ ID NO: 7041085 - DNA, 23 bp, Homo sapiens
tcagttattggtgataaagctgg

SEQ ID NO: 7041086 - DNA, 22 bp, Homo sapiens
tcagttatagatacttttacca

SEQ ID NO: 7041087 - DNA, 22 bp, Homo sapiens
tcagttctaacagtttagaaca

SEQ ID NO: 7041088 - DNA, 22 bp, Homo sapiens
tcagttttaaggtttgagaatt

SEQ ID NO: 7041089 - DNA, 19 bp, Homo sapiens
tcagttttagtcatcagtt

SEQ ID NO: 7041090 - DNA, 22 bp, Homo sapiens
tcagttttcaatttcatcagag

SEQ ID NO: 7041091 - DNA, 22 bp, Homo sapiens
tcagttttcatttcatgagcag

SEQ ID NO: 7041092 - DNA, 22 bp, Homo sapiens
tcagttttctcatctgtaattt

SEQ ID NO: 7041093 - DNA, 22 bp, Homo sapiens
tcagttttctcatctgtgaaat

SEQ ID NO: 7041094 - DNA, 22 bp, Homo sapiens
tcagttttctcatttatgagat

SEQ ID NO: 7041095 - DNA, 22 bp, Homo sapiens
tcagttttgaaaacattgaatg

SEQ ID NO: 7041096 - DNA, 22 bp, Homo sapiens
tcagttttgattcctggttctc

SEQ ID NO: 7041097 - DNA, 23 bp, Homo sapiens
tcagttttggctgttcagtgttg

SEQ ID NO: 7041098 - DNA, 22 bp, Homo sapiens
tcagttttgtatgttgtaagtc

SEQ ID NO: 7041099 - DNA, 22 bp, Homo sapiens
tcagtttttaaatgatataatt

SEQ ID NO: 7041100 - DNA, 22 bp, Homo sapiens
tcagtttttaagagttatgcga

SEQ ID NO: 7041101 - DNA, 22 bp, Homo sapiens
tcagtttttacggtcacaggga

SEQ ID NO: 7041102 - DNA, 22 bp, Homo sapiens
tcagtttttctatactttgtag

SEQ ID NO: 7041103 - DNA, 22 bp, Homo sapiens
tcagtttttgtttgccagatag

SEQ ID NO: 7041104 - DNA, 22 bp, Homo sapiens
tcagctgttttgagtttaattg

SEQ ID NO: 7041105 - DNA, 22 bp, Homo sapiens
tcagctttccttgctttagatt

SEQ ID NO: 7041106 - DNA, 22 bp, Homo sapiens
tcagctttctcaaagaagctgg

SEQ ID NO: 7041107 - DNA, 20 bp, Homo sapiens
tcagaggctgccagctgggg

SEQ ID NO: 7041108 - DNA, 22 bp, Homo sapiens
tcagaggctggaagagcctcct

SEQ ID NO: 7041109 - DNA, 22 bp, Homo sapiens
tcagaggcttctgctcacctca

SEQ ID NO: 7041110 - DNA, 22 bp, Homo sapiens
tcagaggcttctggccagtctg

SEQ ID NO: 7041111 - DNA, 22 bp, Homo sapiens
tcaggagagtgttcagtggagg

SEQ ID NO: 7041112 - DNA, 22 bp, Homo sapiens
tcaggagatggtctttataggc

SEQ ID NO: 7041113 - DNA, 22 bp, Homo sapiens
tcaggagatgtaaccttagctg

SEQ ID NO: 7041114 - DNA, 22 bp, Homo sapiens
tcaggagcctgaaagaggtcta

SEQ ID NO: 7041115 - DNA, 22 bp, Homo sapiens
tcaggagggctaagactgtagc

SEQ ID NO: 7041116 - DNA, 22 bp, Homo sapiens
tcaggaggtctgctgcggggtg

SEQ ID NO: 7041117 - DNA, 21 bp, Homo sapiens
tcacgtggtcacatgagcttt

SEQ ID NO: 7041118 - DNA, 21 bp, Homo sapiens
tcagaactggtgcagatgaat

SEQ ID NO: 7041119 - DNA, 22 bp, Homo sapiens
tcagaggcaaagaactttatta

SEQ ID NO: 7041120 - DNA, 22 bp, Homo sapiens
tcagaggcagctgatgttctgt

SEQ ID NO: 7041121 - DNA, 22 bp, Homo sapiens
tcagaggccaaactgagcaggg

SEQ ID NO: 7041122 - DNA, 22 bp, Homo sapiens
tcagaggcctatgtctacaact

SEQ ID NO: 7041123 - DNA, 22 bp, Homo sapiens
tcagaggctgcatttttatcca

SEQ ID NO: 7041124 - DNA, 22 bp, Homo sapiens
tcaaaaatgttttatattggta

SEQ ID NO: 7041125 - DNA, 22 bp, Homo sapiens
tcaaaagtttcacatagagata

SEQ ID NO: 7041126 - DNA, 22 bp, Homo sapiens
tcaaaattagtgaccaaaggca

SEQ ID NO: 7041127 - DNA, 22 bp, Homo sapiens
tcaaacagaaattgttcatgct

SEQ ID NO: 7041128 - DNA, 22 bp, Homo sapiens
tcaattatgccattgcaatatt

SEQ ID NO: 7041129 - DNA, 22 bp, Homo sapiens
tcaattcaacacatgcacattg

SEQ ID NO: 7041130 - DNA, 22 bp, Homo sapiens
tcaattcaattgaacagttact

SEQ ID NO: 7041131 - DNA, 22 bp, Homo sapiens
tcaattcaattgcatttctgtg

SEQ ID NO: 7041132 - DNA, 22 bp, Homo sapiens
tcaattcacagctctgctattt

SEQ ID NO: 7041133 - DNA, 22 bp, Homo sapiens
tcaattcagactgagaaatgat

SEQ ID NO: 7041134 - DNA, 22 bp, Homo sapiens
tcaattcagtccaacagtaatt

SEQ ID NO: 7041135 - DNA, 22 bp, Homo sapiens
tcaattcatagagttgacacag

SEQ ID NO: 7041136 - DNA, 22 bp, Homo sapiens
tcaattctagagccttacattg

SEQ ID NO: 7041137 - DNA, 22 bp, Homo sapiens
tcaattctgcctctaaatattt

SEQ ID NO: 7041138 - DNA, 22 bp, Homo sapiens
tcacacataaaaagaagactag

SEQ ID NO: 7041139 - DNA, 22 bp, Homo sapiens
tcacagaatagcactgtaagcg

SEQ ID NO: 7041140 - DNA, 20 bp, Homo sapiens
tcacagaatgcctgaagaag

SEQ ID NO: 7041141 - DNA, 22 bp, Homo sapiens
tcacagaatgtctagcataatt

SEQ ID NO: 7041142 - DNA, 22 bp, Homo sapiens
tcacatagtggggcattggaat

SEQ ID NO: 7041143 - DNA, 21 bp, Homo sapiens
tcacatctatgttaagcaaac

SEQ ID NO: 7041144 - DNA, 22 bp, Homo sapiens
tttgtcttatccaatctctcag

SEQ ID NO: 7041145 - DNA, 22 bp, Homo sapiens
tttgtcttccccctttaatcag

SEQ ID NO: 7041146 - DNA, 22 bp, Homo sapiens
ttttaattttagcccttctggt

SEQ ID NO: 7041147 - DNA, 22 bp, Homo sapiens
ttttaattttgcaaatctggtg

SEQ ID NO: 7041148 - DNA, 22 bp, Homo sapiens
ttttacacctgttaactctaag

SEQ ID NO: 7041149 - DNA, 22 bp, Homo sapiens
ttttacacttcggttgtgtgca

SEQ ID NO: 7041150 - DNA, 22 bp, Homo sapiens
ttttacattgggaaatgcctct

SEQ ID NO: 7041151 - DNA, 22 bp, Homo sapiens
ttttaccactgggtgacatgga

SEQ ID NO: 7041152 - DNA, 22 bp, Homo sapiens
ttttacttaattcttggtcatg

SEQ ID NO: 7041153 - DNA, 22 bp, Homo sapiens
ttttacttcattcctgacttca

SEQ ID NO: 7041154 - DNA, 22 bp, Homo sapiens
ttttactttggatacagtactt

SEQ ID NO: 7041155 - DNA, 22 bp, Homo sapiens
ttttagaaatactgatttagtg

SEQ ID NO: 7041156 - DNA, 22 bp, Homo sapiens
ttttagaagtgcctatcctatg

SEQ ID NO: 7041157 - DNA, 22 bp, Homo sapiens
ttttattgtcaatgaagacaga

SEQ ID NO: 7041158 - DNA, 22 bp, Homo sapiens
ttttattgtctcccagttctgg

SEQ ID NO: 7041159 - DNA, 22 bp, Homo sapiens
ttttcaagagagtgttctatgt

SEQ ID NO: 7041160 - DNA, 22 bp, Homo sapiens
ttttccttagcttctctgcgag

SEQ ID NO: 7041161 - DNA, 19 bp, Homo sapiens
ttttccttctatatgtttc

SEQ ID NO: 7041162 - DNA, 22 bp, Homo sapiens
ttttgtcacctgatttgcccac

SEQ ID NO: 7041163 - DNA, 22 bp, Homo sapiens
tttttgtatagaaatgaactaa

SEQ ID NO: 7041164 - DNA, 22 bp, Homo sapiens
ttttttatatcaactgaagtct

SEQ ID NO: 7041165 - DNA, 22 bp, Homo sapiens
ttttttcagcctgtctgtgcca

SEQ ID NO: 7041166 - DNA, 22 bp, Homo sapiens
tttggggccagccccatgtctg

SEQ ID NO: 7041167 - DNA, 22 bp, Homo sapiens
tttggggctcagcaggctgttt

SEQ ID NO: 7041168 - DNA, 22 bp, Homo sapiens
tttgtcataactctgctgcaag

SEQ ID NO: 7041169 - DNA, 22 bp, Homo sapiens
tttgtcatatagactattgtga

SEQ ID NO: 7041170 - DNA, 22 bp, Homo sapiens
tttgtcatattgaaggtgctta

SEQ ID NO: 7041171 - DNA, 22 bp, Homo sapiens
tttgtcatatcacacaattttg

SEQ ID NO: 7041172 - DNA, 22 bp, Homo sapiens
tttgtcatcagttattaatatg

SEQ ID NO: 7041173 - DNA, 22 bp, Homo sapiens
tttgtcatcccttttgaaactg

SEQ ID NO: 7041174 - DNA, 22 bp, Homo sapiens
tttgtcatgctttccttatgga

SEQ ID NO: 7041175 - DNA, 19 bp, Homo sapiens
tttgtcatggtgagttgtt

SEQ ID NO: 7041176 - DNA, 22 bp, Homo sapiens
tttgtcatgtccttaactgtct

SEQ ID NO: 7041177 - DNA, 22 bp, Homo sapiens
tttgtcatgttttgtaatgtct

SEQ ID NO: 7041178 - DNA, 22 bp, Homo sapiens
tttgtcattctgtgtatttaaa

SEQ ID NO: 7041179 - DNA, 22 bp, Homo sapiens
tttgtcatttccctgattaaag

SEQ ID NO: 7041180 - DNA, 22 bp, Homo sapiens
tttctattctggatctgtggca

SEQ ID NO: 7041181 - DNA, 22 bp, Homo sapiens
tttctattgatctaataaacat

SEQ ID NO: 7041182 - DNA, 22 bp, Homo sapiens
tttctattgatctaataaacat

SEQ ID NO: 7041183 - DNA, 22 bp, Homo sapiens
tttctattgatctaataaacat

SEQ ID NO: 7041184 - DNA, 22 bp, Homo sapiens
tttctattggcgtcactgttgt

SEQ ID NO: 7041185 - DNA, 22 bp, Homo sapiens
tttctattggcgtcactgttgt

SEQ ID NO: 7041186 - DNA, 22 bp, Homo sapiens
tttgacagcataatcctacacc

SEQ ID NO: 7041187 - DNA, 22 bp, Homo sapiens
tttgacagcttgttacaaagtt

SEQ ID NO: 7041188 - DNA, 22 bp, Homo sapiens
tttgacagtgctattaagaaac

SEQ ID NO: 7041189 - DNA, 22 bp, Homo sapiens
tttgacagtgctgctaaaatgc

SEQ ID NO: 7041190 - DNA, 19 bp, Homo sapiens
tttgagaagttattatcta

SEQ ID NO: 7041191 - DNA, 22 bp, Homo sapiens
ttttttccaacttaagacttca

SEQ ID NO: 7041192 - DNA, 22 bp, Homo sapiens
ttttttcctgagccttgtggtc

SEQ ID NO: 7041193 - DNA, 22 bp, Homo sapiens
tttcgaatgatgtttggaatat

SEQ ID NO: 7041194 - DNA, 22 bp, Homo sapiens
tttcgagggattagctaggact

SEQ ID NO: 7041195 - DNA, 22 bp, Homo sapiens
tttcggaaatgcagaaacttca

SEQ ID NO: 7041196 - DNA, 22 bp, Homo sapiens
tttctaaaatagattttatggt

SEQ ID NO: 7041197 - DNA, 22 bp, Homo sapiens
tttccagggaggaatgtggggt

SEQ ID NO: 7041198 - DNA, 22 bp, Homo sapiens
tttccaggcagaggagttgtga

SEQ ID NO: 7041199 - DNA, 22 bp, Homo sapiens
tttccagggctctgtagaagaa

SEQ ID NO: 7041200 - DNA, 22 bp, Homo sapiens
tttcataaacagtagaagacta

SEQ ID NO: 7041201 - DNA, 22 bp, Homo sapiens
tttcataacctcaagctacagt

SEQ ID NO: 7041202 - DNA, 22 bp, Homo sapiens
tttcataagggtttctagactt

SEQ ID NO: 7041203 - DNA, 22 bp, Homo sapiens
tttcataatactgtacatgaaa

SEQ ID NO: 7041204 - DNA, 22 bp, Homo sapiens
tttcataatatccagagatttt

SEQ ID NO: 7041205 - DNA, 22 bp, Homo sapiens
tttcataatatccagagatttt

SEQ ID NO: 7041206 - DNA, 22 bp, Homo sapiens
tttcaaggctagttttaattag

SEQ ID NO: 7041207 - DNA, 21 bp, Homo sapiens
tttcaagggaccctggggatc

SEQ ID NO: 7041208 - DNA, 22 bp, Homo sapiens
tttcaaggtgcaggagggtttt

SEQ ID NO: 7041209 - DNA, 22 bp, Homo sapiens
tttcaagtcattctataatatc

SEQ ID NO: 7041210 - DNA, 22 bp, Homo sapiens
tttcaagttctgttcctaaact

SEQ ID NO: 7041211 - DNA, 22 bp, Homo sapiens
tttcaagttgttgcattaaatg

SEQ ID NO: 7041212 - DNA, 22 bp, Homo sapiens
tttcacatggactttttgttct

SEQ ID NO: 7041213 - DNA, 22 bp, Homo sapiens
tttcacattggcttctatttct

SEQ ID NO: 7041214 - DNA, 22 bp, Homo sapiens
tttcagtttgaaggaaaggcca

SEQ ID NO: 7041215 - DNA, 23 bp, Homo sapiens
tttcagtttggaccagccccgac

SEQ ID NO: 7041216 - DNA, 22 bp, Homo sapiens
tttcagtttgtcggccttggac

SEQ ID NO: 7041217 - DNA, 22 bp, Homo sapiens
tttcagttttataactttggcc

SEQ ID NO: 7041218 - DNA, 22 bp, Homo sapiens
tttcagtttttgctcgatgtat

SEQ ID NO: 7041219 - DNA, 22 bp, Homo sapiens
tttaacttagaagagatatcct

SEQ ID NO: 7041220 - DNA, 22 bp, Homo sapiens
ttgtttaaaatgtagcaagaaa

SEQ ID NO: 7041221 - DNA, 22 bp, Homo sapiens
tttaaattatagttaatgtctg

SEQ ID NO: 7041222 - DNA, 22 bp, Homo sapiens
tttaacaggtaaagtaaatgtg

SEQ ID NO: 7041223 - DNA, 21 bp, Homo sapiens
ttgttcttccagaagcaaagt

SEQ ID NO: 7041224 - DNA, 22 bp, Homo sapiens
ttgttcttggagcaggcagaga

SEQ ID NO: 7041225 - DNA, 22 bp, Homo sapiens
tttaagagctagtatgtcattt

SEQ ID NO: 7041226 - DNA, 19 bp, Homo sapiens
tttacaagttctttgtatg

SEQ ID NO: 7041227 - DNA, 22 bp, Homo sapiens
tttacactcctggaaatgatat

SEQ ID NO: 7041228 - DNA, 22 bp, Homo sapiens
tttacactgacagcacataagg

SEQ ID NO: 7041229 - DNA, 22 bp, Homo sapiens
tttacactgccattctgaatac

SEQ ID NO: 7041230 - DNA, 22 bp, Homo sapiens
tttacactgcttgaacaatctc

SEQ ID NO: 7041231 - DNA, 22 bp, Homo sapiens
tttacactgtgaaacaggtatc

SEQ ID NO: 7041232 - DNA, 22 bp, Homo sapiens
tttacactgtgaaacaggtatc

SEQ ID NO: 7041233 - DNA, 22 bp, Homo sapiens
tttacacttattatgaagcttt

SEQ ID NO: 7041234 - DNA, 22 bp, Homo sapiens
tttacacttattatgaagcttt

SEQ ID NO: 7041235 - DNA, 22 bp, Homo sapiens
tttacacttgaggaaactgagg

SEQ ID NO: 7041236 - DNA, 22 bp, Homo sapiens
tttacactttcctgggaacatc

SEQ ID NO: 7041237 - DNA, 22 bp, Homo sapiens
tttacagagaatgtacataaag

SEQ ID NO: 7041238 - DNA, 22 bp, Homo sapiens
tttagcattaagcttttcaaat

SEQ ID NO: 7041239 - DNA, 22 bp, Homo sapiens
tttaggaagagttgagtaaatt

SEQ ID NO: 7041240 - DNA, 22 bp, Homo sapiens
tttaggaagagttgagtaaatt

SEQ ID NO: 7041241 - DNA, 22 bp, Homo sapiens
tttaggaagatctgaaggaaga

SEQ ID NO: 7041242 - DNA, 22 bp, Homo sapiens
tttaggaatagctgacaatctt

SEQ ID NO: 7041243 - DNA, 22 bp, Homo sapiens
tttaggaatattttctttcagg

SEQ ID NO: 7041244 - DNA, 22 bp, Homo sapiens
tttaggaatgtggtttttgagc

SEQ ID NO: 7041245 - DNA, 18 bp, Homo sapiens
tttaggaattccaagaga

SEQ ID NO: 7041246 - DNA, 22 bp, Homo sapiens
tttatctgatattcagcgattt

SEQ ID NO: 7041247 - DNA, 21 bp, Homo sapiens
tttatgtacttcatagagtag

SEQ ID NO: 7041248 - DNA, 22 bp, Homo sapiens
tttatgtttgacaatgatctgg

SEQ ID NO: 7041249 - DNA, 22 bp, Homo sapiens
tttatgtttgacaatgatctgg

SEQ ID NO: 7041250 - DNA, 22 bp, Homo sapiens
tttattgctgtgttagggacag

SEQ ID NO: 7041251 - DNA, 22 bp, Homo sapiens
tttattgtgttgaaactgaatt

SEQ ID NO: 7041252 - DNA, 22 bp, Homo sapiens
ttggctggtttcaagaaggcat

SEQ ID NO: 7041253 - DNA, 22 bp, Homo sapiens
ttggctggtaagccaaatgaaa

SEQ ID NO: 7041254 - DNA, 22 bp, Homo sapiens
ttgggaaagggattatgagtag

SEQ ID NO: 7041255 - DNA, 22 bp, Homo sapiens
ttgggctcctgttgatcctgtc

SEQ ID NO: 7041256 - DNA, 22 bp, Homo sapiens
ttggggctcaggccgccgatgc

SEQ ID NO: 7041257 - DNA, 22 bp, Homo sapiens
ttggggctctgaaaaagatgta

SEQ ID NO: 7041258 - DNA, 22 bp, Homo sapiens
ttgggggcagagggagcatctg

SEQ ID NO: 7041259 - DNA, 22 bp, Homo sapiens
ttgtagaaaattagatgcatgg

SEQ ID NO: 7041260 - DNA, 22 bp, Homo sapiens
ttgtattctgttacagcaacat

SEQ ID NO: 7041261 - DNA, 20 bp, Homo sapiens
ttgttcattgagctgttttc

SEQ ID NO: 7041262 - DNA, 22 bp, Homo sapiens
ttgttcttacttaagagtgaat

SEQ ID NO: 7041263 - DNA, 20 bp, Homo sapiens
ttggatgtgcatggccgtgc

SEQ ID NO: 7041264 - DNA, 21 bp, Homo sapiens
ttggaatcttaggagtgtggg

SEQ ID NO: 7041265 - DNA, 22 bp, Homo sapiens
ttggaagttgatttaaaaagga

SEQ ID NO: 7041266 - DNA, 22 bp, Homo sapiens
ttggaataaaaacaactcacag

SEQ ID NO: 7041267 - DNA, 20 bp, Homo sapiens
ttggaatcacctggagaggt

SEQ ID NO: 7041268 - DNA, 22 bp, Homo sapiens
ttggaatcattcttaaaggtct

SEQ ID NO: 7041269 - DNA, 22 bp, Homo sapiens
ttggaatcctgagatgagaatt

SEQ ID NO: 7041270 - DNA, 22 bp, Homo sapiens
ttggaatctgcaatttaacaaa

SEQ ID NO: 7041271 - DNA, 23 bp, Homo sapiens
ttggaacacagtaaatgcacaat

SEQ ID NO: 7041272 - DNA, 22 bp, Homo sapiens
ttggaacagaaacagacaaata

SEQ ID NO: 7041273 - DNA, 22 bp, Homo sapiens
ttgcatttttagatgcttctgt

SEQ ID NO: 7041274 - DNA, 22 bp, Homo sapiens
ttgcatttcctgtactgtttga

SEQ ID NO: 7041275 - DNA, 22 bp, Homo sapiens
ttgcatttgagaaagttctcct

SEQ ID NO: 7041276 - DNA, 22 bp, Homo sapiens
ttgcctattgttcttacatgtt

SEQ ID NO: 7041277 - DNA, 22 bp, Homo sapiens
ttgcctttaacccctgaaaggc

SEQ ID NO: 7041278 - DNA, 22 bp, Homo sapiens
ttgcctttaagtataactgctg

SEQ ID NO: 7041279 - DNA, 17 bp, Homo sapiens
ttgcctttatggtcact

SEQ ID NO: 7041280 - DNA, 22 bp, Homo sapiens
ttgcctttcccatgtctaggag

SEQ ID NO: 7041281 - DNA, 22 bp, Homo sapiens
ttgcctttcccctctggaagca

SEQ ID NO: 7041282 - DNA, 22 bp, Homo sapiens
ttgcctttgacggtgcagcagt

SEQ ID NO: 7041283 - DNA, 22 bp, Homo sapiens
ttgccttttgctctgggggcag

SEQ ID NO: 7041284 - DNA, 22 bp, Homo sapiens
ttccatattgtactctttggag

SEQ ID NO: 7041285 - DNA, 22 bp, Homo sapiens
ttccatgagtagcagtatttcc

SEQ ID NO: 7041286 - DNA, 22 bp, Homo sapiens
ttccaaggtgggactggggtgc

SEQ ID NO: 7041287 - DNA, 20 bp, Homo sapiens
ttccaaggtctatgcttctt

SEQ ID NO: 7041288 - DNA, 22 bp, Homo sapiens
ttccaaggtgttctgctggttt

SEQ ID NO: 7041289 - DNA, 22 bp, Homo sapiens
ttccaaggttactggtggttta

SEQ ID NO: 7041290 - DNA, 22 bp, Homo sapiens
ttccaaggtttctccagcctcc

SEQ ID NO: 7041291 - DNA, 22 bp, Homo sapiens
ttccaaggttagtttttagggt

SEQ ID NO: 7041292 - DNA, 22 bp, Homo sapiens
ttccaaggctctcttcccacaa

SEQ ID NO: 7041293 - DNA, 22 bp, Homo sapiens
ttccaaggctgctatttgtttc

SEQ ID NO: 7041294 - DNA, 22 bp, Homo sapiens
ttccaaggctgtaaaattggtt

SEQ ID NO: 7041295 - DNA, 22 bp, Homo sapiens
ttccaaggctgtcctcactttg

SEQ ID NO: 7041296 - DNA, 22 bp, Homo sapiens
ttccaagggaatgtttatgagt

SEQ ID NO: 7041297 - DNA, 23 bp, Homo sapiens
ttccaaggggatgtctccaagtg

SEQ ID NO: 7041298 - DNA, 22 bp, Homo sapiens
ttccaattgttctttggaatct

SEQ ID NO: 7041299 - DNA, 21 bp, Homo sapiens
ttccagttttaattaaattgt

SEQ ID NO: 7041300 - DNA, 22 bp, Homo sapiens
ttccataaaggtgatagtatac

SEQ ID NO: 7041301 - DNA, 22 bp, Homo sapiens
ttccatatctgttgcatatcat

SEQ ID NO: 7041302 - DNA, 22 bp, Homo sapiens
ttccaaggagaacactctgtag

SEQ ID NO: 7041303 - DNA, 22 bp, Homo sapiens
ttccaaggagagctcgacctca

SEQ ID NO: 7041304 - DNA, 17 bp, Homo sapiens
ttccaaggagcatttga

SEQ ID NO: 7041305 - DNA, 22 bp, Homo sapiens
ttccaaggagtgaacttcaaat

SEQ ID NO: 7041306 - DNA, 22 bp, Homo sapiens
ttccaaggattgaaatgtagtc

SEQ ID NO: 7041307 - DNA, 22 bp, Homo sapiens
ttccaaggcaacagcctaggct

SEQ ID NO: 7041308 - DNA, 22 bp, Homo sapiens
ttccaaggcagttttctctctg

SEQ ID NO: 7041309 - DNA, 22 bp, Homo sapiens
ttccaaggcatgttctcaagta

SEQ ID NO: 7041310 - DNA, 19 bp, Homo sapiens
ttccaaggcatttctttgc

SEQ ID NO: 7041311 - DNA, 22 bp, Homo sapiens
ttccaaggccagacagggcagt

SEQ ID NO: 7041312 - DNA, 22 bp, Homo sapiens
ttccaaggccaggccctgaggt

SEQ ID NO: 7041313 - DNA, 22 bp, Homo sapiens
ttccaaggcccagcagagagga

SEQ ID NO: 7041314 - DNA, 22 bp, Homo sapiens
ttccaaggcgatggcgcagaac

SEQ ID NO: 7041315 - DNA, 22 bp, Homo sapiens
ttccaaggcgcgccggcgccac

SEQ ID NO: 7041316 - DNA, 22 bp, Homo sapiens
ttccaaggctaggttgtaaagg

SEQ ID NO: 7041317 - DNA, 22 bp, Homo sapiens
ttcaatatgatattagctgtgg

SEQ ID NO: 7041318 - DNA, 22 bp, Homo sapiens
ttcagaaatcgagtttcatgtc

SEQ ID NO: 7041319 - DNA, 22 bp, Homo sapiens
ttcatacatttttactaacagc

SEQ ID NO: 7041320 - DNA, 22 bp, Homo sapiens
ttcatagacccagaactcatta

SEQ ID NO: 7041321 - DNA, 22 bp, Homo sapiens
ttcatagagcagctcactgaat

SEQ ID NO: 7041322 - DNA, 22 bp, Homo sapiens
ttcatatttctttaaggacttt

SEQ ID NO: 7041323 - DNA, 22 bp, Homo sapiens
ttcatattttctgcttgctcac

SEQ ID NO: 7041324 - DNA, 22 bp, Homo sapiens
ttatttaaaagtggtaagattc

SEQ ID NO: 7041325 - DNA, 22 bp, Homo sapiens
ttatttaaaagtggtaagattc

SEQ ID NO: 7041326 - DNA, 22 bp, Homo sapiens
ttatttaaaatgtaggttggga

SEQ ID NO: 7041327 - DNA, 22 bp, Homo sapiens
ttatttaatgtgatctgaagag

SEQ ID NO: 7041328 - DNA, 22 bp, Homo sapiens
ttatttaattttctcactcaga

SEQ ID NO: 7041329 - DNA, 22 bp, Homo sapiens
ttatttacaactcttctcttcc

SEQ ID NO: 7041330 - DNA, 22 bp, Homo sapiens
ttatttactggatggccttggg

SEQ ID NO: 7041331 - DNA, 22 bp, Homo sapiens
ttattttaccttcctctgagct

SEQ ID NO: 7041332 - DNA, 22 bp, Homo sapiens
ttattttcagctaggaaagcca

SEQ ID NO: 7041333 - DNA, 22 bp, Homo sapiens
ttattttctcctcagaaagtgg

SEQ ID NO: 7041334 - DNA, 21 bp, Homo sapiens
ttcaaaatggtgtgtttgtct

SEQ ID NO: 7041335 - DNA, 22 bp, Homo sapiens
ttcaaaattgttctaagctctg

SEQ ID NO: 7041336 - DNA, 22 bp, Homo sapiens
ttcaagaaggtacatttacatc

SEQ ID NO: 7041337 - DNA, 22 bp, Homo sapiens
tcctctccagcaaactggctat

SEQ ID NO: 7041338 - DNA, 22 bp, Homo sapiens
tcctctggatataagcctcacc

SEQ ID NO: 7041339 - DNA, 22 bp, Homo sapiens
tcctctggctctttccctagga

SEQ ID NO: 7041340 - DNA, 20 bp, Homo sapiens
ttagttgagtagctcctgaa

SEQ ID NO: 7041341 - DNA, 22 bp, Homo sapiens
ttataagactgtagtgagtatt

SEQ ID NO: 7041342 - DNA, 22 bp, Homo sapiens
ttatggaaaactccagagagta

SEQ ID NO: 7041343 - DNA, 22 bp, Homo sapiens
ttatggaaaactccagagagta

SEQ ID NO: 7041344 - DNA, 22 bp, Homo sapiens
ttatggaaaatacaattataag

SEQ ID NO: 7041345 - DNA, 22 bp, Homo sapiens
ttatggaaaatacaattataag

SEQ ID NO: 7041346 - DNA, 22 bp, Homo sapiens
ttatggaatggagaaagtctgc

SEQ ID NO: 7041347 - DNA, 22 bp, Homo sapiens
ttatggaatttgcaaaaggtta

SEQ ID NO: 7041348 - DNA, 22 bp, Homo sapiens
ttccctccatttcattttataa

SEQ ID NO: 7041349 - DNA, 22 bp, Homo sapiens
ttcgagttggctttattaaact

SEQ ID NO: 7041350 - DNA, 22 bp, Homo sapiens
ttcgttttctaggaccaacaga

SEQ ID NO: 7041351 - DNA, 21 bp, Homo sapiens
ttctcctaggctgaggcggga

SEQ ID NO: 7041352 - DNA, 22 bp, Homo sapiens
ttctcttcccactttctgtatt

SEQ ID NO: 7041353 - DNA, 22 bp, Homo sapiens
ttctcttctgttcagtgcccaa

SEQ ID NO: 7041354 - DNA, 23 bp, Homo sapiens
ttctctttagatttacattactc

SEQ ID NO: 7041355 - DNA, 22 bp, Homo sapiens
ttctctttgacattattcaggt

SEQ ID NO: 7041356 - DNA, 22 bp, Homo sapiens
ttctctttgacattattcaggt

SEQ ID NO: 7041357 - DNA, 22 bp, Homo sapiens
ttctgccatttacaaatttcat

SEQ ID NO: 7041358 - DNA, 22 bp, Homo sapiens
ttctgcccaccacactttatct

SEQ ID NO: 7041359 - DNA, 22 bp, Homo sapiens
ttcttcttctggctgcacctgg

SEQ ID NO: 7041360 - DNA, 21 bp, Homo sapiens
ttcttcttggactgttttggc

SEQ ID NO: 7041361 - DNA, 21 bp, Homo sapiens
ttcttcttggactgttttggc

SEQ ID NO: 7041362 - DNA, 22 bp, Homo sapiens
ttctttctcactctttaggaag

SEQ ID NO: 7041363 - DNA, 22 bp, Homo sapiens
ttctttctcagtgggcagatac

SEQ ID NO: 7041364 - DNA, 22 bp, Homo sapiens
ttctttctctactagcagagct

SEQ ID NO: 7041365 - DNA, 22 bp, Homo sapiens
ttctttcttctcaggctgggta

SEQ ID NO: 7041366 - DNA, 22 bp, Homo sapiens
ttctttcttggggaacacactc

SEQ ID NO: 7041367 - DNA, 22 bp, Homo sapiens
ttctttctttgtagtcctgaac

SEQ ID NO: 7041368 - DNA, 22 bp, Homo sapiens
ttctttttatcttcccataaga

SEQ ID NO: 7041369 - DNA, 22 bp, Homo sapiens
ttctttttggatagctgatgaa

SEQ ID NO: 7041370 - DNA, 22 bp, Homo sapiens
ttgaaagaaggtggtagagaat

SEQ ID NO: 7041371 - DNA, 22 bp, Homo sapiens
ttgagaaacctggcagtagaga

SEQ ID NO: 7041372 - DNA, 18 bp, Homo sapiens
ttgagaaataagcactaa

SEQ ID NO: 7041373 - DNA, 22 bp, Homo sapiens
ttgagaaataagcatgtctaga

SEQ ID NO: 7041374 - DNA, 16 bp, Homo sapiens
ttgagaaatgaagttt

SEQ ID NO: 7041375 - DNA, 22 bp, Homo sapiens
ttgagaaatgttttttaagctg

SEQ ID NO: 7041376 - DNA, 22 bp, Homo sapiens
aatttatatgtaattaggcaca

SEQ ID NO: 7041377 - DNA, 22 bp, Homo sapiens
aatttataataaatagggcttt

SEQ ID NO: 7041378 - DNA, 22 bp, Homo sapiens
aattggaaaatgctacatatca

SEQ ID NO: 7041379 - DNA, 20 bp, Homo sapiens
aatttactcacagaatgaat

SEQ ID NO: 7041380 - DNA, 22 bp, Homo sapiens
aattatacatgaaggcattata

SEQ ID NO: 7041381 - DNA, 22 bp, Homo sapiens
aattatacattgaacaatctag

SEQ ID NO: 7041382 - DNA, 22 bp, Homo sapiens
aattatatgttaatcttcaatt

SEQ ID NO: 7041383 - DNA, 22 bp, Homo sapiens
aattatatgttaatcttcaatt

SEQ ID NO: 7041384 - DNA, 22 bp, Homo sapiens
aattatattgtggtgtgaatgt

SEQ ID NO: 7041385 - DNA, 22 bp, Homo sapiens
aattggaaaaagacttaattgc

SEQ ID NO: 7041386 - DNA, 22 bp, Homo sapiens
aatgttccacagatatagcatg

SEQ ID NO: 7041387 - DNA, 22 bp, Homo sapiens
aattaccaggatttttcagtat

SEQ ID NO: 7041388 - DNA, 22 bp, Homo sapiens
aatgtcatttttaaatgtgaga

SEQ ID NO: 7041389 - DNA, 22 bp, Homo sapiens
aatgtcatttaggattatgttt

SEQ ID NO: 7041390 - DNA, 22 bp, Homo sapiens
aatgtcatttaaaataattctg

SEQ ID NO: 7041391 - DNA, 22 bp, Homo sapiens
aatgtcattggtaaagattagg

SEQ ID NO: 7041392 - DNA, 22 bp, Homo sapiens
aatgtcattgtgagttaggctt

SEQ ID NO: 7041393 - DNA, 22 bp, Homo sapiens
aatgtcatttaaaataattctg

SEQ ID NO: 7041394 - DNA, 22 bp, Homo sapiens
aatgtctgcctgaactttatat

SEQ ID NO: 7041395 - DNA, 22 bp, Homo sapiens
aatgtctgtgccttaaaacttc

SEQ ID NO: 7041396 - DNA, 22 bp, Homo sapiens
agacagggtgatcgcttgagcc

SEQ ID NO: 7041397 - DNA, 22 bp, Homo sapiens
agacagggccactcatcctcac

SEQ ID NO: 7041398 - DNA, 22 bp, Homo sapiens
aatgtcatagcatttcttcaat

SEQ ID NO: 7041399 - DNA, 22 bp, Homo sapiens
aatgtcatattagtttgtgcct

SEQ ID NO: 7041400 - DNA, 22 bp, Homo sapiens
aatgtcatgagcctgctcttgt

SEQ ID NO: 7041401 - DNA, 22 bp, Homo sapiens
aatgtcatgggaatttattcat

SEQ ID NO: 7041402 - DNA, 21 bp, Homo sapiens
aatgtcattgaatggtgagac

SEQ ID NO: 7041403 - DNA, 22 bp, Homo sapiens
aattttattagaaggcaagggg

SEQ ID NO: 7041404 - DNA, 22 bp, Homo sapiens
aattttatgccttgcacgttgg

SEQ ID NO: 7041405 - DNA, 22 bp, Homo sapiens
aattttattaactggatgtagc

SEQ ID NO: 7041406 - DNA, 22 bp, Homo sapiens
aattttctggtgtgtaatgaag

SEQ ID NO: 7041407 - DNA, 20 bp, Homo sapiens
agaggccagttaggagtcta

SEQ ID NO: 7041408 - DNA, 22 bp, Homo sapiens
agaggccatgctagaggcctgg

SEQ ID NO: 7041409 - DNA, 22 bp, Homo sapiens
agaggccccaggtgagcatgcc

SEQ ID NO: 7041410 - DNA, 21 bp, Homo sapiens
agaggccctcggactgggcgt

SEQ ID NO: 7041411 - DNA, 22 bp, Homo sapiens
acaaaaagggagatgaggtaga

SEQ ID NO: 7041412 - DNA, 22 bp, Homo sapiens
acaaacagagttgaaaaatagg

SEQ ID NO: 7041413 - DNA, 22 bp, Homo sapiens
acaaaattacctagttattttc

SEQ ID NO: 7041414 - DNA, 22 bp, Homo sapiens
acaaaattacctagttattttc

SEQ ID NO: 7041415 - DNA, 22 bp, Homo sapiens
acaaaattgtgttaaactttat

SEQ ID NO: 7041416 - DNA, 22 bp, Homo sapiens
acaaactgggataggatcctgt

SEQ ID NO: 7041417 - DNA, 22 bp, Homo sapiens
acaaacttatgtttcatatgta

SEQ ID NO: 7041418 - DNA, 22 bp, Homo sapiens
acaaacttcccagacaagctcc

SEQ ID NO: 7041419 - DNA, 22 bp, Homo sapiens
acaaatgccatatataaattct

SEQ ID NO: 7041420 - DNA, 23 bp, Homo sapiens
acaaatgcccatacatctagttc

SEQ ID NO: 7041421 - DNA, 22 bp, Homo sapiens
agatggggctgaaagttccaat

SEQ ID NO: 7041422 - DNA, 22 bp, Homo sapiens
acaattcaagaagagagatgaa

SEQ ID NO: 7041423 - DNA, 22 bp, Homo sapiens
acaattcaagatgagattcagg

SEQ ID NO: 7041424 - DNA, 22 bp, Homo sapiens
acaattcaagcaagagagacaa

SEQ ID NO: 7041425 - DNA, 22 bp, Homo sapiens
acaattcattaatgtgaggtag

SEQ ID NO: 7041426 - DNA, 22 bp, Homo sapiens
acaattctctcatatcttatta

SEQ ID NO: 7041427 - DNA, 21 bp, Homo sapiens
agcaaggcagcctctcagcct

SEQ ID NO: 7041428 - DNA, 22 bp, Homo sapiens
acaagctttgtgatagtagaga

SEQ ID NO: 7041429 - DNA, 22 bp, Homo sapiens
agatggggcagaatggagccat

SEQ ID NO: 7041430 - DNA, 22 bp, Homo sapiens
agatggggctcagtgtggaggc

SEQ ID NO: 7041431 - DNA, 18 bp, Homo sapiens
agctctggggagatgggc

SEQ ID NO: 7041432 - DNA, 22 bp, Homo sapiens
acagcaggatttggcgatgttg

SEQ ID NO: 7041433 - DNA, 22 bp, Homo sapiens
acagcaggcacacaaggataga

SEQ ID NO: 7041434 - DNA, 20 bp, Homo sapiens
agctatgtgacctgatggaa

SEQ ID NO: 7041435 - DNA, 22 bp, Homo sapiens
agctatgttatcattggtcctt

SEQ ID NO: 7041436 - DNA, 22 bp, Homo sapiens
agctatgttctgtgtctgtgga

SEQ ID NO: 7041437 - DNA, 18 bp, Homo sapiens
agcccagcggagtgaatc

SEQ ID NO: 7041438 - DNA, 22 bp, Homo sapiens
agcccagctgctatgtacctgg

SEQ ID NO: 7041439 - DNA, 22 bp, Homo sapiens
agcccagcttccttctgtctct

SEQ ID NO: 7041440 - DNA, 22 bp, Homo sapiens
agcccccaggagtctccacgcc

SEQ ID NO: 7041441 - DNA, 20 bp, Homo sapiens
agcaggaaaagtgccagtct

SEQ ID NO: 7041442 - DNA, 22 bp, Homo sapiens
acacatttctctttttgtaagt

SEQ ID NO: 7041443 - DNA, 22 bp, Homo sapiens
acacattttcaacactgtcaag

SEQ ID NO: 7041444 - DNA, 23 bp, Homo sapiens
acacatttttcccgttctgaggt

SEQ ID NO: 7041445 - DNA, 22 bp, Homo sapiens
agcagtgggtgacagagctgag

SEQ ID NO: 7041446 - DNA, 22 bp, Homo sapiens
agcagtggtccccaacctttct

SEQ ID NO: 7041447 - DNA, 22 bp, Homo sapiens
agcagtggtgtgaggagggctc

SEQ ID NO: 7041448 - DNA, 22 bp, Homo sapiens
acagaaattagcagtgagttta

SEQ ID NO: 7041449 - DNA, 22 bp, Homo sapiens
acagaacaacaaggtggaccag

SEQ ID NO: 7041450 - DNA, 22 bp, Homo sapiens
acagaacaagacctgcttattg

SEQ ID NO: 7041451 - DNA, 22 bp, Homo sapiens
acacaggaactctgagaggtgg

SEQ ID NO: 7041452 - DNA, 22 bp, Homo sapiens
acacaggaagagagataataat

SEQ ID NO: 7041453 - DNA, 22 bp, Homo sapiens
acacaggaagcaatttcagagc

SEQ ID NO: 7041454 - DNA, 22 bp, Homo sapiens
acacaggaagtcagcactgatg

SEQ ID NO: 7041455 - DNA, 22 bp, Homo sapiens
acacaggacagggatgtgtttt

SEQ ID NO: 7041456 - DNA, 22 bp, Homo sapiens
acacaggacggccctgtggctt

SEQ ID NO: 7041457 - DNA, 22 bp, Homo sapiens
acacaggagaaaagatctccca

SEQ ID NO: 7041458 - DNA, 22 bp, Homo sapiens
acacaggagagagttgggaagg

SEQ ID NO: 7041459 - DNA, 22 bp, Homo sapiens
acacaggagatatgtaatggct

SEQ ID NO: 7041460 - DNA, 22 bp, Homo sapiens
acacaggaggaggatggtggtc

SEQ ID NO: 7041461 - DNA, 21 bp, Homo sapiens
acacaggagtttcttctttct

SEQ ID NO: 7041462 - DNA, 23 bp, Homo sapiens
acacaggatacatacggaagcaa

SEQ ID NO: 7041463 - DNA, 22 bp, Homo sapiens
acacatatatttgcatatacac

SEQ ID NO: 7041464 - DNA, 22 bp, Homo sapiens
aatgactagtccacatttgtaa

SEQ ID NO: 7041465 - DNA, 22 bp, Homo sapiens
agaaaacactgccccctctctc

SEQ ID NO: 7041466 - DNA, 22 bp, Homo sapiens
agaaaacagaaagtcattggtg

SEQ ID NO: 7041467 - DNA, 22 bp, Homo sapiens
agaaaacataggagacaggaaa

SEQ ID NO: 7041468 - DNA, 22 bp, Homo sapiens
agaaaacattacataggtgtgt

SEQ ID NO: 7041469 - DNA, 22 bp, Homo sapiens
aatgaaactatatttagagagg

SEQ ID NO: 7041470 - DNA, 22 bp, Homo sapiens
aatgaacatataaagagatctt

SEQ ID NO: 7041471 - DNA, 22 bp, Homo sapiens
actttaaaaagagccttctaac

SEQ ID NO: 7041472 - DNA, 19 bp, Homo sapiens
aatattttagcctcttcct

SEQ ID NO: 7041473 - DNA, 22 bp, Homo sapiens
aatattttaggctttccaggct

SEQ ID NO: 7041474 - DNA, 22 bp, Homo sapiens
aatattttaggctttccaggct

SEQ ID NO: 7041475 - DNA, 22 bp, Homo sapiens
aatatttttgaggccctgttat

SEQ ID NO: 7041476 - DNA, 22 bp, Homo sapiens
aatatttttgaggccctgttat

SEQ ID NO: 7041477 - DNA, 22 bp, Homo sapiens
aatcaacattgttttaagtcaa

SEQ ID NO: 7041478 - DNA, 22 bp, Homo sapiens
acttgtaaacaaatctaatgta

SEQ ID NO: 7041479 - DNA, 21 bp, Homo sapiens
acttgtaacttgaaggggcat

SEQ ID NO: 7041480 - DNA, 22 bp, Homo sapiens
acttgtaagctctgtatttgag

SEQ ID NO: 7041481 - DNA, 22 bp, Homo sapiens
acttgtaagtaacaagtgagaa

SEQ ID NO: 7041482 - DNA, 22 bp, Homo sapiens
acttgtaattcctggcccaggt

SEQ ID NO: 7041483 - DNA, 22 bp, Homo sapiens
acttgttaactctcaaagaaca

SEQ ID NO: 7041484 - DNA, 22 bp, Homo sapiens
acttgaaaccctgagatgataa

SEQ ID NO: 7041485 - DNA, 19 bp, Homo sapiens
acttgaaagcagagagttt

SEQ ID NO: 7041486 - DNA, 22 bp, Homo sapiens
acttgattgtatgaagttattt

SEQ ID NO: 7041487 - DNA, 22 bp, Homo sapiens
acttgattgtatgaagttattt

SEQ ID NO: 7041488 - DNA, 22 bp, Homo sapiens
aatatatttgaatcaggaacaa

SEQ ID NO: 7041489 - DNA, 22 bp, Homo sapiens
aatatcaacagtgtccttctaa

SEQ ID NO: 7041490 - DNA, 23 bp, Homo sapiens
aatatcaaggtgatgttcccaga

SEQ ID NO: 7041491 - DNA, 18 bp, Homo sapiens
aatatcaataagggggag

SEQ ID NO: 7041492 - DNA, 22 bp, Homo sapiens
aatattcatttgcagaagaagt

SEQ ID NO: 7041493 - DNA, 19 bp, Homo sapiens
aatattttagcctcttcct

SEQ ID NO: 7041494 - DNA, 22 bp, Homo sapiens
aagtggaagagaagttatctta

SEQ ID NO: 7041495 - DNA, 22 bp, Homo sapiens
aagttacattttggtctaattg

SEQ ID NO: 7041496 - DNA, 22 bp, Homo sapiens
aagttcaaaaatgtaatcagtg

SEQ ID NO: 7041497 - DNA, 22 bp, Homo sapiens
aagttcaagagtgacatattag

SEQ ID NO: 7041498 - DNA, 22 bp, Homo sapiens
aagttctatagtctttctacta

SEQ ID NO: 7041499 - DNA, 22 bp, Homo sapiens
aagtttacataagtgatgatga

SEQ ID NO: 7041500 - DNA, 22 bp, Homo sapiens
aagtttactggggagatcacct

SEQ ID NO: 7041501 - DNA, 22 bp, Homo sapiens
aagtttatccctctcacagtta

SEQ ID NO: 7041502 - DNA, 22 bp, Homo sapiens
aagtttatgttctttgaaggca

SEQ ID NO: 7041503 - DNA, 22 bp, Homo sapiens
aataacttaagaaatttcccca

SEQ ID NO: 7041504 - DNA, 22 bp, Homo sapiens
aataagcaagcctgtgtgcaag

SEQ ID NO: 7041505 - DNA, 22 bp, Homo sapiens
aataattttagctcagagttgt

SEQ ID NO: 7041506 - DNA, 22 bp, Homo sapiens
aagggcctcctggggagcctgg

SEQ ID NO: 7041507 - DNA, 22 bp, Homo sapiens
aagggctctgtgtgcctcccca

SEQ ID NO: 7041508 - DNA, 22 bp, Homo sapiens
aagggccaagctcttctcccat

SEQ ID NO: 7041509 - DNA, 22 bp, Homo sapiens
aagggccacatgccatttaaaa

SEQ ID NO: 7041510 - DNA, 22 bp, Homo sapiens
aagggccacatttgggtccctg

SEQ ID NO: 7041511 - DNA, 22 bp, Homo sapiens
aagggccacttactcctgctgt

SEQ ID NO: 7041512 - DNA, 22 bp, Homo sapiens
aagggccagggcagggttgtga

SEQ ID NO: 7041513 - DNA, 22 bp, Homo sapiens
aagggccagggctctagagata

SEQ ID NO: 7041514 - DNA, 22 bp, Homo sapiens
aagggccagtagaattttagtg

SEQ ID NO: 7041515 - DNA, 22 bp, Homo sapiens
aagggccataacttgcagtgtt

SEQ ID NO: 7041516 - DNA, 22 bp, Homo sapiens
aagggccatcccagaacagaaa

SEQ ID NO: 7041517 - DNA, 22 bp, Homo sapiens
aagggccatcttggactcccca

SEQ ID NO: 7041518 - DNA, 22 bp, Homo sapiens
aagggccatgcctctactttct

SEQ ID NO: 7041519 - DNA, 22 bp, Homo sapiens
aagggccattgctgagagcagt

SEQ ID NO: 7041520 - DNA, 22 bp, Homo sapiens
aagggaatgttgtggttggttt

SEQ ID NO: 7041521 - DNA, 22 bp, Homo sapiens
aagggagaaaacttgtggctta

SEQ ID NO: 7041522 - DNA, 22 bp, Homo sapiens
aagggctgagcacagtgagcca

SEQ ID NO: 7041523 - DNA, 21 bp, Homo sapiens
accatcttccatgcattatat

SEQ ID NO: 7041524 - DNA, 22 bp, Homo sapiens
accatgggtcagccacctcagc

SEQ ID NO: 7041525 - DNA, 22 bp, Homo sapiens
accatgggcagaatctttgcag

SEQ ID NO: 7041526 - DNA, 22 bp, Homo sapiens
aagctgcagatgtgcctgtgga

SEQ ID NO: 7041527 - DNA, 22 bp, Homo sapiens
aaggaaatacaacatgtattca

SEQ ID NO: 7041528 - DNA, 22 bp, Homo sapiens
acagggctcccagcaggtctgt

SEQ ID NO: 7041529 - DNA, 22 bp, Homo sapiens
acagggctcctaggtggtgtgc

SEQ ID NO: 7041530 - DNA, 22 bp, Homo sapiens
acagggctccttgggctgacac

SEQ ID NO: 7041531 - DNA, 22 bp, Homo sapiens
acagggctcgtcgggccctcgg

SEQ ID NO: 7041532 - DNA, 22 bp, Homo sapiens
acagggctctgacaccaaggta

SEQ ID NO: 7041533 - DNA, 19 bp, Homo sapiens
acagggctctggacgccat

SEQ ID NO: 7041534 - DNA, 22 bp, Homo sapiens
acagggctgaggctggcttctt

SEQ ID NO: 7041535 - DNA, 23 bp, Homo sapiens
acagggctggcagctgcaagacc

SEQ ID NO: 7041536 - DNA, 22 bp, Homo sapiens
acagggctggcgttgggacaga

SEQ ID NO: 7041537 - DNA, 22 bp, Homo sapiens
acagggctggggaaagaggcta

SEQ ID NO: 7041538 - DNA, 22 bp, Homo sapiens
acagggctggggcacttggctg

SEQ ID NO: 7041539 - DNA, 23 bp, Homo sapiens
acagggctgtccagggctaggtc

SEQ ID NO: 7041540 - DNA, 22 bp, Homo sapiens
acagggcttagaaatctgttgc

SEQ ID NO: 7041541 - DNA, 22 bp, Homo sapiens
acagggcttagaacttggcctc

SEQ ID NO: 7041542 - DNA, 22 bp, Homo sapiens
acagggcttagtggaaattttt

SEQ ID NO: 7041543 - DNA, 22 bp, Homo sapiens
acagtataaactcctaaaagcc

SEQ ID NO: 7041544 - DNA, 22 bp, Homo sapiens
acagttcctgactttaactcca

SEQ ID NO: 7041545 - DNA, 22 bp, Homo sapiens
aagatttagggccagtttacat

SEQ ID NO: 7041546 - DNA, 19 bp, Homo sapiens
acactgggagaagactgct

SEQ ID NO: 7041547 - DNA, 22 bp, Homo sapiens
acacaggaaatggtttagtttt

SEQ ID NO: 7041548 - DNA, 22 bp, Homo sapiens
acacaggaactcaagctcgctt

SEQ ID NO: 7041549 - DNA, 22 bp, Homo sapiens
aagaggccccccagcaggtgaa

SEQ ID NO: 7041550 - DNA, 22 bp, Homo sapiens
aagaggcctcacctcactgccc

SEQ ID NO: 7041551 - DNA, 22 bp, Homo sapiens
aagaggctagccggctcactaa

SEQ ID NO: 7041552 - DNA, 22 bp, Homo sapiens
aagaggctgaatgagaaagtac

SEQ ID NO: 7041553 - DNA, 22 bp, Homo sapiens
aagaggctggcattgatggtag

SEQ ID NO: 7041554 - DNA, 20 bp, Homo sapiens
aagaggctgtggatcctact

SEQ ID NO: 7041555 - DNA, 18 bp, Homo sapiens
aagaggctgttctgtggg

SEQ ID NO: 7041556 - DNA, 22 bp, Homo sapiens
aagaggcttatagtcttcctgt

SEQ ID NO: 7041557 - DNA, 22 bp, Homo sapiens
aagaggctttcagtgaacttgt

SEQ ID NO: 7041558 - DNA, 22 bp, Homo sapiens
aagcagcattcagtgaaatgtg

SEQ ID NO: 7041559 - DNA, 22 bp, Homo sapiens
aagcatttcaatataatattca

SEQ ID NO: 7041560 - DNA, 22 bp, Homo sapiens
aagaaatacatggtttttgagt

SEQ ID NO: 7041561 - DNA, 22 bp, Homo sapiens
aatgttttgcattagttttcta

SEQ ID NO: 7041562 - DNA, 22 bp, Homo sapiens
aagaataaattaagatacttag

SEQ ID NO: 7041563 - DNA, 22 bp, Homo sapiens
aagaataagtagatgggagaag

SEQ ID NO: 7041564 - DNA, 22 bp, Homo sapiens
aagaatatagattttttgaagt

SEQ ID NO: 7041565 - DNA, 22 bp, Homo sapiens
aagaatatagattttttgaagt

SEQ ID NO: 7041566 - DNA, 22 bp, Homo sapiens
aagacaggaaaagctccaggcc

SEQ ID NO: 7041567 - DNA, 22 bp, Homo sapiens
aagacaggaacatagcaaatcc

SEQ ID NO: 7041568 - DNA, 22 bp, Homo sapiens
acaaagatgtttaaagcattta

SEQ ID NO: 7041569 - DNA, 22 bp, Homo sapiens
acaaggacatgcaatttggatt

SEQ ID NO: 7041570 - DNA, 22 bp, Homo sapiens
aacttaaacaagctcccaagtt

SEQ ID NO: 7041571 - DNA, 22 bp, Homo sapiens
aacttacaaggatgatagctgc

SEQ ID NO: 7041572 - DNA, 22 bp, Homo sapiens
aacttacaatgttagagtctca

SEQ ID NO: 7041573 - DNA, 22 bp, Homo sapiens
aactgttacatagttatagatc

SEQ ID NO: 7041574 - DNA, 22 bp, Homo sapiens
aatgatacaaagggttttattt

SEQ ID NO: 7041575 - DNA, 22 bp, Homo sapiens
aatgatacatatgtatcgttag

SEQ ID NO: 7041576 - DNA, 22 bp, Homo sapiens
aatgataccgccaatattacca

SEQ ID NO: 7041577 - DNA, 22 bp, Homo sapiens
aatgatcacctggtaaagagag

SEQ ID NO: 7041578 - DNA, 20 bp, Homo sapiens
aatgatcagcatagcaagga

SEQ ID NO: 7041579 - DNA, 22 bp, Homo sapiens
aatgatcattataaagtgctct

SEQ ID NO: 7041580 - DNA, 22 bp, Homo sapiens
aatataaattcctgggcccagc

SEQ ID NO: 7041581 - DNA, 22 bp, Homo sapiens
aatataatgctgttttatgcca

SEQ ID NO: 7041582 - DNA, 20 bp, Homo sapiens
aatataattctctgaattta

SEQ ID NO: 7041583 - DNA, 22 bp, Homo sapiens
aactacattgtcctttctgaag

SEQ ID NO: 7041584 - DNA, 22 bp, Homo sapiens
aactgcaataacttgtgcacca

SEQ ID NO: 7041585 - DNA, 22 bp, Homo sapiens
aaccaattaatagataggaaac

SEQ ID NO: 7041586 - DNA, 22 bp, Homo sapiens
aaccaatttaaatataaagact

SEQ ID NO: 7041587 - DNA, 22 bp, Homo sapiens
aacatgctttgataaataaaag

SEQ ID NO: 7041588 - DNA, 22 bp, Homo sapiens
aataacttcatcttcaggatag

SEQ ID NO: 7041589 - DNA, 22 bp, Homo sapiens
aataacttcatgtaacatttaa

SEQ ID NO: 7041590 - DNA, 22 bp, Homo sapiens
aataacttgaagatctcttcca

SEQ ID NO: 7041591 - DNA, 22 bp, Homo sapiens
aataacttgtatggttattcca

SEQ ID NO: 7041592 - DNA, 22 bp, Homo sapiens
aacaggaggccttccagtccag

SEQ ID NO: 7041593 - DNA, 22 bp, Homo sapiens
aacaggccttgtttttgttcat

SEQ ID NO: 7041594 - DNA, 22 bp, Homo sapiens
aacagggacaaggatagagaaa

SEQ ID NO: 7041595 - DNA, 22 bp, Homo sapiens
aacagcagctgaggagctgggc

SEQ ID NO: 7041596 - DNA, 22 bp, Homo sapiens
aacagcaggtcctggcatgggt

SEQ ID NO: 7041597 - DNA, 22 bp, Homo sapiens
aacaaagtttcaggaagataga

SEQ ID NO: 7041598 - DNA, 22 bp, Homo sapiens
aacactctacgtgcagctccta

SEQ ID NO: 7041599 - DNA, 19 bp, Homo sapiens
aaatgtgcactgttttcca

SEQ ID NO: 7041600 - DNA, 22 bp, Homo sapiens
aaatgtgtcagtttcattctct

SEQ ID NO: 7041601 - DNA, 22 bp, Homo sapiens
aaatgtgtgtatgtacatatat

SEQ ID NO: 7041602 - DNA, 22 bp, Homo sapiens
aaattctttggcctactttgaa

SEQ ID NO: 7041603 - DNA, 22 bp, Homo sapiens
aaattctttggcctactttgaa

SEQ ID NO: 7041604 - DNA, 22 bp, Homo sapiens
aaattgcaaaagtacttttagg

SEQ ID NO: 7041605 - DNA, 22 bp, Homo sapiens
aaattgcaaaagtacttttagg

SEQ ID NO: 7041606 - DNA, 22 bp, Homo sapiens
aaattgcacaatatagacatga

SEQ ID NO: 7041607 - DNA, 22 bp, Homo sapiens
aaattgcagatgctaaatgact

SEQ ID NO: 7041608 - DNA, 22 bp, Homo sapiens
aaattgcaggtaggtgggtgat

SEQ ID NO: 7041609 - DNA, 22 bp, Homo sapiens
aaattgcattcaggatgcagga

SEQ ID NO: 7041610 - DNA, 20 bp, Homo sapiens
aacaaactacaaaattatgt

SEQ ID NO: 7041611 - DNA, 22 bp, Homo sapiens
aacaaaggccgttaataaccac

SEQ ID NO: 7041612 - DNA, 22 bp, Homo sapiens
aaatgcatatcaaagacttgaa

SEQ ID NO: 7041613 - DNA, 22 bp, Homo sapiens
aaatgcatgagaaagtattctg

SEQ ID NO: 7041614 - DNA, 22 bp, Homo sapiens
aaatgcaggaaattatgctttt

SEQ ID NO: 7041615 - DNA, 22 bp, Homo sapiens
aagcatcttaaaaagtatcaga

SEQ ID NO: 7041616 - DNA, 19 bp, Homo sapiens
aagcatctttgaaactggg

SEQ ID NO: 7041617 - DNA, 22 bp, Homo sapiens
aaatggcaggctctttgctagt

SEQ ID NO: 7041618 - DNA, 22 bp, Homo sapiens
aaatgtaagtctttgtttctta

SEQ ID NO: 7041619 - DNA, 22 bp, Homo sapiens
aaatgtattgcataggatattt

SEQ ID NO: 7041620 - DNA, 22 bp, Homo sapiens
aagctcttgagtaaactagttt

SEQ ID NO: 7041621 - DNA, 22 bp, Homo sapiens
aaagtgtttacattgctataag

SEQ ID NO: 7041622 - DNA, 22 bp, Homo sapiens
aaagtgttttccatgcaatgaa

SEQ ID NO: 7041623 - DNA, 22 bp, Homo sapiens
aaagtgttttctgatgtgttct

SEQ ID NO: 7041624 - DNA, 19 bp, Homo sapiens
aaagtgttttcttttctgt

SEQ ID NO: 7041625 - DNA, 22 bp, Homo sapiens
aaagttttattcaagcattagt

SEQ ID NO: 7041626 - DNA, 22 bp, Homo sapiens
aaataatcaatttttgtagata

SEQ ID NO: 7041627 - DNA, 22 bp, Homo sapiens
aaagggccaatggagagtgtgg

SEQ ID NO: 7041628 - DNA, 22 bp, Homo sapiens
aaagggcctccgcctgggcagg

SEQ ID NO: 7041629 - DNA, 22 bp, Homo sapiens
aaagggctgaagtagtctctgt

SEQ ID NO: 7041630 - DNA, 22 bp, Homo sapiens
aactaacagtcattaaaagaac

SEQ ID NO: 7041631 - DNA, 22 bp, Homo sapiens
aaagtattcaaaaatatttggt

SEQ ID NO: 7041632 - DNA, 22 bp, Homo sapiens
aaagtattcttgactgtttttc

SEQ ID NO: 7041633 - DNA, 22 bp, Homo sapiens
aaagtatttgtgatttttacca

SEQ ID NO: 7041634 - DNA, 22 bp, Homo sapiens
aaagtgggaacaatggagagtg

SEQ ID NO: 7041635 - DNA, 22 bp, Homo sapiens
aaattttgtattctagttctag

SEQ ID NO: 7041636 - DNA, 22 bp, Homo sapiens
aaagccacagttctatgtctgc

SEQ ID NO: 7041637 - DNA, 22 bp, Homo sapiens
aacagataatttctaagttact

SEQ ID NO: 7041638 - DNA, 22 bp, Homo sapiens
aacagatttaagaagccaaggt

SEQ ID NO: 7041639 - DNA, 22 bp, Homo sapiens
aacagcaatagcactattcatt

SEQ ID NO: 7041640 - DNA, 22 bp, Homo sapiens
aaagctgctatgaacattctat

SEQ ID NO: 7041641 - DNA, 22 bp, Homo sapiens
aaactgataaaataagtacatt

SEQ ID NO: 7041642 - DNA, 22 bp, Homo sapiens
aaactgataaaataagtacatt

SEQ ID NO: 7041643 - DNA, 22 bp, Homo sapiens
aaagaactacctgtatgatatt

SEQ ID NO: 7041644 - DNA, 22 bp, Homo sapiens
aaagaactacctgtatgatatt

SEQ ID NO: 7041645 - DNA, 22 bp, Homo sapiens
aaagaataccctgggtcataaa

SEQ ID NO: 7041646 - DNA, 22 bp, Homo sapiens
aaagacacaaatgtagaccaaa

SEQ ID NO: 7041647 - DNA, 22 bp, Homo sapiens
aaactctgttgagataatattt

SEQ ID NO: 7041648 - DNA, 22 bp, Homo sapiens
aaactcttttgcatattagagg

SEQ ID NO: 7041649 - DNA, 22 bp, Homo sapiens
aaagagttccaagtcattttat

SEQ ID NO: 7041650 - DNA, 22 bp, Homo sapiens
aaattaccattgtaaagtattt

SEQ ID NO: 7041651 - DNA, 20 bp, Homo sapiens
aaattactgccacacatttc

SEQ ID NO: 7041652 - DNA, 22 bp, Homo sapiens
aaacctcttctcaagatttctg

SEQ ID NO: 7041653 - DNA, 22 bp, Homo sapiens
aaacctgtagcagtttgttaca

SEQ ID NO: 7041654 - DNA, 22 bp, Homo sapiens
aaacctagaaggaagggtctct

SEQ ID NO: 7041655 - DNA, 21 bp, Homo sapiens
aaagttacagtcagtgggtgc

SEQ ID NO: 7041656 - DNA, 22 bp, Homo sapiens
aaagttacccaatctctatgaa

SEQ ID NO: 7041657 - DNA, 22 bp, Homo sapiens
aaagttcactatgtagcagcgt

SEQ ID NO: 7041658 - DNA, 22 bp, Homo sapiens
aaagttcactgaccagcactgg

SEQ ID NO: 7041659 - DNA, 22 bp, Homo sapiens
aaagttcagattagactcaaga

SEQ ID NO: 7041660 - DNA, 18 bp, Homo sapiens
aaagttcagggagagttg

SEQ ID NO: 7041661 - DNA, 22 bp, Homo sapiens
aaagttcagtgccttctataca

SEQ ID NO: 7041662 - DNA, 22 bp, Homo sapiens
aaagttcagtgccttctataca

SEQ ID NO: 7041663 - DNA, 21 bp, Homo sapiens
aaagttcatgctttaatattc

SEQ ID NO: 7041664 - DNA, 22 bp, Homo sapiens
aaagttcatggtgttatagaaa

SEQ ID NO: 7041665 - DNA, 20 bp, Homo sapiens
aaagttcatgtttgcacttt

SEQ ID NO: 7041666 - DNA, 22 bp, Homo sapiens
aaagttcattgatgactgaggt

SEQ ID NO: 7041667 - DNA, 22 bp, Homo sapiens
aaactctagtaaaatgtattca

SEQ ID NO: 7041668 - DNA, 22 bp, Homo sapiens
aaacaatttccacctctcctga

SEQ ID NO: 7041669 - DNA, 22 bp, Homo sapiens
aaacagttctcatttgtttaga

SEQ ID NO: 7041670 - DNA, 22 bp, Homo sapiens
aaacagttctccaggaagccag

SEQ ID NO: 7041671 - DNA, 22 bp, Homo sapiens
aaacagttgttatttttatatg

SEQ ID NO: 7041672 - DNA, 22 bp, Homo sapiens
aaacagtttcattttcatgacc

SEQ ID NO: 7041673 - DNA, 22 bp, Homo sapiens
aaagggctttatatcagtgtgt

SEQ ID NO: 7041674 - DNA, 22 bp, Homo sapiens
aaaaaagattgatggtggatgc

SEQ ID NO: 7041675 - DNA, 22 bp, Homo sapiens
aaaaaattatcatagttcctga

SEQ ID NO: 7041676 - DNA, 22 bp, Homo sapiens
aaaaacacaactgtctttctct

SEQ ID NO: 7041677 - DNA, 22 bp, Homo sapiens
aaaatcttgactgtttttagaa

SEQ ID NO: 7041678 - DNA, 22 bp, Homo sapiens
aaaatcttgtgacttaggaagg

SEQ ID NO: 7041679 - DNA, 22 bp, Homo sapiens
aaacagaagggtaggtaaacat

SEQ ID NO: 7041680 - DNA, 21 bp, Homo sapiens
aaacagagctgagtaatagat

SEQ ID NO: 7041681 - DNA, 22 bp, Homo sapiens
aaaagacatctatttcaggcag

SEQ ID NO: 7041682 - DNA, 22 bp, Homo sapiens
aaaagtatggtggtccttttta

SEQ ID NO: 7041683 - DNA, 22 bp, Homo sapiens
aaagactaaccagttgtcaaaa

SEQ ID NO: 7041684 - DNA, 22 bp, Homo sapiens
aaacaagcaagcacataatttt

SEQ ID NO: 7041685 - DNA, 22 bp, Homo sapiens
actagtcatttaggtgatatta

SEQ ID NO: 7041686 - DNA, 22 bp, Homo sapiens
agtatactagtgcagcatgtat

SEQ ID NO: 7041687 - DNA, 22 bp, Homo sapiens
agtattttcaaccatagcctgg

SEQ ID NO: 7041688 - DNA, 22 bp, Homo sapiens
agtattttcgccatcacaagaa

SEQ ID NO: 7041689 - DNA, 22 bp, Homo sapiens
aggtccagttttcagttctcat

SEQ ID NO: 7041690 - DNA, 22 bp, Homo sapiens
aggtctcaaactggcaccctgt

SEQ ID NO: 7041691 - DNA, 20 bp, Homo sapiens
acctcctggaagcaggtgcc

SEQ ID NO: 7041692 - DNA, 22 bp, Homo sapiens
acctctggccttcaggcatcat

SEQ ID NO: 7041693 - DNA, 22 bp, Homo sapiens
agtgtttaatgccttttccagc

SEQ ID NO: 7041694 - DNA, 22 bp, Homo sapiens
agtgtttaagttacacacatat

SEQ ID NO: 7041695 - DNA, 22 bp, Homo sapiens
agtgtttacattgaagcttgta

SEQ ID NO: 7041696 - DNA, 22 bp, Homo sapiens
actgcacttcagcctgggtgtc

SEQ ID NO: 7041697 - DNA, 22 bp, Homo sapiens
agtgtacaagaccttattgttg

SEQ ID NO: 7041698 - DNA, 22 bp, Homo sapiens
agtgtacactaaatgaatacaa

SEQ ID NO: 7041699 - DNA, 22 bp, Homo sapiens
agtgtacagttctatgaatttc

SEQ ID NO: 7041700 - DNA, 22 bp, Homo sapiens
agtctttactaaacagaccacc

SEQ ID NO: 7041701 - DNA, 22 bp, Homo sapiens
agtctttagggaggtcagagtt

SEQ ID NO: 7041702 - DNA, 22 bp, Homo sapiens
atcctttcatctggtaatatat

SEQ ID NO: 7041703 - DNA, 23 bp, Homo sapiens
atctaatccctactttatttccc

SEQ ID NO: 7041704 - DNA, 22 bp, Homo sapiens
agaaagttaaacagtgataaga

SEQ ID NO: 7041705 - DNA, 22 bp, Homo sapiens
agaaagttatcacaaaattgag

SEQ ID NO: 7041706 - DNA, 22 bp, Homo sapiens
agaaagttcactggtatatttt

SEQ ID NO: 7041707 - DNA, 22 bp, Homo sapiens
agaaagttctgtgagttgttca

SEQ ID NO: 7041708 - DNA, 22 bp, Homo sapiens
agaaagttgttggaggaaatga

SEQ ID NO: 7041709 - DNA, 22 bp, Homo sapiens
agaaagtttattcctatctagc

SEQ ID NO: 7041710 - DNA, 22 bp, Homo sapiens
agaaaagtgctctagtgagagc

SEQ ID NO: 7041711 - DNA, 23 bp, Homo sapiens
agaaaagttcatacctttttaac

SEQ ID NO: 7041712 - DNA, 21 bp, Homo sapiens
agaaaagtatttgaatcaaga

SEQ ID NO: 7041713 - DNA, 22 bp, Homo sapiens
atattcatcgtgtagaaatact

SEQ ID NO: 7041714 - DNA, 22 bp, Homo sapiens
atattcttatccttttctctgt

SEQ ID NO: 7041715 - DNA, 22 bp, Homo sapiens
atattcttccaaaacatcattt

SEQ ID NO: 7041716 - DNA, 22 bp, Homo sapiens
atatttataagcaagcaggact

SEQ ID NO: 7041717 - DNA, 22 bp, Homo sapiens
atatttcacgtaggttgttttc

SEQ ID NO: 7041718 - DNA, 22 bp, Homo sapiens
actttcaagaacttctttaatg

SEQ ID NO: 7041719 - DNA, 22 bp, Homo sapiens
actttcacatgtgtgcagacag

SEQ ID NO: 7041720 - DNA, 22 bp, Homo sapiens
actttcatggatctctgttcag

SEQ ID NO: 7041721 - DNA, 22 bp, Homo sapiens
actttcatggtagttgtattct

SEQ ID NO: 7041722 - DNA, 22 bp, Homo sapiens
actttcctagacttcagtgaca

SEQ ID NO: 7041723 - DNA, 22 bp, Homo sapiens
actttcctgccaaggccagagt

SEQ ID NO: 7041724 - DNA, 22 bp, Homo sapiens
actttcctggccctgtcctctg

SEQ ID NO: 7041725 - DNA, 22 bp, Homo sapiens
actttccttatggatggggaaa

SEQ ID NO: 7041726 - DNA, 22 bp, Homo sapiens
actttctcaggaattcacagac

SEQ ID NO: 7041727 - DNA, 22 bp, Homo sapiens
actttctcccacccacccgtct

SEQ ID NO: 7041728 - DNA, 20 bp, Homo sapiens
actttctcggtttctcacct

SEQ ID NO: 7041729 - DNA, 22 bp, Homo sapiens
atatgaaagtaagcatgtgtgt

SEQ ID NO: 7041730 - DNA, 22 bp, Homo sapiens
atatggaatggtaatctacaat

SEQ ID NO: 7041731 - DNA, 22 bp, Homo sapiens
atacatctatgcctttctgaca

SEQ ID NO: 7041732 - DNA, 22 bp, Homo sapiens
atacattagctcatatgattaa

SEQ ID NO: 7041733 - DNA, 22 bp, Homo sapiens
atacattagtgaacaaaagaga

SEQ ID NO: 7041734 - DNA, 22 bp, Homo sapiens
atacattattgttaaagaacat

SEQ ID NO: 7041735 - DNA, 22 bp, Homo sapiens
atactgaaagggtgttacctaa

SEQ ID NO: 7041736 - DNA, 22 bp, Homo sapiens
atactgaacatgtttgcagtca

SEQ ID NO: 7041737 - DNA, 22 bp, Homo sapiens
atactgaattaggtaaagcata

SEQ ID NO: 7041738 - DNA, 22 bp, Homo sapiens
atactgattgatattcccatga

SEQ ID NO: 7041739 - DNA, 22 bp, Homo sapiens
actttatgacaccctttagtga

SEQ ID NO: 7041740 - DNA, 22 bp, Homo sapiens
ataatgcatttagaataattca

SEQ ID NO: 7041741 - DNA, 21 bp, Homo sapiens
acttaaattccttgatattta

SEQ ID NO: 7041742 - DNA, 22 bp, Homo sapiens
acttaagatagagcaagtctga

SEQ ID NO: 7041743 - DNA, 22 bp, Homo sapiens
acttacaatcaaccaccttgga

SEQ ID NO: 7041744 - DNA, 22 bp, Homo sapiens
atacaggtgtacacacatgcaa

SEQ ID NO: 7041745 - DNA, 22 bp, Homo sapiens
actgtaacactcatactgaagt

SEQ ID NO: 7041746 - DNA, 22 bp, Homo sapiens
actgtatacttctgtatacaat

SEQ ID NO: 7041747 - DNA, 22 bp, Homo sapiens
ataaacaagactggccaacttt

SEQ ID NO: 7041748 - DNA, 22 bp, Homo sapiens
ataaacagctccatttagtgcc

SEQ ID NO: 7041749 - DNA, 22 bp, Homo sapiens
ataaacagtagagaaaggtggt

SEQ ID NO: 7041750 - DNA, 22 bp, Homo sapiens
agggggctcagcaggctctgga

SEQ ID NO: 7041751 - DNA, 22 bp, Homo sapiens
agggggctcagcaggctctgga

SEQ ID NO: 7041752 - DNA, 22 bp, Homo sapiens
agggggctcagcatggatggag

SEQ ID NO: 7041753 - DNA, 22 bp, Homo sapiens
agggctgctgaggaagccttgc

SEQ ID NO: 7041754 - DNA, 22 bp, Homo sapiens
acccagctggatgcatggaggc

SEQ ID NO: 7041755 - DNA, 22 bp, Homo sapiens
acccagctggatgcatggaggc

SEQ ID NO: 7041756 - DNA, 17 bp, Homo sapiens
accagcctctcctgggg

SEQ ID NO: 7041757 - DNA, 23 bp, Homo sapiens
agggcactgttgggtgttgagga

SEQ ID NO: 7041758 - DNA, 22 bp, Homo sapiens
agggcacttcagtcagactgag

SEQ ID NO: 7041759 - DNA, 22 bp, Homo sapiens
agggcacttcctctgggtccct

SEQ ID NO: 7041760 - DNA, 22 bp, Homo sapiens
agggcacttgaggctgggcctg

SEQ ID NO: 7041761 - DNA, 22 bp, Homo sapiens
agggcagcacagctgtgctcct

SEQ ID NO: 7041762 - DNA, 22 bp, Homo sapiens
acatgtttaagtttaatgaaaa

SEQ ID NO: 7041763 - DNA, 22 bp, Homo sapiens
acatgtttaagtttgttatatg

SEQ ID NO: 7041764 - DNA, 22 bp, Homo sapiens
acatgtttgataaatatttggg

SEQ ID NO: 7041765 - DNA, 22 bp, Homo sapiens
acatgtttggctctatgctata

SEQ ID NO: 7041766 - DNA, 22 bp, Homo sapiens
aggcctctgtagggccctgaag

SEQ ID NO: 7041767 - DNA, 18 bp, Homo sapiens
aggcctctgtgtgcccag

SEQ ID NO: 7041768 - DNA, 22 bp, Homo sapiens
aggcctcttgtcttcctcacat

SEQ ID NO: 7041769 - DNA, 22 bp, Homo sapiens
aggcctgcccgtgggacctgtg

SEQ ID NO: 7041770 - DNA, 22 bp, Homo sapiens
aggctgagaaagtgggaagatg

SEQ ID NO: 7041771 - DNA, 22 bp, Homo sapiens
aggctgagactgtgcattagtg

SEQ ID NO: 7041772 - DNA, 22 bp, Homo sapiens
acattgcaattaggtacctatg

SEQ ID NO: 7041773 - DNA, 22 bp, Homo sapiens
acattgcagatgtgtttaatgt

SEQ ID NO: 7041774 - DNA, 22 bp, Homo sapiens
aggctgagctggcccttgaaat

SEQ ID NO: 7041775 - DNA, 22 bp, Homo sapiens
aggctgaggagggatgttgctt

SEQ ID NO: 7041776 - DNA, 22 bp, Homo sapiens
acatttctttgctagacagcag

SEQ ID NO: 7041777 - DNA, 22 bp, Homo sapiens
acagtttagagcatgatgacca

SEQ ID NO: 7041778 - DNA, 22 bp, Homo sapiens
acagtttataaaaataatgagg

SEQ ID NO: 7041779 - DNA, 22 bp, Homo sapiens
acatattaactgcactacacta

SEQ ID NO: 7041780 - DNA, 22 bp, Homo sapiens
acaggttttggactccagattt

SEQ ID NO: 7041781 - DNA, 22 bp, Homo sapiens
acagtaaaaagccttagaattt

SEQ ID NO: 7041782 - DNA, 22 bp, Homo sapiens
acagtaaatcaacagaatatct

SEQ ID NO: 7041783 - DNA, 20 bp, Homo sapiens
aggagcacagggtttagtgg

SEQ ID NO: 7041784 - DNA, 22 bp, Homo sapiens
acagtacaccactgtgtacagt

SEQ ID NO: 7041785 - DNA, 22 bp, Homo sapiens
acagtacagctaatgtcattag

SEQ ID NO: 7041786 - DNA, 22 bp, Homo sapiens
acagtatatatagtctaaaagc

SEQ ID NO: 7041787 - DNA, 22 bp, Homo sapiens
acagtatattttcttgattgtt

SEQ ID NO: 7041788 - DNA, 22 bp, Homo sapiens
acagtctcttggaattttcaga

SEQ ID NO: 7041789 - DNA, 20 bp, Homo sapiens
acagtgggtggggagcactg

SEQ ID NO: 7041790 - DNA, 22 bp, Homo sapiens
acaggggcaggcaggacccttt

SEQ ID NO: 7041791 - DNA, 22 bp, Homo sapiens
acaggggcaagggctcacggcc

SEQ ID NO: 7041792 - DNA, 20 bp, Homo sapiens
acaggggcagcacaataatg

SEQ ID NO: 7041793 - DNA, 19 bp, Homo sapiens
acagggcttggcctgacat

SEQ ID NO: 7041794 - DNA, 22 bp, Homo sapiens
acagggcttgtgacaactttaa

SEQ ID NO: 7041795 - DNA, 22 bp, Homo sapiens
acagggcttgttgaaagcggag

SEQ ID NO: 7041796 - DNA, 22 bp, Homo sapiens
acagggcttttaatcagtagtt

SEQ ID NO: 7041797 - DNA, 19 bp, Homo sapiens
acaggggcctttccagggt

SEQ ID NO: 7041798 - DNA, 19 bp, Homo sapiens
acaggggctagcggaagca

SEQ ID NO: 7041799 - DNA, 22 bp, Homo sapiens
aggaagaacagataatggacgc

SEQ ID NO: 7041800 - DNA, 22 bp, Homo sapiens
acagggctatattcctcagagt

SEQ ID NO: 7041801 - DNA, 21 bp, Homo sapiens
acagggcttcagggagggtta

SEQ ID NO: 7041802 - DNA, 22 bp, Homo sapiens
acagggaaggacatgacttggc

SEQ ID NO: 7041803 - DNA, 22 bp, Homo sapiens
acagggacctgtgagctccata

SEQ ID NO: 7041804 - DNA, 22 bp, Homo sapiens
acaggagaaatctggtcaaaag

SEQ ID NO: 7041805 - DNA, 19 bp, Homo sapiens
acaggatatatcaggaaat

SEQ ID NO: 7041806 - DNA, 22 bp, Homo sapiens
agctgaagcactgggatggaag

SEQ ID NO: 7041807 - DNA, 22 bp, Homo sapiens
agctgaagttcagtccagagaa

SEQ ID NO: 7041808 - DNA, 22 bp, Homo sapiens
atgtttacaattcagtattaca

SEQ ID NO: 7041809 - DNA, 22 bp, Homo sapiens
atgtttacaattcagtattaca

SEQ ID NO: 7041810 - DNA, 22 bp, Homo sapiens
atgtttatgacctccataagga

SEQ ID NO: 7041811 - DNA, 22 bp, Homo sapiens
atgtttatgcaaacatgtgagt

SEQ ID NO: 7041812 - DNA, 22 bp, Homo sapiens
attattaaagcttaggtcttat

SEQ ID NO: 7041813 - DNA, 21 bp, Homo sapiens
attattataaagaccacaggg

SEQ ID NO: 7041814 - DNA, 22 bp, Homo sapiens
attattattttagagagaggcc

SEQ ID NO: 7041815 - DNA, 22 bp, Homo sapiens
attccaggcagaccagagagat

SEQ ID NO: 7041816 - DNA, 22 bp, Homo sapiens
attgcagattcttctcagggag

SEQ ID NO: 7041817 - DNA, 22 bp, Homo sapiens
attcagggaggaaaggggcctc

SEQ ID NO: 7041818 - DNA, 18 bp, Homo sapiens
attcaggggctgaatgtg

SEQ ID NO: 7041819 - DNA, 22 bp, Homo sapiens
attcatttgctattgtgtatgg

SEQ ID NO: 7041820 - DNA, 22 bp, Homo sapiens
agaggctcagaggcctggtcct

SEQ ID NO: 7041821 - DNA, 23 bp, Homo sapiens
agaggctcagcgtccacctctac

SEQ ID NO: 7041822 - DNA, 22 bp, Homo sapiens
agaggctccaccttctctgtcc

SEQ ID NO: 7041823 - DNA, 22 bp, Homo sapiens
agaggctccgtcatccctcttt

SEQ ID NO: 7041824 - DNA, 16 bp, Homo sapiens
agaggctcctccttgc

SEQ ID NO: 7041825 - DNA, 22 bp, Homo sapiens
agaggctcctcggtgcctcgtg

SEQ ID NO: 7041826 - DNA, 22 bp, Homo sapiens
caaaagggagttctctggaagg

SEQ ID NO: 7041827 - DNA, 22 bp, Homo sapiens
atttccttcagtgtttaatact

SEQ ID NO: 7041828 - DNA, 22 bp, Homo sapiens
atttccttcatcagcctatcct

SEQ ID NO: 7041829 - DNA, 17 bp, Homo sapiens
atttggaatttctcttc

SEQ ID NO: 7041830 - DNA, 22 bp, Homo sapiens
attgcattgtttgaggcagagg

SEQ ID NO: 7041831 - DNA, 22 bp, Homo sapiens
attgccttgtcagatttctttt

SEQ ID NO: 7041832 - DNA, 22 bp, Homo sapiens
attgcctttggaggaagaaagc

SEQ ID NO: 7041833 - DNA, 22 bp, Homo sapiens
agagttctgaaattatctttac

SEQ ID NO: 7041834 - DNA, 22 bp, Homo sapiens
agagttctgaattttattctct

SEQ ID NO: 7041835 - DNA, 22 bp, Homo sapiens
agagttgctccattagaactta

SEQ ID NO: 7041836 - DNA, 22 bp, Homo sapiens
atttcactgcttgagctgcagc

SEQ ID NO: 7041837 - DNA, 22 bp, Homo sapiens
atgtatttgcttgttatggatt

SEQ ID NO: 7041838 - DNA, 22 bp, Homo sapiens
atgtcaaatcagttttatcaga

SEQ ID NO: 7041839 - DNA, 22 bp, Homo sapiens
atgtgtaaagttagatgtctga

SEQ ID NO: 7041840 - DNA, 22 bp, Homo sapiens
atggggctgttctctgccctgc

SEQ ID NO: 7041841 - DNA, 22 bp, Homo sapiens
atggggtgagactaggattaaa

SEQ ID NO: 7041842 - DNA, 22 bp, Homo sapiens
atggggtgcatgcagattggga

SEQ ID NO: 7041843 - DNA, 22 bp, Homo sapiens
agagaaggaaagctgacatggg

SEQ ID NO: 7041844 - DNA, 22 bp, Homo sapiens
agagaagagtcttgtcaaatta

SEQ ID NO: 7041845 - DNA, 22 bp, Homo sapiens
agagaagattcttatatgtctt

SEQ ID NO: 7041846 - DNA, 22 bp, Homo sapiens
agagacagggttttgtcgtgtt

SEQ ID NO: 7041847 - DNA, 22 bp, Homo sapiens
agagaagagcaatgataaattt

SEQ ID NO: 7041848 - DNA, 22 bp, Homo sapiens
atgaacaatctggcaagaactt

SEQ ID NO: 7041849 - DNA, 22 bp, Homo sapiens
agaaggctttaagtactggcat

SEQ ID NO: 7041850 - DNA, 22 bp, Homo sapiens
atgacaaaatgaatgcagctag

SEQ ID NO: 7041851 - DNA, 22 bp, Homo sapiens
atgacaaaggctgaaagggaaa

SEQ ID NO: 7041852 - DNA, 22 bp, Homo sapiens
atgcacataggccaaatcattt

SEQ ID NO: 7041853 - DNA, 22 bp, Homo sapiens
atgcacccatgtacatacacat

SEQ ID NO: 7041854 - DNA, 22 bp, Homo sapiens
atgcaccccagaagctgcagtg

SEQ ID NO: 7041855 - DNA, 20 bp, Homo sapiens
atgcaccctcagggtccctg

SEQ ID NO: 7041856 - DNA, 22 bp, Homo sapiens
atgcacttaaataacataactt

SEQ ID NO: 7041857 - DNA, 22 bp, Homo sapiens
agcaggggtctctgctaatgaa

SEQ ID NO: 7041858 - DNA, 22 bp, Homo sapiens
agcaggggtggaaggtagcttt

SEQ ID NO: 7041859 - DNA, 22 bp, Homo sapiens
agcagggggccacagtcacagc

SEQ ID NO: 7041860 - DNA, 22 bp, Homo sapiens
agcaggggtaacagaaggaaag

SEQ ID NO: 7041861 - DNA, 22 bp, Homo sapiens
agcagggggagttagactagat

SEQ ID NO: 7041862 - DNA, 22 bp, Homo sapiens
agcagggggcatccttgccctt

SEQ ID NO: 7041863 - DNA, 22 bp, Homo sapiens
agcaggggctcctccacagcca

SEQ ID NO: 7041864 - DNA, 22 bp, Homo sapiens
agcaggggcagggttttgtgct

SEQ ID NO: 7041865 - DNA, 22 bp, Homo sapiens
agcaggcaggaatggtggaaca

SEQ ID NO: 7041866 - DNA, 22 bp, Homo sapiens
agcaggcagccatttggaaggc

SEQ ID NO: 7041867 - DNA, 22 bp, Homo sapiens
agcaggcagcctaggaagtgaa

SEQ ID NO: 7041868 - DNA, 22 bp, Homo sapiens
cacagttcctgaatatatcaca

SEQ ID NO: 7041869 - DNA, 22 bp, Homo sapiens
cacagtttcaataattattctt

SEQ ID NO: 7041870 - DNA, 22 bp, Homo sapiens
cacagtttctataggtcagaat

SEQ ID NO: 7041871 - DNA, 22 bp, Homo sapiens
cacagtttctataggtcagaat

SEQ ID NO: 7041872 - DNA, 22 bp, Homo sapiens
cacagtttggttttgctgtaat

SEQ ID NO: 7041873 - DNA, 22 bp, Homo sapiens
cacacaaatattctggaggcaa

SEQ ID NO: 7041874 - DNA, 21 bp, Homo sapiens
agcaggcaaaggtgaagtctt

SEQ ID NO: 7041875 - DNA, 22 bp, Homo sapiens
agcaggcacaagaaagggaggt

SEQ ID NO: 7041876 - DNA, 22 bp, Homo sapiens
caacagagcagttgatcaggaa

SEQ ID NO: 7041877 - DNA, 22 bp, Homo sapiens
caacagagggaatggatctcat

SEQ ID NO: 7041878 - DNA, 20 bp, Homo sapiens
caacagaggggtctggagta

SEQ ID NO: 7041879 - DNA, 22 bp, Homo sapiens
caaattaccctcaacatctaga

SEQ ID NO: 7041880 - DNA, 22 bp, Homo sapiens
caaatatctttggcaaagagaa

SEQ ID NO: 7041881 - DNA, 22 bp, Homo sapiens
caaatagtgtcacattgtgagg

SEQ ID NO: 7041882 - DNA, 22 bp, Homo sapiens
caaatagtttttcatgtattat

SEQ ID NO: 7041883 - DNA, 22 bp, Homo sapiens
caaatagtttttcatgtattat

SEQ ID NO: 7041884 - DNA, 22 bp, Homo sapiens
agcacatgagctgatggtgggc

SEQ ID NO: 7041885 - DNA, 22 bp, Homo sapiens
caaaagttattgcggtttttgc

SEQ ID NO: 7041886 - DNA, 22 bp, Homo sapiens
caaaagttctcacccagacatg

SEQ ID NO: 7041887 - DNA, 22 bp, Homo sapiens
agcaaacctgcagccttctgag

SEQ ID NO: 7041888 - DNA, 22 bp, Homo sapiens
agcaaactaattgcagttctgg

SEQ ID NO: 7041889 - DNA, 20 bp, Homo sapiens
agcaaactcttcccatcttc

SEQ ID NO: 7041890 - DNA, 22 bp, Homo sapiens
caagagccataattttgagagt

SEQ ID NO: 7041891 - DNA, 22 bp, Homo sapiens
caagcactgtggcactcgcagg

SEQ ID NO: 7041892 - DNA, 22 bp, Homo sapiens
cagagggccccctggccacagt

SEQ ID NO: 7041893 - DNA, 22 bp, Homo sapiens
agcctctgatggctcccaagga

SEQ ID NO: 7041894 - DNA, 22 bp, Homo sapiens
agcctctgcttatgcaaaggta

SEQ ID NO: 7041895 - DNA, 22 bp, Homo sapiens
cagcagtgtggaagctgagggg

SEQ ID NO: 7041896 - DNA, 21 bp, Homo sapiens
cagcagtgtgtctgagctaga

SEQ ID NO: 7041897 - DNA, 22 bp, Homo sapiens
cagcagttatgagtagaatagt

SEQ ID NO: 7041898 - DNA, 22 bp, Homo sapiens
cagccccacacggtctagctct

SEQ ID NO: 7041899 - DNA, 22 bp, Homo sapiens
cagccccagcacttagctgagt

SEQ ID NO: 7041900 - DNA, 22 bp, Homo sapiens
cagctcagtctggagagatgca

SEQ ID NO: 7041901 - DNA, 22 bp, Homo sapiens
agcatataaatggacatatttg

SEQ ID NO: 7041902 - DNA, 22 bp, Homo sapiens
agcatatacaaactcatataca

SEQ ID NO: 7041903 - DNA, 22 bp, Homo sapiens
agcatatacaaactcatataca

SEQ ID NO: 7041904 - DNA, 22 bp, Homo sapiens
cagaatatgacaagattttcct

SEQ ID NO: 7041905 - DNA, 22 bp, Homo sapiens
cagaatcagcccttgctattaa

SEQ ID NO: 7041906 - DNA, 22 bp, Homo sapiens
cagacaggaagttcagaagaaa

SEQ ID NO: 7041907 - DNA, 22 bp, Homo sapiens
cagacaggtagggacagaacat

SEQ ID NO: 7041908 - DNA, 22 bp, Homo sapiens
cagacttttgacattaatacag

SEQ ID NO: 7041909 - DNA, 22 bp, Homo sapiens
agccatatcaagcattcttcac

SEQ ID NO: 7041910 - DNA, 18 bp, Homo sapiens
agccatatggagactctg

SEQ ID NO: 7041911 - DNA, 22 bp, Homo sapiens
agcccagcccgggctgcgcttt

SEQ ID NO: 7041912 - DNA, 21 bp, Homo sapiens
cagaggcaggctctgtgtgtg

SEQ ID NO: 7041913 - DNA, 22 bp, Homo sapiens
agcccaggcagagggatgcttg

SEQ ID NO: 7041914 - DNA, 20 bp, Homo sapiens
agcccaggcctgtgtgagtc

SEQ ID NO: 7041915 - DNA, 22 bp, Homo sapiens
agcccaggctggagtgcagtgg

SEQ ID NO: 7041916 - DNA, 22 bp, Homo sapiens
agctgtggaagactgtcagggt

SEQ ID NO: 7041917 - DNA, 22 bp, Homo sapiens
cagggagctctgggccggactc

SEQ ID NO: 7041918 - DNA, 22 bp, Homo sapiens
cagggagctggctggctgtgcc

SEQ ID NO: 7041919 - DNA, 22 bp, Homo sapiens
cagggagctggctggcgtgagt

SEQ ID NO: 7041920 - DNA, 22 bp, Homo sapiens
cagggagctttcccaggaccct

SEQ ID NO: 7041921 - DNA, 22 bp, Homo sapiens
caggggctgtgggcggagcctc

SEQ ID NO: 7041922 - DNA, 22 bp, Homo sapiens
caggggctgaaatgttggggtt

SEQ ID NO: 7041923 - DNA, 22 bp, Homo sapiens
cagggctccctgcagcctctgt

SEQ ID NO: 7041924 - DNA, 22 bp, Homo sapiens
cagggctcccttgcaaggaggg

SEQ ID NO: 7041925 - DNA, 22 bp, Homo sapiens
cagggctccccagagagcctct

SEQ ID NO: 7041926 - DNA, 22 bp, Homo sapiens
cagggctcgctcttgcccttcg

SEQ ID NO: 7041927 - DNA, 22 bp, Homo sapiens
cagggctcgctgccagcttcag

SEQ ID NO: 7041928 - DNA, 22 bp, Homo sapiens
cagggctctgccttgagggatg

SEQ ID NO: 7041929 - DNA, 23 bp, Homo sapiens
cagggccaggcagcagctgtcac

SEQ ID NO: 7041930 - DNA, 22 bp, Homo sapiens
caggaggattgcttgaggccag

SEQ ID NO: 7041931 - DNA, 22 bp, Homo sapiens
caggaggagcattagcgtctca

SEQ ID NO: 7041932 - DNA, 20 bp, Homo sapiens
caggccagaggtttgatggc

SEQ ID NO: 7041933 - DNA, 22 bp, Homo sapiens
agctgggctgggctgagctgag

SEQ ID NO: 7041934 - DNA, 22 bp, Homo sapiens
agctgcagttcgttccagctct

SEQ ID NO: 7041935 - DNA, 22 bp, Homo sapiens
agctgcagtgaactgttttgtc

SEQ ID NO: 7041936 - DNA, 22 bp, Homo sapiens
agctgcagtgaattcgctaact

SEQ ID NO: 7041937 - DNA, 22 bp, Homo sapiens
agctgcagttagccccagatga

SEQ ID NO: 7041938 - DNA, 22 bp, Homo sapiens
agctgcagttagccccagatga

SEQ ID NO: 7041939 - DNA, 20 bp, Homo sapiens
agctgcagaacccactggac

SEQ ID NO: 7041940 - DNA, 19 bp, Homo sapiens
agctgcagaccagaagtgc

SEQ ID NO: 7041941 - DNA, 18 bp, Homo sapiens
agctgcagaccaggaggt

SEQ ID NO: 7041942 - DNA, 18 bp, Homo sapiens
agctgcagaccaggaggt

SEQ ID NO: 7041943 - DNA, 22 bp, Homo sapiens
agctgcagagaaaagaggctgg

SEQ ID NO: 7041944 - DNA, 22 bp, Homo sapiens
agctgcagagaaaagaggctgg

SEQ ID NO: 7041945 - DNA, 22 bp, Homo sapiens
agctgcagaggtttgtgcaaca

SEQ ID NO: 7041946 - DNA, 22 bp, Homo sapiens
agctgcagataggatgttattt

SEQ ID NO: 7041947 - DNA, 22 bp, Homo sapiens
agctgcagatcaataggctcac

SEQ ID NO: 7041948 - DNA, 17 bp, Homo sapiens
agctgcagatgaagttg

SEQ ID NO: 7041949 - DNA, 23 bp, Homo sapiens
agctgcagatgctcagcgggcag

SEQ ID NO: 7041950 - DNA, 22 bp, Homo sapiens
agctgcagattctatctagaag

SEQ ID NO: 7041951 - DNA, 22 bp, Homo sapiens
agctgcagattctctacttcat

SEQ ID NO: 7041952 - DNA, 22 bp, Homo sapiens
agctgcagcactccagtagccg

SEQ ID NO: 7041953 - DNA, 22 bp, Homo sapiens
agctgcagcactccagtagccg

SEQ ID NO: 7041954 - DNA, 21 bp, Homo sapiens
agctgcagccatgtacatggc

SEQ ID NO: 7041955 - DNA, 22 bp, Homo sapiens
caggaaggaccgtccagatcag

SEQ ID NO: 7041956 - DNA, 22 bp, Homo sapiens
cagctctgggtgacaggagggc

SEQ ID NO: 7041957 - DNA, 22 bp, Homo sapiens
agctgattccactttttcccca

SEQ ID NO: 7041958 - DNA, 22 bp, Homo sapiens
agctgcagaaaggacaactaat

SEQ ID NO: 7041959 - DNA, 22 bp, Homo sapiens
cattaaaatatctcatggtgtt

SEQ ID NO: 7041960 - DNA, 17 bp, Homo sapiens
catttgttgatcagttg

SEQ ID NO: 7041961 - DNA, 22 bp, Homo sapiens
catttgttgggacaatgaaaag

SEQ ID NO: 7041962 - DNA, 22 bp, Homo sapiens
cattttaaatgatttaagccaa

SEQ ID NO: 7041963 - DNA, 19 bp, Homo sapiens
aggcagcaggccagggatg

SEQ ID NO: 7041964 - DNA, 22 bp, Homo sapiens
ccaagattactttcttaattgc

SEQ ID NO: 7041965 - DNA, 22 bp, Homo sapiens
ccaagggctctgacttgcctgc

SEQ ID NO: 7041966 - DNA, 22 bp, Homo sapiens
ccaagggctctggacagagtgg

SEQ ID NO: 7041967 - DNA, 22 bp, Homo sapiens
ccaagggctgagatacatctag

SEQ ID NO: 7041968 - DNA, 22 bp, Homo sapiens
ccaagggctgctgaggtgtcca

SEQ ID NO: 7041969 - DNA, 22 bp, Homo sapiens
ccaaggtggctacagccctgca

SEQ ID NO: 7041970 - DNA, 19 bp, Homo sapiens
catggtgaaaccccgtctc

SEQ ID NO: 7041971 - DNA, 22 bp, Homo sapiens
catgtatacagtagaatactat

SEQ ID NO: 7041972 - DNA, 22 bp, Homo sapiens
catgtatagttggaactacatc

SEQ ID NO: 7041973 - DNA, 22 bp, Homo sapiens
aggagggagcttaagccaggca

SEQ ID NO: 7041974 - DNA, 22 bp, Homo sapiens
catattttagttgctgaacagc

SEQ ID NO: 7041975 - DNA, 22 bp, Homo sapiens
catattctgttggtcacataga

SEQ ID NO: 7041976 - DNA, 22 bp, Homo sapiens
cagttttatcatctgtgaaatg

SEQ ID NO: 7041977 - DNA, 22 bp, Homo sapiens
cagttttatgaatgcttattag

SEQ ID NO: 7041978 - DNA, 22 bp, Homo sapiens
cagttttatgtcgaatgtatac

SEQ ID NO: 7041979 - DNA, 22 bp, Homo sapiens
cataggaatgaggacaattagc

SEQ ID NO: 7041980 - DNA, 22 bp, Homo sapiens
cagtggtactctcagatgttta

SEQ ID NO: 7041981 - DNA, 23 bp, Homo sapiens
cagtggtcagaacgtgggagggt

SEQ ID NO: 7041982 - DNA, 17 bp, Homo sapiens
cagtggtctgaggtatg

SEQ ID NO: 7041983 - DNA, 18 bp, Homo sapiens
cagtggtgctgggatgtg

SEQ ID NO: 7041984 - DNA, 18 bp, Homo sapiens
cagtggtgctgggatgtg

SEQ ID NO: 7041985 - DNA, 22 bp, Homo sapiens
cagtttatttccaagatgacaa

SEQ ID NO: 7041986 - DNA, 22 bp, Homo sapiens
cagtttctccaaacgcaggctg

SEQ ID NO: 7041987 - DNA, 22 bp, Homo sapiens
cagtttctctcaataagcatcg

SEQ ID NO: 7041988 - DNA, 22 bp, Homo sapiens
cagttttaaattgttagataat

SEQ ID NO: 7041989 - DNA, 22 bp, Homo sapiens
cagttttaaattttgaatgtct

SEQ ID NO: 7041990 - DNA, 16 bp, Homo sapiens
cagttttaaggcccaa

SEQ ID NO: 7041991 - DNA, 22 bp, Homo sapiens
cagttttacccaagcttatttt

SEQ ID NO: 7041992 - DNA, 22 bp, Homo sapiens
cagttttagctagagcaaacca

SEQ ID NO: 7041993 - DNA, 22 bp, Homo sapiens
cagttttaggacatgtggatgt

SEQ ID NO: 7041994 - DNA, 22 bp, Homo sapiens
cagttttagggcaatgtgaaga

SEQ ID NO: 7041995 - DNA, 22 bp, Homo sapiens
cagttttatacactgcagctcc

SEQ ID NO: 7041996 - DNA, 22 bp, Homo sapiens
caggtggcttattagggtcagt

SEQ ID NO: 7041997 - DNA, 22 bp, Homo sapiens
caggtggcttctccctaggcca

SEQ ID NO: 7041998 - DNA, 22 bp, Homo sapiens
caggtgggaccatgatagggca

SEQ ID NO: 7041999 - DNA, 22 bp, Homo sapiens
caggtgggagccacagcgtaca

SEQ ID NO: 7042000 - DNA, 22 bp, Homo sapiens
caggtgggagcgaggagctact

SEQ ID NO: 7042001 - DNA, 22 bp, Homo sapiens
caggtgggagcggagactgatt

SEQ ID NO: 7042002 - DNA, 22 bp, Homo sapiens
caggtgggattttgctgcttga

SEQ ID NO: 7042003 - DNA, 22 bp, Homo sapiens
aggaccagaggccagagtcagc

SEQ ID NO: 7042004 - DNA, 22 bp, Homo sapiens
aggaccagcctccaggtctctt

SEQ ID NO: 7042005 - DNA, 23 bp, Homo sapiens
aggaccaggttcccaaaagtcaa

SEQ ID NO: 7042006 - DNA, 22 bp, Homo sapiens
aggaccagtatgagagcatctg

SEQ ID NO: 7042007 - DNA, 22 bp, Homo sapiens
cagtgcccttccaggactgcag

SEQ ID NO: 7042008 - DNA, 22 bp, Homo sapiens
cagtggcatggttgactgcagt

SEQ ID NO: 7042009 - DNA, 22 bp, Homo sapiens
aggctcctgatcctggggtctg

SEQ ID NO: 7042010 - DNA, 22 bp, Homo sapiens
aggctcctgcaggccttgtagg

SEQ ID NO: 7042011 - DNA, 20 bp, Homo sapiens
aggctcctgtacctgaggaa

SEQ ID NO: 7042012 - DNA, 22 bp, Homo sapiens
aggctccttatggctttggggt

SEQ ID NO: 7042013 - DNA, 22 bp, Homo sapiens
ccagggctggtgggagatgctg

SEQ ID NO: 7042014 - DNA, 22 bp, Homo sapiens
ccagggcttaacttttcaggag

SEQ ID NO: 7042015 - DNA, 17 bp, Homo sapiens
aggctcctcctaaggtc

SEQ ID NO: 7042016 - DNA, 22 bp, Homo sapiens
aggctcctcggggctgacggcg

SEQ ID NO: 7042017 - DNA, 22 bp, Homo sapiens
ccaggaggaaagaccagcccat

SEQ ID NO: 7042018 - DNA, 22 bp, Homo sapiens
ccaggaggaaattctaaaggta

SEQ ID NO: 7042019 - DNA, 22 bp, Homo sapiens
aggctcagcctgggcctagagc

SEQ ID NO: 7042020 - DNA, 22 bp, Homo sapiens
aggctcatctgagcagaaacct

SEQ ID NO: 7042021 - DNA, 22 bp, Homo sapiens
ccagggtggaggctggatggag

SEQ ID NO: 7042022 - DNA, 22 bp, Homo sapiens
aggctctgtgatgtgccaggca

SEQ ID NO: 7042023 - DNA, 20 bp, Homo sapiens
aggctgagggtgattgtgtc

SEQ ID NO: 7042024 - DNA, 22 bp, Homo sapiens
aggctgaggtaggaggatcgct

SEQ ID NO: 7042025 - DNA, 22 bp, Homo sapiens
aggctgaggtgtgctgtgatcg

SEQ ID NO: 7042026 - DNA, 22 bp, Homo sapiens
aggctgagtcaagttagggtga

SEQ ID NO: 7042027 - DNA, 22 bp, Homo sapiens
ccatgggcactgggtggaggta

SEQ ID NO: 7042028 - DNA, 22 bp, Homo sapiens
ccatgggcgcacaggcctggag

SEQ ID NO: 7042029 - DNA, 22 bp, Homo sapiens
ccatgggctggctgccttatca

SEQ ID NO: 7042030 - DNA, 22 bp, Homo sapiens
aggccagagttaaggagaacag

SEQ ID NO: 7042031 - DNA, 22 bp, Homo sapiens
ccagcctcatcgcctgcctgtc

SEQ ID NO: 7042032 - DNA, 22 bp, Homo sapiens
aggcccagagcaggaaagggtt

SEQ ID NO: 7042033 - DNA, 19 bp, Homo sapiens
aggcccagcgctgggggct

SEQ ID NO: 7042034 - DNA, 22 bp, Homo sapiens
aggccctgggttagggcccact

SEQ ID NO: 7042035 - DNA, 22 bp, Homo sapiens
aggccctggcactgcctgggag

SEQ ID NO: 7042036 - DNA, 22 bp, Homo sapiens
ccaggagagcagaagcccaggc

SEQ ID NO: 7042037 - DNA, 22 bp, Homo sapiens
ccaggagagcaggcgtgcagct

SEQ ID NO: 7042038 - DNA, 22 bp, Homo sapiens
ccaggagagcattgcacagagg

SEQ ID NO: 7042039 - DNA, 22 bp, Homo sapiens
ccaggagagcgccctcccggcc

SEQ ID NO: 7042040 - DNA, 22 bp, Homo sapiens
ccaggagagcgccctcccggcc

SEQ ID NO: 7042041 - DNA, 22 bp, Homo sapiens
ccaggagagctctaaatggctg

SEQ ID NO: 7042042 - DNA, 22 bp, Homo sapiens
ccaggagagctctcgttcagtg

SEQ ID NO: 7042043 - DNA, 19 bp, Homo sapiens
ccaggagagcttggagaag

SEQ ID NO: 7042044 - DNA, 22 bp, Homo sapiens
ccaggagataagctgagtttat

SEQ ID NO: 7042045 - DNA, 22 bp, Homo sapiens
ccaggagatgatgttggggatt

SEQ ID NO: 7042046 - DNA, 22 bp, Homo sapiens
ccaggagatgggaaagtagcag

SEQ ID NO: 7042047 - DNA, 22 bp, Homo sapiens
ccaggagatgggagcatctaaa

SEQ ID NO: 7042048 - DNA, 22 bp, Homo sapiens
ccaggagatttttccatagcac

SEQ ID NO: 7042049 - DNA, 22 bp, Homo sapiens
ccaggagcaaagatcactggga

SEQ ID NO: 7042050 - DNA, 22 bp, Homo sapiens
aggcaggggagctggaagggta

SEQ ID NO: 7042051 - DNA, 22 bp, Homo sapiens
aggcagggtcttgctatgttgc

SEQ ID NO: 7042052 - DNA, 22 bp, Homo sapiens
aggcagggtgatgataatgatt

SEQ ID NO: 7042053 - DNA, 22 bp, Homo sapiens
ccacaggacggaggtctggccg

SEQ ID NO: 7042054 - DNA, 23 bp, Homo sapiens
ccacaggagggttcatttattca

SEQ ID NO: 7042055 - DNA, 22 bp, Homo sapiens
ccagagagtaggaggcattatt

SEQ ID NO: 7042056 - DNA, 19 bp, Homo sapiens
ccagcagaagccactcctg

SEQ ID NO: 7042057 - DNA, 22 bp, Homo sapiens
ccagcagagctcaaacttcctg

SEQ ID NO: 7042058 - DNA, 22 bp, Homo sapiens
ccagcagagggcgcttcacacc

SEQ ID NO: 7042059 - DNA, 17 bp, Homo sapiens
aggggagagtgggaaga

SEQ ID NO: 7042060 - DNA, 22 bp, Homo sapiens
cctgaggccctggctgtgctga

SEQ ID NO: 7042061 - DNA, 22 bp, Homo sapiens
aggggctgcctggcttggcact

SEQ ID NO: 7042062 - DNA, 22 bp, Homo sapiens
aggggctgctgggtccgcccct

SEQ ID NO: 7042063 - DNA, 22 bp, Homo sapiens
aggggctgctgggtccgcccct

SEQ ID NO: 7042064 - DNA, 22 bp, Homo sapiens
aggggctggagttcgaggttac

SEQ ID NO: 7042065 - DNA, 22 bp, Homo sapiens
aggggctggagttcgaggttac

SEQ ID NO: 7042066 - DNA, 22 bp, Homo sapiens
aggggctggcttatctgagagt

SEQ ID NO: 7042067 - DNA, 22 bp, Homo sapiens
aggggctggcttatctgagagt

SEQ ID NO: 7042068 - DNA, 22 bp, Homo sapiens
aggggctgggacagagccaagc

SEQ ID NO: 7042069 - DNA, 22 bp, Homo sapiens
aggggctgggacagagccaagc

SEQ ID NO: 7042070 - DNA, 22 bp, Homo sapiens
cctcctggagcattggtgagga

SEQ ID NO: 7042071 - DNA, 22 bp, Homo sapiens
cctcctggaggctctaagggag

SEQ ID NO: 7042072 - DNA, 22 bp, Homo sapiens
cctcctggaggctctagggaaa

SEQ ID NO: 7042073 - DNA, 22 bp, Homo sapiens
cctctgggagactgctactgag

SEQ ID NO: 7042074 - DNA, 22 bp, Homo sapiens
cctctgggcctggaagggcagt

SEQ ID NO: 7042075 - DNA, 22 bp, Homo sapiens
ccctttctccagaactgtctga

SEQ ID NO: 7042076 - DNA, 21 bp, Homo sapiens
ccctttctccatacttcatcc

SEQ ID NO: 7042077 - DNA, 22 bp, Homo sapiens
ccctttctgccttctaaaataa

SEQ ID NO: 7042078 - DNA, 22 bp, Homo sapiens
ccctttctgggacccctgtctc

SEQ ID NO: 7042079 - DNA, 22 bp, Homo sapiens
agggccagagtacatcagggct

SEQ ID NO: 7042080 - DNA, 22 bp, Homo sapiens
agggccagagtctgtgtagata

SEQ ID NO: 7042081 - DNA, 22 bp, Homo sapiens
agggccagagtctgtgtagata

SEQ ID NO: 7042082 - DNA, 22 bp, Homo sapiens
agggccagaatccctcagtcta

SEQ ID NO: 7042083 - DNA, 22 bp, Homo sapiens
agggccagaggcaccttgcagc

SEQ ID NO: 7042084 - DNA, 16 bp, Homo sapiens
agggccagaagcatca

SEQ ID NO: 7042085 - DNA, 22 bp, Homo sapiens
agggcccttacgcaggcccttc

SEQ ID NO: 7042086 - DNA, 19 bp, Homo sapiens
agggctaggcacatagggc

SEQ ID NO: 7042087 - DNA, 21 bp, Homo sapiens
agggctcaaatgtgcttgctg

SEQ ID NO: 7042088 - DNA, 22 bp, Homo sapiens
agggctcataattcctgacttc

SEQ ID NO: 7042089 - DNA, 22 bp, Homo sapiens
agggctcatctgagactgacat

SEQ ID NO: 7042090 - DNA, 22 bp, Homo sapiens
agggctcattgacatggaaaag

SEQ ID NO: 7042091 - DNA, 22 bp, Homo sapiens
agggctcctgaggcccttctgg

SEQ ID NO: 7042092 - DNA, 18 bp, Homo sapiens
agggctctctgctgggtt

SEQ ID NO: 7042093 - DNA, 22 bp, Homo sapiens
agggctctcttcttggtttgca

SEQ ID NO: 7042094 - DNA, 18 bp, Homo sapiens
ccctcttgcacaaagcaa

SEQ ID NO: 7042095 - DNA, 22 bp, Homo sapiens
agggacttgatgtcagggagat

SEQ ID NO: 7042096 - DNA, 22 bp, Homo sapiens
agggagaaaattggatgcacaa

SEQ ID NO: 7042097 - DNA, 22 bp, Homo sapiens
agggagaaggtccatgcctgtc

SEQ ID NO: 7042098 - DNA, 22 bp, Homo sapiens
agggaactccatgaggccagag

SEQ ID NO: 7042099 - DNA, 22 bp, Homo sapiens
cccaggagttggaggctgcagt

SEQ ID NO: 7042100 - DNA, 23 bp, Homo sapiens
cccaggagtttcactgcaaaggt

SEQ ID NO: 7042101 - DNA, 22 bp, Homo sapiens
cccaggagtttgagttcagcat

SEQ ID NO: 7042102 - DNA, 20 bp, Homo sapiens
cccaggagtttgctcttact

SEQ ID NO: 7042103 - DNA, 22 bp, Homo sapiens
cccaggggaggtcctcagggaa

SEQ ID NO: 7042104 - DNA, 22 bp, Homo sapiens
aggctggctggcaggggacaca

SEQ ID NO: 7042105 - DNA, 22 bp, Homo sapiens
aggcttcacattttctaggcct

SEQ ID NO: 7042106 - DNA, 22 bp, Homo sapiens
cccaggagttggaggctacggt

SEQ ID NO: 7042107 - DNA, 22 bp, Homo sapiens
aggttattaaagtgtatttttg

SEQ ID NO: 7042108 - DNA, 21 bp, Homo sapiens
aggttattacaatttttctac

SEQ ID NO: 7042109 - DNA, 22 bp, Homo sapiens
aggttattctctatctcatccc

SEQ ID NO: 7042110 - DNA, 22 bp, Homo sapiens
aggttattgctctccaagttca

SEQ ID NO: 7042111 - DNA, 22 bp, Homo sapiens
aggttattgtagattataggca

SEQ ID NO: 7042112 - DNA, 22 bp, Homo sapiens
aggttatttaggaaggtagagc

SEQ ID NO: 7042113 - DNA, 22 bp, Homo sapiens
aggttatttcatccttccctgg

SEQ ID NO: 7042114 - DNA, 22 bp, Homo sapiens
aggttatttgcagatggaattc

SEQ ID NO: 7042115 - DNA, 22 bp, Homo sapiens
aggttattttgctcagggaact

SEQ ID NO: 7042116 - DNA, 22 bp, Homo sapiens
aggttatttttgcttagaaaga

SEQ ID NO: 7042117 - DNA, 22 bp, Homo sapiens
aggtttctactgtgttaagaaa

SEQ ID NO: 7042118 - DNA, 22 bp, Homo sapiens
aggtttctcctttaaagcatgg

SEQ ID NO: 7042119 - DNA, 22 bp, Homo sapiens
cctttatgagatcctggggtga

SEQ ID NO: 7042120 - DNA, 22 bp, Homo sapiens
cctttatgatagatgctttcag

SEQ ID NO: 7042121 - DNA, 21 bp, Homo sapiens
cctttatgcaaggactggcat

SEQ ID NO: 7042122 - DNA, 22 bp, Homo sapiens
cctttatgtcactctggagagc

SEQ ID NO: 7042123 - DNA, 22 bp, Homo sapiens
cctttatgtttctgcagccccc

SEQ ID NO: 7042124 - DNA, 22 bp, Homo sapiens
agtaatcaatttttcggtggat

SEQ ID NO: 7042125 - DNA, 21 bp, Homo sapiens
ctacacagctttctataggaa

SEQ ID NO: 7042126 - DNA, 22 bp, Homo sapiens
ctacacagttctgcctaatggc

SEQ ID NO: 7042127 - DNA, 22 bp, Homo sapiens
cctgggcagggctggactctca

SEQ ID NO: 7042128 - DNA, 22 bp, Homo sapiens
cctgggcaggccggacgctggg

SEQ ID NO: 7042129 - DNA, 22 bp, Homo sapiens
cctgggcagggagaccaggctc

SEQ ID NO: 7042130 - DNA, 22 bp, Homo sapiens
cctgggcagtgctggagttgaa

SEQ ID NO: 7042131 - DNA, 22 bp, Homo sapiens
cctgggcataaatcactccaag

SEQ ID NO: 7042132 - DNA, 22 bp, Homo sapiens
aggtggagtgtgcagggagagc

SEQ ID NO: 7042133 - DNA, 22 bp, Homo sapiens
aggggctgtggaaaccaactct

SEQ ID NO: 7042134 - DNA, 22 bp, Homo sapiens
aggggctgtggaaaccaactct

SEQ ID NO: 7042135 - DNA, 22 bp, Homo sapiens
cctggagcaggagctgcagagg

SEQ ID NO: 7042136 - DNA, 22 bp, Homo sapiens
agtgggagagaagcaagtagta

SEQ ID NO: 7042137 - DNA, 19 bp, Homo sapiens
agtgggcaaggaagatgac

SEQ ID NO: 7042138 - DNA, 21 bp, Homo sapiens
agtggctgtcaagggggcctt

SEQ ID NO: 7042139 - DNA, 22 bp, Homo sapiens
ctctctggcttggcacggagat

SEQ ID NO: 7042140 - DNA, 18 bp, Homo sapiens
ctctctgggtgaggacaa

SEQ ID NO: 7042141 - DNA, 22 bp, Homo sapiens
agtggctggcataggaacagac

SEQ ID NO: 7042142 - DNA, 20 bp, Homo sapiens
agtggggagtcaggagtgcc

SEQ ID NO: 7042143 - DNA, 22 bp, Homo sapiens
ctctgtttttcaatagttcttg

SEQ ID NO: 7042144 - DNA, 22 bp, Homo sapiens
ctcttaaaattacctttgcaaa

SEQ ID NO: 7042145 - DNA, 22 bp, Homo sapiens
ctcttaaagaatgttccagctg

SEQ ID NO: 7042146 - DNA, 19 bp, Homo sapiens
ctcttaaattgtctcttgc

SEQ ID NO: 7042147 - DNA, 19 bp, Homo sapiens
ctcttaaattgtctcttgc

SEQ ID NO: 7042148 - DNA, 19 bp, Homo sapiens
ctcttacagaatagacaca

SEQ ID NO: 7042149 - DNA, 22 bp, Homo sapiens
ctgagaaaggacctcaaacagg

SEQ ID NO: 7042150 - DNA, 22 bp, Homo sapiens
ctgagaaagtgagggttaaaca

SEQ ID NO: 7042151 - DNA, 22 bp, Homo sapiens
agtgcacttttccacatccata

SEQ ID NO: 7042152 - DNA, 22 bp, Homo sapiens
ctcctcccacggtctcaggaag

SEQ ID NO: 7042153 - DNA, 22 bp, Homo sapiens
ctcctccctgcgattgctctgc

SEQ ID NO: 7042154 - DNA, 22 bp, Homo sapiens
ctcctcctggacacaggctgtg

SEQ ID NO: 7042155 - DNA, 22 bp, Homo sapiens
agtcatctcttctacaatatgg

SEQ ID NO: 7042156 - DNA, 21 bp, Homo sapiens
agtcatctgttcattcaacag

SEQ ID NO: 7042157 - DNA, 18 bp, Homo sapiens
agtcatttacttttgtga

SEQ ID NO: 7042158 - DNA, 22 bp, Homo sapiens
agtcattttctgcctgtaatct

SEQ ID NO: 7042159 - DNA, 22 bp, Homo sapiens
agtctctttaatcacagtgtct

SEQ ID NO: 7042160 - DNA, 22 bp, Homo sapiens
agtctcttttgcgaagagtgtt

SEQ ID NO: 7042161 - DNA, 22 bp, Homo sapiens
agtctgcaaatatgttcatgtg

SEQ ID NO: 7042162 - DNA, 19 bp, Homo sapiens
agtctgcatttctagcaag

SEQ ID NO: 7042163 - DNA, 22 bp, Homo sapiens
ctggggcagagcccagcaattt

SEQ ID NO: 7042164 - DNA, 22 bp, Homo sapiens
ctggggcagagcctttagcaaa

SEQ ID NO: 7042165 - DNA, 22 bp, Homo sapiens
ctgggctgtcagttttgtttta

SEQ ID NO: 7042166 - DNA, 22 bp, Homo sapiens
ctgggctgtcccaaccccatcc

SEQ ID NO: 7042167 - DNA, 22 bp, Homo sapiens
ctgggctgtcccagggcggcag

SEQ ID NO: 7042168 - DNA, 23 bp, Homo sapiens
ctgggctgtcctgaggtcacctc

SEQ ID NO: 7042169 - DNA, 22 bp, Homo sapiens
ctgggctgtggtgtggcccaaa

SEQ ID NO: 7042170 - DNA, 22 bp, Homo sapiens
ctgggctgttctgcccctgggt

SEQ ID NO: 7042171 - DNA, 22 bp, Homo sapiens
atatttgtttggcagagttcag

SEQ ID NO: 7042172 - DNA, 22 bp, Homo sapiens
atattttcacagaacttgcaaa

SEQ ID NO: 7042173 - DNA, 22 bp, Homo sapiens
atattttcactgaaccaaagta

SEQ ID NO: 7042174 - DNA, 22 bp, Homo sapiens
atattttgaagttaataatgtg

SEQ ID NO: 7042175 - DNA, 22 bp, Homo sapiens
atattttgaagttaataatgtg

SEQ ID NO: 7042176 - DNA, 22 bp, Homo sapiens
atattttggcaaatgtctagat

SEQ ID NO: 7042177 - DNA, 22 bp, Homo sapiens
ctgtccagaaagggggcaacaa

SEQ ID NO: 7042178 - DNA, 22 bp, Homo sapiens
ctgggctgtaatgtggcactga

SEQ ID NO: 7042179 - DNA, 22 bp, Homo sapiens
ctgggctgggtttaccctcttc

SEQ ID NO: 7042180 - DNA, 22 bp, Homo sapiens
ctgggctgtcaatggccctctg

SEQ ID NO: 7042181 - DNA, 22 bp, Homo sapiens
ctgggcctggggctgttgagag

SEQ ID NO: 7042182 - DNA, 22 bp, Homo sapiens
ctgggctgatttagtcacgttt

SEQ ID NO: 7042183 - DNA, 22 bp, Homo sapiens
ctgggctgcagcgggagcgacg

SEQ ID NO: 7042184 - DNA, 20 bp, Homo sapiens
ctgggctgggctacagggtc

SEQ ID NO: 7042185 - DNA, 22 bp, Homo sapiens
ctgggcctgagctctgaagagt

SEQ ID NO: 7042186 - DNA, 19 bp, Homo sapiens
ctgggcctgcatggttgtt

SEQ ID NO: 7042187 - DNA, 22 bp, Homo sapiens
ctgggcctgccaccatcttagg

SEQ ID NO: 7042188 - DNA, 22 bp, Homo sapiens
ctgggcctggacgggcagatct

SEQ ID NO: 7042189 - DNA, 22 bp, Homo sapiens
ctgggcctggagcccacgagcc

SEQ ID NO: 7042190 - DNA, 22 bp, Homo sapiens
ctgggcctggcgttccaggctg

SEQ ID NO: 7042191 - DNA, 22 bp, Homo sapiens
ctgggcctgggaggccaggtct

SEQ ID NO: 7042192 - DNA, 22 bp, Homo sapiens
ctgggcctctcagctcccgcgg

SEQ ID NO: 7042193 - DNA, 17 bp, Homo sapiens
ctgggcctctgcccttt

SEQ ID NO: 7042194 - DNA, 22 bp, Homo sapiens
ctgggccatgggccagcgaggc

SEQ ID NO: 7042195 - DNA, 22 bp, Homo sapiens
ctgggcagtttacattcctacc

SEQ ID NO: 7042196 - DNA, 22 bp, Homo sapiens
ctgggcagtttattcagttctg

SEQ ID NO: 7042197 - DNA, 22 bp, Homo sapiens
ctgggccatcagaggggctgga

SEQ ID NO: 7042198 - DNA, 22 bp, Homo sapiens
atagtcaaccttgtaattagcc

SEQ ID NO: 7042199 - DNA, 22 bp, Homo sapiens
atagtgattgaaaacattctgt

SEQ ID NO: 7042200 - DNA, 22 bp, Homo sapiens
atatcaaaataaacagcatgca

SEQ ID NO: 7042201 - DNA, 22 bp, Homo sapiens
atatcaaacgaagttattttaa

SEQ ID NO: 7042202 - DNA, 22 bp, Homo sapiens
atatcaaagctagtggaaattt

SEQ ID NO: 7042203 - DNA, 23 bp, Homo sapiens
atatcacacccagtacagtctcc

SEQ ID NO: 7042204 - DNA, 22 bp, Homo sapiens
atatcacagatgcagaaagaga

SEQ ID NO: 7042205 - DNA, 22 bp, Homo sapiens
atatcacagctctttcattgct

SEQ ID NO: 7042206 - DNA, 22 bp, Homo sapiens
ctgtccagggtgtgcaggggct

SEQ ID NO: 7042207 - DNA, 21 bp, Homo sapiens
atcattaattgctgagtgaca

SEQ ID NO: 7042208 - DNA, 22 bp, Homo sapiens
atcattactcctgtaaaattgt

SEQ ID NO: 7042209 - DNA, 22 bp, Homo sapiens
ctgtttatctaggagttgcagg

SEQ ID NO: 7042210 - DNA, 22 bp, Homo sapiens
ctgtttatctctaacctgttta

SEQ ID NO: 7042211 - DNA, 22 bp, Homo sapiens
ctgtttatgaagctgtggttta

SEQ ID NO: 7042212 - DNA, 22 bp, Homo sapiens
ctgtttatggaggtaaggcatc

SEQ ID NO: 7042213 - DNA, 22 bp, Homo sapiens
ctgtttattacactggatagca

SEQ ID NO: 7042214 - DNA, 22 bp, Homo sapiens
ctgtttattacgtaattaatat

SEQ ID NO: 7042215 - DNA, 20 bp, Homo sapiens
ctgtttattagaagtggatt

SEQ ID NO: 7042216 - DNA, 22 bp, Homo sapiens
ctgtttattctcatctaaaatg

SEQ ID NO: 7042217 - DNA, 22 bp, Homo sapiens
ctgtttattctcatctaaaatg

SEQ ID NO: 7042218 - DNA, 22 bp, Homo sapiens
ctgtttattgagcaatctgcca

SEQ ID NO: 7042219 - DNA, 21 bp, Homo sapiens
ctgtttatttcacctgggtgc

SEQ ID NO: 7042220 - DNA, 22 bp, Homo sapiens
ctgtttcagaacttcttaaaaa

SEQ ID NO: 7042221 - DNA, 22 bp, Homo sapiens
ctgtttctaaagggagcagatt

SEQ ID NO: 7042222 - DNA, 22 bp, Homo sapiens
ctgtttctccacactcttccca

SEQ ID NO: 7042223 - DNA, 22 bp, Homo sapiens
atccttgggaactaaatgtaag

SEQ ID NO: 7042224 - DNA, 22 bp, Homo sapiens
atctcataactcatttgaagac

SEQ ID NO: 7042225 - DNA, 22 bp, Homo sapiens
atctcatctgggggaccatttt

SEQ ID NO: 7042226 - DNA, 22 bp, Homo sapiens
cttcagttatgtgccaaggaca

SEQ ID NO: 7042227 - DNA, 22 bp, Homo sapiens
cttcagttctaaagtagaatgt

SEQ ID NO: 7042228 - DNA, 22 bp, Homo sapiens
cttcagtttacaatgcattggc

SEQ ID NO: 7042229 - DNA, 22 bp, Homo sapiens
cttcagtttatcccatcatcca

SEQ ID NO: 7042230 - DNA, 22 bp, Homo sapiens
cttcataagattgttgtgagga

SEQ ID NO: 7042231 - DNA, 22 bp, Homo sapiens
cttcataatctgaaatttgtaa

SEQ ID NO: 7042232 - DNA, 22 bp, Homo sapiens
cttcataattaccttgtctgcc

SEQ ID NO: 7042233 - DNA, 22 bp, Homo sapiens
atagaccttctacacaggacaa

SEQ ID NO: 7042234 - DNA, 20 bp, Homo sapiens
atagtaatgaagtcttgttc

SEQ ID NO: 7042235 - DNA, 22 bp, Homo sapiens
atagaattcgtgtttgtaattc

SEQ ID NO: 7042236 - DNA, 22 bp, Homo sapiens
atagacaaacacgaagatgaca

SEQ ID NO: 7042237 - DNA, 22 bp, Homo sapiens
atacttttaattccttctgagt

SEQ ID NO: 7042238 - DNA, 22 bp, Homo sapiens
atacttttaattccttctgagt

SEQ ID NO: 7042239 - DNA, 22 bp, Homo sapiens
atagaatatgacttttagatcc

SEQ ID NO: 7042240 - DNA, 21 bp, Homo sapiens
atacagaaggtggcaaagtac

SEQ ID NO: 7042241 - DNA, 22 bp, Homo sapiens
atacagaagttttccacttatt

SEQ ID NO: 7042242 - DNA, 22 bp, Homo sapiens
atacatctcatgtaagagataa

SEQ ID NO: 7042243 - DNA, 22 bp, Homo sapiens
atacatcttccttttaaaatgc

SEQ ID NO: 7042244 - DNA, 22 bp, Homo sapiens
atacatcttgtcagattcatgt

SEQ ID NO: 7042245 - DNA, 22 bp, Homo sapiens
atacatgaggctcatttatgtc

SEQ ID NO: 7042246 - DNA, 22 bp, Homo sapiens
atacatgatcactgtattataa

SEQ ID NO: 7042247 - DNA, 22 bp, Homo sapiens
ataattctccaatttttgttgt

SEQ ID NO: 7042248 - DNA, 20 bp, Homo sapiens
atacacattcatagaaaaat

SEQ ID NO: 7042249 - DNA, 22 bp, Homo sapiens
atacagaaaagtggatagccag

SEQ ID NO: 7042250 - DNA, 22 bp, Homo sapiens
atacagaaaatgatgcagagtt

SEQ ID NO: 7042251 - DNA, 22 bp, Homo sapiens
atacagaacaagcctcacctcc

SEQ ID NO: 7042252 - DNA, 22 bp, Homo sapiens
atacagaactctcagttgtata

SEQ ID NO: 7042253 - DNA, 22 bp, Homo sapiens
atacagaagaactatagccact

SEQ ID NO: 7042254 - DNA, 22 bp, Homo sapiens
agttttgatactttctcttcat

SEQ ID NO: 7042255 - DNA, 22 bp, Homo sapiens
agttttcacactcaccaaaagg

SEQ ID NO: 7042256 - DNA, 22 bp, Homo sapiens
agttttcagaaattgcgaccca

SEQ ID NO: 7042257 - DNA, 20 bp, Homo sapiens
agttttcagcagaacaccca

SEQ ID NO: 7042258 - DNA, 22 bp, Homo sapiens
agttttcagggtttctgtcctc

SEQ ID NO: 7042259 - DNA, 22 bp, Homo sapiens
agttttcagtaaatattagtga

SEQ ID NO: 7042260 - DNA, 22 bp, Homo sapiens
agttttctctgtgttctgctta

SEQ ID NO: 7042261 - DNA, 22 bp, Homo sapiens
agttttctgacccctgctctat

SEQ ID NO: 7042262 - DNA, 22 bp, Homo sapiens
agttttctgttctacaatttga

SEQ ID NO: 7042263 - DNA, 22 bp, Homo sapiens
ataagtgctgattagctcttca

SEQ ID NO: 7042264 - DNA, 23 bp, Homo sapiens
ataataattatggcagcaaagtg

SEQ ID NO: 7042265 - DNA, 22 bp, Homo sapiens
agtttacaacagtagctatgga

SEQ ID NO: 7042266 - DNA, 22 bp, Homo sapiens
agtttatgttgtttataagcca

SEQ ID NO: 7042267 - DNA, 19 bp, Homo sapiens
agtttattataggtgattc

SEQ ID NO: 7042268 - DNA, 22 bp, Homo sapiens
agtttattgtatatggtagttt

SEQ ID NO: 7042269 - DNA, 22 bp, Homo sapiens
agtttcagaatttatgcagaca

SEQ ID NO: 7042270 - DNA, 18 bp, Homo sapiens
agtttcagggcaggaaac

SEQ ID NO: 7042271 - DNA, 22 bp, Homo sapiens
agtttctattttcatgtctgtt

SEQ ID NO: 7042272 - DNA, 22 bp, Homo sapiens
agtttctgcaaatcatttttat

SEQ ID NO: 7042273 - DNA, 22 bp, Homo sapiens
agtttctgcaaatcatttttat

SEQ ID NO: 7042274 - DNA, 22 bp, Homo sapiens
agtttctgttaccatatttgac

SEQ ID NO: 7042275 - DNA, 22 bp, Homo sapiens
agtttcttcatccaaaaaatgg

SEQ ID NO: 7042276 - DNA, 22 bp, Homo sapiens
agtttctttagatagaaagttc

SEQ ID NO: 7042277 - DNA, 22 bp, Homo sapiens
ctgatacaatgtctgctttata

SEQ ID NO: 7042278 - DNA, 22 bp, Homo sapiens
ctgatacatagtagcatgtcat

SEQ ID NO: 7042279 - DNA, 22 bp, Homo sapiens
agttttatgttcacagaaggat

SEQ ID NO: 7042280 - DNA, 22 bp, Homo sapiens
agttttattaaatccacagaag

SEQ ID NO: 7042281 - DNA, 22 bp, Homo sapiens
agttttattccaatgtgcagca

SEQ ID NO: 7042282 - DNA, 22 bp, Homo sapiens
agttttattgtcccagaggtga

SEQ ID NO: 7042283 - DNA, 22 bp, Homo sapiens
gagaagttagctctgtttaggt

SEQ ID NO: 7042284 - DNA, 22 bp, Homo sapiens
atgctgtttgcttttagtctgc

SEQ ID NO: 7042285 - DNA, 22 bp, Homo sapiens
gagaatattagagttagtttat

SEQ ID NO: 7042286 - DNA, 22 bp, Homo sapiens
gagacaggatttaaccaaagct

SEQ ID NO: 7042287 - DNA, 22 bp, Homo sapiens
gagacaggcagctagtgggtca

SEQ ID NO: 7042288 - DNA, 22 bp, Homo sapiens
gagacaggccaggtggtactta

SEQ ID NO: 7042289 - DNA, 22 bp, Homo sapiens
atgggcagacagggagctcacg

SEQ ID NO: 7042290 - DNA, 21 bp, Homo sapiens
atgggcagaggcagagaggct

SEQ ID NO: 7042291 - DNA, 22 bp, Homo sapiens
gagctgcacatctgaggctaat

SEQ ID NO: 7042292 - DNA, 22 bp, Homo sapiens
atgggcagagtggggacaggaa

SEQ ID NO: 7042293 - DNA, 22 bp, Homo sapiens
atgggcagagtggggacaggaa

SEQ ID NO: 7042294 - DNA, 22 bp, Homo sapiens
atgggcagctgcagcagtggtg

SEQ ID NO: 7042295 - DNA, 22 bp, Homo sapiens
atgggcaggcactggctctcag

SEQ ID NO: 7042296 - DNA, 22 bp, Homo sapiens
atgtatcacagcaatgtagtca

SEQ ID NO: 7042297 - DNA, 18 bp, Homo sapiens
atgtatgtacatatttat

SEQ ID NO: 7042298 - DNA, 22 bp, Homo sapiens
atgtatgtagtgtacatataca

SEQ ID NO: 7042299 - DNA, 22 bp, Homo sapiens
atgtatgtctgcatacacatac

SEQ ID NO: 7042300 - DNA, 22 bp, Homo sapiens
atgtatgttagtgtattatcta

SEQ ID NO: 7042301 - DNA, 23 bp, Homo sapiens
atgtatttaaatttcagtgatga

SEQ ID NO: 7042302 - DNA, 17 bp, Homo sapiens
atgtggctaagctgctg

SEQ ID NO: 7042303 - DNA, 22 bp, Homo sapiens
atgtggctagtgcagatgaata

SEQ ID NO: 7042304 - DNA, 22 bp, Homo sapiens
atgtggctcacatagctggaaa

SEQ ID NO: 7042305 - DNA, 22 bp, Homo sapiens
atgtggctgatcgcagagctct

SEQ ID NO: 7042306 - DNA, 22 bp, Homo sapiens
atgttacagaaagcaaagatga

SEQ ID NO: 7042307 - DNA, 22 bp, Homo sapiens
atgttacagggagagaaggcca

SEQ ID NO: 7042308 - DNA, 22 bp, Homo sapiens
atgttacagttgagtaaattaa

SEQ ID NO: 7042309 - DNA, 22 bp, Homo sapiens
gaggttatgttcatatcttagt

SEQ ID NO: 7042310 - DNA, 22 bp, Homo sapiens
gaaggaggcgttagccctagga

SEQ ID NO: 7042311 - DNA, 22 bp, Homo sapiens
gaagctaaaagagatgtggttt

SEQ ID NO: 7042312 - DNA, 23 bp, Homo sapiens
gaagtcagccctacagagagcag

SEQ ID NO: 7042313 - DNA, 22 bp, Homo sapiens
atgcatttgacgggatatattt

SEQ ID NO: 7042314 - DNA, 22 bp, Homo sapiens
atgccactgcactccagcctgg

SEQ ID NO: 7042315 - DNA, 22 bp, Homo sapiens
gaattttagaatatgtgggctt

SEQ ID NO: 7042316 - DNA, 22 bp, Homo sapiens
atgacaatggacatagttaaaa

SEQ ID NO: 7042317 - DNA, 22 bp, Homo sapiens
atgacacaagagcagaagccat

SEQ ID NO: 7042318 - DNA, 22 bp, Homo sapiens
atgacacttggtgatactttgt

SEQ ID NO: 7042319 - DNA, 22 bp, Homo sapiens
ctttggaaaaagtgactggctc

SEQ ID NO: 7042320 - DNA, 22 bp, Homo sapiens
ctttggaaaaatacctggcata

SEQ ID NO: 7042321 - DNA, 22 bp, Homo sapiens
ctttggaaaagcataccaagga

SEQ ID NO: 7042322 - DNA, 22 bp, Homo sapiens
ctttggaaagtaagcagctaga

SEQ ID NO: 7042323 - DNA, 22 bp, Homo sapiens
ctttggaaagtggttcaggtga

SEQ ID NO: 7042324 - DNA, 22 bp, Homo sapiens
ctttttataccgtgccagttga

SEQ ID NO: 7042325 - DNA, 22 bp, Homo sapiens
ctttttatagctatgtcctatg

SEQ ID NO: 7042326 - DNA, 22 bp, Homo sapiens
ctttttatctcttaatgatgtt

SEQ ID NO: 7042327 - DNA, 19 bp, Homo sapiens
ctttttcaccttctagaag

SEQ ID NO: 7042328 - DNA, 22 bp, Homo sapiens
ctttttcactgtgtcctcacac

SEQ ID NO: 7042329 - DNA, 22 bp, Homo sapiens
atgagataggaacaaacttaca

SEQ ID NO: 7042330 - DNA, 22 bp, Homo sapiens
cttctcctctgagtcctgggag

SEQ ID NO: 7042331 - DNA, 22 bp, Homo sapiens
atctttctatggtactttctcc

SEQ ID NO: 7042332 - DNA, 22 bp, Homo sapiens
atctttctatggtactttctcc

SEQ ID NO: 7042333 - DNA, 22 bp, Homo sapiens
atctttctccatatacatcttt

SEQ ID NO: 7042334 - DNA, 22 bp, Homo sapiens
atctttctctgcactatacaat

SEQ ID NO: 7042335 - DNA, 22 bp, Homo sapiens
atctttcttatttgaagaaaga

SEQ ID NO: 7042336 - DNA, 22 bp, Homo sapiens
ctttattcctacaagattttct

SEQ ID NO: 7042337 - DNA, 22 bp, Homo sapiens
ctttattctgcaaattgccttg

SEQ ID NO: 7042338 - DNA, 22 bp, Homo sapiens
attatataggacttgcccttcc

SEQ ID NO: 7042339 - DNA, 22 bp, Homo sapiens
attatggacatcaaataactct

SEQ ID NO: 7042340 - DNA, 22 bp, Homo sapiens
gagtggggcccactgctgggtg

SEQ ID NO: 7042341 - DNA, 22 bp, Homo sapiens
atgttatgtgcaagatacataa

SEQ ID NO: 7042342 - DNA, 22 bp, Homo sapiens
atgttattaaagtacagattct

SEQ ID NO: 7042343 - DNA, 22 bp, Homo sapiens
atgttatttctgaaagatcatt

SEQ ID NO: 7042344 - DNA, 22 bp, Homo sapiens
gattctgagacagaaacgtatt

SEQ ID NO: 7042345 - DNA, 22 bp, Homo sapiens
gattctgagctggtgttttacg

SEQ ID NO: 7042346 - DNA, 22 bp, Homo sapiens
gattcttaagacattatgtatt

SEQ ID NO: 7042347 - DNA, 22 bp, Homo sapiens
gattcttatgagtgaactttac

SEQ ID NO: 7042348 - DNA, 22 bp, Homo sapiens
attaacagaattttacatgctt

SEQ ID NO: 7042349 - DNA, 22 bp, Homo sapiens
attgcaaatgagtcttaatata

SEQ ID NO: 7042350 - DNA, 22 bp, Homo sapiens
attctttccagacactgattgc

SEQ ID NO: 7042351 - DNA, 22 bp, Homo sapiens
attcttttaaatggcagtagta

SEQ ID NO: 7042352 - DNA, 22 bp, Homo sapiens
attcttttaagccccagggatt

SEQ ID NO: 7042353 - DNA, 22 bp, Homo sapiens
attcttttcccaactgctttaa

SEQ ID NO: 7042354 - DNA, 22 bp, Homo sapiens
attcttttcccaactgctttaa

SEQ ID NO: 7042355 - DNA, 22 bp, Homo sapiens
attcttttgtcctagcttgata

SEQ ID NO: 7042356 - DNA, 22 bp, Homo sapiens
attcttttttaaggaatagaac

SEQ ID NO: 7042357 - DNA, 20 bp, Homo sapiens
attcacaaagccagtgttgc

SEQ ID NO: 7042358 - DNA, 22 bp, Homo sapiens
attccaaactctttccctgtcg

SEQ ID NO: 7042359 - DNA, 22 bp, Homo sapiens
attccaaggtctttctagattg

SEQ ID NO: 7042360 - DNA, 22 bp, Homo sapiens
attccacaagaccataaattag

SEQ ID NO: 7042361 - DNA, 22 bp, Homo sapiens
attccacaagaccataaattag

SEQ ID NO: 7042362 - DNA, 17 bp, Homo sapiens
attccacagggaatctg

SEQ ID NO: 7042363 - DNA, 22 bp, Homo sapiens
attctgatcattcaagatgtca

SEQ ID NO: 7042364 - DNA, 22 bp, Homo sapiens
gcaggcaaggtagacagaggaa

SEQ ID NO: 7042365 - DNA, 22 bp, Homo sapiens
atttctgtttgctactataagt

SEQ ID NO: 7042366 - DNA, 22 bp, Homo sapiens
atttcttacataacaaattgtt

SEQ ID NO: 7042367 - DNA, 22 bp, Homo sapiens
atttcttatgaatattgactgt

SEQ ID NO: 7042368 - DNA, 22 bp, Homo sapiens
gccctgggctccctgctccaca

SEQ ID NO: 7042369 - DNA, 22 bp, Homo sapiens
gccctggggaaggtgtctccaa

SEQ ID NO: 7042370 - DNA, 22 bp, Homo sapiens
gccctggggaaggtgtctccaa

SEQ ID NO: 7042371 - DNA, 22 bp, Homo sapiens
gccatcctctgagcactaggca

SEQ ID NO: 7042372 - DNA, 22 bp, Homo sapiens
gccagctggagactggcagggg

SEQ ID NO: 7042373 - DNA, 22 bp, Homo sapiens
atttatcatcagaccttttaaa

SEQ ID NO: 7042374 - DNA, 22 bp, Homo sapiens
atttatgtatctgtgtagatca

SEQ ID NO: 7042375 - DNA, 22 bp, Homo sapiens
attttgatgtatctttgtagct

SEQ ID NO: 7042376 - DNA, 22 bp, Homo sapiens
gctcagacttgttttacaggct

SEQ ID NO: 7042377 - DNA, 20 bp, Homo sapiens
caaaagcaatgaagttatga

SEQ ID NO: 7042378 - DNA, 22 bp, Homo sapiens
caaaagcagcaagtttatatgt

SEQ ID NO: 7042379 - DNA, 22 bp, Homo sapiens
caaagaatgagtgagtacataa

SEQ ID NO: 7042380 - DNA, 22 bp, Homo sapiens
attttcatgactaccttaaata

SEQ ID NO: 7042381 - DNA, 22 bp, Homo sapiens
attttcatgactaccttaaata

SEQ ID NO: 7042382 - DNA, 22 bp, Homo sapiens
attttcatgactaccttaaata

SEQ ID NO: 7042383 - DNA, 22 bp, Homo sapiens
attttcatggcttctgctcagt

SEQ ID NO: 7042384 - DNA, 21 bp, Homo sapiens
attttcattaattcagtgtgg

SEQ ID NO: 7042385 - DNA, 21 bp, Homo sapiens
attttcattaattcagtgtgg

SEQ ID NO: 7042386 - DNA, 22 bp, Homo sapiens
attttccaaaataattgttact

SEQ ID NO: 7042387 - DNA, 22 bp, Homo sapiens
gccttccttacacctgctcagc

SEQ ID NO: 7042388 - DNA, 22 bp, Homo sapiens
atttggaatgtgtttgatcacc

SEQ ID NO: 7042389 - DNA, 22 bp, Homo sapiens
atttggaattcgagtaattcca

SEQ ID NO: 7042390 - DNA, 22 bp, Homo sapiens
atttggaattctatttcagtag

SEQ ID NO: 7042391 - DNA, 22 bp, Homo sapiens
atttgtaagctagagccatgat

SEQ ID NO: 7042392 - DNA, 22 bp, Homo sapiens
atttgtaatttcttatctgtgt

SEQ ID NO: 7042393 - DNA, 22 bp, Homo sapiens
atttgtatcaatctcaatatat

SEQ ID NO: 7042394 - DNA, 22 bp, Homo sapiens
atttgtatcttctaatattatc

SEQ ID NO: 7042395 - DNA, 22 bp, Homo sapiens
atttgtatcttctaatattatc

SEQ ID NO: 7042396 - DNA, 22 bp, Homo sapiens
atttgtcaaaacacagagaaca

SEQ ID NO: 7042397 - DNA, 22 bp, Homo sapiens
atttgtcaacaggcatttaggt

SEQ ID NO: 7042398 - DNA, 22 bp, Homo sapiens
atttgtcacacatagtttatcc

SEQ ID NO: 7042399 - DNA, 22 bp, Homo sapiens
atttgtcactgagagagttaga

SEQ ID NO: 7042400 - DNA, 22 bp, Homo sapiens
atttgtcagtggaagtgattca

SEQ ID NO: 7042401 - DNA, 22 bp, Homo sapiens
caaggctgctgcgggtcgcacc

SEQ ID NO: 7042402 - DNA, 22 bp, Homo sapiens
caatatagagagaaaattatgt

SEQ ID NO: 7042403 - DNA, 22 bp, Homo sapiens
caatatataatgagtactttcc

SEQ ID NO: 7042404 - DNA, 22 bp, Homo sapiens
caattcatgttaaacagaagca

SEQ ID NO: 7042405 - DNA, 22 bp, Homo sapiens
caatatcaggtccgcgtaagtc

SEQ ID NO: 7042406 - DNA, 22 bp, Homo sapiens
caattcattacattgcaaagac

SEQ ID NO: 7042407 - DNA, 22 bp, Homo sapiens
caattctttcagctgcatttgt

SEQ ID NO: 7042408 - DNA, 22 bp, Homo sapiens
caattctttcagctgcatttgt

SEQ ID NO: 7042409 - DNA, 22 bp, Homo sapiens
caattgaacagatgagttaaat

SEQ ID NO: 7042410 - DNA, 23 bp, Homo sapiens
caattgtataaagcaaatggttt

SEQ ID NO: 7042411 - DNA, 22 bp, Homo sapiens
caatttcaatacaaaatacatt

SEQ ID NO: 7042412 - DNA, 22 bp, Homo sapiens
caatttcagtctcagagagttc

SEQ ID NO: 7042413 - DNA, 22 bp, Homo sapiens
caatttcattaatagatataga

SEQ ID NO: 7042414 - DNA, 22 bp, Homo sapiens
caatttccttcatagatgactg

SEQ ID NO: 7042415 - DNA, 22 bp, Homo sapiens
ggagagaggctggccgtgatga

SEQ ID NO: 7042416 - DNA, 22 bp, Homo sapiens
cacacagtaggcactcattaat

SEQ ID NO: 7042417 - DNA, 22 bp, Homo sapiens
ggaagaggaggagccaggcttt

SEQ ID NO: 7042418 - DNA, 22 bp, Homo sapiens
cacaaatgactgaaacgactgt

SEQ ID NO: 7042419 - DNA, 22 bp, Homo sapiens
cacaaatggccgtgttcaaaga

SEQ ID NO: 7042420 - DNA, 22 bp, Homo sapiens
ggaccacagcacttggcttgag

SEQ ID NO: 7042421 - DNA, 18 bp, Homo sapiens
ggaccacatcaacttgaa

SEQ ID NO: 7042422 - DNA, 22 bp, Homo sapiens
caagcccccggcaagtgtgtat

SEQ ID NO: 7042423 - DNA, 22 bp, Homo sapiens
gctgggctcagacctagtgaac

SEQ ID NO: 7042424 - DNA, 22 bp, Homo sapiens
gctgggcttgtggccagctggg

SEQ ID NO: 7042425 - DNA, 22 bp, Homo sapiens
caagaagccgagctacaggctc

SEQ ID NO: 7042426 - DNA, 22 bp, Homo sapiens
caagaagtgtcagctttttaaa

SEQ ID NO: 7042427 - DNA, 22 bp, Homo sapiens
caagaattgtacaaactgggtg

SEQ ID NO: 7042428 - DNA, 18 bp, Homo sapiens
gctgcctgcattcctcac

SEQ ID NO: 7042429 - DNA, 22 bp, Homo sapiens
caaattttgtgtgttctctagt

SEQ ID NO: 7042430 - DNA, 22 bp, Homo sapiens
caacaatttcccagtttcccat

SEQ ID NO: 7042431 - DNA, 22 bp, Homo sapiens
caccaggcacatagtaggcact

SEQ ID NO: 7042432 - DNA, 22 bp, Homo sapiens
caccaggctgaaccagagggga

SEQ ID NO: 7042433 - DNA, 22 bp, Homo sapiens
caccaggctgcccaggacaggg

SEQ ID NO: 7042434 - DNA, 22 bp, Homo sapiens
cactctaacctccatcttccat

SEQ ID NO: 7042435 - DNA, 21 bp, Homo sapiens
cactccacttagaacagggtt

SEQ ID NO: 7042436 - DNA, 22 bp, Homo sapiens
cactgcactccagcttgggtga

SEQ ID NO: 7042437 - DNA, 22 bp, Homo sapiens
cactgtaacctccacctcctgg

SEQ ID NO: 7042438 - DNA, 22 bp, Homo sapiens
ggctctgctggattgaggccag

SEQ ID NO: 7042439 - DNA, 22 bp, Homo sapiens
ggctctgctggtaagatgcctc

SEQ ID NO: 7042440 - DNA, 22 bp, Homo sapiens
ggctctgcttgaggccagcctg

SEQ ID NO: 7042441 - DNA, 22 bp, Homo sapiens
cacttgtagaggcattattcca

SEQ ID NO: 7042442 - DNA, 22 bp, Homo sapiens
cacttctcacaaagtgacattc

SEQ ID NO: 7042443 - DNA, 22 bp, Homo sapiens
cacttctctgataatctcagtt

SEQ ID NO: 7042444 - DNA, 22 bp, Homo sapiens
cactgtggcaacctgtgcccaa

SEQ ID NO: 7042445 - DNA, 22 bp, Homo sapiens
cacttcaaggaatatctagaaa

SEQ ID NO: 7042446 - DNA, 22 bp, Homo sapiens
cacttcagctacaatcacatga

SEQ ID NO: 7042447 - DNA, 22 bp, Homo sapiens
cacatgaaggctggggtcgtga

SEQ ID NO: 7042448 - DNA, 22 bp, Homo sapiens
ggcagaggtgacagtgtctttt

SEQ ID NO: 7042449 - DNA, 22 bp, Homo sapiens
cacattaaaatcctaacttcca

SEQ ID NO: 7042450 - DNA, 22 bp, Homo sapiens
cacattcaattacacagatagg

SEQ ID NO: 7042451 - DNA, 22 bp, Homo sapiens
cacattcagggcagaccactca

SEQ ID NO: 7042452 - DNA, 20 bp, Homo sapiens
cacaggccttgtgagcagac

SEQ ID NO: 7042453 - DNA, 22 bp, Homo sapiens
cacagggttgttctgaggattc

SEQ ID NO: 7042454 - DNA, 22 bp, Homo sapiens
cacaggaggttaggaagtggtc

SEQ ID NO: 7042455 - DNA, 22 bp, Homo sapiens
cacaggagttaacataattaag

SEQ ID NO: 7042456 - DNA, 22 bp, Homo sapiens
cacagtctcctctcttagcctg

SEQ ID NO: 7042457 - DNA, 22 bp, Homo sapiens
gtgagcaatgttatcaggttga

SEQ ID NO: 7042458 - DNA, 22 bp, Homo sapiens
cagatttaggtcactagaattt

SEQ ID NO: 7042459 - DNA, 19 bp, Homo sapiens
cagcaaacactgtaaatgg

SEQ ID NO: 7042460 - DNA, 22 bp, Homo sapiens
gtacacagatgcttgagaatct

SEQ ID NO: 7042461 - DNA, 23 bp, Homo sapiens
gtacacatagtgtagttatattt

SEQ ID NO: 7042462 - DNA, 20 bp, Homo sapiens
gtacacatatatgtatgtgt

SEQ ID NO: 7042463 - DNA, 22 bp, Homo sapiens
gtacacattatgcttctctaaa

SEQ ID NO: 7042464 - DNA, 22 bp, Homo sapiens
gtacacattgtctgtttacttc

SEQ ID NO: 7042465 - DNA, 22 bp, Homo sapiens
gtactttaaatcaatgtagatt

SEQ ID NO: 7042466 - DNA, 22 bp, Homo sapiens
gtactttaagactccagtagca

SEQ ID NO: 7042467 - DNA, 22 bp, Homo sapiens
gtactttagagtaaaatagacc

SEQ ID NO: 7042468 - DNA, 22 bp, Homo sapiens
gtagaaatagtggttgacagga

SEQ ID NO: 7042469 - DNA, 22 bp, Homo sapiens
gtattttatggcatgcagtggc

SEQ ID NO: 7042470 - DNA, 22 bp, Homo sapiens
cagcagtgtctccagcatcaca

SEQ ID NO: 7042471 - DNA, 22 bp, Homo sapiens
gtccagagctggcacactgtca

SEQ ID NO: 7042472 - DNA, 22 bp, Homo sapiens
gtccagaggtccaggatcaagg

SEQ ID NO: 7042473 - DNA, 22 bp, Homo sapiens
cagccaggagcctctgcaacta

SEQ ID NO: 7042474 - DNA, 22 bp, Homo sapiens
cagccaggagctccccctgctc

SEQ ID NO: 7042475 - DNA, 22 bp, Homo sapiens
gggcaggggtagcattccaagt

SEQ ID NO: 7042476 - DNA, 22 bp, Homo sapiens
gggcaggggtcagtggccccaa

SEQ ID NO: 7042477 - DNA, 22 bp, Homo sapiens
cagagaattaattgtggctaag

SEQ ID NO: 7042478 - DNA, 22 bp, Homo sapiens
gggagctgctgaacacaagggt

SEQ ID NO: 7042479 - DNA, 21 bp, Homo sapiens
gggagctggaaactgggtgac

SEQ ID NO: 7042480 - DNA, 22 bp, Homo sapiens
gggaggcagtgctggaggctgg

SEQ ID NO: 7042481 - DNA, 22 bp, Homo sapiens
cagacactaggtgacagagtgc

SEQ ID NO: 7042482 - DNA, 22 bp, Homo sapiens
cagacactatgctaaggtacta

SEQ ID NO: 7042483 - DNA, 22 bp, Homo sapiens
gggctggagttgggaagacaaa

SEQ ID NO: 7042484 - DNA, 18 bp, Homo sapiens
gggctgtgagatgggaag

SEQ ID NO: 7042485 - DNA, 22 bp, Homo sapiens
gggctgtgctgagtaggaggtg

SEQ ID NO: 7042486 - DNA, 22 bp, Homo sapiens
gggctgtggagccgcgagggct

SEQ ID NO: 7042487 - DNA, 22 bp, Homo sapiens
ggggcagagtagctggggtgtg

SEQ ID NO: 7042488 - DNA, 23 bp, Homo sapiens
ggggcctgcaccggtctgcgcgg

SEQ ID NO: 7042489 - DNA, 22 bp, Homo sapiens
ggggcctgtagagcttcaggga

SEQ ID NO: 7042490 - DNA, 22 bp, Homo sapiens
ggggccttggatctgtgccccg

SEQ ID NO: 7042491 - DNA, 22 bp, Homo sapiens
ggggccttttctgaatgtggaa

SEQ ID NO: 7042492 - DNA, 22 bp, Homo sapiens
gggtccaggtcttcaggcagag

SEQ ID NO: 7042493 - DNA, 21 bp, Homo sapiens
gggtcctgggatgggatccag

SEQ ID NO: 7042494 - DNA, 20 bp, Homo sapiens
gggtgtgggcccggccaggc

SEQ ID NO: 7042495 - DNA, 22 bp, Homo sapiens
cagatatgtggattctattagc

SEQ ID NO: 7042496 - DNA, 22 bp, Homo sapiens
ccaggctcaggtgcgagagaca

SEQ ID NO: 7042497 - DNA, 22 bp, Homo sapiens
ccagggtgggaggctgaaggcg

SEQ ID NO: 7042498 - DNA, 22 bp, Homo sapiens
ccagggtggggtccaggaacca

SEQ ID NO: 7042499 - DNA, 23 bp, Homo sapiens
ccagggcccctacaccactgtcc

SEQ ID NO: 7042500 - DNA, 22 bp, Homo sapiens
tgaccctctggccccacagcca

SEQ ID NO: 7042501 - DNA, 22 bp, Homo sapiens
tgactttacagatatgtttcct

SEQ ID NO: 7042502 - DNA, 22 bp, Homo sapiens
tgacaattgcagacacagaagt

SEQ ID NO: 7042503 - DNA, 22 bp, Homo sapiens
tgattacacagcagtaatttca

SEQ ID NO: 7042504 - DNA, 22 bp, Homo sapiens
tgattacactatttgggaatag

SEQ ID NO: 7042505 - DNA, 23 bp, Homo sapiens
tgattacaggaagttcaagtgtt

SEQ ID NO: 7042506 - DNA, 22 bp, Homo sapiens
tgattacagtatttgagatcca

SEQ ID NO: 7042507 - DNA, 22 bp, Homo sapiens
tgattacagtctgacagatgtt

SEQ ID NO: 7042508 - DNA, 22 bp, Homo sapiens
tgattacattggtaatgtttat

SEQ ID NO: 7042509 - DNA, 17 bp, Homo sapiens
tgattcaactagaaact

SEQ ID NO: 7042510 - DNA, 22 bp, Homo sapiens
tgaggcaggtaagcaagttttg

SEQ ID NO: 7042511 - DNA, 22 bp, Homo sapiens
tgaggcaggtggattacaaggt

SEQ ID NO: 7042512 - DNA, 22 bp, Homo sapiens
tgatacataaaccatcattttg

SEQ ID NO: 7042513 - DNA, 22 bp, Homo sapiens
tgatgacccaaggtgtcctctg

SEQ ID NO: 7042514 - DNA, 23 bp, Homo sapiens
ccatggagcatggctcactaggc

SEQ ID NO: 7042515 - DNA, 22 bp, Homo sapiens
cccagaggtgaaggaggtggga

SEQ ID NO: 7042516 - DNA, 22 bp, Homo sapiens
tgcagaggtgttgctgagataa

SEQ ID NO: 7042517 - DNA, 22 bp, Homo sapiens
tgcagcagtttaatgcagggtt

SEQ ID NO: 7042518 - DNA, 22 bp, Homo sapiens
cccagctcatcaggagccgccc

SEQ ID NO: 7042519 - DNA, 22 bp, Homo sapiens
cccagctccaagggacagcgaa

SEQ ID NO: 7042520 - DNA, 18 bp, Homo sapiens
cccagctccacttccctc

SEQ ID NO: 7042521 - DNA, 22 bp, Homo sapiens
cccagctccagagccagaaaca

SEQ ID NO: 7042522 - DNA, 22 bp, Homo sapiens
cccagctcccaagttgctatgg

SEQ ID NO: 7042523 - DNA, 22 bp, Homo sapiens
cccagctcccatgttctccaat

SEQ ID NO: 7042524 - DNA, 22 bp, Homo sapiens
cccagctccctggtatttgtgc

SEQ ID NO: 7042525 - DNA, 22 bp, Homo sapiens
cccagctccgagctccgagccg

SEQ ID NO: 7042526 - DNA, 21 bp, Homo sapiens
cccaggagaagaaaagatgca

SEQ ID NO: 7042527 - DNA, 22 bp, Homo sapiens
cccaggagaatataatgttctt

SEQ ID NO: 7042528 - DNA, 22 bp, Homo sapiens
cccaggagaatatttttgggtc

SEQ ID NO: 7042529 - DNA, 22 bp, Homo sapiens
cccaggagacagaaacagaggt

SEQ ID NO: 7042530 - DNA, 22 bp, Homo sapiens
cccaggagacatatagaaggac

SEQ ID NO: 7042531 - DNA, 22 bp, Homo sapiens
cccaggagatctggatctcgtc

SEQ ID NO: 7042532 - DNA, 22 bp, Homo sapiens
cccaggaggacattccataccc

SEQ ID NO: 7042533 - DNA, 21 bp, Homo sapiens
cccaggaggagctccggctcc

SEQ ID NO: 7042534 - DNA, 22 bp, Homo sapiens
cccaggaggaggaaaaagctcg

SEQ ID NO: 7042535 - DNA, 22 bp, Homo sapiens
cccaggaggcagaagttgcagt

SEQ ID NO: 7042536 - DNA, 22 bp, Homo sapiens
cccaggaggcagagatagcagt

SEQ ID NO: 7042537 - DNA, 22 bp, Homo sapiens
cccaggaggcagagcttgcagt

SEQ ID NO: 7042538 - DNA, 22 bp, Homo sapiens
cccaggaggcagaggttgcagt

SEQ ID NO: 7042539 - DNA, 22 bp, Homo sapiens
cccaggaggcagaggttggagc

SEQ ID NO: 7042540 - DNA, 22 bp, Homo sapiens
cccaggaggcagatgttgcagt

SEQ ID NO: 7042541 - DNA, 22 bp, Homo sapiens
cccaggaggccaaggttgcagt

SEQ ID NO: 7042542 - DNA, 22 bp, Homo sapiens
cccaggaggcctgcctggccgg

SEQ ID NO: 7042543 - DNA, 22 bp, Homo sapiens
cccaggaggcgcaggttgcggt

SEQ ID NO: 7042544 - DNA, 19 bp, Homo sapiens
cccaggaggcggaggttgc

SEQ ID NO: 7042545 - DNA, 22 bp, Homo sapiens
cccaggaggcggaggttgcagt

SEQ ID NO: 7042546 - DNA, 22 bp, Homo sapiens
cccaggaggcggaggttgtggt

SEQ ID NO: 7042547 - DNA, 21 bp, Homo sapiens
cccaggaggctgagaagagca

SEQ ID NO: 7042548 - DNA, 22 bp, Homo sapiens
cccaggaggttggggctacagt

SEQ ID NO: 7042549 - DNA, 22 bp, Homo sapiens
cccaggagtaagtgacattgtt

SEQ ID NO: 7042550 - DNA, 21 bp, Homo sapiens
cccaggagtcctatttaaatg

SEQ ID NO: 7042551 - DNA, 19 bp, Homo sapiens
cccaggagtctggctggtt

SEQ ID NO: 7042552 - DNA, 20 bp, Homo sapiens
cccaggagtgagcagcttta

SEQ ID NO: 7042553 - DNA, 22 bp, Homo sapiens
cccaggagttagaggttgtggt

SEQ ID NO: 7042554 - DNA, 22 bp, Homo sapiens
tgccctggttctgtgggtgagc

SEQ ID NO: 7042555 - DNA, 23 bp, Homo sapiens
tggcctctccccacctggcagaa

SEQ ID NO: 7042556 - DNA, 22 bp, Homo sapiens
tggcctctcctggcagcatcca

SEQ ID NO: 7042557 - DNA, 22 bp, Homo sapiens
cctcactctgcaccctgcagca

SEQ ID NO: 7042558 - DNA, 22 bp, Homo sapiens
tggcctcaaccgtcctaagcac

SEQ ID NO: 7042559 - DNA, 22 bp, Homo sapiens
tggcctcaagtctgagggcctt

SEQ ID NO: 7042560 - DNA, 22 bp, Homo sapiens
tggcctcaatctgtcctccagc

SEQ ID NO: 7042561 - DNA, 22 bp, Homo sapiens
tggcctcaccactagctgggtg

SEQ ID NO: 7042562 - DNA, 22 bp, Homo sapiens
tggcctcagattattgcacagt

SEQ ID NO: 7042563 - DNA, 22 bp, Homo sapiens
tggcctcagatttcaggggtgg

SEQ ID NO: 7042564 - DNA, 22 bp, Homo sapiens
tggcctcatttggaaatagggc

SEQ ID NO: 7042565 - DNA, 22 bp, Homo sapiens
tggctaggctccaagagctgga

SEQ ID NO: 7042566 - DNA, 22 bp, Homo sapiens
tggctcagcgcggcctggtctt

SEQ ID NO: 7042567 - DNA, 22 bp, Homo sapiens
cctccctccattgccatcgtct

SEQ ID NO: 7042568 - DNA, 22 bp, Homo sapiens
ccggctactcgggaggctgacg

SEQ ID NO: 7042569 - DNA, 22 bp, Homo sapiens
ccctgtgccagagaggcaggag

SEQ ID NO: 7042570 - DNA, 22 bp, Homo sapiens
ccctggtggtacggcactggca

SEQ ID NO: 7042571 - DNA, 22 bp, Homo sapiens
cctaaatagagtcagatgtaat

SEQ ID NO: 7042572 - DNA, 22 bp, Homo sapiens
tgcctcagtttctccatatgaa

SEQ ID NO: 7042573 - DNA, 22 bp, Homo sapiens
tgctttcaatgaattgtatact

SEQ ID NO: 7042574 - DNA, 22 bp, Homo sapiens
cctcttctgcttcaggagcact

SEQ ID NO: 7042575 - DNA, 22 bp, Homo sapiens
tgggccagcaattgctgctcag

SEQ ID NO: 7042576 - DNA, 22 bp, Homo sapiens
tgggccagatccatggcaataa

SEQ ID NO: 7042577 - DNA, 22 bp, Homo sapiens
tgggccagaagtatgcatgttt

SEQ ID NO: 7042578 - DNA, 22 bp, Homo sapiens
cctctggccacatgggacatag

SEQ ID NO: 7042579 - DNA, 22 bp, Homo sapiens
tgggccactcttccctgggtct

SEQ ID NO: 7042580 - DNA, 22 bp, Homo sapiens
cctccctgcgctcctgcggcgg

SEQ ID NO: 7042581 - DNA, 22 bp, Homo sapiens
tgggagcagttgcatctccagt

SEQ ID NO: 7042582 - DNA, 23 bp, Homo sapiens
tgggagctcaagggaggctgccc

SEQ ID NO: 7042583 - DNA, 22 bp, Homo sapiens
tgggagctcagaaagggaggtc

SEQ ID NO: 7042584 - DNA, 22 bp, Homo sapiens
cctctggatctttctccacact

SEQ ID NO: 7042585 - DNA, 22 bp, Homo sapiens
cctgaggctccacctccagaga

SEQ ID NO: 7042586 - DNA, 22 bp, Homo sapiens
cctgaggctggcccttccatcc

SEQ ID NO: 7042587 - DNA, 22 bp, Homo sapiens
cctgaggcttaatctgtcccaa

SEQ ID NO: 7042588 - DNA, 22 bp, Homo sapiens
tggggtaggagtcagcgagaga

SEQ ID NO: 7042589 - DNA, 22 bp, Homo sapiens
cctggagcttttccatcctgga

SEQ ID NO: 7042590 - DNA, 22 bp, Homo sapiens
tgtcaaatagtagaaagatggc

SEQ ID NO: 7042591 - DNA, 22 bp, Homo sapiens
tgtaaagacgcttatagcttgc

SEQ ID NO: 7042592 - DNA, 22 bp, Homo sapiens
tgtaatgaaaaggaggaaatag

SEQ ID NO: 7042593 - DNA, 22 bp, Homo sapiens
tgtaatttgcatggctgaatgc

SEQ ID NO: 7042594 - DNA, 22 bp, Homo sapiens
cctggagcacatggcaggaggc

SEQ ID NO: 7042595 - DNA, 22 bp, Homo sapiens
ccagagaggccttggcaagaca

SEQ ID NO: 7042596 - DNA, 22 bp, Homo sapiens
ccagagagagtactgggctctg

SEQ ID NO: 7042597 - DNA, 22 bp, Homo sapiens
ccagagagctacaaggcataaa

SEQ ID NO: 7042598 - DNA, 19 bp, Homo sapiens
ccagagagctaggtacaga

SEQ ID NO: 7042599 - DNA, 22 bp, Homo sapiens
ccacctcctaggcctggagaag

SEQ ID NO: 7042600 - DNA, 22 bp, Homo sapiens
tctcaagcttgttggtatgttt

SEQ ID NO: 7042601 - DNA, 22 bp, Homo sapiens
ccactttttagagaacaaaact

SEQ ID NO: 7042602 - DNA, 22 bp, Homo sapiens
ccactttttcagtgtgcatgca

SEQ ID NO: 7042603 - DNA, 22 bp, Homo sapiens
tctcagtttctcattataaaag

SEQ ID NO: 7042604 - DNA, 22 bp, Homo sapiens
tcgctgaggctgcacggctgcc

SEQ ID NO: 7042605 - DNA, 22 bp, Homo sapiens
tcctctgactcccatggcccgc

SEQ ID NO: 7042606 - DNA, 22 bp, Homo sapiens
ccacattcactcatttcattgt

SEQ ID NO: 7042607 - DNA, 22 bp, Homo sapiens
ccacattcatcagttgttaatg

SEQ ID NO: 7042608 - DNA, 21 bp, Homo sapiens
ccacattctcattctgactgc

SEQ ID NO: 7042609 - DNA, 22 bp, Homo sapiens
tctcctggccgggctgtcccct

SEQ ID NO: 7042610 - DNA, 22 bp, Homo sapiens
tctcctggctcaccaggctgga

SEQ ID NO: 7042611 - DNA, 17 bp, Homo sapiens
tctcctggctctatcag

SEQ ID NO: 7042612 - DNA, 23 bp, Homo sapiens
tctcctggctgcactgtggccac

SEQ ID NO: 7042613 - DNA, 19 bp, Homo sapiens
tctctgcagcgcgcccggc

SEQ ID NO: 7042614 - DNA, 22 bp, Homo sapiens
tctctgggaatgggcctgggta

SEQ ID NO: 7042615 - DNA, 22 bp, Homo sapiens
tctctgggacactgggtcagtt

SEQ ID NO: 7042616 - DNA, 22 bp, Homo sapiens
tctctgggagccaggatgacac

SEQ ID NO: 7042617 - DNA, 22 bp, Homo sapiens
tctcttaaaagattttaatgac

SEQ ID NO: 7042618 - DNA, 22 bp, Homo sapiens
tccctagtcgcatctgtggaga

SEQ ID NO: 7042619 - DNA, 22 bp, Homo sapiens
catttggaaagagactagagaa

SEQ ID NO: 7042620 - DNA, 22 bp, Homo sapiens
catttggaccaaaatagccaac

SEQ ID NO: 7042621 - DNA, 18 bp, Homo sapiens
cattcttggcagcttttg

SEQ ID NO: 7042622 - DNA, 22 bp, Homo sapiens
cattgcacatctgagaagagat

SEQ ID NO: 7042623 - DNA, 22 bp, Homo sapiens
catgttcaaataagtagtttct

SEQ ID NO: 7042624 - DNA, 22 bp, Homo sapiens
catgttctaacaatgagaaacc

SEQ ID NO: 7042625 - DNA, 22 bp, Homo sapiens
catgttctaatattgtgacata

SEQ ID NO: 7042626 - DNA, 22 bp, Homo sapiens
catgtttctgagaaaagtagga

SEQ ID NO: 7042627 - DNA, 22 bp, Homo sapiens
cattcaaaggcatgtcctattt

SEQ ID NO: 7042628 - DNA, 22 bp, Homo sapiens
cattcaaatgtgccactgtcct

SEQ ID NO: 7042629 - DNA, 22 bp, Homo sapiens
cattcaaattaagattttgtta

SEQ ID NO: 7042630 - DNA, 22 bp, Homo sapiens
cattcattagaatagatatgta

SEQ ID NO: 7042631 - DNA, 22 bp, Homo sapiens
cattcattcacattttgtctat

SEQ ID NO: 7042632 - DNA, 22 bp, Homo sapiens
tccaggccccagaccgtactgc

SEQ ID NO: 7042633 - DNA, 22 bp, Homo sapiens
tccaggcccctgcctgggcctg

SEQ ID NO: 7042634 - DNA, 22 bp, Homo sapiens
tccaggcccgagatgggctgga

SEQ ID NO: 7042635 - DNA, 21 bp, Homo sapiens
tccagctgcacaagcatgggg

SEQ ID NO: 7042636 - DNA, 22 bp, Homo sapiens
cataacagtggcttcagcaagt

SEQ ID NO: 7042637 - DNA, 22 bp, Homo sapiens
catgaaaataacattgttgtga

SEQ ID NO: 7042638 - DNA, 19 bp, Homo sapiens
tcatgtctctcatctgtga

SEQ ID NO: 7042639 - DNA, 22 bp, Homo sapiens
tcattctggatgactttctaga

SEQ ID NO: 7042640 - DNA, 22 bp, Homo sapiens
tcattcttgcgtatgccatggt

SEQ ID NO: 7042641 - DNA, 22 bp, Homo sapiens
tccacagtggtggaattgttca

SEQ ID NO: 7042642 - DNA, 22 bp, Homo sapiens
tcagctttttacatgtgaaata

SEQ ID NO: 7042643 - DNA, 19 bp, Homo sapiens
cataaatgtacaagataca

SEQ ID NO: 7042644 - DNA, 22 bp, Homo sapiens
cagtttatagctctagcagctt

SEQ ID NO: 7042645 - DNA, 22 bp, Homo sapiens
cagtttatagctctagcagctt

SEQ ID NO: 7042646 - DNA, 22 bp, Homo sapiens
cagtttatatataagcacattg

SEQ ID NO: 7042647 - DNA, 22 bp, Homo sapiens
cagtttatatataagcacattg

SEQ ID NO: 7042648 - DNA, 22 bp, Homo sapiens
tcagctttgcaagttagaaaat

SEQ ID NO: 7042649 - DNA, 22 bp, Homo sapiens
tcagcttttaaaaacaagaagt

SEQ ID NO: 7042650 - DNA, 22 bp, Homo sapiens
cagttacatgctcatgtcatca

SEQ ID NO: 7042651 - DNA, 22 bp, Homo sapiens
cagtgggtaggaaaggctcttc

SEQ ID NO: 7042652 - DNA, 22 bp, Homo sapiens
cagtggggggactgaggcctga

SEQ ID NO: 7042653 - DNA, 22 bp, Homo sapiens
cagtgggaagggcagaggcttt

SEQ ID NO: 7042654 - DNA, 22 bp, Homo sapiens
cagtgccagaggtactagtgga

SEQ ID NO: 7042655 - DNA, 22 bp, Homo sapiens
cagggtggccctgtggtctcat

SEQ ID NO: 7042656 - DNA, 22 bp, Homo sapiens
cagggtgggcacccagcctcca

SEQ ID NO: 7042657 - DNA, 22 bp, Homo sapiens
caggttatctggattaatatca

SEQ ID NO: 7042658 - DNA, 22 bp, Homo sapiens
cagtatatgctctttcatcaaa

SEQ ID NO: 7042659 - DNA, 22 bp, Homo sapiens
tatttcttgttccctccaagtt

SEQ ID NO: 7042660 - DNA, 22 bp, Homo sapiens
tatttctttcaggtatgtgttg

SEQ ID NO: 7042661 - DNA, 22 bp, Homo sapiens
tatttcttttcgtgacttattg

SEQ ID NO: 7042662 - DNA, 22 bp, Homo sapiens
tatttcttttcgtgacttattg

SEQ ID NO: 7042663 - DNA, 22 bp, Homo sapiens
tatttgaaagtgtacaaaaact

SEQ ID NO: 7042664 - DNA, 22 bp, Homo sapiens
cagtgagagagaacgcattcat

SEQ ID NO: 7042665 - DNA, 22 bp, Homo sapiens
tcacagttaattgttggaatgt

SEQ ID NO: 7042666 - DNA, 22 bp, Homo sapiens
tcacagttactccttcagatga

SEQ ID NO: 7042667 - DNA, 23 bp, Homo sapiens
tcacagttacttttgcatcaacc

SEQ ID NO: 7042668 - DNA, 22 bp, Homo sapiens
tcacagttatagtctgtagaat

SEQ ID NO: 7042669 - DNA, 22 bp, Homo sapiens
tcacagttcaaaccccatatct

SEQ ID NO: 7042670 - DNA, 22 bp, Homo sapiens
cagggctccatgcagggactcc

SEQ ID NO: 7042671 - DNA, 22 bp, Homo sapiens
tagggctcactgagatgaatat

SEQ ID NO: 7042672 - DNA, 22 bp, Homo sapiens
tagggctcagagaagtggggcc

SEQ ID NO: 7042673 - DNA, 18 bp, Homo sapiens
tagggctctagggagtga

SEQ ID NO: 7042674 - DNA, 22 bp, Homo sapiens
tagtgataatgtttatgctttt

SEQ ID NO: 7042675 - DNA, 22 bp, Homo sapiens
tatcagtttattctataaatag

SEQ ID NO: 7042676 - DNA, 22 bp, Homo sapiens
tatcataagttaattaaacagt

SEQ ID NO: 7042677 - DNA, 22 bp, Homo sapiens
tagctacatttatacactgtag

SEQ ID NO: 7042678 - DNA, 22 bp, Homo sapiens
tagctttaagatgagatgtgga

SEQ ID NO: 7042679 - DNA, 22 bp, Homo sapiens
cagggctcaccactgggatcct

SEQ ID NO: 7042680 - DNA, 22 bp, Homo sapiens
cagggctcactcggctggcgtc

SEQ ID NO: 7042681 - DNA, 22 bp, Homo sapiens
cagggctcaggctctgggattc

SEQ ID NO: 7042682 - DNA, 22 bp, Homo sapiens
cagggctcaggctctgggattc

SEQ ID NO: 7042683 - DNA, 22 bp, Homo sapiens
cagggctcagggactgcagaaa

SEQ ID NO: 7042684 - DNA, 22 bp, Homo sapiens
tactcagtttatgatttcaagt

SEQ ID NO: 7042685 - DNA, 22 bp, Homo sapiens
tactgtatgaattatgttattt

SEQ ID NO: 7042686 - DNA, 22 bp, Homo sapiens
tactgtatgatttcatgtatat

SEQ ID NO: 7042687 - DNA, 22 bp, Homo sapiens
caggctgcctggaagaggactg

SEQ ID NO: 7042688 - DNA, 22 bp, Homo sapiens
caggctggagtgagtgtagtgg

SEQ ID NO: 7042689 - DNA, 22 bp, Homo sapiens
caggctggagtgcagtggtgcc

SEQ ID NO: 7042690 - DNA, 19 bp, Homo sapiens
tagaatagttacacagatt

SEQ ID NO: 7042691 - DNA, 22 bp, Homo sapiens
tagaatatacactacagcttaa

SEQ ID NO: 7042692 - DNA, 22 bp, Homo sapiens
tagaatatgtggtgtatacttt

SEQ ID NO: 7042693 - DNA, 18 bp, Homo sapiens
tagaatcaaatattttac

SEQ ID NO: 7042694 - DNA, 22 bp, Homo sapiens
tagaggagagttgctggatgga

SEQ ID NO: 7042695 - DNA, 22 bp, Homo sapiens
cagggcaaggcagagcgtcccc

SEQ ID NO: 7042696 - DNA, 22 bp, Homo sapiens
tagcgttttgtaatcaagtatg

SEQ ID NO: 7042697 - DNA, 22 bp, Homo sapiens
ttcaaatgcaagttactacttt

SEQ ID NO: 7042698 - DNA, 22 bp, Homo sapiens
cggagtcttgctatgttgccca

SEQ ID NO: 7042699 - DNA, 22 bp, Homo sapiens
cggcagggctccatgcatttct

SEQ ID NO: 7042700 - DNA, 22 bp, Homo sapiens
cggcagggttggttttctctga

SEQ ID NO: 7042701 - DNA, 22 bp, Homo sapiens
cgtgggccccagccactccctc

SEQ ID NO: 7042702 - DNA, 22 bp, Homo sapiens
cggggctgctcgtcctcctgtg

SEQ ID NO: 7042703 - DNA, 22 bp, Homo sapiens
cggggctggcacaggtgaccac

SEQ ID NO: 7042704 - DNA, 22 bp, Homo sapiens
cggggctggcacaggtgaccac

SEQ ID NO: 7042705 - DNA, 22 bp, Homo sapiens
cggggctgacagcaggtgtgct

SEQ ID NO: 7042706 - DNA, 22 bp, Homo sapiens
cggggctgacagcaggtgtgct

SEQ ID NO: 7042707 - DNA, 22 bp, Homo sapiens
cggggctgaggcaacgcggaga

SEQ ID NO: 7042708 - DNA, 22 bp, Homo sapiens
cggggctgaggcaacgcggaga

SEQ ID NO: 7042709 - DNA, 22 bp, Homo sapiens
cggggctgcgctcttcctgccg

SEQ ID NO: 7042710 - DNA, 22 bp, Homo sapiens
cggggctgcgctcttcctgccg

SEQ ID NO: 7042711 - DNA, 22 bp, Homo sapiens
cggggctgctcgtcctcctgtg

SEQ ID NO: 7042712 - DNA, 22 bp, Homo sapiens
cggggcagagggtcttctccag

SEQ ID NO: 7042713 - DNA, 22 bp, Homo sapiens
cggggcaggagtccctgtagag

SEQ ID NO: 7042714 - DNA, 22 bp, Homo sapiens
cgctgcagaagcgtgttcagga

SEQ ID NO: 7042715 - DNA, 22 bp, Homo sapiens
cgctgcagacgcgctggcgaaa

SEQ ID NO: 7042716 - DNA, 22 bp, Homo sapiens
cgctgcagatgggagctggttg

SEQ ID NO: 7042717 - DNA, 22 bp, Homo sapiens
cgctgcagctggctgcagggaa

SEQ ID NO: 7042718 - DNA, 22 bp, Homo sapiens
cgctgcagtttatgtgttcctg

SEQ ID NO: 7042719 - DNA, 22 bp, Homo sapiens
cgctgccttcatcccacgccta

SEQ ID NO: 7042720 - DNA, 22 bp, Homo sapiens
ttatttcatataatgttatcaa

SEQ ID NO: 7042721 - DNA, 22 bp, Homo sapiens
ttatttcatgtaaaatttatgt

SEQ ID NO: 7042722 - DNA, 22 bp, Homo sapiens
ttatttcatgtaaaatttatgt

SEQ ID NO: 7042723 - DNA, 22 bp, Homo sapiens
ttattgcaactcctaaatagag

SEQ ID NO: 7042724 - DNA, 23 bp, Homo sapiens
ttattgcaaggtaaaattgctga

SEQ ID NO: 7042725 - DNA, 22 bp, Homo sapiens
ccttttctacaagcaaatgtgc

SEQ ID NO: 7042726 - DNA, 22 bp, Homo sapiens
ccttttctaggatgctttatag

SEQ ID NO: 7042727 - DNA, 22 bp, Homo sapiens
ccttttctatgtaccagcagtg

SEQ ID NO: 7042728 - DNA, 22 bp, Homo sapiens
ccttttctgaaccacttaaata

SEQ ID NO: 7042729 - DNA, 22 bp, Homo sapiens
ccttttctgtgtgggtaattta

SEQ ID NO: 7042730 - DNA, 22 bp, Homo sapiens
ccttttctgtttcctgtcactg

SEQ ID NO: 7042731 - DNA, 22 bp, Homo sapiens
cctttttctgagttgtagcttc

SEQ ID NO: 7042732 - DNA, 22 bp, Homo sapiens
ttaaattcattccaacttttga

SEQ ID NO: 7042733 - DNA, 22 bp, Homo sapiens
ttaaattccagcctcataatag

SEQ ID NO: 7042734 - DNA, 22 bp, Homo sapiens
ttaagcaaatgtcagttgttag

SEQ ID NO: 7042735 - DNA, 22 bp, Homo sapiens
ttaagcaacaagaatcccattg

SEQ ID NO: 7042736 - DNA, 22 bp, Homo sapiens
ttaagcaacaagaatcccattg

SEQ ID NO: 7042737 - DNA, 22 bp, Homo sapiens
ttaagcaacacacattaattat

SEQ ID NO: 7042738 - DNA, 22 bp, Homo sapiens
ccttaaaagaactatctcttct

SEQ ID NO: 7042739 - DNA, 22 bp, Homo sapiens
ccttaaattctccatttgaaag

SEQ ID NO: 7042740 - DNA, 22 bp, Homo sapiens
ccttagtgaaacagaggcaatt

SEQ ID NO: 7042741 - DNA, 22 bp, Homo sapiens
ccttagtgtgcctgaggcagat

SEQ ID NO: 7042742 - DNA, 22 bp, Homo sapiens
ttacaaagagtgccagagtgtg

SEQ ID NO: 7042743 - DNA, 22 bp, Homo sapiens
ttacaaagagtgttcttttcca

SEQ ID NO: 7042744 - DNA, 22 bp, Homo sapiens
ttacaaagagtgttcttttcca

SEQ ID NO: 7042745 - DNA, 22 bp, Homo sapiens
ttacaaagattatattcagtta

SEQ ID NO: 7042746 - DNA, 22 bp, Homo sapiens
ttacaaagattatattcagtta

SEQ ID NO: 7042747 - DNA, 21 bp, Homo sapiens
ttacaaagcaagtgctgtgtc

SEQ ID NO: 7042748 - DNA, 22 bp, Homo sapiens
ttacaaagcaggtcagctgaaa

SEQ ID NO: 7042749 - DNA, 22 bp, Homo sapiens
ttacaaagcgctttacctctga

SEQ ID NO: 7042750 - DNA, 22 bp, Homo sapiens
ttacaaagcgttgagacaagta

SEQ ID NO: 7042751 - DNA, 22 bp, Homo sapiens
ttacaaagcgttgagacaagta

SEQ ID NO: 7042752 - DNA, 22 bp, Homo sapiens
ttacagttgttctatcagcatg

SEQ ID NO: 7042753 - DNA, 21 bp, Homo sapiens
ttagcaaagcaaacacatgct

SEQ ID NO: 7042754 - DNA, 22 bp, Homo sapiens
ttagcaaaggcccctacaccca

SEQ ID NO: 7042755 - DNA, 22 bp, Homo sapiens
ttagcaaagtttgccatctagt

SEQ ID NO: 7042756 - DNA, 22 bp, Homo sapiens
ttagcaaatatcttgaaacagg

SEQ ID NO: 7042757 - DNA, 22 bp, Homo sapiens
ttagcactggatttcatcagaa

SEQ ID NO: 7042758 - DNA, 22 bp, Homo sapiens
ccttgcagctgattatttttca

SEQ ID NO: 7042759 - DNA, 22 bp, Homo sapiens
ttagttttctcatctatctcac

SEQ ID NO: 7042760 - DNA, 22 bp, Homo sapiens
ttataacaacagtttactttaa

SEQ ID NO: 7042761 - DNA, 22 bp, Homo sapiens
ttataacactgccttgtcacca

SEQ ID NO: 7042762 - DNA, 22 bp, Homo sapiens
ttataacatcaatcagagttaa

SEQ ID NO: 7042763 - DNA, 22 bp, Homo sapiens
ttataacattataaagtggaga

SEQ ID NO: 7042764 - DNA, 22 bp, Homo sapiens
ttataactttggatatgacaag

SEQ ID NO: 7042765 - DNA, 22 bp, Homo sapiens
ctcaggagatgacagaaggtat

SEQ ID NO: 7042766 - DNA, 22 bp, Homo sapiens
ttgcactttgaaataacagtgg

SEQ ID NO: 7042767 - DNA, 22 bp, Homo sapiens
ttgcagaacttaaagacagagt

SEQ ID NO: 7042768 - DNA, 22 bp, Homo sapiens
ttgcagtttctggatgccttct

SEQ ID NO: 7042769 - DNA, 22 bp, Homo sapiens
ttgcagtttgtggcaactttga

SEQ ID NO: 7042770 - DNA, 22 bp, Homo sapiens
ttgcccagagtcacccagctca

SEQ ID NO: 7042771 - DNA, 22 bp, Homo sapiens
ctcagggcagtatggctgagag

SEQ ID NO: 7042772 - DNA, 22 bp, Homo sapiens
ctcaggggacctggctccgagt

SEQ ID NO: 7042773 - DNA, 21 bp, Homo sapiens
ctcaggggattttgagattag

SEQ ID NO: 7042774 - DNA, 22 bp, Homo sapiens
ctcagggggaatcaggtcacag

SEQ ID NO: 7042775 - DNA, 22 bp, Homo sapiens
ctcagtcttctcctccaatgga

SEQ ID NO: 7042776 - DNA, 22 bp, Homo sapiens
ttggaaaatgaggcacagagag

SEQ ID NO: 7042777 - DNA, 22 bp, Homo sapiens
ctccagagtcacactgcctggg

SEQ ID NO: 7042778 - DNA, 22 bp, Homo sapiens
ctatacagtaaccacagtgatt

SEQ ID NO: 7042779 - DNA, 22 bp, Homo sapiens
ctatacagagcatccttaactt

SEQ ID NO: 7042780 - DNA, 22 bp, Homo sapiens
ctatacagcagcttactagtta

SEQ ID NO: 7042781 - DNA, 22 bp, Homo sapiens
ttctttctctccacaaggcttg

SEQ ID NO: 7042782 - DNA, 22 bp, Homo sapiens
ttctttctctgtaaaaggaaaa

SEQ ID NO: 7042783 - DNA, 22 bp, Homo sapiens
ttctttctctgtaaaaggaaaa

SEQ ID NO: 7042784 - DNA, 21 bp, Homo sapiens
ttctttctgaatctgaagtat

SEQ ID NO: 7042785 - DNA, 21 bp, Homo sapiens
ttctttctgaatctgaagtat

SEQ ID NO: 7042786 - DNA, 22 bp, Homo sapiens
ttctttctggggtccttcggct

SEQ ID NO: 7042787 - DNA, 22 bp, Homo sapiens
ttctttctgtcatggtgtactg

SEQ ID NO: 7042788 - DNA, 22 bp, Homo sapiens
ttctttctgtccataatgagac

SEQ ID NO: 7042789 - DNA, 22 bp, Homo sapiens
cgtttattttgaagattccact

SEQ ID NO: 7042790 - DNA, 22 bp, Homo sapiens
ctagaggctcagcagatgcctg

SEQ ID NO: 7042791 - DNA, 22 bp, Homo sapiens
ttctattgtaccttttctctca

SEQ ID NO: 7042792 - DNA, 22 bp, Homo sapiens
ttctgcatgtgtttcaaatact

SEQ ID NO: 7042793 - DNA, 22 bp, Homo sapiens
ttctggaagagtaaaataagcc

SEQ ID NO: 7042794 - DNA, 22 bp, Homo sapiens
ttctggaagccccagagtcaga

SEQ ID NO: 7042795 - DNA, 22 bp, Homo sapiens
ttctggaagctggaaaaggcaa

SEQ ID NO: 7042796 - DNA, 23 bp, Homo sapiens
tttatattcctaatgtcttgagc

SEQ ID NO: 7042797 - DNA, 22 bp, Homo sapiens
tttatgattattttaaagcagc

SEQ ID NO: 7042798 - DNA, 22 bp, Homo sapiens
tttatgcacacttagacatggc

SEQ ID NO: 7042799 - DNA, 22 bp, Homo sapiens
tttatgcagatttgtacagtga

SEQ ID NO: 7042800 - DNA, 23 bp, Homo sapiens
tttatgcagcatgtagaacatgg

SEQ ID NO: 7042801 - DNA, 22 bp, Homo sapiens
tttatgcagcctcagtatcaga

SEQ ID NO: 7042802 - DNA, 21 bp, Homo sapiens
tttatgcatgcctctctgtca

SEQ ID NO: 7042803 - DNA, 19 bp, Homo sapiens
tttattcacctttaccttg

SEQ ID NO: 7042804 - DNA, 22 bp, Homo sapiens
tttcagaatatcgattcagtga

SEQ ID NO: 7042805 - DNA, 22 bp, Homo sapiens
tttcagtttagactaaaggtag

SEQ ID NO: 7042806 - DNA, 22 bp, Homo sapiens
tttcagtttatgtcttgaatta

SEQ ID NO: 7042807 - DNA, 22 bp, Homo sapiens
tttcagtttcatggcacagcta

SEQ ID NO: 7042808 - DNA, 22 bp, Homo sapiens
tttcagtttccagctttgtcat

SEQ ID NO: 7042809 - DNA, 22 bp, Homo sapiens
tttattccaaagcttgcacttt

SEQ ID NO: 7042810 - DNA, 22 bp, Homo sapiens
tttcagaaattatattagatgc

SEQ ID NO: 7042811 - DNA, 22 bp, Homo sapiens
tttcagaaattgttattattct

SEQ ID NO: 7042812 - DNA, 22 bp, Homo sapiens
tttcattaaagtcaaatctggt

SEQ ID NO: 7042813 - DNA, 22 bp, Homo sapiens
tttcattacgtgtttgacttgt

SEQ ID NO: 7042814 - DNA, 22 bp, Homo sapiens
tttcattacttgttaagggtag

SEQ ID NO: 7042815 - DNA, 22 bp, Homo sapiens
tttcattagtatgacagcacgc

SEQ ID NO: 7042816 - DNA, 22 bp, Homo sapiens
tttcattataaaaagttggctt

SEQ ID NO: 7042817 - DNA, 22 bp, Homo sapiens
tttccaataaagtgtcattgtt

SEQ ID NO: 7042818 - DNA, 22 bp, Homo sapiens
tttctattttaaaggcatatgg

SEQ ID NO: 7042819 - DNA, 22 bp, Homo sapiens
tttctcaagttcagatatttga

SEQ ID NO: 7042820 - DNA, 22 bp, Homo sapiens
ctctctgtcttggcatttggtc

SEQ ID NO: 7042821 - DNA, 22 bp, Homo sapiens
ctctctgttatgctttcatgaa

SEQ ID NO: 7042822 - DNA, 22 bp, Homo sapiens
ctctctgttcattgagtcaaaa

SEQ ID NO: 7042823 - DNA, 18 bp, Homo sapiens
ctctctttccactctttg

SEQ ID NO: 7042824 - DNA, 22 bp, Homo sapiens
ctctctttttcgtgtgccgaag

SEQ ID NO: 7042825 - DNA, 22 bp, Homo sapiens
ctctgaaagagtttagtattat

SEQ ID NO: 7042826 - DNA, 22 bp, Homo sapiens
tttgaaaatttaagtgctacac

SEQ ID NO: 7042827 - DNA, 22 bp, Homo sapiens
tttgagaaaaccagaaagatct

SEQ ID NO: 7042828 - DNA, 22 bp, Homo sapiens
tttgagaaacagacgaaagaca

SEQ ID NO: 7042829 - DNA, 22 bp, Homo sapiens
tttgagaagatgtaatgttaag

SEQ ID NO: 7042830 - DNA, 22 bp, Homo sapiens
tttgcaaacacttaagaagaga

SEQ ID NO: 7042831 - DNA, 22 bp, Homo sapiens
tttggaagtcctgaaatagagg

SEQ ID NO: 7042832 - DNA, 22 bp, Homo sapiens
tttggaagtcctgaaatagagg

SEQ ID NO: 7042833 - DNA, 22 bp, Homo sapiens
tttgttcatgcctatattctca

SEQ ID NO: 7042834 - DNA, 22 bp, Homo sapiens
tttgttcatgcctatattctca

SEQ ID NO: 7042835 - DNA, 22 bp, Homo sapiens
ctctgtgggaagctgggtgtga

SEQ ID NO: 7042836 - DNA, 22 bp, Homo sapiens
ctctgtggtggagtgggtcacc

SEQ ID NO: 7042837 - DNA, 22 bp, Homo sapiens
ttttgcctgcactgtatatata

SEQ ID NO: 7042838 - DNA, 22 bp, Homo sapiens
ctgcaggagcaagcctgggaga

SEQ ID NO: 7042839 - DNA, 22 bp, Homo sapiens
ctgcaggaggatcctgagagtg

SEQ ID NO: 7042840 - DNA, 22 bp, Homo sapiens
ctgcaggattctcccagttgga

SEQ ID NO: 7042841 - DNA, 22 bp, Homo sapiens
ctgagcagctgttacagagtgt

SEQ ID NO: 7042842 - DNA, 22 bp, Homo sapiens
ctgagcaggatattcacagcag

SEQ ID NO: 7042843 - DNA, 22 bp, Homo sapiens
ctcttcttgaaagaggaattca

SEQ ID NO: 7042844 - DNA, 19 bp, Homo sapiens
ttttggaaatgtgaacagc

SEQ ID NO: 7042845 - DNA, 22 bp, Homo sapiens
ttttggaacacagacattagaa

SEQ ID NO: 7042846 - DNA, 22 bp, Homo sapiens
ttttggaaccaacagtgcacct

SEQ ID NO: 7042847 - DNA, 22 bp, Homo sapiens
ttttggaagccgcggctgggca

SEQ ID NO: 7042848 - DNA, 22 bp, Homo sapiens
ttttggaatcatttacagagca

SEQ ID NO: 7042849 - DNA, 22 bp, Homo sapiens
ttttggaatctgggaaaacagt

SEQ ID NO: 7042850 - DNA, 22 bp, Homo sapiens
ctgagccaaaaagcagagcttg

SEQ ID NO: 7042851 - DNA, 22 bp, Homo sapiens
ctgaggcctggtgaggtggtga

SEQ ID NO: 7042852 - DNA, 22 bp, Homo sapiens
ctgctgagcatcagggctgccc

SEQ ID NO: 7042853 - DNA, 22 bp, Homo sapiens
ctgcctggggaatgtgaggatt

SEQ ID NO: 7042854 - DNA, 22 bp, Homo sapiens
ctgccttaaaagtacttttact

SEQ ID NO: 7042855 - DNA, 22 bp, Homo sapiens
ctgcctttgaaagttctgttga

SEQ ID NO: 7042856 - DNA, 22 bp, Homo sapiens
ctgcctttgtgatcagttcttt

SEQ ID NO: 7042857 - DNA, 22 bp, Homo sapiens
ctgctctgagaggctcttccta

SEQ ID NO: 7042858 - DNA, 22 bp, Homo sapiens
ctggagcaggtttaggagtccc

SEQ ID NO: 7042859 - DNA, 22 bp, Homo sapiens
ctggagccccaggctgtgcaga

SEQ ID NO: 7042860 - DNA, 22 bp, Homo sapiens
ctggagccctgaatgggcagga

SEQ ID NO: 7042861 - DNA, 22 bp, Homo sapiens
ctggagccgcatggagcaggga

SEQ ID NO: 7042862 - DNA, 22 bp, Homo sapiens
ctggagccggaccagggacggt

SEQ ID NO: 7042863 - DNA, 22 bp, Homo sapiens
ctggagccggaccagggacggt

SEQ ID NO: 7042864 - DNA, 22 bp, Homo sapiens
ctgggctcagtggctcatggct

SEQ ID NO: 7042865 - DNA, 22 bp, Homo sapiens
ctgggctcagtggctcatggct

SEQ ID NO: 7042866 - DNA, 21 bp, Homo sapiens
ctgggctcatggtgttacaga

SEQ ID NO: 7042867 - DNA, 22 bp, Homo sapiens
ctgggctccactcccacagtgt

SEQ ID NO: 7042868 - DNA, 22 bp, Homo sapiens
ctgggctcaaatcctggccctg

SEQ ID NO: 7042869 - DNA, 22 bp, Homo sapiens
ctgggcctcatgcacagagatg

SEQ ID NO: 7042870 - DNA, 22 bp, Homo sapiens
ctgggcctccacgggccatcac

SEQ ID NO: 7042871 - DNA, 22 bp, Homo sapiens
ctgggcctccagctctgccagc

SEQ ID NO: 7042872 - DNA, 22 bp, Homo sapiens
ctgggcctaacccacagcgttt

SEQ ID NO: 7042873 - DNA, 22 bp, Homo sapiens
ctgggcctagaggaagctgaca

SEQ ID NO: 7042874 - DNA, 22 bp, Homo sapiens
ctgggcctagcaacagaggagt

SEQ ID NO: 7042875 - DNA, 22 bp, Homo sapiens
ctgggcctaggatggaagggcc

SEQ ID NO: 7042876 - DNA, 23 bp, Homo sapiens
ctgggcctatggtctgaatccaa

SEQ ID NO: 7042877 - DNA, 22 bp, Homo sapiens
ctgggcctcaagctcagatttc

SEQ ID NO: 7042878 - DNA, 22 bp, Homo sapiens
ctgggcctcaatctcagagttt

SEQ ID NO: 7042879 - DNA, 22 bp, Homo sapiens
ctgggcctcacacccaccaaat

SEQ ID NO: 7042880 - DNA, 22 bp, Homo sapiens
ctgggcctcaccctagaccaat

SEQ ID NO: 7042881 - DNA, 22 bp, Homo sapiens
ctgggcctcatccagccacaac

SEQ ID NO: 7042882 - DNA, 22 bp, Homo sapiens
ctgggcctcatccccagagttt

SEQ ID NO: 7042883 - DNA, 22 bp, Homo sapiens
ctgggcctcatcctcagagttt

SEQ ID NO: 7042884 - DNA, 22 bp, Homo sapiens
ctggagccttcaccaggggaaa

SEQ ID NO: 7042885 - DNA, 22 bp, Homo sapiens
ctggagccttcaccaggggaaa

SEQ ID NO: 7042886 - DNA, 22 bp, Homo sapiens
ctgggctctaagggagcaccgt

SEQ ID NO: 7042887 - DNA, 22 bp, Homo sapiens
ctgggctcctaaccatccaggt

SEQ ID NO: 7042888 - DNA, 22 bp, Homo sapiens
ctgggggccttacggaactcca

SEQ ID NO: 7042889 - DNA, 22 bp, Homo sapiens
ctgggggcaatggtcagagtgt

SEQ ID NO: 7042890 - DNA, 22 bp, Homo sapiens
ctgggggcagcaagaagccatg

SEQ ID NO: 7042891 - DNA, 22 bp, Homo sapiens
ctgggggcagcaagaagccatg

SEQ ID NO: 7042892 - DNA, 22 bp, Homo sapiens
ctggggctggtgaggcaggctc

SEQ ID NO: 7042893 - DNA, 22 bp, Homo sapiens
ctgggtggaaagtgctgagaat

SEQ ID NO: 7042894 - DNA, 22 bp, Homo sapiens
ctgtgacagtttctcagaattt

SEQ ID NO: 7042895 - DNA, 22 bp, Homo sapiens
ctgtgacagtttctcagacttt

SEQ ID NO: 7042896 - DNA, 22 bp, Homo sapiens
ctgtgagggcagggaccagagg

SEQ ID NO: 7042897 - DNA, 22 bp, Homo sapiens
ctgtgggcctagtctggcctag

SEQ ID NO: 7042898 - DNA, 22 bp, Homo sapiens
ctgtggcattgtgaggactgca

SEQ ID NO: 7042899 - DNA, 22 bp, Homo sapiens
ctgtggagttccatcaggggag

SEQ ID NO: 7042900 - DNA, 22 bp, Homo sapiens
ctgtggagtttgtggcgctgac

SEQ ID NO: 7042901 - DNA, 22 bp, Homo sapiens
ctgtggcaggaagggactagca

SEQ ID NO: 7042902 - DNA, 22 bp, Homo sapiens
gaaatgttggacacttgaaatt

SEQ ID NO: 7042903 - DNA, 22 bp, Homo sapiens
gaaattaaccacctttggcttt

SEQ ID NO: 7042904 - DNA, 22 bp, Homo sapiens
gaaattattgctagagactgca

SEQ ID NO: 7042905 - DNA, 22 bp, Homo sapiens
gaaattcaggacaaagactctt

SEQ ID NO: 7042906 - DNA, 22 bp, Homo sapiens
gaacttataattattaagattg

SEQ ID NO: 7042907 - DNA, 22 bp, Homo sapiens
gaagaaattgaattcatgagct

SEQ ID NO: 7042908 - DNA, 22 bp, Homo sapiens
gaagaactaactgaccatgaat

SEQ ID NO: 7042909 - DNA, 22 bp, Homo sapiens
gaagaactgacaaactagatca

SEQ ID NO: 7042910 - DNA, 22 bp, Homo sapiens
gaagaactgtgacagaagcagt

SEQ ID NO: 7042911 - DNA, 22 bp, Homo sapiens
gaagaacttaacataataagga

SEQ ID NO: 7042912 - DNA, 22 bp, Homo sapiens
gaagaacttataggaatgtcat

SEQ ID NO: 7042913 - DNA, 22 bp, Homo sapiens
gaagaactttagggcagaattt

SEQ ID NO: 7042914 - DNA, 22 bp, Homo sapiens
gaaactgtgaggatcttaactt

SEQ ID NO: 7042915 - DNA, 22 bp, Homo sapiens
cttttttaaggtagctcctcct

SEQ ID NO: 7042916 - DNA, 22 bp, Homo sapiens
ctttggaacatactgctgagct

SEQ ID NO: 7042917 - DNA, 22 bp, Homo sapiens
ctttggaactgtaaggagatgg

SEQ ID NO: 7042918 - DNA, 22 bp, Homo sapiens
ctttggaagccaggcagttcac

SEQ ID NO: 7042919 - DNA, 22 bp, Homo sapiens
ctttggaaggaacaggattctc

SEQ ID NO: 7042920 - DNA, 22 bp, Homo sapiens
ctttggaaggaagacctttcag

SEQ ID NO: 7042921 - DNA, 22 bp, Homo sapiens
ctttggaaggcagagctctgtg

SEQ ID NO: 7042922 - DNA, 22 bp, Homo sapiens
ctttggaaggtcgtccgtgtgg

SEQ ID NO: 7042923 - DNA, 22 bp, Homo sapiens
ctttggaagtaaagtcagcagg

SEQ ID NO: 7042924 - DNA, 22 bp, Homo sapiens
ctttggaagtgaccacaatcct

SEQ ID NO: 7042925 - DNA, 22 bp, Homo sapiens
ctttggaagtgatagatatgat

SEQ ID NO: 7042926 - DNA, 22 bp, Homo sapiens
ctttggaataaaattagttgtt

SEQ ID NO: 7042927 - DNA, 22 bp, Homo sapiens
ctttggaataatcaagctctga

SEQ ID NO: 7042928 - DNA, 22 bp, Homo sapiens
ctttggaataatttcctggagt

SEQ ID NO: 7042929 - DNA, 22 bp, Homo sapiens
ctttggaatattttattgagaa

SEQ ID NO: 7042930 - DNA, 22 bp, Homo sapiens
ctttggaatcattgcttattca

SEQ ID NO: 7042931 - DNA, 22 bp, Homo sapiens
ctttggaatgcacagaggtgta

SEQ ID NO: 7042932 - DNA, 20 bp, Homo sapiens
ctttggcaatgagaacaggg

SEQ ID NO: 7042933 - DNA, 22 bp, Homo sapiens
ctttttctaatcataattgtct

SEQ ID NO: 7042934 - DNA, 22 bp, Homo sapiens
ctttttgcaagagtttctcatc

SEQ ID NO: 7042935 - DNA, 22 bp, Homo sapiens
cttctgtgaagagcagaaccat

SEQ ID NO: 7042936 - DNA, 22 bp, Homo sapiens
cttcttcaagagaatgggagac

SEQ ID NO: 7042937 - DNA, 22 bp, Homo sapiens
cttccagggtccaggaagagcc

SEQ ID NO: 7042938 - DNA, 22 bp, Homo sapiens
cttcactgtttggttcacagca

SEQ ID NO: 7042939 - DNA, 22 bp, Homo sapiens
ctgttaaaatgtggtcttaaaa

SEQ ID NO: 7042940 - DNA, 22 bp, Homo sapiens
cttcaaatgtgattttaataac

SEQ ID NO: 7042941 - DNA, 16 bp, Homo sapiens
cttcacagaggagagt

SEQ ID NO: 7042942 - DNA, 23 bp, Homo sapiens
cttcacaggttcaggggattaag

SEQ ID NO: 7042943 - DNA, 22 bp, Homo sapiens
cttggaaaggttttacaaagcg

SEQ ID NO: 7042944 - DNA, 22 bp, Homo sapiens
ctttccttaataagcaggtata

SEQ ID NO: 7042945 - DNA, 22 bp, Homo sapiens
ctttccttctcgtggttctcac

SEQ ID NO: 7042946 - DNA, 22 bp, Homo sapiens
ctttctcagtgttaattacttt

SEQ ID NO: 7042947 - DNA, 22 bp, Homo sapiens
ctttctctgtggtgaggagggt

SEQ ID NO: 7042948 - DNA, 22 bp, Homo sapiens
ctttctctgtgtggtaaagggc

SEQ ID NO: 7042949 - DNA, 22 bp, Homo sapiens
ctttctcttacccaaggatctg

SEQ ID NO: 7042950 - DNA, 22 bp, Homo sapiens
ctttggaacaagaagaaatggc

SEQ ID NO: 7042951 - DNA, 22 bp, Homo sapiens
ctttggaacacatgggcatggt

SEQ ID NO: 7042952 - DNA, 22 bp, Homo sapiens
ctttggaacacccagctctgtg

SEQ ID NO: 7042953 - DNA, 22 bp, Homo sapiens
gagctcagggcattgagcaaga

SEQ ID NO: 7042954 - DNA, 22 bp, Homo sapiens
gagctcagtgtagtcatggctt

SEQ ID NO: 7042955 - DNA, 22 bp, Homo sapiens
gagctcagattctggtgtcaga

SEQ ID NO: 7042956 - DNA, 22 bp, Homo sapiens
gagctcagcaaaggtctgtgtg

SEQ ID NO: 7042957 - DNA, 22 bp, Homo sapiens
gagctcagcccaaagagcagtg

SEQ ID NO: 7042958 - DNA, 22 bp, Homo sapiens
gagctcagcctgaggcctggct

SEQ ID NO: 7042959 - DNA, 22 bp, Homo sapiens
gagctcagactcgggcctgggg

SEQ ID NO: 7042960 - DNA, 22 bp, Homo sapiens
gagctcagaggattctggggag

SEQ ID NO: 7042961 - DNA, 22 bp, Homo sapiens
gaggagtctagtttatggcttc

SEQ ID NO: 7042962 - DNA, 20 bp, Homo sapiens
gaggagtcttgtagaaaatg

SEQ ID NO: 7042963 - DNA, 22 bp, Homo sapiens
gaggagtctttccctaagtcct

SEQ ID NO: 7042964 - DNA, 22 bp, Homo sapiens
gaggagtctttttagggcctga

SEQ ID NO: 7042965 - DNA, 22 bp, Homo sapiens
gaggagtgccagccgtggagtc

SEQ ID NO: 7042966 - DNA, 22 bp, Homo sapiens
gaggacctggaatccaagagtc

SEQ ID NO: 7042967 - DNA, 22 bp, Homo sapiens
gaggtgggagggcagtccctaa

SEQ ID NO: 7042968 - DNA, 22 bp, Homo sapiens
gagggtggcctttagagcccat

SEQ ID NO: 7042969 - DNA, 22 bp, Homo sapiens
gagggctgataacaggaataca

SEQ ID NO: 7042970 - DNA, 22 bp, Homo sapiens
gagggccaggtagatatcagga

SEQ ID NO: 7042971 - DNA, 22 bp, Homo sapiens
gagggccaggcggagacaggcg

SEQ ID NO: 7042972 - DNA, 22 bp, Homo sapiens
gagggccagcctgccaagggcc

SEQ ID NO: 7042973 - DNA, 22 bp, Homo sapiens
gagggccagatcccaggaggaa

SEQ ID NO: 7042974 - DNA, 22 bp, Homo sapiens
gagggccagcagcctcagcatg

SEQ ID NO: 7042975 - DNA, 22 bp, Homo sapiens
gagggctgaagtgttttatgag

SEQ ID NO: 7042976 - DNA, 22 bp, Homo sapiens
gagggctgataaatgcgcatgg

SEQ ID NO: 7042977 - DNA, 22 bp, Homo sapiens
gagggccagaaagttattgaga

SEQ ID NO: 7042978 - DNA, 22 bp, Homo sapiens
gagggccacgttcagggctctc

SEQ ID NO: 7042979 - DNA, 22 bp, Homo sapiens
gagggaatagttggaactgagt

SEQ ID NO: 7042980 - DNA, 22 bp, Homo sapiens
gaggctcaaacctggacagagc

SEQ ID NO: 7042981 - DNA, 22 bp, Homo sapiens
gaggctcaacccacaggggttg

SEQ ID NO: 7042982 - DNA, 22 bp, Homo sapiens
gaggctatgaggagtgaggttt

SEQ ID NO: 7042983 - DNA, 22 bp, Homo sapiens
gagcaggaactgaaaatgagac

SEQ ID NO: 7042984 - DNA, 22 bp, Homo sapiens
gagcaggaaggccagaagggtc

SEQ ID NO: 7042985 - DNA, 22 bp, Homo sapiens
gagcaacttcaatagtactatt

SEQ ID NO: 7042986 - DNA, 22 bp, Homo sapiens
gagcaaaataaattctgacaaa

SEQ ID NO: 7042987 - DNA, 22 bp, Homo sapiens
gagcaaacaaaactgatgtgac

SEQ ID NO: 7042988 - DNA, 22 bp, Homo sapiens
gagcaaacatcagtgatgtctg

SEQ ID NO: 7042989 - DNA, 23 bp, Homo sapiens
gagcaaacccgtctatgccctcc

SEQ ID NO: 7042990 - DNA, 15 bp, Homo sapiens
gagcaaacattaatc

SEQ ID NO: 7042991 - DNA, 22 bp, Homo sapiens
gagatttttcaacaagaatagg

SEQ ID NO: 7042992 - DNA, 22 bp, Homo sapiens
gagaggagtaggctgatggtgc

SEQ ID NO: 7042993 - DNA, 22 bp, Homo sapiens
gagaggaggtggctatgacagc

SEQ ID NO: 7042994 - DNA, 22 bp, Homo sapiens
gagaggagtagacactttggtt

SEQ ID NO: 7042995 - DNA, 22 bp, Homo sapiens
gagaggagacttatccagattg

SEQ ID NO: 7042996 - DNA, 18 bp, Homo sapiens
gagaggagccagaatttt

SEQ ID NO: 7042997 - DNA, 22 bp, Homo sapiens
gagagacccagacaccatgcat

SEQ ID NO: 7042998 - DNA, 22 bp, Homo sapiens
gagagaccttgctaagtgcctt

SEQ ID NO: 7042999 - DNA, 22 bp, Homo sapiens
gagagccagctcactccagggc

SEQ ID NO: 7043000 - DNA, 22 bp, Homo sapiens
gagagaagggggatatgagcct

SEQ ID NO: 7043001 - DNA, 22 bp, Homo sapiens
gaattttgcttttatgtcaagt

SEQ ID NO: 7043002 - DNA, 22 bp, Homo sapiens
gcccctggctggccagctcctc

SEQ ID NO: 7043003 - DNA, 22 bp, Homo sapiens
gccctgctctggtctctgcccg

SEQ ID NO: 7043004 - DNA, 22 bp, Homo sapiens
gcctggagacctgctcctctac

SEQ ID NO: 7043005 - DNA, 22 bp, Homo sapiens
gcagttaaaaataaaccttcat

SEQ ID NO: 7043006 - DNA, 22 bp, Homo sapiens
gcaggtggaagcagcagactca

SEQ ID NO: 7043007 - DNA, 22 bp, Homo sapiens
gcagttttagagctttaagatg

SEQ ID NO: 7043008 - DNA, 22 bp, Homo sapiens
gcagttttagtggatctggggc

SEQ ID NO: 7043009 - DNA, 22 bp, Homo sapiens
gcagttttattatgatggaaat

SEQ ID NO: 7043010 - DNA, 18 bp, Homo sapiens
gcattctgttaatgtgga

SEQ ID NO: 7043011 - DNA, 21 bp, Homo sapiens
gcattcttcatgtgattcaga

SEQ ID NO: 7043012 - DNA, 22 bp, Homo sapiens
gcattcttcgaagtaagtagtg

SEQ ID NO: 7043013 - DNA, 22 bp, Homo sapiens
gcattcttggtggagtgctaaa

SEQ ID NO: 7043014 - DNA, 22 bp, Homo sapiens
gcattctttagactgagagata

SEQ ID NO: 7043015 - DNA, 22 bp, Homo sapiens
gcattgcaaaaagcagcttgat

SEQ ID NO: 7043016 - DNA, 22 bp, Homo sapiens
gcattgcaactgacagatcatt

SEQ ID NO: 7043017 - DNA, 22 bp, Homo sapiens
gcattgcaggtgtacccagtta

SEQ ID NO: 7043018 - DNA, 22 bp, Homo sapiens
gccacttctgcctggcagggcc

SEQ ID NO: 7043019 - DNA, 22 bp, Homo sapiens
gccagaaggggtggatccaggc

SEQ ID NO: 7043020 - DNA, 22 bp, Homo sapiens
gccagcttggccagtggccagt

SEQ ID NO: 7043021 - DNA, 22 bp, Homo sapiens
gccagctttggcacagggtggt

SEQ ID NO: 7043022 - DNA, 22 bp, Homo sapiens
gcccaagctccgcctcctgtcg

SEQ ID NO: 7043023 - DNA, 19 bp, Homo sapiens
gcagggtggcagagctctt

SEQ ID NO: 7043024 - DNA, 22 bp, Homo sapiens
gcaggccagctgtgcagatggg

SEQ ID NO: 7043025 - DNA, 22 bp, Homo sapiens
gcaggccaggctaggggctgtc

SEQ ID NO: 7043026 - DNA, 22 bp, Homo sapiens
gcagcccaaaaaagaggtagat

SEQ ID NO: 7043027 - DNA, 22 bp, Homo sapiens
gcagaggtgctcagtggcagaa

SEQ ID NO: 7043028 - DNA, 22 bp, Homo sapiens
gcagagtgggagcccagggctg

SEQ ID NO: 7043029 - DNA, 22 bp, Homo sapiens
gagtagaactggttatctaata

SEQ ID NO: 7043030 - DNA, 22 bp, Homo sapiens
ggagccagtatttagtggtctt

SEQ ID NO: 7043031 - DNA, 18 bp, Homo sapiens
ggagccagtctgtctctg

SEQ ID NO: 7043032 - DNA, 22 bp, Homo sapiens
ggagccaggcatatcggggcac

SEQ ID NO: 7043033 - DNA, 22 bp, Homo sapiens
ggagaaagggactgatctgctc

SEQ ID NO: 7043034 - DNA, 22 bp, Homo sapiens
ggacaggggcgtggggattgtt

SEQ ID NO: 7043035 - DNA, 22 bp, Homo sapiens
ggagaaagaaatttttgattgg

SEQ ID NO: 7043036 - DNA, 22 bp, Homo sapiens
ggacaggatgctgaagatgaag

SEQ ID NO: 7043037 - DNA, 22 bp, Homo sapiens
ggaaaaacagtctttattattt

SEQ ID NO: 7043038 - DNA, 22 bp, Homo sapiens
gctttatgggccatgcggtgtc

SEQ ID NO: 7043039 - DNA, 22 bp, Homo sapiens
gctttatgtaagtccaaaggca

SEQ ID NO: 7043040 - DNA, 22 bp, Homo sapiens
gctttatgagtgaggcaggata

SEQ ID NO: 7043041 - DNA, 22 bp, Homo sapiens
gctttatgcaaacctggtactt

SEQ ID NO: 7043042 - DNA, 22 bp, Homo sapiens
gctttatgctacgatttctagt

SEQ ID NO: 7043043 - DNA, 22 bp, Homo sapiens
gctttatggattgtaaactgca

SEQ ID NO: 7043044 - DNA, 22 bp, Homo sapiens
gctttgggtgtcctctgggcct

SEQ ID NO: 7043045 - DNA, 23 bp, Homo sapiens
gcttttaaacctgtgactgccgc

SEQ ID NO: 7043046 - DNA, 22 bp, Homo sapiens
gcttttaattagttgcttccat

SEQ ID NO: 7043047 - DNA, 22 bp, Homo sapiens
gcttttctataagaactttcaa

SEQ ID NO: 7043048 - DNA, 18 bp, Homo sapiens
gctttttagtgcatcttc

SEQ ID NO: 7043049 - DNA, 22 bp, Homo sapiens
gctgtttagtggcagagtcaga

SEQ ID NO: 7043050 - DNA, 22 bp, Homo sapiens
gctgtttcctacatggtgttat

SEQ ID NO: 7043051 - DNA, 22 bp, Homo sapiens
gctgtttcggcctcctggggaa

SEQ ID NO: 7043052 - DNA, 21 bp, Homo sapiens
gctgcagggcccagggcaccc

SEQ ID NO: 7043053 - DNA, 22 bp, Homo sapiens
gctgcagggctctcacaggggg

SEQ ID NO: 7043054 - DNA, 22 bp, Homo sapiens
gctgcagggagctggaaggctc

SEQ ID NO: 7043055 - DNA, 22 bp, Homo sapiens
gctgcaggctgtggcaggggag

SEQ ID NO: 7043056 - DNA, 20 bp, Homo sapiens
gctgaggggtctatggcata

SEQ ID NO: 7043057 - DNA, 22 bp, Homo sapiens
gctgagtgaggtccagagcttg

SEQ ID NO: 7043058 - DNA, 22 bp, Homo sapiens
gctgcaggcagaatctcccaat

SEQ ID NO: 7043059 - DNA, 18 bp, Homo sapiens
gctgcaggcgcctgcggt

SEQ ID NO: 7043060 - DNA, 22 bp, Homo sapiens
gcctggagtggtcctgctgccc

SEQ ID NO: 7043061 - DNA, 20 bp, Homo sapiens
gcctggagttagttttcctt

SEQ ID NO: 7043062 - DNA, 22 bp, Homo sapiens
gctagggactagggaaggagca

SEQ ID NO: 7043063 - DNA, 22 bp, Homo sapiens
gctcagggagagagggcagccg

SEQ ID NO: 7043064 - DNA, 22 bp, Homo sapiens
gctcagggccatggaccagcag

SEQ ID NO: 7043065 - DNA, 22 bp, Homo sapiens
gctcagtgtttctggtagaaaa

SEQ ID NO: 7043066 - DNA, 22 bp, Homo sapiens
gctcatattcaactatcttcac

SEQ ID NO: 7043067 - DNA, 23 bp, Homo sapiens
gctcatcaggcttagagtcaagg

SEQ ID NO: 7043068 - DNA, 22 bp, Homo sapiens
gctctggggttggaaagtgatc

SEQ ID NO: 7043069 - DNA, 22 bp, Homo sapiens
ggaggaggggtttacattggaa

SEQ ID NO: 7043070 - DNA, 22 bp, Homo sapiens
ggaggagtgtggggcactctgc

SEQ ID NO: 7043071 - DNA, 22 bp, Homo sapiens
ggaggatgagctacgaggagct

SEQ ID NO: 7043072 - DNA, 22 bp, Homo sapiens
ggcagcaagtggtgggagactt

SEQ ID NO: 7043073 - DNA, 22 bp, Homo sapiens
ggcaggggtcctggtgttgact

SEQ ID NO: 7043074 - DNA, 22 bp, Homo sapiens
ggcagggccctgattcctgggg

SEQ ID NO: 7043075 - DNA, 22 bp, Homo sapiens
ggcagtggaggaccctgtgtct

SEQ ID NO: 7043076 - DNA, 22 bp, Homo sapiens
ggcctctgcttatgctgatgac

SEQ ID NO: 7043077 - DNA, 22 bp, Homo sapiens
ggcctctgaggacagccttggc

SEQ ID NO: 7043078 - DNA, 22 bp, Homo sapiens
ggcctctgcaactggctgtggc

SEQ ID NO: 7043079 - DNA, 22 bp, Homo sapiens
ggctctgcagagggcccagctt

SEQ ID NO: 7043080 - DNA, 22 bp, Homo sapiens
ggcagtggctcctctctactcc

SEQ ID NO: 7043081 - DNA, 22 bp, Homo sapiens
ggcagtgggaaataagtgagaa

SEQ ID NO: 7043082 - DNA, 22 bp, Homo sapiens
ggccagcagacctcagggactc

SEQ ID NO: 7043083 - DNA, 21 bp, Homo sapiens
ggccagcagcgtccactgtgg

SEQ ID NO: 7043084 - DNA, 22 bp, Homo sapiens
ggccagcagtatatagctaatt

SEQ ID NO: 7043085 - DNA, 22 bp, Homo sapiens
ggccagcagtcacagggtcaga

SEQ ID NO: 7043086 - DNA, 22 bp, Homo sapiens
ggccagctggatgtgggtgacg

SEQ ID NO: 7043087 - DNA, 22 bp, Homo sapiens
ggcccagctctattgaattaca

SEQ ID NO: 7043088 - DNA, 22 bp, Homo sapiens
ggcccagctgggcggggacacg

SEQ ID NO: 7043089 - DNA, 22 bp, Homo sapiens
ggcccagctgtatattacagtt

SEQ ID NO: 7043090 - DNA, 22 bp, Homo sapiens
ggcccagctgtgcttccagccc

SEQ ID NO: 7043091 - DNA, 22 bp, Homo sapiens
ggcccagctttcattccttgct

SEQ ID NO: 7043092 - DNA, 22 bp, Homo sapiens
ggcccaggctggagtgcagtgg

SEQ ID NO: 7043093 - DNA, 22 bp, Homo sapiens
gggcctcaaatctcccgcttat

SEQ ID NO: 7043094 - DNA, 19 bp, Homo sapiens
gggcctcacccacacctcc

SEQ ID NO: 7043095 - DNA, 22 bp, Homo sapiens
gggcctcacctctccaccgcct

SEQ ID NO: 7043096 - DNA, 22 bp, Homo sapiens
gggcctcactatgtggtccagg

SEQ ID NO: 7043097 - DNA, 22 bp, Homo sapiens
gggcctcagagatggtcagtga

SEQ ID NO: 7043098 - DNA, 22 bp, Homo sapiens
gggctaggtctgatcagagaag

SEQ ID NO: 7043099 - DNA, 18 bp, Homo sapiens
gggctcacacaggtcatc

SEQ ID NO: 7043100 - DNA, 22 bp, Homo sapiens
gggctcactcatgcaactgcag

SEQ ID NO: 7043101 - DNA, 22 bp, Homo sapiens
gggcccagtaccctctgccaag

SEQ ID NO: 7043102 - DNA, 22 bp, Homo sapiens
gggctcagttctgcttcatgct

SEQ ID NO: 7043103 - DNA, 22 bp, Homo sapiens
gggctcatcaagcctctccgcc

SEQ ID NO: 7043104 - DNA, 22 bp, Homo sapiens
gggctcatgatgtaggctggta

SEQ ID NO: 7043105 - DNA, 22 bp, Homo sapiens
gggctcatggacagctctccag

SEQ ID NO: 7043106 - DNA, 22 bp, Homo sapiens
gggctcattgggcgctttctaa

SEQ ID NO: 7043107 - DNA, 22 bp, Homo sapiens
gggctccaaaatcctgtagcct

SEQ ID NO: 7043108 - DNA, 22 bp, Homo sapiens
gggctccaacggtgagcatgga

SEQ ID NO: 7043109 - DNA, 22 bp, Homo sapiens
gggctccaaggaggccagcctg

SEQ ID NO: 7043110 - DNA, 22 bp, Homo sapiens
gggctctggaaggtgcaccatg

SEQ ID NO: 7043111 - DNA, 17 bp, Homo sapiens
gggcagggactcctggg

SEQ ID NO: 7043112 - DNA, 22 bp, Homo sapiens
gggagctgaagtaggggtaaat

SEQ ID NO: 7043113 - DNA, 22 bp, Homo sapiens
gggagccacagtgaggtgcatg

SEQ ID NO: 7043114 - DNA, 22 bp, Homo sapiens
ggctgtggtcattaggaggttg

SEQ ID NO: 7043115 - DNA, 22 bp, Homo sapiens
ggctgtggtctcatctagcctt

SEQ ID NO: 7043116 - DNA, 22 bp, Homo sapiens
ggctgtggggccgggtacagtg

SEQ ID NO: 7043117 - DNA, 22 bp, Homo sapiens
ggctgtggggggagcctgcccg

SEQ ID NO: 7043118 - DNA, 22 bp, Homo sapiens
ggctgtgggatgcataggagct

SEQ ID NO: 7043119 - DNA, 22 bp, Homo sapiens
ggctgtggcagctggaagtggt

SEQ ID NO: 7043120 - DNA, 22 bp, Homo sapiens
ggctgtggcagctggaagtggt

SEQ ID NO: 7043121 - DNA, 22 bp, Homo sapiens
ggctgtgctttgcccaaagggc

SEQ ID NO: 7043122 - DNA, 22 bp, Homo sapiens
ggctgcagggcagctggtgtgg

SEQ ID NO: 7043123 - DNA, 21 bp, Homo sapiens
ggctgcagggagccctggggt

SEQ ID NO: 7043124 - DNA, 22 bp, Homo sapiens
ggctctgcggcgtgtgcgcagg

SEQ ID NO: 7043125 - DNA, 22 bp, Homo sapiens
ggctgcaggcttccctccagca

SEQ ID NO: 7043126 - DNA, 22 bp, Homo sapiens
ggctgcaggttggttggcagct

SEQ ID NO: 7043127 - DNA, 17 bp, Homo sapiens
ggctgcagtccaggagg

SEQ ID NO: 7043128 - DNA, 17 bp, Homo sapiens
ggctgcagtccaggagg

SEQ ID NO: 7043129 - DNA, 20 bp, Homo sapiens
ggctgcagtgcacctcatct

SEQ ID NO: 7043130 - DNA, 22 bp, Homo sapiens
ggctgcagttgtgtgaaggccg

SEQ ID NO: 7043131 - DNA, 22 bp, Homo sapiens
ggctgcagtttgtcttttgctt

SEQ ID NO: 7043132 - DNA, 22 bp, Homo sapiens
ggtgagaggcctgagagctgga

SEQ ID NO: 7043133 - DNA, 22 bp, Homo sapiens
ggtgagggagtggaacgaggtg

SEQ ID NO: 7043134 - DNA, 22 bp, Homo sapiens
ggtccccgtggaggctggagcg

SEQ ID NO: 7043135 - DNA, 22 bp, Homo sapiens
ggtgggcgactgagaggggttt

SEQ ID NO: 7043136 - DNA, 22 bp, Homo sapiens
ggtggggcctgctccagcggcc

SEQ ID NO: 7043137 - DNA, 22 bp, Homo sapiens
ggtgggtggaaacagcatgtac

SEQ ID NO: 7043138 - DNA, 22 bp, Homo sapiens
ggtggtggagccagctgggagt

SEQ ID NO: 7043139 - DNA, 22 bp, Homo sapiens
ggttatttctgattatatgata

SEQ ID NO: 7043140 - DNA, 19 bp, Homo sapiens
ggttatttgagggttaaga

SEQ ID NO: 7043141 - DNA, 19 bp, Homo sapiens
ggttatttgagggttaaga

SEQ ID NO: 7043142 - DNA, 23 bp, Homo sapiens
ggttatttgcatcctgtaattat

SEQ ID NO: 7043143 - DNA, 22 bp, Homo sapiens
ggttattttggttgtctaaggc

SEQ ID NO: 7043144 - DNA, 22 bp, Homo sapiens
ggttatttttgattctgtggat

SEQ ID NO: 7043145 - DNA, 20 bp, Homo sapiens
gggtgaggatggagaatttg

SEQ ID NO: 7043146 - DNA, 21 bp, Homo sapiens
gggtggggttccagccttttc

SEQ ID NO: 7043147 - DNA, 22 bp, Homo sapiens
ggggtgggcgtgcagggacacc

SEQ ID NO: 7043148 - DNA, 22 bp, Homo sapiens
ggggtgggagtgccatccttga

SEQ ID NO: 7043149 - DNA, 22 bp, Homo sapiens
ggggtgggagtgccatccttga

SEQ ID NO: 7043150 - DNA, 22 bp, Homo sapiens
ggggccagcactgtgcctttgt

SEQ ID NO: 7043151 - DNA, 22 bp, Homo sapiens
ggggccagcttcgcgtgctctt

SEQ ID NO: 7043152 - DNA, 22 bp, Homo sapiens
ggggccaggtccagcttccaaa

SEQ ID NO: 7043153 - DNA, 22 bp, Homo sapiens
ggggccagtaggagtgatgtac

SEQ ID NO: 7043154 - DNA, 22 bp, Homo sapiens
ggggccagatatcactaaggtt

SEQ ID NO: 7043155 - DNA, 22 bp, Homo sapiens
ggggccagagaggacccaggtg

SEQ ID NO: 7043156 - DNA, 20 bp, Homo sapiens
ggggcaggtttttatggcta

SEQ ID NO: 7043157 - DNA, 22 bp, Homo sapiens
ggggcatcagaaccctgtggga

SEQ ID NO: 7043158 - DNA, 22 bp, Homo sapiens
ggggatggaatgtagtagtgat

SEQ ID NO: 7043159 - DNA, 22 bp, Homo sapiens
ggggagtgacgcagggccatag

SEQ ID NO: 7043160 - DNA, 22 bp, Homo sapiens
ggggaggacctttccaaggctt

SEQ ID NO: 7043161 - DNA, 22 bp, Homo sapiens
gggctgtgtgcagtacgggtcc

SEQ ID NO: 7043162 - DNA, 16 bp, Homo sapiens
gggctgggggattctg

SEQ ID NO: 7043163 - DNA, 19 bp, Homo sapiens
gggctctggcctcagtggg

SEQ ID NO: 7043164 - DNA, 22 bp, Homo sapiens
gggctctgggattcagagcaag

SEQ ID NO: 7043165 - DNA, 22 bp, Homo sapiens
gtatttttagtagagtcggggt

SEQ ID NO: 7043166 - DNA, 22 bp, Homo sapiens
gtatttttcagttaggagctta

SEQ ID NO: 7043167 - DNA, 22 bp, Homo sapiens
gtatttttcattccaagtgaga

SEQ ID NO: 7043168 - DNA, 22 bp, Homo sapiens
gtatttttcattccaagtgaga

SEQ ID NO: 7043169 - DNA, 22 bp, Homo sapiens
gtagttctgcagtgtcacctga

SEQ ID NO: 7043170 - DNA, 22 bp, Homo sapiens
gtataactgctaccacctgatg

SEQ ID NO: 7043171 - DNA, 22 bp, Homo sapiens
gtatacaatacacaatgctctg

SEQ ID NO: 7043172 - DNA, 22 bp, Homo sapiens
gtattttatggcctggggccta

SEQ ID NO: 7043173 - DNA, 22 bp, Homo sapiens
gtatttttaggtaaggaaagta

SEQ ID NO: 7043174 - DNA, 22 bp, Homo sapiens
gtatttttaggtaaggaaagta

SEQ ID NO: 7043175 - DNA, 22 bp, Homo sapiens
gtacaataactagtcttatagt

SEQ ID NO: 7043176 - DNA, 22 bp, Homo sapiens
gtaggtgagtgggagaagaggc

SEQ ID NO: 7043177 - DNA, 22 bp, Homo sapiens
gtacaaaagttattgcggtttt

SEQ ID NO: 7043178 - DNA, 22 bp, Homo sapiens
gtacaaaggcagaattgggtag

SEQ ID NO: 7043179 - DNA, 22 bp, Homo sapiens
gtacaaagtggacctgatagta

SEQ ID NO: 7043180 - DNA, 22 bp, Homo sapiens
gtacaacatgattttactctct

SEQ ID NO: 7043181 - DNA, 22 bp, Homo sapiens
gtccagagaagtcattacttca

SEQ ID NO: 7043182 - DNA, 22 bp, Homo sapiens
gtccagctccagggaggcaggc

SEQ ID NO: 7043183 - DNA, 22 bp, Homo sapiens
gtcctctggcctttcccaggac

SEQ ID NO: 7043184 - DNA, 22 bp, Homo sapiens
gtcctctgtccctggggcacgg

SEQ ID NO: 7043185 - DNA, 20 bp, Homo sapiens
gtgccaggcaagacaggtgg

SEQ ID NO: 7043186 - DNA, 22 bp, Homo sapiens
gtgccagggagtggaggagctt

SEQ ID NO: 7043187 - DNA, 22 bp, Homo sapiens
gtgccagtctctgagttaggac

SEQ ID NO: 7043188 - DNA, 22 bp, Homo sapiens
gtctaattcctgctcttactca

SEQ ID NO: 7043189 - DNA, 22 bp, Homo sapiens
gtcttggatatgtttgccttca

SEQ ID NO: 7043190 - DNA, 21 bp, Homo sapiens
gtctttctacctctatgtggc

SEQ ID NO: 7043191 - DNA, 22 bp, Homo sapiens
gtcttttgctagccagagagct

SEQ ID NO: 7043192 - DNA, 21 bp, Homo sapiens
gtctttttaattgcgatttcc

SEQ ID NO: 7043193 - DNA, 22 bp, Homo sapiens
gtctttttattatagagtggag

SEQ ID NO: 7043194 - DNA, 22 bp, Homo sapiens
gtctttttctacgatagcgcct

SEQ ID NO: 7043195 - DNA, 22 bp, Homo sapiens
gtctttttgtctggcagaggtc

SEQ ID NO: 7043196 - DNA, 22 bp, Homo sapiens
gtctttttgtctggcagaggtc

SEQ ID NO: 7043197 - DNA, 22 bp, Homo sapiens
gtcttttttacaccttacatca

SEQ ID NO: 7043198 - DNA, 22 bp, Homo sapiens
gtcttttttacaccttacatca

SEQ ID NO: 7043199 - DNA, 22 bp, Homo sapiens
gtgagcttctgacagatgcacc

SEQ ID NO: 7043200 - DNA, 22 bp, Homo sapiens
gtgagcttctgcctctcagtcc

SEQ ID NO: 7043201 - DNA, 22 bp, Homo sapiens
gtgaggagggctggtcccaggc

SEQ ID NO: 7043202 - DNA, 22 bp, Homo sapiens
taggccattcttggagcttact

SEQ ID NO: 7043203 - DNA, 22 bp, Homo sapiens
tagggctgcagaacaatggcct

SEQ ID NO: 7043204 - DNA, 22 bp, Homo sapiens
tagggctgcctatggctagata

SEQ ID NO: 7043205 - DNA, 22 bp, Homo sapiens
tagggctgctgcagatgacagg

SEQ ID NO: 7043206 - DNA, 22 bp, Homo sapiens
tagggctgctttgtattctgct

SEQ ID NO: 7043207 - DNA, 22 bp, Homo sapiens
tagggctggcgtgctcagggaa

SEQ ID NO: 7043208 - DNA, 22 bp, Homo sapiens
tagggctgggtacactcttgcc

SEQ ID NO: 7043209 - DNA, 22 bp, Homo sapiens
tagggctgtggtcagtcctcta

SEQ ID NO: 7043210 - DNA, 22 bp, Homo sapiens
taggggcagaagcggcggtcca

SEQ ID NO: 7043211 - DNA, 22 bp, Homo sapiens
taggggcaggatcctttgagcc

SEQ ID NO: 7043212 - DNA, 23 bp, Homo sapiens
taggggctggcgtggagcctgcg

SEQ ID NO: 7043213 - DNA, 21 bp, Homo sapiens
taggggctggggctccagctg

SEQ ID NO: 7043214 - DNA, 22 bp, Homo sapiens
tagtctctatgagtgaatcaca

SEQ ID NO: 7043215 - DNA, 19 bp, Homo sapiens
tagtctctgatgaggcttt

SEQ ID NO: 7043216 - DNA, 22 bp, Homo sapiens
tagtctctgctttgcccttggc

SEQ ID NO: 7043217 - DNA, 22 bp, Homo sapiens
tagtctctggagactctagggg

SEQ ID NO: 7043218 - DNA, 22 bp, Homo sapiens
tagtctctgtggtcctgaggaa

SEQ ID NO: 7043219 - DNA, 22 bp, Homo sapiens
tagtctctgttcccacaatgcc

SEQ ID NO: 7043220 - DNA, 22 bp, Homo sapiens
tagtctctgttgctgctttcat

SEQ ID NO: 7043221 - DNA, 22 bp, Homo sapiens
tagtctcttatcaggcacacac

SEQ ID NO: 7043222 - DNA, 22 bp, Homo sapiens
tagttacaaaccaacaggcagc

SEQ ID NO: 7043223 - DNA, 22 bp, Homo sapiens
tagttacaatgggttctgtgac

SEQ ID NO: 7043224 - DNA, 22 bp, Homo sapiens
tagttacaattatgcatggaaa

SEQ ID NO: 7043225 - DNA, 22 bp, Homo sapiens
tagttacataaagtggactgtt

SEQ ID NO: 7043226 - DNA, 22 bp, Homo sapiens
tagttttataatgttaacatct

SEQ ID NO: 7043227 - DNA, 22 bp, Homo sapiens
tagttttatgaattggtataat

SEQ ID NO: 7043228 - DNA, 22 bp, Homo sapiens
tagtttttaagtgtacaatttc

SEQ ID NO: 7043229 - DNA, 22 bp, Homo sapiens
tagtttttaagtgtacaatttc

SEQ ID NO: 7043230 - DNA, 22 bp, Homo sapiens
tagtttttactgcgagttataa

SEQ ID NO: 7043231 - DNA, 22 bp, Homo sapiens
tagttttttcaacaaatggtgc

SEQ ID NO: 7043232 - DNA, 22 bp, Homo sapiens
tagatcttgttacagatttcct

SEQ ID NO: 7043233 - DNA, 21 bp, Homo sapiens
tagatgaaatcagagtatttc

SEQ ID NO: 7043234 - DNA, 22 bp, Homo sapiens
tagatgaaatgtgtgttattat

SEQ ID NO: 7043235 - DNA, 22 bp, Homo sapiens
tagatgaatgacttatatgtca

SEQ ID NO: 7043236 - DNA, 22 bp, Homo sapiens
tagcaaaagctcaacaggaagg

SEQ ID NO: 7043237 - DNA, 22 bp, Homo sapiens
tagcaaactaatacaggctcaa

SEQ ID NO: 7043238 - DNA, 22 bp, Homo sapiens
tagcaaactaccacaaactggg

SEQ ID NO: 7043239 - DNA, 22 bp, Homo sapiens
tagcaaactcatacatgtgggt

SEQ ID NO: 7043240 - DNA, 22 bp, Homo sapiens
tagcaaagagaaaaattatgct

SEQ ID NO: 7043241 - DNA, 22 bp, Homo sapiens
tagcaaataaaacagtattgaa

SEQ ID NO: 7043242 - DNA, 22 bp, Homo sapiens
tagcaaatacatgatgtaattt

SEQ ID NO: 7043243 - DNA, 22 bp, Homo sapiens
tagcaaatgggcttgttttcca

SEQ ID NO: 7043244 - DNA, 22 bp, Homo sapiens
tagcaaatgtgttatgctatgc

SEQ ID NO: 7043245 - DNA, 22 bp, Homo sapiens
tagaacttagcactagacttgt

SEQ ID NO: 7043246 - DNA, 22 bp, Homo sapiens
tagacaggaaacattaggatgg

SEQ ID NO: 7043247 - DNA, 22 bp, Homo sapiens
tagacaggagtcaggctagaat

SEQ ID NO: 7043248 - DNA, 22 bp, Homo sapiens
tagagaatggccttgaagtagt

SEQ ID NO: 7043249 - DNA, 22 bp, Homo sapiens
tagagaattgtagcctgcaaga

SEQ ID NO: 7043250 - DNA, 22 bp, Homo sapiens
tagagtatagctaactgtatta

SEQ ID NO: 7043251 - DNA, 22 bp, Homo sapiens
tagatacatacattttaaaatg

SEQ ID NO: 7043252 - DNA, 21 bp, Homo sapiens
tagatactgtattaaacctag

SEQ ID NO: 7043253 - DNA, 22 bp, Homo sapiens
tagatataaggtccttagaaca

SEQ ID NO: 7043254 - DNA, 22 bp, Homo sapiens
tagatataggacagtactgtat

SEQ ID NO: 7043255 - DNA, 19 bp, Homo sapiens
tatgacaagtactagttct

SEQ ID NO: 7043256 - DNA, 22 bp, Homo sapiens
tatggaacgctagaggaagaaa

SEQ ID NO: 7043257 - DNA, 22 bp, Homo sapiens
tatgtattctcagatttactaa

SEQ ID NO: 7043258 - DNA, 22 bp, Homo sapiens
tatgtcatgtcttagagaatga

SEQ ID NO: 7043259 - DNA, 22 bp, Homo sapiens
tatgtttcctgagcttacacca

SEQ ID NO: 7043260 - DNA, 22 bp, Homo sapiens
tatgtttctgggcttgatattt

SEQ ID NO: 7043261 - DNA, 22 bp, Homo sapiens
tatgtttcttccttttcataca

SEQ ID NO: 7043262 - DNA, 22 bp, Homo sapiens
tattaacacgtataaagtgttt

SEQ ID NO: 7043263 - DNA, 22 bp, Homo sapiens
tatcagaaatgccttaaattgg

SEQ ID NO: 7043264 - DNA, 18 bp, Homo sapiens
tataaacacacttaggtt

SEQ ID NO: 7043265 - DNA, 22 bp, Homo sapiens
tatcacaggtgtgatttacatt

SEQ ID NO: 7043266 - DNA, 22 bp, Homo sapiens
tatccaaagtggcatattatag

SEQ ID NO: 7043267 - DNA, 23 bp, Homo sapiens
tatctttttcaatgttggaaata

SEQ ID NO: 7043268 - DNA, 22 bp, Homo sapiens
tatgaaaatttagctgaagcat

SEQ ID NO: 7043269 - DNA, 22 bp, Homo sapiens
tattacaaattataatgggaga

SEQ ID NO: 7043270 - DNA, 22 bp, Homo sapiens
tattacaagaaagggcatgaat

SEQ ID NO: 7043271 - DNA, 23 bp, Homo sapiens
tattacaattggtcttattaaga

SEQ ID NO: 7043272 - DNA, 22 bp, Homo sapiens
tattacaatttacattgcactt

SEQ ID NO: 7043273 - DNA, 22 bp, Homo sapiens
tattacaatttacattgcactt

SEQ ID NO: 7043274 - DNA, 22 bp, Homo sapiens
tattgtattaaggattcaagta

SEQ ID NO: 7043275 - DNA, 20 bp, Homo sapiens
tattgtgataggtgttaatc

SEQ ID NO: 7043276 - DNA, 22 bp, Homo sapiens
tatttaaaaagaggccagctgg

SEQ ID NO: 7043277 - DNA, 22 bp, Homo sapiens
tatttaaaataagccccagtgg

SEQ ID NO: 7043278 - DNA, 22 bp, Homo sapiens
tatttaaaatagtgctccagca

SEQ ID NO: 7043279 - DNA, 22 bp, Homo sapiens
tatttaaaatagtgctccagca

SEQ ID NO: 7043280 - DNA, 22 bp, Homo sapiens
tatttgcaaagaactacactag

SEQ ID NO: 7043281 - DNA, 22 bp, Homo sapiens
tatttggaaacaattcacatgc

SEQ ID NO: 7043282 - DNA, 22 bp, Homo sapiens
tatttggaatagcttgctaatg

SEQ ID NO: 7043283 - DNA, 22 bp, Homo sapiens
tattttgaaagtctgttttgaa

SEQ ID NO: 7043284 - DNA, 22 bp, Homo sapiens
tattttgactattaaaccaaca

SEQ ID NO: 7043285 - DNA, 22 bp, Homo sapiens
tattttgagcccctgacatcta

SEQ ID NO: 7043286 - DNA, 22 bp, Homo sapiens
tattttgagcccctgacatcta

SEQ ID NO: 7043287 - DNA, 22 bp, Homo sapiens
tattttgaggtatttttgagct

SEQ ID NO: 7043288 - DNA, 22 bp, Homo sapiens
tattttgcgttgagtcagattt

SEQ ID NO: 7043289 - DNA, 22 bp, Homo sapiens
tattttgtatttatgcaagaaa

SEQ ID NO: 7043290 - DNA, 22 bp, Homo sapiens
tattttgttttgtatccactgt

SEQ ID NO: 7043291 - DNA, 22 bp, Homo sapiens
tcaaaaataagatattctggac

SEQ ID NO: 7043292 - DNA, 22 bp, Homo sapiens
tcaaaaatggtctttgagctgc

SEQ ID NO: 7043293 - DNA, 22 bp, Homo sapiens
tcaaataatgccattcatcatc

SEQ ID NO: 7043294 - DNA, 22 bp, Homo sapiens
tcaaataccagcaatttcatgt

SEQ ID NO: 7043295 - DNA, 22 bp, Homo sapiens
tcaaataccagcaatttcatgt

SEQ ID NO: 7043296 - DNA, 22 bp, Homo sapiens
tcaaataggcttgtagtgactg

SEQ ID NO: 7043297 - DNA, 22 bp, Homo sapiens
tcaaatatgtgatagaagctaa

SEQ ID NO: 7043298 - DNA, 22 bp, Homo sapiens
tcaaatattggctatttcacat

SEQ ID NO: 7043299 - DNA, 22 bp, Homo sapiens
taccacagacagatttcagtaa

SEQ ID NO: 7043300 - DNA, 22 bp, Homo sapiens
taccacagcaaatgaggccaac

SEQ ID NO: 7043301 - DNA, 22 bp, Homo sapiens
taccacaggccaaatttgaggt

SEQ ID NO: 7043302 - DNA, 22 bp, Homo sapiens
tactagaatgccactgttagtg

SEQ ID NO: 7043303 - DNA, 22 bp, Homo sapiens
taccaaagattaaatagcaaca

SEQ ID NO: 7043304 - DNA, 22 bp, Homo sapiens
tacatgaagaaaattaagcagt

SEQ ID NO: 7043305 - DNA, 22 bp, Homo sapiens
tacagtggaaaactcagtgtgt

SEQ ID NO: 7043306 - DNA, 22 bp, Homo sapiens
tacagtggggagctcaggagag

SEQ ID NO: 7043307 - DNA, 22 bp, Homo sapiens
tacagtatttgaagaatatgag

SEQ ID NO: 7043308 - DNA, 22 bp, Homo sapiens
taagcattaactctgctgcaag

SEQ ID NO: 7043309 - DNA, 22 bp, Homo sapiens
taagccccctcaccctggcttc

SEQ ID NO: 7043310 - DNA, 22 bp, Homo sapiens
taatagtttcataatgtgcttc

SEQ ID NO: 7043311 - DNA, 22 bp, Homo sapiens
taatataccaaactgtaatttt

SEQ ID NO: 7043312 - DNA, 22 bp, Homo sapiens
taatatacttcccatagtttga

SEQ ID NO: 7043313 - DNA, 22 bp, Homo sapiens
taatatacttcccatagtttga

SEQ ID NO: 7043314 - DNA, 22 bp, Homo sapiens
taatatatacctttgttaggaa

SEQ ID NO: 7043315 - DNA, 22 bp, Homo sapiens
taatatatacctttgttaggaa

SEQ ID NO: 7043316 - DNA, 21 bp, Homo sapiens
taattccagaggtcactgaag

SEQ ID NO: 7043317 - DNA, 22 bp, Homo sapiens
taattcttcaggccttttgtct

SEQ ID NO: 7043318 - DNA, 22 bp, Homo sapiens
taattcttcaggccttttgtct

SEQ ID NO: 7043319 - DNA, 22 bp, Homo sapiens
taattgaaatcatttcaattca

SEQ ID NO: 7043320 - DNA, 22 bp, Homo sapiens
taatttatagaatttcttggat

SEQ ID NO: 7043321 - DNA, 22 bp, Homo sapiens
taatttatatggaattgttgct

SEQ ID NO: 7043322 - DNA, 22 bp, Homo sapiens
taatttatgatgcaaagaaaag

SEQ ID NO: 7043323 - DNA, 22 bp, Homo sapiens
taatttatggtatgtgtgtaat

SEQ ID NO: 7043324 - DNA, 21 bp, Homo sapiens
taatttattcagcacagtgtt

SEQ ID NO: 7043325 - DNA, 22 bp, Homo sapiens
taatttatttcaactgccaagg

SEQ ID NO: 7043326 - DNA, 22 bp, Homo sapiens
tacacatacattgcttacaagg

SEQ ID NO: 7043327 - DNA, 22 bp, Homo sapiens
gtgttcatcccaatgctgatag

SEQ ID NO: 7043328 - DNA, 22 bp, Homo sapiens
gtgtttaataggtagctgaatc

SEQ ID NO: 7043329 - DNA, 22 bp, Homo sapiens
gtgtttatgtttgtgtagggga

SEQ ID NO: 7043330 - DNA, 22 bp, Homo sapiens
gtgtttctggggcattcatagt

SEQ ID NO: 7043331 - DNA, 22 bp, Homo sapiens
gtgtttcttgcactccccggac

SEQ ID NO: 7043332 - DNA, 22 bp, Homo sapiens
gttatattggcagaagagaaga

SEQ ID NO: 7043333 - DNA, 22 bp, Homo sapiens
gttatttaactttgtagcatgg

SEQ ID NO: 7043334 - DNA, 22 bp, Homo sapiens
gttatttataaggtgtaactcc

SEQ ID NO: 7043335 - DNA, 22 bp, Homo sapiens
gttattttaacttctcagtaat

SEQ ID NO: 7043336 - DNA, 21 bp, Homo sapiens
gttcttcctgactagagtagt

SEQ ID NO: 7043337 - DNA, 19 bp, Homo sapiens
gttcttttcacctctgtgc

SEQ ID NO: 7043338 - DNA, 19 bp, Homo sapiens
gttcttttcacctctgtgc

SEQ ID NO: 7043339 - DNA, 23 bp, Homo sapiens
gttgaagtggtcggggaggcaga

SEQ ID NO: 7043340 - DNA, 22 bp, Homo sapiens
gttgaagtttatatgagtgctt

SEQ ID NO: 7043341 - DNA, 22 bp, Homo sapiens
gtttatattcaacggagtatct

SEQ ID NO: 7043342 - DNA, 22 bp, Homo sapiens
gtttatgaatgtgtcagacata

SEQ ID NO: 7043343 - DNA, 22 bp, Homo sapiens
gtttatgaatgttactatagag

SEQ ID NO: 7043344 - DNA, 22 bp, Homo sapiens
gtttatgaggaaaagttatgat

SEQ ID NO: 7043345 - DNA, 22 bp, Homo sapiens
gtttcaatttcactttccaggc

SEQ ID NO: 7043346 - DNA, 22 bp, Homo sapiens
gtttcaatttgaatgcgaggct

SEQ ID NO: 7043347 - DNA, 22 bp, Homo sapiens
gtttcttagacatatgccatga

SEQ ID NO: 7043348 - DNA, 22 bp, Homo sapiens
gtttcttaggtaaattctttga

SEQ ID NO: 7043349 - DNA, 22 bp, Homo sapiens
gtttcttatttcaactggaaca

SEQ ID NO: 7043350 - DNA, 22 bp, Homo sapiens
gtttcttttgtgatcaccaacc

SEQ ID NO: 7043351 - DNA, 22 bp, Homo sapiens
gtttgtcaggaggttgaagtca

SEQ ID NO: 7043352 - DNA, 22 bp, Homo sapiens
gtttgtcatttgtacttctagc

SEQ ID NO: 7043353 - DNA, 22 bp, Homo sapiens
gtttgtttatacaaaagatcct

SEQ ID NO: 7043354 - DNA, 21 bp, Homo sapiens
gttttaagggagaaaacctag

SEQ ID NO: 7043355 - DNA, 22 bp, Homo sapiens
taaaacttctcatttttatggt

SEQ ID NO: 7043356 - DNA, 22 bp, Homo sapiens
taaatgcaagggaaaggcaaga

SEQ ID NO: 7043357 - DNA, 22 bp, Homo sapiens
taaatgcaatgtgctttaccag

SEQ ID NO: 7043358 - DNA, 22 bp, Homo sapiens
taaatgcagcagtttctgttct

SEQ ID NO: 7043359 - DNA, 22 bp, Homo sapiens
taaatgtggagactcaggagtc

SEQ ID NO: 7043360 - DNA, 22 bp, Homo sapiens
taaatgtttagtcttatttggg

SEQ ID NO: 7043361 - DNA, 20 bp, Homo sapiens
taacagttgaagaacaagga

SEQ ID NO: 7043362 - DNA, 22 bp, Homo sapiens
taagacatgtccaggctgtgag

SEQ ID NO: 7043363 - DNA, 22 bp, Homo sapiens
taagagacttaagaataattga

SEQ ID NO: 7043364 - DNA, 22 bp, Homo sapiens
taagaggatatttggccagaag

SEQ ID NO: 7043365 - DNA, 22 bp, Homo sapiens
tcctgcagctgaagctcatgtg

SEQ ID NO: 7043366 - DNA, 22 bp, Homo sapiens
tcctgcagagccgccctcaggt

SEQ ID NO: 7043367 - DNA, 22 bp, Homo sapiens
tcctctggggcgtggtcctgga

SEQ ID NO: 7043368 - DNA, 22 bp, Homo sapiens
tcctctggggtcagggcactac

SEQ ID NO: 7043369 - DNA, 22 bp, Homo sapiens
tcctctggtcttcggtgtggac

SEQ ID NO: 7043370 - DNA, 22 bp, Homo sapiens
tcccagcctggaccctgccagt

SEQ ID NO: 7043371 - DNA, 22 bp, Homo sapiens
tccatgggtagccctggttgag

SEQ ID NO: 7043372 - DNA, 22 bp, Homo sapiens
tccatgtgaccttgagctgctt

SEQ ID NO: 7043373 - DNA, 22 bp, Homo sapiens
tccatgggaagattttgagtgg

SEQ ID NO: 7043374 - DNA, 22 bp, Homo sapiens
tccatggggcccaggatgagag

SEQ ID NO: 7043375 - DNA, 19 bp, Homo sapiens
tccatgtgtttcagacctg

SEQ ID NO: 7043376 - DNA, 22 bp, Homo sapiens
tccatgtgttttcctgtccaca

SEQ ID NO: 7043377 - DNA, 19 bp, Homo sapiens
tccattaagctcagagctc

SEQ ID NO: 7043378 - DNA, 22 bp, Homo sapiens
tccattatacttctgattcaaa

SEQ ID NO: 7043379 - DNA, 22 bp, Homo sapiens
tccattctacaaggtagcaggg

SEQ ID NO: 7043380 - DNA, 22 bp, Homo sapiens
tccattctatgcttacatttat

SEQ ID NO: 7043381 - DNA, 22 bp, Homo sapiens
tccagggaagagcagaggctac

SEQ ID NO: 7043382 - DNA, 22 bp, Homo sapiens
tccagggaaggtgtgaggctgg

SEQ ID NO: 7043383 - DNA, 21 bp, Homo sapiens
tccagggaatttcaactttta

SEQ ID NO: 7043384 - DNA, 21 bp, Homo sapiens
tccagggaacttctcaggaat

SEQ ID NO: 7043385 - DNA, 18 bp, Homo sapiens
tccaggcctgaagtgtcc

SEQ ID NO: 7043386 - DNA, 22 bp, Homo sapiens
tccaggcctgcctggtgtttgc

SEQ ID NO: 7043387 - DNA, 22 bp, Homo sapiens
tccaggccttgacaggtcagtt

SEQ ID NO: 7043388 - DNA, 22 bp, Homo sapiens
tccctgggaacaaaggatgaga

SEQ ID NO: 7043389 - DNA, 22 bp, Homo sapiens
tccctgggaccggcagctcaca

SEQ ID NO: 7043390 - DNA, 22 bp, Homo sapiens
tccctgggagatgatgatgagg

SEQ ID NO: 7043391 - DNA, 22 bp, Homo sapiens
tccctgggcaagtttactcttc

SEQ ID NO: 7043392 - DNA, 22 bp, Homo sapiens
tcataaattgattatgtgcttt

SEQ ID NO: 7043393 - DNA, 22 bp, Homo sapiens
tcataaattagctgtctttgaa

SEQ ID NO: 7043394 - DNA, 22 bp, Homo sapiens
tcatctcttttgtattggggtt

SEQ ID NO: 7043395 - DNA, 22 bp, Homo sapiens
tcatctgttatgggagtttttg

SEQ ID NO: 7043396 - DNA, 22 bp, Homo sapiens
tcatgaaaaattttccatgtca

SEQ ID NO: 7043397 - DNA, 22 bp, Homo sapiens
tcatgaaaatagatcagaaatt

SEQ ID NO: 7043398 - DNA, 22 bp, Homo sapiens
tcagtgtttttaaagcaatata

SEQ ID NO: 7043399 - DNA, 22 bp, Homo sapiens
tcagtgttttaactgtctttta

SEQ ID NO: 7043400 - DNA, 22 bp, Homo sapiens
tcagtgtttgtggcaaatgtta

SEQ ID NO: 7043401 - DNA, 22 bp, Homo sapiens
tcagtgtttcagtttggaaatg

SEQ ID NO: 7043402 - DNA, 22 bp, Homo sapiens
tcagtgtttaccgtatgttgtt

SEQ ID NO: 7043403 - DNA, 22 bp, Homo sapiens
tcagtgttgtgcacatacaaaa

SEQ ID NO: 7043404 - DNA, 22 bp, Homo sapiens
tcagtgttggtcaagaatcagt

SEQ ID NO: 7043405 - DNA, 22 bp, Homo sapiens
tcagtgttggcattcagaaatg

SEQ ID NO: 7043406 - DNA, 22 bp, Homo sapiens
tcagtgttgaattttttgcaaa

SEQ ID NO: 7043407 - DNA, 22 bp, Homo sapiens
tcagtgttcttatttaattagg

SEQ ID NO: 7043408 - DNA, 22 bp, Homo sapiens
tcaggagacttatgtcacagtg

SEQ ID NO: 7043409 - DNA, 22 bp, Homo sapiens
tcaggagagaaagaatacaatt

SEQ ID NO: 7043410 - DNA, 22 bp, Homo sapiens
tcaggagagagaaattggggct

SEQ ID NO: 7043411 - DNA, 22 bp, Homo sapiens
tcaggagagagttgggtaggct

SEQ ID NO: 7043412 - DNA, 21 bp, Homo sapiens
tcaggagagcccatctacaaa

SEQ ID NO: 7043413 - DNA, 22 bp, Homo sapiens
tcagggcaggacagtgtaggcc

SEQ ID NO: 7043414 - DNA, 22 bp, Homo sapiens
tcagggcaggcgagcagctgct

SEQ ID NO: 7043415 - DNA, 21 bp, Homo sapiens
tcagggcagtgggaggttcct

SEQ ID NO: 7043416 - DNA, 23 bp, Homo sapiens
tcagggctcacacgttttctggc

SEQ ID NO: 7043417 - DNA, 22 bp, Homo sapiens
tcagggctcaccagcctctgcc

SEQ ID NO: 7043418 - DNA, 22 bp, Homo sapiens
tcagggctcagtgggataggtc

SEQ ID NO: 7043419 - DNA, 22 bp, Homo sapiens
tcagggctcagcatctggcatt

SEQ ID NO: 7043420 - DNA, 22 bp, Homo sapiens
tcagggctccggaagtggcctc

SEQ ID NO: 7043421 - DNA, 22 bp, Homo sapiens
tcagggctgactgctactctcc

SEQ ID NO: 7043422 - DNA, 22 bp, Homo sapiens
tcagggctgcagaagaggcagg

SEQ ID NO: 7043423 - DNA, 22 bp, Homo sapiens
tcagggctgcatacaggagata

SEQ ID NO: 7043424 - DNA, 22 bp, Homo sapiens
tcagtatagctaaaagtttgtc

SEQ ID NO: 7043425 - DNA, 19 bp, Homo sapiens
tcagtatataattacacca

SEQ ID NO: 7043426 - DNA, 19 bp, Homo sapiens
tcatttacggttttgatga

SEQ ID NO: 7043427 - DNA, 22 bp, Homo sapiens
tcatttcagccatttttaaatg

SEQ ID NO: 7043428 - DNA, 22 bp, Homo sapiens
tcatttcagccatttttaaatg

SEQ ID NO: 7043429 - DNA, 22 bp, Homo sapiens
tcatttctattgctactgtctg

SEQ ID NO: 7043430 - DNA, 22 bp, Homo sapiens
tcatttctcctaagtgaaatat

SEQ ID NO: 7043431 - DNA, 21 bp, Homo sapiens
tcatttctctatgtatttcac

SEQ ID NO: 7043432 - DNA, 21 bp, Homo sapiens
tcatttctctatgtatttcac

SEQ ID NO: 7043433 - DNA, 22 bp, Homo sapiens
tccaaaaaacgtttgaatagtt

SEQ ID NO: 7043434 - DNA, 22 bp, Homo sapiens
tccaaatattatgattatagga

SEQ ID NO: 7043435 - DNA, 22 bp, Homo sapiens
tccaagggaaactgcacttcta

SEQ ID NO: 7043436 - DNA, 22 bp, Homo sapiens
tccaagggaatgtgggcaatgc

SEQ ID NO: 7043437 - DNA, 22 bp, Homo sapiens
tccaagggaatttaaagttgct

SEQ ID NO: 7043438 - DNA, 22 bp, Homo sapiens
tccaagggcaacaatggaacac

SEQ ID NO: 7043439 - DNA, 20 bp, Homo sapiens
tccaagggcagcagaatcag

SEQ ID NO: 7043440 - DNA, 22 bp, Homo sapiens
tccaagggcagcagccatagcc

SEQ ID NO: 7043441 - DNA, 22 bp, Homo sapiens
tccaagggcagccatagaactt

SEQ ID NO: 7043442 - DNA, 22 bp, Homo sapiens
tccaagggcatgctgaaataag

SEQ ID NO: 7043443 - DNA, 23 bp, Homo sapiens
tccaagggctacaaacacagacc

SEQ ID NO: 7043444 - DNA, 23 bp, Homo sapiens
tccaagggctacaaacacagacc

SEQ ID NO: 7043445 - DNA, 22 bp, Homo sapiens
tccaagggctcatggacacttt

SEQ ID NO: 7043446 - DNA, 22 bp, Homo sapiens
tccaagggctcatggacacttt

SEQ ID NO: 7043447 - DNA, 22 bp, Homo sapiens
tccaagggctttggcgtgaagt

SEQ ID NO: 7043448 - DNA, 22 bp, Homo sapiens
tccaagggctttggcgtgaagt

SEQ ID NO: 7043449 - DNA, 22 bp, Homo sapiens
tccaaggggaaaggcgccggcg

SEQ ID NO: 7043450 - DNA, 22 bp, Homo sapiens
tccaagggttcatgtgcattca

SEQ ID NO: 7043451 - DNA, 22 bp, Homo sapiens
tccaagttgatgtttcttaaat

SEQ ID NO: 7043452 - DNA, 22 bp, Homo sapiens
tccaatatttctcatatatgga

SEQ ID NO: 7043453 - DNA, 22 bp, Homo sapiens
tccaatctagtatgataaatga

SEQ ID NO: 7043454 - DNA, 22 bp, Homo sapiens
tcaggagaaaatatcaggaagt

SEQ ID NO: 7043455 - DNA, 22 bp, Homo sapiens
tcaggagaaagccaattagagt

SEQ ID NO: 7043456 - DNA, 22 bp, Homo sapiens
tcaggagaacttccttctaccc

SEQ ID NO: 7043457 - DNA, 22 bp, Homo sapiens
tcaggagaaggcaatgtggaaa

SEQ ID NO: 7043458 - DNA, 22 bp, Homo sapiens
tcaggagaatcagggctgtcct

SEQ ID NO: 7043459 - DNA, 22 bp, Homo sapiens
tcaggagacaaagggtgcggag

SEQ ID NO: 7043460 - DNA, 18 bp, Homo sapiens
tcaggagacacagacgca

SEQ ID NO: 7043461 - DNA, 22 bp, Homo sapiens
tcaggagacattcttaaagtag

SEQ ID NO: 7043462 - DNA, 22 bp, Homo sapiens
tcaggagactggcagtgcccac

SEQ ID NO: 7043463 - DNA, 22 bp, Homo sapiens
tcagatttcctgttgaagaagt

SEQ ID NO: 7043464 - DNA, 22 bp, Homo sapiens
tcaacagacatttttaagcact

SEQ ID NO: 7043465 - DNA, 22 bp, Homo sapiens
tcaagaactggaaattgatatg

SEQ ID NO: 7043466 - DNA, 22 bp, Homo sapiens
tcaagaactgtgaagagtctga

SEQ ID NO: 7043467 - DNA, 22 bp, Homo sapiens
tcacagtttcttttctgataaa

SEQ ID NO: 7043468 - DNA, 22 bp, Homo sapiens
tcacagttttagctgttaaata

SEQ ID NO: 7043469 - DNA, 22 bp, Homo sapiens
tcacatttatttcaaagttact

SEQ ID NO: 7043470 - DNA, 22 bp, Homo sapiens
ttccttggaaagagacgtcgct

SEQ ID NO: 7043471 - DNA, 22 bp, Homo sapiens
ttccttggaaattctgacttca

SEQ ID NO: 7043472 - DNA, 22 bp, Homo sapiens
ttccttggaagggtaattgcaa

SEQ ID NO: 7043473 - DNA, 22 bp, Homo sapiens
ttccttggagcgctaaagctct

SEQ ID NO: 7043474 - DNA, 22 bp, Homo sapiens
ttccttggagtcaaacagggag

SEQ ID NO: 7043475 - DNA, 22 bp, Homo sapiens
ttccttggagttaagaccctgg

SEQ ID NO: 7043476 - DNA, 22 bp, Homo sapiens
ttccttggatacaagtaacttt

SEQ ID NO: 7043477 - DNA, 20 bp, Homo sapiens
ttccttggattgtgtcttga

SEQ ID NO: 7043478 - DNA, 22 bp, Homo sapiens
ttccttggccacactggtgctt

SEQ ID NO: 7043479 - DNA, 22 bp, Homo sapiens
ttccttggccccatgcccaggg

SEQ ID NO: 7043480 - DNA, 22 bp, Homo sapiens
ttctctgcctctagctatattc

SEQ ID NO: 7043481 - DNA, 22 bp, Homo sapiens
ttctctgagtacgtttcagtgt

SEQ ID NO: 7043482 - DNA, 22 bp, Homo sapiens
ttctctaagccttagtttcttc

SEQ ID NO: 7043483 - DNA, 22 bp, Homo sapiens
ttctctatcttgaatgcgtcaa

SEQ ID NO: 7043484 - DNA, 22 bp, Homo sapiens
ttccttggtgtaactgctccta

SEQ ID NO: 7043485 - DNA, 22 bp, Homo sapiens
ttccttgggaaatgctcgttta

SEQ ID NO: 7043486 - DNA, 22 bp, Homo sapiens
ttccttgggagaaaaaatatat

SEQ ID NO: 7043487 - DNA, 22 bp, Homo sapiens
ttccttgggtgcctacttagag

SEQ ID NO: 7043488 - DNA, 17 bp, Homo sapiens
ttccttgggtgctgggt

SEQ ID NO: 7043489 - DNA, 22 bp, Homo sapiens
ttccttgggttctgatgtgttt

SEQ ID NO: 7043490 - DNA, 18 bp, Homo sapiens
ttccttggtaacatatgc

SEQ ID NO: 7043491 - DNA, 22 bp, Homo sapiens
ttccttggtacagagtagcttt

SEQ ID NO: 7043492 - DNA, 22 bp, Homo sapiens
ttccttggtagagagaatattt

SEQ ID NO: 7043493 - DNA, 22 bp, Homo sapiens
ttccttggtagggacaactctg

SEQ ID NO: 7043494 - DNA, 22 bp, Homo sapiens
ttccttggtgcccgatgtattt

SEQ ID NO: 7043495 - DNA, 22 bp, Homo sapiens
ttccttggtgcgcctgctgcag

SEQ ID NO: 7043496 - DNA, 22 bp, Homo sapiens
ttctggaagttggaaatagcag

SEQ ID NO: 7043497 - DNA, 22 bp, Homo sapiens
ttctggaatcctcaaaacatga

SEQ ID NO: 7043498 - DNA, 22 bp, Homo sapiens
ttctggaatgcctgttctaatt

SEQ ID NO: 7043499 - DNA, 22 bp, Homo sapiens
ttctgtaagctaccaagtttgt

SEQ ID NO: 7043500 - DNA, 22 bp, Homo sapiens
ttctgtaagctaccaagtttgt

SEQ ID NO: 7043501 - DNA, 19 bp, Homo sapiens
ttctgtaaggacattaatc

SEQ ID NO: 7043502 - DNA, 19 bp, Homo sapiens
ttctgtaagggagagaggg

SEQ ID NO: 7043503 - DNA, 22 bp, Homo sapiens
ttctgtaagggatttattctga

SEQ ID NO: 7043504 - DNA, 22 bp, Homo sapiens
ttctgtaattctgttagtttca

SEQ ID NO: 7043505 - DNA, 22 bp, Homo sapiens
ttctgtcttctcggttgtttac

SEQ ID NO: 7043506 - DNA, 22 bp, Homo sapiens
ttcttataagttaatatttcca

SEQ ID NO: 7043507 - DNA, 22 bp, Homo sapiens
ttcttatagaagcaaccattgt

SEQ ID NO: 7043508 - DNA, 21 bp, Homo sapiens
ttcttcaaagaagaaggcaca

SEQ ID NO: 7043509 - DNA, 22 bp, Homo sapiens
ttcttcaagggtaaaggcaacg

SEQ ID NO: 7043510 - DNA, 22 bp, Homo sapiens
ttctttgtaacctttgggaact

SEQ ID NO: 7043511 - DNA, 22 bp, Homo sapiens
ttctttgtaacctttgggaact

SEQ ID NO: 7043512 - DNA, 22 bp, Homo sapiens
ttcttttaatgtctggctttca

SEQ ID NO: 7043513 - DNA, 22 bp, Homo sapiens
ttcttttaattgtgggggagtg

SEQ ID NO: 7043514 - DNA, 20 bp, Homo sapiens
ttcttttgataagcttgaca

SEQ ID NO: 7043515 - DNA, 22 bp, Homo sapiens
ttctttttaaagtgtgtatgca

SEQ ID NO: 7043516 - DNA, 22 bp, Homo sapiens
ttgaagaaagtcatatataatg

SEQ ID NO: 7043517 - DNA, 22 bp, Homo sapiens
ttgaagaaattattttatatag

SEQ ID NO: 7043518 - DNA, 22 bp, Homo sapiens
ttccaggggcagcagtgatggt

SEQ ID NO: 7043519 - DNA, 22 bp, Homo sapiens
ttcagtttcaaatcctggatgc

SEQ ID NO: 7043520 - DNA, 22 bp, Homo sapiens
ttcagtttcaaatcctgtgaag

SEQ ID NO: 7043521 - DNA, 22 bp, Homo sapiens
ttcagtttgtttgactgttaga

SEQ ID NO: 7043522 - DNA, 22 bp, Homo sapiens
ttcagttttattgtactgctat

SEQ ID NO: 7043523 - DNA, 22 bp, Homo sapiens
ttcagttttccctcctgcaggt

SEQ ID NO: 7043524 - DNA, 22 bp, Homo sapiens
ttcagttttctttagaatgtag

SEQ ID NO: 7043525 - DNA, 22 bp, Homo sapiens
ttcagttttgcttttaatcatg

SEQ ID NO: 7043526 - DNA, 22 bp, Homo sapiens
ttcataaacaaattaaggcctg

SEQ ID NO: 7043527 - DNA, 21 bp, Homo sapiens
ttcataaaccattctcatgca

SEQ ID NO: 7043528 - DNA, 19 bp, Homo sapiens
ttcataacttttatatcct

SEQ ID NO: 7043529 - DNA, 22 bp, Homo sapiens
ttcataatcaccaaaaactgga

SEQ ID NO: 7043530 - DNA, 22 bp, Homo sapiens
ttcattgtactttaagagatgc

SEQ ID NO: 7043531 - DNA, 22 bp, Homo sapiens
ttcagcaacctataaatcccag

SEQ ID NO: 7043532 - DNA, 22 bp, Homo sapiens
ttcagcaagaccaccatgtacc

SEQ ID NO: 7043533 - DNA, 22 bp, Homo sapiens
ttcagtgtgaagcttctgaaag

SEQ ID NO: 7043534 - DNA, 19 bp, Homo sapiens
ttcagtgtgctggctcctg

SEQ ID NO: 7043535 - DNA, 22 bp, Homo sapiens
ttcacagatgagaaaattgagg

SEQ ID NO: 7043536 - DNA, 22 bp, Homo sapiens
ttatagaaggagcattcactta

SEQ ID NO: 7043537 - DNA, 22 bp, Homo sapiens
ttatagcagcatgatttataat

SEQ ID NO: 7043538 - DNA, 22 bp, Homo sapiens
ttatagcagcatgatttatagt

SEQ ID NO: 7043539 - DNA, 19 bp, Homo sapiens
ttatatacttggtttctct

SEQ ID NO: 7043540 - DNA, 22 bp, Homo sapiens
ttatatgagtatcatatcactt

SEQ ID NO: 7043541 - DNA, 22 bp, Homo sapiens
ttattaatcttatctttggaaa

SEQ ID NO: 7043542 - DNA, 22 bp, Homo sapiens
ttattacactgaaagaattgcg

SEQ ID NO: 7043543 - DNA, 22 bp, Homo sapiens
ttattataatgagggataaaaa

SEQ ID NO: 7043544 - DNA, 22 bp, Homo sapiens
ttattatagattatgcaagatt

SEQ ID NO: 7043545 - DNA, 22 bp, Homo sapiens
ttattctttaaacatatatgtt

SEQ ID NO: 7043546 - DNA, 22 bp, Homo sapiens
ttattcttttctccagaatccc

SEQ ID NO: 7043547 - DNA, 22 bp, Homo sapiens
ttcaaacagtgtagaatatatg

SEQ ID NO: 7043548 - DNA, 22 bp, Homo sapiens
tttcatgatccatttacaaaat

SEQ ID NO: 7043549 - DNA, 22 bp, Homo sapiens
tttcatgaggtctttcagcaag

SEQ ID NO: 7043550 - DNA, 22 bp, Homo sapiens
tttcatgtaatcatttaggtgg

SEQ ID NO: 7043551 - DNA, 22 bp, Homo sapiens
tttcatgtacttttttgataga

SEQ ID NO: 7043552 - DNA, 22 bp, Homo sapiens
tttcatgtacttttttgataga

SEQ ID NO: 7043553 - DNA, 22 bp, Homo sapiens
tttcatgtctgaattctttagt

SEQ ID NO: 7043554 - DNA, 22 bp, Homo sapiens
tttcatgtgcaattagcaatat

SEQ ID NO: 7043555 - DNA, 22 bp, Homo sapiens
tttcatgttacagtgtaaaagt

SEQ ID NO: 7043556 - DNA, 22 bp, Homo sapiens
tttcattatacagcttcataaa

SEQ ID NO: 7043557 - DNA, 22 bp, Homo sapiens
tttcattcagcaccctgaggtg

SEQ ID NO: 7043558 - DNA, 22 bp, Homo sapiens
tttcattgagactatagacatc

SEQ ID NO: 7043559 - DNA, 18 bp, Homo sapiens
tttcacagattcatgact

SEQ ID NO: 7043560 - DNA, 22 bp, Homo sapiens
tttcacagcaacactgtctgca

SEQ ID NO: 7043561 - DNA, 22 bp, Homo sapiens
tttcacagcgtctttctcttgc

SEQ ID NO: 7043562 - DNA, 22 bp, Homo sapiens
tttcacctcagtctttttatat

SEQ ID NO: 7043563 - DNA, 22 bp, Homo sapiens
tttcactggaattttaacattt

SEQ ID NO: 7043564 - DNA, 22 bp, Homo sapiens
tttcagaaaacttatcatcagt

SEQ ID NO: 7043565 - DNA, 22 bp, Homo sapiens
tttcagaaagctgaacatatga

SEQ ID NO: 7043566 - DNA, 22 bp, Homo sapiens
tttattctagctcagaatagtt

SEQ ID NO: 7043567 - DNA, 22 bp, Homo sapiens
tttattctataggcattaagca

SEQ ID NO: 7043568 - DNA, 22 bp, Homo sapiens
tttattctgtgctacatgaaga

SEQ ID NO: 7043569 - DNA, 22 bp, Homo sapiens
tttattgaacacttgcactggc

SEQ ID NO: 7043570 - DNA, 22 bp, Homo sapiens
tttcaaagtaaggattttcatc

SEQ ID NO: 7043571 - DNA, 23 bp, Homo sapiens
tttcaactcctgccattatttct

SEQ ID NO: 7043572 - DNA, 22 bp, Homo sapiens
tttcaagaagcaaattaaagtc

SEQ ID NO: 7043573 - DNA, 22 bp, Homo sapiens
tttcacagagaaatataacagg

SEQ ID NO: 7043574 - DNA, 22 bp, Homo sapiens
tttatattgggagtcgttttga

SEQ ID NO: 7043575 - DNA, 22 bp, Homo sapiens
tttatattgtaaaaatggttct

SEQ ID NO: 7043576 - DNA, 22 bp, Homo sapiens
tttatatttcccaggattggcc

SEQ ID NO: 7043577 - DNA, 22 bp, Homo sapiens
tttatatagagatttgtgcatg

SEQ ID NO: 7043578 - DNA, 22 bp, Homo sapiens
tttagcaagttctctgagagaa

SEQ ID NO: 7043579 - DNA, 22 bp, Homo sapiens
tttagcaataaagggatattaa

SEQ ID NO: 7043580 - DNA, 22 bp, Homo sapiens
tttagcaatatcataaggaaga

SEQ ID NO: 7043581 - DNA, 22 bp, Homo sapiens
tttagcaattagaatccagcat

SEQ ID NO: 7043582 - DNA, 22 bp, Homo sapiens
tttagcaattattaagggttga

SEQ ID NO: 7043583 - DNA, 22 bp, Homo sapiens
tttagcaatttctaaaagtgtt

SEQ ID NO: 7043584 - DNA, 22 bp, Homo sapiens
tttatccatcatctgctgaagg

SEQ ID NO: 7043585 - DNA, 22 bp, Homo sapiens
tttatccattggttagaaaatc

SEQ ID NO: 7043586 - DNA, 22 bp, Homo sapiens
tttatctgaaaaaactcttgga

SEQ ID NO: 7043587 - DNA, 22 bp, Homo sapiens
tttatctgacctcacttcttaa

SEQ ID NO: 7043588 - DNA, 22 bp, Homo sapiens
tttaccaaatagattatgtcag

SEQ ID NO: 7043589 - DNA, 22 bp, Homo sapiens
tttacatttccctctgtcagtt

SEQ ID NO: 7043590 - DNA, 22 bp, Homo sapiens
tttagagtcattttatattgac

SEQ ID NO: 7043591 - DNA, 22 bp, Homo sapiens
tttagagtccaagttcttcact

SEQ ID NO: 7043592 - DNA, 22 bp, Homo sapiens
tttagagtccttgctcttattc

SEQ ID NO: 7043593 - DNA, 22 bp, Homo sapiens
tttagcaaaaaagctctgcgta

SEQ ID NO: 7043594 - DNA, 22 bp, Homo sapiens
tttagcaaaaaagctctgcgta

SEQ ID NO: 7043595 - DNA, 22 bp, Homo sapiens
tttagcaaaacattatgtctgt

SEQ ID NO: 7043596 - DNA, 20 bp, Homo sapiens
tttagcaaaagggactgctc

SEQ ID NO: 7043597 - DNA, 20 bp, Homo sapiens
tttagcaaaagggactgctc

SEQ ID NO: 7043598 - DNA, 22 bp, Homo sapiens
tttagcaaactttggagtttgt

SEQ ID NO: 7043599 - DNA, 22 bp, Homo sapiens
tttagcaaaggtagggttcaga

SEQ ID NO: 7043600 - DNA, 22 bp, Homo sapiens
tttagcaaaggtgtcttgggca

SEQ ID NO: 7043601 - DNA, 22 bp, Homo sapiens
tttagcaaatatttctgttgat

SEQ ID NO: 7043602 - DNA, 22 bp, Homo sapiens
tttagcaaattactcacagggt

SEQ ID NO: 7043603 - DNA, 22 bp, Homo sapiens
tttagcaaattagcacctctaa

SEQ ID NO: 7043604 - DNA, 22 bp, Homo sapiens
tttagcaacgaagcactcgaca

SEQ ID NO: 7043605 - DNA, 21 bp, Homo sapiens
tttagcaagagtatagtgcat

SEQ ID NO: 7043606 - DNA, 22 bp, Homo sapiens
tttagcaagatgccctggcttt

SEQ ID NO: 7043607 - DNA, 22 bp, Homo sapiens
tttagcaagattgagccgtctt

SEQ ID NO: 7043608 - DNA, 22 bp, Homo sapiens
tttagcaaggagaaataatcct

SEQ ID NO: 7043609 - DNA, 22 bp, Homo sapiens
tttagcaaggtaggtccatgga

SEQ ID NO: 7043610 - DNA, 22 bp, Homo sapiens
tttagcaagtatttactgacta

SEQ ID NO: 7043611 - DNA, 22 bp, Homo sapiens
tttaaagtgctgctcctatcct

SEQ ID NO: 7043612 - DNA, 22 bp, Homo sapiens
tttaaatgcagacgttgattca

SEQ ID NO: 7043613 - DNA, 22 bp, Homo sapiens
tttaaatggcattttcccagat

SEQ ID NO: 7043614 - DNA, 22 bp, Homo sapiens
tttaaatgtttatagagagtac

SEQ ID NO: 7043615 - DNA, 22 bp, Homo sapiens
tttaagcaagttgacatagcat

SEQ ID NO: 7043616 - DNA, 19 bp, Homo sapiens
tttaagcaatagtatcttg

SEQ ID NO: 7043617 - DNA, 22 bp, Homo sapiens
tttaagcacagggataaagtta

SEQ ID NO: 7043618 - DNA, 22 bp, Homo sapiens
tttaagcagagaaatgatgtat

SEQ ID NO: 7043619 - DNA, 22 bp, Homo sapiens
tttaagctaatgtcataattag

SEQ ID NO: 7043620 - DNA, 22 bp, Homo sapiens
tttaatgaataattcaaatctg

SEQ ID NO: 7043621 - DNA, 22 bp, Homo sapiens
tttaatgcccaaggctttgatg

SEQ ID NO: 7043622 - DNA, 22 bp, Homo sapiens
tttaatgtgacatcttttagag

SEQ ID NO: 7043623 - DNA, 22 bp, Homo sapiens
tttacagtctatgttgaattaa

SEQ ID NO: 7043624 - DNA, 22 bp, Homo sapiens
ttggccagtggaaagaggagga

SEQ ID NO: 7043625 - DNA, 22 bp, Homo sapiens
ttgggcaggtgaagagagggct

SEQ ID NO: 7043626 - DNA, 22 bp, Homo sapiens
ttgggcagtctggctgcagagt

SEQ ID NO: 7043627 - DNA, 23 bp, Homo sapiens
ttggagagggtgagtagtgtcag

SEQ ID NO: 7043628 - DNA, 22 bp, Homo sapiens
ttgtaacagctgtttatatagt

SEQ ID NO: 7043629 - DNA, 22 bp, Homo sapiens
ttgtaacttaagttttgcatat

SEQ ID NO: 7043630 - DNA, 22 bp, Homo sapiens
ttgtaatggagcaaacaggttg

SEQ ID NO: 7043631 - DNA, 22 bp, Homo sapiens
ttgtacaagtattatgtgaaca

SEQ ID NO: 7043632 - DNA, 22 bp, Homo sapiens
ttgtcatcatgttttccaaagg

SEQ ID NO: 7043633 - DNA, 22 bp, Homo sapiens
ttgtcatgagtcacaaaaataa

SEQ ID NO: 7043634 - DNA, 22 bp, Homo sapiens
ttgtcatgatccttctgttagg

SEQ ID NO: 7043635 - DNA, 22 bp, Homo sapiens
ttgtcatggatggaagggatat

SEQ ID NO: 7043636 - DNA, 22 bp, Homo sapiens
ttgacagaatgttacatataga

SEQ ID NO: 7043637 - DNA, 21 bp, Homo sapiens
ttgcacagaaaaccatagaga

SEQ ID NO: 7043638 - DNA, 22 bp, Homo sapiens
ttgacaagtaatacttaaatta

SEQ ID NO: 7043639 - DNA, 22 bp, Homo sapiens
ttgcagggaaatcagtgaggat

SEQ ID NO: 7043640 - DNA, 22 bp, Homo sapiens
ttgcagggcaaatggtcagata

SEQ ID NO: 7043641 - DNA, 22 bp, Homo sapiens
ttgcagggtacattcttagaat

SEQ ID NO: 7043642 - DNA, 22 bp, Homo sapiens
ttgcagggtcccagaggcctgg

SEQ ID NO: 7043643 - DNA, 22 bp, Homo sapiens
ttgcagttgctgtatttaagga

SEQ ID NO: 7043644 - DNA, 23 bp, Homo sapiens
ttgcattaatgtggaggcacagg

SEQ ID NO: 7043645 - DNA, 22 bp, Homo sapiens
ttggaaacgtcaccttttcctt

SEQ ID NO: 7043646 - DNA, 22 bp, Homo sapiens
ttggaaaggtgcttttgtctgt

SEQ ID NO: 7043647 - DNA, 22 bp, Homo sapiens
ttggaaagtgacgttcaactgt

SEQ ID NO: 7043648 - DNA, 22 bp, Homo sapiens
ttggaaatacagcagttacttt

SEQ ID NO: 7043649 - DNA, 23 bp, Homo sapiens
ttggaaatggggagaacagattc

SEQ ID NO: 7043650 - DNA, 22 bp, Homo sapiens
ttggaacaatcacatccttgct

SEQ ID NO: 7043651 - DNA, 22 bp, Homo sapiens
ttggaacacaatgtttctttca

SEQ ID NO: 7043652 - DNA, 21 bp, Homo sapiens
ttggacactccctgtgctgtg

SEQ ID NO: 7043653 - DNA, 22 bp, Homo sapiens
ttggacactgagactagcaagc

SEQ ID NO: 7043654 - DNA, 22 bp, Homo sapiens
ttggacagcacagacatagaat

SEQ ID NO: 7043655 - DNA, 22 bp, Homo sapiens
ttggacagtactttaaagcaga

SEQ ID NO: 7043656 - DNA, 22 bp, Homo sapiens
ttttcatggccaccgcaagtga

SEQ ID NO: 7043657 - DNA, 22 bp, Homo sapiens
ttttcatgtcatgtccttgagg

SEQ ID NO: 7043658 - DNA, 22 bp, Homo sapiens
ttttcatgtgatgtgacatttc

SEQ ID NO: 7043659 - DNA, 22 bp, Homo sapiens
ttttcatgaggaaatactgccc

SEQ ID NO: 7043660 - DNA, 22 bp, Homo sapiens
ttttcatgttccttgttaagtg

SEQ ID NO: 7043661 - DNA, 22 bp, Homo sapiens
ttttcattagaatgactgagaa

SEQ ID NO: 7043662 - DNA, 22 bp, Homo sapiens
ttttcattgagcacctgagtaa

SEQ ID NO: 7043663 - DNA, 22 bp, Homo sapiens
ttttcattgtaaatcaggaaac

SEQ ID NO: 7043664 - DNA, 22 bp, Homo sapiens
ttttcattgttactatgagcta

SEQ ID NO: 7043665 - DNA, 22 bp, Homo sapiens
ttttatgtgtgaaatgctgtct

SEQ ID NO: 7043666 - DNA, 22 bp, Homo sapiens
ttttatgttcctgaagctatct

SEQ ID NO: 7043667 - DNA, 22 bp, Homo sapiens
ttttcatttacattagggaaga

SEQ ID NO: 7043668 - DNA, 22 bp, Homo sapiens
ttttcttactgtctgtgatcct

SEQ ID NO: 7043669 - DNA, 22 bp, Homo sapiens
ttttcttactgtctgtgatcct

SEQ ID NO: 7043670 - DNA, 22 bp, Homo sapiens
ttttcttatagagcttaaagtt

SEQ ID NO: 7043671 - DNA, 22 bp, Homo sapiens
ttttcttatagagcttaaagtt

SEQ ID NO: 7043672 - DNA, 22 bp, Homo sapiens
ttttcttatggtgaagcacaaa

SEQ ID NO: 7043673 - DNA, 22 bp, Homo sapiens
ttttcttatggtgaagcacaaa

SEQ ID NO: 7043674 - DNA, 22 bp, Homo sapiens
ttttcttatgtgcagctatatg

SEQ ID NO: 7043675 - DNA, 18 bp, Homo sapiens
ttttaatttcaggggtgg

SEQ ID NO: 7043676 - DNA, 23 bp, Homo sapiens
ttttaatttggacataagaagat

SEQ ID NO: 7043677 - DNA, 23 bp, Homo sapiens
ttttaatttggacataagaagat

SEQ ID NO: 7043678 - DNA, 22 bp, Homo sapiens
ttttatgcaagttatgattaaa

SEQ ID NO: 7043679 - DNA, 21 bp, Homo sapiens
ttttatgcataggaaatatat

SEQ ID NO: 7043680 - DNA, 22 bp, Homo sapiens
ttttatgtcataaggacactca

SEQ ID NO: 7043681 - DNA, 22 bp, Homo sapiens
ttttaagaaatgtatgactgtc

SEQ ID NO: 7043682 - DNA, 22 bp, Homo sapiens
ttttaatgggcgactattatgg

SEQ ID NO: 7043683 - DNA, 22 bp, Homo sapiens
ttttaatgtgctctgcaatgat

SEQ ID NO: 7043684 - DNA, 22 bp, Homo sapiens
ttttaattcaaagtgaatagtg

SEQ ID NO: 7043685 - DNA, 22 bp, Homo sapiens
ttttaattcaaagtgaatagtg

SEQ ID NO: 7043686 - DNA, 22 bp, Homo sapiens
ttttaattgcaattatggtccc

SEQ ID NO: 7043687 - DNA, 22 bp, Homo sapiens
tttgttcaatatgtgtttgtcc

SEQ ID NO: 7043688 - DNA, 22 bp, Homo sapiens
ttttaaagagatgctgtgcata

SEQ ID NO: 7043689 - DNA, 22 bp, Homo sapiens
ttttaaaggatactcttgtcta

SEQ ID NO: 7043690 - DNA, 22 bp, Homo sapiens
ttttaaaggatactcttgtcta

SEQ ID NO: 7043691 - DNA, 22 bp, Homo sapiens
ttttaaaggatagctctggttg

SEQ ID NO: 7043692 - DNA, 22 bp, Homo sapiens
ttttaaaggctgtatgaccaag

SEQ ID NO: 7043693 - DNA, 22 bp, Homo sapiens
ttttaacactcagcactatctc

SEQ ID NO: 7043694 - DNA, 22 bp, Homo sapiens
ttttaacttaaaatacatagat

SEQ ID NO: 7043695 - DNA, 22 bp, Homo sapiens
tttgtaaagtctgttctgagtt

SEQ ID NO: 7043696 - DNA, 22 bp, Homo sapiens
tttgtaaatagcagtactcatg

SEQ ID NO: 7043697 - DNA, 22 bp, Homo sapiens
tttgttaaaatgcagattctgt

SEQ ID NO: 7043698 - DNA, 22 bp, Homo sapiens
tttgttataacaataaaaagtc

SEQ ID NO: 7043699 - DNA, 22 bp, Homo sapiens
tttgttcaacatcacttccacc

SEQ ID NO: 7043700 - DNA, 22 bp, Homo sapiens
tttgttcaaggaatagtaaatg

SEQ ID NO: 7043701 - DNA, 21 bp, Homo sapiens
tttgaaagccctatgttttca

SEQ ID NO: 7043702 - DNA, 22 bp, Homo sapiens
tttgacagacatttactacatt

SEQ ID NO: 7043703 - DNA, 22 bp, Homo sapiens
tttccctctcatctctattatt

SEQ ID NO: 7043704 - DNA, 22 bp, Homo sapiens
tttctttgttgttatcacatca

SEQ ID NO: 7043705 - DNA, 22 bp, Homo sapiens
tttcttttccaatatccctact

SEQ ID NO: 7043706 - DNA, 19 bp, Homo sapiens
tttcttttcccctcagcac

SEQ ID NO: 7043707 - DNA, 22 bp, Homo sapiens
tttcttttgctgagaggggcac

SEQ ID NO: 7043708 - DNA, 22 bp, Homo sapiens
tttgataatacacaagagaaag

SEQ ID NO: 7043709 - DNA, 22 bp, Homo sapiens
tttgatgacctgtatctttttc

SEQ ID NO: 7043710 - DNA, 22 bp, Homo sapiens
tttgatttactataagcagcac

SEQ ID NO: 7043711 - DNA, 22 bp, Homo sapiens
tttgatttactataagcagcac

SEQ ID NO: 7043712 - DNA, 22 bp, Homo sapiens
tttggaaaaagcctgaacatag

SEQ ID NO: 7043713 - DNA, 22 bp, Homo sapiens
tttggaaacatctcagaaaata

SEQ ID NO: 7043714 - DNA, 22 bp, Homo sapiens
tttggaaacatctcagaaaata

SEQ ID NO: 7043715 - DNA, 22 bp, Homo sapiens
tttggaaagacacacagtttta

SEQ ID NO: 7043716 - DNA, 22 bp, Homo sapiens
tttggaaagtgtgatttcaagg

SEQ ID NO: 7043717 - DNA, 22 bp, Homo sapiens
tttggaaatttcatcaatagcc

SEQ ID NO: 7043718 - DNA, 22 bp, Homo sapiens
tttggaaatttcatcaatagcc

SEQ ID NO: 7043719 - DNA, 22 bp, Homo sapiens
tttggaaattttcatccagaca

SEQ ID NO: 7043720 - DNA, 22 bp, Homo sapiens
tttggtcagataagtcaatgta

SEQ ID NO: 7043721 - DNA, 22 bp, Homo sapiens
tttggtcatgtcgtcatttggg

SEQ ID NO: 7043722 - DNA, 22 bp, Homo sapiens
ttttcttatgtgcagctatatg

SEQ ID NO: 7043723 - DNA, 22 bp, Homo sapiens
tttttagaattggctgagaatt

SEQ ID NO: 7043724 - DNA, 22 bp, Homo sapiens
tttttagaattggctgagaatt

SEQ ID NO: 7043725 - DNA, 22 bp, Homo sapiens
tttttagagtgttaccagtata

SEQ ID NO: 7043726 - DNA, 22 bp, Homo sapiens
tttttataactcttttgtgaca

SEQ ID NO: 7043727 - DNA, 22 bp, Homo sapiens
tttttataccacctctcactta

SEQ ID NO: 7043728 - DNA, 22 bp, Homo sapiens
tttttatactttgctcaagatt

SEQ ID NO: 7043729 - DNA, 22 bp, Homo sapiens
tttttataggtcagggcaagtc

SEQ ID NO: 7043730 - DNA, 22 bp, Homo sapiens
tttttcaagacaacctgcatgt

SEQ ID NO: 7043731 - DNA, 22 bp, Homo sapiens
tttttcagccatgaattacact

SEQ ID NO: 7043732 - DNA, 22 bp, Homo sapiens
tttttcatattcccctctctgg

SEQ ID NO: 7043733 - DNA, 22 bp, Homo sapiens
tttttcatctgattgataactc

SEQ ID NO: 7043734 - DNA, 22 bp, Homo sapiens
aattccaaatgttttcaatcca

SEQ ID NO: 7043735 - DNA, 22 bp, Homo sapiens
aattaactaatttggtacaaga

SEQ ID NO: 7043736 - DNA, 23 bp, Homo sapiens
aattacaaccaagaactggaagg

SEQ ID NO: 7043737 - DNA, 22 bp, Homo sapiens
aattacacagggatcacttttt

SEQ ID NO: 7043738 - DNA, 21 bp, Homo sapiens
aattacagatggaattacaga

SEQ ID NO: 7043739 - DNA, 22 bp, Homo sapiens
aattccacaaaaggttctcttc

SEQ ID NO: 7043740 - DNA, 22 bp, Homo sapiens
aatttcaattacttttgcacca

SEQ ID NO: 7043741 - DNA, 22 bp, Homo sapiens
aatttcctgggataaaaagcca

SEQ ID NO: 7043742 - DNA, 22 bp, Homo sapiens
aatgtataaccataggaaattt

SEQ ID NO: 7043743 - DNA, 22 bp, Homo sapiens
aatgtataatatttaatgcttt

SEQ ID NO: 7043744 - DNA, 20 bp, Homo sapiens
aatgtatattttatgccagg

SEQ ID NO: 7043745 - DNA, 21 bp, Homo sapiens
aatgtatgtttatctcacagt

SEQ ID NO: 7043746 - DNA, 22 bp, Homo sapiens
agagcaacgaggtgatactaga

SEQ ID NO: 7043747 - DNA, 22 bp, Homo sapiens
agcaaatacatttttagcataa

SEQ ID NO: 7043748 - DNA, 22 bp, Homo sapiens
agcaaatacttgaataaaaaga

SEQ ID NO: 7043749 - DNA, 22 bp, Homo sapiens
acaagttttggaagtcttaagg

SEQ ID NO: 7043750 - DNA, 22 bp, Homo sapiens
acaatagaaataattaagcaca

SEQ ID NO: 7043751 - DNA, 22 bp, Homo sapiens
acaatagaaggaaactgacata

SEQ ID NO: 7043752 - DNA, 22 bp, Homo sapiens
acaacagtttaggtatttgtag

SEQ ID NO: 7043753 - DNA, 22 bp, Homo sapiens
agcaaagctgctcccttttgtc

SEQ ID NO: 7043754 - DNA, 22 bp, Homo sapiens
agcaaagcttccataaagcagc

SEQ ID NO: 7043755 - DNA, 22 bp, Homo sapiens
agcaaataaagacaattatgtc

SEQ ID NO: 7043756 - DNA, 23 bp, Homo sapiens
agcaaataatctgcttgcttttt

SEQ ID NO: 7043757 - DNA, 23 bp, Homo sapiens
agcaaataatctgcttgcttttt

SEQ ID NO: 7043758 - DNA, 22 bp, Homo sapiens
agcaaataattgtctttgaggg

SEQ ID NO: 7043759 - DNA, 19 bp, Homo sapiens
agcaaatacatcaaaattg

SEQ ID NO: 7043760 - DNA, 22 bp, Homo sapiens
agcaaggcagtcagctggctgg

SEQ ID NO: 7043761 - DNA, 22 bp, Homo sapiens
agcacaaaagcagccacagatg

SEQ ID NO: 7043762 - DNA, 22 bp, Homo sapiens
agcacaggacgtagagcttgga

SEQ ID NO: 7043763 - DNA, 22 bp, Homo sapiens
agcacagggacaatgccaggtg

SEQ ID NO: 7043764 - DNA, 22 bp, Homo sapiens
aatttctcggttttgatattgt

SEQ ID NO: 7043765 - DNA, 22 bp, Homo sapiens
aatttctctctcatgcttcatg

SEQ ID NO: 7043766 - DNA, 22 bp, Homo sapiens
acaacagtagcctttacaaggc

SEQ ID NO: 7043767 - DNA, 22 bp, Homo sapiens
agctgagggcaggatggggtga

SEQ ID NO: 7043768 - DNA, 22 bp, Homo sapiens
agctgagggttcggtgtccaca

SEQ ID NO: 7043769 - DNA, 22 bp, Homo sapiens
acagatacaaatatacaaatac

SEQ ID NO: 7043770 - DNA, 22 bp, Homo sapiens
acagatactcagctctatgctt

SEQ ID NO: 7043771 - DNA, 22 bp, Homo sapiens
acagatagtatgtaaattaagc

SEQ ID NO: 7043772 - DNA, 22 bp, Homo sapiens
acagatataaactatagtagtg

SEQ ID NO: 7043773 - DNA, 22 bp, Homo sapiens
acagatatatgattgtgtaaat

SEQ ID NO: 7043774 - DNA, 22 bp, Homo sapiens
acagatatgcaaagcaaatgga

SEQ ID NO: 7043775 - DNA, 21 bp, Homo sapiens
acagatatttcattgaacatt

SEQ ID NO: 7043776 - DNA, 22 bp, Homo sapiens
agcgggcagaagtggggtctgc

SEQ ID NO: 7043777 - DNA, 22 bp, Homo sapiens
agctaaactaggtaaacagcag

SEQ ID NO: 7043778 - DNA, 22 bp, Homo sapiens
agctaaatcacttattctttca

SEQ ID NO: 7043779 - DNA, 22 bp, Homo sapiens
agctaaatgtgaaatgtcaacc

SEQ ID NO: 7043780 - DNA, 22 bp, Homo sapiens
acagaggctgcgcttgggaacg

SEQ ID NO: 7043781 - DNA, 22 bp, Homo sapiens
acagaggcctcgtaggtacaac

SEQ ID NO: 7043782 - DNA, 22 bp, Homo sapiens
acagaagtccccatgaagaagc

SEQ ID NO: 7043783 - DNA, 22 bp, Homo sapiens
acagaagtgtctttttcattca

SEQ ID NO: 7043784 - DNA, 23 bp, Homo sapiens
acagaataccattgactaggtgt

SEQ ID NO: 7043785 - DNA, 22 bp, Homo sapiens
acagaatactacagactggtta

SEQ ID NO: 7043786 - DNA, 20 bp, Homo sapiens
acagaatatgctggttgtgg

SEQ ID NO: 7043787 - DNA, 22 bp, Homo sapiens
acagaggccccgtgggagagcc

SEQ ID NO: 7043788 - DNA, 22 bp, Homo sapiens
acaccagggcctagccagggcg

SEQ ID NO: 7043789 - DNA, 22 bp, Homo sapiens
agccaatacactgaagatctaa

SEQ ID NO: 7043790 - DNA, 20 bp, Homo sapiens
agccaatacagcaaaatttg

SEQ ID NO: 7043791 - DNA, 22 bp, Homo sapiens
agccagctggtgggtcagctgg

SEQ ID NO: 7043792 - DNA, 22 bp, Homo sapiens
agccagctgtggctatggctcc

SEQ ID NO: 7043793 - DNA, 22 bp, Homo sapiens
agccagctgttctggggcagca

SEQ ID NO: 7043794 - DNA, 22 bp, Homo sapiens
acacaagtgaatattttaagga

SEQ ID NO: 7043795 - DNA, 22 bp, Homo sapiens
acacaatacagggctcaaaata

SEQ ID NO: 7043796 - DNA, 22 bp, Homo sapiens
acacacaactcattgtgtaata

SEQ ID NO: 7043797 - DNA, 22 bp, Homo sapiens
acacagttcaggatcaaatagc

SEQ ID NO: 7043798 - DNA, 22 bp, Homo sapiens
acacagttcaggatcaaatagc

SEQ ID NO: 7043799 - DNA, 22 bp, Homo sapiens
acacagttcatgcatgaggtct

SEQ ID NO: 7043800 - DNA, 22 bp, Homo sapiens
acacagttcgtgcttttctatt

SEQ ID NO: 7043801 - DNA, 22 bp, Homo sapiens
acacagttcgtgcttttctatt

SEQ ID NO: 7043802 - DNA, 22 bp, Homo sapiens
acacagttcgttgttttctact

SEQ ID NO: 7043803 - DNA, 22 bp, Homo sapiens
acacagttcgttgttttctact

SEQ ID NO: 7043804 - DNA, 22 bp, Homo sapiens
acacagttctcttcttgtaact

SEQ ID NO: 7043805 - DNA, 22 bp, Homo sapiens
acacagttcttagcaggtgtct

SEQ ID NO: 7043806 - DNA, 22 bp, Homo sapiens
acacagttctttcactgttggt

SEQ ID NO: 7043807 - DNA, 22 bp, Homo sapiens
acacagttgattgtcactcagg

SEQ ID NO: 7043808 - DNA, 22 bp, Homo sapiens
acacagtttaaacgattagtac

SEQ ID NO: 7043809 - DNA, 22 bp, Homo sapiens
acacagtttatggtattctgtt

SEQ ID NO: 7043810 - DNA, 22 bp, Homo sapiens
acacagtttatggtattctgtt

SEQ ID NO: 7043811 - DNA, 22 bp, Homo sapiens
acacagtttttcagacagagat

SEQ ID NO: 7043812 - DNA, 22 bp, Homo sapiens
agcagggacatggcatctctcc

SEQ ID NO: 7043813 - DNA, 22 bp, Homo sapiens
acacatatgtcattgaaaaatc

SEQ ID NO: 7043814 - DNA, 22 bp, Homo sapiens
agaacacactgggggaaacaag

SEQ ID NO: 7043815 - DNA, 17 bp, Homo sapiens
agaactgtagtagctcc

SEQ ID NO: 7043816 - DNA, 22 bp, Homo sapiens
agaactgtcacgagtgacaaag

SEQ ID NO: 7043817 - DNA, 22 bp, Homo sapiens
agaactgtgccaaaaattttgt

SEQ ID NO: 7043818 - DNA, 22 bp, Homo sapiens
aatgcattgattgctggaaata

SEQ ID NO: 7043819 - DNA, 22 bp, Homo sapiens
acttttatgataatcaatgttc

SEQ ID NO: 7043820 - DNA, 22 bp, Homo sapiens
acttttaaggggccttgattta

SEQ ID NO: 7043821 - DNA, 22 bp, Homo sapiens
acttttatgataatcaatgttc

SEQ ID NO: 7043822 - DNA, 22 bp, Homo sapiens
acttttaaatgagtttcagttg

SEQ ID NO: 7043823 - DNA, 22 bp, Homo sapiens
aatagcttatgggatagatgtt

SEQ ID NO: 7043824 - DNA, 22 bp, Homo sapiens
aatcacaattacttttgcacca

SEQ ID NO: 7043825 - DNA, 20 bp, Homo sapiens
aatcacagttaactctttct

SEQ ID NO: 7043826 - DNA, 22 bp, Homo sapiens
agaaactgacaggaaatgaatt

SEQ ID NO: 7043827 - DNA, 22 bp, Homo sapiens
aataatacatgagattaatgtt

SEQ ID NO: 7043828 - DNA, 20 bp, Homo sapiens
aagttttctccaaatacagt

SEQ ID NO: 7043829 - DNA, 22 bp, Homo sapiens
aagtttttcacattgctgttgt

SEQ ID NO: 7043830 - DNA, 22 bp, Homo sapiens
aagtttttgattctaagagaga

SEQ ID NO: 7043831 - DNA, 22 bp, Homo sapiens
aagtttttggtagagaaaagta

SEQ ID NO: 7043832 - DNA, 22 bp, Homo sapiens
actgtacacacttctctgtctt

SEQ ID NO: 7043833 - DNA, 22 bp, Homo sapiens
aatagcaaagttatcaaattaa

SEQ ID NO: 7043834 - DNA, 18 bp, Homo sapiens
actctttctgcccacagg

SEQ ID NO: 7043835 - DNA, 22 bp, Homo sapiens
actgaaaatgaattagaaacag

SEQ ID NO: 7043836 - DNA, 22 bp, Homo sapiens
aagttcaagtctgcatcttttt

SEQ ID NO: 7043837 - DNA, 22 bp, Homo sapiens
aagttcaagtgtaatctttatt

SEQ ID NO: 7043838 - DNA, 22 bp, Homo sapiens
aagttcaatcagatgaaaaagc

SEQ ID NO: 7043839 - DNA, 22 bp, Homo sapiens
aagttcaatcagatgaaaaagc

SEQ ID NO: 7043840 - DNA, 22 bp, Homo sapiens
aagttcaatggaaaagctttag

SEQ ID NO: 7043841 - DNA, 22 bp, Homo sapiens
aagttcacagaagattccaatt

SEQ ID NO: 7043842 - DNA, 22 bp, Homo sapiens
aagttcagcctggttttaatgc

SEQ ID NO: 7043843 - DNA, 22 bp, Homo sapiens
aagttcctcaaataaaacatga

SEQ ID NO: 7043844 - DNA, 22 bp, Homo sapiens
actgcaggagacacagctgctg

SEQ ID NO: 7043845 - DNA, 22 bp, Homo sapiens
actgcaggccttggtgccagca

SEQ ID NO: 7043846 - DNA, 22 bp, Homo sapiens
acctatcagccctgtggtttag

SEQ ID NO: 7043847 - DNA, 20 bp, Homo sapiens
acctcctggaagcaggtgcc

SEQ ID NO: 7043848 - DNA, 21 bp, Homo sapiens
acctcctggcatcctgttccc

SEQ ID NO: 7043849 - DNA, 20 bp, Homo sapiens
acctcctggcgggcatcctc

SEQ ID NO: 7043850 - DNA, 22 bp, Homo sapiens
acctctgcaatgcaatgtcatg

SEQ ID NO: 7043851 - DNA, 23 bp, Homo sapiens
aagtagatagctaaagttttgtt

SEQ ID NO: 7043852 - DNA, 21 bp, Homo sapiens
aagtagatcactgttctcttg

SEQ ID NO: 7043853 - DNA, 22 bp, Homo sapiens
aagtatactgaaggtatccagg

SEQ ID NO: 7043854 - DNA, 22 bp, Homo sapiens
acctgcctatcagctgcctgct

SEQ ID NO: 7043855 - DNA, 22 bp, Homo sapiens
aagggagacagttgtgtgagga

SEQ ID NO: 7043856 - DNA, 20 bp, Homo sapiens
aagggcagagggaacagact

SEQ ID NO: 7043857 - DNA, 22 bp, Homo sapiens
acatttcagtaagtgttaattt

SEQ ID NO: 7043858 - DNA, 22 bp, Homo sapiens
acatttcagtgagctattgaag

SEQ ID NO: 7043859 - DNA, 20 bp, Homo sapiens
accagaggaaagagcagtga

SEQ ID NO: 7043860 - DNA, 22 bp, Homo sapiens
accagaggaagggaatctcaag

SEQ ID NO: 7043861 - DNA, 22 bp, Homo sapiens
accagaggaggaattaccttcc

SEQ ID NO: 7043862 - DNA, 22 bp, Homo sapiens
accagaggcagtttcggctggt

SEQ ID NO: 7043863 - DNA, 22 bp, Homo sapiens
accagaggctctgccacctcca

SEQ ID NO: 7043864 - DNA, 22 bp, Homo sapiens
accagagggagacttcctcttc

SEQ ID NO: 7043865 - DNA, 22 bp, Homo sapiens
accagagggcaaaccccagtgt

SEQ ID NO: 7043866 - DNA, 22 bp, Homo sapiens
aaggtacagttttaagaataag

SEQ ID NO: 7043867 - DNA, 22 bp, Homo sapiens
acccaggcagcaggagctaaag

SEQ ID NO: 7043868 - DNA, 22 bp, Homo sapiens
aaggaagtgattttcatgtcaa

SEQ ID NO: 7043869 - DNA, 22 bp, Homo sapiens
aaggatgcagggacccaaggct

SEQ ID NO: 7043870 - DNA, 22 bp, Homo sapiens
aaggatgtggcatttttcatat

SEQ ID NO: 7043871 - DNA, 22 bp, Homo sapiens
aaggcaactgtaaaacatgcac

SEQ ID NO: 7043872 - DNA, 22 bp, Homo sapiens
acatccttatataggccaatga

SEQ ID NO: 7043873 - DNA, 22 bp, Homo sapiens
acatccttgattatgtaaggat

SEQ ID NO: 7043874 - DNA, 22 bp, Homo sapiens
acatgaaattctagctgaaccc

SEQ ID NO: 7043875 - DNA, 22 bp, Homo sapiens
acagccaggaattctggagaag

SEQ ID NO: 7043876 - DNA, 22 bp, Homo sapiens
aagcaggctcacgccaggcagt

SEQ ID NO: 7043877 - DNA, 22 bp, Homo sapiens
aagcagtgactctcagaggcag

SEQ ID NO: 7043878 - DNA, 22 bp, Homo sapiens
aagcagttactatttactatta

SEQ ID NO: 7043879 - DNA, 19 bp, Homo sapiens
aagcagtttatatatttgt

SEQ ID NO: 7043880 - DNA, 22 bp, Homo sapiens
aagcagtttttcaactgtttag

SEQ ID NO: 7043881 - DNA, 22 bp, Homo sapiens
acagcagggggagctgttggac

SEQ ID NO: 7043882 - DNA, 22 bp, Homo sapiens
acagcaggggtggaataaacgt

SEQ ID NO: 7043883 - DNA, 22 bp, Homo sapiens
acacttctcatttgatactaac

SEQ ID NO: 7043884 - DNA, 22 bp, Homo sapiens
acacttctcccatctcctgttg

SEQ ID NO: 7043885 - DNA, 22 bp, Homo sapiens
acacttggagcaacacttatgg

SEQ ID NO: 7043886 - DNA, 23 bp, Homo sapiens
acagaaatcatttgtaaggtacc

SEQ ID NO: 7043887 - DNA, 22 bp, Homo sapiens
acagaaatgatgtttggcaata

SEQ ID NO: 7043888 - DNA, 23 bp, Homo sapiens
acagagatcttgacttgtatgga

SEQ ID NO: 7043889 - DNA, 22 bp, Homo sapiens
acagagatgtcagattggcagc

SEQ ID NO: 7043890 - DNA, 22 bp, Homo sapiens
aagaacattgactaagaggggc

SEQ ID NO: 7043891 - DNA, 22 bp, Homo sapiens
aagaacattgatattgtctatg

SEQ ID NO: 7043892 - DNA, 19 bp, Homo sapiens
aagaactatgtgattacag

SEQ ID NO: 7043893 - DNA, 21 bp, Homo sapiens
aagaactattgaggtacacag

SEQ ID NO: 7043894 - DNA, 23 bp, Homo sapiens
aagaactgcgaatggagaaagta

SEQ ID NO: 7043895 - DNA, 22 bp, Homo sapiens
aagaagaagtgttatttttaga

SEQ ID NO: 7043896 - DNA, 22 bp, Homo sapiens
acaaaaagggagatgaggtaga

SEQ ID NO: 7043897 - DNA, 22 bp, Homo sapiens
acaaaaattagctgggcatggt

SEQ ID NO: 7043898 - DNA, 21 bp, Homo sapiens
acaaaagaagctgccttttaa

SEQ ID NO: 7043899 - DNA, 22 bp, Homo sapiens
aagaatatctgttttatttagg

SEQ ID NO: 7043900 - DNA, 17 bp, Homo sapiens
aagaatcattagagaag

SEQ ID NO: 7043901 - DNA, 22 bp, Homo sapiens
acaaatatttactgaatccact

SEQ ID NO: 7043902 - DNA, 22 bp, Homo sapiens
acaaatatttactgaatccact

SEQ ID NO: 7043903 - DNA, 22 bp, Homo sapiens
acaaatatttactgaatccact

SEQ ID NO: 7043904 - DNA, 22 bp, Homo sapiens
acaaatttcataggcaaatttt

SEQ ID NO: 7043905 - DNA, 22 bp, Homo sapiens
acaacaaaatcactagtcttcc

SEQ ID NO: 7043906 - DNA, 22 bp, Homo sapiens
acaatatacacatcctaatggg

SEQ ID NO: 7043907 - DNA, 22 bp, Homo sapiens
acaatatagtccatgagcatgc

SEQ ID NO: 7043908 - DNA, 22 bp, Homo sapiens
acaatatgggatatacatttta

SEQ ID NO: 7043909 - DNA, 22 bp, Homo sapiens
acaatattgtacccagaagttt

SEQ ID NO: 7043910 - DNA, 22 bp, Homo sapiens
acaatattgtacccagaagttt

SEQ ID NO: 7043911 - DNA, 22 bp, Homo sapiens
acaatgtagagtaaaatatgtt

SEQ ID NO: 7043912 - DNA, 22 bp, Homo sapiens
acaatgtaggctgaaaaagctt

SEQ ID NO: 7043913 - DNA, 22 bp, Homo sapiens
aagataatattcattaactaga

SEQ ID NO: 7043914 - DNA, 22 bp, Homo sapiens
aacttgtaaaatagagtgtaca

SEQ ID NO: 7043915 - DNA, 22 bp, Homo sapiens
aacttgtaatgaaaggcaatag

SEQ ID NO: 7043916 - DNA, 22 bp, Homo sapiens
aacttgtatatgttattcagag

SEQ ID NO: 7043917 - DNA, 22 bp, Homo sapiens
aacttgtattgaaaatgggtaa

SEQ ID NO: 7043918 - DNA, 21 bp, Homo sapiens
aacttgtatttctccttattc

SEQ ID NO: 7043919 - DNA, 22 bp, Homo sapiens
aactttaaggctataaattatg

SEQ ID NO: 7043920 - DNA, 23 bp, Homo sapiens
aactttactattttgaataatgc

SEQ ID NO: 7043921 - DNA, 22 bp, Homo sapiens
aatgtacaaaccttctttgtag

SEQ ID NO: 7043922 - DNA, 22 bp, Homo sapiens
aatgcactgtcagtattgttga

SEQ ID NO: 7043923 - DNA, 22 bp, Homo sapiens
aatctcatgagcttcttgtccc

SEQ ID NO: 7043924 - DNA, 22 bp, Homo sapiens
aatattgtttcaagatcacaga

SEQ ID NO: 7043925 - DNA, 21 bp, Homo sapiens
aatatccaaatgattagatct

SEQ ID NO: 7043926 - DNA, 22 bp, Homo sapiens
aatatccacttcaatacaggca

SEQ ID NO: 7043927 - DNA, 22 bp, Homo sapiens
aatatccattgggagcaaatgg

SEQ ID NO: 7043928 - DNA, 21 bp, Homo sapiens
aacagttctctttgaaggtgt

SEQ ID NO: 7043929 - DNA, 22 bp, Homo sapiens
aacagtttatcaagtttttaca

SEQ ID NO: 7043930 - DNA, 22 bp, Homo sapiens
aacagtttatgagatatgctat

SEQ ID NO: 7043931 - DNA, 22 bp, Homo sapiens
aagttacacagagttggaggct

SEQ ID NO: 7043932 - DNA, 22 bp, Homo sapiens
aagttacagtcagaggttaaca

SEQ ID NO: 7043933 - DNA, 22 bp, Homo sapiens
aagttacagttacagaatggag

SEQ ID NO: 7043934 - DNA, 22 bp, Homo sapiens
aagttacagttggaactgtgaa

SEQ ID NO: 7043935 - DNA, 22 bp, Homo sapiens
aagttacatattcttgggctat

SEQ ID NO: 7043936 - DNA, 22 bp, Homo sapiens
aacagtgtgttttgttattaag

SEQ ID NO: 7043937 - DNA, 22 bp, Homo sapiens
aagtctttcataagtctcttat

SEQ ID NO: 7043938 - DNA, 22 bp, Homo sapiens
aagtgaaacatgtatctcttta

SEQ ID NO: 7043939 - DNA, 22 bp, Homo sapiens
aaatggcaacagaagggagttc

SEQ ID NO: 7043940 - DNA, 22 bp, Homo sapiens
aaggagaagggtaatcaacaca

SEQ ID NO: 7043941 - DNA, 22 bp, Homo sapiens
aaggagtctcagctgggcctga

SEQ ID NO: 7043942 - DNA, 22 bp, Homo sapiens
aaggagtgctgaaaggaagcgg

SEQ ID NO: 7043943 - DNA, 22 bp, Homo sapiens
aaatatttgtctgaggcggttg

SEQ ID NO: 7043944 - DNA, 22 bp, Homo sapiens
aaatgatagtatggaactagga

SEQ ID NO: 7043945 - DNA, 22 bp, Homo sapiens
aaatgatgtggagtgaaattgt

SEQ ID NO: 7043946 - DNA, 22 bp, Homo sapiens
aaatgcacaaagattttgcact

SEQ ID NO: 7043947 - DNA, 22 bp, Homo sapiens
aaatgcacaggttttaaatcct

SEQ ID NO: 7043948 - DNA, 22 bp, Homo sapiens
aaagttctttgcatctttgctc

SEQ ID NO: 7043949 - DNA, 22 bp, Homo sapiens
aagaagcatggctgtagattcc

SEQ ID NO: 7043950 - DNA, 22 bp, Homo sapiens
aaatacagtggcagcagataat

SEQ ID NO: 7043951 - DNA, 22 bp, Homo sapiens
aaatatacggtccctaacagtc

SEQ ID NO: 7043952 - DNA, 22 bp, Homo sapiens
aaatatagtgacacttatagtc

SEQ ID NO: 7043953 - DNA, 19 bp, Homo sapiens
aaatatcagagagatgata

SEQ ID NO: 7043954 - DNA, 22 bp, Homo sapiens
aagataaactcttgatttctga

SEQ ID NO: 7043955 - DNA, 22 bp, Homo sapiens
aaattccattttgtgactattc

SEQ ID NO: 7043956 - DNA, 22 bp, Homo sapiens
aaattccagaaactcagtatat

SEQ ID NO: 7043957 - DNA, 22 bp, Homo sapiens
aaattccagcaacaccttttta

SEQ ID NO: 7043958 - DNA, 22 bp, Homo sapiens
aaattccagttcttttacctgc

SEQ ID NO: 7043959 - DNA, 22 bp, Homo sapiens
aaattccattaggaaacttcca

SEQ ID NO: 7043960 - DNA, 22 bp, Homo sapiens
aaattccattatgataatttcg

SEQ ID NO: 7043961 - DNA, 22 bp, Homo sapiens
aaattcagcagtgaaatgcccc

SEQ ID NO: 7043962 - DNA, 23 bp, Homo sapiens
aaattcagtccttcaactctgag

SEQ ID NO: 7043963 - DNA, 22 bp, Homo sapiens
aaattgtatattccatttgtat

SEQ ID NO: 7043964 - DNA, 22 bp, Homo sapiens
aaaggataaggttatcaatttt

SEQ ID NO: 7043965 - DNA, 22 bp, Homo sapiens
aacttctcaactagcttagagt

SEQ ID NO: 7043966 - DNA, 22 bp, Homo sapiens
aacttctcagcctgcacctggc

SEQ ID NO: 7043967 - DNA, 22 bp, Homo sapiens
aacttctcatacaaagaacaag

SEQ ID NO: 7043968 - DNA, 22 bp, Homo sapiens
aacttctctgaagtgacctgtt

SEQ ID NO: 7043969 - DNA, 22 bp, Homo sapiens
aaagttacacatctagtaagtg

SEQ ID NO: 7043970 - DNA, 22 bp, Homo sapiens
aaagttacacgactatttatgt

SEQ ID NO: 7043971 - DNA, 22 bp, Homo sapiens
aaagttctatgtaatgtttttt

SEQ ID NO: 7043972 - DNA, 22 bp, Homo sapiens
aaagttctggcattttctgtct

SEQ ID NO: 7043973 - DNA, 22 bp, Homo sapiens
aaagttctgggggtgtttctgg

SEQ ID NO: 7043974 - DNA, 22 bp, Homo sapiens
aaagttctttctcttatttggt

SEQ ID NO: 7043975 - DNA, 22 bp, Homo sapiens
aaatgacactaggctttttgca

SEQ ID NO: 7043976 - DNA, 22 bp, Homo sapiens
aaactgttcctttttcagcaac

SEQ ID NO: 7043977 - DNA, 22 bp, Homo sapiens
aaacttcaaggatttgcaaatc

SEQ ID NO: 7043978 - DNA, 22 bp, Homo sapiens
aaacttcaaggatttgcaaatc

SEQ ID NO: 7043979 - DNA, 23 bp, Homo sapiens
aaacttcagtagtgtcatcagcc

SEQ ID NO: 7043980 - DNA, 22 bp, Homo sapiens
aaacttcatggataatataaag

SEQ ID NO: 7043981 - DNA, 22 bp, Homo sapiens
aaatgtgagactgagttttcct

SEQ ID NO: 7043982 - DNA, 23 bp, Homo sapiens
aaatgtgagggaaaatctttctg

SEQ ID NO: 7043983 - DNA, 22 bp, Homo sapiens
aaagacacacagccagcaagtg

SEQ ID NO: 7043984 - DNA, 22 bp, Homo sapiens
aaagacacacagtgcttcagtt

SEQ ID NO: 7043985 - DNA, 22 bp, Homo sapiens
aaagacacatatgcttaaccca

SEQ ID NO: 7043986 - DNA, 22 bp, Homo sapiens
aaagacacatgtctcttagatt

SEQ ID NO: 7043987 - DNA, 22 bp, Homo sapiens
aaaattgtgaaggtttctgaaa

SEQ ID NO: 7043988 - DNA, 22 bp, Homo sapiens
aaagctcagtcagtggtgtatg

SEQ ID NO: 7043989 - DNA, 22 bp, Homo sapiens
aaaggactagtctttctaccat

SEQ ID NO: 7043990 - DNA, 22 bp, Homo sapiens
aaagtacaaggaaaggatctga

SEQ ID NO: 7043991 - DNA, 22 bp, Homo sapiens
aaagtacatgcaattcttctga

SEQ ID NO: 7043992 - DNA, 22 bp, Homo sapiens
aaagtcatccaaatttttatgt

SEQ ID NO: 7043993 - DNA, 22 bp, Homo sapiens
aaagttctaaaactctttgtga

SEQ ID NO: 7043994 - DNA, 22 bp, Homo sapiens
aaagtttttaagcaagaccctt

SEQ ID NO: 7043995 - DNA, 22 bp, Homo sapiens
aaaatactactgtcttcttccc

SEQ ID NO: 7043996 - DNA, 22 bp, Homo sapiens
aaaatctgcttccttttacaga

SEQ ID NO: 7043997 - DNA, 22 bp, Homo sapiens
aaaagttcattagtgagcttct

SEQ ID NO: 7043998 - DNA, 22 bp, Homo sapiens
aaaagttccctggttagaaaag

SEQ ID NO: 7043999 - DNA, 22 bp, Homo sapiens
aaaagtttaagactcattctag

SEQ ID NO: 7044000 - DNA, 22 bp, Homo sapiens
aaaatgcaaacctacctacata

SEQ ID NO: 7044001 - DNA, 18 bp, Homo sapiens
aaaatgcaggcgacatgg

SEQ ID NO: 7044002 - DNA, 18 bp, Homo sapiens
aaaatgcaggcgacatgg

SEQ ID NO: 7044003 - DNA, 22 bp, Homo sapiens
aaagcagcctgctcatcctgga

SEQ ID NO: 7044004 - DNA, 22 bp, Homo sapiens
aaaacactgcctgcttgactga

SEQ ID NO: 7044005 - DNA, 22 bp, Homo sapiens
aaaacagacagccagtgtagag

SEQ ID NO: 7044006 - DNA, 22 bp, Homo sapiens
aaaacaggagttttggtaggct

SEQ ID NO: 7044007 - DNA, 22 bp, Homo sapiens
aaaagcaagttgcctaggttga

SEQ ID NO: 7044008 - DNA, 22 bp, Homo sapiens
aaaagcaattgcagttcttgcc

SEQ ID NO: 7044009 - DNA, 22 bp, Homo sapiens
aaaagcaattgcgggttttgcc

SEQ ID NO: 7044010 - DNA, 22 bp, Homo sapiens
aaaagcactacaatttcgcttc

SEQ ID NO: 7044011 - DNA, 22 bp, Homo sapiens
aaaagccaaggtcctcttcaga

SEQ ID NO: 7044012 - DNA, 22 bp, Homo sapiens
aaaagcaagaggctggattaaa

SEQ ID NO: 7044013 - DNA, 22 bp, Homo sapiens
cagaaacttctggtgtcaaata

SEQ ID NO: 7044014 - DNA, 22 bp, Homo sapiens
cagaaactgtttgttaatattt

SEQ ID NO: 7044015 - DNA, 22 bp, Homo sapiens
cagaaactagatttagacacaa

SEQ ID NO: 7044016 - DNA, 22 bp, Homo sapiens
cactgggctgataccaggcttc

SEQ ID NO: 7044017 - DNA, 22 bp, Homo sapiens
cactgggcgtgtcctgggtgag

SEQ ID NO: 7044018 - DNA, 22 bp, Homo sapiens
agcattttctgagagtatagat

SEQ ID NO: 7044019 - DNA, 22 bp, Homo sapiens
cacgttttatgacagaagaagc

SEQ ID NO: 7044020 - DNA, 22 bp, Homo sapiens
cactaattccatctccttttcc

SEQ ID NO: 7044021 - DNA, 22 bp, Homo sapiens
cactaattctggagacaactca

SEQ ID NO: 7044022 - DNA, 22 bp, Homo sapiens
agcaggcaggcccagcggctgg

SEQ ID NO: 7044023 - DNA, 22 bp, Homo sapiens
caattcaaatgcatagttcaca

SEQ ID NO: 7044024 - DNA, 22 bp, Homo sapiens
caattcaacctaagtgcatcca

SEQ ID NO: 7044025 - DNA, 22 bp, Homo sapiens
caattcaacttgcctttgtagc

SEQ ID NO: 7044026 - DNA, 18 bp, Homo sapiens
caattcaagagcctacag

SEQ ID NO: 7044027 - DNA, 22 bp, Homo sapiens
caattcaagttgagtacagctt

SEQ ID NO: 7044028 - DNA, 22 bp, Homo sapiens
caattcaatggcaaagtattgt

SEQ ID NO: 7044029 - DNA, 22 bp, Homo sapiens
caatttctggaactaattctga

SEQ ID NO: 7044030 - DNA, 22 bp, Homo sapiens
agcaattatggagttgttgacg

SEQ ID NO: 7044031 - DNA, 22 bp, Homo sapiens
caagctggctcttatgcaaaaa

SEQ ID NO: 7044032 - DNA, 22 bp, Homo sapiens
caagggacatttctcataggag

SEQ ID NO: 7044033 - DNA, 22 bp, Homo sapiens
caagggcagaggcagggccccg

SEQ ID NO: 7044034 - DNA, 22 bp, Homo sapiens
caagggcaggagaggatggatg

SEQ ID NO: 7044035 - DNA, 22 bp, Homo sapiens
caagggcattgcttgggacctt

SEQ ID NO: 7044036 - DNA, 21 bp, Homo sapiens
caagggccagtgagatgggat

SEQ ID NO: 7044037 - DNA, 22 bp, Homo sapiens
caagggccatctgagggcactg

SEQ ID NO: 7044038 - DNA, 22 bp, Homo sapiens
caagggccctcggatgatgatg

SEQ ID NO: 7044039 - DNA, 22 bp, Homo sapiens
caagggccctgtctatgtatcc

SEQ ID NO: 7044040 - DNA, 22 bp, Homo sapiens
caagggcctccaccttgctcgt

SEQ ID NO: 7044041 - DNA, 22 bp, Homo sapiens
caagggctcaaacggtggttgc

SEQ ID NO: 7044042 - DNA, 22 bp, Homo sapiens
caatgatagattttacaaatta

SEQ ID NO: 7044043 - DNA, 22 bp, Homo sapiens
caatgatagattttacaaatta

SEQ ID NO: 7044044 - DNA, 22 bp, Homo sapiens
caatgatatctaggaatgggac

SEQ ID NO: 7044045 - DNA, 22 bp, Homo sapiens
caattatatttagaatgataca

SEQ ID NO: 7044046 - DNA, 22 bp, Homo sapiens
cagagccaggtctaggagtctc

SEQ ID NO: 7044047 - DNA, 22 bp, Homo sapiens
agccagggaagaggcctacctc

SEQ ID NO: 7044048 - DNA, 22 bp, Homo sapiens
agccagggacgctgcaggctac

SEQ ID NO: 7044049 - DNA, 22 bp, Homo sapiens
agccagggaggtggaggttgca

SEQ ID NO: 7044050 - DNA, 22 bp, Homo sapiens
agccagggatggcagtgcccag

SEQ ID NO: 7044051 - DNA, 22 bp, Homo sapiens
agccagggctgcgagcagacag

SEQ ID NO: 7044052 - DNA, 22 bp, Homo sapiens
cagatattaggagctcaataat

SEQ ID NO: 7044053 - DNA, 22 bp, Homo sapiens
cagatcataacagatacataga

SEQ ID NO: 7044054 - DNA, 22 bp, Homo sapiens
cagatcatgggactgtctcagc

SEQ ID NO: 7044055 - DNA, 22 bp, Homo sapiens
cagagctgttgcggggcttggc

SEQ ID NO: 7044056 - DNA, 22 bp, Homo sapiens
cagaggaggccaccgcataggc

SEQ ID NO: 7044057 - DNA, 22 bp, Homo sapiens
cagagtggagtttttcagcggg

SEQ ID NO: 7044058 - DNA, 22 bp, Homo sapiens
cagagtggcatgaatgaagcct

SEQ ID NO: 7044059 - DNA, 22 bp, Homo sapiens
cagagtggcgaccccctcagct

SEQ ID NO: 7044060 - DNA, 22 bp, Homo sapiens
agcgctgtgggcgtgcgaggag

SEQ ID NO: 7044061 - DNA, 22 bp, Homo sapiens
cagcactggggccactggagtt

SEQ ID NO: 7044062 - DNA, 22 bp, Homo sapiens
cagcatggtgccagtgagtcca

SEQ ID NO: 7044063 - DNA, 22 bp, Homo sapiens
agcgccactgcactccagcctg

SEQ ID NO: 7044064 - DNA, 22 bp, Homo sapiens
agctgaggaggaatgatgggta

SEQ ID NO: 7044065 - DNA, 20 bp, Homo sapiens
agctgaggcacctgaggtta

SEQ ID NO: 7044066 - DNA, 22 bp, Homo sapiens
attattttatgtgcggcctgat

SEQ ID NO: 7044067 - DNA, 22 bp, Homo sapiens
agaggccctggctagagcagct

SEQ ID NO: 7044068 - DNA, 22 bp, Homo sapiens
attcaaagaacctttagcattg

SEQ ID NO: 7044069 - DNA, 22 bp, Homo sapiens
attctaagcacgctgaagtctt

SEQ ID NO: 7044070 - DNA, 22 bp, Homo sapiens
attctctgggttccagtaaatg

SEQ ID NO: 7044071 - DNA, 22 bp, Homo sapiens
attgtataacagcatgtatttt

SEQ ID NO: 7044072 - DNA, 22 bp, Homo sapiens
attgtatttgtacaagacatgt

SEQ ID NO: 7044073 - DNA, 22 bp, Homo sapiens
agatacaactgtttaaacatta

SEQ ID NO: 7044074 - DNA, 22 bp, Homo sapiens
atttctttctggccacggtttt

SEQ ID NO: 7044075 - DNA, 23 bp, Homo sapiens
atttgaaactttcttgtttccag

SEQ ID NO: 7044076 - DNA, 22 bp, Homo sapiens
agatttaaatttgctacaattc

SEQ ID NO: 7044077 - DNA, 22 bp, Homo sapiens
attttgtgggttctgctgatgt

SEQ ID NO: 7044078 - DNA, 22 bp, Homo sapiens
attttttagccaagactctgca

SEQ ID NO: 7044079 - DNA, 22 bp, Homo sapiens
attttttagccaagactctgca

SEQ ID NO: 7044080 - DNA, 22 bp, Homo sapiens
attttttatataccaaggtggg

SEQ ID NO: 7044081 - DNA, 22 bp, Homo sapiens
agagccagccttctcagcttac

SEQ ID NO: 7044082 - DNA, 22 bp, Homo sapiens
agagccagcatttgggccctgc

SEQ ID NO: 7044083 - DNA, 22 bp, Homo sapiens
atgtgcatgtgcacacatgcgt

SEQ ID NO: 7044084 - DNA, 22 bp, Homo sapiens
agagccagcatttgacactggc

SEQ ID NO: 7044085 - DNA, 22 bp, Homo sapiens
agagccaggactgtgtctcact

SEQ ID NO: 7044086 - DNA, 22 bp, Homo sapiens
atgttacacataggcataaatg

SEQ ID NO: 7044087 - DNA, 22 bp, Homo sapiens
atgttacagaaagcaaagatga

SEQ ID NO: 7044088 - DNA, 22 bp, Homo sapiens
atgtgcaggatccaggctccta

SEQ ID NO: 7044089 - DNA, 22 bp, Homo sapiens
atggacacatgagttacgattg

SEQ ID NO: 7044090 - DNA, 22 bp, Homo sapiens
atgggcagttaggaggccagga

SEQ ID NO: 7044091 - DNA, 23 bp, Homo sapiens
atgggccaagcaagacccatgac

SEQ ID NO: 7044092 - DNA, 22 bp, Homo sapiens
atgggctcggcgctgctgggat

SEQ ID NO: 7044093 - DNA, 22 bp, Homo sapiens
atgggctctatgtctaggagat

SEQ ID NO: 7044094 - DNA, 22 bp, Homo sapiens
atgtataatgctaattagctag

SEQ ID NO: 7044095 - DNA, 22 bp, Homo sapiens
atgtataggagttatctgttgt

SEQ ID NO: 7044096 - DNA, 22 bp, Homo sapiens
atgtatatgaagctagtatttt

SEQ ID NO: 7044097 - DNA, 22 bp, Homo sapiens
atgctgataggagttaatggtg

SEQ ID NO: 7044098 - DNA, 22 bp, Homo sapiens
agagaacacgtgcatctgcaat

SEQ ID NO: 7044099 - DNA, 22 bp, Homo sapiens
atgccaggagatggagcagagt

SEQ ID NO: 7044100 - DNA, 22 bp, Homo sapiens
atgccactgcactccagcctag

SEQ ID NO: 7044101 - DNA, 22 bp, Homo sapiens
atgccagaagccaaaaaatatt

SEQ ID NO: 7044102 - DNA, 22 bp, Homo sapiens
atgcaaattgccataaagtggg

SEQ ID NO: 7044103 - DNA, 21 bp, Homo sapiens
atcttaaaaggtcttaacttt

SEQ ID NO: 7044104 - DNA, 22 bp, Homo sapiens
atcttagggttctgtttttaag

SEQ ID NO: 7044105 - DNA, 22 bp, Homo sapiens
atgacaatacttcaataagctg

SEQ ID NO: 7044106 - DNA, 22 bp, Homo sapiens
atgaccagactctcagtggggt

SEQ ID NO: 7044107 - DNA, 22 bp, Homo sapiens
atgactttgttgttttccagcg

SEQ ID NO: 7044108 - DNA, 22 bp, Homo sapiens
atgaggcaaaggtggaggtggg

SEQ ID NO: 7044109 - DNA, 22 bp, Homo sapiens
atgaggcaatcatggtccagtt

SEQ ID NO: 7044110 - DNA, 22 bp, Homo sapiens
atgattctcattttactgtgat

SEQ ID NO: 7044111 - DNA, 20 bp, Homo sapiens
atgattctgggctacactgg

SEQ ID NO: 7044112 - DNA, 22 bp, Homo sapiens
atgattttctgataaagaactg

SEQ ID NO: 7044113 - DNA, 22 bp, Homo sapiens
atgattttctgataaagaactg

SEQ ID NO: 7044114 - DNA, 22 bp, Homo sapiens
atgattttctgataaagaactg

SEQ ID NO: 7044115 - DNA, 22 bp, Homo sapiens
atgcaaatgtcaccacttctaa

SEQ ID NO: 7044116 - DNA, 22 bp, Homo sapiens
atgcaaatgtttaagttactat

SEQ ID NO: 7044117 - DNA, 22 bp, Homo sapiens
atcctgcagggggttttattca

SEQ ID NO: 7044118 - DNA, 22 bp, Homo sapiens
agaaatgtattctgtatgtttt

SEQ ID NO: 7044119 - DNA, 22 bp, Homo sapiens
agaaatgtgaatttcatttcct

SEQ ID NO: 7044120 - DNA, 22 bp, Homo sapiens
agaaatgttacagttgttattt

SEQ ID NO: 7044121 - DNA, 22 bp, Homo sapiens
atatagaaggtgctatttacat

SEQ ID NO: 7044122 - DNA, 19 bp, Homo sapiens
atatagcattattcaattt

SEQ ID NO: 7044123 - DNA, 22 bp, Homo sapiens
agaaagaacgttggttatctta

SEQ ID NO: 7044124 - DNA, 22 bp, Homo sapiens
atattacacacggtatcacggg

SEQ ID NO: 7044125 - DNA, 22 bp, Homo sapiens
agaaagtttgtttttatccata

SEQ ID NO: 7044126 - DNA, 22 bp, Homo sapiens
agaaagttttgtgctatatatg

SEQ ID NO: 7044127 - DNA, 22 bp, Homo sapiens
atagctttacagaagagtttag

SEQ ID NO: 7044128 - DNA, 22 bp, Homo sapiens
atagctttacagaagagtttag

SEQ ID NO: 7044129 - DNA, 22 bp, Homo sapiens
atagctttcttaaatatataaa

SEQ ID NO: 7044130 - DNA, 22 bp, Homo sapiens
atagttatttctgtcactgtca

SEQ ID NO: 7044131 - DNA, 22 bp, Homo sapiens
atagttgagatcagattcaact

SEQ ID NO: 7044132 - DNA, 22 bp, Homo sapiens
agaaaaggattgatggatcaga

SEQ ID NO: 7044133 - DNA, 22 bp, Homo sapiens
atacactgatctttttatgggg

SEQ ID NO: 7044134 - DNA, 22 bp, Homo sapiens
atacactgctgccacacagctg

SEQ ID NO: 7044135 - DNA, 22 bp, Homo sapiens
atacacttccaaatattgatta

SEQ ID NO: 7044136 - DNA, 22 bp, Homo sapiens
atagaactcgggctttggaatc

SEQ ID NO: 7044137 - DNA, 20 bp, Homo sapiens
actttacagagaagactgac

SEQ ID NO: 7044138 - DNA, 22 bp, Homo sapiens
actttactcaacaaatatttat

SEQ ID NO: 7044139 - DNA, 22 bp, Homo sapiens
agttcactccagatgttctgac

SEQ ID NO: 7044140 - DNA, 22 bp, Homo sapiens
agttcactctttatgagaaagt

SEQ ID NO: 7044141 - DNA, 22 bp, Homo sapiens
agttcactgcttaagcctttga

SEQ ID NO: 7044142 - DNA, 22 bp, Homo sapiens
agttctttgcatagatttggct

SEQ ID NO: 7044143 - DNA, 22 bp, Homo sapiens
agttctttgtcatctctggagt

SEQ ID NO: 7044144 - DNA, 22 bp, Homo sapiens
ataaattttcttgctgtactta

SEQ ID NO: 7044145 - DNA, 22 bp, Homo sapiens
ataaattttcttgctgtactta

SEQ ID NO: 7044146 - DNA, 22 bp, Homo sapiens
ataacagacttagagttacaag

SEQ ID NO: 7044147 - DNA, 22 bp, Homo sapiens
ataacagagagctactgaactg

SEQ ID NO: 7044148 - DNA, 22 bp, Homo sapiens
atacaaagacaaatctcaatct

SEQ ID NO: 7044149 - DNA, 20 bp, Homo sapiens
atacaaagagattgatgtat

SEQ ID NO: 7044150 - DNA, 17 bp, Homo sapiens
atacaaagccataaacc

SEQ ID NO: 7044151 - DNA, 22 bp, Homo sapiens
atacacagccattatgaattag

SEQ ID NO: 7044152 - DNA, 22 bp, Homo sapiens
atacacagctacattgaacaat

SEQ ID NO: 7044153 - DNA, 19 bp, Homo sapiens
atacacgtgtatacataca

SEQ ID NO: 7044154 - DNA, 22 bp, Homo sapiens
agttacaactgtttgaatgtca

SEQ ID NO: 7044155 - DNA, 22 bp, Homo sapiens
agttacaagtacaggctttgga

SEQ ID NO: 7044156 - DNA, 22 bp, Homo sapiens
agttaccatatatcaaacatgg

SEQ ID NO: 7044157 - DNA, 22 bp, Homo sapiens
agttattttggaaaatgagtca

SEQ ID NO: 7044158 - DNA, 22 bp, Homo sapiens
agttcaattgttttgtaaaagt

SEQ ID NO: 7044159 - DNA, 22 bp, Homo sapiens
agtgggggccaacgagggcagc

SEQ ID NO: 7044160 - DNA, 21 bp, Homo sapiens
agtggggtctctgtggaggcc

SEQ ID NO: 7044161 - DNA, 22 bp, Homo sapiens
agtgggaggcggctgacgggcg

SEQ ID NO: 7044162 - DNA, 22 bp, Homo sapiens
agtgggagcggcagtcggggac

SEQ ID NO: 7044163 - DNA, 22 bp, Homo sapiens
agtgggagccagcagcttgggg

SEQ ID NO: 7044164 - DNA, 20 bp, Homo sapiens
agtgggagagggcagactgc

SEQ ID NO: 7044165 - DNA, 22 bp, Homo sapiens
agtaacatgagtttttctaatg

SEQ ID NO: 7044166 - DNA, 22 bp, Homo sapiens
agtaagtgagtcactgtgctgg

SEQ ID NO: 7044167 - DNA, 22 bp, Homo sapiens
agtaagtgcagaaaagatgtgg

SEQ ID NO: 7044168 - DNA, 17 bp, Homo sapiens
agtaagtgtgtcacttc

SEQ ID NO: 7044169 - DNA, 22 bp, Homo sapiens
agggtcagtgatgagggagccc

SEQ ID NO: 7044170 - DNA, 22 bp, Homo sapiens
agggtcagttctgtgaggtgtt

SEQ ID NO: 7044171 - DNA, 22 bp, Homo sapiens
aggtggggttcagtctcagccg

SEQ ID NO: 7044172 - DNA, 22 bp, Homo sapiens
aggtgggttccgcggcggcccg

SEQ ID NO: 7044173 - DNA, 22 bp, Homo sapiens
agggctcactacaaccctggga

SEQ ID NO: 7044174 - DNA, 22 bp, Homo sapiens
agggctcactgggaggctataa

SEQ ID NO: 7044175 - DNA, 22 bp, Homo sapiens
agggctcactgggaggctataa

SEQ ID NO: 7044176 - DNA, 22 bp, Homo sapiens
agggctcagaaagcaggttttc

SEQ ID NO: 7044177 - DNA, 22 bp, Homo sapiens
agggctcagaaatgtctacggg

SEQ ID NO: 7044178 - DNA, 22 bp, Homo sapiens
agggctcagaacaatgagtgta

SEQ ID NO: 7044179 - DNA, 22 bp, Homo sapiens
agggctcagagcaaaagggcac

SEQ ID NO: 7044180 - DNA, 22 bp, Homo sapiens
agggctcagagtagttcggttt

SEQ ID NO: 7044181 - DNA, 22 bp, Homo sapiens
agggctcagcatctcattctgt

SEQ ID NO: 7044182 - DNA, 22 bp, Homo sapiens
agggctcagccagcctgtgtgc

SEQ ID NO: 7044183 - DNA, 22 bp, Homo sapiens
agggctcagcctcctcctcagc

SEQ ID NO: 7044184 - DNA, 22 bp, Homo sapiens
agggctcagggcacgtcatcca

SEQ ID NO: 7044185 - DNA, 22 bp, Homo sapiens
agggctcaggggccccaagctg

SEQ ID NO: 7044186 - DNA, 22 bp, Homo sapiens
agggctcagggtcaccatctgt

SEQ ID NO: 7044187 - DNA, 22 bp, Homo sapiens
agggctcagtaaacggtggatt

SEQ ID NO: 7044188 - DNA, 22 bp, Homo sapiens
agggctcagttgcctggagccc

SEQ ID NO: 7044189 - DNA, 22 bp, Homo sapiens
agggctgaagggaggtgctcat

SEQ ID NO: 7044190 - DNA, 22 bp, Homo sapiens
agggctgacaaatggcagtgac

SEQ ID NO: 7044191 - DNA, 22 bp, Homo sapiens
aggggccatgtaagtgtatcac

SEQ ID NO: 7044192 - DNA, 22 bp, Homo sapiens
aggggtgatttgggacaggaca

SEQ ID NO: 7044193 - DNA, 23 bp, Homo sapiens
aggggtggtcagtacccgcagtg

SEQ ID NO: 7044194 - DNA, 22 bp, Homo sapiens
agggccagtgggttgaaaggca

SEQ ID NO: 7044195 - DNA, 22 bp, Homo sapiens
agggccagtcgtgtattactgt

SEQ ID NO: 7044196 - DNA, 22 bp, Homo sapiens
agggccagttcagaggacatgg

SEQ ID NO: 7044197 - DNA, 22 bp, Homo sapiens
agggccagccccaccctctctg

SEQ ID NO: 7044198 - DNA, 22 bp, Homo sapiens
agggccagtaccaggtgggtgg

SEQ ID NO: 7044199 - DNA, 22 bp, Homo sapiens
agggccagtattaaggtaatta

SEQ ID NO: 7044200 - DNA, 22 bp, Homo sapiens
agggccagttctacctctgaat

SEQ ID NO: 7044201 - DNA, 22 bp, Homo sapiens
agggctcaagaaagtgtacctc

SEQ ID NO: 7044202 - DNA, 22 bp, Homo sapiens
agggctcaagggcatgctacgt

SEQ ID NO: 7044203 - DNA, 22 bp, Homo sapiens
agggctcaatggtgggcatgta

SEQ ID NO: 7044204 - DNA, 22 bp, Homo sapiens
agggctcaccactgtgcactcc

SEQ ID NO: 7044205 - DNA, 22 bp, Homo sapiens
agggccagcagcttggccaacc

SEQ ID NO: 7044206 - DNA, 22 bp, Homo sapiens
agggccagccaggccctacaaa

SEQ ID NO: 7044207 - DNA, 22 bp, Homo sapiens
agggccagcccataatgccaaa

SEQ ID NO: 7044208 - DNA, 22 bp, Homo sapiens
agggccagcactcctggcagga

SEQ ID NO: 7044209 - DNA, 22 bp, Homo sapiens
agggccagatgaagccacaagc

SEQ ID NO: 7044210 - DNA, 22 bp, Homo sapiens
agggcactccttggcagctctg

SEQ ID NO: 7044211 - DNA, 22 bp, Homo sapiens
agggcactctgcagggaccacc

SEQ ID NO: 7044212 - DNA, 22 bp, Homo sapiens
agggcactgaacagctgtagca

SEQ ID NO: 7044213 - DNA, 23 bp, Homo sapiens
agggcactgaagctggaattggg

SEQ ID NO: 7044214 - DNA, 22 bp, Homo sapiens
agggcactgcaagggttgaagg

SEQ ID NO: 7044215 - DNA, 22 bp, Homo sapiens
agggcactggcttgcaaactca

SEQ ID NO: 7044216 - DNA, 22 bp, Homo sapiens
agggaggcattagctactgcga

SEQ ID NO: 7044217 - DNA, 19 bp, Homo sapiens
aggctgtgagggaggactc

SEQ ID NO: 7044218 - DNA, 22 bp, Homo sapiens
accagaaaggaataatagaatt

SEQ ID NO: 7044219 - DNA, 23 bp, Homo sapiens
aggctgcagaagaatagggtcat

SEQ ID NO: 7044220 - DNA, 22 bp, Homo sapiens
acatgtcttgtggctttgatct

SEQ ID NO: 7044221 - DNA, 22 bp, Homo sapiens
acatatatgtgcacatgtgcag

SEQ ID NO: 7044222 - DNA, 22 bp, Homo sapiens
acatatattactagtaaagaca

SEQ ID NO: 7044223 - DNA, 22 bp, Homo sapiens
aggcaggtgggtcacttgagtc

SEQ ID NO: 7044224 - DNA, 22 bp, Homo sapiens
aggcaggtgttgggagacacca

SEQ ID NO: 7044225 - DNA, 22 bp, Homo sapiens
acagtggcagtattagggcaga

SEQ ID NO: 7044226 - DNA, 22 bp, Homo sapiens
acagtggcagtcgtgttctcta

SEQ ID NO: 7044227 - DNA, 22 bp, Homo sapiens
acagtggctcatgcctgtcatc

SEQ ID NO: 7044228 - DNA, 22 bp, Homo sapiens
aggaggcaggaagtctatggga

SEQ ID NO: 7044229 - DNA, 20 bp, Homo sapiens
aggaggcatagtctggaaag

SEQ ID NO: 7044230 - DNA, 20 bp, Homo sapiens
aggaggcatgaggggattta

SEQ ID NO: 7044231 - DNA, 22 bp, Homo sapiens
acagggctatattcctcagagc

SEQ ID NO: 7044232 - DNA, 23 bp, Homo sapiens
acagggctagctgacagtggtat

SEQ ID NO: 7044233 - DNA, 22 bp, Homo sapiens
aggaaataggaccagacaaagc

SEQ ID NO: 7044234 - DNA, 22 bp, Homo sapiens
acagcattccctttggctgctt

SEQ ID NO: 7044235 - DNA, 22 bp, Homo sapiens
ccagccctcggtagtcccatag

SEQ ID NO: 7044236 - DNA, 22 bp, Homo sapiens
aggccctgctgaggcctccctc

SEQ ID NO: 7044237 - DNA, 22 bp, Homo sapiens
ccagcaggcagtcatatccttt

SEQ ID NO: 7044238 - DNA, 22 bp, Homo sapiens
ccagccagatgataagctctat

SEQ ID NO: 7044239 - DNA, 22 bp, Homo sapiens
ccagaggatgctggtcagcctc

SEQ ID NO: 7044240 - DNA, 22 bp, Homo sapiens
ccagaggtggaagattgttttg

SEQ ID NO: 7044241 - DNA, 22 bp, Homo sapiens
ccagaggtgggagtgatctggt

SEQ ID NO: 7044242 - DNA, 22 bp, Homo sapiens
ccagaggtggtcatagaaagca

SEQ ID NO: 7044243 - DNA, 22 bp, Homo sapiens
ccagaggtggtgggtgctacag

SEQ ID NO: 7044244 - DNA, 22 bp, Homo sapiens
ccagaggtggtggtgtctagaa

SEQ ID NO: 7044245 - DNA, 22 bp, Homo sapiens
ccagaggttacaccctcagccc

SEQ ID NO: 7044246 - DNA, 22 bp, Homo sapiens
ccagaggttactttgccttgga

SEQ ID NO: 7044247 - DNA, 22 bp, Homo sapiens
ccagaggttccaggctagggag

SEQ ID NO: 7044248 - DNA, 21 bp, Homo sapiens
ccagaggttctgggcctccct

SEQ ID NO: 7044249 - DNA, 19 bp, Homo sapiens
ccagaggtttgctgggcct

SEQ ID NO: 7044250 - DNA, 22 bp, Homo sapiens
ccaggaggtctgagtgtggaca

SEQ ID NO: 7044251 - DNA, 22 bp, Homo sapiens
ccaggaggtggagattgcagtg

SEQ ID NO: 7044252 - DNA, 22 bp, Homo sapiens
ccaggaggtggcaggacttgcc

SEQ ID NO: 7044253 - DNA, 22 bp, Homo sapiens
ccagctcccctcagcaggtaat

SEQ ID NO: 7044254 - DNA, 22 bp, Homo sapiens
aggcctgggtgttcaccagaag

SEQ ID NO: 7044255 - DNA, 21 bp, Homo sapiens
aggctcagagagaaactcttg

SEQ ID NO: 7044256 - DNA, 22 bp, Homo sapiens
aggctcagaggtgagcatctgc

SEQ ID NO: 7044257 - DNA, 22 bp, Homo sapiens
cccacctctcagagagccttgc

SEQ ID NO: 7044258 - DNA, 22 bp, Homo sapiens
aggctgtgcattttggagggcc

SEQ ID NO: 7044259 - DNA, 22 bp, Homo sapiens
aggctgtggtgctgaaggaggg

SEQ ID NO: 7044260 - DNA, 22 bp, Homo sapiens
cccagaggtgacatcccattct

SEQ ID NO: 7044261 - DNA, 22 bp, Homo sapiens
cccagaggttccttagggacca

SEQ ID NO: 7044262 - DNA, 20 bp, Homo sapiens
cccagaggttgcggcaggag

SEQ ID NO: 7044263 - DNA, 22 bp, Homo sapiens
aggctgtgggacagttaggaga

SEQ ID NO: 7044264 - DNA, 22 bp, Homo sapiens
aggctgcagaggtgctgccaga

SEQ ID NO: 7044265 - DNA, 22 bp, Homo sapiens
aggctgcagcttgtctcgtggg

SEQ ID NO: 7044266 - DNA, 22 bp, Homo sapiens
aggctgcaggtctgggtcatgt

SEQ ID NO: 7044267 - DNA, 22 bp, Homo sapiens
cccctgccagctatccctgaac

SEQ ID NO: 7044268 - DNA, 21 bp, Homo sapiens
cccctgggagccctgtcagta

SEQ ID NO: 7044269 - DNA, 21 bp, Homo sapiens
cccctgggagccctgtcagta

SEQ ID NO: 7044270 - DNA, 22 bp, Homo sapiens
agggcagactaggatggaagtg

SEQ ID NO: 7044271 - DNA, 22 bp, Homo sapiens
agggcactttacccatagcttg

SEQ ID NO: 7044272 - DNA, 20 bp, Homo sapiens
agggcacttttgctggagca

SEQ ID NO: 7044273 - DNA, 23 bp, Homo sapiens
agggccaggtgcggaaacagctc

SEQ ID NO: 7044274 - DNA, 22 bp, Homo sapiens
agggccagtaaatgtttcctca

SEQ ID NO: 7044275 - DNA, 22 bp, Homo sapiens
agggcccaccttggtgctgagg

SEQ ID NO: 7044276 - DNA, 22 bp, Homo sapiens
agggcccagcagcatttcagtg

SEQ ID NO: 7044277 - DNA, 20 bp, Homo sapiens
agggcccaggaagagagtta

SEQ ID NO: 7044278 - DNA, 22 bp, Homo sapiens
agggcccaggacagcatcaggg

SEQ ID NO: 7044279 - DNA, 22 bp, Homo sapiens
cccctggggatcagctggaatt

SEQ ID NO: 7044280 - DNA, 22 bp, Homo sapiens
cccctgggtccaggcttctctg

SEQ ID NO: 7044281 - DNA, 22 bp, Homo sapiens
agggacagttacatcatcagac

SEQ ID NO: 7044282 - DNA, 22 bp, Homo sapiens
agggacccatagagagaccagt

SEQ ID NO: 7044283 - DNA, 22 bp, Homo sapiens
agggacctcttcttgcagctga

SEQ ID NO: 7044284 - DNA, 22 bp, Homo sapiens
agggggtgtctctgattgggtt

SEQ ID NO: 7044285 - DNA, 22 bp, Homo sapiens
agggggtgggaagtctagaatc

SEQ ID NO: 7044286 - DNA, 22 bp, Homo sapiens
aggggtgaaggcccgataggag

SEQ ID NO: 7044287 - DNA, 22 bp, Homo sapiens
agggggctcctccggtgcttcc

SEQ ID NO: 7044288 - DNA, 22 bp, Homo sapiens
agggggctgccaaggaatgtaa

SEQ ID NO: 7044289 - DNA, 22 bp, Homo sapiens
agggggctggagacacctcctc

SEQ ID NO: 7044290 - DNA, 22 bp, Homo sapiens
agggggctggagacacctcctc

SEQ ID NO: 7044291 - DNA, 22 bp, Homo sapiens
agggggtgaatgtctgtctaca

SEQ ID NO: 7044292 - DNA, 22 bp, Homo sapiens
cctctgttgaaaattacaaaca

SEQ ID NO: 7044293 - DNA, 20 bp, Homo sapiens
cctctgtttacaacacaccc

SEQ ID NO: 7044294 - DNA, 22 bp, Homo sapiens
aggggaaggccagcctgtagag

SEQ ID NO: 7044295 - DNA, 22 bp, Homo sapiens
aggggctgactggaaagtgcca

SEQ ID NO: 7044296 - DNA, 22 bp, Homo sapiens
aggggctgactggaaagtgcca

SEQ ID NO: 7044297 - DNA, 22 bp, Homo sapiens
aggggctgcctggcttggcact

SEQ ID NO: 7044298 - DNA, 22 bp, Homo sapiens
agggcccatgtgggagcacttg

SEQ ID NO: 7044299 - DNA, 22 bp, Homo sapiens
agggcccatgtcgggcgctctg

SEQ ID NO: 7044300 - DNA, 22 bp, Homo sapiens
agggcccatagatcgtcagctt

SEQ ID NO: 7044301 - DNA, 22 bp, Homo sapiens
agggcccagtggagagctgagc

SEQ ID NO: 7044302 - DNA, 22 bp, Homo sapiens
agggcccagtggagagctgagc

SEQ ID NO: 7044303 - DNA, 22 bp, Homo sapiens
cctacagagcagcaggaccaga

SEQ ID NO: 7044304 - DNA, 22 bp, Homo sapiens
cctacagttatattcttgattg

SEQ ID NO: 7044305 - DNA, 22 bp, Homo sapiens
agggctcttcctttgcctctca

SEQ ID NO: 7044306 - DNA, 20 bp, Homo sapiens
agggctgagaagggactagc

SEQ ID NO: 7044307 - DNA, 22 bp, Homo sapiens
agggctgagcccaggcatgtag

SEQ ID NO: 7044308 - DNA, 22 bp, Homo sapiens
agggctgaggcgagggagatgc

SEQ ID NO: 7044309 - DNA, 21 bp, Homo sapiens
aggagccagcctgtcagtcta

SEQ ID NO: 7044310 - DNA, 22 bp, Homo sapiens
aggagccagcgttcctcaggat

SEQ ID NO: 7044311 - DNA, 22 bp, Homo sapiens
aggagccagcgttcctcaggat

SEQ ID NO: 7044312 - DNA, 22 bp, Homo sapiens
aggagccagaatccagactcgg

SEQ ID NO: 7044313 - DNA, 23 bp, Homo sapiens
aggagccaggaaccagcttcccc

SEQ ID NO: 7044314 - DNA, 22 bp, Homo sapiens
aggagccaggccccatggggct

SEQ ID NO: 7044315 - DNA, 22 bp, Homo sapiens
aggagccaggccccatggggct

SEQ ID NO: 7044316 - DNA, 23 bp, Homo sapiens
aggagccaggtgcagcccttgtg

SEQ ID NO: 7044317 - DNA, 22 bp, Homo sapiens
aggagccacctaggagctgttt

SEQ ID NO: 7044318 - DNA, 22 bp, Homo sapiens
aggagccagttccaccccagga

SEQ ID NO: 7044319 - DNA, 22 bp, Homo sapiens
aggagccatccccatgagaggt

SEQ ID NO: 7044320 - DNA, 22 bp, Homo sapiens
cagttttattggttgaaatctg

SEQ ID NO: 7044321 - DNA, 22 bp, Homo sapiens
cataatatactacattgatgaa

SEQ ID NO: 7044322 - DNA, 22 bp, Homo sapiens
aggaggctgcaaccctgaggcc

SEQ ID NO: 7044323 - DNA, 22 bp, Homo sapiens
catacaaatgtgtccaggctct

SEQ ID NO: 7044324 - DNA, 22 bp, Homo sapiens
aggatgtcagtcagcttggatt

SEQ ID NO: 7044325 - DNA, 22 bp, Homo sapiens
aggatgtccacccagaccttgc

SEQ ID NO: 7044326 - DNA, 19 bp, Homo sapiens
cattcctttgtctgccaaa

SEQ ID NO: 7044327 - DNA, 22 bp, Homo sapiens
cattgcacttctgcttttcctc

SEQ ID NO: 7044328 - DNA, 20 bp, Homo sapiens
cattgcatatttcattgagg

SEQ ID NO: 7044329 - DNA, 22 bp, Homo sapiens
cattgctgtgggcatttgctgc

SEQ ID NO: 7044330 - DNA, 22 bp, Homo sapiens
cattggaaaatgcatgcttttt

SEQ ID NO: 7044331 - DNA, 22 bp, Homo sapiens
catttctcctgggtgataaatt

SEQ ID NO: 7044332 - DNA, 22 bp, Homo sapiens
catttctgtcacgttcttttat

SEQ ID NO: 7044333 - DNA, 22 bp, Homo sapiens
catttctgtgacacttccatct

SEQ ID NO: 7044334 - DNA, 22 bp, Homo sapiens
aggcaggaaccctgtgtgcgcc

SEQ ID NO: 7044335 - DNA, 22 bp, Homo sapiens
aggcaggagcaagccctacaag

SEQ ID NO: 7044336 - DNA, 22 bp, Homo sapiens
aggcaggaggatcatggatgca

SEQ ID NO: 7044337 - DNA, 18 bp, Homo sapiens
aggcaggatcctggcctc

SEQ ID NO: 7044338 - DNA, 22 bp, Homo sapiens
ccacagttattcatttgtgaca

SEQ ID NO: 7044339 - DNA, 22 bp, Homo sapiens
ccacagtttgccagccaggaat

SEQ ID NO: 7044340 - DNA, 22 bp, Homo sapiens
ccaccaggctctgtccgagcgg

SEQ ID NO: 7044341 - DNA, 18 bp, Homo sapiens
ccacccagggggagagga

SEQ ID NO: 7044342 - DNA, 22 bp, Homo sapiens
aggaagaaacctactagagttt

SEQ ID NO: 7044343 - DNA, 22 bp, Homo sapiens
caggtgggccatgaaaaatgac

SEQ ID NO: 7044344 - DNA, 22 bp, Homo sapiens
cagtaaattatctcatctctgt

SEQ ID NO: 7044345 - DNA, 22 bp, Homo sapiens
cagtatgtccttcctcgttggc

SEQ ID NO: 7044346 - DNA, 22 bp, Homo sapiens
cagtatttcattcagaattgtt

SEQ ID NO: 7044347 - DNA, 22 bp, Homo sapiens
cagtatttcctcttcttaactt

SEQ ID NO: 7044348 - DNA, 22 bp, Homo sapiens
caggcccatgagggcagccaca

SEQ ID NO: 7044349 - DNA, 22 bp, Homo sapiens
caggcccatttgtagccacttt

SEQ ID NO: 7044350 - DNA, 22 bp, Homo sapiens
caggagcaaggagcagtgggat

SEQ ID NO: 7044351 - DNA, 22 bp, Homo sapiens
caggagcagagggtggtcagca

SEQ ID NO: 7044352 - DNA, 18 bp, Homo sapiens
caggagcaggagttgaac

SEQ ID NO: 7044353 - DNA, 22 bp, Homo sapiens
caggcacacagggaatttggct

SEQ ID NO: 7044354 - DNA, 22 bp, Homo sapiens
caggcagagttagagcaactgg

SEQ ID NO: 7044355 - DNA, 22 bp, Homo sapiens
cctgtgccaaaatctaggcagt

SEQ ID NO: 7044356 - DNA, 22 bp, Homo sapiens
aggtggggaggagtgtctcttt

SEQ ID NO: 7044357 - DNA, 22 bp, Homo sapiens
aggtggggagtatatgtaattg

SEQ ID NO: 7044358 - DNA, 22 bp, Homo sapiens
aggtggggccaaatgctacagt

SEQ ID NO: 7044359 - DNA, 22 bp, Homo sapiens
aggtggggcccaccaatttgca

SEQ ID NO: 7044360 - DNA, 22 bp, Homo sapiens
cctgggctttcggcggcttcct

SEQ ID NO: 7044361 - DNA, 22 bp, Homo sapiens
cctgggctttcaaaaccagcct

SEQ ID NO: 7044362 - DNA, 22 bp, Homo sapiens
cctgggctttgagggcaggatg

SEQ ID NO: 7044363 - DNA, 20 bp, Homo sapiens
cctgggctccaggagccccg

SEQ ID NO: 7044364 - DNA, 22 bp, Homo sapiens
cctgggctcgcgcacttcaccc

SEQ ID NO: 7044365 - DNA, 22 bp, Homo sapiens
cctgggcttctgtctagatgtt

SEQ ID NO: 7044366 - DNA, 22 bp, Homo sapiens
cctgggcttgcatctgtgctgg

SEQ ID NO: 7044367 - DNA, 22 bp, Homo sapiens
cctgggcttgcatctgtgctgg

SEQ ID NO: 7044368 - DNA, 22 bp, Homo sapiens
cctgggcttggttgttgagaac

SEQ ID NO: 7044369 - DNA, 22 bp, Homo sapiens
cctgggctcaagtgatggtccc

SEQ ID NO: 7044370 - DNA, 22 bp, Homo sapiens
cctgggctcacagccaaggctc

SEQ ID NO: 7044371 - DNA, 22 bp, Homo sapiens
cctgggctcaccatgccttgga

SEQ ID NO: 7044372 - DNA, 22 bp, Homo sapiens
cctgggctcaggcttgggcagc

SEQ ID NO: 7044373 - DNA, 22 bp, Homo sapiens
cctgggctccactccaagagca

SEQ ID NO: 7044374 - DNA, 22 bp, Homo sapiens
cgcaggggaggaaggtacacct

SEQ ID NO: 7044375 - DNA, 20 bp, Homo sapiens
cggctcagcctctccctccc

SEQ ID NO: 7044376 - DNA, 22 bp, Homo sapiens
cgggcactcagggtcgaggtgg

SEQ ID NO: 7044377 - DNA, 22 bp, Homo sapiens
cgggcactccagcagaaatctt

SEQ ID NO: 7044378 - DNA, 22 bp, Homo sapiens
cgggcactccatatccacactg

SEQ ID NO: 7044379 - DNA, 22 bp, Homo sapiens
cgggcactgccaggcttcccag

SEQ ID NO: 7044380 - DNA, 22 bp, Homo sapiens
cgggcactgcctttgttgattt

SEQ ID NO: 7044381 - DNA, 22 bp, Homo sapiens
cgggcactttgaaaatccattt

SEQ ID NO: 7044382 - DNA, 17 bp, Homo sapiens
cgggcatggagggcagg

SEQ ID NO: 7044383 - DNA, 22 bp, Homo sapiens
cgggctcagccagcccattctt

SEQ ID NO: 7044384 - DNA, 22 bp, Homo sapiens
cgggctcagcccggcccctcgc

SEQ ID NO: 7044385 - DNA, 22 bp, Homo sapiens
cgggctcagctccacccacccc

SEQ ID NO: 7044386 - DNA, 22 bp, Homo sapiens
cgggctcaggaggaaacaggag

SEQ ID NO: 7044387 - DNA, 22 bp, Homo sapiens
agtacacaagacacatttaaaa

SEQ ID NO: 7044388 - DNA, 22 bp, Homo sapiens
agtatgtcagagtgaaaatggt

SEQ ID NO: 7044389 - DNA, 22 bp, Homo sapiens
agtatttagagacacaagatgg

SEQ ID NO: 7044390 - DNA, 22 bp, Homo sapiens
agtatttagctgactcgctaca

SEQ ID NO: 7044391 - DNA, 22 bp, Homo sapiens
ctctgggcttacctgcttcctg

SEQ ID NO: 7044392 - DNA, 22 bp, Homo sapiens
ctctggggtggaggaggctgac

SEQ ID NO: 7044393 - DNA, 18 bp, Homo sapiens
ctgaattatctcatcatt

SEQ ID NO: 7044394 - DNA, 22 bp, Homo sapiens
ctgacaaacttaattttctgaa

SEQ ID NO: 7044395 - DNA, 22 bp, Homo sapiens
ctgagaaaagctttcttataca

SEQ ID NO: 7044396 - DNA, 22 bp, Homo sapiens
ctgagaaacatatttccatcta

SEQ ID NO: 7044397 - DNA, 22 bp, Homo sapiens
agtcttatatcactatgctctg

SEQ ID NO: 7044398 - DNA, 22 bp, Homo sapiens
agtcttatggccatctctgatt

SEQ ID NO: 7044399 - DNA, 22 bp, Homo sapiens
agtcttatgtgatttatctttc

SEQ ID NO: 7044400 - DNA, 22 bp, Homo sapiens
agtcttcagagaaattaactct

SEQ ID NO: 7044401 - DNA, 22 bp, Homo sapiens
agtccccaggggatgcccacgc

SEQ ID NO: 7044402 - DNA, 22 bp, Homo sapiens
agtcctctgctgtgcgtctttg

SEQ ID NO: 7044403 - DNA, 22 bp, Homo sapiens
agtcctctggagtatgccttat

SEQ ID NO: 7044404 - DNA, 22 bp, Homo sapiens
ctccctccctacgtgagctcac

SEQ ID NO: 7044405 - DNA, 22 bp, Homo sapiens
ctcctggggccatggaaggaac

SEQ ID NO: 7044406 - DNA, 23 bp, Homo sapiens
ctcctggtgctgctatcaggggt

SEQ ID NO: 7044407 - DNA, 22 bp, Homo sapiens
agtggcagaggttgactgcagt

SEQ ID NO: 7044408 - DNA, 22 bp, Homo sapiens
agtggcagagtgcactcaggca

SEQ ID NO: 7044409 - DNA, 22 bp, Homo sapiens
ctgggctcagcaggccaaggcc

SEQ ID NO: 7044410 - DNA, 22 bp, Homo sapiens
ctgggctcagcaggccaaggcc

SEQ ID NO: 7044411 - DNA, 22 bp, Homo sapiens
ctgggcctggtagggcttgaaa

SEQ ID NO: 7044412 - DNA, 22 bp, Homo sapiens
atattcttcttgttcagactat

SEQ ID NO: 7044413 - DNA, 22 bp, Homo sapiens
atattcttgaaagatcctggta

SEQ ID NO: 7044414 - DNA, 22 bp, Homo sapiens
ctgggctgagcctgggctgtgt

SEQ ID NO: 7044415 - DNA, 22 bp, Homo sapiens
ctgggctgagctgtggaaactc

SEQ ID NO: 7044416 - DNA, 19 bp, Homo sapiens
ctgggctgaggtctgcctt

SEQ ID NO: 7044417 - DNA, 22 bp, Homo sapiens
atattatagacagagtcttctg

SEQ ID NO: 7044418 - DNA, 22 bp, Homo sapiens
atattatagacagagtcttctg

SEQ ID NO: 7044419 - DNA, 22 bp, Homo sapiens
ctgggctcttcccagatccaga

SEQ ID NO: 7044420 - DNA, 22 bp, Homo sapiens
ctgggctgaaagtgttccttga

SEQ ID NO: 7044421 - DNA, 22 bp, Homo sapiens
ctgggctgaaggctccccacac

SEQ ID NO: 7044422 - DNA, 22 bp, Homo sapiens
atatgcattaacattgtaggag

SEQ ID NO: 7044423 - DNA, 22 bp, Homo sapiens
atattataagttatttcaagtt

SEQ ID NO: 7044424 - DNA, 22 bp, Homo sapiens
atatttaaacagggtaccaata

SEQ ID NO: 7044425 - DNA, 22 bp, Homo sapiens
atatttaactggtcccaatata

SEQ ID NO: 7044426 - DNA, 22 bp, Homo sapiens
atatttaactggtcccaatata

SEQ ID NO: 7044427 - DNA, 22 bp, Homo sapiens
atatttaaacagggtaccaata

SEQ ID NO: 7044428 - DNA, 22 bp, Homo sapiens
atattcttgaagggagattata

SEQ ID NO: 7044429 - DNA, 22 bp, Homo sapiens
atattcttgtgattataaagta

SEQ ID NO: 7044430 - DNA, 20 bp, Homo sapiens
atattgcaaggaagctggat

SEQ ID NO: 7044431 - DNA, 22 bp, Homo sapiens
atattgcaatagatgcatcatt

SEQ ID NO: 7044432 - DNA, 22 bp, Homo sapiens
atattgcagggacagtctggat

SEQ ID NO: 7044433 - DNA, 22 bp, Homo sapiens
atattgcagtgtgtttatgtga

SEQ ID NO: 7044434 - DNA, 22 bp, Homo sapiens
atattgcatggctttgctggtt

SEQ ID NO: 7044435 - DNA, 22 bp, Homo sapiens
atattgcattggctggtcttga

SEQ ID NO: 7044436 - DNA, 22 bp, Homo sapiens
atcaaatcattgcattaatgtt

SEQ ID NO: 7044437 - DNA, 22 bp, Homo sapiens
atcaaattatgtgctacaagaa

SEQ ID NO: 7044438 - DNA, 22 bp, Homo sapiens
atcactttggtaccaattcagc

SEQ ID NO: 7044439 - DNA, 22 bp, Homo sapiens
ctgtggctttggggcggaggac

SEQ ID NO: 7044440 - DNA, 22 bp, Homo sapiens
ctgtggctaggaagctgtggga

SEQ ID NO: 7044441 - DNA, 22 bp, Homo sapiens
cttcattaaccaaaatgcaata

SEQ ID NO: 7044442 - DNA, 22 bp, Homo sapiens
atctgcagaggacaggcgagga

SEQ ID NO: 7044443 - DNA, 22 bp, Homo sapiens
atctgcaggaatgtgtgcagag

SEQ ID NO: 7044444 - DNA, 22 bp, Homo sapiens
cttcttatctgaaagtaatatt

SEQ ID NO: 7044445 - DNA, 22 bp, Homo sapiens
ctggctggccatgtagagatga

SEQ ID NO: 7044446 - DNA, 22 bp, Homo sapiens
atagcaatggcaacaactaagc

SEQ ID NO: 7044447 - DNA, 22 bp, Homo sapiens
atagcaattaagctccagaatt

SEQ ID NO: 7044448 - DNA, 22 bp, Homo sapiens
atagcaaatattttaatgagca

SEQ ID NO: 7044449 - DNA, 22 bp, Homo sapiens
atactacacattgactatattt

SEQ ID NO: 7044450 - DNA, 22 bp, Homo sapiens
atactacactatgcatggatgt

SEQ ID NO: 7044451 - DNA, 22 bp, Homo sapiens
atagcaaaaatgaacaaagctt

SEQ ID NO: 7044452 - DNA, 22 bp, Homo sapiens
atagcaaaaggcaccagagtga

SEQ ID NO: 7044453 - DNA, 22 bp, Homo sapiens
atagcaaactggcagcttgtgg

SEQ ID NO: 7044454 - DNA, 22 bp, Homo sapiens
atagcaaagatcacttccttga

SEQ ID NO: 7044455 - DNA, 22 bp, Homo sapiens
atagcaaagatgtcaattcccc

SEQ ID NO: 7044456 - DNA, 22 bp, Homo sapiens
atagcaaaggacaatagtcagt

SEQ ID NO: 7044457 - DNA, 22 bp, Homo sapiens
atacagtattacctgttcagga

SEQ ID NO: 7044458 - DNA, 22 bp, Homo sapiens
atacatagttctgtgaaaagta

SEQ ID NO: 7044459 - DNA, 22 bp, Homo sapiens
atacctgcagtattttattgtt

SEQ ID NO: 7044460 - DNA, 22 bp, Homo sapiens
ataccttttagacatgtagttg

SEQ ID NO: 7044461 - DNA, 22 bp, Homo sapiens
ataccttttactcattatccat

SEQ ID NO: 7044462 - DNA, 22 bp, Homo sapiens
ctggagacctctcctgagagtg

SEQ ID NO: 7044463 - DNA, 23 bp, Homo sapiens
ctgcatgtccactggtgtaaatg

SEQ ID NO: 7044464 - DNA, 22 bp, Homo sapiens
agttatcaggtgttttcatgga

SEQ ID NO: 7044465 - DNA, 22 bp, Homo sapiens
agttatcatcccttacactttg

SEQ ID NO: 7044466 - DNA, 22 bp, Homo sapiens
agttattaagtcctgttttgag

SEQ ID NO: 7044467 - DNA, 22 bp, Homo sapiens
agttatttactcctttgtctct

SEQ ID NO: 7044468 - DNA, 22 bp, Homo sapiens
agttatttcagtaacataatag

SEQ ID NO: 7044469 - DNA, 22 bp, Homo sapiens
ctgcaagatgttgtcatatgct

SEQ ID NO: 7044470 - DNA, 22 bp, Homo sapiens
ctgcaagattggaagatgcaat

SEQ ID NO: 7044471 - DNA, 22 bp, Homo sapiens
ataactttcttcacccttgctg

SEQ ID NO: 7044472 - DNA, 22 bp, Homo sapiens
atacaaagctaaatatggtttc

SEQ ID NO: 7044473 - DNA, 22 bp, Homo sapiens
atacaaagctaaatatggtttc

SEQ ID NO: 7044474 - DNA, 22 bp, Homo sapiens
atacaaagctttctgtctggta

SEQ ID NO: 7044475 - DNA, 22 bp, Homo sapiens
atacaaaggaacacaggcatgt

SEQ ID NO: 7044476 - DNA, 22 bp, Homo sapiens
atacaaagtattaatcctggat

SEQ ID NO: 7044477 - DNA, 22 bp, Homo sapiens
atacaaagtattgatcctgagt

SEQ ID NO: 7044478 - DNA, 22 bp, Homo sapiens
atacaacagaaaatgattattc

SEQ ID NO: 7044479 - DNA, 22 bp, Homo sapiens
gacactcagtaggacttcaagg

SEQ ID NO: 7044480 - DNA, 22 bp, Homo sapiens
gacatttctagcccataaaact

SEQ ID NO: 7044481 - DNA, 22 bp, Homo sapiens
gaccacagaagccttgataggg

SEQ ID NO: 7044482 - DNA, 22 bp, Homo sapiens
gacaattaggttaagagcaaga

SEQ ID NO: 7044483 - DNA, 21 bp, Homo sapiens
gacacaaagggtagtaatggt

SEQ ID NO: 7044484 - DNA, 22 bp, Homo sapiens
gacacaaagtttgtcagaaatt

SEQ ID NO: 7044485 - DNA, 22 bp, Homo sapiens
gacaccagtaaatattcaaaag

SEQ ID NO: 7044486 - DNA, 22 bp, Homo sapiens
gacggagctggttgctgcggct

SEQ ID NO: 7044487 - DNA, 22 bp, Homo sapiens
gactacagatagccaattaagt

SEQ ID NO: 7044488 - DNA, 22 bp, Homo sapiens
atgcacagaacaattttaagag

SEQ ID NO: 7044489 - DNA, 22 bp, Homo sapiens
gaatacaaacttaaggctttac

SEQ ID NO: 7044490 - DNA, 22 bp, Homo sapiens
gaatacaaagcagaactcatac

SEQ ID NO: 7044491 - DNA, 22 bp, Homo sapiens
gaatacaaagcagaactcatac

SEQ ID NO: 7044492 - DNA, 23 bp, Homo sapiens
gaatacaaagcagatggtccagc

SEQ ID NO: 7044493 - DNA, 22 bp, Homo sapiens
gaatacaaataataccaaggtg

SEQ ID NO: 7044494 - DNA, 22 bp, Homo sapiens
gaatacaaataataccaaggtg

SEQ ID NO: 7044495 - DNA, 22 bp, Homo sapiens
gaatatttttaaagggactaat

SEQ ID NO: 7044496 - DNA, 22 bp, Homo sapiens
gacaatatagttgaatgagcaa

SEQ ID NO: 7044497 - DNA, 22 bp, Homo sapiens
atgatccaaagccacaggggca

SEQ ID NO: 7044498 - DNA, 19 bp, Homo sapiens
atgatacaggtgaaaattg

SEQ ID NO: 7044499 - DNA, 21 bp, Homo sapiens
atgatatgcttgtatttccaa

SEQ ID NO: 7044500 - DNA, 22 bp, Homo sapiens
atgatattattctagcccagag

SEQ ID NO: 7044501 - DNA, 22 bp, Homo sapiens
atgatcaagaattttgtattcc

SEQ ID NO: 7044502 - DNA, 22 bp, Homo sapiens
ctttcttctccctcaatattac

SEQ ID NO: 7044503 - DNA, 22 bp, Homo sapiens
ctttctttcgaagacgtgatta

SEQ ID NO: 7044504 - DNA, 22 bp, Homo sapiens
ctttctttcgaagacgtgatta

SEQ ID NO: 7044505 - DNA, 22 bp, Homo sapiens
cttctttaatgtatacaaaaga

SEQ ID NO: 7044506 - DNA, 22 bp, Homo sapiens
ctttccctgcttagaaggattt

SEQ ID NO: 7044507 - DNA, 22 bp, Homo sapiens
atgaaaatactgtggttgatag

SEQ ID NO: 7044508 - DNA, 22 bp, Homo sapiens
atgaaaatgtacatgtgtataa

SEQ ID NO: 7044509 - DNA, 20 bp, Homo sapiens
atgaaattcctgttttctga

SEQ ID NO: 7044510 - DNA, 23 bp, Homo sapiens
atgaacattagtttcagatattg

SEQ ID NO: 7044511 - DNA, 22 bp, Homo sapiens
ctttctgaaagacattttaact

SEQ ID NO: 7044512 - DNA, 22 bp, Homo sapiens
ctttcttaatttttaaggacac

SEQ ID NO: 7044513 - DNA, 22 bp, Homo sapiens
ctttcttatacctgtcagggcc

SEQ ID NO: 7044514 - DNA, 22 bp, Homo sapiens
atgttattttggaaaatacaaa

SEQ ID NO: 7044515 - DNA, 22 bp, Homo sapiens
atgttcttccaaatctgtaaca

SEQ ID NO: 7044516 - DNA, 22 bp, Homo sapiens
atgttcttccttcaatttggaa

SEQ ID NO: 7044517 - DNA, 22 bp, Homo sapiens
atgttcttctatctttattaaa

SEQ ID NO: 7044518 - DNA, 21 bp, Homo sapiens
atgttggaatccaaaaacatt

SEQ ID NO: 7044519 - DNA, 22 bp, Homo sapiens
gatacaaaatataaatggagag

SEQ ID NO: 7044520 - DNA, 22 bp, Homo sapiens
atgtagaagctgacagtgctgt

SEQ ID NO: 7044521 - DNA, 22 bp, Homo sapiens
atgtcattgccaagatgctaat

SEQ ID NO: 7044522 - DNA, 22 bp, Homo sapiens
atgtccttcggacaaaattctt

SEQ ID NO: 7044523 - DNA, 22 bp, Homo sapiens
atgtccttgtgagtaaatgatg

SEQ ID NO: 7044524 - DNA, 22 bp, Homo sapiens
atgtccttttatttaaagcagg

SEQ ID NO: 7044525 - DNA, 22 bp, Homo sapiens
gagggctcactgagaaagcagt

SEQ ID NO: 7044526 - DNA, 23 bp, Homo sapiens
gagggctctgagtgcttgggcca

SEQ ID NO: 7044527 - DNA, 22 bp, Homo sapiens
gagggctgaagattgtggcccc

SEQ ID NO: 7044528 - DNA, 21 bp, Homo sapiens
atgtgaaatatcatcagagca

SEQ ID NO: 7044529 - DNA, 22 bp, Homo sapiens
atgtgactccaggcagttttgt

SEQ ID NO: 7044530 - DNA, 22 bp, Homo sapiens
atggctggcatccaggtgggct

SEQ ID NO: 7044531 - DNA, 22 bp, Homo sapiens
atgggcagtaacagtggcagtc

SEQ ID NO: 7044532 - DNA, 22 bp, Homo sapiens
atgggctgaggaagctcctgag

SEQ ID NO: 7044533 - DNA, 22 bp, Homo sapiens
atgggctggcagcctgaacagc

SEQ ID NO: 7044534 - DNA, 22 bp, Homo sapiens
atggggctagacaaccagtgcc

SEQ ID NO: 7044535 - DNA, 22 bp, Homo sapiens
caaatgatacctattactaggc

SEQ ID NO: 7044536 - DNA, 22 bp, Homo sapiens
caaatactgagtttattttcaa

SEQ ID NO: 7044537 - DNA, 22 bp, Homo sapiens
caaatactgggtaagttaattt

SEQ ID NO: 7044538 - DNA, 22 bp, Homo sapiens
attttactttgtgaatattgac

SEQ ID NO: 7044539 - DNA, 22 bp, Homo sapiens
attttactttgtgaatattgac

SEQ ID NO: 7044540 - DNA, 22 bp, Homo sapiens
attttagagctccaagtacagc

SEQ ID NO: 7044541 - DNA, 22 bp, Homo sapiens
attttttagaacctggcctgat

SEQ ID NO: 7044542 - DNA, 22 bp, Homo sapiens
caaaatgttctggcacctttaa

SEQ ID NO: 7044543 - DNA, 22 bp, Homo sapiens
caaacaatttgcatttccttag

SEQ ID NO: 7044544 - DNA, 22 bp, Homo sapiens
caaacatagtgaagcaatgaca

SEQ ID NO: 7044545 - DNA, 22 bp, Homo sapiens
caaagccaggctttctaatgta

SEQ ID NO: 7044546 - DNA, 22 bp, Homo sapiens
gccaggtgagaggactgaggct

SEQ ID NO: 7044547 - DNA, 22 bp, Homo sapiens
gccaggtgcatggctgagtctc

SEQ ID NO: 7044548 - DNA, 22 bp, Homo sapiens
atttccaggagttgaggtctga

SEQ ID NO: 7044549 - DNA, 22 bp, Homo sapiens
atttccatacacccatttctga

SEQ ID NO: 7044550 - DNA, 22 bp, Homo sapiens
atttccatgaaggcagatttta

SEQ ID NO: 7044551 - DNA, 22 bp, Homo sapiens
atttccatgaagtttagttata

SEQ ID NO: 7044552 - DNA, 22 bp, Homo sapiens
atttccatgtccaaaaattagt

SEQ ID NO: 7044553 - DNA, 22 bp, Homo sapiens
atttccatgtcggtattttata

SEQ ID NO: 7044554 - DNA, 22 bp, Homo sapiens
atttccattatcatgacaaatt

SEQ ID NO: 7044555 - DNA, 22 bp, Homo sapiens
gcccacctaacctgctcacctt

SEQ ID NO: 7044556 - DNA, 22 bp, Homo sapiens
atttctgtagtccacattcttt

SEQ ID NO: 7044557 - DNA, 22 bp, Homo sapiens
atttctgtagtccacattcttt

SEQ ID NO: 7044558 - DNA, 22 bp, Homo sapiens
atttctgtatcctgctgtcaga

SEQ ID NO: 7044559 - DNA, 22 bp, Homo sapiens
atttctgtggcttcattctcct

SEQ ID NO: 7044560 - DNA, 22 bp, Homo sapiens
atttctgttgcttataaattac

SEQ ID NO: 7044561 - DNA, 22 bp, Homo sapiens
gccccctcaaagaggaagctct

SEQ ID NO: 7044562 - DNA, 22 bp, Homo sapiens
atttgccttttaaactcacaat

SEQ ID NO: 7044563 - DNA, 22 bp, Homo sapiens
atttggaaaagcggtaacttgc

SEQ ID NO: 7044564 - DNA, 22 bp, Homo sapiens
atttggaaaagtttcttcaact

SEQ ID NO: 7044565 - DNA, 22 bp, Homo sapiens
atttggaaaagtttcttcaact

SEQ ID NO: 7044566 - DNA, 22 bp, Homo sapiens
atttggaaaatctggttataga

SEQ ID NO: 7044567 - DNA, 22 bp, Homo sapiens
atttggaaaatctggttataga

SEQ ID NO: 7044568 - DNA, 22 bp, Homo sapiens
atttggaaacaaatggtttcgc

SEQ ID NO: 7044569 - DNA, 22 bp, Homo sapiens
atttggaaacaattatattctt

SEQ ID NO: 7044570 - DNA, 22 bp, Homo sapiens
atttggaaacatgctgaccatg

SEQ ID NO: 7044571 - DNA, 19 bp, Homo sapiens
atttggaaataaggtcttc

SEQ ID NO: 7044572 - DNA, 22 bp, Homo sapiens
atttggaaatacgcgcttttgg

SEQ ID NO: 7044573 - DNA, 22 bp, Homo sapiens
atttggaaatgcatctcttgag

SEQ ID NO: 7044574 - DNA, 22 bp, Homo sapiens
atttggaaatgtaagaatgcaa

SEQ ID NO: 7044575 - DNA, 22 bp, Homo sapiens
atttggaacaaatattagtaaa

SEQ ID NO: 7044576 - DNA, 22 bp, Homo sapiens
atttggaactgggcatgcaaac

SEQ ID NO: 7044577 - DNA, 22 bp, Homo sapiens
atttggaactgggcatgcaaac

SEQ ID NO: 7044578 - DNA, 22 bp, Homo sapiens
atttggaacttataataagttt

SEQ ID NO: 7044579 - DNA, 22 bp, Homo sapiens
atttggaagaaatctgtcacag

SEQ ID NO: 7044580 - DNA, 22 bp, Homo sapiens
gcctagtgcactggcagggctc

SEQ ID NO: 7044581 - DNA, 22 bp, Homo sapiens
atttggaagcatttccaaagca

SEQ ID NO: 7044582 - DNA, 22 bp, Homo sapiens
atttggaagcatttccaaagca

SEQ ID NO: 7044583 - DNA, 22 bp, Homo sapiens
atttggaagcatttccaaagca

SEQ ID NO: 7044584 - DNA, 22 bp, Homo sapiens
atttggaagcttgaagattatt

SEQ ID NO: 7044585 - DNA, 22 bp, Homo sapiens
atttggaaggagctgcacagca

SEQ ID NO: 7044586 - DNA, 22 bp, Homo sapiens
atttggaaggagctgcacagca

SEQ ID NO: 7044587 - DNA, 22 bp, Homo sapiens
atttggaaggcgtttctctgta

SEQ ID NO: 7044588 - DNA, 22 bp, Homo sapiens
atttggaaggtttacaaagaga

SEQ ID NO: 7044589 - DNA, 22 bp, Homo sapiens
atttggaaggtttacaaagaga

SEQ ID NO: 7044590 - DNA, 22 bp, Homo sapiens
atttggaagtttggagtgaagg

SEQ ID NO: 7044591 - DNA, 22 bp, Homo sapiens
atttggaagtttggagtgaagg

SEQ ID NO: 7044592 - DNA, 22 bp, Homo sapiens
atttggaagtttttgtgggaat

SEQ ID NO: 7044593 - DNA, 22 bp, Homo sapiens
atttggaatagctgtagaaata

SEQ ID NO: 7044594 - DNA, 22 bp, Homo sapiens
atttggaatagctgtagaaata

SEQ ID NO: 7044595 - DNA, 22 bp, Homo sapiens
atttggaatgctagtgaatgta

SEQ ID NO: 7044596 - DNA, 22 bp, Homo sapiens
atttggaatgggagcctggcat

SEQ ID NO: 7044597 - DNA, 22 bp, Homo sapiens
atttggaatggtctggcatttg

SEQ ID NO: 7044598 - DNA, 22 bp, Homo sapiens
atttggaatgtgtttgatcacc

SEQ ID NO: 7044599 - DNA, 22 bp, Homo sapiens
attttactactccaattaatga

SEQ ID NO: 7044600 - DNA, 22 bp, Homo sapiens
gcagggctgggacttactggta

SEQ ID NO: 7044601 - DNA, 22 bp, Homo sapiens
attgtcattccagtcattgtta

SEQ ID NO: 7044602 - DNA, 22 bp, Homo sapiens
attgtcattggcttctatgtct

SEQ ID NO: 7044603 - DNA, 22 bp, Homo sapiens
attgtctttccactgagaagtt

SEQ ID NO: 7044604 - DNA, 22 bp, Homo sapiens
gcattctctctctaaatgttgt

SEQ ID NO: 7044605 - DNA, 22 bp, Homo sapiens
gcagggctgctgaaacttgttt

SEQ ID NO: 7044606 - DNA, 18 bp, Homo sapiens
gcagggctggacaagtca

SEQ ID NO: 7044607 - DNA, 22 bp, Homo sapiens
gcagggctgcagagggcactgt

SEQ ID NO: 7044608 - DNA, 22 bp, Homo sapiens
gcagggctgatgttattgacga

SEQ ID NO: 7044609 - DNA, 18 bp, Homo sapiens
gcagggctgcacacgcat

SEQ ID NO: 7044610 - DNA, 22 bp, Homo sapiens
gcagggctgatggcttccctca

SEQ ID NO: 7044611 - DNA, 22 bp, Homo sapiens
gcagggctgagtcatgtgtgcc

SEQ ID NO: 7044612 - DNA, 22 bp, Homo sapiens
attgcaaaattgtcctgtggaa

SEQ ID NO: 7044613 - DNA, 22 bp, Homo sapiens
attgcaaagaaatacatgctta

SEQ ID NO: 7044614 - DNA, 22 bp, Homo sapiens
gcagggctgactcagccaccct

SEQ ID NO: 7044615 - DNA, 23 bp, Homo sapiens
attgactctaagagattcttgaa

SEQ ID NO: 7044616 - DNA, 22 bp, Homo sapiens
attccttgggctgccttattat

SEQ ID NO: 7044617 - DNA, 22 bp, Homo sapiens
attccttgggaattattgaatg

SEQ ID NO: 7044618 - DNA, 22 bp, Homo sapiens
attcttgcttcacactcctctg

SEQ ID NO: 7044619 - DNA, 19 bp, Homo sapiens
attcttgttaagtgtcatc

SEQ ID NO: 7044620 - DNA, 22 bp, Homo sapiens
attctttaattcaattgaagga

SEQ ID NO: 7044621 - DNA, 22 bp, Homo sapiens
attctttcaaggaatagttatt

SEQ ID NO: 7044622 - DNA, 22 bp, Homo sapiens
attctttcaaggaatagttatt

SEQ ID NO: 7044623 - DNA, 22 bp, Homo sapiens
attccttgctctcatcaacctt

SEQ ID NO: 7044624 - DNA, 22 bp, Homo sapiens
attccttgcacatcagatagtt

SEQ ID NO: 7044625 - DNA, 22 bp, Homo sapiens
attcaaagtaataaccagaact

SEQ ID NO: 7044626 - DNA, 22 bp, Homo sapiens
attcaaattaagttaattcagc

SEQ ID NO: 7044627 - DNA, 22 bp, Homo sapiens
attcaagagcccatgtttcctg

SEQ ID NO: 7044628 - DNA, 22 bp, Homo sapiens
gatattcaagtggaattattct

SEQ ID NO: 7044629 - DNA, 22 bp, Homo sapiens
attacaatcgagagaaacaaat

SEQ ID NO: 7044630 - DNA, 22 bp, Homo sapiens
attacagttaatttaccttctt

SEQ ID NO: 7044631 - DNA, 22 bp, Homo sapiens
attacagttctgcaggtagttt

SEQ ID NO: 7044632 - DNA, 22 bp, Homo sapiens
gatttcagccctgggggtcatt

SEQ ID NO: 7044633 - DNA, 22 bp, Homo sapiens
attcaagaggaacaatgaagat

SEQ ID NO: 7044634 - DNA, 22 bp, Homo sapiens
attcaagattaattctatgtca

SEQ ID NO: 7044635 - DNA, 18 bp, Homo sapiens
gcaccttaccaattctac

SEQ ID NO: 7044636 - DNA, 22 bp, Homo sapiens
attcacaatgatacataagcga

SEQ ID NO: 7044637 - DNA, 22 bp, Homo sapiens
attcagttctaaggtcagtgcc

SEQ ID NO: 7044638 - DNA, 22 bp, Homo sapiens
attcagttctgctggttctgct

SEQ ID NO: 7044639 - DNA, 22 bp, Homo sapiens
attcagttctggctgccttcct

SEQ ID NO: 7044640 - DNA, 22 bp, Homo sapiens
attcagttgtaatctttgttag

SEQ ID NO: 7044641 - DNA, 22 bp, Homo sapiens
attcagttgtctactactgcct

SEQ ID NO: 7044642 - DNA, 23 bp, Homo sapiens
attcagttgtgagagaagacaca

SEQ ID NO: 7044643 - DNA, 22 bp, Homo sapiens
attcagtttcaatcattgtagt

SEQ ID NO: 7044644 - DNA, 22 bp, Homo sapiens
attcagtttcatggcacagcta

SEQ ID NO: 7044645 - DNA, 21 bp, Homo sapiens
attcagtttgacatctagcag

SEQ ID NO: 7044646 - DNA, 22 bp, Homo sapiens
attcagtttttattggaccagc

SEQ ID NO: 7044647 - DNA, 22 bp, Homo sapiens
attcagtttttgaagggaaatt

SEQ ID NO: 7044648 - DNA, 22 bp, Homo sapiens
attcataacggcaaatgtcacc

SEQ ID NO: 7044649 - DNA, 22 bp, Homo sapiens
gctttctgtaggtagttactgt

SEQ ID NO: 7044650 - DNA, 22 bp, Homo sapiens
caagtttggattatgaaaaagt

SEQ ID NO: 7044651 - DNA, 22 bp, Homo sapiens
caagttttagaaatatctggat

SEQ ID NO: 7044652 - DNA, 22 bp, Homo sapiens
caagttttctgggttcagagca

SEQ ID NO: 7044653 - DNA, 22 bp, Homo sapiens
caagttttgattttgcagtaaa

SEQ ID NO: 7044654 - DNA, 22 bp, Homo sapiens
caagttttgcatagttctgtat

SEQ ID NO: 7044655 - DNA, 22 bp, Homo sapiens
gctttcttatttagaagatttg

SEQ ID NO: 7044656 - DNA, 18 bp, Homo sapiens
caagtatagaattaggtt

SEQ ID NO: 7044657 - DNA, 22 bp, Homo sapiens
caagtcaatgattataagagtc

SEQ ID NO: 7044658 - DNA, 22 bp, Homo sapiens
caaatgtgacttttgggcttct

SEQ ID NO: 7044659 - DNA, 22 bp, Homo sapiens
caaatgtgtagagcttttgggg

SEQ ID NO: 7044660 - DNA, 22 bp, Homo sapiens
gctggagcttgagaggacaggg

SEQ ID NO: 7044661 - DNA, 19 bp, Homo sapiens
caagggtcatgacaggaac

SEQ ID NO: 7044662 - DNA, 22 bp, Homo sapiens
caagggttctgtgcctcctgct

SEQ ID NO: 7044663 - DNA, 22 bp, Homo sapiens
cacaggaatataagtttgagtt

SEQ ID NO: 7044664 - DNA, 22 bp, Homo sapiens
cacaggaatctgcattttgacc

SEQ ID NO: 7044665 - DNA, 22 bp, Homo sapiens
ggaggcagaatagagtgtgggt

SEQ ID NO: 7044666 - DNA, 22 bp, Homo sapiens
cacagaatggaccagttttaga

SEQ ID NO: 7044667 - DNA, 22 bp, Homo sapiens
cacagaattttctctttacaat

SEQ ID NO: 7044668 - DNA, 21 bp, Homo sapiens
cacagaatatacattttagtt

SEQ ID NO: 7044669 - DNA, 22 bp, Homo sapiens
cacttttaacaggagaattccc

SEQ ID NO: 7044670 - DNA, 22 bp, Homo sapiens
cagaaaacaaacctatcctgag

SEQ ID NO: 7044671 - DNA, 23 bp, Homo sapiens
cagaaaacccagagctcagtccc

SEQ ID NO: 7044672 - DNA, 22 bp, Homo sapiens
cagaaaacctgactctagaact

SEQ ID NO: 7044673 - DNA, 22 bp, Homo sapiens
cagaaaggcacccactgggtct

SEQ ID NO: 7044674 - DNA, 23 bp, Homo sapiens
cagaaataaactggtttgtagat

SEQ ID NO: 7044675 - DNA, 17 bp, Homo sapiens
ggctgtttttaggctgt

SEQ ID NO: 7044676 - DNA, 22 bp, Homo sapiens
ggctgtttttatagagtccata

SEQ ID NO: 7044677 - DNA, 20 bp, Homo sapiens
ggctctggaatctggtgggc

SEQ ID NO: 7044678 - DNA, 22 bp, Homo sapiens
ggctccagggtctctccttgtg

SEQ ID NO: 7044679 - DNA, 22 bp, Homo sapiens
ggctgaggcggcgatgcccttg

SEQ ID NO: 7044680 - DNA, 22 bp, Homo sapiens
ggctcagggaatgaggaagaat

SEQ ID NO: 7044681 - DNA, 19 bp, Homo sapiens
ggctcagggcgctgccgcc

SEQ ID NO: 7044682 - DNA, 22 bp, Homo sapiens
cacctgggtcattgctggtgtt

SEQ ID NO: 7044683 - DNA, 22 bp, Homo sapiens
cacgcatttattcacgtattcg

SEQ ID NO: 7044684 - DNA, 22 bp, Homo sapiens
ggaggtggaggttgcaatgagc

SEQ ID NO: 7044685 - DNA, 22 bp, Homo sapiens
ggaggtgaggccgtagggtgtg

SEQ ID NO: 7044686 - DNA, 22 bp, Homo sapiens
cacatttagaggttagcatggt

SEQ ID NO: 7044687 - DNA, 22 bp, Homo sapiens
cacatttcattggcttacgtaa

SEQ ID NO: 7044688 - DNA, 22 bp, Homo sapiens
cacatttccttggcctttaatt

SEQ ID NO: 7044689 - DNA, 22 bp, Homo sapiens
cacatttctaggaaattaaatg

SEQ ID NO: 7044690 - DNA, 22 bp, Homo sapiens
ggcaggcaggagctctgtctcc

SEQ ID NO: 7044691 - DNA, 22 bp, Homo sapiens
cagccaggggctggcgtgttga

SEQ ID NO: 7044692 - DNA, 22 bp, Homo sapiens
gtctgtggcaggggagaagttt

SEQ ID NO: 7044693 - DNA, 22 bp, Homo sapiens
gtccctgggcgcctccgtgctc

SEQ ID NO: 7044694 - DNA, 22 bp, Homo sapiens
gtccctggtttgcccaggacca

SEQ ID NO: 7044695 - DNA, 22 bp, Homo sapiens
gtctcttgtggatgttgggaag

SEQ ID NO: 7044696 - DNA, 22 bp, Homo sapiens
cagccaggcctggtgaccaaag

SEQ ID NO: 7044697 - DNA, 22 bp, Homo sapiens
gtcatggtgctcatcattggtg

SEQ ID NO: 7044698 - DNA, 22 bp, Homo sapiens
cagctatattgttttctactgt

SEQ ID NO: 7044699 - DNA, 21 bp, Homo sapiens
cagagggccggcatgtggtct

SEQ ID NO: 7044700 - DNA, 22 bp, Homo sapiens
cagagggctcagtcctgctgga

SEQ ID NO: 7044701 - DNA, 22 bp, Homo sapiens
cagagggctcagtcctgctgga

SEQ ID NO: 7044702 - DNA, 22 bp, Homo sapiens
cagagggctcttggctgcctgc

SEQ ID NO: 7044703 - DNA, 22 bp, Homo sapiens
cagagggctgccctgagttcgt

SEQ ID NO: 7044704 - DNA, 22 bp, Homo sapiens
cagagggctgtgtaaggatgtt

SEQ ID NO: 7044705 - DNA, 21 bp, Homo sapiens
cagagggcttttctctgttct

SEQ ID NO: 7044706 - DNA, 22 bp, Homo sapiens
cagagggttgtcaggcgccttg

SEQ ID NO: 7044707 - DNA, 22 bp, Homo sapiens
cagagcctctgccctgggcact

SEQ ID NO: 7044708 - DNA, 22 bp, Homo sapiens
gggctgaggggtatctcatggg

SEQ ID NO: 7044709 - DNA, 22 bp, Homo sapiens
gggctgaggggtatctcatggg

SEQ ID NO: 7044710 - DNA, 22 bp, Homo sapiens
gggctgagtcatctggggcctc

SEQ ID NO: 7044711 - DNA, 22 bp, Homo sapiens
gggctgagtctgctgcctgtca

SEQ ID NO: 7044712 - DNA, 22 bp, Homo sapiens
gggctgagtgacctcaggccaa

SEQ ID NO: 7044713 - DNA, 22 bp, Homo sapiens
gggcagtgtcggggcccaggga

SEQ ID NO: 7044714 - DNA, 22 bp, Homo sapiens
gggctctgtttagaccagagat

SEQ ID NO: 7044715 - DNA, 22 bp, Homo sapiens
gggctctgtttagatcagagat

SEQ ID NO: 7044716 - DNA, 22 bp, Homo sapiens
ggcttcagaagactggacaggt

SEQ ID NO: 7044717 - DNA, 22 bp, Homo sapiens
ggcttcagaggagaagagggtg

SEQ ID NO: 7044718 - DNA, 22 bp, Homo sapiens
cagacagggtgggtttctgggc

SEQ ID NO: 7044719 - DNA, 22 bp, Homo sapiens
cagacccaggatccaaatgttg

SEQ ID NO: 7044720 - DNA, 22 bp, Homo sapiens
gggcagcagttgccctaatcaa

SEQ ID NO: 7044721 - DNA, 22 bp, Homo sapiens
gggcagcatgaggaccctcatc

SEQ ID NO: 7044722 - DNA, 22 bp, Homo sapiens
cagggagcagcgctggggcctc

SEQ ID NO: 7044723 - DNA, 22 bp, Homo sapiens
cagggagcagcgctggggcctc

SEQ ID NO: 7044724 - DNA, 22 bp, Homo sapiens
cagggagatcttggctcctggt

SEQ ID NO: 7044725 - DNA, 22 bp, Homo sapiens
cagggccattggaacaaagagg

SEQ ID NO: 7044726 - DNA, 22 bp, Homo sapiens
cagggccattggcgtggctgtc

SEQ ID NO: 7044727 - DNA, 22 bp, Homo sapiens
cagggccatgaggcacagggtc

SEQ ID NO: 7044728 - DNA, 22 bp, Homo sapiens
cagggccatgaggcacagggtc

SEQ ID NO: 7044729 - DNA, 22 bp, Homo sapiens
cagggccagggctatggtgaag

SEQ ID NO: 7044730 - DNA, 22 bp, Homo sapiens
cagggccagttctcgcagcagt

SEQ ID NO: 7044731 - DNA, 22 bp, Homo sapiens
cagggagccccaattccatgcc

SEQ ID NO: 7044732 - DNA, 22 bp, Homo sapiens
cagggccactgcatgaggttca

SEQ ID NO: 7044733 - DNA, 22 bp, Homo sapiens
cagggccattggcgtggctgtc

SEQ ID NO: 7044734 - DNA, 22 bp, Homo sapiens
cagggggtggtccaggctgcgc

SEQ ID NO: 7044735 - DNA, 22 bp, Homo sapiens
cagggctccatgcagggactcc

SEQ ID NO: 7044736 - DNA, 20 bp, Homo sapiens
cagggctctgggcctggcct

SEQ ID NO: 7044737 - DNA, 23 bp, Homo sapiens
caggtggctccacgaggggtggg

SEQ ID NO: 7044738 - DNA, 22 bp, Homo sapiens
tattataatttagggcttggat

SEQ ID NO: 7044739 - DNA, 22 bp, Homo sapiens
tattatcattaactgttgaatt

SEQ ID NO: 7044740 - DNA, 22 bp, Homo sapiens
tattattaaatggcagaatttt

SEQ ID NO: 7044741 - DNA, 22 bp, Homo sapiens
caggtgggtacatcacagagac

SEQ ID NO: 7044742 - DNA, 18 bp, Homo sapiens
caggtgggtctcctgccc

SEQ ID NO: 7044743 - DNA, 22 bp, Homo sapiens
cagggtttctgttgagaagtcc

SEQ ID NO: 7044744 - DNA, 22 bp, Homo sapiens
cagtcacatggatgatggatag

SEQ ID NO: 7044745 - DNA, 22 bp, Homo sapiens
tatttgaagattcttctgatgt

SEQ ID NO: 7044746 - DNA, 22 bp, Homo sapiens
tatttgaaggcatacattttga

SEQ ID NO: 7044747 - DNA, 22 bp, Homo sapiens
tattttaaagactgccagccta

SEQ ID NO: 7044748 - DNA, 22 bp, Homo sapiens
tattttaaagactgccagccta

SEQ ID NO: 7044749 - DNA, 22 bp, Homo sapiens
tattttaaagtgaagggtcttg

SEQ ID NO: 7044750 - DNA, 22 bp, Homo sapiens
tattttaaagtgaagggtcttg

SEQ ID NO: 7044751 - DNA, 22 bp, Homo sapiens
tattttacagactactttagat

SEQ ID NO: 7044752 - DNA, 22 bp, Homo sapiens
tattttacagactactttagat

SEQ ID NO: 7044753 - DNA, 22 bp, Homo sapiens
tattttacatgacaggtgttta

SEQ ID NO: 7044754 - DNA, 22 bp, Homo sapiens
tattttactttaaagcgagaga

SEQ ID NO: 7044755 - DNA, 22 bp, Homo sapiens
tattttatctgccagagtggag

SEQ ID NO: 7044756 - DNA, 22 bp, Homo sapiens
tcaaaaattttctgaggatgag

SEQ ID NO: 7044757 - DNA, 22 bp, Homo sapiens
tcaagctattggctgaggctgc

SEQ ID NO: 7044758 - DNA, 22 bp, Homo sapiens
cagggacaatggcagagcctga

SEQ ID NO: 7044759 - DNA, 22 bp, Homo sapiens
caggctgcatggaggggtacag

SEQ ID NO: 7044760 - DNA, 22 bp, Homo sapiens
caggctgccgtggggtccaggc

SEQ ID NO: 7044761 - DNA, 22 bp, Homo sapiens
caggcccagcccttagccaggt

SEQ ID NO: 7044762 - DNA, 22 bp, Homo sapiens
caggcccagggagggagaccaa

SEQ ID NO: 7044763 - DNA, 21 bp, Homo sapiens
caggccgggtgagcaggcagc

SEQ ID NO: 7044764 - DNA, 22 bp, Homo sapiens
caggcctcctatgagcactagc

SEQ ID NO: 7044765 - DNA, 22 bp, Homo sapiens
caggcctcgaggagacagctac

SEQ ID NO: 7044766 - DNA, 22 bp, Homo sapiens
caggcctctatggtcagctgag

SEQ ID NO: 7044767 - DNA, 22 bp, Homo sapiens
caggcctctccttagtctggca

SEQ ID NO: 7044768 - DNA, 20 bp, Homo sapiens
caggcctctgggggccctgg

SEQ ID NO: 7044769 - DNA, 19 bp, Homo sapiens
caggcctctggtctgctgt

SEQ ID NO: 7044770 - DNA, 19 bp, Homo sapiens
caggcctcttaccctctct

SEQ ID NO: 7044771 - DNA, 22 bp, Homo sapiens
caggcctcttccatgcagcagc

SEQ ID NO: 7044772 - DNA, 22 bp, Homo sapiens
caggctatatttaaagaagaac

SEQ ID NO: 7044773 - DNA, 22 bp, Homo sapiens
tactttaaagaggtgtaatgag

SEQ ID NO: 7044774 - DNA, 22 bp, Homo sapiens
tactttaatatatgtgaagttc

SEQ ID NO: 7044775 - DNA, 22 bp, Homo sapiens
tactttatattgtggctggcca

SEQ ID NO: 7044776 - DNA, 22 bp, Homo sapiens
tactttatcagcgtcaaaggta

SEQ ID NO: 7044777 - DNA, 22 bp, Homo sapiens
tactttatcagcgtcaaaggta

SEQ ID NO: 7044778 - DNA, 22 bp, Homo sapiens
tactttattcaggaaggctggt

SEQ ID NO: 7044779 - DNA, 18 bp, Homo sapiens
tactttattccccctcca

SEQ ID NO: 7044780 - DNA, 22 bp, Homo sapiens
tactttattgtaaatgctgatg

SEQ ID NO: 7044781 - DNA, 22 bp, Homo sapiens
caggctgcagtgcagtggctat

SEQ ID NO: 7044782 - DNA, 22 bp, Homo sapiens
caggccagagcgcgtggttggg

SEQ ID NO: 7044783 - DNA, 22 bp, Homo sapiens
caggccagaggctgttgttgcg

SEQ ID NO: 7044784 - DNA, 22 bp, Homo sapiens
tacaaaaggaagagggatctta

SEQ ID NO: 7044785 - DNA, 22 bp, Homo sapiens
tacaaaagtaattacggttttt

SEQ ID NO: 7044786 - DNA, 22 bp, Homo sapiens
caggcattgccattcctccaga

SEQ ID NO: 7044787 - DNA, 22 bp, Homo sapiens
tacaaaaaattgatactgacga

SEQ ID NO: 7044788 - DNA, 22 bp, Homo sapiens
tacaaaaaattgatactgacga

SEQ ID NO: 7044789 - DNA, 22 bp, Homo sapiens
taatatgtgttactgacttttt

SEQ ID NO: 7044790 - DNA, 22 bp, Homo sapiens
taatatttctaccctgctgcct

SEQ ID NO: 7044791 - DNA, 22 bp, Homo sapiens
cagctcagacgcaggtcgagca

SEQ ID NO: 7044792 - DNA, 23 bp, Homo sapiens
cagctcagcacataggaggtact

SEQ ID NO: 7044793 - DNA, 22 bp, Homo sapiens
taagtcgtggatgattcttcgg

SEQ ID NO: 7044794 - DNA, 22 bp, Homo sapiens
caggcaccaatagggatcgtgg

SEQ ID NO: 7044795 - DNA, 22 bp, Homo sapiens
caggcaccacactaggggctga

SEQ ID NO: 7044796 - DNA, 22 bp, Homo sapiens
caggcaccctctgaggggaagc

SEQ ID NO: 7044797 - DNA, 22 bp, Homo sapiens
caggcagagttagagcaactgg

SEQ ID NO: 7044798 - DNA, 22 bp, Homo sapiens
taataattttaaagaaggctag

SEQ ID NO: 7044799 - DNA, 22 bp, Homo sapiens
tcctgggcttgctcctccagct

SEQ ID NO: 7044800 - DNA, 22 bp, Homo sapiens
tcctgggctttgtttctctcct

SEQ ID NO: 7044801 - DNA, 19 bp, Homo sapiens
tccttaaaaaagcagttct

SEQ ID NO: 7044802 - DNA, 22 bp, Homo sapiens
tccttaaacaacacactttgta

SEQ ID NO: 7044803 - DNA, 22 bp, Homo sapiens
tccttaaagtgcacctcctcat

SEQ ID NO: 7044804 - DNA, 22 bp, Homo sapiens
tccttaaatatttactgttaac

SEQ ID NO: 7044805 - DNA, 22 bp, Homo sapiens
tccttgtaaaggagctctaaca

SEQ ID NO: 7044806 - DNA, 23 bp, Homo sapiens
tcctttaagatatcttattcctt

SEQ ID NO: 7044807 - DNA, 22 bp, Homo sapiens
ccaagaggttgtgaggcaggca

SEQ ID NO: 7044808 - DNA, 22 bp, Homo sapiens
ccaaggaggccccaggtcagct

SEQ ID NO: 7044809 - DNA, 22 bp, Homo sapiens
ccaaggcccctgtggtctagcc

SEQ ID NO: 7044810 - DNA, 22 bp, Homo sapiens
ccaaggcttcccagagatgctc

SEQ ID NO: 7044811 - DNA, 22 bp, Homo sapiens
ccaagggaaaccgagaggctgg

SEQ ID NO: 7044812 - DNA, 22 bp, Homo sapiens
tcctgggagacccagctgtgga

SEQ ID NO: 7044813 - DNA, 22 bp, Homo sapiens
tcctgggagagtgggactgtat

SEQ ID NO: 7044814 - DNA, 22 bp, Homo sapiens
tcctgggcttaagtgatcctcc

SEQ ID NO: 7044815 - DNA, 22 bp, Homo sapiens
cattcatttatgaaatatctat

SEQ ID NO: 7044816 - DNA, 22 bp, Homo sapiens
cattctctacactcctgccctg

SEQ ID NO: 7044817 - DNA, 22 bp, Homo sapiens
cattagagcagataatatgtgt

SEQ ID NO: 7044818 - DNA, 22 bp, Homo sapiens
cattctctctacttgttttcaa

SEQ ID NO: 7044819 - DNA, 22 bp, Homo sapiens
cattctctgatcttcacatacc

SEQ ID NO: 7044820 - DNA, 17 bp, Homo sapiens
cattctgtaatctttct

SEQ ID NO: 7044821 - DNA, 22 bp, Homo sapiens
cattcttacacaatattttaat

SEQ ID NO: 7044822 - DNA, 19 bp, Homo sapiens
tccaggagcaaagccagtt

SEQ ID NO: 7044823 - DNA, 21 bp, Homo sapiens
tccaggagcacgggactagga

SEQ ID NO: 7044824 - DNA, 22 bp, Homo sapiens
tccaggagacacaaggtacata

SEQ ID NO: 7044825 - DNA, 22 bp, Homo sapiens
tccaggagacacccttgtgtgt

SEQ ID NO: 7044826 - DNA, 22 bp, Homo sapiens
tccaggagaggcctgaccaggt

SEQ ID NO: 7044827 - DNA, 22 bp, Homo sapiens
tccaggagaggtgtggggactg

SEQ ID NO: 7044828 - DNA, 22 bp, Homo sapiens
tccaggagatacactgcaccag

SEQ ID NO: 7044829 - DNA, 22 bp, Homo sapiens
catgggcagttggcagggctca

SEQ ID NO: 7044830 - DNA, 22 bp, Homo sapiens
catgggccagagctcctctggg

SEQ ID NO: 7044831 - DNA, 22 bp, Homo sapiens
catgggccatggtgaagccagg

SEQ ID NO: 7044832 - DNA, 22 bp, Homo sapiens
catgggcccgtgagaggcaggg

SEQ ID NO: 7044833 - DNA, 18 bp, Homo sapiens
tccctcctgcctgcttcc

SEQ ID NO: 7044834 - DNA, 22 bp, Homo sapiens
tccctctccctattgcctggag

SEQ ID NO: 7044835 - DNA, 18 bp, Homo sapiens
tccctggggctgccaccc

SEQ ID NO: 7044836 - DNA, 18 bp, Homo sapiens
tccctggggctgccaccc

SEQ ID NO: 7044837 - DNA, 22 bp, Homo sapiens
tccctggggtaacattagaggg

SEQ ID NO: 7044838 - DNA, 22 bp, Homo sapiens
tccctggggtatcgctgaggca

SEQ ID NO: 7044839 - DNA, 22 bp, Homo sapiens
tccctggggttcctccagccac

SEQ ID NO: 7044840 - DNA, 22 bp, Homo sapiens
tccctggggttcctccagccac

SEQ ID NO: 7044841 - DNA, 22 bp, Homo sapiens
tccctgggtcattctctggcac

SEQ ID NO: 7044842 - DNA, 22 bp, Homo sapiens
tccctgggtcctgcttgctctc

SEQ ID NO: 7044843 - DNA, 22 bp, Homo sapiens
tccctgggtcctgcttgctctc

SEQ ID NO: 7044844 - DNA, 22 bp, Homo sapiens
tccctgggttcccgtggaagtg

SEQ ID NO: 7044845 - DNA, 22 bp, Homo sapiens
tccaggagaaggccatccagcg

SEQ ID NO: 7044846 - DNA, 23 bp, Homo sapiens
tccaggagaattccagggcccgg

SEQ ID NO: 7044847 - DNA, 22 bp, Homo sapiens
catgcattgtaatttttagtct

SEQ ID NO: 7044848 - DNA, 22 bp, Homo sapiens
catgaattttaagactgttttt

SEQ ID NO: 7044849 - DNA, 22 bp, Homo sapiens
tcagggagatttggggactcaa

SEQ ID NO: 7044850 - DNA, 22 bp, Homo sapiens
tcagggagggacctgaggctgg

SEQ ID NO: 7044851 - DNA, 23 bp, Homo sapiens
tcagtcccaacagcttctcctgg

SEQ ID NO: 7044852 - DNA, 22 bp, Homo sapiens
tcagtcccaaggtcctgaggtg

SEQ ID NO: 7044853 - DNA, 22 bp, Homo sapiens
tcagtccctcgcaccctgccat

SEQ ID NO: 7044854 - DNA, 21 bp, Homo sapiens
tcagtccctgggtgtgtccca

SEQ ID NO: 7044855 - DNA, 22 bp, Homo sapiens
tcaatatagcagtgtacttgag

SEQ ID NO: 7044856 - DNA, 22 bp, Homo sapiens
tcaatatattccatgttttctc

SEQ ID NO: 7044857 - DNA, 22 bp, Homo sapiens
tcaatatttttatgagcataga

SEQ ID NO: 7044858 - DNA, 22 bp, Homo sapiens
cagttctggagtttcattcttt

SEQ ID NO: 7044859 - DNA, 22 bp, Homo sapiens
cagttgtaatgctttcctctga

SEQ ID NO: 7044860 - DNA, 22 bp, Homo sapiens
cagttgtaggcatgtgcatgga

SEQ ID NO: 7044861 - DNA, 22 bp, Homo sapiens
cagttgttcccagcaatgaaag

SEQ ID NO: 7044862 - DNA, 22 bp, Homo sapiens
tcagatatagtcatttaaataa

SEQ ID NO: 7044863 - DNA, 22 bp, Homo sapiens
tcagatatgaattcatatctct

SEQ ID NO: 7044864 - DNA, 22 bp, Homo sapiens
cagttttctatggtagaagcat

SEQ ID NO: 7044865 - DNA, 22 bp, Homo sapiens
cagttttctatggtagaagcat

SEQ ID NO: 7044866 - DNA, 22 bp, Homo sapiens
cagtttttagattagttggtgg

SEQ ID NO: 7044867 - DNA, 18 bp, Homo sapiens
cagtttttatatctggca

SEQ ID NO: 7044868 - DNA, 22 bp, Homo sapiens
cagtttttcaaaattacatgat

SEQ ID NO: 7044869 - DNA, 22 bp, Homo sapiens
cagtttttgccattaagagtaa

SEQ ID NO: 7044870 - DNA, 22 bp, Homo sapiens
cataatttgatatgcttgatgg

SEQ ID NO: 7044871 - DNA, 22 bp, Homo sapiens
catagaatatgtgtgattgtta

SEQ ID NO: 7044872 - DNA, 22 bp, Homo sapiens
tcagggagaggtgagagcctgt

SEQ ID NO: 7044873 - DNA, 22 bp, Homo sapiens
ccaggcccaccttggccactta

SEQ ID NO: 7044874 - DNA, 22 bp, Homo sapiens
ccaggccagggctgcagcgagc

SEQ ID NO: 7044875 - DNA, 22 bp, Homo sapiens
tctttcttcagccctgtaagat

SEQ ID NO: 7044876 - DNA, 22 bp, Homo sapiens
tctttcttcctggagcccaaca

SEQ ID NO: 7044877 - DNA, 22 bp, Homo sapiens
tctttcttcctggagcccaaca

SEQ ID NO: 7044878 - DNA, 22 bp, Homo sapiens
tctttcttggtataaagcaggg

SEQ ID NO: 7044879 - DNA, 22 bp, Homo sapiens
tctttcttggtataaagcaggg

SEQ ID NO: 7044880 - DNA, 22 bp, Homo sapiens
tctttcttggtattctgagcta

SEQ ID NO: 7044881 - DNA, 22 bp, Homo sapiens
tctttcttgtgggtgccctttt

SEQ ID NO: 7044882 - DNA, 22 bp, Homo sapiens
tctttctttatcacctgatatg

SEQ ID NO: 7044883 - DNA, 22 bp, Homo sapiens
tctttgggagatgttatttata

SEQ ID NO: 7044884 - DNA, 19 bp, Homo sapiens
ccaggagtggtggggtgag

SEQ ID NO: 7044885 - DNA, 22 bp, Homo sapiens
ccaggagtctggatgaggtgtc

SEQ ID NO: 7044886 - DNA, 22 bp, Homo sapiens
ccaggagaatgggattacccta

SEQ ID NO: 7044887 - DNA, 22 bp, Homo sapiens
ccaggagacaaagatgactgct

SEQ ID NO: 7044888 - DNA, 22 bp, Homo sapiens
ccaggagacccagggaaggagc

SEQ ID NO: 7044889 - DNA, 22 bp, Homo sapiens
ccaggagactgtactgatattt

SEQ ID NO: 7044890 - DNA, 22 bp, Homo sapiens
ccaggaggttgaggctgcagtg

SEQ ID NO: 7044891 - DNA, 22 bp, Homo sapiens
ccaggagaagcatctgagtgta

SEQ ID NO: 7044892 - DNA, 22 bp, Homo sapiens
ccaggagaagcatctgagtgta

SEQ ID NO: 7044893 - DNA, 22 bp, Homo sapiens
ccaggagaataatggcagatta

SEQ ID NO: 7044894 - DNA, 22 bp, Homo sapiens
tctgggagatccaagcagaact

SEQ ID NO: 7044895 - DNA, 22 bp, Homo sapiens
tctgggagccatgccttggagt

SEQ ID NO: 7044896 - DNA, 22 bp, Homo sapiens
tctgggagcgctgtttttccca

SEQ ID NO: 7044897 - DNA, 22 bp, Homo sapiens
tctgggagctggctttgcctca

SEQ ID NO: 7044898 - DNA, 22 bp, Homo sapiens
ccagctctgattttgacctcca

SEQ ID NO: 7044899 - DNA, 22 bp, Homo sapiens
ccagctctcttcaagcccactc

SEQ ID NO: 7044900 - DNA, 22 bp, Homo sapiens
ccagctctctgtcctccccaca

SEQ ID NO: 7044901 - DNA, 22 bp, Homo sapiens
tctgctttgaccttcttgatgc

SEQ ID NO: 7044902 - DNA, 22 bp, Homo sapiens
ccagagagagaggtcaatggca

SEQ ID NO: 7044903 - DNA, 22 bp, Homo sapiens
ccatcctggcctcgctgtccac

SEQ ID NO: 7044904 - DNA, 22 bp, Homo sapiens
ccatcctggccttgctgtccac

SEQ ID NO: 7044905 - DNA, 22 bp, Homo sapiens
ccagtcccgcatggtccagaat

SEQ ID NO: 7044906 - DNA, 20 bp, Homo sapiens
ccagtccctgagcaccaggg

SEQ ID NO: 7044907 - DNA, 22 bp, Homo sapiens
ccagtctcctaagagcccctga

SEQ ID NO: 7044908 - DNA, 22 bp, Homo sapiens
ccagtctcttccctcctgccag

SEQ ID NO: 7044909 - DNA, 22 bp, Homo sapiens
ccattattataggaggctcatt

SEQ ID NO: 7044910 - DNA, 23 bp, Homo sapiens
ccattcccactgtgccttccctg

SEQ ID NO: 7044911 - DNA, 22 bp, Homo sapiens
ccattctgaacaattcttgtct

SEQ ID NO: 7044912 - DNA, 22 bp, Homo sapiens
ccattctgacacctaattctgt

SEQ ID NO: 7044913 - DNA, 22 bp, Homo sapiens
ccattctgacttcattgcctca

SEQ ID NO: 7044914 - DNA, 22 bp, Homo sapiens
ccattctgagtcttatgtcttt

SEQ ID NO: 7044915 - DNA, 22 bp, Homo sapiens
ccattctgccatgcttcatcta

SEQ ID NO: 7044916 - DNA, 19 bp, Homo sapiens
ccattctgtctctgccaca

SEQ ID NO: 7044917 - DNA, 22 bp, Homo sapiens
ccattctgtgtctctccacagc

SEQ ID NO: 7044918 - DNA, 22 bp, Homo sapiens
tgattcaagctactgttactgg

SEQ ID NO: 7044919 - DNA, 23 bp, Homo sapiens
tgattttaaaaagtaagttatca

SEQ ID NO: 7044920 - DNA, 22 bp, Homo sapiens
tgattttattggtgaggaaatt

SEQ ID NO: 7044921 - DNA, 22 bp, Homo sapiens
tgcaaagggctttgcatacaga

SEQ ID NO: 7044922 - DNA, 23 bp, Homo sapiens
tgcaaataacaaggagtttaagg

SEQ ID NO: 7044923 - DNA, 22 bp, Homo sapiens
tgcaaataagctattatggaat

SEQ ID NO: 7044924 - DNA, 22 bp, Homo sapiens
tgcaaatagcctatatttatag

SEQ ID NO: 7044925 - DNA, 22 bp, Homo sapiens
tgcaaatagcctatatttatag

SEQ ID NO: 7044926 - DNA, 22 bp, Homo sapiens
tgcaaatattagcattcgatat

SEQ ID NO: 7044927 - DNA, 22 bp, Homo sapiens
ccaggggctggtgctgagctgg

SEQ ID NO: 7044928 - DNA, 22 bp, Homo sapiens
ccaggggctctcagggtgtgtg

SEQ ID NO: 7044929 - DNA, 22 bp, Homo sapiens
ccaggggcctgtgaaggtgccc

SEQ ID NO: 7044930 - DNA, 22 bp, Homo sapiens
ccaggggctgcagatccatggt

SEQ ID NO: 7044931 - DNA, 22 bp, Homo sapiens
tgagacatgtgaatatttgtac

SEQ ID NO: 7044932 - DNA, 22 bp, Homo sapiens
tgagacgaagtcttgctctgtt

SEQ ID NO: 7044933 - DNA, 22 bp, Homo sapiens
ccaggggaaacagggagcactc

SEQ ID NO: 7044934 - DNA, 19 bp, Homo sapiens
ccagggctttaagttgagg

SEQ ID NO: 7044935 - DNA, 22 bp, Homo sapiens
ccagggctttatctgcctttga

SEQ ID NO: 7044936 - DNA, 22 bp, Homo sapiens
ccagggctttgccaaagtccag

SEQ ID NO: 7044937 - DNA, 22 bp, Homo sapiens
ccagggcttcagttagtggtga

SEQ ID NO: 7044938 - DNA, 22 bp, Homo sapiens
ccagggcttcccacgtgccctg

SEQ ID NO: 7044939 - DNA, 22 bp, Homo sapiens
ccagggcttggtggcttgtatc

SEQ ID NO: 7044940 - DNA, 22 bp, Homo sapiens
ccagggctgctgtgggactcca

SEQ ID NO: 7044941 - DNA, 22 bp, Homo sapiens
ccagggcttcagaggttttggc

SEQ ID NO: 7044942 - DNA, 21 bp, Homo sapiens
ccaggggcaaattgtcgtttc

SEQ ID NO: 7044943 - DNA, 22 bp, Homo sapiens
tgacaaattcatatttcagagg

SEQ ID NO: 7044944 - DNA, 22 bp, Homo sapiens
tgacaacagccatcacttttag

SEQ ID NO: 7044945 - DNA, 22 bp, Homo sapiens
tgaatgatatgtgaaaaggaac

SEQ ID NO: 7044946 - DNA, 21 bp, Homo sapiens
cccttctgctccagctttgcc

SEQ ID NO: 7044947 - DNA, 22 bp, Homo sapiens
cccttctgtaaatgctgactgg

SEQ ID NO: 7044948 - DNA, 21 bp, Homo sapiens
cccttcttgggtcaaagtata

SEQ ID NO: 7044949 - DNA, 22 bp, Homo sapiens
tggcagggtgggcttcagcccc

SEQ ID NO: 7044950 - DNA, 22 bp, Homo sapiens
tggcagggttggccaccttacc

SEQ ID NO: 7044951 - DNA, 22 bp, Homo sapiens
tggcagggtggcaacttttggt

SEQ ID NO: 7044952 - DNA, 22 bp, Homo sapiens
tggcagaggaggctcagattga

SEQ ID NO: 7044953 - DNA, 22 bp, Homo sapiens
tggcagaggctctgtgatgttg

SEQ ID NO: 7044954 - DNA, 22 bp, Homo sapiens
tggcccagcagttctgccccag

SEQ ID NO: 7044955 - DNA, 22 bp, Homo sapiens
tggcccagcagttctgccccag

SEQ ID NO: 7044956 - DNA, 20 bp, Homo sapiens
tggcccagcacgacgaggac

SEQ ID NO: 7044957 - DNA, 22 bp, Homo sapiens
tggcccagatctctgaccttga

SEQ ID NO: 7044958 - DNA, 19 bp, Homo sapiens
tggcccagatggtcctggg

SEQ ID NO: 7044959 - DNA, 22 bp, Homo sapiens
cctcagtttatcctctgtaaca

SEQ ID NO: 7044960 - DNA, 22 bp, Homo sapiens
tggcctgggcctgccggtgcaa

SEQ ID NO: 7044961 - DNA, 22 bp, Homo sapiens
tggcctgggcctgccggtgcaa

SEQ ID NO: 7044962 - DNA, 22 bp, Homo sapiens
tggcctggggaagaccatgggc

SEQ ID NO: 7044963 - DNA, 22 bp, Homo sapiens
tggcctggggacctgtgagacc

SEQ ID NO: 7044964 - DNA, 22 bp, Homo sapiens
tggggaggaagtcagatttcag

SEQ ID NO: 7044965 - DNA, 22 bp, Homo sapiens
cctgagctagggaaggaagacc

SEQ ID NO: 7044966 - DNA, 22 bp, Homo sapiens
tgggccctggtggccatgcctc

SEQ ID NO: 7044967 - DNA, 22 bp, Homo sapiens
tgggcccaagagagtctccaac

SEQ ID NO: 7044968 - DNA, 22 bp, Homo sapiens
tgggcccacatgcctttctgcc

SEQ ID NO: 7044969 - DNA, 21 bp, Homo sapiens
tgggcccagttcccgctgggc

SEQ ID NO: 7044970 - DNA, 21 bp, Homo sapiens
tgggcccagttcccgctgggc

SEQ ID NO: 7044971 - DNA, 22 bp, Homo sapiens
tgggcccatcattgctgtgggc

SEQ ID NO: 7044972 - DNA, 22 bp, Homo sapiens
tgggctgctgtctgcacatgct

SEQ ID NO: 7044973 - DNA, 22 bp, Homo sapiens
tgggctgctgttacaggggctg

SEQ ID NO: 7044974 - DNA, 22 bp, Homo sapiens
tgggctgctgttacaggggctg

SEQ ID NO: 7044975 - DNA, 22 bp, Homo sapiens
tgggccatttttggaagactgg

SEQ ID NO: 7044976 - DNA, 22 bp, Homo sapiens
cctcttctaccatttacatttt

SEQ ID NO: 7044977 - DNA, 22 bp, Homo sapiens
cctcttctaggtttcagcctgc

SEQ ID NO: 7044978 - DNA, 22 bp, Homo sapiens
cctctggaggctctaagagaga

SEQ ID NO: 7044979 - DNA, 22 bp, Homo sapiens
tgctgtggttcccagagtggat

SEQ ID NO: 7044980 - DNA, 22 bp, Homo sapiens
ccctcctctccctaagagtcac

SEQ ID NO: 7044981 - DNA, 22 bp, Homo sapiens
ccctcctgtgcctgaggccagc

SEQ ID NO: 7044982 - DNA, 22 bp, Homo sapiens
ccctccttaccaccacagctcc

SEQ ID NO: 7044983 - DNA, 19 bp, Homo sapiens
ccctcttgcacaaagcaaa

SEQ ID NO: 7044984 - DNA, 22 bp, Homo sapiens
ccctgagaggttgagtgtctgc

SEQ ID NO: 7044985 - DNA, 22 bp, Homo sapiens
cccattctaagctttgctcttc

SEQ ID NO: 7044986 - DNA, 22 bp, Homo sapiens
cccattctaggctttgctcttc

SEQ ID NO: 7044987 - DNA, 19 bp, Homo sapiens
cccaggctacatggagagg

SEQ ID NO: 7044988 - DNA, 22 bp, Homo sapiens
tgccctgggctttgctatgact

SEQ ID NO: 7044989 - DNA, 22 bp, Homo sapiens
tgccctggggtctggagcagca

SEQ ID NO: 7044990 - DNA, 22 bp, Homo sapiens
tgccaggaagtgtgtgggcctg

SEQ ID NO: 7044991 - DNA, 22 bp, Homo sapiens
cccaggagacctagatctgttt

SEQ ID NO: 7044992 - DNA, 22 bp, Homo sapiens
cccaggagacctgtgaaaggac

SEQ ID NO: 7044993 - DNA, 22 bp, Homo sapiens
cccaggagactgagctgtaacc

SEQ ID NO: 7044994 - DNA, 22 bp, Homo sapiens
cccaggagagagacttgaatct

SEQ ID NO: 7044995 - DNA, 22 bp, Homo sapiens
cccaggagagaggccagttggc

SEQ ID NO: 7044996 - DNA, 22 bp, Homo sapiens
cccaggagagaggggataaagc

SEQ ID NO: 7044997 - DNA, 22 bp, Homo sapiens
cccaggagagggaaccaaatgt

SEQ ID NO: 7044998 - DNA, 22 bp, Homo sapiens
cccaggagataacgttcccaag

SEQ ID NO: 7044999 - DNA, 22 bp, Homo sapiens
tgccctggtatcatgtggaatt

SEQ ID NO: 7045000 - DNA, 22 bp, Homo sapiens
tgccctggttacactggagtcc

SEQ ID NO: 7045001 - DNA, 22 bp, Homo sapiens
cccaggctggagtgcagtggcg

SEQ ID NO: 7045002 - DNA, 22 bp, Homo sapiens
tgtttacttcatcgagtacttc

SEQ ID NO: 7045003 - DNA, 22 bp, Homo sapiens
tgttcattactgctgtttgcca

SEQ ID NO: 7045004 - DNA, 22 bp, Homo sapiens
tgttcattattcttcatctgcc

SEQ ID NO: 7045005 - DNA, 22 bp, Homo sapiens
tgttcattcaacatgtcatcta

SEQ ID NO: 7045006 - DNA, 22 bp, Homo sapiens
tgttcattcgctattgtctatg

SEQ ID NO: 7045007 - DNA, 22 bp, Homo sapiens
cctgggctgggcgtctcatggg

SEQ ID NO: 7045008 - DNA, 22 bp, Homo sapiens
cctgggctgtacctgtgcgcgg

SEQ ID NO: 7045009 - DNA, 21 bp, Homo sapiens
cctgggctgtggtttggagac

SEQ ID NO: 7045010 - DNA, 22 bp, Homo sapiens
cctgggctgttgcatcatcctt

SEQ ID NO: 7045011 - DNA, 22 bp, Homo sapiens
cctgggcttacgacctctgact

SEQ ID NO: 7045012 - DNA, 22 bp, Homo sapiens
cctgggcttccacgagcagagg

SEQ ID NO: 7045013 - DNA, 22 bp, Homo sapiens
cctgggctctatcctgacccag

SEQ ID NO: 7045014 - DNA, 22 bp, Homo sapiens
cctgggctctgaggagggagtc

SEQ ID NO: 7045015 - DNA, 22 bp, Homo sapiens
cctgggctctgtcagaattggg

SEQ ID NO: 7045016 - DNA, 16 bp, Homo sapiens
cctgggctctgttgga

SEQ ID NO: 7045017 - DNA, 22 bp, Homo sapiens
cctgggctgaagtcaagtgtgg

SEQ ID NO: 7045018 - DNA, 22 bp, Homo sapiens
cctgggctgcatgatggcattt

SEQ ID NO: 7045019 - DNA, 22 bp, Homo sapiens
cctgggctgctcatggggatga

SEQ ID NO: 7045020 - DNA, 22 bp, Homo sapiens
cctgggctggagtacagcagtg

SEQ ID NO: 7045021 - DNA, 22 bp, Homo sapiens
tggggctgtccttagtctgaga

SEQ ID NO: 7045022 - DNA, 22 bp, Homo sapiens
tggggctgtgagactacaggat

SEQ ID NO: 7045023 - DNA, 22 bp, Homo sapiens
tggggctgtgagactacaggat

SEQ ID NO: 7045024 - DNA, 22 bp, Homo sapiens
tggggctgtggattctcacgaa

SEQ ID NO: 7045025 - DNA, 22 bp, Homo sapiens
tggggctgtggattctcacgaa

SEQ ID NO: 7045026 - DNA, 19 bp, Homo sapiens
tggggctgtgttttgaccc

SEQ ID NO: 7045027 - DNA, 19 bp, Homo sapiens
tggggctgtgttttgaccc

SEQ ID NO: 7045028 - DNA, 22 bp, Homo sapiens
cctgggcaaatgccagagacaa

SEQ ID NO: 7045029 - DNA, 22 bp, Homo sapiens
cctgggcaacatagggagaccc

SEQ ID NO: 7045030 - DNA, 22 bp, Homo sapiens
cctgggcaacatagtgagaccc

SEQ ID NO: 7045031 - DNA, 22 bp, Homo sapiens
cctgggcaacatagtgagacct

SEQ ID NO: 7045032 - DNA, 22 bp, Homo sapiens
cctgggcaatatagtgaggccc

SEQ ID NO: 7045033 - DNA, 22 bp, Homo sapiens
tgtgtattaatgtttgtatatg

SEQ ID NO: 7045034 - DNA, 22 bp, Homo sapiens
ttacttttgcaccaaactaata

SEQ ID NO: 7045035 - DNA, 22 bp, Homo sapiens
ttacttttgcaccaaactaata

SEQ ID NO: 7045036 - DNA, 22 bp, Homo sapiens
cctgtgccctgccaggctggtg

SEQ ID NO: 7045037 - DNA, 22 bp, Homo sapiens
cctgtgctggacagggctgggc

SEQ ID NO: 7045038 - DNA, 22 bp, Homo sapiens
ttaaagtttgcctatgtgttgt

SEQ ID NO: 7045039 - DNA, 22 bp, Homo sapiens
ttctctaagagatgcagaagtt

SEQ ID NO: 7045040 - DNA, 22 bp, Homo sapiens
ctaccgggttctcagccaggca

SEQ ID NO: 7045041 - DNA, 22 bp, Homo sapiens
ctacaggagtaaaataatttca

SEQ ID NO: 7045042 - DNA, 22 bp, Homo sapiens
ttcctggctgtcatgccctagt

SEQ ID NO: 7045043 - DNA, 22 bp, Homo sapiens
ctagatttctagttcattatcc

SEQ ID NO: 7045044 - DNA, 22 bp, Homo sapiens
ctattaaatactcttcaaattg

SEQ ID NO: 7045045 - DNA, 22 bp, Homo sapiens
ttcatgaatatattgaattagc

SEQ ID NO: 7045046 - DNA, 22 bp, Homo sapiens
ttcatgaatggaatcaatgctc

SEQ ID NO: 7045047 - DNA, 22 bp, Homo sapiens
ctaaatactagccttcagattt

SEQ ID NO: 7045048 - DNA, 22 bp, Homo sapiens
cggtcaggtgcagcgttggcac

SEQ ID NO: 7045049 - DNA, 22 bp, Homo sapiens
cggtctcccgtgtgtgtgcgct

SEQ ID NO: 7045050 - DNA, 22 bp, Homo sapiens
ttcatgaaaaggtctatttctt

SEQ ID NO: 7045051 - DNA, 22 bp, Homo sapiens
cggggctgtagcacagctgagc

SEQ ID NO: 7045052 - DNA, 22 bp, Homo sapiens
ttcagggagagcgggacgggtg

SEQ ID NO: 7045053 - DNA, 22 bp, Homo sapiens
cggggctgtagcacagctgagc

SEQ ID NO: 7045054 - DNA, 22 bp, Homo sapiens
ttcaggagtgtcaggagtgcct

SEQ ID NO: 7045055 - DNA, 22 bp, Homo sapiens
ttcacagaatggcaagttatgg

SEQ ID NO: 7045056 - DNA, 22 bp, Homo sapiens
ttcagagggttcagagggttcg

SEQ ID NO: 7045057 - DNA, 22 bp, Homo sapiens
ttcagaggtgggctgagaggat

SEQ ID NO: 7045058 - DNA, 22 bp, Homo sapiens
ttcagaggttagagcagtggga

SEQ ID NO: 7045059 - DNA, 22 bp, Homo sapiens
ttaggcaatttgatttttcaag

SEQ ID NO: 7045060 - DNA, 22 bp, Homo sapiens
ttaggcaattttgtcattgtgt

SEQ ID NO: 7045061 - DNA, 23 bp, Homo sapiens
cgcccagcctcagtgacctgggc

SEQ ID NO: 7045062 - DNA, 18 bp, Homo sapiens
cctttcctcccctcagct

SEQ ID NO: 7045063 - DNA, 22 bp, Homo sapiens
cctttcctgcctcaggaagtag

SEQ ID NO: 7045064 - DNA, 22 bp, Homo sapiens
cctttcctgtgtccttttaagg

SEQ ID NO: 7045065 - DNA, 22 bp, Homo sapiens
cctttcctttttagtgtgggag

SEQ ID NO: 7045066 - DNA, 22 bp, Homo sapiens
cctttctcattttaagcattag

SEQ ID NO: 7045067 - DNA, 22 bp, Homo sapiens
cctttctctggcagcaggacag

SEQ ID NO: 7045068 - DNA, 22 bp, Homo sapiens
ttaggaatatgtattttaaagt

SEQ ID NO: 7045069 - DNA, 22 bp, Homo sapiens
ttaggaatttatcacagactgg

SEQ ID NO: 7045070 - DNA, 22 bp, Homo sapiens
ttaggaatttattccattgttg

SEQ ID NO: 7045071 - DNA, 22 bp, Homo sapiens
ttcaagttaactctccttgtac

SEQ ID NO: 7045072 - DNA, 22 bp, Homo sapiens
ttcaagttctagtgttcacttc

SEQ ID NO: 7045073 - DNA, 22 bp, Homo sapiens
ttcaagtttgtatttctgtatt

SEQ ID NO: 7045074 - DNA, 18 bp, Homo sapiens
tttccttgtatgaacata

SEQ ID NO: 7045075 - DNA, 22 bp, Homo sapiens
tttccttgggtctcttagtggc

SEQ ID NO: 7045076 - DNA, 23 bp, Homo sapiens
tttcaaattactctgcagatgac

SEQ ID NO: 7045077 - DNA, 22 bp, Homo sapiens
tttcaatgtatgtctttctgag

SEQ ID NO: 7045078 - DNA, 21 bp, Homo sapiens
tttcaatgtgttctttgtagt

SEQ ID NO: 7045079 - DNA, 22 bp, Homo sapiens
tttcaattgactttggaagaaa

SEQ ID NO: 7045080 - DNA, 22 bp, Homo sapiens
tttcaattgactttggaagaaa

SEQ ID NO: 7045081 - DNA, 22 bp, Homo sapiens
tttcaatttccaggctagaatt

SEQ ID NO: 7045082 - DNA, 20 bp, Homo sapiens
tttcacagtccctgtttcct

SEQ ID NO: 7045083 - DNA, 22 bp, Homo sapiens
tttcctaaggctcattttaaaa

SEQ ID NO: 7045084 - DNA, 22 bp, Homo sapiens
tttcctaaggctcattttaaaa

SEQ ID NO: 7045085 - DNA, 20 bp, Homo sapiens
tttcctaagtggtttgctga

SEQ ID NO: 7045086 - DNA, 22 bp, Homo sapiens
tttcctaatcccaatgacattt

SEQ ID NO: 7045087 - DNA, 22 bp, Homo sapiens
ctccccatccaggcagcaggtg

SEQ ID NO: 7045088 - DNA, 22 bp, Homo sapiens
tttagtactgtttaaaaatgga

SEQ ID NO: 7045089 - DNA, 22 bp, Homo sapiens
tttagtcatttggatttgatct

SEQ ID NO: 7045090 - DNA, 23 bp, Homo sapiens
tttagtgatctcgtgtttttagc

SEQ ID NO: 7045091 - DNA, 22 bp, Homo sapiens
tttattccagtgtttctcaaat

SEQ ID NO: 7045092 - DNA, 22 bp, Homo sapiens
tttattccatgtgtctatgacc

SEQ ID NO: 7045093 - DNA, 18 bp, Homo sapiens
tttattcctgcccccagc

SEQ ID NO: 7045094 - DNA, 22 bp, Homo sapiens
ctcctggccctgagctcccagg

SEQ ID NO: 7045095 - DNA, 22 bp, Homo sapiens
ttctttcttagcaatctatggt

SEQ ID NO: 7045096 - DNA, 22 bp, Homo sapiens
ttcttttaatttctgtctgcag

SEQ ID NO: 7045097 - DNA, 22 bp, Homo sapiens
ttcttttaatttctgtctgcag

SEQ ID NO: 7045098 - DNA, 22 bp, Homo sapiens
ttcttttacattaagatttcag

SEQ ID NO: 7045099 - DNA, 22 bp, Homo sapiens
ttcttttacattaagatttcag

SEQ ID NO: 7045100 - DNA, 22 bp, Homo sapiens
ttcttttagaatttcctaaggt

SEQ ID NO: 7045101 - DNA, 22 bp, Homo sapiens
ttcttttagtcattcagggaag

SEQ ID NO: 7045102 - DNA, 18 bp, Homo sapiens
ttcttttcatgtgatctc

SEQ ID NO: 7045103 - DNA, 22 bp, Homo sapiens
ctccaaggctctggtgctgagg

SEQ ID NO: 7045104 - DNA, 20 bp, Homo sapiens
ctccaaggcttgcaggaggc

SEQ ID NO: 7045105 - DNA, 22 bp, Homo sapiens
ttgtaattaatggcagcaatta

SEQ ID NO: 7045106 - DNA, 22 bp, Homo sapiens
ttgtacaacgttttaaatttga

SEQ ID NO: 7045107 - DNA, 22 bp, Homo sapiens
ttgtggttaaccgcacattttt

SEQ ID NO: 7045108 - DNA, 22 bp, Homo sapiens
tttaacagatgtgaaattttca

SEQ ID NO: 7045109 - DNA, 22 bp, Homo sapiens
tttaacagatgtgaaattttca

SEQ ID NO: 7045110 - DNA, 22 bp, Homo sapiens
ctgcacccatgagctcaaggga

SEQ ID NO: 7045111 - DNA, 17 bp, Homo sapiens
ctgaggcccagggccca

SEQ ID NO: 7045112 - DNA, 22 bp, Homo sapiens
ctgcaaataggggtgtgaataa

SEQ ID NO: 7045113 - DNA, 19 bp, Homo sapiens
ctctttccattgtatttgc

SEQ ID NO: 7045114 - DNA, 22 bp, Homo sapiens
ctctttctcattgtcagcagaa

SEQ ID NO: 7045115 - DNA, 22 bp, Homo sapiens
ctctttctggaaggcagagtgg

SEQ ID NO: 7045116 - DNA, 18 bp, Homo sapiens
ctctttctttggcacaaa

SEQ ID NO: 7045117 - DNA, 22 bp, Homo sapiens
ttttcaggtacatcacatactg

SEQ ID NO: 7045118 - DNA, 22 bp, Homo sapiens
ttttcaggccagaagatagacc

SEQ ID NO: 7045119 - DNA, 22 bp, Homo sapiens
ttttcaggctgatttgtgttag

SEQ ID NO: 7045120 - DNA, 22 bp, Homo sapiens
ttttcaggtgcagtaatcatat

SEQ ID NO: 7045121 - DNA, 22 bp, Homo sapiens
ttttcacttaaggaatttcatg

SEQ ID NO: 7045122 - DNA, 22 bp, Homo sapiens
ttttagtaccaaccagaagatg

SEQ ID NO: 7045123 - DNA, 22 bp, Homo sapiens
tttgtacatatataaaatctgt

SEQ ID NO: 7045124 - DNA, 22 bp, Homo sapiens
ttttaagaactgttctgtgctt

SEQ ID NO: 7045125 - DNA, 22 bp, Homo sapiens
ttttaagatgctagtatttcag

SEQ ID NO: 7045126 - DNA, 22 bp, Homo sapiens
ttttaagatgctagtatttcag

SEQ ID NO: 7045127 - DNA, 19 bp, Homo sapiens
ttttaagtcctctctattc

SEQ ID NO: 7045128 - DNA, 22 bp, Homo sapiens
ttttaagtgcaatctgaatgcg

SEQ ID NO: 7045129 - DNA, 19 bp, Homo sapiens
ttttaagtgccctttcttc

SEQ ID NO: 7045130 - DNA, 22 bp, Homo sapiens
ttttaagttggattgctaagta

SEQ ID NO: 7045131 - DNA, 22 bp, Homo sapiens
ttttaagtttattccagtacat

SEQ ID NO: 7045132 - DNA, 22 bp, Homo sapiens
ttttaatactgctattgtagga

SEQ ID NO: 7045133 - DNA, 22 bp, Homo sapiens
ttttagcaattggtctctcgtt

SEQ ID NO: 7045134 - DNA, 22 bp, Homo sapiens
ttttagcacactttctttagcg

SEQ ID NO: 7045135 - DNA, 22 bp, Homo sapiens
ttttagcactaagtgatatgct

SEQ ID NO: 7045136 - DNA, 20 bp, Homo sapiens
ttttagcacttgttatggtg

SEQ ID NO: 7045137 - DNA, 20 bp, Homo sapiens
ttttagcacttgttatggtg

SEQ ID NO: 7045138 - DNA, 20 bp, Homo sapiens
ttttagcagaaagaaagctc

SEQ ID NO: 7045139 - DNA, 22 bp, Homo sapiens
tttgggaagtttaaaataagta

SEQ ID NO: 7045140 - DNA, 22 bp, Homo sapiens
tttgggaaccagaagttcaaaa

SEQ ID NO: 7045141 - DNA, 22 bp, Homo sapiens
tttggacaaacagaatagagct

SEQ ID NO: 7045142 - DNA, 22 bp, Homo sapiens
tttgggaaatagtagaaaatgt

SEQ ID NO: 7045143 - DNA, 21 bp, Homo sapiens
tttgccttcacgaagcatcct

SEQ ID NO: 7045144 - DNA, 22 bp, Homo sapiens
tttgccttctctgaacctattt

SEQ ID NO: 7045145 - DNA, 22 bp, Homo sapiens
ctctggaaatggccatagtcat

SEQ ID NO: 7045146 - DNA, 22 bp, Homo sapiens
ctctgcccccagctggtgcttg

SEQ ID NO: 7045147 - DNA, 21 bp, Homo sapiens
ctctgcccagggcctcctgcc

SEQ ID NO: 7045148 - DNA, 22 bp, Homo sapiens
tttccttgttcatttgccctat

SEQ ID NO: 7045149 - DNA, 22 bp, Homo sapiens
tttcctttatgacatcaccact

SEQ ID NO: 7045150 - DNA, 22 bp, Homo sapiens
ctgtgccccacagagctccaca

SEQ ID NO: 7045151 - DNA, 22 bp, Homo sapiens
ctgtgcccggcccagggccctg

SEQ ID NO: 7045152 - DNA, 22 bp, Homo sapiens
ctgggtgagtataggaaaggga

SEQ ID NO: 7045153 - DNA, 22 bp, Homo sapiens
ctgtggctcattcttggtggca

SEQ ID NO: 7045154 - DNA, 22 bp, Homo sapiens
ctgtggctccatagaagttgca

SEQ ID NO: 7045155 - DNA, 22 bp, Homo sapiens
ctgtggctctcagaggctgctg

SEQ ID NO: 7045156 - DNA, 22 bp, Homo sapiens
ctgtggctctccaatggaggga

SEQ ID NO: 7045157 - DNA, 22 bp, Homo sapiens
ctgtggctctctgcagggtccc

SEQ ID NO: 7045158 - DNA, 22 bp, Homo sapiens
ctgtggctgcgccctgggggag

SEQ ID NO: 7045159 - DNA, 22 bp, Homo sapiens
ctgtggctggaataataaatgt

SEQ ID NO: 7045160 - DNA, 22 bp, Homo sapiens
ctgtggctggctcatcataggt

SEQ ID NO: 7045161 - DNA, 22 bp, Homo sapiens
ctgtggctgtatttggccagag

SEQ ID NO: 7045162 - DNA, 22 bp, Homo sapiens
ctgttgctccagggaacacaga

SEQ ID NO: 7045163 - DNA, 22 bp, Homo sapiens
ctgttgcttcaggaaacagtaa

SEQ ID NO: 7045164 - DNA, 22 bp, Homo sapiens
cttatttactgatccacagatg

SEQ ID NO: 7045165 - DNA, 22 bp, Homo sapiens
cttattttaagtcagtttgggt

SEQ ID NO: 7045166 - DNA, 22 bp, Homo sapiens
cttattttgctgatgacccagg

SEQ ID NO: 7045167 - DNA, 22 bp, Homo sapiens
cttcaaaagccagaagcctgcg

SEQ ID NO: 7045168 - DNA, 22 bp, Homo sapiens
cttcagctgcagttatgtttag

SEQ ID NO: 7045169 - DNA, 22 bp, Homo sapiens
cttcagggaggagcatgggttc

SEQ ID NO: 7045170 - DNA, 19 bp, Homo sapiens
cttcagggaggggccaggc

SEQ ID NO: 7045171 - DNA, 22 bp, Homo sapiens
cttcagggcatattattggctc

SEQ ID NO: 7045172 - DNA, 22 bp, Homo sapiens
cttcaggggtgttagttttgtg

SEQ ID NO: 7045173 - DNA, 22 bp, Homo sapiens
cttcagggtgacgcaggctgca

SEQ ID NO: 7045174 - DNA, 22 bp, Homo sapiens
cttcctggatgaagcccagcat

SEQ ID NO: 7045175 - DNA, 22 bp, Homo sapiens
cttcctggatgagcaggctgat

SEQ ID NO: 7045176 - DNA, 22 bp, Homo sapiens
cttgacactgtcactcaggcca

SEQ ID NO: 7045177 - DNA, 22 bp, Homo sapiens
cttgcacatttcacacaatagg

SEQ ID NO: 7045178 - DNA, 23 bp, Homo sapiens
cttgtattcactcatttgggaac

SEQ ID NO: 7045179 - DNA, 22 bp, Homo sapiens
cttgtattcagcatcttaacta

SEQ ID NO: 7045180 - DNA, 22 bp, Homo sapiens
cttgtattgctgttttgcatct

SEQ ID NO: 7045181 - DNA, 22 bp, Homo sapiens
cttgtcaagtcactttaacctc

SEQ ID NO: 7045182 - DNA, 22 bp, Homo sapiens
cttgtcaggtaggtgtcatttc

SEQ ID NO: 7045183 - DNA, 22 bp, Homo sapiens
ctgggtctggaggccaagggtg

SEQ ID NO: 7045184 - DNA, 22 bp, Homo sapiens
ctggggctctctggaatgcttg

SEQ ID NO: 7045185 - DNA, 22 bp, Homo sapiens
ctggggctgcagcgatcttcat

SEQ ID NO: 7045186 - DNA, 22 bp, Homo sapiens
ctggggctgcggacgggagccc

SEQ ID NO: 7045187 - DNA, 22 bp, Homo sapiens
ctggggctgcggtggaggagcc

SEQ ID NO: 7045188 - DNA, 22 bp, Homo sapiens
ctggggctggtgaggcaggctc

SEQ ID NO: 7045189 - DNA, 22 bp, Homo sapiens
ctggggccacaacggcgcacgc

SEQ ID NO: 7045190 - DNA, 22 bp, Homo sapiens
ctggggccagtgaggaggcttt

SEQ ID NO: 7045191 - DNA, 22 bp, Homo sapiens
ctggggctcactccagccctgg

SEQ ID NO: 7045192 - DNA, 22 bp, Homo sapiens
ctggggctcactccagccctgg

SEQ ID NO: 7045193 - DNA, 22 bp, Homo sapiens
ctggggctcactttggtcaggc

SEQ ID NO: 7045194 - DNA, 23 bp, Homo sapiens
ctggggctcattgcagtagccat

SEQ ID NO: 7045195 - DNA, 23 bp, Homo sapiens
ctggggctcattgcagtagccat

SEQ ID NO: 7045196 - DNA, 22 bp, Homo sapiens
ctggggctctctggaatgcttg

SEQ ID NO: 7045197 - DNA, 22 bp, Homo sapiens
ctgggctgccaggtaggcacac

SEQ ID NO: 7045198 - DNA, 20 bp, Homo sapiens
ctgggctgcccagctatggg

SEQ ID NO: 7045199 - DNA, 22 bp, Homo sapiens
ctgggctgcgggcgcccctcca

SEQ ID NO: 7045200 - DNA, 22 bp, Homo sapiens
ctgggctgcggtggtaggttgt

SEQ ID NO: 7045201 - DNA, 22 bp, Homo sapiens
ctgggctgcggttctctgaagc

SEQ ID NO: 7045202 - DNA, 22 bp, Homo sapiens
ctgggctgctcagccccctcgc

SEQ ID NO: 7045203 - DNA, 22 bp, Homo sapiens
ctgggctgctgtccactagggt

SEQ ID NO: 7045204 - DNA, 23 bp, Homo sapiens
ctgggctgcttgagtccctggct

SEQ ID NO: 7045205 - DNA, 22 bp, Homo sapiens
ctgggctgcttgctgaaggggt

SEQ ID NO: 7045206 - DNA, 22 bp, Homo sapiens
ctgggctggacacacttaacct

SEQ ID NO: 7045207 - DNA, 22 bp, Homo sapiens
ctgggccagaccttgtggtctt

SEQ ID NO: 7045208 - DNA, 22 bp, Homo sapiens
ctgggccagaccttgtggtctt

SEQ ID NO: 7045209 - DNA, 22 bp, Homo sapiens
ctgggccagatccagcctcaca

SEQ ID NO: 7045210 - DNA, 22 bp, Homo sapiens
ctgggctgcaggagtggggcaa

SEQ ID NO: 7045211 - DNA, 22 bp, Homo sapiens
ctgggctgcaggcactaattgg

SEQ ID NO: 7045212 - DNA, 22 bp, Homo sapiens
ctgggctgcagttcctggtcct

SEQ ID NO: 7045213 - DNA, 22 bp, Homo sapiens
ctgggctgcatcaaagaggcat

SEQ ID NO: 7045214 - DNA, 22 bp, Homo sapiens
ctgggcaggagaggtggttgga

SEQ ID NO: 7045215 - DNA, 22 bp, Homo sapiens
ctgggcaggagggctctatgga

SEQ ID NO: 7045216 - DNA, 22 bp, Homo sapiens
ctgggcagttttacatcattgc

SEQ ID NO: 7045217 - DNA, 22 bp, Homo sapiens
ctgggcatatacgtgcaagtca

SEQ ID NO: 7045218 - DNA, 22 bp, Homo sapiens
ctgggccacaagcctgtgtgat

SEQ ID NO: 7045219 - DNA, 22 bp, Homo sapiens
ctgggccacatcagatgaagac

SEQ ID NO: 7045220 - DNA, 22 bp, Homo sapiens
ctgggccactccagatgcccac

SEQ ID NO: 7045221 - DNA, 22 bp, Homo sapiens
ctgggagctcagccctggggtg

SEQ ID NO: 7045222 - DNA, 22 bp, Homo sapiens
ctgggaggcaccgcgtcgtgct

SEQ ID NO: 7045223 - DNA, 22 bp, Homo sapiens
ctggccctcggagtccagctgc

SEQ ID NO: 7045224 - DNA, 22 bp, Homo sapiens
gaggagctgttccctcacctct

SEQ ID NO: 7045225 - DNA, 22 bp, Homo sapiens
gaggaggaagttctctgtaggc

SEQ ID NO: 7045226 - DNA, 22 bp, Homo sapiens
gaggccagcgcgcagcactttt

SEQ ID NO: 7045227 - DNA, 22 bp, Homo sapiens
gaggccagctacccaagggtca

SEQ ID NO: 7045228 - DNA, 22 bp, Homo sapiens
gagctgttgtaagtattagaag

SEQ ID NO: 7045229 - DNA, 22 bp, Homo sapiens
gagcttcagcgtgtgctaaggg

SEQ ID NO: 7045230 - DNA, 22 bp, Homo sapiens
gagcttcatatgttgcagagaa

SEQ ID NO: 7045231 - DNA, 22 bp, Homo sapiens
gagcttcatgattgctttgctt

SEQ ID NO: 7045232 - DNA, 22 bp, Homo sapiens
gagccaggtttgaatctcagtc

SEQ ID NO: 7045233 - DNA, 22 bp, Homo sapiens
gagaggctatgaggttctgtgt

SEQ ID NO: 7045234 - DNA, 22 bp, Homo sapiens
gagaggctcagggacttgctga

SEQ ID NO: 7045235 - DNA, 22 bp, Homo sapiens
gagaggctggtaaagtctgaac

SEQ ID NO: 7045236 - DNA, 22 bp, Homo sapiens
gagaggcttaagggctgtgaag

SEQ ID NO: 7045237 - DNA, 22 bp, Homo sapiens
gagaggcttgtgtgaagaacaa

SEQ ID NO: 7045238 - DNA, 18 bp, Homo sapiens
gagagggatccctcagga

SEQ ID NO: 7045239 - DNA, 22 bp, Homo sapiens
gagatgaatgtaaacaaaggca

SEQ ID NO: 7045240 - DNA, 22 bp, Homo sapiens
gacctcagattttcccaggcca

SEQ ID NO: 7045241 - DNA, 22 bp, Homo sapiens
gacctcagctgtggggatgctg

SEQ ID NO: 7045242 - DNA, 22 bp, Homo sapiens
gacctcaggcttctgtaattaa

SEQ ID NO: 7045243 - DNA, 22 bp, Homo sapiens
gacctctgaaggcagagcaggg

SEQ ID NO: 7045244 - DNA, 22 bp, Homo sapiens
gacctctgggtgatgcccaggc

SEQ ID NO: 7045245 - DNA, 22 bp, Homo sapiens
gagaaggagtagctgacctggg

SEQ ID NO: 7045246 - DNA, 20 bp, Homo sapiens
gagatggacagatgaagggg

SEQ ID NO: 7045247 - DNA, 22 bp, Homo sapiens
gagcagcagttgttacaatgat

SEQ ID NO: 7045248 - DNA, 22 bp, Homo sapiens
gagccaggggtcagctccgagg

SEQ ID NO: 7045249 - DNA, 22 bp, Homo sapiens
gagccaggtcgggccgcggcga

SEQ ID NO: 7045250 - DNA, 22 bp, Homo sapiens
gagccaggttggaggctgcagt

SEQ ID NO: 7045251 - DNA, 22 bp, Homo sapiens
gacagggtccaaaggcagggga

SEQ ID NO: 7045252 - DNA, 22 bp, Homo sapiens
gaccctgtttctacaaataatt

SEQ ID NO: 7045253 - DNA, 22 bp, Homo sapiens
gacagggacacagccagtgagg

SEQ ID NO: 7045254 - DNA, 22 bp, Homo sapiens
gacaggggctttgcatgcttta

SEQ ID NO: 7045255 - DNA, 22 bp, Homo sapiens
gacaggcctagattcactgctg

SEQ ID NO: 7045256 - DNA, 22 bp, Homo sapiens
gaaggaaatctgtgatttatgc

SEQ ID NO: 7045257 - DNA, 22 bp, Homo sapiens
gaatacaagccaggcacaaggc

SEQ ID NO: 7045258 - DNA, 22 bp, Homo sapiens
gaatacaagcctgccacctgga

SEQ ID NO: 7045259 - DNA, 22 bp, Homo sapiens
gaatacatgtgtgtatagaggt

SEQ ID NO: 7045260 - DNA, 22 bp, Homo sapiens
gaatacttttgttaggaaaacg

SEQ ID NO: 7045261 - DNA, 22 bp, Homo sapiens
gaatatattattcagcttttca

SEQ ID NO: 7045262 - DNA, 22 bp, Homo sapiens
gaatattagtatcagttatacc

SEQ ID NO: 7045263 - DNA, 22 bp, Homo sapiens
gaagccccaaaccctcgccatc

SEQ ID NO: 7045264 - DNA, 22 bp, Homo sapiens
gaagccccatggatatatgtga

SEQ ID NO: 7045265 - DNA, 22 bp, Homo sapiens
gaagcaaaatgtctgcacatat

SEQ ID NO: 7045266 - DNA, 22 bp, Homo sapiens
gaagataattcctacttataac

SEQ ID NO: 7045267 - DNA, 22 bp, Homo sapiens
gaagattaatgagaaacctgct

SEQ ID NO: 7045268 - DNA, 22 bp, Homo sapiens
gaagattagggttagcataagt

SEQ ID NO: 7045269 - DNA, 22 bp, Homo sapiens
gaagaggactgtggcatcctag

SEQ ID NO: 7045270 - DNA, 22 bp, Homo sapiens
gaagaggatgacaggagccggt

SEQ ID NO: 7045271 - DNA, 22 bp, Homo sapiens
gaagacacaattggtgggtcca

SEQ ID NO: 7045272 - DNA, 20 bp, Homo sapiens
gaagacacagagttcatctc

SEQ ID NO: 7045273 - DNA, 21 bp, Homo sapiens
gaagacacataacctctctcc

SEQ ID NO: 7045274 - DNA, 22 bp, Homo sapiens
gaagacacctactgtcatttct

SEQ ID NO: 7045275 - DNA, 22 bp, Homo sapiens
gaagacactaaactggggcttc

SEQ ID NO: 7045276 - DNA, 22 bp, Homo sapiens
gaagacactaaggcccagggag

SEQ ID NO: 7045277 - DNA, 22 bp, Homo sapiens
gaagacactctgcagagttatc

SEQ ID NO: 7045278 - DNA, 22 bp, Homo sapiens
gaagacatgtggattctagttt

SEQ ID NO: 7045279 - DNA, 22 bp, Homo sapiens
gaagacatgtttttaatatgta

SEQ ID NO: 7045280 - DNA, 22 bp, Homo sapiens
gaaatgcagattctgattctgt

SEQ ID NO: 7045281 - DNA, 22 bp, Homo sapiens
gaaatgcaggcttggattcagc

SEQ ID NO: 7045282 - DNA, 22 bp, Homo sapiens
gaaatgcaaattctctctcgct

SEQ ID NO: 7045283 - DNA, 22 bp, Homo sapiens
gaacatttggatttgtaaattt

SEQ ID NO: 7045284 - DNA, 22 bp, Homo sapiens
ctttcaatcaaagtttctagtg

SEQ ID NO: 7045285 - DNA, 22 bp, Homo sapiens
ctttcaatgtgcctgccttggg

SEQ ID NO: 7045286 - DNA, 22 bp, Homo sapiens
ctttcaggaaggttaaatataa

SEQ ID NO: 7045287 - DNA, 22 bp, Homo sapiens
ctttcaggagaggattataaca

SEQ ID NO: 7045288 - DNA, 22 bp, Homo sapiens
ctttcagggcaacacttctttt

SEQ ID NO: 7045289 - DNA, 22 bp, Homo sapiens
ctttcagggcagacaacgagca

SEQ ID NO: 7045290 - DNA, 22 bp, Homo sapiens
ctttcaggggcttgactccaca

SEQ ID NO: 7045291 - DNA, 22 bp, Homo sapiens
ctttcaggtcacataacgccaa

SEQ ID NO: 7045292 - DNA, 22 bp, Homo sapiens
ctttcaggttctataggaagcc

SEQ ID NO: 7045293 - DNA, 22 bp, Homo sapiens
ctttcataaaggaaatgatgag

SEQ ID NO: 7045294 - DNA, 22 bp, Homo sapiens
ctttcatagttaaaatagtttg

SEQ ID NO: 7045295 - DNA, 22 bp, Homo sapiens
ctttcattcttagatattagtg

SEQ ID NO: 7045296 - DNA, 22 bp, Homo sapiens
gaaatcaaacccttttctgata

SEQ ID NO: 7045297 - DNA, 22 bp, Homo sapiens
gaaatcaaggctacattcaggt

SEQ ID NO: 7045298 - DNA, 22 bp, Homo sapiens
gaaatcaatttcttggttgata

SEQ ID NO: 7045299 - DNA, 22 bp, Homo sapiens
gcctccggagtcacagtgtctt

SEQ ID NO: 7045300 - DNA, 22 bp, Homo sapiens
gcctccggagttgcagtgtctt

SEQ ID NO: 7045301 - DNA, 22 bp, Homo sapiens
gcctcctcacaatgtacccacg

SEQ ID NO: 7045302 - DNA, 22 bp, Homo sapiens
gcctcctccttcccgagggtct

SEQ ID NO: 7045303 - DNA, 22 bp, Homo sapiens
gcctcctcttgagggtcaggga

SEQ ID NO: 7045304 - DNA, 22 bp, Homo sapiens
gcctctggagtcgcagcgtctt

SEQ ID NO: 7045305 - DNA, 22 bp, Homo sapiens
gcctctggcttctgcatcagtg

SEQ ID NO: 7045306 - DNA, 22 bp, Homo sapiens
gccctgtgcttggatggcagat

SEQ ID NO: 7045307 - DNA, 22 bp, Homo sapiens
gccctgggcaaggttctggcca

SEQ ID NO: 7045308 - DNA, 22 bp, Homo sapiens
gccctgggctccctgctccaca

SEQ ID NO: 7045309 - DNA, 22 bp, Homo sapiens
gccctgggattgggtggaggct

SEQ ID NO: 7045310 - DNA, 22 bp, Homo sapiens
gcccaggactcagggtgtcgcg

SEQ ID NO: 7045311 - DNA, 22 bp, Homo sapiens
gcccaggagaggccagggctga

SEQ ID NO: 7045312 - DNA, 22 bp, Homo sapiens
gcccaggagcctggagatgtgt

SEQ ID NO: 7045313 - DNA, 22 bp, Homo sapiens
gcccaggaggagaggctgcagt

SEQ ID NO: 7045314 - DNA, 22 bp, Homo sapiens
gcccatggcttccctaggcaca

SEQ ID NO: 7045315 - DNA, 22 bp, Homo sapiens
gcccatgggcctgaggccctag

SEQ ID NO: 7045316 - DNA, 22 bp, Homo sapiens
gcccatgggctccagacctggg

SEQ ID NO: 7045317 - DNA, 22 bp, Homo sapiens
gcccagctggcttccagcacat

SEQ ID NO: 7045318 - DNA, 22 bp, Homo sapiens
gcccagctgtctggcagggatg

SEQ ID NO: 7045319 - DNA, 22 bp, Homo sapiens
gcccagcttttcacttccacac

SEQ ID NO: 7045320 - DNA, 22 bp, Homo sapiens
gcccagcttttcacttccacac

SEQ ID NO: 7045321 - DNA, 22 bp, Homo sapiens
gcccagctttttgaggcaggca

SEQ ID NO: 7045322 - DNA, 22 bp, Homo sapiens
gcccaggaagtgactcagatgt

SEQ ID NO: 7045323 - DNA, 22 bp, Homo sapiens
gcccaggaagttgaggctgccg

SEQ ID NO: 7045324 - DNA, 20 bp, Homo sapiens
gcccaggaatttgcatttct

SEQ ID NO: 7045325 - DNA, 16 bp, Homo sapiens
gcccaggacgggaggc

SEQ ID NO: 7045326 - DNA, 22 bp, Homo sapiens
gcccagcctccaagctccaagg

SEQ ID NO: 7045327 - DNA, 22 bp, Homo sapiens
gcccagctccattcttggtgag

SEQ ID NO: 7045328 - DNA, 22 bp, Homo sapiens
gcccagctccattcttggtgag

SEQ ID NO: 7045329 - DNA, 22 bp, Homo sapiens
gcccagctcctctgcagaccct

SEQ ID NO: 7045330 - DNA, 22 bp, Homo sapiens
gcccagctgagaagcgcggggc

SEQ ID NO: 7045331 - DNA, 22 bp, Homo sapiens
gcccagctgcaccctggtgggt

SEQ ID NO: 7045332 - DNA, 22 bp, Homo sapiens
gcccagctgcaccctggtgggt

SEQ ID NO: 7045333 - DNA, 22 bp, Homo sapiens
gcccagctggcttccagcacat

SEQ ID NO: 7045334 - DNA, 22 bp, Homo sapiens
gccaggggacgcggagcgacga

SEQ ID NO: 7045335 - DNA, 22 bp, Homo sapiens
gccagggggtcagcaggcactt

SEQ ID NO: 7045336 - DNA, 22 bp, Homo sapiens
gccagggggtcagcaggcactt

SEQ ID NO: 7045337 - DNA, 22 bp, Homo sapiens
gccagggtgtgcagggacagga

SEQ ID NO: 7045338 - DNA, 22 bp, Homo sapiens
gcatgcagggagggtctggctg

SEQ ID NO: 7045339 - DNA, 22 bp, Homo sapiens
gcatgcaggataggttgagctc

SEQ ID NO: 7045340 - DNA, 22 bp, Homo sapiens
gcatgcaggaagggcttgggga

SEQ ID NO: 7045341 - DNA, 22 bp, Homo sapiens
gcagtggcatgatgtgggctca

SEQ ID NO: 7045342 - DNA, 22 bp, Homo sapiens
gcagtggccacatggaggagga

SEQ ID NO: 7045343 - DNA, 22 bp, Homo sapiens
gcagtggcccagcttgcaggct

SEQ ID NO: 7045344 - DNA, 22 bp, Homo sapiens
gcagtgggaaggttggcacatg

SEQ ID NO: 7045345 - DNA, 22 bp, Homo sapiens
gcagtgggaaggttggcacatg

SEQ ID NO: 7045346 - DNA, 17 bp, Homo sapiens
gcagtggaggggtagtt

SEQ ID NO: 7045347 - DNA, 22 bp, Homo sapiens
gcagtggatggccagcaggggc

SEQ ID NO: 7045348 - DNA, 22 bp, Homo sapiens
gcagtggcagagacagcaccaa

SEQ ID NO: 7045349 - DNA, 22 bp, Homo sapiens
gcagtggcagctgagggggtat

SEQ ID NO: 7045350 - DNA, 22 bp, Homo sapiens
gccagggaggctgtagggtcct

SEQ ID NO: 7045351 - DNA, 22 bp, Homo sapiens
gccagggagtctgggccacaga

SEQ ID NO: 7045352 - DNA, 21 bp, Homo sapiens
gccagggagttaaagagtctt

SEQ ID NO: 7045353 - DNA, 22 bp, Homo sapiens
gccagggaacccaagggcctca

SEQ ID NO: 7045354 - DNA, 21 bp, Homo sapiens
gccagggaagagagttggctg

SEQ ID NO: 7045355 - DNA, 17 bp, Homo sapiens
gccagggagaggaagcc

SEQ ID NO: 7045356 - DNA, 22 bp, Homo sapiens
gccagcctgtgcttggccaggc

SEQ ID NO: 7045357 - DNA, 22 bp, Homo sapiens
gccagctcttgatgggtgggta

SEQ ID NO: 7045358 - DNA, 22 bp, Homo sapiens
gcagggctttttgaaacatggt

SEQ ID NO: 7045359 - DNA, 22 bp, Homo sapiens
gcagggcttgcagcagctagac

SEQ ID NO: 7045360 - DNA, 22 bp, Homo sapiens
gcagggctgtttagtgaatagg

SEQ ID NO: 7045361 - DNA, 22 bp, Homo sapiens
gcagggcttagaaatggtggct

SEQ ID NO: 7045362 - DNA, 22 bp, Homo sapiens
gcagggcttgcagcagctagac

SEQ ID NO: 7045363 - DNA, 22 bp, Homo sapiens
gcagggctgtggacactttggt

SEQ ID NO: 7045364 - DNA, 22 bp, Homo sapiens
gcagggctgttcaggagggtgg

SEQ ID NO: 7045365 - DNA, 22 bp, Homo sapiens
gcagggctgaaggtcccaggcc

SEQ ID NO: 7045366 - DNA, 22 bp, Homo sapiens
gcagggctctgctgtagtccta

SEQ ID NO: 7045367 - DNA, 22 bp, Homo sapiens
gcagggctggggctgctcctga

SEQ ID NO: 7045368 - DNA, 22 bp, Homo sapiens
gcagggctgggtcctgtctcat

SEQ ID NO: 7045369 - DNA, 22 bp, Homo sapiens
gcagggctgggtgggagacaga

SEQ ID NO: 7045370 - DNA, 22 bp, Homo sapiens
gcagggctgtaatttgagcctg

SEQ ID NO: 7045371 - DNA, 22 bp, Homo sapiens
gcagggaccaaaagaggcagta

SEQ ID NO: 7045372 - DNA, 22 bp, Homo sapiens
gcagggaagacccggagcagcg

SEQ ID NO: 7045373 - DNA, 22 bp, Homo sapiens
gcagggaaggggcatgctggag

SEQ ID NO: 7045374 - DNA, 22 bp, Homo sapiens
gcaggaagggaaaggttgactc

SEQ ID NO: 7045375 - DNA, 22 bp, Homo sapiens
gaggccagtgaaatgttataaa

SEQ ID NO: 7045376 - DNA, 22 bp, Homo sapiens
gcaaataaatgctcactgctgt

SEQ ID NO: 7045377 - DNA, 22 bp, Homo sapiens
gcacagtggagtgtgtccaggg

SEQ ID NO: 7045378 - DNA, 22 bp, Homo sapiens
gcacagttgacaatgattaaga

SEQ ID NO: 7045379 - DNA, 22 bp, Homo sapiens
gcacatgagaagctggcgatgc

SEQ ID NO: 7045380 - DNA, 22 bp, Homo sapiens
gcacatgagctgctgggatggg

SEQ ID NO: 7045381 - DNA, 22 bp, Homo sapiens
gcacatgagttaagctggggca

SEQ ID NO: 7045382 - DNA, 21 bp, Homo sapiens
gcagactgccctgctgtcccc

SEQ ID NO: 7045383 - DNA, 22 bp, Homo sapiens
gcagaggatagcatatgaacct

SEQ ID NO: 7045384 - DNA, 22 bp, Homo sapiens
gcagaggcatttctgacgctgc

SEQ ID NO: 7045385 - DNA, 22 bp, Homo sapiens
gcagaggccatcaactttgcca

SEQ ID NO: 7045386 - DNA, 22 bp, Homo sapiens
gcagagggtcctgtgccagcag

SEQ ID NO: 7045387 - DNA, 22 bp, Homo sapiens
gctgagggccgcatagggtcat

SEQ ID NO: 7045388 - DNA, 22 bp, Homo sapiens
gctgcctgtgtggccactcact

SEQ ID NO: 7045389 - DNA, 22 bp, Homo sapiens
gctgcttctctgatggagtcca

SEQ ID NO: 7045390 - DNA, 22 bp, Homo sapiens
gctcctccaatatggactcctc

SEQ ID NO: 7045391 - DNA, 22 bp, Homo sapiens
gctcctccctgtgcagacccag

SEQ ID NO: 7045392 - DNA, 20 bp, Homo sapiens
gctctgggagggatgtgatg

SEQ ID NO: 7045393 - DNA, 22 bp, Homo sapiens
gctctgggccatcctggccggg

SEQ ID NO: 7045394 - DNA, 22 bp, Homo sapiens
gctctgggctgccctctggaca

SEQ ID NO: 7045395 - DNA, 22 bp, Homo sapiens
gctctggggcccagggatcaca

SEQ ID NO: 7045396 - DNA, 22 bp, Homo sapiens
gctgacagagtgcctggcctca

SEQ ID NO: 7045397 - DNA, 22 bp, Homo sapiens
gctgagacttccactgccatct

SEQ ID NO: 7045398 - DNA, 19 bp, Homo sapiens
gctcagagggccctgtgct

SEQ ID NO: 7045399 - DNA, 23 bp, Homo sapiens
gctcagaggtttttctctggatg

SEQ ID NO: 7045400 - DNA, 22 bp, Homo sapiens
gctccctgcactctgcagccct

SEQ ID NO: 7045401 - DNA, 22 bp, Homo sapiens
gctccctgctccttcaccgacc

SEQ ID NO: 7045402 - DNA, 22 bp, Homo sapiens
gcctctggggtggagcccagca

SEQ ID NO: 7045403 - DNA, 22 bp, Homo sapiens
gcctctggggttaatagagttt

SEQ ID NO: 7045404 - DNA, 22 bp, Homo sapiens
gcctctgggtgacgaaaggtga

SEQ ID NO: 7045405 - DNA, 22 bp, Homo sapiens
gcctctgggttggtgacaggct

SEQ ID NO: 7045406 - DNA, 23 bp, Homo sapiens
gccttggcgatccgtggggcatc

SEQ ID NO: 7045407 - DNA, 22 bp, Homo sapiens
gcctttcacagagatttaaaaa

SEQ ID NO: 7045408 - DNA, 23 bp, Homo sapiens
gctacagctgactgtcattccct

SEQ ID NO: 7045409 - DNA, 22 bp, Homo sapiens
gctgggcttcacctccagagtt

SEQ ID NO: 7045410 - DNA, 22 bp, Homo sapiens
gctgggcttctcaatgctgcct

SEQ ID NO: 7045411 - DNA, 22 bp, Homo sapiens
gctgggctggccgccgagatcg

SEQ ID NO: 7045412 - DNA, 22 bp, Homo sapiens
gctggagagataggcatggggt

SEQ ID NO: 7045413 - DNA, 22 bp, Homo sapiens
gcttgcagtggttggcatgacc

SEQ ID NO: 7045414 - DNA, 22 bp, Homo sapiens
gctttatgtgagtagcactgtc

SEQ ID NO: 7045415 - DNA, 22 bp, Homo sapiens
ggagccagaaatgctgtggttg

SEQ ID NO: 7045416 - DNA, 22 bp, Homo sapiens
ggagccagaaatgctgtggttg

SEQ ID NO: 7045417 - DNA, 22 bp, Homo sapiens
ggagcagggaattacagcgcag

SEQ ID NO: 7045418 - DNA, 22 bp, Homo sapiens
ggagagaattccatggacatgt

SEQ ID NO: 7045419 - DNA, 22 bp, Homo sapiens
ggagcagggaattacagcgcag

SEQ ID NO: 7045420 - DNA, 22 bp, Homo sapiens
ggagacagtgacttagagactg

SEQ ID NO: 7045421 - DNA, 22 bp, Homo sapiens
ggagacagtggtagggcctaag

SEQ ID NO: 7045422 - DNA, 22 bp, Homo sapiens
ggagaccttaaggtgcttccta

SEQ ID NO: 7045423 - DNA, 18 bp, Homo sapiens
ggagactaaactgttgac

SEQ ID NO: 7045424 - DNA, 22 bp, Homo sapiens
ggagagaactggctccttctag

SEQ ID NO: 7045425 - DNA, 22 bp, Homo sapiens
ggacagggttggggcatataaa

SEQ ID NO: 7045426 - DNA, 23 bp, Homo sapiens
ggacacaggccttgtctgcgcct

SEQ ID NO: 7045427 - DNA, 22 bp, Homo sapiens
ggagacagtatggcttgtagct

SEQ ID NO: 7045428 - DNA, 22 bp, Homo sapiens
ggaagaggctggtagtgcccgt

SEQ ID NO: 7045429 - DNA, 22 bp, Homo sapiens
gctttcaaggaatttggtattt

SEQ ID NO: 7045430 - DNA, 22 bp, Homo sapiens
gctttcctggccctgtccctgc

SEQ ID NO: 7045431 - DNA, 17 bp, Homo sapiens
gctttccttgcccctcc

SEQ ID NO: 7045432 - DNA, 22 bp, Homo sapiens
ggcacagccctctctgtggaca

SEQ ID NO: 7045433 - DNA, 22 bp, Homo sapiens
ggcagaggaagctggaagtggg

SEQ ID NO: 7045434 - DNA, 22 bp, Homo sapiens
ggcagaggaaggatgaattcac

SEQ ID NO: 7045435 - DNA, 20 bp, Homo sapiens
ggcagagggcctgggagaag

SEQ ID NO: 7045436 - DNA, 22 bp, Homo sapiens
ggcagaggagctggaaacatgg

SEQ ID NO: 7045437 - DNA, 22 bp, Homo sapiens
ggcagaggagctggaaacatgg

SEQ ID NO: 7045438 - DNA, 22 bp, Homo sapiens
ggcagaggagctggaaacatgg

SEQ ID NO: 7045439 - DNA, 20 bp, Homo sapiens
ggcagagggcctgggagaag

SEQ ID NO: 7045440 - DNA, 22 bp, Homo sapiens
ggcagaggtagctggaaccagg

SEQ ID NO: 7045441 - DNA, 22 bp, Homo sapiens
ggcagaggtagctggaaccagg

SEQ ID NO: 7045442 - DNA, 22 bp, Homo sapiens
ggcaggaggaagagttagcacc

SEQ ID NO: 7045443 - DNA, 22 bp, Homo sapiens
ggcaacaactggacatagctgg

SEQ ID NO: 7045444 - DNA, 23 bp, Homo sapiens
ggagccagcctgtggggagcggg

SEQ ID NO: 7045445 - DNA, 22 bp, Homo sapiens
ggagccagagcactggggagcc

SEQ ID NO: 7045446 - DNA, 22 bp, Homo sapiens
ggagtcagaacccaggcttcta

SEQ ID NO: 7045447 - DNA, 22 bp, Homo sapiens
ggagtcagaggaaggcttgctc

SEQ ID NO: 7045448 - DNA, 22 bp, Homo sapiens
ggagtcagcctgtcagagtgta

SEQ ID NO: 7045449 - DNA, 22 bp, Homo sapiens
ggagtcaggagcaggctgggct

SEQ ID NO: 7045450 - DNA, 22 bp, Homo sapiens
ggagtcctgtgtcttccaggaa

SEQ ID NO: 7045451 - DNA, 22 bp, Homo sapiens
ggagtctagggtcctgggcctg

SEQ ID NO: 7045452 - DNA, 22 bp, Homo sapiens
ggcctctggttcacagggagga

SEQ ID NO: 7045453 - DNA, 22 bp, Homo sapiens
ggcctctggttcgtggtgacct

SEQ ID NO: 7045454 - DNA, 21 bp, Homo sapiens
ggcctctgtcatcctgggaag

SEQ ID NO: 7045455 - DNA, 23 bp, Homo sapiens
ggcctctgtgttctgcccacatg

SEQ ID NO: 7045456 - DNA, 22 bp, Homo sapiens
ggcctctgttctgcattcctcc

SEQ ID NO: 7045457 - DNA, 22 bp, Homo sapiens
ggcctctgtttggagccaggat

SEQ ID NO: 7045458 - DNA, 18 bp, Homo sapiens
ggcctgcagtgaagcaag

SEQ ID NO: 7045459 - DNA, 22 bp, Homo sapiens
ggcaggtggccaagtgtctaag

SEQ ID NO: 7045460 - DNA, 22 bp, Homo sapiens
ggccaaggtggagaaggcactg

SEQ ID NO: 7045461 - DNA, 22 bp, Homo sapiens
ggccagggcctggggactgtcc

SEQ ID NO: 7045462 - DNA, 22 bp, Homo sapiens
gggaggaaagagaagtggtcca

SEQ ID NO: 7045463 - DNA, 22 bp, Homo sapiens
gggaggaatgcaacttatttag

SEQ ID NO: 7045464 - DNA, 22 bp, Homo sapiens
gggagaggttacccgagcaact

SEQ ID NO: 7045465 - DNA, 22 bp, Homo sapiens
gggagctgtaagggacaggtag

SEQ ID NO: 7045466 - DNA, 22 bp, Homo sapiens
gggagacacgctgcaggcataa

SEQ ID NO: 7045467 - DNA, 19 bp, Homo sapiens
gggagacagctctgggctg

SEQ ID NO: 7045468 - DNA, 23 bp, Homo sapiens
gggaccaggcccttcctggtttg

SEQ ID NO: 7045469 - DNA, 20 bp, Homo sapiens
ggcttgtctgagtccctggc

SEQ ID NO: 7045470 - DNA, 22 bp, Homo sapiens
ggctgggcaaacaagactcttc

SEQ ID NO: 7045471 - DNA, 22 bp, Homo sapiens
ggctgggcagcagctgttaagc

SEQ ID NO: 7045472 - DNA, 22 bp, Homo sapiens
ggctgctggagttgggtctctc

SEQ ID NO: 7045473 - DNA, 22 bp, Homo sapiens
ggctgagagtggatcccaggga

SEQ ID NO: 7045474 - DNA, 21 bp, Homo sapiens
ggctgggcaggacccacccct

SEQ ID NO: 7045475 - DNA, 22 bp, Homo sapiens
ggctgggcaggtctgcacaggg

SEQ ID NO: 7045476 - DNA, 22 bp, Homo sapiens
ggctgggcaggtctgcacaggg

SEQ ID NO: 7045477 - DNA, 22 bp, Homo sapiens
ggctgggcatccatccatgaga

SEQ ID NO: 7045478 - DNA, 22 bp, Homo sapiens
ggctgggccagggcctgtggac

SEQ ID NO: 7045479 - DNA, 19 bp, Homo sapiens
ggctgggccctgtttctcc

SEQ ID NO: 7045480 - DNA, 22 bp, Homo sapiens
ggctgggccgcggctacccaga

SEQ ID NO: 7045481 - DNA, 22 bp, Homo sapiens
ggctgggcctctccctcagctg

SEQ ID NO: 7045482 - DNA, 22 bp, Homo sapiens
ggctgggctccgggagcatgcg

SEQ ID NO: 7045483 - DNA, 22 bp, Homo sapiens
ggctgggctcgctgattggctg

SEQ ID NO: 7045484 - DNA, 22 bp, Homo sapiens
ggctgggctgcggctgtacctg

SEQ ID NO: 7045485 - DNA, 22 bp, Homo sapiens
ggctgggctgctgggtcagagc

SEQ ID NO: 7045486 - DNA, 22 bp, Homo sapiens
ggctctggctcctggctttgtg

SEQ ID NO: 7045487 - DNA, 22 bp, Homo sapiens
ggctgaagaactgggagtctca

SEQ ID NO: 7045488 - DNA, 22 bp, Homo sapiens
ggctgagaacaggcccagcctc

SEQ ID NO: 7045489 - DNA, 22 bp, Homo sapiens
ggctgagaatcaacaacctgct

SEQ ID NO: 7045490 - DNA, 22 bp, Homo sapiens
ggctctgctcctggtgccagtg

SEQ ID NO: 7045491 - DNA, 22 bp, Homo sapiens
gtgcacccccaaggaggtggag

SEQ ID NO: 7045492 - DNA, 22 bp, Homo sapiens
gtgcacttgatctagacagatt

SEQ ID NO: 7045493 - DNA, 22 bp, Homo sapiens
gtgagacaagatttgtaggcag

SEQ ID NO: 7045494 - DNA, 22 bp, Homo sapiens
gtgagacaattcctcagtagac

SEQ ID NO: 7045495 - DNA, 22 bp, Homo sapiens
gtcctgggggcagctgtgtcca

SEQ ID NO: 7045496 - DNA, 22 bp, Homo sapiens
gtgaagatctgagccctcaggt

SEQ ID NO: 7045497 - DNA, 22 bp, Homo sapiens
gtgaagataaggatgctgcagt

SEQ ID NO: 7045498 - DNA, 22 bp, Homo sapiens
gtgaagatgcctcaggtgaccc

SEQ ID NO: 7045499 - DNA, 22 bp, Homo sapiens
ggttttaaccattcacaagtga

SEQ ID NO: 7045500 - DNA, 22 bp, Homo sapiens
ggttttaactacagaattgcaa

SEQ ID NO: 7045501 - DNA, 22 bp, Homo sapiens
gtattcttaaggattgagcaaa

SEQ ID NO: 7045502 - DNA, 22 bp, Homo sapiens
gtattcttatactcagtgagct

SEQ ID NO: 7045503 - DNA, 22 bp, Homo sapiens
gtattcttgagtggcaactagg

SEQ ID NO: 7045504 - DNA, 22 bp, Homo sapiens
gtattcttggttatcaaaatac

SEQ ID NO: 7045505 - DNA, 21 bp, Homo sapiens
gtattctttatgaagtgaaaa

SEQ ID NO: 7045506 - DNA, 17 bp, Homo sapiens
gtattctttgccttcca

SEQ ID NO: 7045507 - DNA, 22 bp, Homo sapiens
gtattgcaattactcttcttct

SEQ ID NO: 7045508 - DNA, 21 bp, Homo sapiens
gtattgcagagttatgtgctc

SEQ ID NO: 7045509 - DNA, 22 bp, Homo sapiens
gtattgcatagacctgggatga

SEQ ID NO: 7045510 - DNA, 22 bp, Homo sapiens
gtattgcattttgaatgcatgg

SEQ ID NO: 7045511 - DNA, 22 bp, Homo sapiens
gtccctcaaggtccagtcatgg

SEQ ID NO: 7045512 - DNA, 22 bp, Homo sapiens
gtccctggaatggactctgcgc

SEQ ID NO: 7045513 - DNA, 22 bp, Homo sapiens
gtcctgggaggggctggtcctg

SEQ ID NO: 7045514 - DNA, 22 bp, Homo sapiens
gtcctgggcccaggggctgcct

SEQ ID NO: 7045515 - DNA, 22 bp, Homo sapiens
ggtggcggccacttcagccctg

SEQ ID NO: 7045516 - DNA, 22 bp, Homo sapiens
ggtgtgggccctgatgtcagca

SEQ ID NO: 7045517 - DNA, 22 bp, Homo sapiens
ggtgtgggccctgatgtcagca

SEQ ID NO: 7045518 - DNA, 22 bp, Homo sapiens
ggtgttggaacatggtgagatt

SEQ ID NO: 7045519 - DNA, 22 bp, Homo sapiens
ggtctcagactggcaggcagtg

SEQ ID NO: 7045520 - DNA, 22 bp, Homo sapiens
ggtctcagaggtttctgctcag

SEQ ID NO: 7045521 - DNA, 22 bp, Homo sapiens
ggtctcagccctcgccagcagc

SEQ ID NO: 7045522 - DNA, 22 bp, Homo sapiens
ggtctcaggagactggagagca

SEQ ID NO: 7045523 - DNA, 22 bp, Homo sapiens
ggtctcaggtagggcctaggaa

SEQ ID NO: 7045524 - DNA, 19 bp, Homo sapiens
ggtctcagtgcagctgcag

SEQ ID NO: 7045525 - DNA, 22 bp, Homo sapiens
ggtctcctgacctttagtccct

SEQ ID NO: 7045526 - DNA, 22 bp, Homo sapiens
ggtctcctgggttgaccagctg

SEQ ID NO: 7045527 - DNA, 22 bp, Homo sapiens
gggtagggtgacttaggctggc

SEQ ID NO: 7045528 - DNA, 22 bp, Homo sapiens
gggtggagtagaaagatgaatt

SEQ ID NO: 7045529 - DNA, 22 bp, Homo sapiens
ggggctggtggtggtttctcca

SEQ ID NO: 7045530 - DNA, 22 bp, Homo sapiens
ggggtgggcgtgcagggacacc

SEQ ID NO: 7045531 - DNA, 22 bp, Homo sapiens
ggggtgggcgtgcagggacacc

SEQ ID NO: 7045532 - DNA, 22 bp, Homo sapiens
ggggtggggttactcattgtgc

SEQ ID NO: 7045533 - DNA, 22 bp, Homo sapiens
ggggtggggttactcattgtgc

SEQ ID NO: 7045534 - DNA, 22 bp, Homo sapiens
ggggctcacacctccctaaggg

SEQ ID NO: 7045535 - DNA, 22 bp, Homo sapiens
ggggctcaggggaagtgtccag

SEQ ID NO: 7045536 - DNA, 22 bp, Homo sapiens
ggggctcagttcggacagcctg

SEQ ID NO: 7045537 - DNA, 22 bp, Homo sapiens
ggggctcatgctgtttggtctt

SEQ ID NO: 7045538 - DNA, 22 bp, Homo sapiens
ggggctgacgggcatgtggctt

SEQ ID NO: 7045539 - DNA, 22 bp, Homo sapiens
ggggctgatggaactcaggcct

SEQ ID NO: 7045540 - DNA, 22 bp, Homo sapiens
ggggctgctcccacccctgagg

SEQ ID NO: 7045541 - DNA, 22 bp, Homo sapiens
ggggctggctcactaagagact

SEQ ID NO: 7045542 - DNA, 22 bp, Homo sapiens
ggggctggctcactaagagact

SEQ ID NO: 7045543 - DNA, 22 bp, Homo sapiens
ggggctgggatttgaacccagg

SEQ ID NO: 7045544 - DNA, 22 bp, Homo sapiens
gggctgagccacagcttttgtt

SEQ ID NO: 7045545 - DNA, 22 bp, Homo sapiens
gggctgagccatttgaaccttg

SEQ ID NO: 7045546 - DNA, 22 bp, Homo sapiens
gggctgaggctaccactggtct

SEQ ID NO: 7045547 - DNA, 22 bp, Homo sapiens
gggctgagggccaattcctact

SEQ ID NO: 7045548 - DNA, 22 bp, Homo sapiens
gggctgagttcctgcctcactc

SEQ ID NO: 7045549 - DNA, 22 bp, Homo sapiens
gggctgcaatgcttcagttgtt

SEQ ID NO: 7045550 - DNA, 22 bp, Homo sapiens
gggctgcatcagcaggacccgg

SEQ ID NO: 7045551 - DNA, 20 bp, Homo sapiens
tcccagtcagccagagtgag

SEQ ID NO: 7045552 - DNA, 22 bp, Homo sapiens
tcccagtctgtgtcctttacag

SEQ ID NO: 7045553 - DNA, 22 bp, Homo sapiens
tcccagtgtggcaggccatgga

SEQ ID NO: 7045554 - DNA, 23 bp, Homo sapiens
tcccatgggctcactgccctgca

SEQ ID NO: 7045555 - DNA, 22 bp, Homo sapiens
tcccatggtctatatagaggca

SEQ ID NO: 7045556 - DNA, 20 bp, Homo sapiens
tcccatgtccatatcagccc

SEQ ID NO: 7045557 - DNA, 18 bp, Homo sapiens
tcccatgttgtttttaaa

SEQ ID NO: 7045558 - DNA, 22 bp, Homo sapiens
tccaggccactgcagaggctct

SEQ ID NO: 7045559 - DNA, 22 bp, Homo sapiens
tccaggccacatggatggcgat

SEQ ID NO: 7045560 - DNA, 22 bp, Homo sapiens
tccaggccacgacctcctggat

SEQ ID NO: 7045561 - DNA, 21 bp, Homo sapiens
tccaggagtggctgggcaggg

SEQ ID NO: 7045562 - DNA, 22 bp, Homo sapiens
tccaggagtgataaggccactg

SEQ ID NO: 7045563 - DNA, 22 bp, Homo sapiens
tccaggagtttgacctgtgggc

SEQ ID NO: 7045564 - DNA, 22 bp, Homo sapiens
tccaggagggttttctgccttc

SEQ ID NO: 7045565 - DNA, 22 bp, Homo sapiens
tccaggaggtagtgcttaattt

SEQ ID NO: 7045566 - DNA, 22 bp, Homo sapiens
tccaggaggtgaggggaccaaa

SEQ ID NO: 7045567 - DNA, 22 bp, Homo sapiens
tccaggaggtttggaggaagca

SEQ ID NO: 7045568 - DNA, 22 bp, Homo sapiens
tccaggagtcctgggagtgatt

SEQ ID NO: 7045569 - DNA, 22 bp, Homo sapiens
tccaggagtcctgggtggcccc

SEQ ID NO: 7045570 - DNA, 22 bp, Homo sapiens
tccaggagtctagcctcaggcc

SEQ ID NO: 7045571 - DNA, 22 bp, Homo sapiens
tcccaaggccaggcatctagaa

SEQ ID NO: 7045572 - DNA, 22 bp, Homo sapiens
tcattgcagactaacaatctca

SEQ ID NO: 7045573 - DNA, 22 bp, Homo sapiens
tccagaggcaaaaaggtatgga

SEQ ID NO: 7045574 - DNA, 20 bp, Homo sapiens
tccagaggccacatccagtg

SEQ ID NO: 7045575 - DNA, 22 bp, Homo sapiens
tccagaggctccaaagggagat

SEQ ID NO: 7045576 - DNA, 20 bp, Homo sapiens
tccagctgttgagatctgag

SEQ ID NO: 7045577 - DNA, 22 bp, Homo sapiens
tccagcttcagctcttggatag

SEQ ID NO: 7045578 - DNA, 22 bp, Homo sapiens
tccagcttccagtggctggctg

SEQ ID NO: 7045579 - DNA, 22 bp, Homo sapiens
tccagcttgcttcaggatggtc

SEQ ID NO: 7045580 - DNA, 22 bp, Homo sapiens
tccagcttgggtgggaggaggt

SEQ ID NO: 7045581 - DNA, 22 bp, Homo sapiens
tccagctttggctctagctaca

SEQ ID NO: 7045582 - DNA, 22 bp, Homo sapiens
tccaggaggcctcatttcctgt

SEQ ID NO: 7045583 - DNA, 22 bp, Homo sapiens
tccaggaggctctggttgacgt

SEQ ID NO: 7045584 - DNA, 19 bp, Homo sapiens
tccaggaggctgccattga

SEQ ID NO: 7045585 - DNA, 22 bp, Homo sapiens
tcatggaagaaaggtttgtttc

SEQ ID NO: 7045586 - DNA, 19 bp, Homo sapiens
tcatggaagaaatgtgata

SEQ ID NO: 7045587 - DNA, 22 bp, Homo sapiens
tcatggaagaggtattttttgt

SEQ ID NO: 7045588 - DNA, 22 bp, Homo sapiens
tcatgcttattgcatatttgga

SEQ ID NO: 7045589 - DNA, 22 bp, Homo sapiens
tcattcaatgtaagcatatata

SEQ ID NO: 7045590 - DNA, 22 bp, Homo sapiens
tcattcactttgaaataaacga

SEQ ID NO: 7045591 - DNA, 22 bp, Homo sapiens
tcatatactgccttgtagatta

SEQ ID NO: 7045592 - DNA, 22 bp, Homo sapiens
tcatatatctgcaaagcagtat

SEQ ID NO: 7045593 - DNA, 22 bp, Homo sapiens
tcatatattttggcagtgatca

SEQ ID NO: 7045594 - DNA, 22 bp, Homo sapiens
tcatatgattgtaatgagaata

SEQ ID NO: 7045595 - DNA, 21 bp, Homo sapiens
tcatatttctcttgctattgt

SEQ ID NO: 7045596 - DNA, 22 bp, Homo sapiens
tcatgctgaggggattttaaat

SEQ ID NO: 7045597 - DNA, 22 bp, Homo sapiens
tcagtcttgcttctcttgggtc

SEQ ID NO: 7045598 - DNA, 23 bp, Homo sapiens
tcagtcttggcttctgattttcc

SEQ ID NO: 7045599 - DNA, 22 bp, Homo sapiens
tcagtcttgtttgattcctcac

SEQ ID NO: 7045600 - DNA, 22 bp, Homo sapiens
tcagtcttgtttttctggtcca

SEQ ID NO: 7045601 - DNA, 22 bp, Homo sapiens
tcagtctttcgaattcagccag

SEQ ID NO: 7045602 - DNA, 22 bp, Homo sapiens
tcagtcttttaactttctgcca

SEQ ID NO: 7045603 - DNA, 22 bp, Homo sapiens
tcagggacccctctgagtggag

SEQ ID NO: 7045604 - DNA, 22 bp, Homo sapiens
tcaggtggccaaatgggagcgc

SEQ ID NO: 7045605 - DNA, 22 bp, Homo sapiens
tcaggtggctggttgctggcta

SEQ ID NO: 7045606 - DNA, 22 bp, Homo sapiens
tcaggatggcttctgcatcaaa

SEQ ID NO: 7045607 - DNA, 22 bp, Homo sapiens
tcaggaagctgctctgggtggt

SEQ ID NO: 7045608 - DNA, 22 bp, Homo sapiens
tcaggaggttgaccacggggca

SEQ ID NO: 7045609 - DNA, 18 bp, Homo sapiens
tcactgagccgcctctct

SEQ ID NO: 7045610 - DNA, 22 bp, Homo sapiens
tcacattttcttaggaaactta

SEQ ID NO: 7045611 - DNA, 22 bp, Homo sapiens
tcacttttgatccctatgcagt

SEQ ID NO: 7045612 - DNA, 22 bp, Homo sapiens
tcacttttgggtttccagtaga

SEQ ID NO: 7045613 - DNA, 22 bp, Homo sapiens
tcactttttgatatcattctgc

SEQ ID NO: 7045614 - DNA, 22 bp, Homo sapiens
tcagaaaagaccacattattct

SEQ ID NO: 7045615 - DNA, 22 bp, Homo sapiens
tcacagaagttgaatttgcatg

SEQ ID NO: 7045616 - DNA, 22 bp, Homo sapiens
tcacaaagctttgataagcaga

SEQ ID NO: 7045617 - DNA, 22 bp, Homo sapiens
tcacaattcagaaaccaagtag

SEQ ID NO: 7045618 - DNA, 22 bp, Homo sapiens
tcacagaaataagatagttatt

SEQ ID NO: 7045619 - DNA, 22 bp, Homo sapiens
tcacagaagagatattgacaga

SEQ ID NO: 7045620 - DNA, 22 bp, Homo sapiens
tcacagaagagcattaagatga

SEQ ID NO: 7045621 - DNA, 22 bp, Homo sapiens
tatttctgggagttcagaaatt

SEQ ID NO: 7045622 - DNA, 22 bp, Homo sapiens
tatttcttcgggattcaagcta

SEQ ID NO: 7045623 - DNA, 22 bp, Homo sapiens
tatttcttgagactcgtcttcc

SEQ ID NO: 7045624 - DNA, 20 bp, Homo sapiens
tcaagttttgcttgacaaga

SEQ ID NO: 7045625 - DNA, 22 bp, Homo sapiens
tcaataactttgtttagcattg

SEQ ID NO: 7045626 - DNA, 20 bp, Homo sapiens
tcaatttcaggtagcatagt

SEQ ID NO: 7045627 - DNA, 22 bp, Homo sapiens
tattctctgcagctgaatgttt

SEQ ID NO: 7045628 - DNA, 22 bp, Homo sapiens
tattctgagctgtctcaggttg

SEQ ID NO: 7045629 - DNA, 22 bp, Homo sapiens
tattcaaagtaccttcattgcc

SEQ ID NO: 7045630 - DNA, 22 bp, Homo sapiens
tattccaaaatagttaagcact

SEQ ID NO: 7045631 - DNA, 22 bp, Homo sapiens
tattccaaaatcccaaactgcc

SEQ ID NO: 7045632 - DNA, 22 bp, Homo sapiens
tattccaaaggtagggattact

SEQ ID NO: 7045633 - DNA, 22 bp, Homo sapiens
tattccaactgtcatagtcata

SEQ ID NO: 7045634 - DNA, 22 bp, Homo sapiens
tattccttggcaaaaaatatat

SEQ ID NO: 7045635 - DNA, 20 bp, Homo sapiens
tatttacaacttagagcctc

SEQ ID NO: 7045636 - DNA, 22 bp, Homo sapiens
tatttataatctgccaaagaga

SEQ ID NO: 7045637 - DNA, 22 bp, Homo sapiens
tatgtacagtccttaacttaaa

SEQ ID NO: 7045638 - DNA, 22 bp, Homo sapiens
tatgtacagggatagaacttga

SEQ ID NO: 7045639 - DNA, 22 bp, Homo sapiens
tatgtacacacacatgcatgta

SEQ ID NO: 7045640 - DNA, 22 bp, Homo sapiens
tatgtacacatacacttgtaat

SEQ ID NO: 7045641 - DNA, 22 bp, Homo sapiens
tatgtacaagcacacatgtgac

SEQ ID NO: 7045642 - DNA, 22 bp, Homo sapiens
tatgtgcagtttgctcttaaca

SEQ ID NO: 7045643 - DNA, 22 bp, Homo sapiens
tattacatccacttttattgca

SEQ ID NO: 7045644 - DNA, 22 bp, Homo sapiens
taggtgggtgacttccatgggg

SEQ ID NO: 7045645 - DNA, 22 bp, Homo sapiens
tataaatgccaggactttagat

SEQ ID NO: 7045646 - DNA, 22 bp, Homo sapiens
tataaatgccaggactttagat

SEQ ID NO: 7045647 - DNA, 22 bp, Homo sapiens
tataacactcagaaagaatcat

SEQ ID NO: 7045648 - DNA, 22 bp, Homo sapiens
tataatttatcatgtcacagtt

SEQ ID NO: 7045649 - DNA, 22 bp, Homo sapiens
tatacacacctccaaagcagga

SEQ ID NO: 7045650 - DNA, 17 bp, Homo sapiens
tatacacagacagactg

SEQ ID NO: 7045651 - DNA, 22 bp, Homo sapiens
tatacacatcctccaaagatag

SEQ ID NO: 7045652 - DNA, 23 bp, Homo sapiens
tatacacatgtggcagtatagtg

SEQ ID NO: 7045653 - DNA, 22 bp, Homo sapiens
tatacacatgtgtgtattcata

SEQ ID NO: 7045654 - DNA, 22 bp, Homo sapiens
tatacacatttttacctatagt

SEQ ID NO: 7045655 - DNA, 22 bp, Homo sapiens
tatacagaaagaattcaagtct

SEQ ID NO: 7045656 - DNA, 22 bp, Homo sapiens
tatagcaattcagaatacatgt

SEQ ID NO: 7045657 - DNA, 22 bp, Homo sapiens
tatatcatggagattaacattc

SEQ ID NO: 7045658 - DNA, 22 bp, Homo sapiens
tatgacattatgtattacatgt

SEQ ID NO: 7045659 - DNA, 22 bp, Homo sapiens
tatgacattgctttttagaact

SEQ ID NO: 7045660 - DNA, 22 bp, Homo sapiens
tatgacctctcctattgcctta

SEQ ID NO: 7045661 - DNA, 22 bp, Homo sapiens
taggatatgagtaagcctttgt

SEQ ID NO: 7045662 - DNA, 22 bp, Homo sapiens
taggatatgcatttttatacat

SEQ ID NO: 7045663 - DNA, 22 bp, Homo sapiens
taggatatggtagaaatcattc

SEQ ID NO: 7045664 - DNA, 22 bp, Homo sapiens
taggatatgtgaaatcatatta

SEQ ID NO: 7045665 - DNA, 22 bp, Homo sapiens
tagctttacaaagtgctgcacc

SEQ ID NO: 7045666 - DNA, 22 bp, Homo sapiens
tagctttagtgaaaaatatcag

SEQ ID NO: 7045667 - DNA, 22 bp, Homo sapiens
taggaaaaatacagaattatat

SEQ ID NO: 7045668 - DNA, 22 bp, Homo sapiens
tagggagaaacaccaatttatt

SEQ ID NO: 7045669 - DNA, 22 bp, Homo sapiens
tagaggtagcaacaggactaga

SEQ ID NO: 7045670 - DNA, 22 bp, Homo sapiens
tagcagaagttccaatgcatat

SEQ ID NO: 7045671 - DNA, 17 bp, Homo sapiens
tagcagcagtaattgtg

SEQ ID NO: 7045672 - DNA, 23 bp, Homo sapiens
tagcagcatttttagcctctgtc

SEQ ID NO: 7045673 - DNA, 22 bp, Homo sapiens
tagctgttcaagttcctggaaa

SEQ ID NO: 7045674 - DNA, 22 bp, Homo sapiens
tagacaaaagggggcagatatg

SEQ ID NO: 7045675 - DNA, 22 bp, Homo sapiens
tagacacatacccttgcccaaa

SEQ ID NO: 7045676 - DNA, 22 bp, Homo sapiens
tagaatgtggaggtaacagact

SEQ ID NO: 7045677 - DNA, 22 bp, Homo sapiens
tagacacatcaagtatagttaa

SEQ ID NO: 7045678 - DNA, 22 bp, Homo sapiens
tagaaaggaacaggtcagcgtt

SEQ ID NO: 7045679 - DNA, 22 bp, Homo sapiens
tagaaaggaagctacttagggg

SEQ ID NO: 7045680 - DNA, 22 bp, Homo sapiens
tagaaaggagcattttagacta

SEQ ID NO: 7045681 - DNA, 22 bp, Homo sapiens
tagaaaggcaagcgtgaaatat

SEQ ID NO: 7045682 - DNA, 22 bp, Homo sapiens
tagaaaggcaatcattcttgga

SEQ ID NO: 7045683 - DNA, 22 bp, Homo sapiens
tagaaagtaaatcagttttatt

SEQ ID NO: 7045684 - DNA, 22 bp, Homo sapiens
tagaaatccccagtctcatagt

SEQ ID NO: 7045685 - DNA, 22 bp, Homo sapiens
tagaaatgaatgtttaaaagtc

SEQ ID NO: 7045686 - DNA, 22 bp, Homo sapiens
tagaaatgattgagctgtaata

SEQ ID NO: 7045687 - DNA, 22 bp, Homo sapiens
tagaaatgattttgatgcttca

SEQ ID NO: 7045688 - DNA, 22 bp, Homo sapiens
tagaaatgcccagattctgcta

SEQ ID NO: 7045689 - DNA, 22 bp, Homo sapiens
tagaaatggagaacagattaat

SEQ ID NO: 7045690 - DNA, 22 bp, Homo sapiens
tagaaacatataggatggcagg

SEQ ID NO: 7045691 - DNA, 22 bp, Homo sapiens
tagaaacatatgtttgagacat

SEQ ID NO: 7045692 - DNA, 22 bp, Homo sapiens
tacatttgggacaataagagaa

SEQ ID NO: 7045693 - DNA, 22 bp, Homo sapiens
taccaaagaatattttaaatag

SEQ ID NO: 7045694 - DNA, 22 bp, Homo sapiens
tacttttaaaattcacaggtat

SEQ ID NO: 7045695 - DNA, 22 bp, Homo sapiens
tacttttagcctatttgattct

SEQ ID NO: 7045696 - DNA, 22 bp, Homo sapiens
tacttttatgtgatgaaatctg

SEQ ID NO: 7045697 - DNA, 22 bp, Homo sapiens
tactttttagcacagtgtgtgc

SEQ ID NO: 7045698 - DNA, 22 bp, Homo sapiens
tactttttatgataagaactga

SEQ ID NO: 7045699 - DNA, 22 bp, Homo sapiens
tactttttatgataagaactga

SEQ ID NO: 7045700 - DNA, 22 bp, Homo sapiens
tactttttatgataagaactga

SEQ ID NO: 7045701 - DNA, 22 bp, Homo sapiens
tactttttgtctctttgaatgt

SEQ ID NO: 7045702 - DNA, 22 bp, Homo sapiens
tacatttgcctccaccaaaggt

SEQ ID NO: 7045703 - DNA, 22 bp, Homo sapiens
tacattctactttttcactccc

SEQ ID NO: 7045704 - DNA, 22 bp, Homo sapiens
tacatagtgttttgaagaatta

SEQ ID NO: 7045705 - DNA, 22 bp, Homo sapiens
tacatatactgagtgatttgct

SEQ ID NO: 7045706 - DNA, 20 bp, Homo sapiens
tacaggagtgagtgggtggg

SEQ ID NO: 7045707 - DNA, 22 bp, Homo sapiens
tacaggagcacaaaagagttga

SEQ ID NO: 7045708 - DNA, 22 bp, Homo sapiens
tacaggagcatggggaagggat

SEQ ID NO: 7045709 - DNA, 17 bp, Homo sapiens
tacaggagagcaggaac

SEQ ID NO: 7045710 - DNA, 22 bp, Homo sapiens
tacatacattacctcatttagt

SEQ ID NO: 7045711 - DNA, 22 bp, Homo sapiens
tacatagagggtaatagcatca

SEQ ID NO: 7045712 - DNA, 22 bp, Homo sapiens
tacatagattttgaaactggac

SEQ ID NO: 7045713 - DNA, 22 bp, Homo sapiens
tacaaagtgaaataattctgag

SEQ ID NO: 7045714 - DNA, 22 bp, Homo sapiens
tacaaagtgctttagaaatgaa

SEQ ID NO: 7045715 - DNA, 22 bp, Homo sapiens
tacaacaatttccacattagaa

SEQ ID NO: 7045716 - DNA, 22 bp, Homo sapiens
tacactcacccagcttggggcc

SEQ ID NO: 7045717 - DNA, 21 bp, Homo sapiens
tacactcatcctctcccaagg

SEQ ID NO: 7045718 - DNA, 20 bp, Homo sapiens
tacagaaacaggacttttgg

SEQ ID NO: 7045719 - DNA, 22 bp, Homo sapiens
tacagaaatcacatcgctttga

SEQ ID NO: 7045720 - DNA, 22 bp, Homo sapiens
tacagaagcttttgaaaagatg

SEQ ID NO: 7045721 - DNA, 22 bp, Homo sapiens
tacagaaggaagtttagctaaa

SEQ ID NO: 7045722 - DNA, 23 bp, Homo sapiens
tacagaaggagtagtcactaaga

SEQ ID NO: 7045723 - DNA, 22 bp, Homo sapiens
tacagaagtaaataccaaaagc

SEQ ID NO: 7045724 - DNA, 22 bp, Homo sapiens
tacagatacagatctagataca

SEQ ID NO: 7045725 - DNA, 22 bp, Homo sapiens
tacagatacagatctagataca

SEQ ID NO: 7045726 - DNA, 22 bp, Homo sapiens
tacagatatagagatttataga

SEQ ID NO: 7045727 - DNA, 20 bp, Homo sapiens
taaggctgttttgtattcct

SEQ ID NO: 7045728 - DNA, 22 bp, Homo sapiens
taagtagcctacaagtatattt

SEQ ID NO: 7045729 - DNA, 22 bp, Homo sapiens
taagtagctcttggaatatata

SEQ ID NO: 7045730 - DNA, 21 bp, Homo sapiens
taagtgcaaagagacagatac

SEQ ID NO: 7045731 - DNA, 22 bp, Homo sapiens
taagtgcaatgttttacttaaa

SEQ ID NO: 7045732 - DNA, 22 bp, Homo sapiens
taagtgcatctgatctttcatg

SEQ ID NO: 7045733 - DNA, 22 bp, Homo sapiens
taagtggcagagcttgttctca

SEQ ID NO: 7045734 - DNA, 22 bp, Homo sapiens
taagtgtccctattgtgatttt

SEQ ID NO: 7045735 - DNA, 22 bp, Homo sapiens
taatacagtagcttttacacag

SEQ ID NO: 7045736 - DNA, 22 bp, Homo sapiens
taatacttttgccttgtattca

SEQ ID NO: 7045737 - DNA, 22 bp, Homo sapiens
taatgtttccagtctatgatgg

SEQ ID NO: 7045738 - DNA, 22 bp, Homo sapiens
taattacagaggtttgccagtt

SEQ ID NO: 7045739 - DNA, 22 bp, Homo sapiens
tacaaactccgaagtttgtacc

SEQ ID NO: 7045740 - DNA, 22 bp, Homo sapiens
tacaaactctttatatttcata

SEQ ID NO: 7045741 - DNA, 22 bp, Homo sapiens
tacaaacttgttttaagtaagt

SEQ ID NO: 7045742 - DNA, 20 bp, Homo sapiens
tacaaagaatgaggttcagg

SEQ ID NO: 7045743 - DNA, 22 bp, Homo sapiens
tacaaagaggcagctccatttt

SEQ ID NO: 7045744 - DNA, 22 bp, Homo sapiens
tacaaagaggtaattgcatata

SEQ ID NO: 7045745 - DNA, 22 bp, Homo sapiens
tacaaagaggtaattgcatata

SEQ ID NO: 7045746 - DNA, 22 bp, Homo sapiens
tacaaagatagtgttagagtaa

SEQ ID NO: 7045747 - DNA, 22 bp, Homo sapiens
tacaaagcagttccaacacgaa

SEQ ID NO: 7045748 - DNA, 22 bp, Homo sapiens
tacaaaggaaacttcttttccc

SEQ ID NO: 7045749 - DNA, 22 bp, Homo sapiens
tacaaaggacagcagaaaaata

SEQ ID NO: 7045750 - DNA, 22 bp, Homo sapiens
tacaaaggagactctgtattta

SEQ ID NO: 7045751 - DNA, 22 bp, Homo sapiens
tacaaaggaggtgcatagaaca

SEQ ID NO: 7045752 - DNA, 22 bp, Homo sapiens
tacaaagggaatattggcttta

SEQ ID NO: 7045753 - DNA, 22 bp, Homo sapiens
gttcatttatgatgtaacatgt

SEQ ID NO: 7045754 - DNA, 22 bp, Homo sapiens
gttcagttatgtgacctcaaaa

SEQ ID NO: 7045755 - DNA, 22 bp, Homo sapiens
gttcagttatttctgaagatat

SEQ ID NO: 7045756 - DNA, 22 bp, Homo sapiens
gttcagtttgacaacctttata

SEQ ID NO: 7045757 - DNA, 22 bp, Homo sapiens
gttcagtttgagattaccatgg

SEQ ID NO: 7045758 - DNA, 22 bp, Homo sapiens
gttcagtttggggtatttgaag

SEQ ID NO: 7045759 - DNA, 22 bp, Homo sapiens
gttcagttttgaaatgttaatt

SEQ ID NO: 7045760 - DNA, 22 bp, Homo sapiens
gttcagttttggggctgttaca

SEQ ID NO: 7045761 - DNA, 22 bp, Homo sapiens
gttcaattaagttacaaattta

SEQ ID NO: 7045762 - DNA, 22 bp, Homo sapiens
gttcagggagacagactaaact

SEQ ID NO: 7045763 - DNA, 22 bp, Homo sapiens
gttcagggagggacagatgaag

SEQ ID NO: 7045764 - DNA, 22 bp, Homo sapiens
gttgattccggggccatttcaa

SEQ ID NO: 7045765 - DNA, 22 bp, Homo sapiens
gttgcagatgtggaactcgtgc

SEQ ID NO: 7045766 - DNA, 22 bp, Homo sapiens
gttgcagatgtggaactcgtgc

SEQ ID NO: 7045767 - DNA, 22 bp, Homo sapiens
gttgccttctatgattctcagt

SEQ ID NO: 7045768 - DNA, 23 bp, Homo sapiens
gttgcctttgcatcttcatccat

SEQ ID NO: 7045769 - DNA, 22 bp, Homo sapiens
gtttcagggccttttatgtgtt

SEQ ID NO: 7045770 - DNA, 22 bp, Homo sapiens
gtttcaggttggacaacatgcc

SEQ ID NO: 7045771 - DNA, 22 bp, Homo sapiens
gtttcaggtttaggcacctgga

SEQ ID NO: 7045772 - DNA, 22 bp, Homo sapiens
gtttcatgccatttccagattg

SEQ ID NO: 7045773 - DNA, 19 bp, Homo sapiens
gtttcattaagataggaaa

SEQ ID NO: 7045774 - DNA, 22 bp, Homo sapiens
gttaagtgaatgtcatgtcagg

SEQ ID NO: 7045775 - DNA, 22 bp, Homo sapiens
gttaagtgggaccagtgtcctt

SEQ ID NO: 7045776 - DNA, 18 bp, Homo sapiens
gttaattttgaagttcat

SEQ ID NO: 7045777 - DNA, 21 bp, Homo sapiens
gttttctttgatagagggaag

SEQ ID NO: 7045778 - DNA, 22 bp, Homo sapiens
gttttgaaatgaaagaaccaag

SEQ ID NO: 7045779 - DNA, 22 bp, Homo sapiens
gttttgaagaagaccttgaaac

SEQ ID NO: 7045780 - DNA, 22 bp, Homo sapiens
gttttgaatactactagaactt

SEQ ID NO: 7045781 - DNA, 22 bp, Homo sapiens
gtttttatctaatagcagttat

SEQ ID NO: 7045782 - DNA, 22 bp, Homo sapiens
gtttttattgtgtaaatgtggg

SEQ ID NO: 7045783 - DNA, 22 bp, Homo sapiens
taaaagttttagttgtacataa

SEQ ID NO: 7045784 - DNA, 22 bp, Homo sapiens
taaaatgtgtttctgtatggtt

SEQ ID NO: 7045785 - DNA, 22 bp, Homo sapiens
taaaatgtttgcaagagaccag

SEQ ID NO: 7045786 - DNA, 22 bp, Homo sapiens
taaaatttgtccctgagtgttg

SEQ ID NO: 7045787 - DNA, 22 bp, Homo sapiens
taaacaagctggactgataagt

SEQ ID NO: 7045788 - DNA, 22 bp, Homo sapiens
taaacagaaagcagatgtactt

SEQ ID NO: 7045789 - DNA, 22 bp, Homo sapiens
taaattcccaactctgctcttc

SEQ ID NO: 7045790 - DNA, 22 bp, Homo sapiens
taaattctgatcaagttccttc

SEQ ID NO: 7045791 - DNA, 22 bp, Homo sapiens
tgtggaggattctgatgccagc

SEQ ID NO: 7045792 - DNA, 22 bp, Homo sapiens
tgtggcatggcagaagggcaca

SEQ ID NO: 7045793 - DNA, 22 bp, Homo sapiens
tgtggcatggttgcaaggacaa

SEQ ID NO: 7045794 - DNA, 21 bp, Homo sapiens
tccccagtgccctctctaaga

SEQ ID NO: 7045795 - DNA, 22 bp, Homo sapiens
tccccatgaggctgaattgggc

SEQ ID NO: 7045796 - DNA, 22 bp, Homo sapiens
tccccatggaaggatgatggaa

SEQ ID NO: 7045797 - DNA, 22 bp, Homo sapiens
tccccatgggtggggacacata

SEQ ID NO: 7045798 - DNA, 22 bp, Homo sapiens
tccccatgtctgcagggagggt

SEQ ID NO: 7045799 - DNA, 22 bp, Homo sapiens
tgtgggtggcatcgtcctggcc

SEQ ID NO: 7045800 - DNA, 22 bp, Homo sapiens
tgtgtcctgtgatctctagggt

SEQ ID NO: 7045801 - DNA, 22 bp, Homo sapiens
tgtgtcttggccaccttgggaa

SEQ ID NO: 7045802 - DNA, 22 bp, Homo sapiens
tgtgtttcagaaccttctttca

SEQ ID NO: 7045803 - DNA, 22 bp, Homo sapiens
tgtgttttaaatggaaatttga

SEQ ID NO: 7045804 - DNA, 22 bp, Homo sapiens
tgtttaatcttcaggacagtct

SEQ ID NO: 7045805 - DNA, 22 bp, Homo sapiens
tgtttacaaggagaatttgagg

SEQ ID NO: 7045806 - DNA, 22 bp, Homo sapiens
tgtttcatgtggacatagttgt

SEQ ID NO: 7045807 - DNA, 22 bp, Homo sapiens
tgtttcttgagagtattaccct

SEQ ID NO: 7045808 - DNA, 22 bp, Homo sapiens
tgtttcttgataaagcagaaaa

SEQ ID NO: 7045809 - DNA, 22 bp, Homo sapiens
tgtttcttgataaagcagaaaa

SEQ ID NO: 7045810 - DNA, 22 bp, Homo sapiens
tgtttcttgggtgctcacatca

SEQ ID NO: 7045811 - DNA, 20 bp, Homo sapiens
tgtttctttaaggtgagaca

SEQ ID NO: 7045812 - DNA, 22 bp, Homo sapiens
tgtttctttgtagatattcttt

SEQ ID NO: 7045813 - DNA, 22 bp, Homo sapiens
tgtttctttgtagatattcttt

SEQ ID NO: 7045814 - DNA, 20 bp, Homo sapiens
tgtttcttttaatgagcggc

SEQ ID NO: 7045815 - DNA, 22 bp, Homo sapiens
ttacactttggcaagctattaa

SEQ ID NO: 7045816 - DNA, 22 bp, Homo sapiens
ttacatattatccaaaactgct

SEQ ID NO: 7045817 - DNA, 22 bp, Homo sapiens
ttacatattatccaaaactgct

SEQ ID NO: 7045818 - DNA, 22 bp, Homo sapiens
ttaatttgaccataaatatctt

SEQ ID NO: 7045819 - DNA, 22 bp, Homo sapiens
ttaattttctcatctgtgaaat

SEQ ID NO: 7045820 - DNA, 22 bp, Homo sapiens
ttacaaacaacagacatttatt

SEQ ID NO: 7045821 - DNA, 22 bp, Homo sapiens
ttacaaacaacagacatttatt

SEQ ID NO: 7045822 - DNA, 22 bp, Homo sapiens
ttacaaacaagatcttattctt

SEQ ID NO: 7045823 - DNA, 22 bp, Homo sapiens
ttacaaagaaaattaggcattt

SEQ ID NO: 7045824 - DNA, 22 bp, Homo sapiens
ttacacagaaattttattgcct

SEQ ID NO: 7045825 - DNA, 22 bp, Homo sapiens
ttacacagtgcacaagcagagt

SEQ ID NO: 7045826 - DNA, 22 bp, Homo sapiens
ttacactcatattgcacttacc

SEQ ID NO: 7045827 - DNA, 19 bp, Homo sapiens
ttacactcctgggcagtgg

SEQ ID NO: 7045828 - DNA, 22 bp, Homo sapiens
ttacactctggttgtgggcctt

SEQ ID NO: 7045829 - DNA, 22 bp, Homo sapiens
ttaccaaatcccgtgcacattc

SEQ ID NO: 7045830 - DNA, 22 bp, Homo sapiens
ttactacattgtaacacagtac

SEQ ID NO: 7045831 - DNA, 22 bp, Homo sapiens
ttactgaaagtatacatttctg

SEQ ID NO: 7045832 - DNA, 22 bp, Homo sapiens
ttactttaagggtgtcttatta

SEQ ID NO: 7045833 - DNA, 22 bp, Homo sapiens
ttactttagatcatactgtgtg

SEQ ID NO: 7045834 - DNA, 22 bp, Homo sapiens
ttactttatgtgatggattagt

SEQ ID NO: 7045835 - DNA, 22 bp, Homo sapiens
ttactttcaagtggctgggggt

SEQ ID NO: 7045836 - DNA, 22 bp, Homo sapiens
ttactttccagctctagcttca

SEQ ID NO: 7045837 - DNA, 22 bp, Homo sapiens
ttaagaaggtactcaaagatct

SEQ ID NO: 7045838 - DNA, 22 bp, Homo sapiens
ttaagacatgtgagcataactt

SEQ ID NO: 7045839 - DNA, 22 bp, Homo sapiens
ttaagagacaggagaatgatgt

SEQ ID NO: 7045840 - DNA, 22 bp, Homo sapiens
ttaacagtaaagaattgtgcaa

SEQ ID NO: 7045841 - DNA, 22 bp, Homo sapiens
ttaacagttaaacaattggcta

SEQ ID NO: 7045842 - DNA, 22 bp, Homo sapiens
ttaagtgcaaaaatgaaagtat

SEQ ID NO: 7045843 - DNA, 22 bp, Homo sapiens
ttaagtgccagtgctccctcag

SEQ ID NO: 7045844 - DNA, 22 bp, Homo sapiens
ttaagtgcctctaaaacaagcc

SEQ ID NO: 7045845 - DNA, 18 bp, Homo sapiens
ttaagtgctatgcaattg

SEQ ID NO: 7045846 - DNA, 22 bp, Homo sapiens
ttaattctagtttaacacttag

SEQ ID NO: 7045847 - DNA, 22 bp, Homo sapiens
ttaattctagtttaacacttag

SEQ ID NO: 7045848 - DNA, 22 bp, Homo sapiens
ttaattctgcctttcatgtaac

SEQ ID NO: 7045849 - DNA, 22 bp, Homo sapiens
ttaattgagccagaaagtatct

SEQ ID NO: 7045850 - DNA, 22 bp, Homo sapiens
tgttttctgatggttaatgagt

SEQ ID NO: 7045851 - DNA, 22 bp, Homo sapiens
tgtttttaaataatgatagaaa

SEQ ID NO: 7045852 - DNA, 22 bp, Homo sapiens
tgtttttatctctgtgtacaac

SEQ ID NO: 7045853 - DNA, 22 bp, Homo sapiens
tgtttttcaaatattgctctgt

SEQ ID NO: 7045854 - DNA, 22 bp, Homo sapiens
ttaaatgaacgagatatgcaac

SEQ ID NO: 7045855 - DNA, 22 bp, Homo sapiens
ttaaatgctcacataaaggtag

SEQ ID NO: 7045856 - DNA, 22 bp, Homo sapiens
ttaacaaagctctgttcctttt

SEQ ID NO: 7045857 - DNA, 22 bp, Homo sapiens
ttaacaaagtaacgggaaaaga

SEQ ID NO: 7045858 - DNA, 22 bp, Homo sapiens
ttaacaatagagtttcttcagg

SEQ ID NO: 7045859 - DNA, 22 bp, Homo sapiens
ttaacacagggggagacaaagt

SEQ ID NO: 7045860 - DNA, 22 bp, Homo sapiens
ttcatgatagtattttttgtga

SEQ ID NO: 7045861 - DNA, 22 bp, Homo sapiens
ttcatgcactatttcttctagc

SEQ ID NO: 7045862 - DNA, 22 bp, Homo sapiens
ttcagtcttgttgaaaacttgg

SEQ ID NO: 7045863 - DNA, 22 bp, Homo sapiens
ttcagtgacttacctggagcca

SEQ ID NO: 7045864 - DNA, 22 bp, Homo sapiens
ttcagtgtcaatttttaaatat

SEQ ID NO: 7045865 - DNA, 20 bp, Homo sapiens
ttcatgggagcaaagaggcc

SEQ ID NO: 7045866 - DNA, 20 bp, Homo sapiens
ttcatggtgtatttctttct

SEQ ID NO: 7045867 - DNA, 22 bp, Homo sapiens
ttcatgtaattccataaggtaa

SEQ ID NO: 7045868 - DNA, 22 bp, Homo sapiens
ttcatgttcatgcttaggaaaa

SEQ ID NO: 7045869 - DNA, 22 bp, Homo sapiens
ttcatgttggcatgtttttagg

SEQ ID NO: 7045870 - DNA, 22 bp, Homo sapiens
ttcatgttgtagtatgtatcag

SEQ ID NO: 7045871 - DNA, 22 bp, Homo sapiens
ttcaggagctagggatgtgaaa

SEQ ID NO: 7045872 - DNA, 22 bp, Homo sapiens
ttcaggagctggctgcgaagga

SEQ ID NO: 7045873 - DNA, 20 bp, Homo sapiens
ttcagggctttggggacacc

SEQ ID NO: 7045874 - DNA, 22 bp, Homo sapiens
ttcaggtgtggccagaggagaa

SEQ ID NO: 7045875 - DNA, 22 bp, Homo sapiens
ttcagtatacttcataacattt

SEQ ID NO: 7045876 - DNA, 22 bp, Homo sapiens
ttcagtatccctgcttggacag

SEQ ID NO: 7045877 - DNA, 22 bp, Homo sapiens
ttcagtatgctgaatgattttt

SEQ ID NO: 7045878 - DNA, 22 bp, Homo sapiens
ttcagtatgtgtaaactacttt

SEQ ID NO: 7045879 - DNA, 22 bp, Homo sapiens
ttcagtattcaaatatgtctta

SEQ ID NO: 7045880 - DNA, 22 bp, Homo sapiens
ttcagtctcctcattttacaaa

SEQ ID NO: 7045881 - DNA, 21 bp, Homo sapiens
ttagagtagagaacatgatcc

SEQ ID NO: 7045882 - DNA, 22 bp, Homo sapiens
ttagagttaggatttgtcttta

SEQ ID NO: 7045883 - DNA, 22 bp, Homo sapiens
ttagagttcagcatgactttga

SEQ ID NO: 7045884 - DNA, 22 bp, Homo sapiens
ttagagttttctgttcctctaa

SEQ ID NO: 7045885 - DNA, 22 bp, Homo sapiens
ttcaacaatgaaagctaaggaa

SEQ ID NO: 7045886 - DNA, 22 bp, Homo sapiens
ttcaacagcttccaaagtgtgt

SEQ ID NO: 7045887 - DNA, 22 bp, Homo sapiens
ttcaagaagcccaaagactagc

SEQ ID NO: 7045888 - DNA, 22 bp, Homo sapiens
ttcaatttgtgctaaggcaccg

SEQ ID NO: 7045889 - DNA, 22 bp, Homo sapiens
ttcacaaaaatgctgaacagtt

SEQ ID NO: 7045890 - DNA, 22 bp, Homo sapiens
ttcacaaaatggtttgttgatg

SEQ ID NO: 7045891 - DNA, 22 bp, Homo sapiens
ttcacaaagctggagcatttcc

SEQ ID NO: 7045892 - DNA, 22 bp, Homo sapiens
ttcacaaagctggagcatttcc

SEQ ID NO: 7045893 - DNA, 22 bp, Homo sapiens
ttcacagtgagctatgtcttgt

SEQ ID NO: 7045894 - DNA, 21 bp, Homo sapiens
ttccacagtgagaactgcaag

SEQ ID NO: 7045895 - DNA, 22 bp, Homo sapiens
ttcctaggtgtttacattcaac

SEQ ID NO: 7045896 - DNA, 22 bp, Homo sapiens
ttccttctctgtggggaaggca

SEQ ID NO: 7045897 - DNA, 19 bp, Homo sapiens
ttctaatgttacattttgg

SEQ ID NO: 7045898 - DNA, 22 bp, Homo sapiens
ttctaattattcccttgtccca

SEQ ID NO: 7045899 - DNA, 22 bp, Homo sapiens
ttctaattgtgtttgcatatct

SEQ ID NO: 7045900 - DNA, 20 bp, Homo sapiens
ttctaatttgatggagtagc

SEQ ID NO: 7045901 - DNA, 22 bp, Homo sapiens
ttctagcatgccttttagcaca

SEQ ID NO: 7045902 - DNA, 22 bp, Homo sapiens
ttctagggaatgggatgaggat

SEQ ID NO: 7045903 - DNA, 22 bp, Homo sapiens
ttctagtttccattttaagaca

SEQ ID NO: 7045904 - DNA, 22 bp, Homo sapiens
ttctagttttgccttatcaaca

SEQ ID NO: 7045905 - DNA, 22 bp, Homo sapiens
ttctataagactcatatttctt

SEQ ID NO: 7045906 - DNA, 22 bp, Homo sapiens
ttctcttttcaccagttgctaa

SEQ ID NO: 7045907 - DNA, 22 bp, Homo sapiens
ttctcttttgtgatgtgagatg

SEQ ID NO: 7045908 - DNA, 19 bp, Homo sapiens
ttctgctagaccatttgtt

SEQ ID NO: 7045909 - DNA, 22 bp, Homo sapiens
ttctgctatgaaaaaagtgctg

SEQ ID NO: 7045910 - DNA, 22 bp, Homo sapiens
ttctgctttcagttcttctggg

SEQ ID NO: 7045911 - DNA, 22 bp, Homo sapiens
ttctgcttttctctgtctgagt

SEQ ID NO: 7045912 - DNA, 22 bp, Homo sapiens
ttctgttatcattaagcattat

SEQ ID NO: 7045913 - DNA, 22 bp, Homo sapiens
ttctgtttactcagaaatacaa

SEQ ID NO: 7045914 - DNA, 22 bp, Homo sapiens
ttctgtttataatttgcagttg

SEQ ID NO: 7045915 - DNA, 22 bp, Homo sapiens
ttctgtttctggggtctctgac

SEQ ID NO: 7045916 - DNA, 22 bp, Homo sapiens
ttctgtttgccatatatagtag

SEQ ID NO: 7045917 - DNA, 22 bp, Homo sapiens
ttctgttttagaaataagtagt

SEQ ID NO: 7045918 - DNA, 22 bp, Homo sapiens
ttctgttttgcacagacttgaa

SEQ ID NO: 7045919 - DNA, 22 bp, Homo sapiens
ttctgttttgcacagacttgaa

SEQ ID NO: 7045920 - DNA, 22 bp, Homo sapiens
ttcttaaaacttatggacaggt

SEQ ID NO: 7045921 - DNA, 22 bp, Homo sapiens
ttcttacagccctattactaaa

SEQ ID NO: 7045922 - DNA, 22 bp, Homo sapiens
ttcttacatcagtttattttgt

SEQ ID NO: 7045923 - DNA, 22 bp, Homo sapiens
ttcttcttgtctgccctcacat

SEQ ID NO: 7045924 - DNA, 22 bp, Homo sapiens
ttcttctttatctcagtatcct

SEQ ID NO: 7045925 - DNA, 22 bp, Homo sapiens
ttcttctttccccctgtggtac

SEQ ID NO: 7045926 - DNA, 19 bp, Homo sapiens
ttcttgaacatgtttctca

SEQ ID NO: 7045927 - DNA, 22 bp, Homo sapiens
ttcttgaaggggatataaatag

SEQ ID NO: 7045928 - DNA, 22 bp, Homo sapiens
ttcttgaatagggattgataaa

SEQ ID NO: 7045929 - DNA, 19 bp, Homo sapiens
ttcttgagacctcagtctg

SEQ ID NO: 7045930 - DNA, 22 bp, Homo sapiens
ttcttgagtatctgcacagtgc

SEQ ID NO: 7045931 - DNA, 22 bp, Homo sapiens
ttcttgatgaatgctaagaact

SEQ ID NO: 7045932 - DNA, 22 bp, Homo sapiens
ttcttgctcaatgtctgtttaa

SEQ ID NO: 7045933 - DNA, 22 bp, Homo sapiens
ttcttggaaactgattccttgt

SEQ ID NO: 7045934 - DNA, 23 bp, Homo sapiens
ttctttcaagaagttcacagtgc

SEQ ID NO: 7045935 - DNA, 22 bp, Homo sapiens
ttctttccaaccagatattggt

SEQ ID NO: 7045936 - DNA, 22 bp, Homo sapiens
ttctttcccagaagatatgttt

SEQ ID NO: 7045937 - DNA, 22 bp, Homo sapiens
ttctttcccagtagatgtgaaa

SEQ ID NO: 7045938 - DNA, 22 bp, Homo sapiens
ttctttctcaacatgaatgttt

SEQ ID NO: 7045939 - DNA, 22 bp, Homo sapiens
ttgaagagtaaagtgttttctc

SEQ ID NO: 7045940 - DNA, 22 bp, Homo sapiens
ttgaagataggccaggatgagc

SEQ ID NO: 7045941 - DNA, 22 bp, Homo sapiens
ttgagcccaggaggcctgggtg

SEQ ID NO: 7045942 - DNA, 22 bp, Homo sapiens
ttgatctttataatagttttga

SEQ ID NO: 7045943 - DNA, 22 bp, Homo sapiens
ttgattctagaatcttccctct

SEQ ID NO: 7045944 - DNA, 22 bp, Homo sapiens
ttgattctatgttgttgtctca

SEQ ID NO: 7045945 - DNA, 22 bp, Homo sapiens
ttgattctgatcctttgctagc

SEQ ID NO: 7045946 - DNA, 22 bp, Homo sapiens
ttgattctgatgaaagtccatt

SEQ ID NO: 7045947 - DNA, 22 bp, Homo sapiens
ttgattctgctgatctcggacg

SEQ ID NO: 7045948 - DNA, 22 bp, Homo sapiens
ttgattctgggctcatttcttt

SEQ ID NO: 7045949 - DNA, 22 bp, Homo sapiens
ttgattcttctgaatttgcaga

SEQ ID NO: 7045950 - DNA, 22 bp, Homo sapiens
ttgattctttgagaccgtgata

SEQ ID NO: 7045951 - DNA, 22 bp, Homo sapiens
ttgattttaaaatagtgacact

SEQ ID NO: 7045952 - DNA, 21 bp, Homo sapiens
ttgattttaggaagtttgtca

SEQ ID NO: 7045953 - DNA, 21 bp, Homo sapiens
ttgattttaggaagtttgtca

SEQ ID NO: 7045954 - DNA, 22 bp, Homo sapiens
ttgattttcaattcattgacaa

SEQ ID NO: 7045955 - DNA, 22 bp, Homo sapiens
ttgattttgcctgatctgagag

SEQ ID NO: 7045956 - DNA, 22 bp, Homo sapiens
ttgatttttccagcttctagag

SEQ ID NO: 7045957 - DNA, 22 bp, Homo sapiens
ttgcaaataaacaagtatacat

SEQ ID NO: 7045958 - DNA, 22 bp, Homo sapiens
ttgcaaatattgtttacctttc

SEQ ID NO: 7045959 - DNA, 22 bp, Homo sapiens
ttgcaaatctttgccagaaggc

SEQ ID NO: 7045960 - DNA, 22 bp, Homo sapiens
ttgcaaatgaccattgccacat

SEQ ID NO: 7045961 - DNA, 22 bp, Homo sapiens
ttgcaaatgggcaaagcagatc

SEQ ID NO: 7045962 - DNA, 22 bp, Homo sapiens
ttgcaaatggtaccaagggtct

SEQ ID NO: 7045963 - DNA, 22 bp, Homo sapiens
ttgcaaatgtttcataacagta

SEQ ID NO: 7045964 - DNA, 22 bp, Homo sapiens
tttttcatgagactagaagtca

SEQ ID NO: 7045965 - DNA, 22 bp, Homo sapiens
tttttcattgcagcctctctcc

SEQ ID NO: 7045966 - DNA, 22 bp, Homo sapiens
tttttcctagcgatttgtcagc

SEQ ID NO: 7045967 - DNA, 22 bp, Homo sapiens
tttttccttaggggttactcac

SEQ ID NO: 7045968 - DNA, 22 bp, Homo sapiens
ttttggcaaaggcattctcttt

SEQ ID NO: 7045969 - DNA, 22 bp, Homo sapiens
ttttgcctaagaatctctctga

SEQ ID NO: 7045970 - DNA, 22 bp, Homo sapiens
ttttggaatgaggaacatccag

SEQ ID NO: 7045971 - DNA, 22 bp, Homo sapiens
ttttggaatttatacagtaatg

SEQ ID NO: 7045972 - DNA, 22 bp, Homo sapiens
ttttgaaagccaggtttgtatg

SEQ ID NO: 7045973 - DNA, 22 bp, Homo sapiens
ttttctaacatctagtaatttg

SEQ ID NO: 7045974 - DNA, 22 bp, Homo sapiens
ttttctatctcctagaactgcc

SEQ ID NO: 7045975 - DNA, 22 bp, Homo sapiens
ttttctattaactcattttgca

SEQ ID NO: 7045976 - DNA, 22 bp, Homo sapiens
ttttctttaatctggtggggtg

SEQ ID NO: 7045977 - DNA, 22 bp, Homo sapiens
ttttccttctgatactccattt

SEQ ID NO: 7045978 - DNA, 20 bp, Homo sapiens
tttttccttctctacaggca

SEQ ID NO: 7045979 - DNA, 22 bp, Homo sapiens
tttggcaagcgagtactttctg

SEQ ID NO: 7045980 - DNA, 22 bp, Homo sapiens
tttggcaagtgggaaattagta

SEQ ID NO: 7045981 - DNA, 22 bp, Homo sapiens
tttggaacaagacaaaacatta

SEQ ID NO: 7045982 - DNA, 22 bp, Homo sapiens
tttggacaaatgtctgactttc

SEQ ID NO: 7045983 - DNA, 22 bp, Homo sapiens
tttggacacattatttatcttc

SEQ ID NO: 7045984 - DNA, 22 bp, Homo sapiens
tttggacatgagtctttaatct

SEQ ID NO: 7045985 - DNA, 22 bp, Homo sapiens
tttggagagagttaaatatgtt

SEQ ID NO: 7045986 - DNA, 22 bp, Homo sapiens
tttggcaaagatcaacatgtta

SEQ ID NO: 7045987 - DNA, 22 bp, Homo sapiens
tttggcaacggagaacttactc

SEQ ID NO: 7045988 - DNA, 22 bp, Homo sapiens
tttctttcaattctcctaatgc

SEQ ID NO: 7045989 - DNA, 22 bp, Homo sapiens
tttctttccatacatattgcta

SEQ ID NO: 7045990 - DNA, 22 bp, Homo sapiens
tttgcaggcacggaggcagctg

SEQ ID NO: 7045991 - DNA, 22 bp, Homo sapiens
tttgtagcagcatgatttataa

SEQ ID NO: 7045992 - DNA, 22 bp, Homo sapiens
tttgttcacctagcaaactttt

SEQ ID NO: 7045993 - DNA, 22 bp, Homo sapiens
tttgtttacaaaaataagcagt

SEQ ID NO: 7045994 - DNA, 22 bp, Homo sapiens
tttgtttagatggtaaatcagt

SEQ ID NO: 7045995 - DNA, 22 bp, Homo sapiens
ttttataagcaagaaagggaaa

SEQ ID NO: 7045996 - DNA, 22 bp, Homo sapiens
ttttatagctgaatagtattcc

SEQ ID NO: 7045997 - DNA, 22 bp, Homo sapiens
ttttatcaatcattaagacatt

SEQ ID NO: 7045998 - DNA, 22 bp, Homo sapiens
ttttatcagcagggataacaag

SEQ ID NO: 7045999 - DNA, 22 bp, Homo sapiens
tttcagggaagtgttgaaaagg

SEQ ID NO: 7046000 - DNA, 22 bp, Homo sapiens
tttcagggagcctagaagagct

SEQ ID NO: 7046001 - DNA, 22 bp, Homo sapiens
tttcagggtacatggagcaaat

SEQ ID NO: 7046002 - DNA, 22 bp, Homo sapiens
tttcagggtcagcctgtatgtg

SEQ ID NO: 7046003 - DNA, 22 bp, Homo sapiens
tttcagggtgctccagacaccc

SEQ ID NO: 7046004 - DNA, 22 bp, Homo sapiens
tttcaaagggaagttatgaagt

SEQ ID NO: 7046005 - DNA, 22 bp, Homo sapiens
tttcattttggttatgccataa

SEQ ID NO: 7046006 - DNA, 22 bp, Homo sapiens
tttcctcttatacagtgtttat

SEQ ID NO: 7046007 - DNA, 22 bp, Homo sapiens
tttcctcttcgattaagtttgg

SEQ ID NO: 7046008 - DNA, 22 bp, Homo sapiens
tttcctgagccagagtttcatt

SEQ ID NO: 7046009 - DNA, 22 bp, Homo sapiens
tttcctgagtcagagacaccag

SEQ ID NO: 7046010 - DNA, 22 bp, Homo sapiens
tttctaatctttagttacaaaa

SEQ ID NO: 7046011 - DNA, 22 bp, Homo sapiens
tttctatttacagtgctaggta

SEQ ID NO: 7046012 - DNA, 22 bp, Homo sapiens
tttctcgcgtttgagctctcag

SEQ ID NO: 7046013 - DNA, 22 bp, Homo sapiens
tttctctagctattcattaaat

SEQ ID NO: 7046014 - DNA, 22 bp, Homo sapiens
tttctgaacaaagccattatca

SEQ ID NO: 7046015 - DNA, 21 bp, Homo sapiens
tttctgaaggcaacatctatc

SEQ ID NO: 7046016 - DNA, 22 bp, Homo sapiens
tttctgaaggttaaggaattag

SEQ ID NO: 7046017 - DNA, 22 bp, Homo sapiens
tttctgaagtcttctaacagat

SEQ ID NO: 7046018 - DNA, 18 bp, Homo sapiens
tttctgaatgtctatttc

SEQ ID NO: 7046019 - DNA, 22 bp, Homo sapiens
tttctgacctgcaacagtttac

SEQ ID NO: 7046020 - DNA, 22 bp, Homo sapiens
tttctgctaatcttttactgag

SEQ ID NO: 7046021 - DNA, 22 bp, Homo sapiens
tttctggaaacgggttcaagct

SEQ ID NO: 7046022 - DNA, 20 bp, Homo sapiens
tttctgtaaggcattaatct

SEQ ID NO: 7046023 - DNA, 22 bp, Homo sapiens
tttctgtaagtggcaaataatg

SEQ ID NO: 7046024 - DNA, 22 bp, Homo sapiens
tttctgtacacccactattcat

SEQ ID NO: 7046025 - DNA, 22 bp, Homo sapiens
tttctgtacacccactattcat

SEQ ID NO: 7046026 - DNA, 20 bp, Homo sapiens
tttctgtagctcagtattca

SEQ ID NO: 7046027 - DNA, 20 bp, Homo sapiens
tttctgtagctcagtattca

SEQ ID NO: 7046028 - DNA, 22 bp, Homo sapiens
tttctgtaggggatatctttga

SEQ ID NO: 7046029 - DNA, 22 bp, Homo sapiens
tttctgtatttaaaagatctgg

SEQ ID NO: 7046030 - DNA, 22 bp, Homo sapiens
tttctgtcattactttcctccc

SEQ ID NO: 7046031 - DNA, 19 bp, Homo sapiens
tttctgtctgtgttttgcc

SEQ ID NO: 7046032 - DNA, 21 bp, Homo sapiens
tttcttatctgtaaagtggga

SEQ ID NO: 7046033 - DNA, 22 bp, Homo sapiens
tttcttatgagcaagactctat

SEQ ID NO: 7046034 - DNA, 22 bp, Homo sapiens
tttcttatggggtagtccttta

SEQ ID NO: 7046035 - DNA, 22 bp, Homo sapiens
tttcttcattgacaaggaaaaa

SEQ ID NO: 7046036 - DNA, 22 bp, Homo sapiens
tttcttccaaaggcacgttctc

SEQ ID NO: 7046037 - DNA, 22 bp, Homo sapiens
tttcttcccaagcagtttcaga

SEQ ID NO: 7046038 - DNA, 22 bp, Homo sapiens
tttcttccccaagtgaatttta

SEQ ID NO: 7046039 - DNA, 22 bp, Homo sapiens
tttcttcctaaatatgatttcc

SEQ ID NO: 7046040 - DNA, 22 bp, Homo sapiens
tttcttcctatgtatcttgctg

SEQ ID NO: 7046041 - DNA, 22 bp, Homo sapiens
tttcttcctgctttgtcccatg

SEQ ID NO: 7046042 - DNA, 22 bp, Homo sapiens
tttcttcctggattcctacttc

SEQ ID NO: 7046043 - DNA, 22 bp, Homo sapiens
tttcttctaagatttcaaacta

SEQ ID NO: 7046044 - DNA, 22 bp, Homo sapiens
tttcttctatgtgtgatatttt

SEQ ID NO: 7046045 - DNA, 22 bp, Homo sapiens
tttcttctctaatctcaatgat

SEQ ID NO: 7046046 - DNA, 22 bp, Homo sapiens
tttctttaaaggaactctgttt

SEQ ID NO: 7046047 - DNA, 22 bp, Homo sapiens
tttaaaagttatcatctgtcca

SEQ ID NO: 7046048 - DNA, 22 bp, Homo sapiens
tttaaaatcagatgggagttgg

SEQ ID NO: 7046049 - DNA, 22 bp, Homo sapiens
tttaaaaaactagtctgagtct

SEQ ID NO: 7046050 - DNA, 22 bp, Homo sapiens
tttaaaatcagatgggagttgg

SEQ ID NO: 7046051 - DNA, 22 bp, Homo sapiens
tttaaaatttagacctctccac

SEQ ID NO: 7046052 - DNA, 22 bp, Homo sapiens
tttaaaatttagacctctccac

SEQ ID NO: 7046053 - DNA, 19 bp, Homo sapiens
tttaatgtgtgctgcaatc

SEQ ID NO: 7046054 - DNA, 22 bp, Homo sapiens
tttaatgttaaatttgtagatg

SEQ ID NO: 7046055 - DNA, 22 bp, Homo sapiens
tttaatgtttgagtcagtatat

SEQ ID NO: 7046056 - DNA, 22 bp, Homo sapiens
tttaattctggcataatagctc

SEQ ID NO: 7046057 - DNA, 22 bp, Homo sapiens
tttaattgcatttaaagatgga

SEQ ID NO: 7046058 - DNA, 22 bp, Homo sapiens
tttaattgttgtgggtacatag

SEQ ID NO: 7046059 - DNA, 22 bp, Homo sapiens
tttaatttgaaatgagtaaccc

SEQ ID NO: 7046060 - DNA, 21 bp, Homo sapiens
tttaatttgcatgtatgacgc

SEQ ID NO: 7046061 - DNA, 22 bp, Homo sapiens
tttaatttgtatttctagaggg

SEQ ID NO: 7046062 - DNA, 22 bp, Homo sapiens
tttactttctcaagtatatagg

SEQ ID NO: 7046063 - DNA, 22 bp, Homo sapiens
tttactttgtgtcaagtcaaga

SEQ ID NO: 7046064 - DNA, 22 bp, Homo sapiens
tttagttttgatgaaaatgcca

SEQ ID NO: 7046065 - DNA, 22 bp, Homo sapiens
tttataattatctctactctta

SEQ ID NO: 7046066 - DNA, 23 bp, Homo sapiens
tttatagcagcatgatttataat

SEQ ID NO: 7046067 - DNA, 23 bp, Homo sapiens
tttatagcagcatgatttatagt

SEQ ID NO: 7046068 - DNA, 22 bp, Homo sapiens
tttattaagatgcgaatgctga

SEQ ID NO: 7046069 - DNA, 22 bp, Homo sapiens
tttattatgatggacaccttcg

SEQ ID NO: 7046070 - DNA, 22 bp, Homo sapiens
tttcaaaagcgtacgtagtgaa

SEQ ID NO: 7046071 - DNA, 22 bp, Homo sapiens
tttcaaaattttgcagtggtaa

SEQ ID NO: 7046072 - DNA, 22 bp, Homo sapiens
ttgtgttaaggtgcatctagtg

SEQ ID NO: 7046073 - DNA, 22 bp, Homo sapiens
ttgttacagcagcaatagaaaa

SEQ ID NO: 7046074 - DNA, 22 bp, Homo sapiens
ttgtttaagccacccaatctgt

SEQ ID NO: 7046075 - DNA, 20 bp, Homo sapiens
ttgtttcctggctgttctgc

SEQ ID NO: 7046076 - DNA, 22 bp, Homo sapiens
ttgtttctccagtctaggaaaa

SEQ ID NO: 7046077 - DNA, 22 bp, Homo sapiens
ttgtttctcctggtgcctgata

SEQ ID NO: 7046078 - DNA, 22 bp, Homo sapiens
ttgtttctctggtcttgagtga

SEQ ID NO: 7046079 - DNA, 22 bp, Homo sapiens
ttgtttctgagttttcatgtat

SEQ ID NO: 7046080 - DNA, 20 bp, Homo sapiens
ttgtttctgctattttctaa

SEQ ID NO: 7046081 - DNA, 22 bp, Homo sapiens
ttgtttctggaaaaggcgagaa

SEQ ID NO: 7046082 - DNA, 22 bp, Homo sapiens
ttgtttcttcaggcttttagga

SEQ ID NO: 7046083 - DNA, 22 bp, Homo sapiens
ttgtttcttcaggcttttagga

SEQ ID NO: 7046084 - DNA, 22 bp, Homo sapiens
ttgtttcttcatttagaagctt

SEQ ID NO: 7046085 - DNA, 17 bp, Homo sapiens
ttgtttcttctctgtgg

SEQ ID NO: 7046086 - DNA, 22 bp, Homo sapiens
ttgtttctttgaagtttctaga

SEQ ID NO: 7046087 - DNA, 22 bp, Homo sapiens
ttgtttctttgaagtttctaga

SEQ ID NO: 7046088 - DNA, 23 bp, Homo sapiens
ttgtttctttgtattgtctctat

SEQ ID NO: 7046089 - DNA, 22 bp, Homo sapiens
ttgttttaacgactcagcttgt

SEQ ID NO: 7046090 - DNA, 22 bp, Homo sapiens
ttgcaattaacatatgtcaact

SEQ ID NO: 7046091 - DNA, 22 bp, Homo sapiens
ttgcaaattccaatccaatatt

SEQ ID NO: 7046092 - DNA, 18 bp, Homo sapiens
ttgcaaattcttccctgt

SEQ ID NO: 7046093 - DNA, 23 bp, Homo sapiens
ttgcaaatttcagttagttcatg

SEQ ID NO: 7046094 - DNA, 22 bp, Homo sapiens
ttggtccaaagtcctctgagta

SEQ ID NO: 7046095 - DNA, 22 bp, Homo sapiens
ttggttttatcttaagattctt

SEQ ID NO: 7046096 - DNA, 23 bp, Homo sapiens
ttgtaaaacagtgtgacggttcc

SEQ ID NO: 7046097 - DNA, 23 bp, Homo sapiens
ttgtccttctgaaatatatctgg

SEQ ID NO: 7046098 - DNA, 22 bp, Homo sapiens
gggcagcatgaggaccctcatc

SEQ ID NO: 7046099 - DNA, 22 bp, Homo sapiens
gggcagcagttgccctaatcaa

SEQ ID NO: 7046100 - DNA, 22 bp, Homo sapiens
cagagacaggaatcagctgcag

SEQ ID NO: 7046101 - DNA, 22 bp, Homo sapiens
cagagacaggaatcagctgcag

SEQ ID NO: 7046102 - DNA, 22 bp, Homo sapiens
cagagacaggagtgctcccagt

SEQ ID NO: 7046103 - DNA, 22 bp, Homo sapiens
cagagacaggatctcgaagact

SEQ ID NO: 7046104 - DNA, 22 bp, Homo sapiens
cagagacaggcttgccctccac

SEQ ID NO: 7046105 - DNA, 20 bp, Homo sapiens
gggcagtggcgctatctcag

SEQ ID NO: 7046106 - DNA, 22 bp, Homo sapiens
gggcagtgggtggctgcagcct

SEQ ID NO: 7046107 - DNA, 22 bp, Homo sapiens
gggcagtggttacacagctgag

SEQ ID NO: 7046108 - DNA, 22 bp, Homo sapiens
cagacccaggatccaaatgttg

SEQ ID NO: 7046109 - DNA, 22 bp, Homo sapiens
cagacagggtgggtttctgggc

SEQ ID NO: 7046110 - DNA, 22 bp, Homo sapiens
cagaccagaaggaagccgacaa

SEQ ID NO: 7046111 - DNA, 21 bp, Homo sapiens
cagaccctctagaggccacct

SEQ ID NO: 7046112 - DNA, 22 bp, Homo sapiens
cagacctcagtcctcagtagga

SEQ ID NO: 7046113 - DNA, 22 bp, Homo sapiens
ggcttcagaagactggacaggt

SEQ ID NO: 7046114 - DNA, 17 bp, Homo sapiens
ggcttacaggtgccagc

SEQ ID NO: 7046115 - DNA, 22 bp, Homo sapiens
cagacctgaggagcactgagcc

SEQ ID NO: 7046116 - DNA, 22 bp, Homo sapiens
cagacctgaggagcactgagcc

SEQ ID NO: 7046117 - DNA, 22 bp, Homo sapiens
cagacctggggcctgggagccc

SEQ ID NO: 7046118 - DNA, 19 bp, Homo sapiens
cagacctgtccagcctgtg

SEQ ID NO: 7046119 - DNA, 22 bp, Homo sapiens
gggctgaaaggccgcctcagat

SEQ ID NO: 7046120 - DNA, 22 bp, Homo sapiens
gggctgacaaccatctgacaag

SEQ ID NO: 7046121 - DNA, 22 bp, Homo sapiens
gggctgactcaaccttgcaaag

SEQ ID NO: 7046122 - DNA, 22 bp, Homo sapiens
gggctgagaagttgatcccaag

SEQ ID NO: 7046123 - DNA, 22 bp, Homo sapiens
cagagcctaaaacgactccact

SEQ ID NO: 7046124 - DNA, 19 bp, Homo sapiens
cagagcctcagagctagaa

SEQ ID NO: 7046125 - DNA, 19 bp, Homo sapiens
cagagcctcagagctagaa

SEQ ID NO: 7046126 - DNA, 22 bp, Homo sapiens
gggctgagtgacctcaggccaa

SEQ ID NO: 7046127 - DNA, 22 bp, Homo sapiens
gggctgagtgacctcaggccaa

SEQ ID NO: 7046128 - DNA, 22 bp, Homo sapiens
gggctgagtctgctgcctgtca

SEQ ID NO: 7046129 - DNA, 22 bp, Homo sapiens
gggctgagtctgctgcctgtca

SEQ ID NO: 7046130 - DNA, 22 bp, Homo sapiens
gggctgagtcatctggggcctc

SEQ ID NO: 7046131 - DNA, 22 bp, Homo sapiens
gggctgaggggtatctcatggg

SEQ ID NO: 7046132 - DNA, 22 bp, Homo sapiens
gggctgagtcatctggggcctc

SEQ ID NO: 7046133 - DNA, 22 bp, Homo sapiens
gggctgaggggtatctcatggg

SEQ ID NO: 7046134 - DNA, 22 bp, Homo sapiens
gggctgaggggtatctcatggg

SEQ ID NO: 7046135 - DNA, 22 bp, Homo sapiens
cagagctgggtttgggaaacct

SEQ ID NO: 7046136 - DNA, 22 bp, Homo sapiens
gggctgaggggtatctcatggg

SEQ ID NO: 7046137 - DNA, 22 bp, Homo sapiens
gggctgagtgggcctcttactt

SEQ ID NO: 7046138 - DNA, 22 bp, Homo sapiens
cagaggagaattgcgggatcat

SEQ ID NO: 7046139 - DNA, 20 bp, Homo sapiens
cagaggcaaggagacttgga

SEQ ID NO: 7046140 - DNA, 22 bp, Homo sapiens
cagagcctctgccctgggcact

SEQ ID NO: 7046141 - DNA, 22 bp, Homo sapiens
cagagcctctgccctgggcact

SEQ ID NO: 7046142 - DNA, 22 bp, Homo sapiens
cagagcctctcagaggtcagac

SEQ ID NO: 7046143 - DNA, 19 bp, Homo sapiens
cagagctgctggcctcgtc

SEQ ID NO: 7046144 - DNA, 22 bp, Homo sapiens
cagagctgggatcccatgggcg

SEQ ID NO: 7046145 - DNA, 23 bp, Homo sapiens
cagagctggcttcatgggtgtgc

SEQ ID NO: 7046146 - DNA, 22 bp, Homo sapiens
cagagctgggatcccatgggcg

SEQ ID NO: 7046147 - DNA, 22 bp, Homo sapiens
cagagctgggtttgggaaacct

SEQ ID NO: 7046148 - DNA, 22 bp, Homo sapiens
cagaggtacaagctaagttggg

SEQ ID NO: 7046149 - DNA, 22 bp, Homo sapiens
cagaggtacagccattgaagat

SEQ ID NO: 7046150 - DNA, 22 bp, Homo sapiens
cagaggtaccagcagcctctgg

SEQ ID NO: 7046151 - DNA, 22 bp, Homo sapiens
cagaggtagaactggccctcac

SEQ ID NO: 7046152 - DNA, 22 bp, Homo sapiens
cagaggtagaaggcatgcagtg

SEQ ID NO: 7046153 - DNA, 22 bp, Homo sapiens
cagaggtagcatgctgtggctt

SEQ ID NO: 7046154 - DNA, 22 bp, Homo sapiens
cagaggtagccgagtgcaatcg

SEQ ID NO: 7046155 - DNA, 22 bp, Homo sapiens
ggtcacaggggagaagagtgat

SEQ ID NO: 7046156 - DNA, 22 bp, Homo sapiens
ggtcatctgcctccaaagcact

SEQ ID NO: 7046157 - DNA, 22 bp, Homo sapiens
ggtcatctgtaattctgttcct

SEQ ID NO: 7046158 - DNA, 22 bp, Homo sapiens
ggtcatgagggagcagtgcagg

SEQ ID NO: 7046159 - DNA, 23 bp, Homo sapiens
ggtccacccgagcctgcagcttc

SEQ ID NO: 7046160 - DNA, 22 bp, Homo sapiens
ggtccacctccaagctggggac

SEQ ID NO: 7046161 - DNA, 22 bp, Homo sapiens
cagagtctggactgcaggctcc

SEQ ID NO: 7046162 - DNA, 22 bp, Homo sapiens
cagagtgaaaactgagctcaaa

SEQ ID NO: 7046163 - DNA, 22 bp, Homo sapiens
cagaggggataacaggtgtaga

SEQ ID NO: 7046164 - DNA, 22 bp, Homo sapiens
cagaggggataacaggtgtaga

SEQ ID NO: 7046165 - DNA, 21 bp, Homo sapiens
cagaggggctagcctggctgc

SEQ ID NO: 7046166 - DNA, 22 bp, Homo sapiens
cagagggtgtgaaggggatgaa

SEQ ID NO: 7046167 - DNA, 22 bp, Homo sapiens
cagagggtgtgaaggggatgaa

SEQ ID NO: 7046168 - DNA, 23 bp, Homo sapiens
cagagggttccatggagcatggt

SEQ ID NO: 7046169 - DNA, 22 bp, Homo sapiens
cagagggctgtgtaaggatgtt

SEQ ID NO: 7046170 - DNA, 22 bp, Homo sapiens
cagagggctgccctgagttcgt

SEQ ID NO: 7046171 - DNA, 22 bp, Homo sapiens
cagagggctcagtcctgctgga

SEQ ID NO: 7046172 - DNA, 22 bp, Homo sapiens
cagaggcacaagaaagcaaggc

SEQ ID NO: 7046173 - DNA, 22 bp, Homo sapiens
cagaggcacagcttcttttaat

SEQ ID NO: 7046174 - DNA, 19 bp, Homo sapiens
cagaggcaccaggtataga

SEQ ID NO: 7046175 - DNA, 19 bp, Homo sapiens
cagaggcaccaggtataga

SEQ ID NO: 7046176 - DNA, 19 bp, Homo sapiens
cagaggcaccaggtataga

SEQ ID NO: 7046177 - DNA, 19 bp, Homo sapiens
cagaggcactttctcttag

SEQ ID NO: 7046178 - DNA, 22 bp, Homo sapiens
ggggagcaatagttgaggtgtg

SEQ ID NO: 7046179 - DNA, 22 bp, Homo sapiens
ggggagctgggaggtgagttac

SEQ ID NO: 7046180 - DNA, 22 bp, Homo sapiens
ggtgctggttcagggtggctgt

SEQ ID NO: 7046181 - DNA, 22 bp, Homo sapiens
cagcacagtacaaggcacggat

SEQ ID NO: 7046182 - DNA, 22 bp, Homo sapiens
ggtgctgcctatagtctgaaac

SEQ ID NO: 7046183 - DNA, 22 bp, Homo sapiens
cagcaaggactgggcatgtgaa

SEQ ID NO: 7046184 - DNA, 22 bp, Homo sapiens
cagcaaggactgggcatgtgaa

SEQ ID NO: 7046185 - DNA, 22 bp, Homo sapiens
cagcacagtagagtagttgtaa

SEQ ID NO: 7046186 - DNA, 22 bp, Homo sapiens
cagcacagtttgcttggcagag

SEQ ID NO: 7046187 - DNA, 22 bp, Homo sapiens
cagcacatctgattatatgact

SEQ ID NO: 7046188 - DNA, 22 bp, Homo sapiens
cagcacatgctcatcagggaag

SEQ ID NO: 7046189 - DNA, 22 bp, Homo sapiens
ggtctgagcttgagcccatgct

SEQ ID NO: 7046190 - DNA, 22 bp, Homo sapiens
ggtctgaggtgggacccaggaa

SEQ ID NO: 7046191 - DNA, 22 bp, Homo sapiens
ggtctgagtgccagggagagaa

SEQ ID NO: 7046192 - DNA, 22 bp, Homo sapiens
ggtctgagtggggcctgagatt

SEQ ID NO: 7046193 - DNA, 22 bp, Homo sapiens
ggtctgccacaagatttttgag

SEQ ID NO: 7046194 - DNA, 22 bp, Homo sapiens
ggtctgcccactactctccatt

SEQ ID NO: 7046195 - DNA, 22 bp, Homo sapiens
ggtctgccctgggtggaggcgc

SEQ ID NO: 7046196 - DNA, 22 bp, Homo sapiens
ggtgacagtggttaaaatttgt

SEQ ID NO: 7046197 - DNA, 22 bp, Homo sapiens
ggtgacagttccggaggtacag

SEQ ID NO: 7046198 - DNA, 22 bp, Homo sapiens
ggtgacctcacctggtcccacc

SEQ ID NO: 7046199 - DNA, 22 bp, Homo sapiens
ggtgacctcacctggtcccacc

SEQ ID NO: 7046200 - DNA, 22 bp, Homo sapiens
ggtgacgaatccatagcatcga

SEQ ID NO: 7046201 - DNA, 22 bp, Homo sapiens
cagcaagatttttaaagcaagg

SEQ ID NO: 7046202 - DNA, 22 bp, Homo sapiens
cagctatagatggactgaagag

SEQ ID NO: 7046203 - DNA, 22 bp, Homo sapiens
cagctattctctgaaatgaata

SEQ ID NO: 7046204 - DNA, 22 bp, Homo sapiens
gtgcccaggtgtccctgagaag

SEQ ID NO: 7046205 - DNA, 22 bp, Homo sapiens
gtgcccagtaaatgaaagcttt

SEQ ID NO: 7046206 - DNA, 22 bp, Homo sapiens
gtgcccagtgcaggcccgcagg

SEQ ID NO: 7046207 - DNA, 22 bp, Homo sapiens
cagctaccatggtttgttccag

SEQ ID NO: 7046208 - DNA, 21 bp, Homo sapiens
cagcctgctgctccagggcca

SEQ ID NO: 7046209 - DNA, 22 bp, Homo sapiens
cagcctgtagaatacagtaaat

SEQ ID NO: 7046210 - DNA, 22 bp, Homo sapiens
cagcctgtggcagaggtctaat

SEQ ID NO: 7046211 - DNA, 22 bp, Homo sapiens
cagccctgaaacaacctcctct

SEQ ID NO: 7046212 - DNA, 22 bp, Homo sapiens
cagccctgccatggagcctcct

SEQ ID NO: 7046213 - DNA, 22 bp, Homo sapiens
cagccctgctcttagtgtctcc

SEQ ID NO: 7046214 - DNA, 22 bp, Homo sapiens
cagccctgctgacactgtctga

SEQ ID NO: 7046215 - DNA, 22 bp, Homo sapiens
cagccctgctggcaatgatgag

SEQ ID NO: 7046216 - DNA, 22 bp, Homo sapiens
cagccctgcttccccgctagtt

SEQ ID NO: 7046217 - DNA, 22 bp, Homo sapiens
cagccctgcttccccgctagtt

SEQ ID NO: 7046218 - DNA, 22 bp, Homo sapiens
cagccctggaacagctgactca

SEQ ID NO: 7046219 - DNA, 23 bp, Homo sapiens
cagccctggagatgtgggaggca

SEQ ID NO: 7046220 - DNA, 20 bp, Homo sapiens
cagcctccactcactcagct

SEQ ID NO: 7046221 - DNA, 22 bp, Homo sapiens
cagcctgagccttctgtagcaa

SEQ ID NO: 7046222 - DNA, 22 bp, Homo sapiens
cagcctgcaggaggccgtcagc

SEQ ID NO: 7046223 - DNA, 22 bp, Homo sapiens
cagcctgccctggaagcccagc

SEQ ID NO: 7046224 - DNA, 22 bp, Homo sapiens
cagcctgccgtcagccaggtag

SEQ ID NO: 7046225 - DNA, 22 bp, Homo sapiens
gtgcccagttgaggccaggact

SEQ ID NO: 7046226 - DNA, 22 bp, Homo sapiens
gtgcccagttgaggccaggact

SEQ ID NO: 7046227 - DNA, 22 bp, Homo sapiens
gtgccctcacaaagtggaaaga

SEQ ID NO: 7046228 - DNA, 22 bp, Homo sapiens
gtgccctcatgaaacgaaggat

SEQ ID NO: 7046229 - DNA, 22 bp, Homo sapiens
gtgccctcctgaagccatcaca

SEQ ID NO: 7046230 - DNA, 22 bp, Homo sapiens
gtgctgagtagaatgaatgcct

SEQ ID NO: 7046231 - DNA, 22 bp, Homo sapiens
gtgctgagtagaatgaatgcct

SEQ ID NO: 7046232 - DNA, 22 bp, Homo sapiens
gtgctgtgcgctttttctgtat

SEQ ID NO: 7046233 - DNA, 18 bp, Homo sapiens
gtgctgtgggcagtggcc

SEQ ID NO: 7046234 - DNA, 22 bp, Homo sapiens
gtgctgtgtctatcaggaataa

SEQ ID NO: 7046235 - DNA, 22 bp, Homo sapiens
gtgctgtgtgatccatgctggc

SEQ ID NO: 7046236 - DNA, 22 bp, Homo sapiens
cagcaggcgttgggagaaagac

SEQ ID NO: 7046237 - DNA, 20 bp, Homo sapiens
cagcaggctatggggcaccc

SEQ ID NO: 7046238 - DNA, 22 bp, Homo sapiens
gtcataggttcaaaaggcagat

SEQ ID NO: 7046239 - DNA, 22 bp, Homo sapiens
gtcatcttaaggactgctatag

SEQ ID NO: 7046240 - DNA, 22 bp, Homo sapiens
gtcatcttcgcagagtgatttt

SEQ ID NO: 7046241 - DNA, 22 bp, Homo sapiens
cagcaggctctgagtggctgcc

SEQ ID NO: 7046242 - DNA, 22 bp, Homo sapiens
cagcaggctgcgattgctcatt

SEQ ID NO: 7046243 - DNA, 22 bp, Homo sapiens
cagcaggctgtggaaatcctgg

SEQ ID NO: 7046244 - DNA, 22 bp, Homo sapiens
gtcccagagagcactagtccat

SEQ ID NO: 7046245 - DNA, 22 bp, Homo sapiens
gtcccagaggacagggtcacat

SEQ ID NO: 7046246 - DNA, 22 bp, Homo sapiens
gtcccagaggctttggccacag

SEQ ID NO: 7046247 - DNA, 22 bp, Homo sapiens
gtcccagatgtctggaactccc

SEQ ID NO: 7046248 - DNA, 22 bp, Homo sapiens
cagcacctaggacagtagtcag

SEQ ID NO: 7046249 - DNA, 22 bp, Homo sapiens
cagcagctgggaaggaggctga

SEQ ID NO: 7046250 - DNA, 22 bp, Homo sapiens
cagcagctggttatacctgtgg

SEQ ID NO: 7046251 - DNA, 22 bp, Homo sapiens
cagcagctttgccaagtcagcc

SEQ ID NO: 7046252 - DNA, 22 bp, Homo sapiens
gtcagcctgcactcagggagcg

SEQ ID NO: 7046253 - DNA, 22 bp, Homo sapiens
gtcagcgtgctcagcctattat

SEQ ID NO: 7046254 - DNA, 22 bp, Homo sapiens
cagccagggagggcaaatgaga

SEQ ID NO: 7046255 - DNA, 22 bp, Homo sapiens
cagccaggcccccgagtcgttg

SEQ ID NO: 7046256 - DNA, 22 bp, Homo sapiens
gtctggaagaactagggatgtt

SEQ ID NO: 7046257 - DNA, 22 bp, Homo sapiens
gtctcttttatggtgagttgat

SEQ ID NO: 7046258 - DNA, 22 bp, Homo sapiens
gtctgcttttgttttactggta

SEQ ID NO: 7046259 - DNA, 22 bp, Homo sapiens
gtccctgggtctaaggcagtaa

SEQ ID NO: 7046260 - DNA, 22 bp, Homo sapiens
gtccctggggaatcagctggag

SEQ ID NO: 7046261 - DNA, 22 bp, Homo sapiens
gtcccaggctccatggcagcca

SEQ ID NO: 7046262 - DNA, 22 bp, Homo sapiens
gtctgtccatcagcaaaggctt

SEQ ID NO: 7046263 - DNA, 22 bp, Homo sapiens
cagccagggtcaggcagcttct

SEQ ID NO: 7046264 - DNA, 22 bp, Homo sapiens
cagccagggagggcaaatgaga

SEQ ID NO: 7046265 - DNA, 22 bp, Homo sapiens
cagccagggtcaggcagcttct

SEQ ID NO: 7046266 - DNA, 22 bp, Homo sapiens
cagccaggtatgggcgtgcggg

SEQ ID NO: 7046267 - DNA, 22 bp, Homo sapiens
cagccccttcctggcatctgga

SEQ ID NO: 7046268 - DNA, 22 bp, Homo sapiens
cagccccttgtccggtagccac

SEQ ID NO: 7046269 - DNA, 22 bp, Homo sapiens
cagcccctcacagagctgtcct

SEQ ID NO: 7046270 - DNA, 22 bp, Homo sapiens
cagcccctcacagagctgtcct

SEQ ID NO: 7046271 - DNA, 22 bp, Homo sapiens
cagcccctccctcaggcaggtg

SEQ ID NO: 7046272 - DNA, 22 bp, Homo sapiens
ggcaggcaggagcgtgcttggg

SEQ ID NO: 7046273 - DNA, 22 bp, Homo sapiens
ggcaggcaggagcgtgcttggg

SEQ ID NO: 7046274 - DNA, 22 bp, Homo sapiens
ggcaggcaggagctctgtctcc

SEQ ID NO: 7046275 - DNA, 22 bp, Homo sapiens
ggcaggcaggtcttcatggccc

SEQ ID NO: 7046276 - DNA, 22 bp, Homo sapiens
ggcaggcagtgtggtgtgaaac

SEQ ID NO: 7046277 - DNA, 22 bp, Homo sapiens
ggcaggcatcatgtggtcatta

SEQ ID NO: 7046278 - DNA, 22 bp, Homo sapiens
ggcaggcatcatgtggtcatta

SEQ ID NO: 7046279 - DNA, 22 bp, Homo sapiens
ggcaggcatggggtctgccatt

SEQ ID NO: 7046280 - DNA, 22 bp, Homo sapiens
ggcaggcatggggtctgccatt

SEQ ID NO: 7046281 - DNA, 22 bp, Homo sapiens
ggcagggagagcatgctgataa

SEQ ID NO: 7046282 - DNA, 20 bp, Homo sapiens
ggcagggagggatactgagg

SEQ ID NO: 7046283 - DNA, 22 bp, Homo sapiens
cacatagataggcagaagaaca

SEQ ID NO: 7046284 - DNA, 22 bp, Homo sapiens
cacatatacctcttcttgagtt

SEQ ID NO: 7046285 - DNA, 22 bp, Homo sapiens
ggaggtgaggccgtagggtgtg

SEQ ID NO: 7046286 - DNA, 22 bp, Homo sapiens
ggaggtgaggccgtagggtgtg

SEQ ID NO: 7046287 - DNA, 22 bp, Homo sapiens
ggaggtgctgatcccagtcaac

SEQ ID NO: 7046288 - DNA, 22 bp, Homo sapiens
ggaggtgctggcggccagctct

SEQ ID NO: 7046289 - DNA, 22 bp, Homo sapiens
cacagggaaccaaggctgggcc

SEQ ID NO: 7046290 - DNA, 22 bp, Homo sapiens
ggaggtggaggttgcagtgagc

SEQ ID NO: 7046291 - DNA, 22 bp, Homo sapiens
ggaggtggaggttgcaatgagc

SEQ ID NO: 7046292 - DNA, 22 bp, Homo sapiens
ggaggtggaggttgcaatgagc

SEQ ID NO: 7046293 - DNA, 22 bp, Homo sapiens
ggaggtggagctggaagttcca

SEQ ID NO: 7046294 - DNA, 22 bp, Homo sapiens
ggaggtggagctggaagttcca

SEQ ID NO: 7046295 - DNA, 22 bp, Homo sapiens
cacataaatggtgccatgtttt

SEQ ID NO: 7046296 - DNA, 22 bp, Homo sapiens
cacatacaatggtgttatttgg

SEQ ID NO: 7046297 - DNA, 22 bp, Homo sapiens
cacatacatacgtatgtataca

SEQ ID NO: 7046298 - DNA, 22 bp, Homo sapiens
cacatacattcatgttactcta

SEQ ID NO: 7046299 - DNA, 22 bp, Homo sapiens
cacgcacgctgggtggaggcgc

SEQ ID NO: 7046300 - DNA, 21 bp, Homo sapiens
caccttatagataaaattaga

SEQ ID NO: 7046301 - DNA, 22 bp, Homo sapiens
cacctttgaccttgcagcgcac

SEQ ID NO: 7046302 - DNA, 22 bp, Homo sapiens
cacctttgcaaaccaaatctga

SEQ ID NO: 7046303 - DNA, 22 bp, Homo sapiens
ggccggggcctgctcgcctgtg

SEQ ID NO: 7046304 - DNA, 22 bp, Homo sapiens
ggccactgacctacatctgggg

SEQ ID NO: 7046305 - DNA, 22 bp, Homo sapiens
ggccactgctctccagcctggg

SEQ ID NO: 7046306 - DNA, 22 bp, Homo sapiens
ggccactgctgctctggtggag

SEQ ID NO: 7046307 - DNA, 22 bp, Homo sapiens
ggccactgtttcctgggcagtt

SEQ ID NO: 7046308 - DNA, 22 bp, Homo sapiens
ggccctgtccccttcagttttg

SEQ ID NO: 7046309 - DNA, 22 bp, Homo sapiens
ggccctgtgatggatgtattag

SEQ ID NO: 7046310 - DNA, 22 bp, Homo sapiens
ggccctgtggttttgcaaagtc

SEQ ID NO: 7046311 - DNA, 22 bp, Homo sapiens
ggcccttcctcttgtgctggca

SEQ ID NO: 7046312 - DNA, 22 bp, Homo sapiens
ggcccttcctgctctcttagct

SEQ ID NO: 7046313 - DNA, 22 bp, Homo sapiens
ggcaggtgccttctgtgctagc

SEQ ID NO: 7046314 - DNA, 22 bp, Homo sapiens
ggcaggtgccagttggcttggg

SEQ ID NO: 7046315 - DNA, 22 bp, Homo sapiens
ggcaggtgcccagagagcacga

SEQ ID NO: 7046316 - DNA, 22 bp, Homo sapiens
ggcaggtgatctagagtcaata

SEQ ID NO: 7046317 - DNA, 22 bp, Homo sapiens
ggcaggtgatctagagtcaata

SEQ ID NO: 7046318 - DNA, 22 bp, Homo sapiens
ggcaggtgcacctgagccatct

SEQ ID NO: 7046319 - DNA, 22 bp, Homo sapiens
ggcagggcaggaaagtcaggaa

SEQ ID NO: 7046320 - DNA, 22 bp, Homo sapiens
ggcagggcaggaaagtcaggaa

SEQ ID NO: 7046321 - DNA, 22 bp, Homo sapiens
ggcagggcaggaaagtcaggaa

SEQ ID NO: 7046322 - DNA, 22 bp, Homo sapiens
ggcagggagtggagactcccta

SEQ ID NO: 7046323 - DNA, 22 bp, Homo sapiens
ggcagggagtggagactcccta

SEQ ID NO: 7046324 - DNA, 22 bp, Homo sapiens
ggcagggcagcgctgattaggg

SEQ ID NO: 7046325 - DNA, 22 bp, Homo sapiens
ggcatttagttttcatattctg

SEQ ID NO: 7046326 - DNA, 22 bp, Homo sapiens
ggccaaggatggtggctctggt

SEQ ID NO: 7046327 - DNA, 23 bp, Homo sapiens
ggccactgaattttctgcatctt

SEQ ID NO: 7046328 - DNA, 23 bp, Homo sapiens
ggccactgaattttctgcatctt

SEQ ID NO: 7046329 - DNA, 19 bp, Homo sapiens
ggctcagggcgctgccgcc

SEQ ID NO: 7046330 - DNA, 22 bp, Homo sapiens
ggctcaggggccaggcctgtcc

SEQ ID NO: 7046331 - DNA, 22 bp, Homo sapiens
ggctcagggaatgaggaagaat

SEQ ID NO: 7046332 - DNA, 22 bp, Homo sapiens
ggctcaggctggagtgcagtgg

SEQ ID NO: 7046333 - DNA, 22 bp, Homo sapiens
ggctcaggctggagtgcagtgg

SEQ ID NO: 7046334 - DNA, 22 bp, Homo sapiens
ggctcaggctggagtgcagtgg

SEQ ID NO: 7046335 - DNA, 22 bp, Homo sapiens
ggcctgtgggaggacagctggg

SEQ ID NO: 7046336 - DNA, 22 bp, Homo sapiens
ggcctgtggtttctagtaggtt

SEQ ID NO: 7046337 - DNA, 22 bp, Homo sapiens
ggcctgagcagacagcatgatg

SEQ ID NO: 7046338 - DNA, 22 bp, Homo sapiens
ggcctgagcagacagcatgatg

SEQ ID NO: 7046339 - DNA, 22 bp, Homo sapiens
ggcctgagcttgggcagcgtat

SEQ ID NO: 7046340 - DNA, 22 bp, Homo sapiens
ggcctgaggccaccagcagccc

SEQ ID NO: 7046341 - DNA, 22 bp, Homo sapiens
ggcctgaggcgtcccagctgtg

SEQ ID NO: 7046342 - DNA, 22 bp, Homo sapiens
ggctgaggctcatgccatcttg

SEQ ID NO: 7046343 - DNA, 22 bp, Homo sapiens
ggctgaggcggcgatgcccttg

SEQ ID NO: 7046344 - DNA, 22 bp, Homo sapiens
ggctgaggcggcgatgcccttg

SEQ ID NO: 7046345 - DNA, 22 bp, Homo sapiens
ggctgagcttatatatgtgctg

SEQ ID NO: 7046346 - DNA, 22 bp, Homo sapiens
ggctgaggcggcgatgcccttg

SEQ ID NO: 7046347 - DNA, 22 bp, Homo sapiens
ggctgagcctggagcatctggt

SEQ ID NO: 7046348 - DNA, 19 bp, Homo sapiens
ggctgagcgccttggctgc

SEQ ID NO: 7046349 - DNA, 22 bp, Homo sapiens
ggctgagcgtggctgccgtggg

SEQ ID NO: 7046350 - DNA, 22 bp, Homo sapiens
ggctctggtcagtgaggggcct

SEQ ID NO: 7046351 - DNA, 22 bp, Homo sapiens
ggctctggtgagggtaggagat

SEQ ID NO: 7046352 - DNA, 22 bp, Homo sapiens
ggctctggtgccctggctccca

SEQ ID NO: 7046353 - DNA, 22 bp, Homo sapiens
ggctctggtgtgaagcagcctc

SEQ ID NO: 7046354 - DNA, 22 bp, Homo sapiens
ggctgagccccctctgcgtagg

SEQ ID NO: 7046355 - DNA, 22 bp, Homo sapiens
ggctctgggttctgcaatgcgt

SEQ ID NO: 7046356 - DNA, 22 bp, Homo sapiens
ggctctggtgagggtaggagat

SEQ ID NO: 7046357 - DNA, 22 bp, Homo sapiens
ggcttaaaaggaaaatgagagt

SEQ ID NO: 7046358 - DNA, 22 bp, Homo sapiens
ggctgtgaaccctggcagtgtg

SEQ ID NO: 7046359 - DNA, 22 bp, Homo sapiens
ggctgtgaagtagcaggggcag

SEQ ID NO: 7046360 - DNA, 22 bp, Homo sapiens
ggctgtaggttggtgctggaca

SEQ ID NO: 7046361 - DNA, 22 bp, Homo sapiens
ggctgtagttacctgatgaaat

SEQ ID NO: 7046362 - DNA, 23 bp, Homo sapiens
cagaaataaactggtttgtagat

SEQ ID NO: 7046363 - DNA, 22 bp, Homo sapiens
ggctgggaggatgacttgctac

SEQ ID NO: 7046364 - DNA, 22 bp, Homo sapiens
cagaaagtgatttgctattcca

SEQ ID NO: 7046365 - DNA, 18 bp, Homo sapiens
cagaaagttatttactct

SEQ ID NO: 7046366 - DNA, 18 bp, Homo sapiens
cagaaagttatttactct

SEQ ID NO: 7046367 - DNA, 23 bp, Homo sapiens
cagaaagtttgagaagatacatc

SEQ ID NO: 7046368 - DNA, 22 bp, Homo sapiens
cagaaaacctgactctagaact

SEQ ID NO: 7046369 - DNA, 23 bp, Homo sapiens
cagaaaacccagagctcagtccc

SEQ ID NO: 7046370 - DNA, 22 bp, Homo sapiens
cagaaaataaagtttctacgca

SEQ ID NO: 7046371 - DNA, 22 bp, Homo sapiens
ggctgccctcggggtcgcaggc

SEQ ID NO: 7046372 - DNA, 22 bp, Homo sapiens
cagaaagccgacttacaatgga

SEQ ID NO: 7046373 - DNA, 22 bp, Homo sapiens
cacagaataattcacatggctc

SEQ ID NO: 7046374 - DNA, 22 bp, Homo sapiens
cacagaactggttaatagcaga

SEQ ID NO: 7046375 - DNA, 22 bp, Homo sapiens
ggaaggggagctggaaagggta

SEQ ID NO: 7046376 - DNA, 22 bp, Homo sapiens
ggaaggggagctggaaagggta

SEQ ID NO: 7046377 - DNA, 22 bp, Homo sapiens
ggaaggggagctggaaagggta

SEQ ID NO: 7046378 - DNA, 20 bp, Homo sapiens
ggaaggggcaaagtgtgtga

SEQ ID NO: 7046379 - DNA, 21 bp, Homo sapiens
cacacagctgcccttaggtag

SEQ ID NO: 7046380 - DNA, 22 bp, Homo sapiens
cacacagacagctctctgaaga

SEQ ID NO: 7046381 - DNA, 22 bp, Homo sapiens
cacacagacagctctctgaaga

SEQ ID NO: 7046382 - DNA, 22 bp, Homo sapiens
cacacagacagctctctgaaga

SEQ ID NO: 7046383 - DNA, 22 bp, Homo sapiens
cacacagatggtaagggaggga

SEQ ID NO: 7046384 - DNA, 22 bp, Homo sapiens
cacagacagtgtccctttgttg

SEQ ID NO: 7046385 - DNA, 22 bp, Homo sapiens
ggactgggagaatggaggcaag

SEQ ID NO: 7046386 - DNA, 22 bp, Homo sapiens
ggactgggagaatggaggcaag

SEQ ID NO: 7046387 - DNA, 22 bp, Homo sapiens
ggactgggagaatggaggcaag

SEQ ID NO: 7046388 - DNA, 22 bp, Homo sapiens
ggactgggccaggggttggact

SEQ ID NO: 7046389 - DNA, 17 bp, Homo sapiens
ggactgggcggggcagg

SEQ ID NO: 7046390 - DNA, 22 bp, Homo sapiens
ggactgggccaggggttggact

SEQ ID NO: 7046391 - DNA, 22 bp, Homo sapiens
ggactgggcatgggtgctctgc

SEQ ID NO: 7046392 - DNA, 22 bp, Homo sapiens
ggactgggattctggatctgct

SEQ ID NO: 7046393 - DNA, 22 bp, Homo sapiens
ggactgggattctggatctgct

SEQ ID NO: 7046394 - DNA, 22 bp, Homo sapiens
cacagagctgaacctgggtcat

SEQ ID NO: 7046395 - DNA, 22 bp, Homo sapiens
cacagaggaaatgactttctta

SEQ ID NO: 7046396 - DNA, 22 bp, Homo sapiens
cacagaggagtgcacactctct

SEQ ID NO: 7046397 - DNA, 22 bp, Homo sapiens
cacagaggatgcccaagcgatc

SEQ ID NO: 7046398 - DNA, 22 bp, Homo sapiens
cacagaggatgcccaagcgatc

SEQ ID NO: 7046399 - DNA, 22 bp, Homo sapiens
cacagaggctcaaagccaggtg

SEQ ID NO: 7046400 - DNA, 22 bp, Homo sapiens
cacaggagaaaggggaagctcg

SEQ ID NO: 7046401 - DNA, 22 bp, Homo sapiens
ggaggcagaatagagtgtgggt

SEQ ID NO: 7046402 - DNA, 22 bp, Homo sapiens
cacaggaatgaacagggaaaga

SEQ ID NO: 7046403 - DNA, 22 bp, Homo sapiens
cacaggaatgaacagggaaaga

SEQ ID NO: 7046404 - DNA, 22 bp, Homo sapiens
cacaggactcgactgcagacag

SEQ ID NO: 7046405 - DNA, 22 bp, Homo sapiens
cacaggaatcgtcacttagcgc

SEQ ID NO: 7046406 - DNA, 22 bp, Homo sapiens
cacaggaatcagcattaatggc

SEQ ID NO: 7046407 - DNA, 22 bp, Homo sapiens
cacagctttgctttccttaata

SEQ ID NO: 7046408 - DNA, 22 bp, Homo sapiens
ggaggcatctctgtggctgtct

SEQ ID NO: 7046409 - DNA, 22 bp, Homo sapiens
ggaggcatctctgtggctgtct

SEQ ID NO: 7046410 - DNA, 22 bp, Homo sapiens
ggaggcattatggggaagactt

SEQ ID NO: 7046411 - DNA, 22 bp, Homo sapiens
ggaggccaaggaggagcttgcc

SEQ ID NO: 7046412 - DNA, 20 bp, Homo sapiens
cacaggctatatgagagcca

SEQ ID NO: 7046413 - DNA, 22 bp, Homo sapiens
cacaggctgggaagcctaggcc

SEQ ID NO: 7046414 - DNA, 22 bp, Homo sapiens
cacaggcttccagtccccagct

SEQ ID NO: 7046415 - DNA, 22 bp, Homo sapiens
cacaggcttccagtccccagct

SEQ ID NO: 7046416 - DNA, 22 bp, Homo sapiens
cacaggcttgtcagcatgaggc

SEQ ID NO: 7046417 - DNA, 22 bp, Homo sapiens
cacaggcttgtcagcatgaggc

SEQ ID NO: 7046418 - DNA, 22 bp, Homo sapiens
cacaggcttgtcagcatgaggc

SEQ ID NO: 7046419 - DNA, 22 bp, Homo sapiens
cacaggcttgtcagcatgaggc

SEQ ID NO: 7046420 - DNA, 22 bp, Homo sapiens
cacaggcttttctgacataggc

SEQ ID NO: 7046421 - DNA, 22 bp, Homo sapiens
cacaggcttttctgacataggc

SEQ ID NO: 7046422 - DNA, 22 bp, Homo sapiens
ggagctggagagctagcctagg

SEQ ID NO: 7046423 - DNA, 22 bp, Homo sapiens
ggagctggagagtacagagttt

SEQ ID NO: 7046424 - DNA, 23 bp, Homo sapiens
ggagcctccggtgtgtgagaggc

SEQ ID NO: 7046425 - DNA, 22 bp, Homo sapiens
cacagaggtctgggcccagcag

SEQ ID NO: 7046426 - DNA, 22 bp, Homo sapiens
cacagaggtgatagtggtcaag

SEQ ID NO: 7046427 - DNA, 22 bp, Homo sapiens
cacagcaaagacactctcaact

SEQ ID NO: 7046428 - DNA, 22 bp, Homo sapiens
ggagccctgccctaggcagctc

SEQ ID NO: 7046429 - DNA, 22 bp, Homo sapiens
ggagccggagggccactggcag

SEQ ID NO: 7046430 - DNA, 20 bp, Homo sapiens
caagggtttgcattggcttt

SEQ ID NO: 7046431 - DNA, 22 bp, Homo sapiens
caagggaagaggacagggacct

SEQ ID NO: 7046432 - DNA, 22 bp, Homo sapiens
caagggtggtattgggagcata

SEQ ID NO: 7046433 - DNA, 22 bp, Homo sapiens
gctggctgtatcacctggccag

SEQ ID NO: 7046434 - DNA, 21 bp, Homo sapiens
gctggctgtcccagggaagca

SEQ ID NO: 7046435 - DNA, 22 bp, Homo sapiens
caaggccttcgtctcctagctt

SEQ ID NO: 7046436 - DNA, 22 bp, Homo sapiens
gctggctgggtccctgagaggc

SEQ ID NO: 7046437 - DNA, 22 bp, Homo sapiens
gctggctggtccagcaggggct

SEQ ID NO: 7046438 - DNA, 22 bp, Homo sapiens
caaggcctaatcatactgctaa

SEQ ID NO: 7046439 - DNA, 22 bp, Homo sapiens
gctggaggatggactggaagaa

SEQ ID NO: 7046440 - DNA, 22 bp, Homo sapiens
gctggaggatggactggaagaa

SEQ ID NO: 7046441 - DNA, 22 bp, Homo sapiens
gctggaggatggactggaagaa

SEQ ID NO: 7046442 - DNA, 22 bp, Homo sapiens
caagcatgtcttcttaagcaat

SEQ ID NO: 7046443 - DNA, 22 bp, Homo sapiens
caaatgtattctcacttcaggg

SEQ ID NO: 7046444 - DNA, 22 bp, Homo sapiens
caaatgtattctcacttcaggg

SEQ ID NO: 7046445 - DNA, 22 bp, Homo sapiens
caagcagccccaacatgaggat

SEQ ID NO: 7046446 - DNA, 22 bp, Homo sapiens
caagcagggatactgcagggag

SEQ ID NO: 7046447 - DNA, 22 bp, Homo sapiens
caaatgtaaattcttttgaagc

SEQ ID NO: 7046448 - DNA, 22 bp, Homo sapiens
caaatgtaataaggagtttccc

SEQ ID NO: 7046449 - DNA, 22 bp, Homo sapiens
caaatgtaatggcaggttttgc

SEQ ID NO: 7046450 - DNA, 22 bp, Homo sapiens
caaatgtaattgcggtttttgc

SEQ ID NO: 7046451 - DNA, 23 bp, Homo sapiens
caaatgtagtgtgtccacccctg

SEQ ID NO: 7046452 - DNA, 22 bp, Homo sapiens
caaatgtataaatgtactttct

SEQ ID NO: 7046453 - DNA, 22 bp, Homo sapiens
caaatgtatcagcccagggatt

SEQ ID NO: 7046454 - DNA, 22 bp, Homo sapiens
caaatgtatgttttcctatgta

SEQ ID NO: 7046455 - DNA, 22 bp, Homo sapiens
caagtcaatgattataagagtc

SEQ ID NO: 7046456 - DNA, 22 bp, Homo sapiens
caagtcaagcatgcccttattt

SEQ ID NO: 7046457 - DNA, 22 bp, Homo sapiens
caagtcaactcaaattgttatc

SEQ ID NO: 7046458 - DNA, 19 bp, Homo sapiens
gctgttaaggaccctcgga

SEQ ID NO: 7046459 - DNA, 22 bp, Homo sapiens
gctgttctctgtaacatgcatt

SEQ ID NO: 7046460 - DNA, 21 bp, Homo sapiens
gctgttgcccgccgcctcttc

SEQ ID NO: 7046461 - DNA, 22 bp, Homo sapiens
caagtatatttgaacatgtaaa

SEQ ID NO: 7046462 - DNA, 22 bp, Homo sapiens
caaggtgccatgctgggcgggg

SEQ ID NO: 7046463 - DNA, 22 bp, Homo sapiens
caaggtttacattgggctatca

SEQ ID NO: 7046464 - DNA, 22 bp, Homo sapiens
caaggtttactttatgatccag

SEQ ID NO: 7046465 - DNA, 22 bp, Homo sapiens
caaggtttcgagttcccaacca

SEQ ID NO: 7046466 - DNA, 22 bp, Homo sapiens
caaggtttctatgctcaaagga

SEQ ID NO: 7046467 - DNA, 22 bp, Homo sapiens
caaggtttgaaaacgccatggc

SEQ ID NO: 7046468 - DNA, 22 bp, Homo sapiens
caaggttttgcttgtaagggaa

SEQ ID NO: 7046469 - DNA, 22 bp, Homo sapiens
caaggttttggaagattttcgt

SEQ ID NO: 7046470 - DNA, 22 bp, Homo sapiens
gctttgaagacttttccagggt

SEQ ID NO: 7046471 - DNA, 22 bp, Homo sapiens
gctttgaagtctgtgtcttttg

SEQ ID NO: 7046472 - DNA, 22 bp, Homo sapiens
gctttgcacagtgctgtgttaa

SEQ ID NO: 7046473 - DNA, 21 bp, Homo sapiens
caataaactgcacattgagac

SEQ ID NO: 7046474 - DNA, 22 bp, Homo sapiens
caagtttgtgttctatcattct

SEQ ID NO: 7046475 - DNA, 22 bp, Homo sapiens
caagtttgctgatccttgtttt

SEQ ID NO: 7046476 - DNA, 22 bp, Homo sapiens
attcagaatggcaaacttctag

SEQ ID NO: 7046477 - DNA, 22 bp, Homo sapiens
gcagatggaaagtgcttgaggg

SEQ ID NO: 7046478 - DNA, 22 bp, Homo sapiens
gcagcagagaccccaggaagga

SEQ ID NO: 7046479 - DNA, 22 bp, Homo sapiens
gcagcagagctttgtcctggct

SEQ ID NO: 7046480 - DNA, 22 bp, Homo sapiens
attcacagtttcctcatattct

SEQ ID NO: 7046481 - DNA, 22 bp, Homo sapiens
gcacggctaatttttgtatttt

SEQ ID NO: 7046482 - DNA, 22 bp, Homo sapiens
gcactaaaccaacatgtaataa

SEQ ID NO: 7046483 - DNA, 22 bp, Homo sapiens
gcacctggtttatataatcata

SEQ ID NO: 7046484 - DNA, 22 bp, Homo sapiens
gcacggctaatttttgtatttt

SEQ ID NO: 7046485 - DNA, 22 bp, Homo sapiens
attcaaggtatttaaaacataa

SEQ ID NO: 7046486 - DNA, 22 bp, Homo sapiens
gcacctggggtacacagctaca

SEQ ID NO: 7046487 - DNA, 22 bp, Homo sapiens
attcactgtcagcttgcatggg

SEQ ID NO: 7046488 - DNA, 21 bp, Homo sapiens
attcagaaagggaataaactc

SEQ ID NO: 7046489 - DNA, 22 bp, Homo sapiens
gatttcctaatgtggatctctg

SEQ ID NO: 7046490 - DNA, 22 bp, Homo sapiens
gatttcctagacatggggcaga

SEQ ID NO: 7046491 - DNA, 22 bp, Homo sapiens
gatttcctcactaacatccatc

SEQ ID NO: 7046492 - DNA, 17 bp, Homo sapiens
gatttcctgaagttctt

SEQ ID NO: 7046493 - DNA, 22 bp, Homo sapiens
gatttccttgcatattggtaat

SEQ ID NO: 7046494 - DNA, 22 bp, Homo sapiens
gatttctagtaagtcatgaagg

SEQ ID NO: 7046495 - DNA, 22 bp, Homo sapiens
gatttctgggctttatttcaga

SEQ ID NO: 7046496 - DNA, 22 bp, Homo sapiens
attacagttctgcaggtagttt

SEQ ID NO: 7046497 - DNA, 22 bp, Homo sapiens
attactctgtctgcctctgacc

SEQ ID NO: 7046498 - DNA, 22 bp, Homo sapiens
gatatttaactctcacaggtcc

SEQ ID NO: 7046499 - DNA, 22 bp, Homo sapiens
attacaatcgagagaaacaaat

SEQ ID NO: 7046500 - DNA, 22 bp, Homo sapiens
attacagtgggtaaacagaatt

SEQ ID NO: 7046501 - DNA, 22 bp, Homo sapiens
attcaacatattctgagtaaaa

SEQ ID NO: 7046502 - DNA, 22 bp, Homo sapiens
attcaaattaagttaattcagc

SEQ ID NO: 7046503 - DNA, 22 bp, Homo sapiens
attatttctcactcacataata

SEQ ID NO: 7046504 - DNA, 22 bp, Homo sapiens
attcaaagtactagctattttt

SEQ ID NO: 7046505 - DNA, 22 bp, Homo sapiens
attatttccttgctttgaggaa

SEQ ID NO: 7046506 - DNA, 22 bp, Homo sapiens
attaggattttgtccaagtagc

SEQ ID NO: 7046507 - DNA, 22 bp, Homo sapiens
attagatacacagatttccact

SEQ ID NO: 7046508 - DNA, 22 bp, Homo sapiens
attagatatttgctgttggatt

SEQ ID NO: 7046509 - DNA, 22 bp, Homo sapiens
attaggatgtgtatattgtgtt

SEQ ID NO: 7046510 - DNA, 22 bp, Homo sapiens
attaggatgttcctatgcacat

SEQ ID NO: 7046511 - DNA, 22 bp, Homo sapiens
attaggatttggtatggtcata

SEQ ID NO: 7046512 - DNA, 20 bp, Homo sapiens
attaggattttaggtcatca

SEQ ID NO: 7046513 - DNA, 22 bp, Homo sapiens
gcagctggacccacacggctta

SEQ ID NO: 7046514 - DNA, 22 bp, Homo sapiens
gcagcgaggtgatgaaatagct

SEQ ID NO: 7046515 - DNA, 22 bp, Homo sapiens
gcagctgctggaagttcctgcc

SEQ ID NO: 7046516 - DNA, 22 bp, Homo sapiens
attctttcaaggaatagttatt

SEQ ID NO: 7046517 - DNA, 22 bp, Homo sapiens
attctttcaaggaatagttatt

SEQ ID NO: 7046518 - DNA, 22 bp, Homo sapiens
attctttcatataaaggctcag

SEQ ID NO: 7046519 - DNA, 22 bp, Homo sapiens
attctttagttggcttcttgcc

SEQ ID NO: 7046520 - DNA, 22 bp, Homo sapiens
attcttcttgagtcttggactc

SEQ ID NO: 7046521 - DNA, 22 bp, Homo sapiens
attgactagagtcacagttgca

SEQ ID NO: 7046522 - DNA, 23 bp, Homo sapiens
attgatgacttgattacactttt

SEQ ID NO: 7046523 - DNA, 22 bp, Homo sapiens
attgcaaagcattgtgagcgca

SEQ ID NO: 7046524 - DNA, 22 bp, Homo sapiens
attgcaaaattgtcctgtggaa

SEQ ID NO: 7046525 - DNA, 22 bp, Homo sapiens
gcagggctgatggcttccctca

SEQ ID NO: 7046526 - DNA, 22 bp, Homo sapiens
gcagggctgcagagggcactgt

SEQ ID NO: 7046527 - DNA, 22 bp, Homo sapiens
gcagggctgcagagggcactgt

SEQ ID NO: 7046528 - DNA, 22 bp, Homo sapiens
gcagggctgggacttactggta

SEQ ID NO: 7046529 - DNA, 22 bp, Homo sapiens
gccaaagcagtcttgcctctgc

SEQ ID NO: 7046530 - DNA, 22 bp, Homo sapiens
attgtgcaatgttttacaattt

SEQ ID NO: 7046531 - DNA, 22 bp, Homo sapiens
attgtgaattgagagtacttct

SEQ ID NO: 7046532 - DNA, 22 bp, Homo sapiens
attgtgaattgagagtacttct

SEQ ID NO: 7046533 - DNA, 22 bp, Homo sapiens
attgtctttaaaaatatacaac

SEQ ID NO: 7046534 - DNA, 22 bp, Homo sapiens
attgtctttccactgagaagtt

SEQ ID NO: 7046535 - DNA, 22 bp, Homo sapiens
attgtctttggtgcttccagga

SEQ ID NO: 7046536 - DNA, 20 bp, Homo sapiens
attgtgaatactgcatatgt

SEQ ID NO: 7046537 - DNA, 22 bp, Homo sapiens
attgtcttaaacaaatgtgttt

SEQ ID NO: 7046538 - DNA, 22 bp, Homo sapiens
attgtcttctggtcttatcttt

SEQ ID NO: 7046539 - DNA, 22 bp, Homo sapiens
attgtcttctgtcttatagttc

SEQ ID NO: 7046540 - DNA, 22 bp, Homo sapiens
gccaaagtacctagccctctgc

SEQ ID NO: 7046541 - DNA, 20 bp, Homo sapiens
gccaacgcgctggggctgcc

SEQ ID NO: 7046542 - DNA, 22 bp, Homo sapiens
gccaagagtttccagctgcaag

SEQ ID NO: 7046543 - DNA, 22 bp, Homo sapiens
gcatatgatcacgtgtgtcggt

SEQ ID NO: 7046544 - DNA, 22 bp, Homo sapiens
gcatattttcacaagctcttgg

SEQ ID NO: 7046545 - DNA, 22 bp, Homo sapiens
gcatattttcacaagctcttgg

SEQ ID NO: 7046546 - DNA, 17 bp, Homo sapiens
gcatcacagataacacg

SEQ ID NO: 7046547 - DNA, 22 bp, Homo sapiens
attgtagcaatttctcttaatt

SEQ ID NO: 7046548 - DNA, 22 bp, Homo sapiens
gcagggctgggatttgagccca

SEQ ID NO: 7046549 - DNA, 22 bp, Homo sapiens
gcagtgtgaccgagcttgcttc

SEQ ID NO: 7046550 - DNA, 22 bp, Homo sapiens
gcagtgtgtctcttggcttcct

SEQ ID NO: 7046551 - DNA, 22 bp, Homo sapiens
gcagtgtgtggtgagggctgcc

SEQ ID NO: 7046552 - DNA, 22 bp, Homo sapiens
gcagtgtgtggtgagggctgcc

SEQ ID NO: 7046553 - DNA, 22 bp, Homo sapiens
gcatacagagaggatgtggcat

SEQ ID NO: 7046554 - DNA, 22 bp, Homo sapiens
gcagtgtgtgtccccacactgg

SEQ ID NO: 7046555 - DNA, 22 bp, Homo sapiens
attttacttagtgtaatgtcca

SEQ ID NO: 7046556 - DNA, 22 bp, Homo sapiens
attttactactccaattaatga

SEQ ID NO: 7046557 - DNA, 22 bp, Homo sapiens
attttactactccaattaatga

SEQ ID NO: 7046558 - DNA, 22 bp, Homo sapiens
gcctgacctcttctgccctggg

SEQ ID NO: 7046559 - DNA, 22 bp, Homo sapiens
gcctgagaaggacacagcaggt

SEQ ID NO: 7046560 - DNA, 22 bp, Homo sapiens
gcctgagaaggataggaagcga

SEQ ID NO: 7046561 - DNA, 22 bp, Homo sapiens
gcctgagagttgaagttcagtg

SEQ ID NO: 7046562 - DNA, 22 bp, Homo sapiens
gcctatggattggagaaggagc

SEQ ID NO: 7046563 - DNA, 22 bp, Homo sapiens
gcctctgatggaggccagcgct

SEQ ID NO: 7046564 - DNA, 22 bp, Homo sapiens
gcctaggagacaagcgtgaaag

SEQ ID NO: 7046565 - DNA, 22 bp, Homo sapiens
gcctaggagtacagaatggttt

SEQ ID NO: 7046566 - DNA, 22 bp, Homo sapiens
gcctaggagtggggatggcggt

SEQ ID NO: 7046567 - DNA, 22 bp, Homo sapiens
gcctaggggtaagagtactggc

SEQ ID NO: 7046568 - DNA, 22 bp, Homo sapiens
gcccccagaagggccacagatt

SEQ ID NO: 7046569 - DNA, 22 bp, Homo sapiens
atttctgttgcttataaattac

SEQ ID NO: 7046570 - DNA, 22 bp, Homo sapiens
gccccaggttgcctgtcccagg

SEQ ID NO: 7046571 - DNA, 19 bp, Homo sapiens
gcccacggccctgctctgc

SEQ ID NO: 7046572 - DNA, 22 bp, Homo sapiens
atttccagtgcactgaatagaa

SEQ ID NO: 7046573 - DNA, 22 bp, Homo sapiens
gccaggtggctgagcagctgca

SEQ ID NO: 7046574 - DNA, 22 bp, Homo sapiens
atttcattgaagttaattcttc

SEQ ID NO: 7046575 - DNA, 22 bp, Homo sapiens
gccaggtggaggttgcagtgag

SEQ ID NO: 7046576 - DNA, 22 bp, Homo sapiens
gccaggtgagaggactgaggct

SEQ ID NO: 7046577 - DNA, 22 bp, Homo sapiens
gccaggtgagaggactgaggct

SEQ ID NO: 7046578 - DNA, 22 bp, Homo sapiens
gccacagggcgagcggaggcca

SEQ ID NO: 7046579 - DNA, 22 bp, Homo sapiens
gccacaggtcggctagagggtc

SEQ ID NO: 7046580 - DNA, 22 bp, Homo sapiens
gccaggctgctggctgctgtcc

SEQ ID NO: 7046581 - DNA, 22 bp, Homo sapiens
gccaggctggaaagaacagaca

SEQ ID NO: 7046582 - DNA, 22 bp, Homo sapiens
gccaggctggcaaaaggaaacc

SEQ ID NO: 7046583 - DNA, 22 bp, Homo sapiens
gccaggctggccagcaccttct

SEQ ID NO: 7046584 - DNA, 22 bp, Homo sapiens
gccaggctggccagcaccttct

SEQ ID NO: 7046585 - DNA, 22 bp, Homo sapiens
gccaggctggtcttgaactcct

SEQ ID NO: 7046586 - DNA, 22 bp, Homo sapiens
gccaggctggtcttgaactcct

SEQ ID NO: 7046587 - DNA, 22 bp, Homo sapiens
gccaggctggtgcaaggatatt

SEQ ID NO: 7046588 - DNA, 22 bp, Homo sapiens
gccaggctggtgcaaggatatt

SEQ ID NO: 7046589 - DNA, 22 bp, Homo sapiens
caaagccatagagtagataaga

SEQ ID NO: 7046590 - DNA, 21 bp, Homo sapiens
caaagccaggcaactctctcc

SEQ ID NO: 7046591 - DNA, 22 bp, Homo sapiens
caaagccaggctttctaatgta

SEQ ID NO: 7046592 - DNA, 22 bp, Homo sapiens
caaagcagtattggattcttta

SEQ ID NO: 7046593 - DNA, 22 bp, Homo sapiens
caaacattcaagtacaagtctt

SEQ ID NO: 7046594 - DNA, 22 bp, Homo sapiens
caaacattcaagtacaagtctt

SEQ ID NO: 7046595 - DNA, 22 bp, Homo sapiens
caaacattccgcttctcccagg

SEQ ID NO: 7046596 - DNA, 22 bp, Homo sapiens
caaagaggttttgagggcagct

SEQ ID NO: 7046597 - DNA, 22 bp, Homo sapiens
caaagagttttttcatataatg

SEQ ID NO: 7046598 - DNA, 22 bp, Homo sapiens
caaaattagggagtgagctgga

SEQ ID NO: 7046599 - DNA, 22 bp, Homo sapiens
caaaattagaaatgcagctgtt

SEQ ID NO: 7046600 - DNA, 22 bp, Homo sapiens
caaaatgttctggcacctttaa

SEQ ID NO: 7046601 - DNA, 22 bp, Homo sapiens
caaaataccacgacttgtttta

SEQ ID NO: 7046602 - DNA, 22 bp, Homo sapiens
caaaatgatgtgattttattgt

SEQ ID NO: 7046603 - DNA, 22 bp, Homo sapiens
caaaatgatgtgattttattgt

SEQ ID NO: 7046604 - DNA, 22 bp, Homo sapiens
caaaatgtgagtcccacctcaa

SEQ ID NO: 7046605 - DNA, 22 bp, Homo sapiens
atttttctctttccactgagat

SEQ ID NO: 7046606 - DNA, 22 bp, Homo sapiens
atttttgagctgtgaacatagc

SEQ ID NO: 7046607 - DNA, 22 bp, Homo sapiens
atttttctctcacacttaccag

SEQ ID NO: 7046608 - DNA, 22 bp, Homo sapiens
atttttctctccactccattaa

SEQ ID NO: 7046609 - DNA, 22 bp, Homo sapiens
atttttctctccactccattaa

SEQ ID NO: 7046610 - DNA, 22 bp, Homo sapiens
attttagagaaacaaacgtagg

SEQ ID NO: 7046611 - DNA, 22 bp, Homo sapiens
attttagagctccaagtacagc

SEQ ID NO: 7046612 - DNA, 22 bp, Homo sapiens
attttagagaaacaaacgtagg

SEQ ID NO: 7046613 - DNA, 22 bp, Homo sapiens
attttactttgtgaatattgac

SEQ ID NO: 7046614 - DNA, 22 bp, Homo sapiens
attttacttagtgtaatgtcca

SEQ ID NO: 7046615 - DNA, 22 bp, Homo sapiens
attttacttcatttgaaatgcc

SEQ ID NO: 7046616 - DNA, 22 bp, Homo sapiens
attttgctttatgtaaatatgt

SEQ ID NO: 7046617 - DNA, 22 bp, Homo sapiens
attttgtttcctttggagtaga

SEQ ID NO: 7046618 - DNA, 22 bp, Homo sapiens
atttttatgacaaaccatcctc

SEQ ID NO: 7046619 - DNA, 22 bp, Homo sapiens
atttttcagcttcattgaggca

SEQ ID NO: 7046620 - DNA, 22 bp, Homo sapiens
atttttccaattaggataaaga

SEQ ID NO: 7046621 - DNA, 22 bp, Homo sapiens
atttttccatgatacttatctg

SEQ ID NO: 7046622 - DNA, 22 bp, Homo sapiens
caaatactgagtttattttcaa

SEQ ID NO: 7046623 - DNA, 22 bp, Homo sapiens
caaatactgagtttattttcaa

SEQ ID NO: 7046624 - DNA, 22 bp, Homo sapiens
caaatactctggatgtgtttgt

SEQ ID NO: 7046625 - DNA, 22 bp, Homo sapiens
caaatactgagtttattttcaa

SEQ ID NO: 7046626 - DNA, 22 bp, Homo sapiens
caaatactgggtaagttaattt

SEQ ID NO: 7046627 - DNA, 18 bp, Homo sapiens
caaatactgttgtcttat

SEQ ID NO: 7046628 - DNA, 21 bp, Homo sapiens
caaatacttagaaacttaaga

SEQ ID NO: 7046629 - DNA, 22 bp, Homo sapiens
caaatactttatatacttcaaa

SEQ ID NO: 7046630 - DNA, 22 bp, Homo sapiens
caaatactttatatacttcaaa

SEQ ID NO: 7046631 - DNA, 22 bp, Homo sapiens
caaatagaactcacagacaaga

SEQ ID NO: 7046632 - DNA, 22 bp, Homo sapiens
caaatagaaggtactcagagaa

SEQ ID NO: 7046633 - DNA, 22 bp, Homo sapiens
caaatagacaagatggcaggaa

SEQ ID NO: 7046634 - DNA, 22 bp, Homo sapiens
caaagcctctgatttcacttgt

SEQ ID NO: 7046635 - DNA, 18 bp, Homo sapiens
caaagctcacgttccatc

SEQ ID NO: 7046636 - DNA, 22 bp, Homo sapiens
caaagctcatgctcttagccat

SEQ ID NO: 7046637 - DNA, 22 bp, Homo sapiens
caaagctgacgaggtcagcatc

SEQ ID NO: 7046638 - DNA, 22 bp, Homo sapiens
caaagctgatactcagcaagta

SEQ ID NO: 7046639 - DNA, 22 bp, Homo sapiens
caaagtgctggaattacaggtg

SEQ ID NO: 7046640 - DNA, 22 bp, Homo sapiens
caaatactaaacataagatttt

SEQ ID NO: 7046641 - DNA, 22 bp, Homo sapiens
caaatgatacctattactaggc

SEQ ID NO: 7046642 - DNA, 22 bp, Homo sapiens
caaatgatacctattactaggc

SEQ ID NO: 7046643 - DNA, 22 bp, Homo sapiens
caaatgcatagtttataagaag

SEQ ID NO: 7046644 - DNA, 22 bp, Homo sapiens
caaatgctaacttctttccaaa

SEQ ID NO: 7046645 - DNA, 22 bp, Homo sapiens
caaatagactctagaatttatt

SEQ ID NO: 7046646 - DNA, 22 bp, Homo sapiens
gctcttgtcaaaaattagttga

SEQ ID NO: 7046647 - DNA, 22 bp, Homo sapiens
gctcttgtcaaaaattagttga

SEQ ID NO: 7046648 - DNA, 22 bp, Homo sapiens
gctgacagagtgcctggcctca

SEQ ID NO: 7046649 - DNA, 22 bp, Homo sapiens
gctgacagttactgctgtaaca

SEQ ID NO: 7046650 - DNA, 22 bp, Homo sapiens
gctgacccctacaggttgtgtt

SEQ ID NO: 7046651 - DNA, 22 bp, Homo sapiens
gaggaaggctaaggggcttaga

SEQ ID NO: 7046652 - DNA, 22 bp, Homo sapiens
gaggagaaatttggggacctga

SEQ ID NO: 7046653 - DNA, 22 bp, Homo sapiens
gaggagaagctaagaaacacag

SEQ ID NO: 7046654 - DNA, 22 bp, Homo sapiens
gaggagaagctattggaaggac

SEQ ID NO: 7046655 - DNA, 22 bp, Homo sapiens
gaggagacagtggagccgctac

SEQ ID NO: 7046656 - DNA, 22 bp, Homo sapiens
atggtgaagcttcatgggtgtt

SEQ ID NO: 7046657 - DNA, 22 bp, Homo sapiens
atggtggacgggagacaggact

SEQ ID NO: 7046658 - DNA, 22 bp, Homo sapiens
atggtggactcttgattcaggc

SEQ ID NO: 7046659 - DNA, 22 bp, Homo sapiens
atggtggatttgtgattcagct

SEQ ID NO: 7046660 - DNA, 22 bp, Homo sapiens
gaggcacatatatacagagccc

SEQ ID NO: 7046661 - DNA, 22 bp, Homo sapiens
gaggcagcagggctggttcctt

SEQ ID NO: 7046662 - DNA, 22 bp, Homo sapiens
gaggcagcatctatggtgggaa

SEQ ID NO: 7046663 - DNA, 22 bp, Homo sapiens
gaggcagcattcgcatagacag

SEQ ID NO: 7046664 - DNA, 22 bp, Homo sapiens
gaggcagcattcgcatagacag

SEQ ID NO: 7046665 - DNA, 22 bp, Homo sapiens
gaggcagccagaggttctcatt

SEQ ID NO: 7046666 - DNA, 22 bp, Homo sapiens
gaggcagcctcagtggacctcg

SEQ ID NO: 7046667 - DNA, 22 bp, Homo sapiens
gaggcagcctcagtggacctcg

SEQ ID NO: 7046668 - DNA, 22 bp, Homo sapiens
atgggctgggaatacacagggg

SEQ ID NO: 7046669 - DNA, 22 bp, Homo sapiens
atgggctgggatctgagtgtca

SEQ ID NO: 7046670 - DNA, 22 bp, Homo sapiens
atgggctggggaagctcactcc

SEQ ID NO: 7046671 - DNA, 20 bp, Homo sapiens
atgggctggttaggaagtgt

SEQ ID NO: 7046672 - DNA, 22 bp, Homo sapiens
atgggctgtccattgctggctg

SEQ ID NO: 7046673 - DNA, 22 bp, Homo sapiens
atggggaagagccagtgagctg

SEQ ID NO: 7046674 - DNA, 22 bp, Homo sapiens
atggggagagaagggctgagct

SEQ ID NO: 7046675 - DNA, 22 bp, Homo sapiens
atgggctgaggtgggatagaag

SEQ ID NO: 7046676 - DNA, 22 bp, Homo sapiens
atgggctgacccagtcgtggca

SEQ ID NO: 7046677 - DNA, 22 bp, Homo sapiens
atgggctgaggaagctcctgag

SEQ ID NO: 7046678 - DNA, 22 bp, Homo sapiens
atgggcagtaacagtggcagtc

SEQ ID NO: 7046679 - DNA, 22 bp, Homo sapiens
atgggctgaaagagtaagctgt

SEQ ID NO: 7046680 - DNA, 22 bp, Homo sapiens
atgggctgacaagacatgcata

SEQ ID NO: 7046681 - DNA, 22 bp, Homo sapiens
atgggagaaacatcatgaggca

SEQ ID NO: 7046682 - DNA, 22 bp, Homo sapiens
atgggaaggttttgagagcggg

SEQ ID NO: 7046683 - DNA, 22 bp, Homo sapiens
atgggaagtgttagaagatttt

SEQ ID NO: 7046684 - DNA, 22 bp, Homo sapiens
atgggaagtgttagaagatttt

SEQ ID NO: 7046685 - DNA, 22 bp, Homo sapiens
atgggagaaacatcatgaggca

SEQ ID NO: 7046686 - DNA, 22 bp, Homo sapiens
atggctggcatccaggtgggct

SEQ ID NO: 7046687 - DNA, 22 bp, Homo sapiens
atggcttccaaggccctccgtg

SEQ ID NO: 7046688 - DNA, 22 bp, Homo sapiens
atggcttggcaccatctccttg

SEQ ID NO: 7046689 - DNA, 22 bp, Homo sapiens
atggcttgtctatgagtgctct

SEQ ID NO: 7046690 - DNA, 17 bp, Homo sapiens
gagatgggtggatcacc

SEQ ID NO: 7046691 - DNA, 17 bp, Homo sapiens
gagatgggtggatcacc

SEQ ID NO: 7046692 - DNA, 22 bp, Homo sapiens
atggcattcacatttccagaga

SEQ ID NO: 7046693 - DNA, 21 bp, Homo sapiens
atggagggaccagggaagcag

SEQ ID NO: 7046694 - DNA, 22 bp, Homo sapiens
atggagggaaaagtggagagcc

SEQ ID NO: 7046695 - DNA, 21 bp, Homo sapiens
atggagggaccagggaagcag

SEQ ID NO: 7046696 - DNA, 18 bp, Homo sapiens
atggaggcagagagctga

SEQ ID NO: 7046697 - DNA, 22 bp, Homo sapiens
atggaggatgtgcagcatgggc

SEQ ID NO: 7046698 - DNA, 17 bp, Homo sapiens
atggaggcagacaggtc

SEQ ID NO: 7046699 - DNA, 22 bp, Homo sapiens
gagagaggcctccatgtactga

SEQ ID NO: 7046700 - DNA, 22 bp, Homo sapiens
atgtgagctccggcaggtggaa

SEQ ID NO: 7046701 - DNA, 22 bp, Homo sapiens
atgtgaggaagaaagaggtaag

SEQ ID NO: 7046702 - DNA, 22 bp, Homo sapiens
atgtgagggaaatcagtcagaa

SEQ ID NO: 7046703 - DNA, 22 bp, Homo sapiens
atgtgagggctcaggctgactg

SEQ ID NO: 7046704 - DNA, 22 bp, Homo sapiens
gaggtaggtgtaggaggcctgc

SEQ ID NO: 7046705 - DNA, 20 bp, Homo sapiens
atgtgaagtaggaagggtgt

SEQ ID NO: 7046706 - DNA, 22 bp, Homo sapiens
atgtgaaactgaagcatccata

SEQ ID NO: 7046707 - DNA, 22 bp, Homo sapiens
gagggctgaagtgttttatgag

SEQ ID NO: 7046708 - DNA, 22 bp, Homo sapiens
gagggctctaccaagtaactct

SEQ ID NO: 7046709 - DNA, 22 bp, Homo sapiens
gagggctctactcaccaccctg

SEQ ID NO: 7046710 - DNA, 22 bp, Homo sapiens
gagggctgaagattgtggcccc

SEQ ID NO: 7046711 - DNA, 22 bp, Homo sapiens
gagggctcactgagaaagcagt

SEQ ID NO: 7046712 - DNA, 19 bp, Homo sapiens
gagggctcatttgaacaat

SEQ ID NO: 7046713 - DNA, 19 bp, Homo sapiens
gagggctcatttgaacaat

SEQ ID NO: 7046714 - DNA, 20 bp, Homo sapiens
gagggctcgtggatggataa

SEQ ID NO: 7046715 - DNA, 22 bp, Homo sapiens
atgtctgcaaatatctgccagt

SEQ ID NO: 7046716 - DNA, 22 bp, Homo sapiens
atgtctgcggcccaggccaggg

SEQ ID NO: 7046717 - DNA, 22 bp, Homo sapiens
atgtctgcgttatatcaatatc

SEQ ID NO: 7046718 - DNA, 22 bp, Homo sapiens
atgtctgctattcatagggaaa

SEQ ID NO: 7046719 - DNA, 22 bp, Homo sapiens
gagggcagagacagtgattcac

SEQ ID NO: 7046720 - DNA, 22 bp, Homo sapiens
gagggctcaactactactaggc

SEQ ID NO: 7046721 - DNA, 22 bp, Homo sapiens
gagggctcactgagaaagcagt

SEQ ID NO: 7046722 - DNA, 20 bp, Homo sapiens
atgtcctgcttctcctcacc

SEQ ID NO: 7046723 - DNA, 21 bp, Homo sapiens
atgtcctggctaccagcgcag

SEQ ID NO: 7046724 - DNA, 22 bp, Homo sapiens
atgtcctggtcctccaccatgg

SEQ ID NO: 7046725 - DNA, 20 bp, Homo sapiens
atgtcctgttgctgccccag

SEQ ID NO: 7046726 - DNA, 22 bp, Homo sapiens
atgtagctgcagatgataatgc

SEQ ID NO: 7046727 - DNA, 22 bp, Homo sapiens
atgtagaacaggttaatgacag

SEQ ID NO: 7046728 - DNA, 22 bp, Homo sapiens
atgtagaagctgacagtgctgt

SEQ ID NO: 7046729 - DNA, 22 bp, Homo sapiens
atgtagaagtgggcattataga

SEQ ID NO: 7046730 - DNA, 22 bp, Homo sapiens
atgtagaagtgggcattataga

SEQ ID NO: 7046731 - DNA, 22 bp, Homo sapiens
atgtagaattccttctactttg

SEQ ID NO: 7046732 - DNA, 22 bp, Homo sapiens
atgtagacctttctttgtgatt

SEQ ID NO: 7046733 - DNA, 22 bp, Homo sapiens
atgtagagcagtgttgtccaat

SEQ ID NO: 7046734 - DNA, 22 bp, Homo sapiens
gaggcagcggctcacagagaaa

SEQ ID NO: 7046735 - DNA, 22 bp, Homo sapiens
gatacaaaatataaatggagag

SEQ ID NO: 7046736 - DNA, 22 bp, Homo sapiens
gataattttagtctgaaaattg

SEQ ID NO: 7046737 - DNA, 22 bp, Homo sapiens
gataatgtgccgataatttcta

SEQ ID NO: 7046738 - DNA, 22 bp, Homo sapiens
gataattataggctaagccact

SEQ ID NO: 7046739 - DNA, 22 bp, Homo sapiens
gatacaaattcatgtctgaatt

SEQ ID NO: 7046740 - DNA, 22 bp, Homo sapiens
gatacaagactaataggaaaca

SEQ ID NO: 7046741 - DNA, 22 bp, Homo sapiens
gatatatttggaccagagcatt

SEQ ID NO: 7046742 - DNA, 22 bp, Homo sapiens
gatatattttccatggtctgca

SEQ ID NO: 7046743 - DNA, 22 bp, Homo sapiens
gatatgaagtggcattgtgaag

SEQ ID NO: 7046744 - DNA, 22 bp, Homo sapiens
atgttggagtcgtaaggcatgg

SEQ ID NO: 7046745 - DNA, 22 bp, Homo sapiens
atgtttaagaaagtcttccata

SEQ ID NO: 7046746 - DNA, 22 bp, Homo sapiens
atgtttaaggaactggtttgct

SEQ ID NO: 7046747 - DNA, 20 bp, Homo sapiens
gagttccccatttctcctgg

SEQ ID NO: 7046748 - DNA, 22 bp, Homo sapiens
gagttctattatggttagaagt

SEQ ID NO: 7046749 - DNA, 22 bp, Homo sapiens
gataatgatgacaatgacaacc

SEQ ID NO: 7046750 - DNA, 22 bp, Homo sapiens
atgttcttctatctttattaaa

SEQ ID NO: 7046751 - DNA, 22 bp, Homo sapiens
atgttctttcagccagtgcatc

SEQ ID NO: 7046752 - DNA, 22 bp, Homo sapiens
atgttctttgaaatattttaga

SEQ ID NO: 7046753 - DNA, 22 bp, Homo sapiens
atgttctttggaatttatgaaa

SEQ ID NO: 7046754 - DNA, 22 bp, Homo sapiens
atgttattttggaaaatacaaa

SEQ ID NO: 7046755 - DNA, 22 bp, Homo sapiens
atgttctgttttgtaattcata

SEQ ID NO: 7046756 - DNA, 22 bp, Homo sapiens
gaggtggcgcgccatccctgcc

SEQ ID NO: 7046757 - DNA, 22 bp, Homo sapiens
gaggtggcgcgccatccctgcc

SEQ ID NO: 7046758 - DNA, 22 bp, Homo sapiens
gaggtggcactgtgaggagcac

SEQ ID NO: 7046759 - DNA, 22 bp, Homo sapiens
gaggtggcactgtgaggagcac

SEQ ID NO: 7046760 - DNA, 22 bp, Homo sapiens
gaggtggcactgtgaggagcac

SEQ ID NO: 7046761 - DNA, 22 bp, Homo sapiens
gaggtggccaagcgaggaaggg

SEQ ID NO: 7046762 - DNA, 22 bp, Homo sapiens
gaggtggcccttgctcagcctt

SEQ ID NO: 7046763 - DNA, 22 bp, Homo sapiens
ctttcttaatttttaaggacac

SEQ ID NO: 7046764 - DNA, 22 bp, Homo sapiens
ctttcttatacctgtcagggcc

SEQ ID NO: 7046765 - DNA, 22 bp, Homo sapiens
atgaacatctctgatccaagca

SEQ ID NO: 7046766 - DNA, 22 bp, Homo sapiens
atgaagaaactgttctgggtgg

SEQ ID NO: 7046767 - DNA, 22 bp, Homo sapiens
atgaaattcatctgagaatgct

SEQ ID NO: 7046768 - DNA, 22 bp, Homo sapiens
atgaaacagtgaattagtcaag

SEQ ID NO: 7046769 - DNA, 22 bp, Homo sapiens
ctttcccttagccccattctat

SEQ ID NO: 7046770 - DNA, 22 bp, Homo sapiens
ctttccccagtatatcattgcc

SEQ ID NO: 7046771 - DNA, 22 bp, Homo sapiens
ctttcctagaaatatatactta

SEQ ID NO: 7046772 - DNA, 22 bp, Homo sapiens
ctttcctagatggccatctttc

SEQ ID NO: 7046773 - DNA, 22 bp, Homo sapiens
ctttcctagtagttacagaatg

SEQ ID NO: 7046774 - DNA, 22 bp, Homo sapiens
cttctttactttctagaaataa

SEQ ID NO: 7046775 - DNA, 22 bp, Homo sapiens
ctttctttcgaagacgtgatta

SEQ ID NO: 7046776 - DNA, 22 bp, Homo sapiens
gaaaatgttagcttcatagtca

SEQ ID NO: 7046777 - DNA, 22 bp, Homo sapiens
gaaacattcagtcaacagtgtt

SEQ ID NO: 7046778 - DNA, 22 bp, Homo sapiens
gaaacattgtgttctacagatt

SEQ ID NO: 7046779 - DNA, 22 bp, Homo sapiens
atgacaggaggcagctgggcag

SEQ ID NO: 7046780 - DNA, 22 bp, Homo sapiens
atgacagcattcaagacataga

SEQ ID NO: 7046781 - DNA, 22 bp, Homo sapiens
gaaacatttgttgagtacttgc

SEQ ID NO: 7046782 - DNA, 22 bp, Homo sapiens
atgacagttctacacttaatct

SEQ ID NO: 7046783 - DNA, 22 bp, Homo sapiens
atgacatgacctggtagagaca

SEQ ID NO: 7046784 - DNA, 22 bp, Homo sapiens
gaaagcagtatttagttctgtt

SEQ ID NO: 7046785 - DNA, 22 bp, Homo sapiens
gaaaggttgtaacaagactctt

SEQ ID NO: 7046786 - DNA, 22 bp, Homo sapiens
gaaaggtttaagtaggatttgt

SEQ ID NO: 7046787 - DNA, 22 bp, Homo sapiens
gaaaggtttcatctacttttca

SEQ ID NO: 7046788 - DNA, 22 bp, Homo sapiens
atgatatttgcaatgtgcttgc

SEQ ID NO: 7046789 - DNA, 19 bp, Homo sapiens
atgatacaggtgaaaattg

SEQ ID NO: 7046790 - DNA, 22 bp, Homo sapiens
gaaatagaggacagctggatca

SEQ ID NO: 7046791 - DNA, 22 bp, Homo sapiens
gaaatagatctctgggatgcaa

SEQ ID NO: 7046792 - DNA, 22 bp, Homo sapiens
atgatcatggaagtgcacccat

SEQ ID NO: 7046793 - DNA, 22 bp, Homo sapiens
atgatcatacagagccctggta

SEQ ID NO: 7046794 - DNA, 22 bp, Homo sapiens
atgatgaaaactgaaggttagg

SEQ ID NO: 7046795 - DNA, 22 bp, Homo sapiens
atgatgaaattttctatcatgt

SEQ ID NO: 7046796 - DNA, 22 bp, Homo sapiens
atgatggaggccgtgatggacg

SEQ ID NO: 7046797 - DNA, 22 bp, Homo sapiens
gaaaggtttggcttttcagtag

SEQ ID NO: 7046798 - DNA, 22 bp, Homo sapiens
gaaagtaacatttcttgaatta

SEQ ID NO: 7046799 - DNA, 22 bp, Homo sapiens
gaaagtattagcctagaagtca

SEQ ID NO: 7046800 - DNA, 22 bp, Homo sapiens
gaaatagaagctgccaatttct

SEQ ID NO: 7046801 - DNA, 22 bp, Homo sapiens
gaaatagacactttctatgaat

SEQ ID NO: 7046802 - DNA, 22 bp, Homo sapiens
gacaataaagtgatacatggga

SEQ ID NO: 7046803 - DNA, 22 bp, Homo sapiens
gaatatttttaaagggactaat

SEQ ID NO: 7046804 - DNA, 22 bp, Homo sapiens
gaatattttcagtacagatggt

SEQ ID NO: 7046805 - DNA, 22 bp, Homo sapiens
gaatattttcagtacagatggt

SEQ ID NO: 7046806 - DNA, 22 bp, Homo sapiens
gaatacaaacttaaggctttac

SEQ ID NO: 7046807 - DNA, 22 bp, Homo sapiens
gaataatattgactttgcaggc

SEQ ID NO: 7046808 - DNA, 22 bp, Homo sapiens
gaataatcatgaaattcagtga

SEQ ID NO: 7046809 - DNA, 22 bp, Homo sapiens
atgcacaggctgtgggctggtt

SEQ ID NO: 7046810 - DNA, 22 bp, Homo sapiens
atgcacaggtgctgatgcacgc

SEQ ID NO: 7046811 - DNA, 22 bp, Homo sapiens
gaagtcttttagcaaaacgaac

SEQ ID NO: 7046812 - DNA, 22 bp, Homo sapiens
gaataacattttttcctttaca

SEQ ID NO: 7046813 - DNA, 22 bp, Homo sapiens
gaataacattttttcctttaca

SEQ ID NO: 7046814 - DNA, 22 bp, Homo sapiens
gaataatagcagaaattagcag

SEQ ID NO: 7046815 - DNA, 22 bp, Homo sapiens
atgcacagaacaattttaagag

SEQ ID NO: 7046816 - DNA, 22 bp, Homo sapiens
atgcacagacccaaaggccatc

SEQ ID NO: 7046817 - DNA, 22 bp, Homo sapiens
atgcacagctgaacactctaaa

SEQ ID NO: 7046818 - DNA, 22 bp, Homo sapiens
gaaggctggggcatcagtgaaa

SEQ ID NO: 7046819 - DNA, 22 bp, Homo sapiens
gaaggctgtcagagaggagggc

SEQ ID NO: 7046820 - DNA, 22 bp, Homo sapiens
gaaggctgtcagagaggagggc

SEQ ID NO: 7046821 - DNA, 22 bp, Homo sapiens
gaaggctgtcagagaggagggc

SEQ ID NO: 7046822 - DNA, 22 bp, Homo sapiens
gaaggctgtttctggtagtgat

SEQ ID NO: 7046823 - DNA, 22 bp, Homo sapiens
gaaggctggaaggcaagtagga

SEQ ID NO: 7046824 - DNA, 22 bp, Homo sapiens
gaaggctggaaggcaagtagga

SEQ ID NO: 7046825 - DNA, 22 bp, Homo sapiens
gaaggctggctttctgagagca

SEQ ID NO: 7046826 - DNA, 22 bp, Homo sapiens
gaaggctggctttctgagagca

SEQ ID NO: 7046827 - DNA, 22 bp, Homo sapiens
gaaggctggctttctgagagca

SEQ ID NO: 7046828 - DNA, 19 bp, Homo sapiens
gactacagggggaagaagt

SEQ ID NO: 7046829 - DNA, 22 bp, Homo sapiens
gactacagatagccaattaagt

SEQ ID NO: 7046830 - DNA, 22 bp, Homo sapiens
gactacaggccggcatcagaga

SEQ ID NO: 7046831 - DNA, 22 bp, Homo sapiens
gacggagctggttgctgcggct

SEQ ID NO: 7046832 - DNA, 22 bp, Homo sapiens
gactggaatcccaggctctgtg

SEQ ID NO: 7046833 - DNA, 21 bp, Homo sapiens
gactggagagaggaagtctgg

SEQ ID NO: 7046834 - DNA, 22 bp, Homo sapiens
gactggagcccccaaggacacc

SEQ ID NO: 7046835 - DNA, 22 bp, Homo sapiens
gactgggagggttcagctgggt

SEQ ID NO: 7046836 - DNA, 22 bp, Homo sapiens
atgctatttaccacacatcatt

SEQ ID NO: 7046837 - DNA, 22 bp, Homo sapiens
atgctcagggcacactctggac

SEQ ID NO: 7046838 - DNA, 22 bp, Homo sapiens
atgctcagtagctggctgaccc

SEQ ID NO: 7046839 - DNA, 22 bp, Homo sapiens
atgctcattttattgagaatga

SEQ ID NO: 7046840 - DNA, 22 bp, Homo sapiens
gaccctggcagataccgtcaca

SEQ ID NO: 7046841 - DNA, 22 bp, Homo sapiens
gacaccagcaaggctgtgagga

SEQ ID NO: 7046842 - DNA, 18 bp, Homo sapiens
gacaccagcctctgcccc

SEQ ID NO: 7046843 - DNA, 22 bp, Homo sapiens
gacacatacagcagtaagtcta

SEQ ID NO: 7046844 - DNA, 22 bp, Homo sapiens
gacacattgatgtgagtacata

SEQ ID NO: 7046845 - DNA, 22 bp, Homo sapiens
gacaccagaagacataagcaga

SEQ ID NO: 7046846 - DNA, 22 bp, Homo sapiens
gaccacagaggtgtgggagaga

SEQ ID NO: 7046847 - DNA, 22 bp, Homo sapiens
gacatttattggattttacgag

SEQ ID NO: 7046848 - DNA, 22 bp, Homo sapiens
gacatttattagaaaactatca

SEQ ID NO: 7046849 - DNA, 22 bp, Homo sapiens
gacactctcctccagtggatag

SEQ ID NO: 7046850 - DNA, 22 bp, Homo sapiens
gacataaatgaagtttgactat

SEQ ID NO: 7046851 - DNA, 22 bp, Homo sapiens
atacaaatttatagatgcattt

SEQ ID NO: 7046852 - DNA, 22 bp, Homo sapiens
atacaactttacatgcaattcc

SEQ ID NO: 7046853 - DNA, 22 bp, Homo sapiens
ctgctgcaactctttagagggt

SEQ ID NO: 7046854 - DNA, 22 bp, Homo sapiens
atacaaagctaaatatggtttc

SEQ ID NO: 7046855 - DNA, 22 bp, Homo sapiens
ataatttactaagctctacctt

SEQ ID NO: 7046856 - DNA, 22 bp, Homo sapiens
ataagaggaattacagaagagg

SEQ ID NO: 7046857 - DNA, 22 bp, Homo sapiens
ataacttcagggctgtgacaga

SEQ ID NO: 7046858 - DNA, 22 bp, Homo sapiens
ataacttcagtttctgtgtcct

SEQ ID NO: 7046859 - DNA, 22 bp, Homo sapiens
ataacttaatgggtcatgctct

SEQ ID NO: 7046860 - DNA, 22 bp, Homo sapiens
ataagagctacagccagttctg

SEQ ID NO: 7046861 - DNA, 22 bp, Homo sapiens
ctgcatttcacatttaaacttt

SEQ ID NO: 7046862 - DNA, 22 bp, Homo sapiens
ctgcctctcagcctgaccgcca

SEQ ID NO: 7046863 - DNA, 22 bp, Homo sapiens
ctgcctctcagcctgaccgcca

SEQ ID NO: 7046864 - DNA, 22 bp, Homo sapiens
ctgcctctcaggtccctgagat

SEQ ID NO: 7046865 - DNA, 22 bp, Homo sapiens
ctgcctctcaggtccctgagat

SEQ ID NO: 7046866 - DNA, 22 bp, Homo sapiens
ctgcctctcaggtccctgagat

SEQ ID NO: 7046867 - DNA, 22 bp, Homo sapiens
ctgcctctccccagagtggccc

SEQ ID NO: 7046868 - DNA, 22 bp, Homo sapiens
ctgcctctccccagagtggccc

SEQ ID NO: 7046869 - DNA, 22 bp, Homo sapiens
ctgcctctgcgtcccacagagt

SEQ ID NO: 7046870 - DNA, 22 bp, Homo sapiens
ataaatgaacattcacagagct

SEQ ID NO: 7046871 - DNA, 22 bp, Homo sapiens
ataaatgaacattcacagagct

SEQ ID NO: 7046872 - DNA, 22 bp, Homo sapiens
ataaatgattcagcaggaaata

SEQ ID NO: 7046873 - DNA, 22 bp, Homo sapiens
ataaatgattcagcaggaaata

SEQ ID NO: 7046874 - DNA, 22 bp, Homo sapiens
ataaatgtgaaatgagcagtta

SEQ ID NO: 7046875 - DNA, 23 bp, Homo sapiens
ataaattactatctccctagagc

SEQ ID NO: 7046876 - DNA, 22 bp, Homo sapiens
ataaattaggatctggggttcc

SEQ ID NO: 7046877 - DNA, 22 bp, Homo sapiens
ataacagagttgggaagtgaaa

SEQ ID NO: 7046878 - DNA, 22 bp, Homo sapiens
ataacagatgcttcagcataaa

SEQ ID NO: 7046879 - DNA, 22 bp, Homo sapiens
ataacatggagtttgtcattta

SEQ ID NO: 7046880 - DNA, 19 bp, Homo sapiens
ataactacattggctcagt

SEQ ID NO: 7046881 - DNA, 22 bp, Homo sapiens
ataactctgtttttttcatgca

SEQ ID NO: 7046882 - DNA, 22 bp, Homo sapiens
ctgcaatagtttagaataattg

SEQ ID NO: 7046883 - DNA, 22 bp, Homo sapiens
ctgcaatatgatgtctgagaaa

SEQ ID NO: 7046884 - DNA, 22 bp, Homo sapiens
ctgcaaataggggtgtgaataa

SEQ ID NO: 7046885 - DNA, 22 bp, Homo sapiens
ctgcaaatcaagttcttataat

SEQ ID NO: 7046886 - DNA, 22 bp, Homo sapiens
agttattactctttaacatatt

SEQ ID NO: 7046887 - DNA, 22 bp, Homo sapiens
agttatcatcccttacactttg

SEQ ID NO: 7046888 - DNA, 22 bp, Homo sapiens
ctgaggagatccccccagaagt

SEQ ID NO: 7046889 - DNA, 22 bp, Homo sapiens
ctgaggagcagctggcccgcta

SEQ ID NO: 7046890 - DNA, 22 bp, Homo sapiens
ctgaggagctgaaggccctcca

SEQ ID NO: 7046891 - DNA, 22 bp, Homo sapiens
ctgaggagctgaaggccctcca

SEQ ID NO: 7046892 - DNA, 22 bp, Homo sapiens
ctgcatgagctgtcagtggagg

SEQ ID NO: 7046893 - DNA, 20 bp, Homo sapiens
ctgcagggttagaggctcca

SEQ ID NO: 7046894 - DNA, 22 bp, Homo sapiens
ctgcagagatgaagaaggtggc

SEQ ID NO: 7046895 - DNA, 22 bp, Homo sapiens
ctgcagagcaagtaacatcctc

SEQ ID NO: 7046896 - DNA, 22 bp, Homo sapiens
ctgcagagacctaggtcaggtt

SEQ ID NO: 7046897 - DNA, 22 bp, Homo sapiens
ctgcagagacctaggtcaggtt

SEQ ID NO: 7046898 - DNA, 22 bp, Homo sapiens
ctgcagagagtgccgggcagcc

SEQ ID NO: 7046899 - DNA, 22 bp, Homo sapiens
ctgcagagatgaagaaggtggc

SEQ ID NO: 7046900 - DNA, 22 bp, Homo sapiens
ctggagagaaatgacaaagcta

SEQ ID NO: 7046901 - DNA, 22 bp, Homo sapiens
ctggagagaatgtggaatgatt

SEQ ID NO: 7046902 - DNA, 22 bp, Homo sapiens
ctggaatgtctgctcaatgttt

SEQ ID NO: 7046903 - DNA, 22 bp, Homo sapiens
ctggaatgtctgctcaatgttt

SEQ ID NO: 7046904 - DNA, 17 bp, Homo sapiens
ctggagaagcctgtgga

SEQ ID NO: 7046905 - DNA, 22 bp, Homo sapiens
ctggagaagtactgagacattt

SEQ ID NO: 7046906 - DNA, 22 bp, Homo sapiens
ctggagagaccgaaagaggctg

SEQ ID NO: 7046907 - DNA, 22 bp, Homo sapiens
ctggagagaatgttcattgcag

SEQ ID NO: 7046908 - DNA, 22 bp, Homo sapiens
atacagtaatttgtaactcatc

SEQ ID NO: 7046909 - DNA, 22 bp, Homo sapiens
ctggaatgcctccctgtcagag

SEQ ID NO: 7046910 - DNA, 19 bp, Homo sapiens
ctggaatgagaacatgccc

SEQ ID NO: 7046911 - DNA, 22 bp, Homo sapiens
ctggaatgagcagggcttatgg

SEQ ID NO: 7046912 - DNA, 22 bp, Homo sapiens
ctggaatgggtttcaggcactg

SEQ ID NO: 7046913 - DNA, 22 bp, Homo sapiens
ctggaatgtatgtatcttaaga

SEQ ID NO: 7046914 - DNA, 22 bp, Homo sapiens
ctgctgccaagggtgccacagg

SEQ ID NO: 7046915 - DNA, 22 bp, Homo sapiens
ctggaagactcaatggcctgcc

SEQ ID NO: 7046916 - DNA, 22 bp, Homo sapiens
ctgctgccattagggcacagac

SEQ ID NO: 7046917 - DNA, 22 bp, Homo sapiens
ctggaagaggaagccagctgga

SEQ ID NO: 7046918 - DNA, 22 bp, Homo sapiens
ctggaagtggggttggcttgaa

SEQ ID NO: 7046919 - DNA, 22 bp, Homo sapiens
ctggaagtttccttcctggtca

SEQ ID NO: 7046920 - DNA, 22 bp, Homo sapiens
atacctgatcaaggcaaaaatg

SEQ ID NO: 7046921 - DNA, 22 bp, Homo sapiens
atacctgtgtatccacaagcgt

SEQ ID NO: 7046922 - DNA, 22 bp, Homo sapiens
ataccatggcagtttattcacg

SEQ ID NO: 7046923 - DNA, 22 bp, Homo sapiens
atacatatatggtacttcctgg

SEQ ID NO: 7046924 - DNA, 22 bp, Homo sapiens
atacatgttcgtgtacatgttc

SEQ ID NO: 7046925 - DNA, 22 bp, Homo sapiens
atacattcatcacttttggtcc

SEQ ID NO: 7046926 - DNA, 21 bp, Homo sapiens
atacattctattaagcattta

SEQ ID NO: 7046927 - DNA, 22 bp, Homo sapiens
atacatacatgtatgcacatac

SEQ ID NO: 7046928 - DNA, 22 bp, Homo sapiens
atacatagatagataatctggc

SEQ ID NO: 7046929 - DNA, 22 bp, Homo sapiens
atacatagcagggtagtagatc

SEQ ID NO: 7046930 - DNA, 22 bp, Homo sapiens
ctggccccagagtttcacttgg

SEQ ID NO: 7046931 - DNA, 22 bp, Homo sapiens
ctggccccaggcagcctgctgg

SEQ ID NO: 7046932 - DNA, 22 bp, Homo sapiens
ctggccccatctggagtctgag

SEQ ID NO: 7046933 - DNA, 22 bp, Homo sapiens
ctggccccatctggagtctgag

SEQ ID NO: 7046934 - DNA, 22 bp, Homo sapiens
ctggcccccacacctgtcaggg

SEQ ID NO: 7046935 - DNA, 22 bp, Homo sapiens
ctggccccggttcctaaaaacc

SEQ ID NO: 7046936 - DNA, 22 bp, Homo sapiens
ctggcccctgtggctaaaatca

SEQ ID NO: 7046937 - DNA, 22 bp, Homo sapiens
atagatgttttagtaatactgt

SEQ ID NO: 7046938 - DNA, 22 bp, Homo sapiens
atagattagccctatagtttta

SEQ ID NO: 7046939 - DNA, 22 bp, Homo sapiens
atagattatttgctcattactt

SEQ ID NO: 7046940 - DNA, 22 bp, Homo sapiens
atagatgttcaatcagatattt

SEQ ID NO: 7046941 - DNA, 22 bp, Homo sapiens
atactacatactatgtaaacat

SEQ ID NO: 7046942 - DNA, 22 bp, Homo sapiens
ctggctcccggggatcgagcac

SEQ ID NO: 7046943 - DNA, 22 bp, Homo sapiens
ctggctcccgtctggtggccat

SEQ ID NO: 7046944 - DNA, 22 bp, Homo sapiens
ctggctccatctttgcttcctg

SEQ ID NO: 7046945 - DNA, 22 bp, Homo sapiens
atagcaattaagctccagaatt

SEQ ID NO: 7046946 - DNA, 22 bp, Homo sapiens
ctggctggccatgtagagatga

SEQ ID NO: 7046947 - DNA, 22 bp, Homo sapiens
cttcttgcaattttcatcttat

SEQ ID NO: 7046948 - DNA, 22 bp, Homo sapiens
cttcttgctgggggcctcagtg

SEQ ID NO: 7046949 - DNA, 22 bp, Homo sapiens
cttcttaatgcataaactgtgt

SEQ ID NO: 7046950 - DNA, 22 bp, Homo sapiens
cttcttggtgatggcttacctg

SEQ ID NO: 7046951 - DNA, 22 bp, Homo sapiens
atctgacaaggccacatattct

SEQ ID NO: 7046952 - DNA, 22 bp, Homo sapiens
cttcctccgaagaagttgctgg

SEQ ID NO: 7046953 - DNA, 22 bp, Homo sapiens
cttcctctagcctagtaatgcc

SEQ ID NO: 7046954 - DNA, 22 bp, Homo sapiens
atctctgatttacagcatctct

SEQ ID NO: 7046955 - DNA, 22 bp, Homo sapiens
atctctgcgtccccagcatcga

SEQ ID NO: 7046956 - DNA, 23 bp, Homo sapiens
atctgaaaagcatttgcagtttg

SEQ ID NO: 7046957 - DNA, 22 bp, Homo sapiens
atctgaaaagctttaatgagct

SEQ ID NO: 7046958 - DNA, 22 bp, Homo sapiens
atctgaaaagctttaatgagct

SEQ ID NO: 7046959 - DNA, 22 bp, Homo sapiens
atctgaaactctgacattgtct

SEQ ID NO: 7046960 - DNA, 21 bp, Homo sapiens
atctgaaaggttagtgttgag

SEQ ID NO: 7046961 - DNA, 21 bp, Homo sapiens
atctgaaatgtcaaagcagat

SEQ ID NO: 7046962 - DNA, 22 bp, Homo sapiens
atctgaagggaagtggaaggca

SEQ ID NO: 7046963 - DNA, 19 bp, Homo sapiens
atctgaagtaggtgcagct

SEQ ID NO: 7046964 - DNA, 22 bp, Homo sapiens
cttagacatggcagctccaagt

SEQ ID NO: 7046965 - DNA, 22 bp, Homo sapiens
atcctgtgcaatgactgcatct

SEQ ID NO: 7046966 - DNA, 22 bp, Homo sapiens
atcctgtggggcggctgcaggg

SEQ ID NO: 7046967 - DNA, 22 bp, Homo sapiens
cttccagtagtatcattctcat

SEQ ID NO: 7046968 - DNA, 22 bp, Homo sapiens
cttccagtcttttcagtggagt

SEQ ID NO: 7046969 - DNA, 22 bp, Homo sapiens
cttcccaagactgtattgcaag

SEQ ID NO: 7046970 - DNA, 22 bp, Homo sapiens
cttcccacagaattcaatcagt

SEQ ID NO: 7046971 - DNA, 22 bp, Homo sapiens
cttcccagaacaatgtaggctt

SEQ ID NO: 7046972 - DNA, 22 bp, Homo sapiens
cttcctaaaagcttcaagagaa

SEQ ID NO: 7046973 - DNA, 22 bp, Homo sapiens
cttcctagcttcagagtctgtt

SEQ ID NO: 7046974 - DNA, 22 bp, Homo sapiens
cttcctagtgtctactttggag

SEQ ID NO: 7046975 - DNA, 22 bp, Homo sapiens
cttcctcacggtgcaacaggaa

SEQ ID NO: 7046976 - DNA, 22 bp, Homo sapiens
cttcctcaggcattagctggac

SEQ ID NO: 7046977 - DNA, 18 bp, Homo sapiens
cttcctcatcgctctccc

SEQ ID NO: 7046978 - DNA, 18 bp, Homo sapiens
cttcctcatcgctctccc

SEQ ID NO: 7046979 - DNA, 18 bp, Homo sapiens
cttcctcatcgctctccc

SEQ ID NO: 7046980 - DNA, 22 bp, Homo sapiens
cttcctcatgtgcaatgcaagc

SEQ ID NO: 7046981 - DNA, 22 bp, Homo sapiens
cttcctcccccacacactcact

SEQ ID NO: 7046982 - DNA, 22 bp, Homo sapiens
cttcctcccccacacactcact

SEQ ID NO: 7046983 - DNA, 22 bp, Homo sapiens
cttcctcccccacacactcact

SEQ ID NO: 7046984 - DNA, 22 bp, Homo sapiens
cttcctcccggcccatgctctg

SEQ ID NO: 7046985 - DNA, 22 bp, Homo sapiens
cttcctcccggcccatgctctg

SEQ ID NO: 7046986 - DNA, 22 bp, Homo sapiens
cttcctcccggcccatgctctg

SEQ ID NO: 7046987 - DNA, 22 bp, Homo sapiens
cttcctcccggcccatgctctg

SEQ ID NO: 7046988 - DNA, 22 bp, Homo sapiens
ctgtggagttccatcaggggag

SEQ ID NO: 7046989 - DNA, 22 bp, Homo sapiens
atcagacaattgttgagtactg

SEQ ID NO: 7046990 - DNA, 22 bp, Homo sapiens
atcagagaagtttcactggcat

SEQ ID NO: 7046991 - DNA, 22 bp, Homo sapiens
atcagagacaaaaccagcactt

SEQ ID NO: 7046992 - DNA, 22 bp, Homo sapiens
ctgtggagtgtagatgctgggt

SEQ ID NO: 7046993 - DNA, 22 bp, Homo sapiens
ctgtggctcaattgcctactga

SEQ ID NO: 7046994 - DNA, 22 bp, Homo sapiens
ctgtggctcaaaatcccatgat

SEQ ID NO: 7046995 - DNA, 21 bp, Homo sapiens
ctgtgggaccaagcactggga

SEQ ID NO: 7046996 - DNA, 22 bp, Homo sapiens
atcctgtctatgagtagataat

SEQ ID NO: 7046997 - DNA, 22 bp, Homo sapiens
atcctgtctctacccatcggct

SEQ ID NO: 7046998 - DNA, 22 bp, Homo sapiens
atcctgggcctcagaggtgtgt

SEQ ID NO: 7046999 - DNA, 22 bp, Homo sapiens
atcctgggctgcaccctcagcc

SEQ ID NO: 7047000 - DNA, 22 bp, Homo sapiens
atcctgggcagttttgagtgct

SEQ ID NO: 7047001 - DNA, 22 bp, Homo sapiens
ctgtgtgtcatttgtcaatcct

SEQ ID NO: 7047002 - DNA, 22 bp, Homo sapiens
ctgtgtgtcctcggacgagttt

SEQ ID NO: 7047003 - DNA, 22 bp, Homo sapiens
atccaggcctgagtctggtcct

SEQ ID NO: 7047004 - DNA, 22 bp, Homo sapiens
atccaggctgctttctatgccc

SEQ ID NO: 7047005 - DNA, 22 bp, Homo sapiens
atccagggataaaagtaaggtt

SEQ ID NO: 7047006 - DNA, 22 bp, Homo sapiens
atccagggataaaagtaaggtt

SEQ ID NO: 7047007 - DNA, 22 bp, Homo sapiens
atccagggtgtggagagagctc

SEQ ID NO: 7047008 - DNA, 22 bp, Homo sapiens
atccagtcaaaattagtaaggt

SEQ ID NO: 7047009 - DNA, 22 bp, Homo sapiens
atccagtgagtgcagctgttgt

SEQ ID NO: 7047010 - DNA, 22 bp, Homo sapiens
atcagaaaaacataatgttatt

SEQ ID NO: 7047011 - DNA, 22 bp, Homo sapiens
atcacattctttcaaagcagtc

SEQ ID NO: 7047012 - DNA, 22 bp, Homo sapiens
atcacattctttcaaagcagtc

SEQ ID NO: 7047013 - DNA, 22 bp, Homo sapiens
atcacattgccagtgattaccc

SEQ ID NO: 7047014 - DNA, 22 bp, Homo sapiens
atcaacatgaatttctctgaag

SEQ ID NO: 7047015 - DNA, 22 bp, Homo sapiens
atcaaatataataattttcgct

SEQ ID NO: 7047016 - DNA, 22 bp, Homo sapiens
atcaaagtttcccagaagttgt

SEQ ID NO: 7047017 - DNA, 22 bp, Homo sapiens
atcaaatacaaagggcataagg

SEQ ID NO: 7047018 - DNA, 21 bp, Homo sapiens
atcagaaaatgtaatggagca

SEQ ID NO: 7047019 - DNA, 22 bp, Homo sapiens
atcagaagaaatggatgtgact

SEQ ID NO: 7047020 - DNA, 22 bp, Homo sapiens
atattcttgtgattataaagta

SEQ ID NO: 7047021 - DNA, 22 bp, Homo sapiens
atattcttgaagggagattata

SEQ ID NO: 7047022 - DNA, 22 bp, Homo sapiens
atattcttgtgattataaagta

SEQ ID NO: 7047023 - DNA, 22 bp, Homo sapiens
atattcttgtgattataaagta

SEQ ID NO: 7047024 - DNA, 22 bp, Homo sapiens
atattcttgtgattataaagta

SEQ ID NO: 7047025 - DNA, 22 bp, Homo sapiens
atattgaaccctacagactgta

SEQ ID NO: 7047026 - DNA, 22 bp, Homo sapiens
atattgttgactataagagtaa

SEQ ID NO: 7047027 - DNA, 22 bp, Homo sapiens
atattgtactagggttacatgt

SEQ ID NO: 7047028 - DNA, 22 bp, Homo sapiens
atattgtactagggttacatgt

SEQ ID NO: 7047029 - DNA, 22 bp, Homo sapiens
atatttaactggtcccaatata

SEQ ID NO: 7047030 - DNA, 20 bp, Homo sapiens
atcaaaggctgattcagtcc

SEQ ID NO: 7047031 - DNA, 22 bp, Homo sapiens
atcaaagtccatcagaaggtag

SEQ ID NO: 7047032 - DNA, 22 bp, Homo sapiens
atcaaagttcgtaactgataac

SEQ ID NO: 7047033 - DNA, 22 bp, Homo sapiens
atattataagttatttcaagtt

SEQ ID NO: 7047034 - DNA, 22 bp, Homo sapiens
atattataagttatttcaagtt

SEQ ID NO: 7047035 - DNA, 22 bp, Homo sapiens
atattaaaactatggttttcag

SEQ ID NO: 7047036 - DNA, 22 bp, Homo sapiens
ctgggctcttcccagatccaga

SEQ ID NO: 7047037 - DNA, 22 bp, Homo sapiens
ctgggctctgtgtttcagtttc

SEQ ID NO: 7047038 - DNA, 22 bp, Homo sapiens
atattatagacagagtcttctg

SEQ ID NO: 7047039 - DNA, 22 bp, Homo sapiens
atattataagttatttcaagtt

SEQ ID NO: 7047040 - DNA, 22 bp, Homo sapiens
atattatgctaagggaaataag

SEQ ID NO: 7047041 - DNA, 22 bp, Homo sapiens
atattcttcttgttcagactat

SEQ ID NO: 7047042 - DNA, 22 bp, Homo sapiens
atattcttcttgttcagactat

SEQ ID NO: 7047043 - DNA, 22 bp, Homo sapiens
ctgggctgatttagtcacgttt

SEQ ID NO: 7047044 - DNA, 22 bp, Homo sapiens
atattcactgggtactaaaaag

SEQ ID NO: 7047045 - DNA, 20 bp, Homo sapiens
ctgggctcaagtgatcctcc

SEQ ID NO: 7047046 - DNA, 22 bp, Homo sapiens
atatgcagtctcttgcccttct

SEQ ID NO: 7047047 - DNA, 22 bp, Homo sapiens
atatgcatatgtcaaaacttat

SEQ ID NO: 7047048 - DNA, 20 bp, Homo sapiens
ctgggctcaagtgatcctcc

SEQ ID NO: 7047049 - DNA, 22 bp, Homo sapiens
ctggctggccggaggcatccct

SEQ ID NO: 7047050 - DNA, 22 bp, Homo sapiens
ctggctgtgtcttggaggagct

SEQ ID NO: 7047051 - DNA, 22 bp, Homo sapiens
ctggctgtttcaggcagtgtcc

SEQ ID NO: 7047052 - DNA, 22 bp, Homo sapiens
ctggcttccaccatggcccctg

SEQ ID NO: 7047053 - DNA, 22 bp, Homo sapiens
ctggcttcctcaggagcagtgg

SEQ ID NO: 7047054 - DNA, 22 bp, Homo sapiens
agtggcagatctctggtctgga

SEQ ID NO: 7047055 - DNA, 19 bp, Homo sapiens
agtggcagatctggaagta

SEQ ID NO: 7047056 - DNA, 19 bp, Homo sapiens
agtggcagatctggaagta

SEQ ID NO: 7047057 - DNA, 22 bp, Homo sapiens
ctctcagaagtttatgtcagaa

SEQ ID NO: 7047058 - DNA, 22 bp, Homo sapiens
ctctcagacacccatttggaaa

SEQ ID NO: 7047059 - DNA, 22 bp, Homo sapiens
ctctcagatggagtgtgaatgg

SEQ ID NO: 7047060 - DNA, 22 bp, Homo sapiens
ctctcagcaggaaagcatgcaa

SEQ ID NO: 7047061 - DNA, 22 bp, Homo sapiens
agtggcagagtgcactcaggca

SEQ ID NO: 7047062 - DNA, 22 bp, Homo sapiens
agtggcagaggttgactgcagt

SEQ ID NO: 7047063 - DNA, 22 bp, Homo sapiens
ctcctgggggacagcggcaggg

SEQ ID NO: 7047064 - DNA, 22 bp, Homo sapiens
ctcctgggggacagcggcaggg

SEQ ID NO: 7047065 - DNA, 22 bp, Homo sapiens
ctcctgggagcagggatggatg

SEQ ID NO: 7047066 - DNA, 22 bp, Homo sapiens
ctcctgggaaaggctggacaca

SEQ ID NO: 7047067 - DNA, 22 bp, Homo sapiens
ctcctgggaatttagttgtgag

SEQ ID NO: 7047068 - DNA, 22 bp, Homo sapiens
ctccctccctacgtgagctcac

SEQ ID NO: 7047069 - DNA, 22 bp, Homo sapiens
ctccctcctcaaatatctttgt

SEQ ID NO: 7047070 - DNA, 22 bp, Homo sapiens
ctccctctcaccggagccctgg

SEQ ID NO: 7047071 - DNA, 22 bp, Homo sapiens
ctccctcaggccttagccctgc

SEQ ID NO: 7047072 - DNA, 22 bp, Homo sapiens
ctccctcaggccttagccctgc

SEQ ID NO: 7047073 - DNA, 22 bp, Homo sapiens
ctccctctctaaggcaaagaga

SEQ ID NO: 7047074 - DNA, 22 bp, Homo sapiens
ctcctcacacccactgcaacca

SEQ ID NO: 7047075 - DNA, 22 bp, Homo sapiens
ctcctcacacccactgcaacca

SEQ ID NO: 7047076 - DNA, 22 bp, Homo sapiens
ctcctcagaagagggtaacaca

SEQ ID NO: 7047077 - DNA, 19 bp, Homo sapiens
ctcctggctctgtcatttt

SEQ ID NO: 7047078 - DNA, 22 bp, Homo sapiens
agtcctggacttggagtcaggg

SEQ ID NO: 7047079 - DNA, 22 bp, Homo sapiens
agtccctggattgtctctgtca

SEQ ID NO: 7047080 - DNA, 22 bp, Homo sapiens
agtccctgtactttccactgcc

SEQ ID NO: 7047081 - DNA, 22 bp, Homo sapiens
agtccctgtactttccactgcc

SEQ ID NO: 7047082 - DNA, 22 bp, Homo sapiens
agtccctttagtctggagagct

SEQ ID NO: 7047083 - DNA, 22 bp, Homo sapiens
agtccgcctgctgccgtggcag

SEQ ID NO: 7047084 - DNA, 22 bp, Homo sapiens
ctcattgcccagatccccacag

SEQ ID NO: 7047085 - DNA, 22 bp, Homo sapiens
ctcattctttcacagtctgtgg

SEQ ID NO: 7047086 - DNA, 22 bp, Homo sapiens
ctcattgcaacctccgcctccc

SEQ ID NO: 7047087 - DNA, 22 bp, Homo sapiens
ctcattaaaggaaatcacctgc

SEQ ID NO: 7047088 - DNA, 22 bp, Homo sapiens
agtcctgggtccagcaggtcct

SEQ ID NO: 7047089 - DNA, 22 bp, Homo sapiens
agtcctggccccaaggaaggat

SEQ ID NO: 7047090 - DNA, 18 bp, Homo sapiens
agtcctggctctaccacc

SEQ ID NO: 7047091 - DNA, 22 bp, Homo sapiens
agtcctgggtccagcaggtcct

SEQ ID NO: 7047092 - DNA, 22 bp, Homo sapiens
agtcttagataagtgaccaatg

SEQ ID NO: 7047093 - DNA, 22 bp, Homo sapiens
agtcttccctgtgccagagtgt

SEQ ID NO: 7047094 - DNA, 22 bp, Homo sapiens
agtcttctcatttcacatgctt

SEQ ID NO: 7047095 - DNA, 18 bp, Homo sapiens
ctccagagctgtgagaca

SEQ ID NO: 7047096 - DNA, 22 bp, Homo sapiens
ctccagctgctggtctgagact

SEQ ID NO: 7047097 - DNA, 22 bp, Homo sapiens
ctccagctttagctctccaggg

SEQ ID NO: 7047098 - DNA, 22 bp, Homo sapiens
ctccaggaaaatagggaatgag

SEQ ID NO: 7047099 - DNA, 22 bp, Homo sapiens
ctccaggaaagcctgaggcccg

SEQ ID NO: 7047100 - DNA, 22 bp, Homo sapiens
ctccaggacactaacccaggct

SEQ ID NO: 7047101 - DNA, 22 bp, Homo sapiens
ctgagaaaccaggtgctctgat

SEQ ID NO: 7047102 - DNA, 22 bp, Homo sapiens
agttagaaagtaaatcatttga

SEQ ID NO: 7047103 - DNA, 22 bp, Homo sapiens
agttagaagtgtgtcatctgtg

SEQ ID NO: 7047104 - DNA, 22 bp, Homo sapiens
agttagaatagtcagattgtag

SEQ ID NO: 7047105 - DNA, 22 bp, Homo sapiens
agttagaatagtcagattgtag

SEQ ID NO: 7047106 - DNA, 22 bp, Homo sapiens
agttagaatataattatgttaa

SEQ ID NO: 7047107 - DNA, 22 bp, Homo sapiens
agttataaaaggagcactgatt

SEQ ID NO: 7047108 - DNA, 22 bp, Homo sapiens
agttataatctgctactgatat

SEQ ID NO: 7047109 - DNA, 22 bp, Homo sapiens
agttataccttatacacatatg

SEQ ID NO: 7047110 - DNA, 22 bp, Homo sapiens
agttatataactatctagatgc

SEQ ID NO: 7047111 - DNA, 22 bp, Homo sapiens
ctgagcagcaacccagagcctc

SEQ ID NO: 7047112 - DNA, 22 bp, Homo sapiens
ctgagcagcacagggcgccagg

SEQ ID NO: 7047113 - DNA, 22 bp, Homo sapiens
ctgagcagccccaccagccatt

SEQ ID NO: 7047114 - DNA, 22 bp, Homo sapiens
ctgagctgggactcagtagcaa

SEQ ID NO: 7047115 - DNA, 22 bp, Homo sapiens
ctgaggagaggtggcctgtgtt

SEQ ID NO: 7047116 - DNA, 22 bp, Homo sapiens
ctgaattctgccttgaggcctt

SEQ ID NO: 7047117 - DNA, 22 bp, Homo sapiens
ctgaatgcctgcagagccagag

SEQ ID NO: 7047118 - DNA, 22 bp, Homo sapiens
ctgaatgtcgatcagcttgggt

SEQ ID NO: 7047119 - DNA, 22 bp, Homo sapiens
agtgtctgcctgggaggagcat

SEQ ID NO: 7047120 - DNA, 22 bp, Homo sapiens
agtgtctgcggcggggaggcgg

SEQ ID NO: 7047121 - DNA, 22 bp, Homo sapiens
agtgtctgcgggcagaggagcg

SEQ ID NO: 7047122 - DNA, 22 bp, Homo sapiens
agtgtctgctaggttcatcaac

SEQ ID NO: 7047123 - DNA, 22 bp, Homo sapiens
agtgtctgctaggttcatcaac

SEQ ID NO: 7047124 - DNA, 22 bp, Homo sapiens
agtgtctgctcagacagctaca

SEQ ID NO: 7047125 - DNA, 22 bp, Homo sapiens
agtgtctgcttatcagttcttg

SEQ ID NO: 7047126 - DNA, 22 bp, Homo sapiens
agtgtctgcttatcagttcttg

SEQ ID NO: 7047127 - DNA, 22 bp, Homo sapiens
agtgtctgctttgagtcaggtg

SEQ ID NO: 7047128 - DNA, 22 bp, Homo sapiens
agtgtctggaggcattcttggt

SEQ ID NO: 7047129 - DNA, 18 bp, Homo sapiens
agtgtctggatatttggg

SEQ ID NO: 7047130 - DNA, 20 bp, Homo sapiens
agtgtctggattttgtaacc

SEQ ID NO: 7047131 - DNA, 22 bp, Homo sapiens
ctgaaggaagcagaagcgaggt

SEQ ID NO: 7047132 - DNA, 22 bp, Homo sapiens
ctgaatgaggaaaagagtgagg

SEQ ID NO: 7047133 - DNA, 22 bp, Homo sapiens
ctctggggttaagcttccatgg

SEQ ID NO: 7047134 - DNA, 22 bp, Homo sapiens
ctctggggaaatggatatgtac

SEQ ID NO: 7047135 - DNA, 22 bp, Homo sapiens
ctctggggaagcagccagctgg

SEQ ID NO: 7047136 - DNA, 22 bp, Homo sapiens
ctgaaagggagaacaccaagag

SEQ ID NO: 7047137 - DNA, 22 bp, Homo sapiens
ctgaaagggttacatagtaagt

SEQ ID NO: 7047138 - DNA, 22 bp, Homo sapiens
ctgaaaggtataaataagactt

SEQ ID NO: 7047139 - DNA, 23 bp, Homo sapiens
ctgaaataccagaaaatcagtgt

SEQ ID NO: 7047140 - DNA, 22 bp, Homo sapiens
ctgaaatagtttcatagaactt

SEQ ID NO: 7047141 - DNA, 17 bp, Homo sapiens
ctgaaatattatgataa

SEQ ID NO: 7047142 - DNA, 22 bp, Homo sapiens
ctgaaatattttaatctcagga

SEQ ID NO: 7047143 - DNA, 22 bp, Homo sapiens
ctctgggcttacctgcttcctg

SEQ ID NO: 7047144 - DNA, 22 bp, Homo sapiens
ctctgggcttcaagtcagattt

SEQ ID NO: 7047145 - DNA, 22 bp, Homo sapiens
ctctgggacatcccttggccta

SEQ ID NO: 7047146 - DNA, 22 bp, Homo sapiens
ctctgggacatcccttggccta

SEQ ID NO: 7047147 - DNA, 22 bp, Homo sapiens
ctctgggaccacgtgactctgc

SEQ ID NO: 7047148 - DNA, 22 bp, Homo sapiens
ctctgggagaggacacttggag

SEQ ID NO: 7047149 - DNA, 22 bp, Homo sapiens
ctctggctttgctcatgcatcc

SEQ ID NO: 7047150 - DNA, 22 bp, Homo sapiens
ctctgggaaagattgtgcaggc

SEQ ID NO: 7047151 - DNA, 22 bp, Homo sapiens
ctctgggaattctgagcaagca

SEQ ID NO: 7047152 - DNA, 19 bp, Homo sapiens
ctctcagcctgtctccttg

SEQ ID NO: 7047153 - DNA, 22 bp, Homo sapiens
ctctgcaggcacccagggtggg

SEQ ID NO: 7047154 - DNA, 22 bp, Homo sapiens
ctctgcatgccttgctcagaca

SEQ ID NO: 7047155 - DNA, 22 bp, Homo sapiens
ctctgcattttaacagatgatt

SEQ ID NO: 7047156 - DNA, 22 bp, Homo sapiens
ctctgcctgccactgttcaggc

SEQ ID NO: 7047157 - DNA, 22 bp, Homo sapiens
ctctgcctgcccaccgacccat

SEQ ID NO: 7047158 - DNA, 22 bp, Homo sapiens
ctctgcctgcccaccgacccat

SEQ ID NO: 7047159 - DNA, 22 bp, Homo sapiens
ctctgcctgtctcatcctgcaa

SEQ ID NO: 7047160 - DNA, 22 bp, Homo sapiens
ctctgcctgtctcatcctgcaa

SEQ ID NO: 7047161 - DNA, 22 bp, Homo sapiens
ctctgcctgtctcatcctgcaa

SEQ ID NO: 7047162 - DNA, 22 bp, Homo sapiens
ctctgcctgtctcatcctgcaa

SEQ ID NO: 7047163 - DNA, 22 bp, Homo sapiens
ctctgcctgtgtcgccaccaca

SEQ ID NO: 7047164 - DNA, 22 bp, Homo sapiens
ctctgcctgtgtcgccaccaca

SEQ ID NO: 7047165 - DNA, 22 bp, Homo sapiens
ctctgcctgtgtcgccaccaca

SEQ ID NO: 7047166 - DNA, 22 bp, Homo sapiens
ctctgctcaccagccatgtgat

SEQ ID NO: 7047167 - DNA, 22 bp, Homo sapiens
ctacatttgttcaaataagctg

SEQ ID NO: 7047168 - DNA, 22 bp, Homo sapiens
ctagaaatattttacagtcaag

SEQ ID NO: 7047169 - DNA, 22 bp, Homo sapiens
ctagaagcaactagatctgttt

SEQ ID NO: 7047170 - DNA, 22 bp, Homo sapiens
ctagaatactcgtattattccc

SEQ ID NO: 7047171 - DNA, 22 bp, Homo sapiens
ctagaatatcatatgaagagac

SEQ ID NO: 7047172 - DNA, 22 bp, Homo sapiens
agtcccagctactcaagaggct

SEQ ID NO: 7047173 - DNA, 22 bp, Homo sapiens
agtacacagaattctacttgtt

SEQ ID NO: 7047174 - DNA, 22 bp, Homo sapiens
agtacacagtagactttctcat

SEQ ID NO: 7047175 - DNA, 22 bp, Homo sapiens
ctaagaggaagtactctgttat

SEQ ID NO: 7047176 - DNA, 22 bp, Homo sapiens
ctaagaggaagtactctgttat

SEQ ID NO: 7047177 - DNA, 20 bp, Homo sapiens
ctaagaggaggactaggttt

SEQ ID NO: 7047178 - DNA, 20 bp, Homo sapiens
ctaagaggtccttccacatc

SEQ ID NO: 7047179 - DNA, 20 bp, Homo sapiens
ctaagaggtccttccacatc

SEQ ID NO: 7047180 - DNA, 18 bp, Homo sapiens
ctaagaggtcgtttctca

SEQ ID NO: 7047181 - DNA, 21 bp, Homo sapiens
cgggctggccgggccctcacc

SEQ ID NO: 7047182 - DNA, 22 bp, Homo sapiens
cgggcgcactccgggcagctgt

SEQ ID NO: 7047183 - DNA, 22 bp, Homo sapiens
agtacaagtagaatgctacaag

SEQ ID NO: 7047184 - DNA, 17 bp, Homo sapiens
cgggcatggagggcagg

SEQ ID NO: 7047185 - DNA, 22 bp, Homo sapiens
cgggcagcggcgtggccatggt

SEQ ID NO: 7047186 - DNA, 22 bp, Homo sapiens
aggtttctggaaaggttttgct

SEQ ID NO: 7047187 - DNA, 22 bp, Homo sapiens
aggtttctggatttattatggc

SEQ ID NO: 7047188 - DNA, 21 bp, Homo sapiens
aggtttctgtgagcagagcag

SEQ ID NO: 7047189 - DNA, 22 bp, Homo sapiens
aggtttcttcttaggaatatgt

SEQ ID NO: 7047190 - DNA, 22 bp, Homo sapiens
aggtttctttatgctgctagaa

SEQ ID NO: 7047191 - DNA, 22 bp, Homo sapiens
cgcaggtgaaagaggctgggca

SEQ ID NO: 7047192 - DNA, 22 bp, Homo sapiens
cgcagggccgcgagcgggacca

SEQ ID NO: 7047193 - DNA, 22 bp, Homo sapiens
aggtttctgcaatgtgtgtaca

SEQ ID NO: 7047194 - DNA, 22 bp, Homo sapiens
aggtttctgctgtcctccttct

SEQ ID NO: 7047195 - DNA, 22 bp, Homo sapiens
cctgtgttctaatccatctcag

SEQ ID NO: 7047196 - DNA, 22 bp, Homo sapiens
cctgtgtttagatatgatgctg

SEQ ID NO: 7047197 - DNA, 17 bp, Homo sapiens
cctgtgtttgctccttc

SEQ ID NO: 7047198 - DNA, 17 bp, Homo sapiens
cctgttgttgcctttgc

SEQ ID NO: 7047199 - DNA, 19 bp, Homo sapiens
cgcaggagccgaggtgacc

SEQ ID NO: 7047200 - DNA, 22 bp, Homo sapiens
cgcaggcaatgctccgcggggg

SEQ ID NO: 7047201 - DNA, 22 bp, Homo sapiens
cctgggctcaggcttgggcagc

SEQ ID NO: 7047202 - DNA, 22 bp, Homo sapiens
cctggctctgcgtgcagctccg

SEQ ID NO: 7047203 - DNA, 22 bp, Homo sapiens
cctgggctttcaaaaccagcct

SEQ ID NO: 7047204 - DNA, 22 bp, Homo sapiens
cctgtcagttgctgtcagggat

SEQ ID NO: 7047205 - DNA, 22 bp, Homo sapiens
cctgtcagttgctgtcagggat

SEQ ID NO: 7047206 - DNA, 21 bp, Homo sapiens
aggtggggctgcacctctgct

SEQ ID NO: 7047207 - DNA, 22 bp, Homo sapiens
aggtggggccaaatgctacagt

SEQ ID NO: 7047208 - DNA, 22 bp, Homo sapiens
cctgtcccctcacaatgccact

SEQ ID NO: 7047209 - DNA, 22 bp, Homo sapiens
cctgtcctccaagagcacatct

SEQ ID NO: 7047210 - DNA, 22 bp, Homo sapiens
cctgtcctccaagagcacatct

SEQ ID NO: 7047211 - DNA, 22 bp, Homo sapiens
cctgtctccctggcatggctca

SEQ ID NO: 7047212 - DNA, 22 bp, Homo sapiens
cctgtctccctggcatggctca

SEQ ID NO: 7047213 - DNA, 20 bp, Homo sapiens
cctgtctcctcttacctggc

SEQ ID NO: 7047214 - DNA, 19 bp, Homo sapiens
cctgtgagaggacaggtgt

SEQ ID NO: 7047215 - DNA, 22 bp, Homo sapiens
cctgtgaggtcttgcatgtgaa

SEQ ID NO: 7047216 - DNA, 18 bp, Homo sapiens
cctgcagcccaggaggcc

SEQ ID NO: 7047217 - DNA, 23 bp, Homo sapiens
cctgcagctgccacgccctgctc

SEQ ID NO: 7047218 - DNA, 22 bp, Homo sapiens
cctgccagatcccctgagctga

SEQ ID NO: 7047219 - DNA, 22 bp, Homo sapiens
cctgccagcatggcttatctcc

SEQ ID NO: 7047220 - DNA, 22 bp, Homo sapiens
cctgccagcccgcgttcatgcc

SEQ ID NO: 7047221 - DNA, 22 bp, Homo sapiens
cctgccagcgcttatctctcgg

SEQ ID NO: 7047222 - DNA, 21 bp, Homo sapiens
cctgccaggaaactgagtgtc

SEQ ID NO: 7047223 - DNA, 21 bp, Homo sapiens
cctgccaggaaactgagtgtc

SEQ ID NO: 7047224 - DNA, 22 bp, Homo sapiens
aggtaggccctgagtgctgttg

SEQ ID NO: 7047225 - DNA, 22 bp, Homo sapiens
aggtagggaagaaggcatgaaa

SEQ ID NO: 7047226 - DNA, 22 bp, Homo sapiens
aggtagggaagaaggcatgaaa

SEQ ID NO: 7047227 - DNA, 23 bp, Homo sapiens
aggtaggttattgctgctacctg

SEQ ID NO: 7047228 - DNA, 22 bp, Homo sapiens
aggtagtgtagctgagtgggat

SEQ ID NO: 7047229 - DNA, 22 bp, Homo sapiens
cctggattcaagtctttctttc

SEQ ID NO: 7047230 - DNA, 22 bp, Homo sapiens
cctggcacaagagcagcattgg

SEQ ID NO: 7047231 - DNA, 22 bp, Homo sapiens
aggtcatgatccattggtgagt

SEQ ID NO: 7047232 - DNA, 22 bp, Homo sapiens
aggtccctgcagcagactgcca

SEQ ID NO: 7047233 - DNA, 22 bp, Homo sapiens
caggcagagttagagcaactgg

SEQ ID NO: 7047234 - DNA, 20 bp, Homo sapiens
caggcacactcattcctgct

SEQ ID NO: 7047235 - DNA, 22 bp, Homo sapiens
caggcacacatccgtgagagat

SEQ ID NO: 7047236 - DNA, 22 bp, Homo sapiens
caggcacacccactggtgcaga

SEQ ID NO: 7047237 - DNA, 22 bp, Homo sapiens
caggcacacaggctccctgggc

SEQ ID NO: 7047238 - DNA, 22 bp, Homo sapiens
caggatgggatgtagtgggccc

SEQ ID NO: 7047239 - DNA, 22 bp, Homo sapiens
caggatgggatgtagtgggccc

SEQ ID NO: 7047240 - DNA, 22 bp, Homo sapiens
caggatgggatgtagtgggccc

SEQ ID NO: 7047241 - DNA, 22 bp, Homo sapiens
caggatgggtgtcggccagcac

SEQ ID NO: 7047242 - DNA, 22 bp, Homo sapiens
caggcacaattatttccctttc

SEQ ID NO: 7047243 - DNA, 18 bp, Homo sapiens
caggagcaggagttgaac

SEQ ID NO: 7047244 - DNA, 22 bp, Homo sapiens
caggagtgaaatgaggcccagg

SEQ ID NO: 7047245 - DNA, 22 bp, Homo sapiens
caggatggagggagggctgtta

SEQ ID NO: 7047246 - DNA, 22 bp, Homo sapiens
caggatggagggagggctgtta

SEQ ID NO: 7047247 - DNA, 22 bp, Homo sapiens
caggatggagggagggctgtta

SEQ ID NO: 7047248 - DNA, 22 bp, Homo sapiens
caggatggccccggggctgtgc

SEQ ID NO: 7047249 - DNA, 22 bp, Homo sapiens
caggatggccccggggctgtgc

SEQ ID NO: 7047250 - DNA, 22 bp, Homo sapiens
caggatggccccggggctgtgc

SEQ ID NO: 7047251 - DNA, 20 bp, Homo sapiens
caggacagcgcaatcggagg

SEQ ID NO: 7047252 - DNA, 22 bp, Homo sapiens
caggagaaacataattttctgg

SEQ ID NO: 7047253 - DNA, 22 bp, Homo sapiens
caggagaaggtttggagtgcag

SEQ ID NO: 7047254 - DNA, 22 bp, Homo sapiens
cagctgtccaaacacattaact

SEQ ID NO: 7047255 - DNA, 22 bp, Homo sapiens
cagctgggtttagtggggtgtg

SEQ ID NO: 7047256 - DNA, 22 bp, Homo sapiens
cagctggtcaactgaatgaaca

SEQ ID NO: 7047257 - DNA, 22 bp, Homo sapiens
cagctggtgtccagggaagtgg

SEQ ID NO: 7047258 - DNA, 22 bp, Homo sapiens
cagctggtgtccagggaagtgg

SEQ ID NO: 7047259 - DNA, 22 bp, Homo sapiens
cagctggttggaagggagctga

SEQ ID NO: 7047260 - DNA, 22 bp, Homo sapiens
cagctggttggaagggagctga

SEQ ID NO: 7047261 - DNA, 23 bp, Homo sapiens
cagctggttgtgggagtggctgc

SEQ ID NO: 7047262 - DNA, 19 bp, Homo sapiens
agcttccatattctctagt

SEQ ID NO: 7047263 - DNA, 22 bp, Homo sapiens
agctgtctgtctcctgaggaga

SEQ ID NO: 7047264 - DNA, 22 bp, Homo sapiens
caggcccagtgatcagggctct

SEQ ID NO: 7047265 - DNA, 22 bp, Homo sapiens
agcttcctgtcttctgcacaaa

SEQ ID NO: 7047266 - DNA, 22 bp, Homo sapiens
agcttcctgttgagagagggag

SEQ ID NO: 7047267 - DNA, 22 bp, Homo sapiens
agcttccttgaattctgtagaa

SEQ ID NO: 7047268 - DNA, 22 bp, Homo sapiens
agcttccttggcgctgaggcct

SEQ ID NO: 7047269 - DNA, 22 bp, Homo sapiens
agcttcctgatgcaagagggct

SEQ ID NO: 7047270 - DNA, 21 bp, Homo sapiens
agcttcctgcagtgggaggtc

SEQ ID NO: 7047271 - DNA, 22 bp, Homo sapiens
agcttcctgtcttctgcacaaa

SEQ ID NO: 7047272 - DNA, 18 bp, Homo sapiens
agcttccctctgagaggg

SEQ ID NO: 7047273 - DNA, 22 bp, Homo sapiens
agcttcctacaaccatctcaga

SEQ ID NO: 7047274 - DNA, 22 bp, Homo sapiens
agcttcctacaaccatctcaga

SEQ ID NO: 7047275 - DNA, 23 bp, Homo sapiens
agcttcctagtgacctggagtct

SEQ ID NO: 7047276 - DNA, 22 bp, Homo sapiens
agcttcctcacctcagaggtct

SEQ ID NO: 7047277 - DNA, 22 bp, Homo sapiens
agcttcctgactggtgctctta

SEQ ID NO: 7047278 - DNA, 23 bp, Homo sapiens
agcttcgccttcctttctctgca

SEQ ID NO: 7047279 - DNA, 22 bp, Homo sapiens
agcttctcaggagtctgaggca

SEQ ID NO: 7047280 - DNA, 22 bp, Homo sapiens
caggctctgctgctacagctgt

SEQ ID NO: 7047281 - DNA, 21 bp, Homo sapiens
caggctctgctgggtgctggg

SEQ ID NO: 7047282 - DNA, 22 bp, Homo sapiens
caggcagcctgcggtctgcaca

SEQ ID NO: 7047283 - DNA, 22 bp, Homo sapiens
caggcagcgctcgtggcctggc

SEQ ID NO: 7047284 - DNA, 22 bp, Homo sapiens
caggcagcgctcgtggcctggc

SEQ ID NO: 7047285 - DNA, 22 bp, Homo sapiens
caggcagcgtcctgcttcctgt

SEQ ID NO: 7047286 - DNA, 22 bp, Homo sapiens
caggcagctagatttataacaa

SEQ ID NO: 7047287 - DNA, 22 bp, Homo sapiens
caggcagctcaaccttgggagc

SEQ ID NO: 7047288 - DNA, 22 bp, Homo sapiens
caggcagctcaaccttgggagc

SEQ ID NO: 7047289 - DNA, 22 bp, Homo sapiens
caggcagggagctggaaaggat

SEQ ID NO: 7047290 - DNA, 22 bp, Homo sapiens
caggcaggtgcagattcctctt

SEQ ID NO: 7047291 - DNA, 22 bp, Homo sapiens
caggcaggtgcagattcctctt

SEQ ID NO: 7047292 - DNA, 22 bp, Homo sapiens
caggcagtgtcccaggaagcca

SEQ ID NO: 7047293 - DNA, 22 bp, Homo sapiens
caggcagtgtgacgctagggtt

SEQ ID NO: 7047294 - DNA, 22 bp, Homo sapiens
agctggtggaagggagcccaaa

SEQ ID NO: 7047295 - DNA, 22 bp, Homo sapiens
agctggtggagaagcagacctc

SEQ ID NO: 7047296 - DNA, 22 bp, Homo sapiens
agctgtcaccaggagccggacc

SEQ ID NO: 7047297 - DNA, 22 bp, Homo sapiens
agctgtcctggctcaggctgtg

SEQ ID NO: 7047298 - DNA, 22 bp, Homo sapiens
cagtatttggtaattggctacc

SEQ ID NO: 7047299 - DNA, 22 bp, Homo sapiens
cagtatttgttccctatcaatg

SEQ ID NO: 7047300 - DNA, 22 bp, Homo sapiens
cagtatcttgcttatagacaca

SEQ ID NO: 7047301 - DNA, 22 bp, Homo sapiens
cagtatgattgccagttctatc

SEQ ID NO: 7047302 - DNA, 20 bp, Homo sapiens
cagtatctgaagccacacaa

SEQ ID NO: 7047303 - DNA, 22 bp, Homo sapiens
cagtaaatgagaagctagtaat

SEQ ID NO: 7047304 - DNA, 22 bp, Homo sapiens
aggacagagggaccagagccca

SEQ ID NO: 7047305 - DNA, 22 bp, Homo sapiens
caggtggttatgaggaaggtga

SEQ ID NO: 7047306 - DNA, 22 bp, Homo sapiens
cagggcttgatctgcatcctgc

SEQ ID NO: 7047307 - DNA, 22 bp, Homo sapiens
cagggcttcgctcctggtgcac

SEQ ID NO: 7047308 - DNA, 22 bp, Homo sapiens
cagggcttcgctcctggtgcac

SEQ ID NO: 7047309 - DNA, 22 bp, Homo sapiens
cagggcttcgtgtctcagtgct

SEQ ID NO: 7047310 - DNA, 22 bp, Homo sapiens
caggtggttgagagctgtaggc

SEQ ID NO: 7047311 - DNA, 22 bp, Homo sapiens
caggtggttgtttggattctaa

SEQ ID NO: 7047312 - DNA, 22 bp, Homo sapiens
caggtgtcaaaatactaagtgg

SEQ ID NO: 7047313 - DNA, 22 bp, Homo sapiens
caggtgtctaattctcaccccc

SEQ ID NO: 7047314 - DNA, 22 bp, Homo sapiens
aggaagtgctaagagaacatca

SEQ ID NO: 7047315 - DNA, 21 bp, Homo sapiens
aggaagtggccagattgggaa

SEQ ID NO: 7047316 - DNA, 23 bp, Homo sapiens
aggaagttaaggcagacagacag

SEQ ID NO: 7047317 - DNA, 22 bp, Homo sapiens
aggaatgaactcgagtgatctg

SEQ ID NO: 7047318 - DNA, 22 bp, Homo sapiens
aggaaaggcctttgcatttggt

SEQ ID NO: 7047319 - DNA, 21 bp, Homo sapiens
aggaaaggccagcacgtaggg

SEQ ID NO: 7047320 - DNA, 22 bp, Homo sapiens
aggaaaggcctcagcagaaacc

SEQ ID NO: 7047321 - DNA, 22 bp, Homo sapiens
cagggctggcttccaagttgtt

SEQ ID NO: 7047322 - DNA, 23 bp, Homo sapiens
cagggctgggcttggtgttaggc

SEQ ID NO: 7047323 - DNA, 22 bp, Homo sapiens
cagggctgggttaaaagcaggg

SEQ ID NO: 7047324 - DNA, 22 bp, Homo sapiens
cagggctgggttaaaagcaggg

SEQ ID NO: 7047325 - DNA, 19 bp, Homo sapiens
aggaaaggatcaaaatagc

SEQ ID NO: 7047326 - DNA, 22 bp, Homo sapiens
aggaaaggattggcttctctgt

SEQ ID NO: 7047327 - DNA, 22 bp, Homo sapiens
aggaaaggattggcttctctgt

SEQ ID NO: 7047328 - DNA, 22 bp, Homo sapiens
cagggctgttagctgctgctct

SEQ ID NO: 7047329 - DNA, 22 bp, Homo sapiens
aggaagagcccgggtgacataa

SEQ ID NO: 7047330 - DNA, 22 bp, Homo sapiens
aggaagagcccgggtgacataa

SEQ ID NO: 7047331 - DNA, 22 bp, Homo sapiens
aggaagagcccgggtgacataa

SEQ ID NO: 7047332 - DNA, 22 bp, Homo sapiens
aggaagagcccgggtgacataa

SEQ ID NO: 7047333 - DNA, 22 bp, Homo sapiens
aggaagagctggaccagaggac

SEQ ID NO: 7047334 - DNA, 22 bp, Homo sapiens
aggaagagctggaccagaggac

SEQ ID NO: 7047335 - DNA, 22 bp, Homo sapiens
aggaagagctggaccagaggac

SEQ ID NO: 7047336 - DNA, 22 bp, Homo sapiens
caggctgaagtgcagtggtgtg

SEQ ID NO: 7047337 - DNA, 22 bp, Homo sapiens
caggctgacaactgagcatttt

SEQ ID NO: 7047338 - DNA, 22 bp, Homo sapiens
cagggatgtgatgagctgagcc

SEQ ID NO: 7047339 - DNA, 22 bp, Homo sapiens
cagggattcagctgaaggaggc

SEQ ID NO: 7047340 - DNA, 22 bp, Homo sapiens
cagggcaggatgctgtgattat

SEQ ID NO: 7047341 - DNA, 22 bp, Homo sapiens
cagggcagggagcttagaatga

SEQ ID NO: 7047342 - DNA, 22 bp, Homo sapiens
cagggcagtaacgggaacatct

SEQ ID NO: 7047343 - DNA, 22 bp, Homo sapiens
cagggcagtaccgccctctggc

SEQ ID NO: 7047344 - DNA, 22 bp, Homo sapiens
agctttgggattcaggcaggaa

SEQ ID NO: 7047345 - DNA, 22 bp, Homo sapiens
agctttgggcagaagaggattc

SEQ ID NO: 7047346 - DNA, 22 bp, Homo sapiens
agctttgggccactggctggat

SEQ ID NO: 7047347 - DNA, 22 bp, Homo sapiens
cagggctggctcatgaaaagtt

SEQ ID NO: 7047348 - DNA, 22 bp, Homo sapiens
cagggctggctcatgaaaagtt

SEQ ID NO: 7047349 - DNA, 22 bp, Homo sapiens
cagggctggctgtggcaatctc

SEQ ID NO: 7047350 - DNA, 22 bp, Homo sapiens
cagggctggctgtggcaatctc

SEQ ID NO: 7047351 - DNA, 22 bp, Homo sapiens
cagggctggctgtggcaatctc

SEQ ID NO: 7047352 - DNA, 22 bp, Homo sapiens
ccacccagccagatgcaggaag

SEQ ID NO: 7047353 - DNA, 22 bp, Homo sapiens
ccacccagaccagggatctggg

SEQ ID NO: 7047354 - DNA, 22 bp, Homo sapiens
ccacccagccagatgcaggaag

SEQ ID NO: 7047355 - DNA, 23 bp, Homo sapiens
ccacgtctgcactgtagctgttg

SEQ ID NO: 7047356 - DNA, 22 bp, Homo sapiens
ccaccatgggaagagagactaa

SEQ ID NO: 7047357 - DNA, 22 bp, Homo sapiens
ccacccacaaccagctggctgt

SEQ ID NO: 7047358 - DNA, 22 bp, Homo sapiens
ccacatctcggtcccctctttg

SEQ ID NO: 7047359 - DNA, 22 bp, Homo sapiens
ccaccaggcactcacagggaag

SEQ ID NO: 7047360 - DNA, 21 bp, Homo sapiens
ccaccaggtcttctgctcggg

SEQ ID NO: 7047361 - DNA, 20 bp, Homo sapiens
ccacagtggagactggagac

SEQ ID NO: 7047362 - DNA, 22 bp, Homo sapiens
ccacagtgggcacagcaggact

SEQ ID NO: 7047363 - DNA, 22 bp, Homo sapiens
ccacagtggttgtggcatgtgg

SEQ ID NO: 7047364 - DNA, 18 bp, Homo sapiens
aggcaggatcctggcctc

SEQ ID NO: 7047365 - DNA, 18 bp, Homo sapiens
aggcaggatcctggcctc

SEQ ID NO: 7047366 - DNA, 23 bp, Homo sapiens
ccacaggcacagaggcttgcatc

SEQ ID NO: 7047367 - DNA, 22 bp, Homo sapiens
aggcaggaggatcatggatgca

SEQ ID NO: 7047368 - DNA, 22 bp, Homo sapiens
aggcaggagtgaccctgacagg

SEQ ID NO: 7047369 - DNA, 22 bp, Homo sapiens
aggcaggaggatcatggatgca

SEQ ID NO: 7047370 - DNA, 22 bp, Homo sapiens
aggcaggaaccctgtgtgcgcc

SEQ ID NO: 7047371 - DNA, 19 bp, Homo sapiens
ccacagagcatgctgaggc

SEQ ID NO: 7047372 - DNA, 22 bp, Homo sapiens
ccacagagcattagatttcaga

SEQ ID NO: 7047373 - DNA, 22 bp, Homo sapiens
catttctgtgacacttccatct

SEQ ID NO: 7047374 - DNA, 22 bp, Homo sapiens
catttctgttctcttcctgtac

SEQ ID NO: 7047375 - DNA, 22 bp, Homo sapiens
catttctgtcacgttcttttat

SEQ ID NO: 7047376 - DNA, 22 bp, Homo sapiens
ccacagagactctgcaggactg

SEQ ID NO: 7047377 - DNA, 22 bp, Homo sapiens
ccacagagagtgtcagcctttg

SEQ ID NO: 7047378 - DNA, 22 bp, Homo sapiens
catttcacaaatggccacatca

SEQ ID NO: 7047379 - DNA, 22 bp, Homo sapiens
catttattggttaggccagcag

SEQ ID NO: 7047380 - DNA, 22 bp, Homo sapiens
cattggtcttctaacagagaga

SEQ ID NO: 7047381 - DNA, 22 bp, Homo sapiens
cattgtaagctgttgaatcctc

SEQ ID NO: 7047382 - DNA, 22 bp, Homo sapiens
aggcactgttcccagttatcct

SEQ ID NO: 7047383 - DNA, 20 bp, Homo sapiens
aggcactgttgtctgtatcc

SEQ ID NO: 7047384 - DNA, 21 bp, Homo sapiens
aggcactgtttgtggtttggg

SEQ ID NO: 7047385 - DNA, 22 bp, Homo sapiens
cattgctgttaattgtctctag

SEQ ID NO: 7047386 - DNA, 22 bp, Homo sapiens
cattgcttcctatgtcccttct

SEQ ID NO: 7047387 - DNA, 22 bp, Homo sapiens
cattgctttgtgcatatttaaa

SEQ ID NO: 7047388 - DNA, 22 bp, Homo sapiens
cattggaaaatgcatgcttttt

SEQ ID NO: 7047389 - DNA, 17 bp, Homo sapiens
aggcaatgactgtggtt

SEQ ID NO: 7047390 - DNA, 22 bp, Homo sapiens
aggcaagcagtcagtctatgag

SEQ ID NO: 7047391 - DNA, 22 bp, Homo sapiens
aggcaagcattgggaacagggc

SEQ ID NO: 7047392 - DNA, 22 bp, Homo sapiens
aggcaagcccccagtgaggctc

SEQ ID NO: 7047393 - DNA, 22 bp, Homo sapiens
aggcaagggggcgccaccttcc

SEQ ID NO: 7047394 - DNA, 20 bp, Homo sapiens
aggcaaggtagatgtctgct

SEQ ID NO: 7047395 - DNA, 22 bp, Homo sapiens
aggcaaggtgctacagacagtg

SEQ ID NO: 7047396 - DNA, 22 bp, Homo sapiens
catgagataatttttctccagt

SEQ ID NO: 7047397 - DNA, 22 bp, Homo sapiens
catgagatctgcagggatgggc

SEQ ID NO: 7047398 - DNA, 22 bp, Homo sapiens
catgagcataaatcagtcacga

SEQ ID NO: 7047399 - DNA, 22 bp, Homo sapiens
catgaggatccaggtgacaggc

SEQ ID NO: 7047400 - DNA, 22 bp, Homo sapiens
catgaggatccaggtgacaggc

SEQ ID NO: 7047401 - DNA, 22 bp, Homo sapiens
aggatgagagatacatggagca

SEQ ID NO: 7047402 - DNA, 22 bp, Homo sapiens
aggatggcttgcaggaggctgt

SEQ ID NO: 7047403 - DNA, 22 bp, Homo sapiens
aggatgggcctgggatatgctt

SEQ ID NO: 7047404 - DNA, 22 bp, Homo sapiens
aggatggggtctgcagcctggt

SEQ ID NO: 7047405 - DNA, 22 bp, Homo sapiens
aggatggggtctgcagcctggt

SEQ ID NO: 7047406 - DNA, 22 bp, Homo sapiens
aggatggggtctgcagcctggt

SEQ ID NO: 7047407 - DNA, 22 bp, Homo sapiens
aggatggggtctgcagcctggt

SEQ ID NO: 7047408 - DNA, 23 bp, Homo sapiens
aggatgggtggcaatagaaagac

SEQ ID NO: 7047409 - DNA, 22 bp, Homo sapiens
aggaggctgcaaccctgaggcc

SEQ ID NO: 7047410 - DNA, 22 bp, Homo sapiens
aggaggctgaactagggtctgg

SEQ ID NO: 7047411 - DNA, 22 bp, Homo sapiens
aggaggcctgcagctgccattc

SEQ ID NO: 7047412 - DNA, 22 bp, Homo sapiens
aggaggctctcaggtcctcccc

SEQ ID NO: 7047413 - DNA, 22 bp, Homo sapiens
catacaaatgtgtccaggctct

SEQ ID NO: 7047414 - DNA, 22 bp, Homo sapiens
catacatatgtggatgtcatat

SEQ ID NO: 7047415 - DNA, 22 bp, Homo sapiens
catacatatgtggatgtcatat

SEQ ID NO: 7047416 - DNA, 22 bp, Homo sapiens
catctccaggagttctactcat

SEQ ID NO: 7047417 - DNA, 22 bp, Homo sapiens
catctccaggagttctactcat

SEQ ID NO: 7047418 - DNA, 20 bp, Homo sapiens
catctcctgcctccatgttc

SEQ ID NO: 7047419 - DNA, 20 bp, Homo sapiens
catctcctgcctccatgttc

SEQ ID NO: 7047420 - DNA, 22 bp, Homo sapiens
catctctccacggcagctctcg

SEQ ID NO: 7047421 - DNA, 22 bp, Homo sapiens
catctctccacggcagctctcg

SEQ ID NO: 7047422 - DNA, 22 bp, Homo sapiens
catctctgagacctcagctggg

SEQ ID NO: 7047423 - DNA, 22 bp, Homo sapiens
catctctgtgtccccagagctt

SEQ ID NO: 7047424 - DNA, 22 bp, Homo sapiens
catctcttcattagcattattg

SEQ ID NO: 7047425 - DNA, 22 bp, Homo sapiens
cagttttattggttgaaatctg

SEQ ID NO: 7047426 - DNA, 22 bp, Homo sapiens
cagttttatgtcgaatgtatac

SEQ ID NO: 7047427 - DNA, 22 bp, Homo sapiens
cataacatgtacatataaatgc

SEQ ID NO: 7047428 - DNA, 22 bp, Homo sapiens
cataacattaagcctctatttc

SEQ ID NO: 7047429 - DNA, 22 bp, Homo sapiens
aggagctgtcagagtgccagag

SEQ ID NO: 7047430 - DNA, 22 bp, Homo sapiens
aggagctgtgaatgggaggggt

SEQ ID NO: 7047431 - DNA, 22 bp, Homo sapiens
aggagccacttaggtgagataa

SEQ ID NO: 7047432 - DNA, 22 bp, Homo sapiens
aggagccaggccccatggggct

SEQ ID NO: 7047433 - DNA, 22 bp, Homo sapiens
aggagccagaatccagactcgg

SEQ ID NO: 7047434 - DNA, 22 bp, Homo sapiens
cagtccagctcatcagtggcac

SEQ ID NO: 7047435 - DNA, 22 bp, Homo sapiens
cagtccaggcctggaggagcca

SEQ ID NO: 7047436 - DNA, 22 bp, Homo sapiens
cagtgtggagggagagagcctg

SEQ ID NO: 7047437 - DNA, 22 bp, Homo sapiens
cagtgtggctgagacagaggct

SEQ ID NO: 7047438 - DNA, 22 bp, Homo sapiens
agggctgagtgggagagagttg

SEQ ID NO: 7047439 - DNA, 22 bp, Homo sapiens
agggctgaggcgagggagatgc

SEQ ID NO: 7047440 - DNA, 22 bp, Homo sapiens
agggctgagcccaggcatgtag

SEQ ID NO: 7047441 - DNA, 22 bp, Homo sapiens
agggctgagcccaggcatgtag

SEQ ID NO: 7047442 - DNA, 22 bp, Homo sapiens
agggctgagactaaggccagat

SEQ ID NO: 7047443 - DNA, 22 bp, Homo sapiens
agggctgagactaaggccagat

SEQ ID NO: 7047444 - DNA, 22 bp, Homo sapiens
agggctgagactaaggccagat

SEQ ID NO: 7047445 - DNA, 20 bp, Homo sapiens
agggctgagaagggactagc

SEQ ID NO: 7047446 - DNA, 20 bp, Homo sapiens
agggctgagaagggactagc

SEQ ID NO: 7047447 - DNA, 22 bp, Homo sapiens
agggctgagaatgacagggccg

SEQ ID NO: 7047448 - DNA, 22 bp, Homo sapiens
agggctgacagtggcgtggcgt

SEQ ID NO: 7047449 - DNA, 22 bp, Homo sapiens
agggctgacagtggcgtggcgt

SEQ ID NO: 7047450 - DNA, 22 bp, Homo sapiens
agggctgaaacataatccttct

SEQ ID NO: 7047451 - DNA, 22 bp, Homo sapiens
agggctgacctaagctccactt

SEQ ID NO: 7047452 - DNA, 22 bp, Homo sapiens
cctactctgagcgcctccgcat

SEQ ID NO: 7047453 - DNA, 22 bp, Homo sapiens
cctactctgagcgcctccgcat

SEQ ID NO: 7047454 - DNA, 22 bp, Homo sapiens
cctactctgagcgcctccgcat

SEQ ID NO: 7047455 - DNA, 22 bp, Homo sapiens
cctactctgagcgcctccgcat

SEQ ID NO: 7047456 - DNA, 22 bp, Homo sapiens
cctcaggggtgcccacagctgc

SEQ ID NO: 7047457 - DNA, 22 bp, Homo sapiens
cctcagggtggcatcagatctt

SEQ ID NO: 7047458 - DNA, 22 bp, Homo sapiens
agggctgggctgcttgttgtca

SEQ ID NO: 7047459 - DNA, 22 bp, Homo sapiens
agggctggtatgtccatgaaag

SEQ ID NO: 7047460 - DNA, 22 bp, Homo sapiens
cctacagttatattcttgattg

SEQ ID NO: 7047461 - DNA, 22 bp, Homo sapiens
cctacaggaaattgtatcaaaa

SEQ ID NO: 7047462 - DNA, 20 bp, Homo sapiens
agggcctgttgcaagcgttt

SEQ ID NO: 7047463 - DNA, 22 bp, Homo sapiens
agggcctggcttcactttctca

SEQ ID NO: 7047464 - DNA, 22 bp, Homo sapiens
agggcctgtctgtagaactgaa

SEQ ID NO: 7047465 - DNA, 22 bp, Homo sapiens
agggcctgtgaattctccctgc

SEQ ID NO: 7047466 - DNA, 21 bp, Homo sapiens
agggcctgtgctctccaggtc

SEQ ID NO: 7047467 - DNA, 22 bp, Homo sapiens
agggcctgtgctgagtagacga

SEQ ID NO: 7047468 - DNA, 22 bp, Homo sapiens
agggcccagtggagagctgagc

SEQ ID NO: 7047469 - DNA, 22 bp, Homo sapiens
agggcccatgtgggagcacttg

SEQ ID NO: 7047470 - DNA, 22 bp, Homo sapiens
ccctggcagaatgtctctgggc

SEQ ID NO: 7047471 - DNA, 22 bp, Homo sapiens
ccctggcagagggggcaggtgc

SEQ ID NO: 7047472 - DNA, 19 bp, Homo sapiens
ccctggcaggcaagcctgg

SEQ ID NO: 7047473 - DNA, 22 bp, Homo sapiens
ccctggcataaaacttctccag

SEQ ID NO: 7047474 - DNA, 22 bp, Homo sapiens
ccctggcatgcatgtccctggc

SEQ ID NO: 7047475 - DNA, 22 bp, Homo sapiens
aggggctcaaagtgtgcaggga

SEQ ID NO: 7047476 - DNA, 22 bp, Homo sapiens
aggggaatgggtagactgttga

SEQ ID NO: 7047477 - DNA, 22 bp, Homo sapiens
aggggaatgggtagactgttga

SEQ ID NO: 7047478 - DNA, 22 bp, Homo sapiens
aggggaaggccagcctgtagag

SEQ ID NO: 7047479 - DNA, 22 bp, Homo sapiens
cctcctggtgggcgcttctggc

SEQ ID NO: 7047480 - DNA, 22 bp, Homo sapiens
cctccttctggggccttctgct

SEQ ID NO: 7047481 - DNA, 22 bp, Homo sapiens
cctcgacctccccaggctcagg

SEQ ID NO: 7047482 - DNA, 22 bp, Homo sapiens
cctcctttcctgttttcctgag

SEQ ID NO: 7047483 - DNA, 22 bp, Homo sapiens
cctcgacctccccaggctcagg

SEQ ID NO: 7047484 - DNA, 22 bp, Homo sapiens
cctctgtggtctgtctaatgca

SEQ ID NO: 7047485 - DNA, 22 bp, Homo sapiens
cctctgtgtcagggaagagact

SEQ ID NO: 7047486 - DNA, 22 bp, Homo sapiens
cctctgtgtcctggtcattgaa

SEQ ID NO: 7047487 - DNA, 22 bp, Homo sapiens
agggggtgaatgtctgtctaca

SEQ ID NO: 7047488 - DNA, 22 bp, Homo sapiens
agggggagcttggctactcctg

SEQ ID NO: 7047489 - DNA, 22 bp, Homo sapiens
cctcttcaggcactcgaaggcc

SEQ ID NO: 7047490 - DNA, 22 bp, Homo sapiens
aggggtgaaggcccgataggag

SEQ ID NO: 7047491 - DNA, 22 bp, Homo sapiens
aggggtctatcctgagatggtc

SEQ ID NO: 7047492 - DNA, 22 bp, Homo sapiens
agggggtgggaagtctagaatc

SEQ ID NO: 7047493 - DNA, 22 bp, Homo sapiens
agggggtgtctctgattgggtt

SEQ ID NO: 7047494 - DNA, 22 bp, Homo sapiens
agggggtgtctctgattgggtt

SEQ ID NO: 7047495 - DNA, 22 bp, Homo sapiens
agggggtgcatttgtgaatgaa

SEQ ID NO: 7047496 - DNA, 22 bp, Homo sapiens
agggggtgcatttgtgaatgaa

SEQ ID NO: 7047497 - DNA, 22 bp, Homo sapiens
agggggtgcatttgtgaatgaa

SEQ ID NO: 7047498 - DNA, 22 bp, Homo sapiens
agggactatttacccatctcac

SEQ ID NO: 7047499 - DNA, 22 bp, Homo sapiens
agggacccatagagagaccagt

SEQ ID NO: 7047500 - DNA, 22 bp, Homo sapiens
agggactatttacccatctcac

SEQ ID NO: 7047501 - DNA, 22 bp, Homo sapiens
cccaggccagaacttggttgct

SEQ ID NO: 7047502 - DNA, 22 bp, Homo sapiens
agggacatgaggatgatctaga

SEQ ID NO: 7047503 - DNA, 22 bp, Homo sapiens
agggacatctcacaaacaactt

SEQ ID NO: 7047504 - DNA, 22 bp, Homo sapiens
agggacagttacatcatcagac

SEQ ID NO: 7047505 - DNA, 22 bp, Homo sapiens
agggaatggatgatggcaggtt

SEQ ID NO: 7047506 - DNA, 22 bp, Homo sapiens
agggacagtctactgttcactg

SEQ ID NO: 7047507 - DNA, 22 bp, Homo sapiens
agggagccttcctggctgtggt

SEQ ID NO: 7047508 - DNA, 22 bp, Homo sapiens
cccaggcctggtctgggccagt

SEQ ID NO: 7047509 - DNA, 22 bp, Homo sapiens
aggctttggggcattctgtgtt

SEQ ID NO: 7047510 - DNA, 22 bp, Homo sapiens
cccctgggtccaggcttctctg

SEQ ID NO: 7047511 - DNA, 22 bp, Homo sapiens
cccctggggatcagctggaatt

SEQ ID NO: 7047512 - DNA, 22 bp, Homo sapiens
cccctgtgttgttcaagggtca

SEQ ID NO: 7047513 - DNA, 22 bp, Homo sapiens
agggcatgtgggagaggagcct

SEQ ID NO: 7047514 - DNA, 22 bp, Homo sapiens
agggccacagtggggcctgaga

SEQ ID NO: 7047515 - DNA, 22 bp, Homo sapiens
agggccaccagagcagggcagt

SEQ ID NO: 7047516 - DNA, 22 bp, Homo sapiens
agggccacagtggggcctgaga

SEQ ID NO: 7047517 - DNA, 22 bp, Homo sapiens
agggccacctctctgggttccc

SEQ ID NO: 7047518 - DNA, 19 bp, Homo sapiens
agggccacggggaggtatt

SEQ ID NO: 7047519 - DNA, 23 bp, Homo sapiens
agggccactgggaaggattactg

SEQ ID NO: 7047520 - DNA, 23 bp, Homo sapiens
agggcccaagcctggacagcagg

SEQ ID NO: 7047521 - DNA, 22 bp, Homo sapiens
ccctgatggcacagtggcaggc

SEQ ID NO: 7047522 - DNA, 22 bp, Homo sapiens
ccctgaggggagtggtgaggtg

SEQ ID NO: 7047523 - DNA, 22 bp, Homo sapiens
ccctgagtcatcattgcggaag

SEQ ID NO: 7047524 - DNA, 22 bp, Homo sapiens
ccctgagttagtacagttgagt

SEQ ID NO: 7047525 - DNA, 22 bp, Homo sapiens
agggcagaaaccaccttgatgg

SEQ ID NO: 7047526 - DNA, 22 bp, Homo sapiens
agggcagaaatattgatactgt

SEQ ID NO: 7047527 - DNA, 23 bp, Homo sapiens
cccaggtgtggaggcggtggcag

SEQ ID NO: 7047528 - DNA, 19 bp, Homo sapiens
cccaggtgtttgaggctgc

SEQ ID NO: 7047529 - DNA, 19 bp, Homo sapiens
cccaggtgtttgaggctgc

SEQ ID NO: 7047530 - DNA, 22 bp, Homo sapiens
cccaggtgtttgtggcagaggt

SEQ ID NO: 7047531 - DNA, 22 bp, Homo sapiens
cccaggtggcagaagctgcagt

SEQ ID NO: 7047532 - DNA, 22 bp, Homo sapiens
cccaggtggcagaagctgcagt

SEQ ID NO: 7047533 - DNA, 21 bp, Homo sapiens
cccaggtgggatggttgcctc

SEQ ID NO: 7047534 - DNA, 22 bp, Homo sapiens
cccaggtgggcacctcgaggaa

SEQ ID NO: 7047535 - DNA, 22 bp, Homo sapiens
cccaggtgggcacctcgaggaa

SEQ ID NO: 7047536 - DNA, 22 bp, Homo sapiens
cccaggtgggttggcctctgtc

SEQ ID NO: 7047537 - DNA, 22 bp, Homo sapiens
cccctgctggcctgctggtttc

SEQ ID NO: 7047538 - DNA, 22 bp, Homo sapiens
cccctgccagctatccctgaac

SEQ ID NO: 7047539 - DNA, 22 bp, Homo sapiens
agggcagagaaatgtagttgag

SEQ ID NO: 7047540 - DNA, 22 bp, Homo sapiens
aggctgagtgctcccctagatg

SEQ ID NO: 7047541 - DNA, 18 bp, Homo sapiens
cccacacagcagtagctc

SEQ ID NO: 7047542 - DNA, 22 bp, Homo sapiens
cccacacatttttcacttaccg

SEQ ID NO: 7047543 - DNA, 22 bp, Homo sapiens
aggctgtgggacagttaggaga

SEQ ID NO: 7047544 - DNA, 22 bp, Homo sapiens
aggctgtgggagttgagagtct

SEQ ID NO: 7047545 - DNA, 22 bp, Homo sapiens
aggctgtggccctggtctagca

SEQ ID NO: 7047546 - DNA, 22 bp, Homo sapiens
aggctgtgcgaggtctcagagt

SEQ ID NO: 7047547 - DNA, 22 bp, Homo sapiens
aggctgtggcatcacatcagga

SEQ ID NO: 7047548 - DNA, 22 bp, Homo sapiens
aggctgtggccctggtctagca

SEQ ID NO: 7047549 - DNA, 22 bp, Homo sapiens
cccagaggttccttagggacca

SEQ ID NO: 7047550 - DNA, 22 bp, Homo sapiens
cccagaggtgacatcccattct

SEQ ID NO: 7047551 - DNA, 22 bp, Homo sapiens
aggctgtggtgctgaaggaggg

SEQ ID NO: 7047552 - DNA, 22 bp, Homo sapiens
aggctgtggtgctgaaggaggg

SEQ ID NO: 7047553 - DNA, 22 bp, Homo sapiens
aggctgtgcattttggagggcc

SEQ ID NO: 7047554 - DNA, 22 bp, Homo sapiens
aggctgtgcattttggagggcc

SEQ ID NO: 7047555 - DNA, 22 bp, Homo sapiens
aggctgtgactacgcagggaag

SEQ ID NO: 7047556 - DNA, 22 bp, Homo sapiens
aggctgtgcacagggcacctgc

SEQ ID NO: 7047557 - DNA, 22 bp, Homo sapiens
cccactctggctcccttctagt

SEQ ID NO: 7047558 - DNA, 22 bp, Homo sapiens
aggctgtgacagggtcatggag

SEQ ID NO: 7047559 - DNA, 22 bp, Homo sapiens
cccactccctgcacgcctgccg

SEQ ID NO: 7047560 - DNA, 22 bp, Homo sapiens
cccacgttgaaccgcttacaga

SEQ ID NO: 7047561 - DNA, 22 bp, Homo sapiens
ccagggcagaaaaagagggaat

SEQ ID NO: 7047562 - DNA, 22 bp, Homo sapiens
ccaggtgcactcaagacctgct

SEQ ID NO: 7047563 - DNA, 22 bp, Homo sapiens
ccaggtgcctccagtcacagtg

SEQ ID NO: 7047564 - DNA, 16 bp, Homo sapiens
ccaggtggggctgtga

SEQ ID NO: 7047565 - DNA, 22 bp, Homo sapiens
ccaggtggtgaaagtgggccct

SEQ ID NO: 7047566 - DNA, 18 bp, Homo sapiens
ccaggtggtgacagagat

SEQ ID NO: 7047567 - DNA, 18 bp, Homo sapiens
ccaggtggtgacagagat

SEQ ID NO: 7047568 - DNA, 22 bp, Homo sapiens
ccaggtggtgcctctgttcgca

SEQ ID NO: 7047569 - DNA, 20 bp, Homo sapiens
ccaggtggtgcctggagagg

SEQ ID NO: 7047570 - DNA, 20 bp, Homo sapiens
ccaggtggtgcctggagagg

SEQ ID NO: 7047571 - DNA, 22 bp, Homo sapiens
ccaggtggttcaggtcaccata

SEQ ID NO: 7047572 - DNA, 22 bp, Homo sapiens
ccaggtgttctttgtccctgtt

SEQ ID NO: 7047573 - DNA, 22 bp, Homo sapiens
aggctgagtgctcccctagatg

SEQ ID NO: 7047574 - DNA, 20 bp, Homo sapiens
ccaggcctgggcctgctcta

SEQ ID NO: 7047575 - DNA, 20 bp, Homo sapiens
ccaggcctgggcctgctcta

SEQ ID NO: 7047576 - DNA, 22 bp, Homo sapiens
ccaggccttctgaggacactct

SEQ ID NO: 7047577 - DNA, 22 bp, Homo sapiens
ccaggccttctgaggacactct

SEQ ID NO: 7047578 - DNA, 22 bp, Homo sapiens
ccaggccttctgaggacactct

SEQ ID NO: 7047579 - DNA, 22 bp, Homo sapiens
ccaggcctttcttcttggtctg

SEQ ID NO: 7047580 - DNA, 22 bp, Homo sapiens
aggctctgggaagcagtgagtt

SEQ ID NO: 7047581 - DNA, 22 bp, Homo sapiens
ccaggcaccatgttcttaggac

SEQ ID NO: 7047582 - DNA, 22 bp, Homo sapiens
ccaggcacggtggctcatgcct

SEQ ID NO: 7047583 - DNA, 20 bp, Homo sapiens
ccaggcactgtcccatgcag

SEQ ID NO: 7047584 - DNA, 22 bp, Homo sapiens
aggctagatagagggtcatctt

SEQ ID NO: 7047585 - DNA, 22 bp, Homo sapiens
aggcctggtgtgccggatgcag

SEQ ID NO: 7047586 - DNA, 22 bp, Homo sapiens
ccagctcccattcttcacctgt

SEQ ID NO: 7047587 - DNA, 22 bp, Homo sapiens
ccagctcccgcaggctgcacag

SEQ ID NO: 7047588 - DNA, 22 bp, Homo sapiens
aggccctgctttccagagctca

SEQ ID NO: 7047589 - DNA, 22 bp, Homo sapiens
aggccctggacactcaagccgg

SEQ ID NO: 7047590 - DNA, 22 bp, Homo sapiens
aggccctggcactgcctgggag

SEQ ID NO: 7047591 - DNA, 22 bp, Homo sapiens
ccaggaggtggcaggacttgcc

SEQ ID NO: 7047592 - DNA, 22 bp, Homo sapiens
ccaggaggttgaggctgcagtg

SEQ ID NO: 7047593 - DNA, 22 bp, Homo sapiens
ccaggaggttgaggctgcagtg

SEQ ID NO: 7047594 - DNA, 22 bp, Homo sapiens
aggcctgggacgggagccgtga

SEQ ID NO: 7047595 - DNA, 22 bp, Homo sapiens
ccaggaggtgctggaagaaagc

SEQ ID NO: 7047596 - DNA, 22 bp, Homo sapiens
ccaggaggatgaggggcataga

SEQ ID NO: 7047597 - DNA, 22 bp, Homo sapiens
ccaggaggggtctctgtctccc

SEQ ID NO: 7047598 - DNA, 19 bp, Homo sapiens
ccagaggtttgctgggcct

SEQ ID NO: 7047599 - DNA, 21 bp, Homo sapiens
ccagaggttctgggcctccct

SEQ ID NO: 7047600 - DNA, 22 bp, Homo sapiens
ccagaggttccaggctagggag

SEQ ID NO: 7047601 - DNA, 22 bp, Homo sapiens
ccagaggttactttgccttgga

SEQ ID NO: 7047602 - DNA, 22 bp, Homo sapiens
ccagaggttacaccctcagccc

SEQ ID NO: 7047603 - DNA, 22 bp, Homo sapiens
ccagaggtggtggtgtctagaa

SEQ ID NO: 7047604 - DNA, 22 bp, Homo sapiens
ccagaggtggtgggtgctacag

SEQ ID NO: 7047605 - DNA, 22 bp, Homo sapiens
ccagaggtggtcatagaaagca

SEQ ID NO: 7047606 - DNA, 22 bp, Homo sapiens
ccagaggtgggagtgatctggt

SEQ ID NO: 7047607 - DNA, 22 bp, Homo sapiens
ccagaggtggaagattgttttg

SEQ ID NO: 7047608 - DNA, 22 bp, Homo sapiens
ccagaggctggcaagggctcct

SEQ ID NO: 7047609 - DNA, 22 bp, Homo sapiens
ccagaggctggcaagggctcct

SEQ ID NO: 7047610 - DNA, 20 bp, Homo sapiens
ccagaggctgacagactttg

SEQ ID NO: 7047611 - DNA, 22 bp, Homo sapiens
ccagaggctggcaagggctcct

SEQ ID NO: 7047612 - DNA, 18 bp, Homo sapiens
ccagaggcccgggcaggc

SEQ ID NO: 7047613 - DNA, 21 bp, Homo sapiens
ccagaggcctctcttggccac

SEQ ID NO: 7047614 - DNA, 22 bp, Homo sapiens
ccagaggcggaggtttgcagtg

SEQ ID NO: 7047615 - DNA, 22 bp, Homo sapiens
ccagaggatgctggtcagcctc

SEQ ID NO: 7047616 - DNA, 20 bp, Homo sapiens
ccagagctgatggctgcccg

SEQ ID NO: 7047617 - DNA, 19 bp, Homo sapiens
aggcaggtgcagaggtccc

SEQ ID NO: 7047618 - DNA, 22 bp, Homo sapiens
ccagaggatgctggtcagcctc

SEQ ID NO: 7047619 - DNA, 19 bp, Homo sapiens
ccagaggcagcttctgtaa

SEQ ID NO: 7047620 - DNA, 22 bp, Homo sapiens
ccagaggcatgttcaaagcaat

SEQ ID NO: 7047621 - DNA, 22 bp, Homo sapiens
aggcaggtcccctggaaggcac

SEQ ID NO: 7047622 - DNA, 22 bp, Homo sapiens
aggccctgcccagagctcctcg

SEQ ID NO: 7047623 - DNA, 22 bp, Homo sapiens
aggccctgcccagtgccacaag

SEQ ID NO: 7047624 - DNA, 22 bp, Homo sapiens
aggccctgcccagtgccacaag

SEQ ID NO: 7047625 - DNA, 22 bp, Homo sapiens
aggccctgacctgggagatcta

SEQ ID NO: 7047626 - DNA, 22 bp, Homo sapiens
aggccctgcccagagctcctcg

SEQ ID NO: 7047627 - DNA, 22 bp, Homo sapiens
acagccactcaaagggccgaag

SEQ ID NO: 7047628 - DNA, 22 bp, Homo sapiens
acaggacaaaaatctggatggc

SEQ ID NO: 7047629 - DNA, 22 bp, Homo sapiens
acaggacaactcagcagccagc

SEQ ID NO: 7047630 - DNA, 22 bp, Homo sapiens
acaggacaaggggaagaagata

SEQ ID NO: 7047631 - DNA, 22 bp, Homo sapiens
acaggacaggctgggctagact

SEQ ID NO: 7047632 - DNA, 22 bp, Homo sapiens
acaggacagtctagtaacagta

SEQ ID NO: 7047633 - DNA, 22 bp, Homo sapiens
acaggacatggcttctgtgacg

SEQ ID NO: 7047634 - DNA, 22 bp, Homo sapiens
acaggagaaatctggtcaaaag

SEQ ID NO: 7047635 - DNA, 22 bp, Homo sapiens
agcttcttctgatttgtcagtc

SEQ ID NO: 7047636 - DNA, 22 bp, Homo sapiens
agcttcttcttggtctttccca

SEQ ID NO: 7047637 - DNA, 22 bp, Homo sapiens
agcttcttgaccaagcctgtaa

SEQ ID NO: 7047638 - DNA, 22 bp, Homo sapiens
agcttctttaattcagcatgat

SEQ ID NO: 7047639 - DNA, 22 bp, Homo sapiens
agcttctttgtgggctccagaa

SEQ ID NO: 7047640 - DNA, 22 bp, Homo sapiens
acaggcacaccttcctgcaggc

SEQ ID NO: 7047641 - DNA, 22 bp, Homo sapiens
aggaaaggggtaggtgtggacg

SEQ ID NO: 7047642 - DNA, 22 bp, Homo sapiens
aggaaaggtagcgtgccagcag

SEQ ID NO: 7047643 - DNA, 22 bp, Homo sapiens
aggaaaggtgagagcggccgcg

SEQ ID NO: 7047644 - DNA, 19 bp, Homo sapiens
aggaaaggtggccttagca

SEQ ID NO: 7047645 - DNA, 22 bp, Homo sapiens
aggaaaggttcagtgattgaaa

SEQ ID NO: 7047646 - DNA, 22 bp, Homo sapiens
acaggctctcagccagttggca

SEQ ID NO: 7047647 - DNA, 21 bp, Homo sapiens
acaggctctggggatgctggg

SEQ ID NO: 7047648 - DNA, 21 bp, Homo sapiens
acagggcatgcagctggctgt

SEQ ID NO: 7047649 - DNA, 22 bp, Homo sapiens
acagggcatttcctctatgtgt

SEQ ID NO: 7047650 - DNA, 22 bp, Homo sapiens
acagggctatattcctcagagc

SEQ ID NO: 7047651 - DNA, 22 bp, Homo sapiens
aggacacaggtaagccagtgga

SEQ ID NO: 7047652 - DNA, 22 bp, Homo sapiens
aggacagggattcaaactccca

SEQ ID NO: 7047653 - DNA, 22 bp, Homo sapiens
aggacagggattcaaactccca

SEQ ID NO: 7047654 - DNA, 22 bp, Homo sapiens
aggacaggtgtagtgggctctg

SEQ ID NO: 7047655 - DNA, 22 bp, Homo sapiens
aggacaggtgtagtgggctctg

SEQ ID NO: 7047656 - DNA, 22 bp, Homo sapiens
acagggccattggaggattata

SEQ ID NO: 7047657 - DNA, 22 bp, Homo sapiens
aggacaggtgtagtgggctctg

SEQ ID NO: 7047658 - DNA, 22 bp, Homo sapiens
aggacagtataggctttaggag

SEQ ID NO: 7047659 - DNA, 23 bp, Homo sapiens
aggacagtggaatttagggattg

SEQ ID NO: 7047660 - DNA, 22 bp, Homo sapiens
aggacagtggcaaggcaggaca

SEQ ID NO: 7047661 - DNA, 22 bp, Homo sapiens
aggacagttagttaggaagttt

SEQ ID NO: 7047662 - DNA, 22 bp, Homo sapiens
aggacatgaagaaagggcaagg

SEQ ID NO: 7047663 - DNA, 22 bp, Homo sapiens
aggacatgtaaatggagaggga

SEQ ID NO: 7047664 - DNA, 22 bp, Homo sapiens
aggactggcagtgtgaggggtc

SEQ ID NO: 7047665 - DNA, 22 bp, Homo sapiens
aggactggcagtgtgaggggtc

SEQ ID NO: 7047666 - DNA, 22 bp, Homo sapiens
aggactggccctgaggggaggc

SEQ ID NO: 7047667 - DNA, 22 bp, Homo sapiens
aggactggcggtcggtggggat

SEQ ID NO: 7047668 - DNA, 22 bp, Homo sapiens
aggactgggtgcagagggcatc

SEQ ID NO: 7047669 - DNA, 22 bp, Homo sapiens
aggactgggtgcagagggcatc

SEQ ID NO: 7047670 - DNA, 22 bp, Homo sapiens
aggactgggtgcagagggcatc

SEQ ID NO: 7047671 - DNA, 22 bp, Homo sapiens
aggactggtgccagacaaggta

SEQ ID NO: 7047672 - DNA, 22 bp, Homo sapiens
aggactggtgccagacaaggta

SEQ ID NO: 7047673 - DNA, 22 bp, Homo sapiens
aggaggccaggccctcaagcct

SEQ ID NO: 7047674 - DNA, 22 bp, Homo sapiens
acagtggaaagaaacgaattag

SEQ ID NO: 7047675 - DNA, 22 bp, Homo sapiens
acagtggaaagaacatggattt

SEQ ID NO: 7047676 - DNA, 22 bp, Homo sapiens
acagtgaggaagcagctgtgct

SEQ ID NO: 7047677 - DNA, 22 bp, Homo sapiens
acagtgagatccaagggcaggc

SEQ ID NO: 7047678 - DNA, 22 bp, Homo sapiens
acagtgagcccactccaggaga

SEQ ID NO: 7047679 - DNA, 22 bp, Homo sapiens
acagtgacgtttatttgagacg

SEQ ID NO: 7047680 - DNA, 22 bp, Homo sapiens
acagtgagatccaagggcaggc

SEQ ID NO: 7047681 - DNA, 22 bp, Homo sapiens
acagtctggaggctgcttcatt

SEQ ID NO: 7047682 - DNA, 22 bp, Homo sapiens
acagtctggcaggtgttgaaag

SEQ ID NO: 7047683 - DNA, 22 bp, Homo sapiens
acagtctgtcccccaggtgcta

SEQ ID NO: 7047684 - DNA, 22 bp, Homo sapiens
aggcaccgctcctcagtccaga

SEQ ID NO: 7047685 - DNA, 22 bp, Homo sapiens
aggcacctcagctgagcctggg

SEQ ID NO: 7047686 - DNA, 22 bp, Homo sapiens
aggcacctcttaggctgctact

SEQ ID NO: 7047687 - DNA, 17 bp, Homo sapiens
aggcacctcttcctgct

SEQ ID NO: 7047688 - DNA, 22 bp, Homo sapiens
acagtggaaatgtgggagggga

SEQ ID NO: 7047689 - DNA, 22 bp, Homo sapiens
acagtggaaatgtgggagggga

SEQ ID NO: 7047690 - DNA, 20 bp, Homo sapiens
acagtggaaattgatgtctg

SEQ ID NO: 7047691 - DNA, 20 bp, Homo sapiens
acagtggaaattgatgtctg

SEQ ID NO: 7047692 - DNA, 22 bp, Homo sapiens
acagtggaagaagcactgaact

SEQ ID NO: 7047693 - DNA, 22 bp, Homo sapiens
acagtggaagcatgatgctatc

SEQ ID NO: 7047694 - DNA, 22 bp, Homo sapiens
acagtggaatggtgggcctgca

SEQ ID NO: 7047695 - DNA, 22 bp, Homo sapiens
acagtggaatttgtagatgtgt

SEQ ID NO: 7047696 - DNA, 22 bp, Homo sapiens
acagtggagaagcaaatgcagt

SEQ ID NO: 7047697 - DNA, 22 bp, Homo sapiens
acagtggagaaggcatgaggct

SEQ ID NO: 7047698 - DNA, 22 bp, Homo sapiens
acagtggagaaggcatgaggct

SEQ ID NO: 7047699 - DNA, 22 bp, Homo sapiens
acagtggagctcagatgaaaat

SEQ ID NO: 7047700 - DNA, 22 bp, Homo sapiens
acagtggaggccatatggtcct

SEQ ID NO: 7047701 - DNA, 22 bp, Homo sapiens
acagtggaggccatatggtcct

SEQ ID NO: 7047702 - DNA, 22 bp, Homo sapiens
acagtggagttggggtagccct

SEQ ID NO: 7047703 - DNA, 22 bp, Homo sapiens
acagtggatatattaaatgaga

SEQ ID NO: 7047704 - DNA, 22 bp, Homo sapiens
acagtggatgacatccttttgc

SEQ ID NO: 7047705 - DNA, 22 bp, Homo sapiens
acagtggatgtgatgtccaggt

SEQ ID NO: 7047706 - DNA, 22 bp, Homo sapiens
acagtggatgtgatgtccaggt

SEQ ID NO: 7047707 - DNA, 22 bp, Homo sapiens
acagtggatgtgatgtccaggt

SEQ ID NO: 7047708 - DNA, 22 bp, Homo sapiens
aggcactggtccattttctgca

SEQ ID NO: 7047709 - DNA, 22 bp, Homo sapiens
aggcagaaaatagtcatccaaa

SEQ ID NO: 7047710 - DNA, 22 bp, Homo sapiens
aggcactgaaaggtggccagag

SEQ ID NO: 7047711 - DNA, 22 bp, Homo sapiens
aggcacgagcaatggccgagga

SEQ ID NO: 7047712 - DNA, 22 bp, Homo sapiens
aggcacctgaggtggccagcct

SEQ ID NO: 7047713 - DNA, 22 bp, Homo sapiens
aggcaccttgagagcaggagct

SEQ ID NO: 7047714 - DNA, 22 bp, Homo sapiens
aggcaccttgcggtccagtgaa

SEQ ID NO: 7047715 - DNA, 22 bp, Homo sapiens
aggcaggtgttgggagacacca

SEQ ID NO: 7047716 - DNA, 22 bp, Homo sapiens
aggcaggttggtgagaagactg

SEQ ID NO: 7047717 - DNA, 22 bp, Homo sapiens
aggcagcaagattatttaatcc

SEQ ID NO: 7047718 - DNA, 22 bp, Homo sapiens
aggcagagaaaaaccagatatg

SEQ ID NO: 7047719 - DNA, 22 bp, Homo sapiens
aggcagacttcctgcttggatc

SEQ ID NO: 7047720 - DNA, 22 bp, Homo sapiens
aggcagagaaaaaccagatatg

SEQ ID NO: 7047721 - DNA, 22 bp, Homo sapiens
aggcagatgggagctggaagtt

SEQ ID NO: 7047722 - DNA, 22 bp, Homo sapiens
aggcagatggtaactgtgatat

SEQ ID NO: 7047723 - DNA, 22 bp, Homo sapiens
acatatattactagtaaagaca

SEQ ID NO: 7047724 - DNA, 22 bp, Homo sapiens
acatatattactagtaaagaca

SEQ ID NO: 7047725 - DNA, 22 bp, Homo sapiens
acatatattactagtaaagaca

SEQ ID NO: 7047726 - DNA, 22 bp, Homo sapiens
acatatatgtaaagtactttgt

SEQ ID NO: 7047727 - DNA, 22 bp, Homo sapiens
acatatatgtaaagtactttgt

SEQ ID NO: 7047728 - DNA, 22 bp, Homo sapiens
acatatatgcgtgggctcatgg

SEQ ID NO: 7047729 - DNA, 22 bp, Homo sapiens
aggcagtgtattgctagcggct

SEQ ID NO: 7047730 - DNA, 20 bp, Homo sapiens
aggcagtgtagagatgagta

SEQ ID NO: 7047731 - DNA, 22 bp, Homo sapiens
aggcagtgtgtagctggaagag

SEQ ID NO: 7047732 - DNA, 22 bp, Homo sapiens
aggcagtgtgtagctggaagag

SEQ ID NO: 7047733 - DNA, 20 bp, Homo sapiens
aggcagtgtagagatgagta

SEQ ID NO: 7047734 - DNA, 22 bp, Homo sapiens
acatgtgaggtgtgagtgatac

SEQ ID NO: 7047735 - DNA, 22 bp, Homo sapiens
acatgtgcagacagcaagcagg

SEQ ID NO: 7047736 - DNA, 20 bp, Homo sapiens
aggctcagctgagctcttgg

SEQ ID NO: 7047737 - DNA, 22 bp, Homo sapiens
aggcagtgttcttctaagggca

SEQ ID NO: 7047738 - DNA, 22 bp, Homo sapiens
acatgtaaaagataaattaaca

SEQ ID NO: 7047739 - DNA, 22 bp, Homo sapiens
acatgtaaaaggaacatgcatg

SEQ ID NO: 7047740 - DNA, 22 bp, Homo sapiens
acatgtaaacatttacagtatt

SEQ ID NO: 7047741 - DNA, 22 bp, Homo sapiens
acatgtaacatatatgtagcat

SEQ ID NO: 7047742 - DNA, 22 bp, Homo sapiens
acatgtaagactagcttaaagt

SEQ ID NO: 7047743 - DNA, 21 bp, Homo sapiens
acatgtaagagagtttcaaga

SEQ ID NO: 7047744 - DNA, 22 bp, Homo sapiens
acatgtacatacacatatgtaa

SEQ ID NO: 7047745 - DNA, 20 bp, Homo sapiens
acatgtactaatgaatacag

SEQ ID NO: 7047746 - DNA, 22 bp, Homo sapiens
acatgtatacaatgtgtaatga

SEQ ID NO: 7047747 - DNA, 22 bp, Homo sapiens
acatgtattgacattatattct

SEQ ID NO: 7047748 - DNA, 22 bp, Homo sapiens
acatgtctccacccatcttaaa

SEQ ID NO: 7047749 - DNA, 22 bp, Homo sapiens
acattaacaccataagtgtgtt

SEQ ID NO: 7047750 - DNA, 22 bp, Homo sapiens
acattaaatttcatagtgatta

SEQ ID NO: 7047751 - DNA, 22 bp, Homo sapiens
aggctctccagagagctgcttt

SEQ ID NO: 7047752 - DNA, 22 bp, Homo sapiens
aggctgctctgcgaagtcagct

SEQ ID NO: 7047753 - DNA, 22 bp, Homo sapiens
aggctgctgccttggagagtgt

SEQ ID NO: 7047754 - DNA, 22 bp, Homo sapiens
aggctgctgccttggagagtgt

SEQ ID NO: 7047755 - DNA, 22 bp, Homo sapiens
aggctgctggcaggcgtggacg

SEQ ID NO: 7047756 - DNA, 22 bp, Homo sapiens
aggctgctggcaggcgtggacg

SEQ ID NO: 7047757 - DNA, 17 bp, Homo sapiens
aggctgctgggccaggg

SEQ ID NO: 7047758 - DNA, 23 bp, Homo sapiens
aggctgcttactggtatcagagc

SEQ ID NO: 7047759 - DNA, 18 bp, Homo sapiens
acatttctccttctgacc

SEQ ID NO: 7047760 - DNA, 23 bp, Homo sapiens
aggctggcttcaggagcctctcc

SEQ ID NO: 7047761 - DNA, 22 bp, Homo sapiens
aggctggcttggctctcctgtg

SEQ ID NO: 7047762 - DNA, 22 bp, Homo sapiens
accactgggcgggcagcctgct

SEQ ID NO: 7047763 - DNA, 22 bp, Homo sapiens
aggctgtgatgagcctcatgga

SEQ ID NO: 7047764 - DNA, 22 bp, Homo sapiens
aggctgtgatgagcctcatgga

SEQ ID NO: 7047765 - DNA, 22 bp, Homo sapiens
accacaggacccatgagtcagt

SEQ ID NO: 7047766 - DNA, 22 bp, Homo sapiens
accacaggacccatgagtcagt

SEQ ID NO: 7047767 - DNA, 22 bp, Homo sapiens
accactgcccatggtgaaaact

SEQ ID NO: 7047768 - DNA, 19 bp, Homo sapiens
aggctgtgagggaggactc

SEQ ID NO: 7047769 - DNA, 22 bp, Homo sapiens
aggctgtgagcaagaacaccta

SEQ ID NO: 7047770 - DNA, 19 bp, Homo sapiens
aggctgtgagggaggactc

SEQ ID NO: 7047771 - DNA, 22 bp, Homo sapiens
aggctgtgagaagtccttcagt

SEQ ID NO: 7047772 - DNA, 19 bp, Homo sapiens
aggctgtgagggaggactc

SEQ ID NO: 7047773 - DNA, 19 bp, Homo sapiens
aggctgtgaggggaaggaa

SEQ ID NO: 7047774 - DNA, 22 bp, Homo sapiens
aggctgtgagttttgtctcaga

SEQ ID NO: 7047775 - DNA, 22 bp, Homo sapiens
aggctggctttggtagcatggt

SEQ ID NO: 7047776 - DNA, 22 bp, Homo sapiens
aggctgggaaacctgaagttgt

SEQ ID NO: 7047777 - DNA, 22 bp, Homo sapiens
aggctgggaaacctgaagttgt

SEQ ID NO: 7047778 - DNA, 22 bp, Homo sapiens
aggctggctttggtagcatggt

SEQ ID NO: 7047779 - DNA, 22 bp, Homo sapiens
aggctgggaaatgtagtcttcc

SEQ ID NO: 7047780 - DNA, 22 bp, Homo sapiens
aggctgggaaatgtattccagc

SEQ ID NO: 7047781 - DNA, 22 bp, Homo sapiens
agggaggcattagctactgcga

SEQ ID NO: 7047782 - DNA, 22 bp, Homo sapiens
agggcaatccagccagctgatc

SEQ ID NO: 7047783 - DNA, 22 bp, Homo sapiens
agggcacatctgctgggaatgg

SEQ ID NO: 7047784 - DNA, 22 bp, Homo sapiens
accagagcagactactggaggt

SEQ ID NO: 7047785 - DNA, 22 bp, Homo sapiens
accagagctcttcagcacagga

SEQ ID NO: 7047786 - DNA, 22 bp, Homo sapiens
agggcatgctggaggagagaca

SEQ ID NO: 7047787 - DNA, 22 bp, Homo sapiens
agggccagatgaagccacaagc

SEQ ID NO: 7047788 - DNA, 22 bp, Homo sapiens
agggccagatgaagccacaagc

SEQ ID NO: 7047789 - DNA, 22 bp, Homo sapiens
agggccagcactcctggcagga

SEQ ID NO: 7047790 - DNA, 22 bp, Homo sapiens
agggccagatgaagccacaagc

SEQ ID NO: 7047791 - DNA, 22 bp, Homo sapiens
agggccagccaggccctacaaa

SEQ ID NO: 7047792 - DNA, 22 bp, Homo sapiens
agggccagcagcttggccaacc

SEQ ID NO: 7047793 - DNA, 22 bp, Homo sapiens
agggccagcccataatgccaaa

SEQ ID NO: 7047794 - DNA, 22 bp, Homo sapiens
agggccagcactcctggcagga

SEQ ID NO: 7047795 - DNA, 22 bp, Homo sapiens
agggctcaatggtgggcatgta

SEQ ID NO: 7047796 - DNA, 22 bp, Homo sapiens
agggctcaccactgtgcactcc

SEQ ID NO: 7047797 - DNA, 22 bp, Homo sapiens
agggctcaccactgtgcactcc

SEQ ID NO: 7047798 - DNA, 22 bp, Homo sapiens
agggctcaccactgtgcactcc

SEQ ID NO: 7047799 - DNA, 22 bp, Homo sapiens
agggccagttctacctctgaat

SEQ ID NO: 7047800 - DNA, 22 bp, Homo sapiens
agggccagttctacctctgaat

SEQ ID NO: 7047801 - DNA, 22 bp, Homo sapiens
agggcctgtcagcggtgtcctg

SEQ ID NO: 7047802 - DNA, 22 bp, Homo sapiens
agggccagccccaccctctctg

SEQ ID NO: 7047803 - DNA, 22 bp, Homo sapiens
agggccagtaccaggtgggtgg

SEQ ID NO: 7047804 - DNA, 22 bp, Homo sapiens
aggggtgtgcatcctggaggat

SEQ ID NO: 7047805 - DNA, 22 bp, Homo sapiens
agggtcagtagtgatgcgtgaa

SEQ ID NO: 7047806 - DNA, 22 bp, Homo sapiens
agggtcagtgatgagggagccc

SEQ ID NO: 7047807 - DNA, 22 bp, Homo sapiens
aggggtgatttgggacaggaca

SEQ ID NO: 7047808 - DNA, 22 bp, Homo sapiens
aggggtgatttgggacaggaca

SEQ ID NO: 7047809 - DNA, 22 bp, Homo sapiens
aggggtgatttgggacaggaca

SEQ ID NO: 7047810 - DNA, 22 bp, Homo sapiens
aggggtgacacatatcagtgca

SEQ ID NO: 7047811 - DNA, 20 bp, Homo sapiens
aggggtgatcgggtgacact

SEQ ID NO: 7047812 - DNA, 22 bp, Homo sapiens
acctccagctttttagagacat

SEQ ID NO: 7047813 - DNA, 22 bp, Homo sapiens
acctccaggaagctcttggtac

SEQ ID NO: 7047814 - DNA, 16 bp, Homo sapiens
acctccagtcaagggt

SEQ ID NO: 7047815 - DNA, 22 bp, Homo sapiens
acctcccagaaagttttgcagg

SEQ ID NO: 7047816 - DNA, 22 bp, Homo sapiens
acctcccagctctgagcttggg

SEQ ID NO: 7047817 - DNA, 22 bp, Homo sapiens
accctttgtccaatagaaatga

SEQ ID NO: 7047818 - DNA, 21 bp, Homo sapiens
acctcaagcaacaaccaaggt

SEQ ID NO: 7047819 - DNA, 21 bp, Homo sapiens
acctcaagcaacaaccaaggt

SEQ ID NO: 7047820 - DNA, 22 bp, Homo sapiens
acctcagctatttcaaaacaga

SEQ ID NO: 7047821 - DNA, 22 bp, Homo sapiens
agggctgacagtaaaagtatga

SEQ ID NO: 7047822 - DNA, 22 bp, Homo sapiens
agggctgacagtgaggagtcaa

SEQ ID NO: 7047823 - DNA, 22 bp, Homo sapiens
agggctgacacaccttatcctc

SEQ ID NO: 7047824 - DNA, 23 bp, Homo sapiens
agggctgaatgcagagaagcaga

SEQ ID NO: 7047825 - DNA, 23 bp, Homo sapiens
agggctgaatgcagagaagcaga

SEQ ID NO: 7047826 - DNA, 22 bp, Homo sapiens
agggctgacaaatggcagtgac

SEQ ID NO: 7047827 - DNA, 22 bp, Homo sapiens
agggctgacaaatggcagtgac

SEQ ID NO: 7047828 - DNA, 22 bp, Homo sapiens
agggctgaagttatggctgagc

SEQ ID NO: 7047829 - DNA, 22 bp, Homo sapiens
agggctgaagggaggtgctcat

SEQ ID NO: 7047830 - DNA, 22 bp, Homo sapiens
agggctgaagggaggtgctcat

SEQ ID NO: 7047831 - DNA, 22 bp, Homo sapiens
agggctcagtaaacggtggatt

SEQ ID NO: 7047832 - DNA, 22 bp, Homo sapiens
agggctcagggtcaccatctgt

SEQ ID NO: 7047833 - DNA, 22 bp, Homo sapiens
agggctcagccagcctgtgtgc

SEQ ID NO: 7047834 - DNA, 22 bp, Homo sapiens
agggctcagaacaatgagtgta

SEQ ID NO: 7047835 - DNA, 22 bp, Homo sapiens
agggctcagaaatgtctacggg

SEQ ID NO: 7047836 - DNA, 22 bp, Homo sapiens
agggctcactgggaggctataa

SEQ ID NO: 7047837 - DNA, 22 bp, Homo sapiens
aggggagcaacatagtcactct

SEQ ID NO: 7047838 - DNA, 22 bp, Homo sapiens
aggggagcaaggccgtggtgta

SEQ ID NO: 7047839 - DNA, 22 bp, Homo sapiens
aggggagccagggctgcgagtt

SEQ ID NO: 7047840 - DNA, 22 bp, Homo sapiens
aggggagcccctggtcctggtg

SEQ ID NO: 7047841 - DNA, 22 bp, Homo sapiens
aggggagccgaggggcatctgt

SEQ ID NO: 7047842 - DNA, 22 bp, Homo sapiens
aggggagccgaggggcatctgt

SEQ ID NO: 7047843 - DNA, 22 bp, Homo sapiens
aggggagctaacaccagagccc

SEQ ID NO: 7047844 - DNA, 22 bp, Homo sapiens
aggggagcttgaggcatggcct

SEQ ID NO: 7047845 - DNA, 22 bp, Homo sapiens
aggggagcttgcctggtcaccc

SEQ ID NO: 7047846 - DNA, 22 bp, Homo sapiens
aggtggggaggagtgtctcttt

SEQ ID NO: 7047847 - DNA, 22 bp, Homo sapiens
aggtggagaagagatgggcagt

SEQ ID NO: 7047848 - DNA, 22 bp, Homo sapiens
aggtggagaagagatgggcagt

SEQ ID NO: 7047849 - DNA, 22 bp, Homo sapiens
aggtggagacccagagaaggcg

SEQ ID NO: 7047850 - DNA, 22 bp, Homo sapiens
aggtggagacccagagaaggcg

SEQ ID NO: 7047851 - DNA, 22 bp, Homo sapiens
aggtggagacccagagaaggcg

SEQ ID NO: 7047852 - DNA, 22 bp, Homo sapiens
aggtggtgatgacagaagacag

SEQ ID NO: 7047853 - DNA, 22 bp, Homo sapiens
aggtgtctggatgggtgtcctt

SEQ ID NO: 7047854 - DNA, 21 bp, Homo sapiens
aggttcctgagtcatgcctta

SEQ ID NO: 7047855 - DNA, 22 bp, Homo sapiens
aggttctggcattgctcagtaa

SEQ ID NO: 7047856 - DNA, 22 bp, Homo sapiens
actcagagcctcgagggactgc

SEQ ID NO: 7047857 - DNA, 22 bp, Homo sapiens
agggtcagttctgtgaggtgtt

SEQ ID NO: 7047858 - DNA, 18 bp, Homo sapiens
agggtcagtgtcactggc

SEQ ID NO: 7047859 - DNA, 19 bp, Homo sapiens
agggtccagggagcggctc

SEQ ID NO: 7047860 - DNA, 22 bp, Homo sapiens
agggtccagtaacagatgccag

SEQ ID NO: 7047861 - DNA, 22 bp, Homo sapiens
agggtccatcaaggactgcaca

SEQ ID NO: 7047862 - DNA, 22 bp, Homo sapiens
agggtccatcaaggactgcaca

SEQ ID NO: 7047863 - DNA, 23 bp, Homo sapiens
agggtgagcaagctatggagacc

SEQ ID NO: 7047864 - DNA, 22 bp, Homo sapiens
agggtgcctgctgcaggttcag

SEQ ID NO: 7047865 - DNA, 22 bp, Homo sapiens
aggtgaggataggtggccaagg

SEQ ID NO: 7047866 - DNA, 22 bp, Homo sapiens
agggtgcatgtttgcaagagtg

SEQ ID NO: 7047867 - DNA, 19 bp, Homo sapiens
aggtgcaggtcacagggga

SEQ ID NO: 7047868 - DNA, 22 bp, Homo sapiens
aggtgcagtggctcatgcctgt

SEQ ID NO: 7047869 - DNA, 22 bp, Homo sapiens
agtaataatagctgtaaagtgc

SEQ ID NO: 7047870 - DNA, 22 bp, Homo sapiens
agtcaggggttggacggggcca

SEQ ID NO: 7047871 - DNA, 22 bp, Homo sapiens
agtcagtgaatggtgtatgcta

SEQ ID NO: 7047872 - DNA, 22 bp, Homo sapiens
agtcagtgacttttgctgagag

SEQ ID NO: 7047873 - DNA, 23 bp, Homo sapiens
agtaacatgcaaataacagtctg

SEQ ID NO: 7047874 - DNA, 22 bp, Homo sapiens
actcagagtgcatctcctattt

SEQ ID NO: 7047875 - DNA, 22 bp, Homo sapiens
actcagagcttggctccttgct

SEQ ID NO: 7047876 - DNA, 22 bp, Homo sapiens
agtccagccttcaatcttagtg

SEQ ID NO: 7047877 - DNA, 21 bp, Homo sapiens
agtccaggaggaggccaggtt

SEQ ID NO: 7047878 - DNA, 22 bp, Homo sapiens
agtccaggcattccagccattc

SEQ ID NO: 7047879 - DNA, 22 bp, Homo sapiens
agtccaggcctcctcttttcct

SEQ ID NO: 7047880 - DNA, 22 bp, Homo sapiens
agtccaggcgggtatagaggct

SEQ ID NO: 7047881 - DNA, 22 bp, Homo sapiens
actctgctctgtatttcactgt

SEQ ID NO: 7047882 - DNA, 22 bp, Homo sapiens
actctgggctgttaggagctgt

SEQ ID NO: 7047883 - DNA, 22 bp, Homo sapiens
agtcctgggtgtgcaaggcaga

SEQ ID NO: 7047884 - DNA, 20 bp, Homo sapiens
agtgggagagggcagactgc

SEQ ID NO: 7047885 - DNA, 22 bp, Homo sapiens
agtgggagccagcagcttgggg

SEQ ID NO: 7047886 - DNA, 20 bp, Homo sapiens
agtgggagagggcagactgc

SEQ ID NO: 7047887 - DNA, 22 bp, Homo sapiens
agtggcagagccaagatatgat

SEQ ID NO: 7047888 - DNA, 22 bp, Homo sapiens
agtggcagagccaagtagagcc

SEQ ID NO: 7047889 - DNA, 22 bp, Homo sapiens
agtggcagagccaagtagagcc

SEQ ID NO: 7047890 - DNA, 22 bp, Homo sapiens
agtggctggaattgcaggtgcg

SEQ ID NO: 7047891 - DNA, 22 bp, Homo sapiens
agtgggagcggcagtcggggac

SEQ ID NO: 7047892 - DNA, 22 bp, Homo sapiens
agtgggagccagcagcttgggg

SEQ ID NO: 7047893 - DNA, 22 bp, Homo sapiens
agtgggagccagcagcttgggg

SEQ ID NO: 7047894 - DNA, 22 bp, Homo sapiens
agtgggaggaagtggtgatatt

SEQ ID NO: 7047895 - DNA, 22 bp, Homo sapiens
agtgggagcggcagtcggggac

SEQ ID NO: 7047896 - DNA, 22 bp, Homo sapiens
agtgggaggcggctgacgggcg

SEQ ID NO: 7047897 - DNA, 22 bp, Homo sapiens
agtgggaggaagtggtgatatt

SEQ ID NO: 7047898 - DNA, 22 bp, Homo sapiens
agtgggagggccatatggtgaa

SEQ ID NO: 7047899 - DNA, 22 bp, Homo sapiens
agtgctgttaggttaatatagt

SEQ ID NO: 7047900 - DNA, 22 bp, Homo sapiens
agtgctgttaggttaatatagt

SEQ ID NO: 7047901 - DNA, 22 bp, Homo sapiens
agtgctgttggataatgctgtc

SEQ ID NO: 7047902 - DNA, 22 bp, Homo sapiens
agtgcttaaaaccctgcactag

SEQ ID NO: 7047903 - DNA, 22 bp, Homo sapiens
agtgcttaatagatgtccagca

SEQ ID NO: 7047904 - DNA, 22 bp, Homo sapiens
agtgcttataccaaagactctt

SEQ ID NO: 7047905 - DNA, 22 bp, Homo sapiens
agtgctttacctagataatgtt

SEQ ID NO: 7047906 - DNA, 22 bp, Homo sapiens
agtgctttagagaaatggtgct

SEQ ID NO: 7047907 - DNA, 22 bp, Homo sapiens
agtgctttagcatccaactgtc

SEQ ID NO: 7047908 - DNA, 22 bp, Homo sapiens
agtgctttatgttgttgtgcaa

SEQ ID NO: 7047909 - DNA, 22 bp, Homo sapiens
agtgctttccctgaaaccttcc

SEQ ID NO: 7047910 - DNA, 22 bp, Homo sapiens
agtgctttccttcttgtgacat

SEQ ID NO: 7047911 - DNA, 22 bp, Homo sapiens
agtgctttcttgctccatcagt

SEQ ID NO: 7047912 - DNA, 22 bp, Homo sapiens
agtgctttgaacgaaaggctga

SEQ ID NO: 7047913 - DNA, 22 bp, Homo sapiens
agtgctttgagcgtttgaaaag

SEQ ID NO: 7047914 - DNA, 22 bp, Homo sapiens
agtgctttggtatagaactatt

SEQ ID NO: 7047915 - DNA, 22 bp, Homo sapiens
agtggcagacacaatgtgggca

SEQ ID NO: 7047916 - DNA, 22 bp, Homo sapiens
agtggcagacagagacagtacc

SEQ ID NO: 7047917 - DNA, 22 bp, Homo sapiens
agtggcagagcaggtgctggaa

SEQ ID NO: 7047918 - DNA, 22 bp, Homo sapiens
agtcctttgggaaaaatgacta

SEQ ID NO: 7047919 - DNA, 22 bp, Homo sapiens
agtgaatgtccccgcgggtcag

SEQ ID NO: 7047920 - DNA, 23 bp, Homo sapiens
agtgagcagctgtagggcaagga

SEQ ID NO: 7047921 - DNA, 22 bp, Homo sapiens
agtgagcattcgtttggaaccc

SEQ ID NO: 7047922 - DNA, 22 bp, Homo sapiens
agtgaggaaatccattatcaag

SEQ ID NO: 7047923 - DNA, 17 bp, Homo sapiens
agtgaggagattggaag

SEQ ID NO: 7047924 - DNA, 22 bp, Homo sapiens
agtgaggcaaagtgagaggcag

SEQ ID NO: 7047925 - DNA, 22 bp, Homo sapiens
agtgaggataccaatgtgtaga

SEQ ID NO: 7047926 - DNA, 22 bp, Homo sapiens
agtgaggctaataggcaatggt

SEQ ID NO: 7047927 - DNA, 22 bp, Homo sapiens
agtgattttgctttgaagtgac

SEQ ID NO: 7047928 - DNA, 22 bp, Homo sapiens
agtgcaaaattcagaagcaatt

SEQ ID NO: 7047929 - DNA, 20 bp, Homo sapiens
agtgcaagaaagcacagctg

SEQ ID NO: 7047930 - DNA, 23 bp, Homo sapiens
agtgctgaattgaaagctccagg

SEQ ID NO: 7047931 - DNA, 21 bp, Homo sapiens
agtggggtctctgtggaggcc

SEQ ID NO: 7047932 - DNA, 22 bp, Homo sapiens
agtggggtcctcagtatggttc

SEQ ID NO: 7047933 - DNA, 22 bp, Homo sapiens
agtgtctgaaccaccggggcat

SEQ ID NO: 7047934 - DNA, 22 bp, Homo sapiens
agtgtctggtctctgaactaaa

SEQ ID NO: 7047935 - DNA, 22 bp, Homo sapiens
agtgtctggtgagggctctctc

SEQ ID NO: 7047936 - DNA, 20 bp, Homo sapiens
agtgtctggtgcagggcctc

SEQ ID NO: 7047937 - DNA, 22 bp, Homo sapiens
agtgtctgtgaggggaattcct

SEQ ID NO: 7047938 - DNA, 22 bp, Homo sapiens
agtgtctgtgatgaggtcagga

SEQ ID NO: 7047939 - DNA, 22 bp, Homo sapiens
agtgtctgtgctttgcagcaaa

SEQ ID NO: 7047940 - DNA, 22 bp, Homo sapiens
agtgtctgtgttttctattgct

SEQ ID NO: 7047941 - DNA, 22 bp, Homo sapiens
agtgtctgttacgcttgcagaa

SEQ ID NO: 7047942 - DNA, 22 bp, Homo sapiens
agtgtctgttgagtttcaaaag

SEQ ID NO: 7047943 - DNA, 17 bp, Homo sapiens
agtgtgtgaaatggtgg

SEQ ID NO: 7047944 - DNA, 22 bp, Homo sapiens
agtgtctgttgcttttgcagtg

SEQ ID NO: 7047945 - DNA, 22 bp, Homo sapiens
agtgtctgttgttcagaactct

SEQ ID NO: 7047946 - DNA, 22 bp, Homo sapiens
actggtggctttcagacagaaa

SEQ ID NO: 7047947 - DNA, 22 bp, Homo sapiens
agttacaaacactatcagttct

SEQ ID NO: 7047948 - DNA, 22 bp, Homo sapiens
atacacatttgctagagatggg

SEQ ID NO: 7047949 - DNA, 22 bp, Homo sapiens
atacacagctacattgaacaat

SEQ ID NO: 7047950 - DNA, 22 bp, Homo sapiens
atacacagccattatgaattag

SEQ ID NO: 7047951 - DNA, 22 bp, Homo sapiens
atacacagcgatgagaggaggc

SEQ ID NO: 7047952 - DNA, 22 bp, Homo sapiens
ataaggaatgatgtatcagttt

SEQ ID NO: 7047953 - DNA, 22 bp, Homo sapiens
ataaatttataattgtttcctg

SEQ ID NO: 7047954 - DNA, 22 bp, Homo sapiens
ataacaatagtggtagtgctgg

SEQ ID NO: 7047955 - DNA, 19 bp, Homo sapiens
ataaataaaaagtgggaga

SEQ ID NO: 7047956 - DNA, 22 bp, Homo sapiens
ataaattatgaatggccctttt

SEQ ID NO: 7047957 - DNA, 22 bp, Homo sapiens
ataaattctctgatgtatagta

SEQ ID NO: 7047958 - DNA, 22 bp, Homo sapiens
ataaattctctgatgtatagta

SEQ ID NO: 7047959 - DNA, 21 bp, Homo sapiens
ataaattctgagaggctctgc

SEQ ID NO: 7047960 - DNA, 22 bp, Homo sapiens
agttcttttgtgaacatatgct

SEQ ID NO: 7047961 - DNA, 22 bp, Homo sapiens
agttgaaagccttatttctctg

SEQ ID NO: 7047962 - DNA, 22 bp, Homo sapiens
agttgaaggttggctgatccat

SEQ ID NO: 7047963 - DNA, 22 bp, Homo sapiens
agttcaggcataaggcatgaac

SEQ ID NO: 7047964 - DNA, 22 bp, Homo sapiens
agttcacatatctgttttattt

SEQ ID NO: 7047965 - DNA, 22 bp, Homo sapiens
actttacatttgatctctctaa

SEQ ID NO: 7047966 - DNA, 22 bp, Homo sapiens
atagaatagcatagaaaattga

SEQ ID NO: 7047967 - DNA, 22 bp, Homo sapiens
atagaatagcatagaaaattga

SEQ ID NO: 7047968 - DNA, 22 bp, Homo sapiens
atagaatagcatagaaaattga

SEQ ID NO: 7047969 - DNA, 22 bp, Homo sapiens
actttactccccaacataaatg

SEQ ID NO: 7047970 - DNA, 22 bp, Homo sapiens
atagatgtacgtatgtaaatca

SEQ ID NO: 7047971 - DNA, 22 bp, Homo sapiens
atagatgtcattgtcatccatc

SEQ ID NO: 7047972 - DNA, 22 bp, Homo sapiens
atagatgtgtgtaagtacataa

SEQ ID NO: 7047973 - DNA, 21 bp, Homo sapiens
atagaacaccaggcatatata

SEQ ID NO: 7047974 - DNA, 22 bp, Homo sapiens
atacacttcatgttttcatctg

SEQ ID NO: 7047975 - DNA, 20 bp, Homo sapiens
atacacttgcccagcttgtg

SEQ ID NO: 7047976 - DNA, 22 bp, Homo sapiens
atactgtttctcttctacatga

SEQ ID NO: 7047977 - DNA, 22 bp, Homo sapiens
atactgttttgtgacttatctt

SEQ ID NO: 7047978 - DNA, 22 bp, Homo sapiens
agaaaaggattgatggatcaga

SEQ ID NO: 7047979 - DNA, 17 bp, Homo sapiens
agaaaagagaccagcag

SEQ ID NO: 7047980 - DNA, 22 bp, Homo sapiens
agaaaagaggctttctaagcat

SEQ ID NO: 7047981 - DNA, 22 bp, Homo sapiens
agaaaagaggctttctaagcat

SEQ ID NO: 7047982 - DNA, 22 bp, Homo sapiens
atagttgtgtggggattctggt

SEQ ID NO: 7047983 - DNA, 22 bp, Homo sapiens
atagttccagcatctttggtaa

SEQ ID NO: 7047984 - DNA, 22 bp, Homo sapiens
agaaaaatcttggcgcttgtct

SEQ ID NO: 7047985 - DNA, 22 bp, Homo sapiens
agaaaacttgctcgagcctgtt

SEQ ID NO: 7047986 - DNA, 22 bp, Homo sapiens
agaaaacttgtcacagctctca

SEQ ID NO: 7047987 - DNA, 22 bp, Homo sapiens
agaaaacttgtcacagctctca

SEQ ID NO: 7047988 - DNA, 22 bp, Homo sapiens
atagctttttgtcatagagtct

SEQ ID NO: 7047989 - DNA, 22 bp, Homo sapiens
atagctgttagattggggtcga

SEQ ID NO: 7047990 - DNA, 22 bp, Homo sapiens
ataggatgataaaattagaaac

SEQ ID NO: 7047991 - DNA, 22 bp, Homo sapiens
ataggagatcaatatgcaattt

SEQ ID NO: 7047992 - DNA, 22 bp, Homo sapiens
ataggaaatcgctattaaccta

SEQ ID NO: 7047993 - DNA, 22 bp, Homo sapiens
atagttatgctctagacaagaa

SEQ ID NO: 7047994 - DNA, 22 bp, Homo sapiens
agaaagtttgtttttatccata

SEQ ID NO: 7047995 - DNA, 22 bp, Homo sapiens
agaaagttttgtgctatatatg

SEQ ID NO: 7047996 - DNA, 22 bp, Homo sapiens
agaaatagcagagtcaggcggg

SEQ ID NO: 7047997 - DNA, 19 bp, Homo sapiens
agaaatagccttccttgtc

SEQ ID NO: 7047998 - DNA, 22 bp, Homo sapiens
atattacacacggtatcacggg

SEQ ID NO: 7047999 - DNA, 22 bp, Homo sapiens
agaaatagtcacattggaggaa

SEQ ID NO: 7048000 - DNA, 20 bp, Homo sapiens
agaaatcagcatgtcctctg

SEQ ID NO: 7048001 - DNA, 18 bp, Homo sapiens
atcaaggaggggaaggtc

SEQ ID NO: 7048002 - DNA, 23 bp, Homo sapiens
atcaagtcatcagcaaaatacat

SEQ ID NO: 7048003 - DNA, 22 bp, Homo sapiens
atcaagtctgcctgtctggagg

SEQ ID NO: 7048004 - DNA, 22 bp, Homo sapiens
atcaagttctgtcacatttgtc

SEQ ID NO: 7048005 - DNA, 22 bp, Homo sapiens
atcaatgacagttgaattctac

SEQ ID NO: 7048006 - DNA, 22 bp, Homo sapiens
atcaattttgaggatacaagaa

SEQ ID NO: 7048007 - DNA, 22 bp, Homo sapiens
atattaaaactatggttttcag

SEQ ID NO: 7048008 - DNA, 22 bp, Homo sapiens
atattaaatggattttgggagc

SEQ ID NO: 7048009 - DNA, 22 bp, Homo sapiens
atattaatgggatttagtcagg

SEQ ID NO: 7048010 - DNA, 22 bp, Homo sapiens
atattaatgggatttagtcagg

SEQ ID NO: 7048011 - DNA, 22 bp, Homo sapiens
atatagtaagcagtctgtaaat

SEQ ID NO: 7048012 - DNA, 22 bp, Homo sapiens
atatagtaagcagtctgtaaat

SEQ ID NO: 7048013 - DNA, 22 bp, Homo sapiens
agaaaagggcaggagggataca

SEQ ID NO: 7048014 - DNA, 22 bp, Homo sapiens
atatagaaggtgctatttacat

SEQ ID NO: 7048015 - DNA, 22 bp, Homo sapiens
atatagaaggtgctatttacat

SEQ ID NO: 7048016 - DNA, 22 bp, Homo sapiens
atatagttgggtttcattctac

SEQ ID NO: 7048017 - DNA, 22 bp, Homo sapiens
atatagtttaagaaagtacagt

SEQ ID NO: 7048018 - DNA, 22 bp, Homo sapiens
agaaacttcagctattcttttg

SEQ ID NO: 7048019 - DNA, 22 bp, Homo sapiens
agaagcagttattttttgcaca

SEQ ID NO: 7048020 - DNA, 20 bp, Homo sapiens
agaagcatcattctgatgtc

SEQ ID NO: 7048021 - DNA, 22 bp, Homo sapiens
agaagcattataacatgcaagg

SEQ ID NO: 7048022 - DNA, 22 bp, Homo sapiens
agaagcattatttaattttact

SEQ ID NO: 7048023 - DNA, 20 bp, Homo sapiens
agaagcattcaaagaaaact

SEQ ID NO: 7048024 - DNA, 20 bp, Homo sapiens
agaagcattcaaagaaaact

SEQ ID NO: 7048025 - DNA, 22 bp, Homo sapiens
agaagcattggaccaggggccc

SEQ ID NO: 7048026 - DNA, 22 bp, Homo sapiens
agaagccaaatgccagtgacct

SEQ ID NO: 7048027 - DNA, 22 bp, Homo sapiens
agaagccaacagggcaggagag

SEQ ID NO: 7048028 - DNA, 23 bp, Homo sapiens
atcctgctgatggccctccagga

SEQ ID NO: 7048029 - DNA, 22 bp, Homo sapiens
atcctgctgctgtggacttctc

SEQ ID NO: 7048030 - DNA, 22 bp, Homo sapiens
atcctgggaatgggagggtcat

SEQ ID NO: 7048031 - DNA, 22 bp, Homo sapiens
atcctgggaagctgacattgaa

SEQ ID NO: 7048032 - DNA, 22 bp, Homo sapiens
agaagccaccagctgaggaaga

SEQ ID NO: 7048033 - DNA, 22 bp, Homo sapiens
agaagccatagtatctcagggt

SEQ ID NO: 7048034 - DNA, 22 bp, Homo sapiens
agaagccatagtctgggaggca

SEQ ID NO: 7048035 - DNA, 22 bp, Homo sapiens
agaagccatggtatgcaactac

SEQ ID NO: 7048036 - DNA, 21 bp, Homo sapiens
agaagccatgtggtggagaac

SEQ ID NO: 7048037 - DNA, 22 bp, Homo sapiens
agaagccatgtttagtaggatg

SEQ ID NO: 7048038 - DNA, 22 bp, Homo sapiens
agaagccattccctgtaggctc

SEQ ID NO: 7048039 - DNA, 22 bp, Homo sapiens
agaagccattccctgtaggctc

SEQ ID NO: 7048040 - DNA, 22 bp, Homo sapiens
agaagccattgaagcagacctc

SEQ ID NO: 7048041 - DNA, 21 bp, Homo sapiens
agaagcctgggtggaggtggg

SEQ ID NO: 7048042 - DNA, 22 bp, Homo sapiens
agaagctgcgtttatttaaatc

SEQ ID NO: 7048043 - DNA, 22 bp, Homo sapiens
agaagctgcctacatgaccagc

SEQ ID NO: 7048044 - DNA, 20 bp, Homo sapiens
atctgcttgcctgtcctcgg

SEQ ID NO: 7048045 - DNA, 22 bp, Homo sapiens
atctgcttttgagaatttactt

SEQ ID NO: 7048046 - DNA, 22 bp, Homo sapiens
atgatttaaagtcattgtgaac

SEQ ID NO: 7048047 - DNA, 22 bp, Homo sapiens
atgattctggtgagaatgagga

SEQ ID NO: 7048048 - DNA, 22 bp, Homo sapiens
atgattgaaaatgacattgcca

SEQ ID NO: 7048049 - DNA, 22 bp, Homo sapiens
atgattgaccatctgctgggct

SEQ ID NO: 7048050 - DNA, 22 bp, Homo sapiens
atgattctaaacttaaggggga

SEQ ID NO: 7048051 - DNA, 22 bp, Homo sapiens
atgaggcaatcatggtccagtt

SEQ ID NO: 7048052 - DNA, 22 bp, Homo sapiens
atgaggcacatcacagccaatg

SEQ ID NO: 7048053 - DNA, 22 bp, Homo sapiens
atgaggcacgtgttactggcct

SEQ ID NO: 7048054 - DNA, 22 bp, Homo sapiens
atgatatagagagtagattaaa

SEQ ID NO: 7048055 - DNA, 22 bp, Homo sapiens
atgatatatgtgttgagcttgc

SEQ ID NO: 7048056 - DNA, 22 bp, Homo sapiens
atgaggcaaaggtggaggtggg

SEQ ID NO: 7048057 - DNA, 22 bp, Homo sapiens
atgaggatgttagtggactgga

SEQ ID NO: 7048058 - DNA, 22 bp, Homo sapiens
atgaggcaaaggtggaggtggg

SEQ ID NO: 7048059 - DNA, 22 bp, Homo sapiens
atgaggcaaggctggccgtgtt

SEQ ID NO: 7048060 - DNA, 22 bp, Homo sapiens
atgacttttaaaagctggtact

SEQ ID NO: 7048061 - DNA, 22 bp, Homo sapiens
atgacttattacaagtcatatt

SEQ ID NO: 7048062 - DNA, 22 bp, Homo sapiens
atgacttcgttttctctctgca

SEQ ID NO: 7048063 - DNA, 22 bp, Homo sapiens
atgacttctgcaaggtcatttg

SEQ ID NO: 7048064 - DNA, 22 bp, Homo sapiens
atgactttcctggcaaaagttg

SEQ ID NO: 7048065 - DNA, 22 bp, Homo sapiens
atgaggagaccaaggcctgatg

SEQ ID NO: 7048066 - DNA, 22 bp, Homo sapiens
atgaccagccgagataaacaga

SEQ ID NO: 7048067 - DNA, 22 bp, Homo sapiens
atgaccagtgttgctggccccg

SEQ ID NO: 7048068 - DNA, 22 bp, Homo sapiens
atcttagagagtcgtgttttgt

SEQ ID NO: 7048069 - DNA, 22 bp, Homo sapiens
atctggggaggtatctgtagtc

SEQ ID NO: 7048070 - DNA, 22 bp, Homo sapiens
atctggggtcagacagccctgg

SEQ ID NO: 7048071 - DNA, 22 bp, Homo sapiens
atgccactgcactccagcctag

SEQ ID NO: 7048072 - DNA, 22 bp, Homo sapiens
atgccaggaacaaacagtggtg

SEQ ID NO: 7048073 - DNA, 22 bp, Homo sapiens
atgccagggtcatcccctgggt

SEQ ID NO: 7048074 - DNA, 22 bp, Homo sapiens
agacagtgtgagttcagggtgg

SEQ ID NO: 7048075 - DNA, 22 bp, Homo sapiens
agacagtgtgtgtatatatggt

SEQ ID NO: 7048076 - DNA, 22 bp, Homo sapiens
agacataagccagtcactcact

SEQ ID NO: 7048077 - DNA, 22 bp, Homo sapiens
agacataagtgctatgacattg

SEQ ID NO: 7048078 - DNA, 22 bp, Homo sapiens
agacatagaaaatcattaggaa

SEQ ID NO: 7048079 - DNA, 22 bp, Homo sapiens
agacatagataggcactgattg

SEQ ID NO: 7048080 - DNA, 22 bp, Homo sapiens
atgcttgaaaaccccatgaata

SEQ ID NO: 7048081 - DNA, 22 bp, Homo sapiens
agagaaaagccatcccagccaa

SEQ ID NO: 7048082 - DNA, 22 bp, Homo sapiens
atgctgaggtgtgtttaattta

SEQ ID NO: 7048083 - DNA, 22 bp, Homo sapiens
atgctgagactggagcagctgg

SEQ ID NO: 7048084 - DNA, 22 bp, Homo sapiens
atgctgagataaggctttagtc

SEQ ID NO: 7048085 - DNA, 22 bp, Homo sapiens
atgctgagatcctcaggccaga

SEQ ID NO: 7048086 - DNA, 22 bp, Homo sapiens
atgctgcagctgcaggatcaga

SEQ ID NO: 7048087 - DNA, 22 bp, Homo sapiens
agacataggattccacatagca

SEQ ID NO: 7048088 - DNA, 22 bp, Homo sapiens
atgctgaagaatcacagggact

SEQ ID NO: 7048089 - DNA, 22 bp, Homo sapiens
atgctgaagagtgcacaggcta

SEQ ID NO: 7048090 - DNA, 22 bp, Homo sapiens
atgctgaagagtgcacaggcta

SEQ ID NO: 7048091 - DNA, 22 bp, Homo sapiens
atgctgaagagttcatgattat

SEQ ID NO: 7048092 - DNA, 22 bp, Homo sapiens
atgctgaaggtgaattgacaat

SEQ ID NO: 7048093 - DNA, 22 bp, Homo sapiens
atgctgaatagttcactcttct

SEQ ID NO: 7048094 - DNA, 22 bp, Homo sapiens
atgctgaatattagcctcatga

SEQ ID NO: 7048095 - DNA, 22 bp, Homo sapiens
atgctgaattgatgcgagggag

SEQ ID NO: 7048096 - DNA, 22 bp, Homo sapiens
atgctgacagactattaactat

SEQ ID NO: 7048097 - DNA, 22 bp, Homo sapiens
atgctgacttctctctgcagtg

SEQ ID NO: 7048098 - DNA, 21 bp, Homo sapiens
atgtagtgacttcattccttc

SEQ ID NO: 7048099 - DNA, 22 bp, Homo sapiens
atgtagtgccctttgtcatcta

SEQ ID NO: 7048100 - DNA, 22 bp, Homo sapiens
atgtagtgtagagattagtctc

SEQ ID NO: 7048101 - DNA, 20 bp, Homo sapiens
atgtatattactggctgtga

SEQ ID NO: 7048102 - DNA, 22 bp, Homo sapiens
agagactgctttatattgtact

SEQ ID NO: 7048103 - DNA, 21 bp, Homo sapiens
agagactgtcactgcagtacc

SEQ ID NO: 7048104 - DNA, 22 bp, Homo sapiens
agagactgtgtccatcgtgcct

SEQ ID NO: 7048105 - DNA, 22 bp, Homo sapiens
agagacttctgccttagcaaga

SEQ ID NO: 7048106 - DNA, 22 bp, Homo sapiens
atgtagggaactaaattcactg

SEQ ID NO: 7048107 - DNA, 22 bp, Homo sapiens
atgggcagttaggaggccagga

SEQ ID NO: 7048108 - DNA, 22 bp, Homo sapiens
atggacaggcttataacagcaa

SEQ ID NO: 7048109 - DNA, 23 bp, Homo sapiens
atggacagggtttcagggtcaca

SEQ ID NO: 7048110 - DNA, 18 bp, Homo sapiens
atgggaggggccaagaga

SEQ ID NO: 7048111 - DNA, 22 bp, Homo sapiens
atggacagcaactggaagcttc

SEQ ID NO: 7048112 - DNA, 22 bp, Homo sapiens
agagaagacttacagccacagt

SEQ ID NO: 7048113 - DNA, 22 bp, Homo sapiens
atgtgcaatggtgtcaccacat

SEQ ID NO: 7048114 - DNA, 22 bp, Homo sapiens
agagatgtatgcatttgtcaca

SEQ ID NO: 7048115 - DNA, 22 bp, Homo sapiens
atgttacacataggcataaatg

SEQ ID NO: 7048116 - DNA, 22 bp, Homo sapiens
agagccaggaagtggcgtgggg

SEQ ID NO: 7048117 - DNA, 22 bp, Homo sapiens
agagccaggactgtgtctcact

SEQ ID NO: 7048118 - DNA, 22 bp, Homo sapiens
agagccaggactgtgtctcact

SEQ ID NO: 7048119 - DNA, 22 bp, Homo sapiens
agagccagcatttgacactggc

SEQ ID NO: 7048120 - DNA, 22 bp, Homo sapiens
agagccagcatttgacactggc

SEQ ID NO: 7048121 - DNA, 22 bp, Homo sapiens
agagccagcatttgacactggc

SEQ ID NO: 7048122 - DNA, 22 bp, Homo sapiens
atgtgcatgcacttacatgtgt

SEQ ID NO: 7048123 - DNA, 22 bp, Homo sapiens
agagccaggaagtggcgtgggg

SEQ ID NO: 7048124 - DNA, 22 bp, Homo sapiens
agagccaggaagtggcgtgggg

SEQ ID NO: 7048125 - DNA, 22 bp, Homo sapiens
atgttcaaactttttacacacc

SEQ ID NO: 7048126 - DNA, 22 bp, Homo sapiens
agagctataacagcactgtaca

SEQ ID NO: 7048127 - DNA, 22 bp, Homo sapiens
agagctcaagacgctcacagta

SEQ ID NO: 7048128 - DNA, 22 bp, Homo sapiens
agagctcaagacgctcacagta

SEQ ID NO: 7048129 - DNA, 22 bp, Homo sapiens
agagctctgcagctggcctcag

SEQ ID NO: 7048130 - DNA, 22 bp, Homo sapiens
attaaatactgcaggctaagca

SEQ ID NO: 7048131 - DNA, 22 bp, Homo sapiens
attaaggaacaaagccttttga

SEQ ID NO: 7048132 - DNA, 22 bp, Homo sapiens
attaaggaagcctattctctcc

SEQ ID NO: 7048133 - DNA, 22 bp, Homo sapiens
attaaggaatgtaggcaagaag

SEQ ID NO: 7048134 - DNA, 18 bp, Homo sapiens
attaaggaattctttaga

SEQ ID NO: 7048135 - DNA, 22 bp, Homo sapiens
attaaggagggctgggcatgat

SEQ ID NO: 7048136 - DNA, 22 bp, Homo sapiens
attaaggaggtaaactatggtt

SEQ ID NO: 7048137 - DNA, 22 bp, Homo sapiens
attaaggattatactctccttt

SEQ ID NO: 7048138 - DNA, 22 bp, Homo sapiens
attttttatataccaaggtggg

SEQ ID NO: 7048139 - DNA, 22 bp, Homo sapiens
attttttcagattgagtgttaa

SEQ ID NO: 7048140 - DNA, 22 bp, Homo sapiens
attttttagccaagactctgca

SEQ ID NO: 7048141 - DNA, 22 bp, Homo sapiens
attttgttgatggtggagtagc

SEQ ID NO: 7048142 - DNA, 22 bp, Homo sapiens
attttgttatagaactctgtga

SEQ ID NO: 7048143 - DNA, 23 bp, Homo sapiens
attttttgtctttgtaactagat

SEQ ID NO: 7048144 - DNA, 22 bp, Homo sapiens
agcaaggctcttaatgcccaaa

SEQ ID NO: 7048145 - DNA, 22 bp, Homo sapiens
caaacattgctaccagaggttt

SEQ ID NO: 7048146 - DNA, 22 bp, Homo sapiens
caaacatttgacttctctcagg

SEQ ID NO: 7048147 - DNA, 22 bp, Homo sapiens
caaagggctctagactcagcag

SEQ ID NO: 7048148 - DNA, 22 bp, Homo sapiens
caaagtgctgggattacaggct

SEQ ID NO: 7048149 - DNA, 22 bp, Homo sapiens
caaagtgctgggattacaggtg

SEQ ID NO: 7048150 - DNA, 22 bp, Homo sapiens
agattgtgtcaatttctcttta

SEQ ID NO: 7048151 - DNA, 22 bp, Homo sapiens
agatttacaaaggatttgcttt

SEQ ID NO: 7048152 - DNA, 19 bp, Homo sapiens
agatttacctcatatagtt

SEQ ID NO: 7048153 - DNA, 22 bp, Homo sapiens
agatttagctgtgaacagcttg

SEQ ID NO: 7048154 - DNA, 22 bp, Homo sapiens
agatttatgtggtcacactcag

SEQ ID NO: 7048155 - DNA, 22 bp, Homo sapiens
agatttatgtggtcacactcag

SEQ ID NO: 7048156 - DNA, 22 bp, Homo sapiens
agatttatgtggtcacactcag

SEQ ID NO: 7048157 - DNA, 22 bp, Homo sapiens
attttctgtaactatttctata

SEQ ID NO: 7048158 - DNA, 20 bp, Homo sapiens
attttggtgaacacagcttc

SEQ ID NO: 7048159 - DNA, 22 bp, Homo sapiens
agatgatggccatgtcctctcc

SEQ ID NO: 7048160 - DNA, 21 bp, Homo sapiens
agattcataatctgtaaaatg

SEQ ID NO: 7048161 - DNA, 22 bp, Homo sapiens
agattcatgggaaagctttagg

SEQ ID NO: 7048162 - DNA, 22 bp, Homo sapiens
agattcattatcttctttgtac

SEQ ID NO: 7048163 - DNA, 23 bp, Homo sapiens
atttgaaactttcttgtttccag

SEQ ID NO: 7048164 - DNA, 22 bp, Homo sapiens
atttcttttcaagagggtgctt

SEQ ID NO: 7048165 - DNA, 22 bp, Homo sapiens
atttcttttcaagagggtgctt

SEQ ID NO: 7048166 - DNA, 22 bp, Homo sapiens
atttctttctggccacggtttt

SEQ ID NO: 7048167 - DNA, 22 bp, Homo sapiens
atttctgataaacgtaagctgc

SEQ ID NO: 7048168 - DNA, 22 bp, Homo sapiens
atttctcttagcaagacattac

SEQ ID NO: 7048169 - DNA, 22 bp, Homo sapiens
atttacaggacagcttggcatt

SEQ ID NO: 7048170 - DNA, 19 bp, Homo sapiens
atttgaaagctgtgcttgc

SEQ ID NO: 7048171 - DNA, 22 bp, Homo sapiens
atttgaagaaagttttctagat

SEQ ID NO: 7048172 - DNA, 22 bp, Homo sapiens
atttgaatggcttaacacaacg

SEQ ID NO: 7048173 - DNA, 21 bp, Homo sapiens
agatgaggatactgaggccta

SEQ ID NO: 7048174 - DNA, 21 bp, Homo sapiens
agatgaggatactgaggccta

SEQ ID NO: 7048175 - DNA, 23 bp, Homo sapiens
agatgaggcttctccatgttggt

SEQ ID NO: 7048176 - DNA, 22 bp, Homo sapiens
agatgaggggtagaaaggactt

SEQ ID NO: 7048177 - DNA, 22 bp, Homo sapiens
agatgaggggtagaaaggactt

SEQ ID NO: 7048178 - DNA, 22 bp, Homo sapiens
agatgagtaaatggagtcttcc

SEQ ID NO: 7048179 - DNA, 22 bp, Homo sapiens
agatacaactgtttaaacatta

SEQ ID NO: 7048180 - DNA, 22 bp, Homo sapiens
agatacagcctgccaggttctt

SEQ ID NO: 7048181 - DNA, 22 bp, Homo sapiens
attgttaataactattacattg

SEQ ID NO: 7048182 - DNA, 22 bp, Homo sapiens
agataaattcctaagatttcag

SEQ ID NO: 7048183 - DNA, 22 bp, Homo sapiens
agataatttgagtaaattaatt

SEQ ID NO: 7048184 - DNA, 22 bp, Homo sapiens
agatacaaaggcctacagagca

SEQ ID NO: 7048185 - DNA, 22 bp, Homo sapiens
attgtatttccagcttgaatgt

SEQ ID NO: 7048186 - DNA, 22 bp, Homo sapiens
attgtggtgtcagttataggca

SEQ ID NO: 7048187 - DNA, 22 bp, Homo sapiens
attgttaaaaaggtggaaatgc

SEQ ID NO: 7048188 - DNA, 22 bp, Homo sapiens
attgttaaactgaagcattact

SEQ ID NO: 7048189 - DNA, 22 bp, Homo sapiens
attgttaaagtaataaccatgg

SEQ ID NO: 7048190 - DNA, 22 bp, Homo sapiens
attgtataagtctatttacaat

SEQ ID NO: 7048191 - DNA, 22 bp, Homo sapiens
attggtggtgaggacatgccag

SEQ ID NO: 7048192 - DNA, 22 bp, Homo sapiens
attgtataacagcatgtatttt

SEQ ID NO: 7048193 - DNA, 22 bp, Homo sapiens
attgtataagtctatttacaat

SEQ ID NO: 7048194 - DNA, 22 bp, Homo sapiens
attgaaaataaggccagaaaca

SEQ ID NO: 7048195 - DNA, 22 bp, Homo sapiens
attgaaagataggctactgtgg

SEQ ID NO: 7048196 - DNA, 22 bp, Homo sapiens
attgaaaggttttgagcagata

SEQ ID NO: 7048197 - DNA, 22 bp, Homo sapiens
attctctggctaaaacctgaag

SEQ ID NO: 7048198 - DNA, 22 bp, Homo sapiens
attctacaacccaataataatt

SEQ ID NO: 7048199 - DNA, 20 bp, Homo sapiens
attctacaagaataagcatg

SEQ ID NO: 7048200 - DNA, 19 bp, Homo sapiens
attctccctagaattttga

SEQ ID NO: 7048201 - DNA, 22 bp, Homo sapiens
attctctcatttatctgtccta

SEQ ID NO: 7048202 - DNA, 22 bp, Homo sapiens
attctctctagaagctgagatg

SEQ ID NO: 7048203 - DNA, 22 bp, Homo sapiens
attctctctctatgaaaactga

SEQ ID NO: 7048204 - DNA, 22 bp, Homo sapiens
attctctcttctgctgcccgtg

SEQ ID NO: 7048205 - DNA, 22 bp, Homo sapiens
attctaattagttctacatgtt

SEQ ID NO: 7048206 - DNA, 22 bp, Homo sapiens
attcgcgggcctggagggtggg

SEQ ID NO: 7048207 - DNA, 20 bp, Homo sapiens
attctaaagctctgctcttt

SEQ ID NO: 7048208 - DNA, 22 bp, Homo sapiens
attcccaggtaaaagtagagct

SEQ ID NO: 7048209 - DNA, 22 bp, Homo sapiens
agaggaagccattgcttactga

SEQ ID NO: 7048210 - DNA, 22 bp, Homo sapiens
attaatacattatagggattgt

SEQ ID NO: 7048211 - DNA, 23 bp, Homo sapiens
agagctttctaaaatgtaaatct

SEQ ID NO: 7048212 - DNA, 22 bp, Homo sapiens
attattttatgtgcggcctgat

SEQ ID NO: 7048213 - DNA, 22 bp, Homo sapiens
attattttatgtgcggcctgat

SEQ ID NO: 7048214 - DNA, 22 bp, Homo sapiens
agaggccggccgagcccatggg

SEQ ID NO: 7048215 - DNA, 22 bp, Homo sapiens
agaggccgggtgcctgctcaga

SEQ ID NO: 7048216 - DNA, 22 bp, Homo sapiens
agaggcctaattgctacccttt

SEQ ID NO: 7048217 - DNA, 22 bp, Homo sapiens
agaggcctccctcccagctggt

SEQ ID NO: 7048218 - DNA, 20 bp, Homo sapiens
agctgaggcacctgaggtta

SEQ ID NO: 7048219 - DNA, 20 bp, Homo sapiens
agctgaggcacctgaggtta

SEQ ID NO: 7048220 - DNA, 22 bp, Homo sapiens
cagctgctttagttttccatcc

SEQ ID NO: 7048221 - DNA, 22 bp, Homo sapiens
cagctgctttcagcaggaggga

SEQ ID NO: 7048222 - DNA, 22 bp, Homo sapiens
cagctggcaagtggagcagggt

SEQ ID NO: 7048223 - DNA, 22 bp, Homo sapiens
cagctggcaagtggagcagggt

SEQ ID NO: 7048224 - DNA, 22 bp, Homo sapiens
cagctggcagaacctgcatcca

SEQ ID NO: 7048225 - DNA, 22 bp, Homo sapiens
cagctggcagccctggccctgc

SEQ ID NO: 7048226 - DNA, 22 bp, Homo sapiens
agctgaggaggaatgatgggta

SEQ ID NO: 7048227 - DNA, 22 bp, Homo sapiens
agctgaggaggaatgatgggta

SEQ ID NO: 7048228 - DNA, 22 bp, Homo sapiens
agctgaggaataataacaaggt

SEQ ID NO: 7048229 - DNA, 22 bp, Homo sapiens
agctgaggacgtgaagggcggc

SEQ ID NO: 7048230 - DNA, 22 bp, Homo sapiens
agctgaggacgtgaagggcggc

SEQ ID NO: 7048231 - DNA, 17 bp, Homo sapiens
agctgagctggccaggg

SEQ ID NO: 7048232 - DNA, 22 bp, Homo sapiens
agctgagctgcagatgactgta

SEQ ID NO: 7048233 - DNA, 22 bp, Homo sapiens
agctgagccagcagcaacagga

SEQ ID NO: 7048234 - DNA, 22 bp, Homo sapiens
agctgagctcaggctgatgtaa

SEQ ID NO: 7048235 - DNA, 22 bp, Homo sapiens
agctctgggagtagttccacct

SEQ ID NO: 7048236 - DNA, 22 bp, Homo sapiens
agctgagccagcagcaacagga

SEQ ID NO: 7048237 - DNA, 22 bp, Homo sapiens
cagcctctgagccttggcagat

SEQ ID NO: 7048238 - DNA, 22 bp, Homo sapiens
cagccttcgacagttggagtag

SEQ ID NO: 7048239 - DNA, 22 bp, Homo sapiens
cagcgcctcctggacctcctct

SEQ ID NO: 7048240 - DNA, 22 bp, Homo sapiens
cagcgctggggtaggagcacct

SEQ ID NO: 7048241 - DNA, 22 bp, Homo sapiens
cagcggccggtgaggaagggga

SEQ ID NO: 7048242 - DNA, 22 bp, Homo sapiens
cagctgagagtagaaatggagg

SEQ ID NO: 7048243 - DNA, 22 bp, Homo sapiens
cagctgagagtagaaatggagg

SEQ ID NO: 7048244 - DNA, 22 bp, Homo sapiens
cagctgagcatcactagtctgg

SEQ ID NO: 7048245 - DNA, 18 bp, Homo sapiens
cagctgccagctcatgga

SEQ ID NO: 7048246 - DNA, 22 bp, Homo sapiens
agcgccactgcactccagcctg

SEQ ID NO: 7048247 - DNA, 22 bp, Homo sapiens
agcgagggaggtctgaggacag

SEQ ID NO: 7048248 - DNA, 22 bp, Homo sapiens
agcgagtgggtcagcgttgcag

SEQ ID NO: 7048249 - DNA, 22 bp, Homo sapiens
agcgagtgggtcagcgttgcag

SEQ ID NO: 7048250 - DNA, 22 bp, Homo sapiens
agcgcgctcgatggtttccgcg

SEQ ID NO: 7048251 - DNA, 22 bp, Homo sapiens
agcgcgctctaggacaccgcgg

SEQ ID NO: 7048252 - DNA, 22 bp, Homo sapiens
agcgcgctgtcagactggctcg

SEQ ID NO: 7048253 - DNA, 22 bp, Homo sapiens
cagcatggtgccagtgagtcca

SEQ ID NO: 7048254 - DNA, 22 bp, Homo sapiens
agcgagggaggtctgaggacag

SEQ ID NO: 7048255 - DNA, 22 bp, Homo sapiens
cagccagtgtgaccgaggagga

SEQ ID NO: 7048256 - DNA, 22 bp, Homo sapiens
cagcccacgtcagggccactca

SEQ ID NO: 7048257 - DNA, 22 bp, Homo sapiens
cagccatcagtaaagacagctt

SEQ ID NO: 7048258 - DNA, 22 bp, Homo sapiens
cagcctcctgggacactcaccg

SEQ ID NO: 7048259 - DNA, 22 bp, Homo sapiens
cagcctctaagcacagcctctc

SEQ ID NO: 7048260 - DNA, 22 bp, Homo sapiens
cagagtggcactctgctggatg

SEQ ID NO: 7048261 - DNA, 22 bp, Homo sapiens
agccctcctggggccacgctgg

SEQ ID NO: 7048262 - DNA, 22 bp, Homo sapiens
agccctcctttgttcatgctgc

SEQ ID NO: 7048263 - DNA, 22 bp, Homo sapiens
agccctctctatggccctcttg

SEQ ID NO: 7048264 - DNA, 22 bp, Homo sapiens
agccctgggctgtagataagca

SEQ ID NO: 7048265 - DNA, 22 bp, Homo sapiens
cagaggaggcggtatacactgc

SEQ ID NO: 7048266 - DNA, 22 bp, Homo sapiens
cagaggaggcggtatacactgc

SEQ ID NO: 7048267 - DNA, 22 bp, Homo sapiens
cagaggaggcggtatacactgc

SEQ ID NO: 7048268 - DNA, 22 bp, Homo sapiens
cagaggagaattgcgggatcat

SEQ ID NO: 7048269 - DNA, 18 bp, Homo sapiens
cagaggagagacattcag

SEQ ID NO: 7048270 - DNA, 17 bp, Homo sapiens
cagaggagctttggggg

SEQ ID NO: 7048271 - DNA, 20 bp, Homo sapiens
cagaggagtacatatgttca

SEQ ID NO: 7048272 - DNA, 22 bp, Homo sapiens
cagaggagttcagtacacagcc

SEQ ID NO: 7048273 - DNA, 22 bp, Homo sapiens
cagagtgaaataggggatcaag

SEQ ID NO: 7048274 - DNA, 22 bp, Homo sapiens
cagagtgaacagtgggatgtgc

SEQ ID NO: 7048275 - DNA, 22 bp, Homo sapiens
cagagtgatggcacctgctggg

SEQ ID NO: 7048276 - DNA, 23 bp, Homo sapiens
cagatcatatatccagctgtaag

SEQ ID NO: 7048277 - DNA, 22 bp, Homo sapiens
cagatcataacagatacataga

SEQ ID NO: 7048278 - DNA, 22 bp, Homo sapiens
agcctaggtttccgattctctt

SEQ ID NO: 7048279 - DNA, 22 bp, Homo sapiens
agcctgcttgagagtcctggct

SEQ ID NO: 7048280 - DNA, 22 bp, Homo sapiens
cagatgaagatcatagaatagt

SEQ ID NO: 7048281 - DNA, 22 bp, Homo sapiens
cagatctgctcctctgtccatg

SEQ ID NO: 7048282 - DNA, 22 bp, Homo sapiens
cagatctgtggtatctctattt

SEQ ID NO: 7048283 - DNA, 22 bp, Homo sapiens
cagatgaactgtgactgaaaat

SEQ ID NO: 7048284 - DNA, 22 bp, Homo sapiens
agccaggggagtcagctgctgg

SEQ ID NO: 7048285 - DNA, 22 bp, Homo sapiens
cagagcaccagtgggagacaag

SEQ ID NO: 7048286 - DNA, 22 bp, Homo sapiens
cagagcaggggtttcccaggtt

SEQ ID NO: 7048287 - DNA, 23 bp, Homo sapiens
agccagggcactggtggagattg

SEQ ID NO: 7048288 - DNA, 23 bp, Homo sapiens
agccagggcactggtggagattg

SEQ ID NO: 7048289 - DNA, 22 bp, Homo sapiens
agccagggatgcagcacagtga

SEQ ID NO: 7048290 - DNA, 22 bp, Homo sapiens
agccagggaaggataacaagaa

SEQ ID NO: 7048291 - DNA, 22 bp, Homo sapiens
agccagggacgctgcaggctac

SEQ ID NO: 7048292 - DNA, 22 bp, Homo sapiens
agccaggctgcagttggctggc

SEQ ID NO: 7048293 - DNA, 16 bp, Homo sapiens
agccaggctgcctcgg

SEQ ID NO: 7048294 - DNA, 22 bp, Homo sapiens
agccaggcgcagtggcttatgc

SEQ ID NO: 7048295 - DNA, 20 bp, Homo sapiens
cagagccagggttttgtttt

SEQ ID NO: 7048296 - DNA, 20 bp, Homo sapiens
cagagccagggttttgtttt

SEQ ID NO: 7048297 - DNA, 22 bp, Homo sapiens
cagagccaggtggtgttggggc

SEQ ID NO: 7048298 - DNA, 22 bp, Homo sapiens
cagagccagggttgcacccctg

SEQ ID NO: 7048299 - DNA, 22 bp, Homo sapiens
cagagcagtccttgtcaatcag

SEQ ID NO: 7048300 - DNA, 22 bp, Homo sapiens
cagagcagtctggagatccagc

SEQ ID NO: 7048301 - DNA, 22 bp, Homo sapiens
cagagctgtccaaaccctgaca

SEQ ID NO: 7048302 - DNA, 22 bp, Homo sapiens
cagagctgttgcggggcttggc

SEQ ID NO: 7048303 - DNA, 22 bp, Homo sapiens
cagagctgttgcggggcttggc

SEQ ID NO: 7048304 - DNA, 22 bp, Homo sapiens
cagagcttaaaactccatggaa

SEQ ID NO: 7048305 - DNA, 21 bp, Homo sapiens
cagagctgtccaaaccctgac

SEQ ID NO: 7048306 - DNA, 23 bp, Homo sapiens
cagagctggctcagagctgcctg

SEQ ID NO: 7048307 - DNA, 22 bp, Homo sapiens
cagagccatcccagcctgtggt

SEQ ID NO: 7048308 - DNA, 21 bp, Homo sapiens
caattacagatggctcagggg

SEQ ID NO: 7048309 - DNA, 22 bp, Homo sapiens
caattacatttattgagcattc

SEQ ID NO: 7048310 - DNA, 22 bp, Homo sapiens
caagtccttttcttggctcagg

SEQ ID NO: 7048311 - DNA, 22 bp, Homo sapiens
caagtctgacctctgggtgaag

SEQ ID NO: 7048312 - DNA, 22 bp, Homo sapiens
caagggaaggctaagggcaaca

SEQ ID NO: 7048313 - DNA, 22 bp, Homo sapiens
agcaatttcccatctcttctgc

SEQ ID NO: 7048314 - DNA, 22 bp, Homo sapiens
caaggaaaacagatgatcaaca

SEQ ID NO: 7048315 - DNA, 22 bp, Homo sapiens
caaggaaaagaagtatttcaga

SEQ ID NO: 7048316 - DNA, 21 bp, Homo sapiens
agcagacagatgcacgcacac

SEQ ID NO: 7048317 - DNA, 21 bp, Homo sapiens
agcagacagatgcacgcacac

SEQ ID NO: 7048318 - DNA, 22 bp, Homo sapiens
agcagacaggctgccacagtgc

SEQ ID NO: 7048319 - DNA, 22 bp, Homo sapiens
agcagacatatctcatgtcaca

SEQ ID NO: 7048320 - DNA, 22 bp, Homo sapiens
agcagaccaggagtgcacaggt

SEQ ID NO: 7048321 - DNA, 22 bp, Homo sapiens
agcagagaagacacaggcttca

SEQ ID NO: 7048322 - DNA, 22 bp, Homo sapiens
agcagagaagacacaggcttca

SEQ ID NO: 7048323 - DNA, 22 bp, Homo sapiens
agcagagacatgaaatatgctt

SEQ ID NO: 7048324 - DNA, 22 bp, Homo sapiens
caagggaaggctaagggcaaca

SEQ ID NO: 7048325 - DNA, 22 bp, Homo sapiens
caatttctggaactaattctga

SEQ ID NO: 7048326 - DNA, 22 bp, Homo sapiens
caattcaacctaagtgcatcca

SEQ ID NO: 7048327 - DNA, 22 bp, Homo sapiens
caatttcttgttaattctcagg

SEQ ID NO: 7048328 - DNA, 22 bp, Homo sapiens
cacacatgaatccctagtacct

SEQ ID NO: 7048329 - DNA, 22 bp, Homo sapiens
cacacatgaatccctagtacct

SEQ ID NO: 7048330 - DNA, 22 bp, Homo sapiens
cacacatgagtctccccattgg

SEQ ID NO: 7048331 - DNA, 22 bp, Homo sapiens
cacacatgcatgtaagacctct

SEQ ID NO: 7048332 - DNA, 22 bp, Homo sapiens
cacacatggctgccagggaggt

SEQ ID NO: 7048333 - DNA, 22 bp, Homo sapiens
cacacatggtagcaggtacaag

SEQ ID NO: 7048334 - DNA, 22 bp, Homo sapiens
cacacatggttccgcaggatgc

SEQ ID NO: 7048335 - DNA, 22 bp, Homo sapiens
cacacatgtctctccatgctct

SEQ ID NO: 7048336 - DNA, 22 bp, Homo sapiens
cacacatgtgtgcagcttagaa

SEQ ID NO: 7048337 - DNA, 22 bp, Homo sapiens
cacacattaatatcaaaggctc

SEQ ID NO: 7048338 - DNA, 22 bp, Homo sapiens
cacactttcaggtcctctttgc

SEQ ID NO: 7048339 - DNA, 22 bp, Homo sapiens
cacactttgttgaagttttcat

SEQ ID NO: 7048340 - DNA, 22 bp, Homo sapiens
cacagaaaaaggcttgaaaatc

SEQ ID NO: 7048341 - DNA, 22 bp, Homo sapiens
agcaggcaggcccagcggctgg

SEQ ID NO: 7048342 - DNA, 20 bp, Homo sapiens
cacaggaaagctactcagtt

SEQ ID NO: 7048343 - DNA, 22 bp, Homo sapiens
cacagaaatattgtgtcccttg

SEQ ID NO: 7048344 - DNA, 22 bp, Homo sapiens
cacagaaattattaggatgctt

SEQ ID NO: 7048345 - DNA, 22 bp, Homo sapiens
cacagcagccagaacatttttg

SEQ ID NO: 7048346 - DNA, 22 bp, Homo sapiens
cacagcaggcactatacagggc

SEQ ID NO: 7048347 - DNA, 22 bp, Homo sapiens
cacagctgccatggctgcactt

SEQ ID NO: 7048348 - DNA, 22 bp, Homo sapiens
cacagctgccctactccatgtg

SEQ ID NO: 7048349 - DNA, 22 bp, Homo sapiens
cactacagaatcaaatacgggc

SEQ ID NO: 7048350 - DNA, 22 bp, Homo sapiens
cactacaggggtccacagctga

SEQ ID NO: 7048351 - DNA, 22 bp, Homo sapiens
cactacaggggtccacagctga

SEQ ID NO: 7048352 - DNA, 22 bp, Homo sapiens
agcaggtggatttagacgggag

SEQ ID NO: 7048353 - DNA, 22 bp, Homo sapiens
agcaggtggatttagacgggag

SEQ ID NO: 7048354 - DNA, 22 bp, Homo sapiens
agcaggtggccacgaggaggag

SEQ ID NO: 7048355 - DNA, 22 bp, Homo sapiens
agcaggtggcctcctgtctgtc

SEQ ID NO: 7048356 - DNA, 22 bp, Homo sapiens
agcaggtgggatcaagctggca

SEQ ID NO: 7048357 - DNA, 22 bp, Homo sapiens
agcaggtgggcatgaaagctga

SEQ ID NO: 7048358 - DNA, 22 bp, Homo sapiens
cactgaaatcgaaaaatgtagg

SEQ ID NO: 7048359 - DNA, 22 bp, Homo sapiens
cactaaatgtttcaatgtggga

SEQ ID NO: 7048360 - DNA, 22 bp, Homo sapiens
cacgtgagaccttgcagaggtg

SEQ ID NO: 7048361 - DNA, 22 bp, Homo sapiens
cacgggtggaatcagggactcc

SEQ ID NO: 7048362 - DNA, 22 bp, Homo sapiens
cacatttaagtgcttgttcaga

SEQ ID NO: 7048363 - DNA, 22 bp, Homo sapiens
cacctgagtgtcagtattctca

SEQ ID NO: 7048364 - DNA, 20 bp, Homo sapiens
cacaggctatatgagagcca

SEQ ID NO: 7048365 - DNA, 20 bp, Homo sapiens
cacaggctatatgagagcca

SEQ ID NO: 7048366 - DNA, 20 bp, Homo sapiens
cacaggctatatgagagcca

SEQ ID NO: 7048367 - DNA, 18 bp, Homo sapiens
cacaggctcccagtgagg

SEQ ID NO: 7048368 - DNA, 18 bp, Homo sapiens
cacaggctcccagtgagg

SEQ ID NO: 7048369 - DNA, 22 bp, Homo sapiens
cacaggctccggccttgcagcc

SEQ ID NO: 7048370 - DNA, 22 bp, Homo sapiens
cacaggctccggccttgcagcc

SEQ ID NO: 7048371 - DNA, 22 bp, Homo sapiens
cacaggctctccagggcctgga

SEQ ID NO: 7048372 - DNA, 22 bp, Homo sapiens
cacaggctctccagggcctgga

SEQ ID NO: 7048373 - DNA, 22 bp, Homo sapiens
cacaggctcttctcacttgatt

SEQ ID NO: 7048374 - DNA, 22 bp, Homo sapiens
cacaggctgcccgcagctggga

SEQ ID NO: 7048375 - DNA, 22 bp, Homo sapiens
cacaggctgcccgcagctggga

SEQ ID NO: 7048376 - DNA, 22 bp, Homo sapiens
cacatgaacatgctggaaaagc

SEQ ID NO: 7048377 - DNA, 22 bp, Homo sapiens
cacatgaacatgctggaaaagc

SEQ ID NO: 7048378 - DNA, 22 bp, Homo sapiens
cacatggaagagatacagtgag

SEQ ID NO: 7048379 - DNA, 22 bp, Homo sapiens
cacatggggcgctgcattggcc

SEQ ID NO: 7048380 - DNA, 22 bp, Homo sapiens
cacatgtcctggcgctgagccc

SEQ ID NO: 7048381 - DNA, 17 bp, Homo sapiens
cacatgtctacatggat

SEQ ID NO: 7048382 - DNA, 22 bp, Homo sapiens
cactgggctttgtagttagcat

SEQ ID NO: 7048383 - DNA, 22 bp, Homo sapiens
cactggtcagcatggtagacca

SEQ ID NO: 7048384 - DNA, 22 bp, Homo sapiens
cactttgaagagctttttgaca

SEQ ID NO: 7048385 - DNA, 22 bp, Homo sapiens
cactgcacttcagcctgggtga

SEQ ID NO: 7048386 - DNA, 22 bp, Homo sapiens
cactgcacttcagcctgggtga

SEQ ID NO: 7048387 - DNA, 22 bp, Homo sapiens
cactgcactccagcccgggcaa

SEQ ID NO: 7048388 - DNA, 22 bp, Homo sapiens
cactgcactccagcccgggcaa

SEQ ID NO: 7048389 - DNA, 22 bp, Homo sapiens
cactgcactccatcctgggaaa

SEQ ID NO: 7048390 - DNA, 22 bp, Homo sapiens
aaaaatgaaacggctggttggc

SEQ ID NO: 7048391 - DNA, 22 bp, Homo sapiens
aaaaatgttatctactgtccga

SEQ ID NO: 7048392 - DNA, 22 bp, Homo sapiens
aaaacacaagaagcagggtaca

SEQ ID NO: 7048393 - DNA, 22 bp, Homo sapiens
aaaacattttactgccatctca

SEQ ID NO: 7048394 - DNA, 22 bp, Homo sapiens
aaaagcagttatctgggaggaa

SEQ ID NO: 7048395 - DNA, 22 bp, Homo sapiens
aaaagcagagactctggagcta

SEQ ID NO: 7048396 - DNA, 20 bp, Homo sapiens
aaaagcagccagagatggta

SEQ ID NO: 7048397 - DNA, 22 bp, Homo sapiens
aaaacaggagttttggtaggct

SEQ ID NO: 7048398 - DNA, 22 bp, Homo sapiens
aaaacagtttaggcatcacagt

SEQ ID NO: 7048399 - DNA, 22 bp, Homo sapiens
aaaacagtttttgctaactgct

SEQ ID NO: 7048400 - DNA, 23 bp, Homo sapiens
aaaacagcttcctccagtggctc

SEQ ID NO: 7048401 - DNA, 22 bp, Homo sapiens
aaagcagcagcacctgcatttc

SEQ ID NO: 7048402 - DNA, 22 bp, Homo sapiens
aaagcagcagcacgtggaagag

SEQ ID NO: 7048403 - DNA, 21 bp, Homo sapiens
aaaatgtagacttttccctga

SEQ ID NO: 7048404 - DNA, 21 bp, Homo sapiens
aaaatgtagacttttccctga

SEQ ID NO: 7048405 - DNA, 22 bp, Homo sapiens
aaaatgtatgatggaggtgcta

SEQ ID NO: 7048406 - DNA, 22 bp, Homo sapiens
aaagcagcggtgtctttactgc

SEQ ID NO: 7048407 - DNA, 22 bp, Homo sapiens
aaagcagggtccaaggagatgt

SEQ ID NO: 7048408 - DNA, 18 bp, Homo sapiens
aaaatgcaggcgacatgg

SEQ ID NO: 7048409 - DNA, 18 bp, Homo sapiens
aaaatgcaggcgacatgg

SEQ ID NO: 7048410 - DNA, 22 bp, Homo sapiens
aaaatgtaaagcttgagtgtag

SEQ ID NO: 7048411 - DNA, 20 bp, Homo sapiens
aaaatgatgggcagggcagg

SEQ ID NO: 7048412 - DNA, 22 bp, Homo sapiens
aaaatgcaaacctacctacata

SEQ ID NO: 7048413 - DNA, 22 bp, Homo sapiens
aaaatgatgctgtaatttggca

SEQ ID NO: 7048414 - DNA, 22 bp, Homo sapiens
aaaatgatgctgtaatttggca

SEQ ID NO: 7048415 - DNA, 22 bp, Homo sapiens
aaaatgatgctgtaatttggca

SEQ ID NO: 7048416 - DNA, 22 bp, Homo sapiens
aaaatgatatcctgacttttat

SEQ ID NO: 7048417 - DNA, 22 bp, Homo sapiens
aaaatgatatcctgacttttat

SEQ ID NO: 7048418 - DNA, 22 bp, Homo sapiens
aaaagtttaagactcattctag

SEQ ID NO: 7048419 - DNA, 22 bp, Homo sapiens
aaaagtttaagactcattctag

SEQ ID NO: 7048420 - DNA, 22 bp, Homo sapiens
aaaagctagtcaatgatgtatt

SEQ ID NO: 7048421 - DNA, 22 bp, Homo sapiens
aaaagctctttctgctgtagat

SEQ ID NO: 7048422 - DNA, 22 bp, Homo sapiens
aaaagctctttctgctgtagat

SEQ ID NO: 7048423 - DNA, 22 bp, Homo sapiens
aaaatactactgtcttcttccc

SEQ ID NO: 7048424 - DNA, 18 bp, Homo sapiens
aaaataacaaagttggct

SEQ ID NO: 7048425 - DNA, 22 bp, Homo sapiens
aaaataacttctactatttgca

SEQ ID NO: 7048426 - DNA, 22 bp, Homo sapiens
aaaataacttctactatttgca

SEQ ID NO: 7048427 - DNA, 22 bp, Homo sapiens
aaagtcatctgtcctaggctct

SEQ ID NO: 7048428 - DNA, 22 bp, Homo sapiens
aaaggagaaaacatacaggact

SEQ ID NO: 7048429 - DNA, 22 bp, Homo sapiens
aaaggagagtgagtcagatgcc

SEQ ID NO: 7048430 - DNA, 22 bp, Homo sapiens
aaagctcacagtaatacaaggc

SEQ ID NO: 7048431 - DNA, 22 bp, Homo sapiens
aaaattgtgaaggtttctgaaa

SEQ ID NO: 7048432 - DNA, 22 bp, Homo sapiens
aaaattttgccctatccttcat

SEQ ID NO: 7048433 - DNA, 22 bp, Homo sapiens
aaagccaggggagggattccca

SEQ ID NO: 7048434 - DNA, 22 bp, Homo sapiens
aaagctatagggtcaagcattt

SEQ ID NO: 7048435 - DNA, 22 bp, Homo sapiens
aaagctatgaggcatgcatttc

SEQ ID NO: 7048436 - DNA, 22 bp, Homo sapiens
aaagctattcaacacgaacatg

SEQ ID NO: 7048437 - DNA, 22 bp, Homo sapiens
aaagctatttattacagagaat

SEQ ID NO: 7048438 - DNA, 22 bp, Homo sapiens
aaagctatttgtgagttataga

SEQ ID NO: 7048439 - DNA, 22 bp, Homo sapiens
aaagctatttgttatgagagaa

SEQ ID NO: 7048440 - DNA, 22 bp, Homo sapiens
aaagacagatggcaaggatgat

SEQ ID NO: 7048441 - DNA, 22 bp, Homo sapiens
aaagacatatttctaagtttat

SEQ ID NO: 7048442 - DNA, 22 bp, Homo sapiens
aaatgtgagttatagcaataga

SEQ ID NO: 7048443 - DNA, 22 bp, Homo sapiens
aaacttcatggataatataaag

SEQ ID NO: 7048444 - DNA, 22 bp, Homo sapiens
aaacttcagtgaatgacttatg

SEQ ID NO: 7048445 - DNA, 22 bp, Homo sapiens
aaacttcatggataatataaag

SEQ ID NO: 7048446 - DNA, 22 bp, Homo sapiens
aaacttcatggataatataaag

SEQ ID NO: 7048447 - DNA, 22 bp, Homo sapiens
aaacttcagggaataaaagagt

SEQ ID NO: 7048448 - DNA, 22 bp, Homo sapiens
aaacttcagggaataaaagagt

SEQ ID NO: 7048449 - DNA, 22 bp, Homo sapiens
aaacttcagtaggagccaacct

SEQ ID NO: 7048450 - DNA, 22 bp, Homo sapiens
aaacttcagtaggagccaacct

SEQ ID NO: 7048451 - DNA, 22 bp, Homo sapiens
aaacttcaaggatttgcaaatc

SEQ ID NO: 7048452 - DNA, 22 bp, Homo sapiens
aaacttcaaggatttgcaaatc

SEQ ID NO: 7048453 - DNA, 22 bp, Homo sapiens
aaacttcagactccccacttct

SEQ ID NO: 7048454 - DNA, 22 bp, Homo sapiens
aaacttcaactggaatgggcta

SEQ ID NO: 7048455 - DNA, 22 bp, Homo sapiens
aaacttcaactggaatgggcta

SEQ ID NO: 7048456 - DNA, 22 bp, Homo sapiens
aaacttcaagattcaagcctgg

SEQ ID NO: 7048457 - DNA, 22 bp, Homo sapiens
aaactgttgtggtttatcatta

SEQ ID NO: 7048458 - DNA, 22 bp, Homo sapiens
aaactgtttccctccataacct

SEQ ID NO: 7048459 - DNA, 22 bp, Homo sapiens
aaatgacagagtaagctgttta

SEQ ID NO: 7048460 - DNA, 22 bp, Homo sapiens
aaatgacactaggctttttgca

SEQ ID NO: 7048461 - DNA, 22 bp, Homo sapiens
aaatgacaataaaagtccatgc

SEQ ID NO: 7048462 - DNA, 21 bp, Homo sapiens
aaatgaatgtggtagtgcaag

SEQ ID NO: 7048463 - DNA, 22 bp, Homo sapiens
aaatacacgtacatgtgtaaaa

SEQ ID NO: 7048464 - DNA, 22 bp, Homo sapiens
aaatacacgtacatgtgtaaaa

SEQ ID NO: 7048465 - DNA, 22 bp, Homo sapiens
aaataacagtcagggacaacat

SEQ ID NO: 7048466 - DNA, 22 bp, Homo sapiens
aaataacagtcagggacaacat

SEQ ID NO: 7048467 - DNA, 22 bp, Homo sapiens
aaatacaatttcaggctgtaat

SEQ ID NO: 7048468 - DNA, 22 bp, Homo sapiens
aaataaaggtccactttagggc

SEQ ID NO: 7048469 - DNA, 22 bp, Homo sapiens
aaagttctgggggagaagaacg

SEQ ID NO: 7048470 - DNA, 22 bp, Homo sapiens
aacttcttggtcctgagctgtt

SEQ ID NO: 7048471 - DNA, 22 bp, Homo sapiens
aaaggcatgattaattctgtgt

SEQ ID NO: 7048472 - DNA, 22 bp, Homo sapiens
aaaggcatgcctccatttctat

SEQ ID NO: 7048473 - DNA, 22 bp, Homo sapiens
aaaggctccttctcccatgacc

SEQ ID NO: 7048474 - DNA, 22 bp, Homo sapiens
aaaggctccttctcccatgacc

SEQ ID NO: 7048475 - DNA, 22 bp, Homo sapiens
aaaggctggaaactgaagataa

SEQ ID NO: 7048476 - DNA, 22 bp, Homo sapiens
aaaggctggattcagagaggtg

SEQ ID NO: 7048477 - DNA, 22 bp, Homo sapiens
aaaggctggggactgaggaagg

SEQ ID NO: 7048478 - DNA, 22 bp, Homo sapiens
aaaggctttgagaagtcctgca

SEQ ID NO: 7048479 - DNA, 22 bp, Homo sapiens
aaagggaagttgcacatgttcc

SEQ ID NO: 7048480 - DNA, 22 bp, Homo sapiens
aaagggagcatggctgcaggga

SEQ ID NO: 7048481 - DNA, 22 bp, Homo sapiens
aaagggagcatggctgcaggga

SEQ ID NO: 7048482 - DNA, 22 bp, Homo sapiens
aaagggaggggcgataagccgg

SEQ ID NO: 7048483 - DNA, 22 bp, Homo sapiens
aaaggataaggttatcaatttt

SEQ ID NO: 7048484 - DNA, 22 bp, Homo sapiens
aaaggagttactcataaagctt

SEQ ID NO: 7048485 - DNA, 22 bp, Homo sapiens
aaaggataaggttatcaatttt

SEQ ID NO: 7048486 - DNA, 22 bp, Homo sapiens
aaaggcacacactccttgttat

SEQ ID NO: 7048487 - DNA, 22 bp, Homo sapiens
aaaggcactggatagctgggga

SEQ ID NO: 7048488 - DNA, 21 bp, Homo sapiens
aaagcatcacgaacatttggg

SEQ ID NO: 7048489 - DNA, 22 bp, Homo sapiens
aaagcatgactcaagaattact

SEQ ID NO: 7048490 - DNA, 22 bp, Homo sapiens
aaagcatgattagatagatgat

SEQ ID NO: 7048491 - DNA, 22 bp, Homo sapiens
aaagcatggcatgaagaacatg

SEQ ID NO: 7048492 - DNA, 22 bp, Homo sapiens
aaagcatggttaaagacagtgg

SEQ ID NO: 7048493 - DNA, 22 bp, Homo sapiens
aaagcatggttaaagacagtgg

SEQ ID NO: 7048494 - DNA, 22 bp, Homo sapiens
aaagcatgtgaatagaatatgg

SEQ ID NO: 7048495 - DNA, 22 bp, Homo sapiens
aaagccaaatgaaagatggttc

SEQ ID NO: 7048496 - DNA, 22 bp, Homo sapiens
aaagccaaatgaaagatggttc

SEQ ID NO: 7048497 - DNA, 22 bp, Homo sapiens
aaagccaagctgggaaggcagg

SEQ ID NO: 7048498 - DNA, 23 bp, Homo sapiens
aaagccaagtcagtctactggaa

SEQ ID NO: 7048499 - DNA, 22 bp, Homo sapiens
aaagccacagttctatgtctgc

SEQ ID NO: 7048500 - DNA, 22 bp, Homo sapiens
aaagcagcaagtatttgttact

SEQ ID NO: 7048501 - DNA, 22 bp, Homo sapiens
aaattgtaatgacttcacttga

SEQ ID NO: 7048502 - DNA, 22 bp, Homo sapiens
aaattccaccagaatcagtaat

SEQ ID NO: 7048503 - DNA, 22 bp, Homo sapiens
aaattgctgaccaagtatattc

SEQ ID NO: 7048504 - DNA, 22 bp, Homo sapiens
aaatatgagagtaggagtttgg

SEQ ID NO: 7048505 - DNA, 22 bp, Homo sapiens
aagagtttgacctgtgccatcc

SEQ ID NO: 7048506 - DNA, 22 bp, Homo sapiens
aagagtttgggcaagtcataaa

SEQ ID NO: 7048507 - DNA, 22 bp, Homo sapiens
aagagtttgtcagatctgcacg

SEQ ID NO: 7048508 - DNA, 22 bp, Homo sapiens
aagagttttagacaaactgatt

SEQ ID NO: 7048509 - DNA, 22 bp, Homo sapiens
aagagttttctataatcttggc

SEQ ID NO: 7048510 - DNA, 22 bp, Homo sapiens
aagagtttctgattcagtaggt

SEQ ID NO: 7048511 - DNA, 22 bp, Homo sapiens
aagagtttctgggtcaaggatt

SEQ ID NO: 7048512 - DNA, 22 bp, Homo sapiens
aagagtttctttattaaccttt

SEQ ID NO: 7048513 - DNA, 22 bp, Homo sapiens
aaatatagtgacacttatagtc

SEQ ID NO: 7048514 - DNA, 19 bp, Homo sapiens
aaatatcagagagatgata

SEQ ID NO: 7048515 - DNA, 22 bp, Homo sapiens
aaatatactagatgatgaccca

SEQ ID NO: 7048516 - DNA, 22 bp, Homo sapiens
aaatataccagttgcctgcatc

SEQ ID NO: 7048517 - DNA, 22 bp, Homo sapiens
aagagagagcattcttctgtta

SEQ ID NO: 7048518 - DNA, 22 bp, Homo sapiens
aagagagagtgcgctcacagaa

SEQ ID NO: 7048519 - DNA, 22 bp, Homo sapiens
aaatacagtggcagcagataat

SEQ ID NO: 7048520 - DNA, 22 bp, Homo sapiens
aaatacataaaggttgtaccag

SEQ ID NO: 7048521 - DNA, 22 bp, Homo sapiens
aaatacatacactgtacgtggc

SEQ ID NO: 7048522 - DNA, 22 bp, Homo sapiens
aagaaggtgtggaaagatgctc

SEQ ID NO: 7048523 - DNA, 22 bp, Homo sapiens
aagaagcatgagaagattttat

SEQ ID NO: 7048524 - DNA, 22 bp, Homo sapiens
aagaagctgtagggattaactc

SEQ ID NO: 7048525 - DNA, 22 bp, Homo sapiens
aaagttgaccgaaagattttga

SEQ ID NO: 7048526 - DNA, 22 bp, Homo sapiens
aaagttgagttttatgtgttac

SEQ ID NO: 7048527 - DNA, 22 bp, Homo sapiens
aaatgcaattgtatgtactcca

SEQ ID NO: 7048528 - DNA, 22 bp, Homo sapiens
aaatgatgttataagaccagga

SEQ ID NO: 7048529 - DNA, 22 bp, Homo sapiens
aaatgatggaaatgaggctgaa

SEQ ID NO: 7048530 - DNA, 20 bp, Homo sapiens
aaatgatgggaataatctat

SEQ ID NO: 7048531 - DNA, 22 bp, Homo sapiens
aaatgattgtcaaagttctgtt

SEQ ID NO: 7048532 - DNA, 22 bp, Homo sapiens
aaatgcaaggccatgtgaagga

SEQ ID NO: 7048533 - DNA, 22 bp, Homo sapiens
aaatgcttgctcttgattattt

SEQ ID NO: 7048534 - DNA, 22 bp, Homo sapiens
aaatgatcatgtaatttcagaa

SEQ ID NO: 7048535 - DNA, 22 bp, Homo sapiens
aaatgactaatgatcctgggca

SEQ ID NO: 7048536 - DNA, 22 bp, Homo sapiens
aaatcagaggtcagctgtacca

SEQ ID NO: 7048537 - DNA, 23 bp, Homo sapiens
aaatattcttttttagtaagtgc

SEQ ID NO: 7048538 - DNA, 22 bp, Homo sapiens
aaatcactaagttatagtgtgg

SEQ ID NO: 7048539 - DNA, 22 bp, Homo sapiens
aaatcactaagttatagtgtgg

SEQ ID NO: 7048540 - DNA, 22 bp, Homo sapiens
aaatcagaaaatatggagagga

SEQ ID NO: 7048541 - DNA, 22 bp, Homo sapiens
aaggagtctgggccattcagag

SEQ ID NO: 7048542 - DNA, 22 bp, Homo sapiens
aaggagtctgggccattcagag

SEQ ID NO: 7048543 - DNA, 22 bp, Homo sapiens
aaggagtctgggccattcagag

SEQ ID NO: 7048544 - DNA, 17 bp, Homo sapiens
aaggatattatagttct

SEQ ID NO: 7048545 - DNA, 22 bp, Homo sapiens
aaggatcaagtggattttctta

SEQ ID NO: 7048546 - DNA, 22 bp, Homo sapiens
aaggatcatagtaaacattgat

SEQ ID NO: 7048547 - DNA, 22 bp, Homo sapiens
aaggcactgaacttaaattctg

SEQ ID NO: 7048548 - DNA, 22 bp, Homo sapiens
aaggcactgactgtgcagggga

SEQ ID NO: 7048549 - DNA, 22 bp, Homo sapiens
aaggagggttcccaggtcctgg

SEQ ID NO: 7048550 - DNA, 22 bp, Homo sapiens
aaatggcaacagaagggagttc

SEQ ID NO: 7048551 - DNA, 22 bp, Homo sapiens
aaatggaagaagtgcaatactg

SEQ ID NO: 7048552 - DNA, 22 bp, Homo sapiens
aaatggatctgtggaatacatt

SEQ ID NO: 7048553 - DNA, 22 bp, Homo sapiens
aaggctgaaagaccttgaacct

SEQ ID NO: 7048554 - DNA, 22 bp, Homo sapiens
aaggctgaattcaagggtaggc

SEQ ID NO: 7048555 - DNA, 22 bp, Homo sapiens
aaggctgaattcaagggtaggc

SEQ ID NO: 7048556 - DNA, 22 bp, Homo sapiens
aaggctgaccagtttacacttt

SEQ ID NO: 7048557 - DNA, 22 bp, Homo sapiens
aaggctgaccagtttacacttt

SEQ ID NO: 7048558 - DNA, 22 bp, Homo sapiens
aaggctgacgtttgtgtttatt

SEQ ID NO: 7048559 - DNA, 22 bp, Homo sapiens
aaggctgacgtttgtgtttatt

SEQ ID NO: 7048560 - DNA, 22 bp, Homo sapiens
aaggctgactcaacagggggcc

SEQ ID NO: 7048561 - DNA, 21 bp, Homo sapiens
aaggctgagacaactcaggag

SEQ ID NO: 7048562 - DNA, 22 bp, Homo sapiens
aaggctgagacagcacaggtcc

SEQ ID NO: 7048563 - DNA, 22 bp, Homo sapiens
aaggctgagacagcacaggtcc

SEQ ID NO: 7048564 - DNA, 22 bp, Homo sapiens
aagggcaggagaagacggatat

SEQ ID NO: 7048565 - DNA, 22 bp, Homo sapiens
aagggcaggcacccaccctcac

SEQ ID NO: 7048566 - DNA, 22 bp, Homo sapiens
aagtgaaacatgtatctcttta

SEQ ID NO: 7048567 - DNA, 22 bp, Homo sapiens
aagtctttttgaatctataact

SEQ ID NO: 7048568 - DNA, 22 bp, Homo sapiens
aagtgcctgacctagcctggag

SEQ ID NO: 7048569 - DNA, 22 bp, Homo sapiens
aagtgctgagactacaggcatg

SEQ ID NO: 7048570 - DNA, 22 bp, Homo sapiens
aagtgctgggattacaggcatg

SEQ ID NO: 7048571 - DNA, 22 bp, Homo sapiens
aagtgctgggattacaggtgtc

SEQ ID NO: 7048572 - DNA, 22 bp, Homo sapiens
aagtgctgggattacaggtgtg

SEQ ID NO: 7048573 - DNA, 22 bp, Homo sapiens
aagtgctgggattataggcatg

SEQ ID NO: 7048574 - DNA, 22 bp, Homo sapiens
aagggctgcatttgatgtgtca

SEQ ID NO: 7048575 - DNA, 22 bp, Homo sapiens
aagggctgcatttgatgtgtca

SEQ ID NO: 7048576 - DNA, 22 bp, Homo sapiens
aagggctgccagggggtgccag

SEQ ID NO: 7048577 - DNA, 22 bp, Homo sapiens
aagggctgccagggggtgccag

SEQ ID NO: 7048578 - DNA, 22 bp, Homo sapiens
aagggctgctgtagaagcagag

SEQ ID NO: 7048579 - DNA, 22 bp, Homo sapiens
aagggctgctgtagaagcagag

SEQ ID NO: 7048580 - DNA, 22 bp, Homo sapiens
aagggctggaatatctcttaga

SEQ ID NO: 7048581 - DNA, 22 bp, Homo sapiens
aagggctggaatatctcttaga

SEQ ID NO: 7048582 - DNA, 21 bp, Homo sapiens
aaggtctgtaaagtgacagga

SEQ ID NO: 7048583 - DNA, 22 bp, Homo sapiens
aaggtgtcggcagagccgcttc

SEQ ID NO: 7048584 - DNA, 22 bp, Homo sapiens
aaggtgtcgggttagctcagcc

SEQ ID NO: 7048585 - DNA, 22 bp, Homo sapiens
aaggtgtgaagagatgggaaga

SEQ ID NO: 7048586 - DNA, 22 bp, Homo sapiens
aaggtgttcaggttttcccatt

SEQ ID NO: 7048587 - DNA, 23 bp, Homo sapiens
aaggtgtttgttttcagaaagca

SEQ ID NO: 7048588 - DNA, 22 bp, Homo sapiens
aagtaacatctgaacatgatgt

SEQ ID NO: 7048589 - DNA, 22 bp, Homo sapiens
aagtaacatctgaacatgatgt

SEQ ID NO: 7048590 - DNA, 22 bp, Homo sapiens
aagtctgatcatttcttctata

SEQ ID NO: 7048591 - DNA, 22 bp, Homo sapiens
aagttacagtcagaggttaaca

SEQ ID NO: 7048592 - DNA, 22 bp, Homo sapiens
aacagtttatcaagtttttaca

SEQ ID NO: 7048593 - DNA, 22 bp, Homo sapiens
aacagtttatgagatatgctat

SEQ ID NO: 7048594 - DNA, 22 bp, Homo sapiens
aataagaattgccagatttgaa

SEQ ID NO: 7048595 - DNA, 22 bp, Homo sapiens
aataatattcctctgtgtgcgt

SEQ ID NO: 7048596 - DNA, 22 bp, Homo sapiens
aataatatttgaagcttcaaag

SEQ ID NO: 7048597 - DNA, 22 bp, Homo sapiens
aataatgtaggatgataaatga

SEQ ID NO: 7048598 - DNA, 22 bp, Homo sapiens
aataatgtaggatgataaatga

SEQ ID NO: 7048599 - DNA, 22 bp, Homo sapiens
aatacagaggggtcacaattca

SEQ ID NO: 7048600 - DNA, 22 bp, Homo sapiens
aatacagatattcagtggtact

SEQ ID NO: 7048601 - DNA, 22 bp, Homo sapiens
aatacagatgagcttctgcctc

SEQ ID NO: 7048602 - DNA, 22 bp, Homo sapiens
aatacagatggcatgtgaagat

SEQ ID NO: 7048603 - DNA, 22 bp, Homo sapiens
aatattgtttcaagatcacaga

SEQ ID NO: 7048604 - DNA, 22 bp, Homo sapiens
aatatttatatttctcttccct

SEQ ID NO: 7048605 - DNA, 22 bp, Homo sapiens
aatatttatgacaggaagtagc

SEQ ID NO: 7048606 - DNA, 22 bp, Homo sapiens
aatatctgtggccatacaattt

SEQ ID NO: 7048607 - DNA, 22 bp, Homo sapiens
aatatctggagatgctttttgt

SEQ ID NO: 7048608 - DNA, 22 bp, Homo sapiens
aatatctgtctctaatgcatat

SEQ ID NO: 7048609 - DNA, 22 bp, Homo sapiens
aatatctgtggccatacaattt

SEQ ID NO: 7048610 - DNA, 22 bp, Homo sapiens
aatatctgtggccatacaattt

SEQ ID NO: 7048611 - DNA, 22 bp, Homo sapiens
aatatttctccttcgttatagc

SEQ ID NO: 7048612 - DNA, 22 bp, Homo sapiens
aatctgaaagtatggagcagta

SEQ ID NO: 7048613 - DNA, 22 bp, Homo sapiens
aatctgaatatttatgtgtatt

SEQ ID NO: 7048614 - DNA, 20 bp, Homo sapiens
aatctgaatcccagtcctag

SEQ ID NO: 7048615 - DNA, 22 bp, Homo sapiens
aatctggacacagttctcatgc

SEQ ID NO: 7048616 - DNA, 22 bp, Homo sapiens
aatgaaatctgctgggtaaaga

SEQ ID NO: 7048617 - DNA, 21 bp, Homo sapiens
aatgatgaaagatgacagagt

SEQ ID NO: 7048618 - DNA, 22 bp, Homo sapiens
aatgatgaactcagagggaacc

SEQ ID NO: 7048619 - DNA, 22 bp, Homo sapiens
aatgtacaaaccttctttgtag

SEQ ID NO: 7048620 - DNA, 22 bp, Homo sapiens
aactttacttgaaagaacatgt

SEQ ID NO: 7048621 - DNA, 22 bp, Homo sapiens
aatgtaaacagcaagagaaggg

SEQ ID NO: 7048622 - DNA, 22 bp, Homo sapiens
aatgtaaagttgggcacaaatg

SEQ ID NO: 7048623 - DNA, 23 bp, Homo sapiens
aactttactattttgaataatgc

SEQ ID NO: 7048624 - DNA, 22 bp, Homo sapiens
aactttaaagaggaggcttggg

SEQ ID NO: 7048625 - DNA, 22 bp, Homo sapiens
aactttaaggctataaattatg

SEQ ID NO: 7048626 - DNA, 22 bp, Homo sapiens
aactttaaggctataaattatg

SEQ ID NO: 7048627 - DNA, 22 bp, Homo sapiens
aactttaaaaaatatgtctgtt

SEQ ID NO: 7048628 - DNA, 22 bp, Homo sapiens
aacttcatttataatgtcatta

SEQ ID NO: 7048629 - DNA, 22 bp, Homo sapiens
aatgcagtgagccattaaatgg

SEQ ID NO: 7048630 - DNA, 22 bp, Homo sapiens
aatgcagtttcatttgtagaat

SEQ ID NO: 7048631 - DNA, 22 bp, Homo sapiens
aatgcataatggtttgtgacaa

SEQ ID NO: 7048632 - DNA, 22 bp, Homo sapiens
aagagtttccatgctctgtgct

SEQ ID NO: 7048633 - DNA, 22 bp, Homo sapiens
acacagccgtgaatctgcttct

SEQ ID NO: 7048634 - DNA, 22 bp, Homo sapiens
acacagctagtgagtggcagag

SEQ ID NO: 7048635 - DNA, 22 bp, Homo sapiens
acacagctttcagtcattatct

SEQ ID NO: 7048636 - DNA, 22 bp, Homo sapiens
acacagctttcagtcattatct

SEQ ID NO: 7048637 - DNA, 22 bp, Homo sapiens
acacacatgcctttcctaagta

SEQ ID NO: 7048638 - DNA, 17 bp, Homo sapiens
acacagagattaacaca

SEQ ID NO: 7048639 - DNA, 22 bp, Homo sapiens
acacagagccagggaatacagt

SEQ ID NO: 7048640 - DNA, 22 bp, Homo sapiens
acacagagctggaactgcttca

SEQ ID NO: 7048641 - DNA, 22 bp, Homo sapiens
acacagcaacttgcagtatgga

SEQ ID NO: 7048642 - DNA, 22 bp, Homo sapiens
acaatgtagttgtcatgagaca

SEQ ID NO: 7048643 - DNA, 22 bp, Homo sapiens
acaatattgtacccagaagttt

SEQ ID NO: 7048644 - DNA, 22 bp, Homo sapiens
acaatatgggatatacatttta

SEQ ID NO: 7048645 - DNA, 22 bp, Homo sapiens
acaatatagtccatgagcatgc

SEQ ID NO: 7048646 - DNA, 22 bp, Homo sapiens
acaatatagtccatgagcatgc

SEQ ID NO: 7048647 - DNA, 22 bp, Homo sapiens
acaacaaaatcactagtcttcc

SEQ ID NO: 7048648 - DNA, 22 bp, Homo sapiens
acaatagacccatgacacatac

SEQ ID NO: 7048649 - DNA, 22 bp, Homo sapiens
acaatatacacatcctaatggg

SEQ ID NO: 7048650 - DNA, 17 bp, Homo sapiens
aagaatcattagagaag

SEQ ID NO: 7048651 - DNA, 22 bp, Homo sapiens
aagaatcattgtaaagttctgt

SEQ ID NO: 7048652 - DNA, 22 bp, Homo sapiens
aagaatatctgttttatttagg

SEQ ID NO: 7048653 - DNA, 22 bp, Homo sapiens
aagaatatagattttttgaagt

SEQ ID NO: 7048654 - DNA, 22 bp, Homo sapiens
acaaaagaataagatgagtcat

SEQ ID NO: 7048655 - DNA, 22 bp, Homo sapiens
acaaaagtgtaggaattcctta

SEQ ID NO: 7048656 - DNA, 22 bp, Homo sapiens
aattttatctctaagcaggctt

SEQ ID NO: 7048657 - DNA, 22 bp, Homo sapiens
aattttatctctaagcaggctt

SEQ ID NO: 7048658 - DNA, 22 bp, Homo sapiens
aagaagatggttaactttcagt

SEQ ID NO: 7048659 - DNA, 22 bp, Homo sapiens
aagaacattttgtagaatgaca

SEQ ID NO: 7048660 - DNA, 22 bp, Homo sapiens
aatgtacaagggttccagtttt

SEQ ID NO: 7048661 - DNA, 22 bp, Homo sapiens
acagagcaactttatttcatgg

SEQ ID NO: 7048662 - DNA, 22 bp, Homo sapiens
acagaaatgatgtttggcaata

SEQ ID NO: 7048663 - DNA, 23 bp, Homo sapiens
acagaaagttctgctggacagag

SEQ ID NO: 7048664 - DNA, 18 bp, Homo sapiens
acagaaatagctgtgcct

SEQ ID NO: 7048665 - DNA, 23 bp, Homo sapiens
acagacattccataatgtacacc

SEQ ID NO: 7048666 - DNA, 22 bp, Homo sapiens
acacttggagcaacacttatgg

SEQ ID NO: 7048667 - DNA, 22 bp, Homo sapiens
acactttaagcatttcacactg

SEQ ID NO: 7048668 - DNA, 22 bp, Homo sapiens
acagaaagatgatttgaaatgg

SEQ ID NO: 7048669 - DNA, 20 bp, Homo sapiens
acagaaagctgccttgtccc

SEQ ID NO: 7048670 - DNA, 23 bp, Homo sapiens
acagaaagttctgctggacagag

SEQ ID NO: 7048671 - DNA, 22 bp, Homo sapiens
acacttctcccatctcctgttg

SEQ ID NO: 7048672 - DNA, 18 bp, Homo sapiens
acacttcctggtggtgtg

SEQ ID NO: 7048673 - DNA, 18 bp, Homo sapiens
acacttcctggtggtgtg

SEQ ID NO: 7048674 - DNA, 18 bp, Homo sapiens
acacttcctggtggtgtg

SEQ ID NO: 7048675 - DNA, 18 bp, Homo sapiens
acacttcctggtggtgtg

SEQ ID NO: 7048676 - DNA, 22 bp, Homo sapiens
acacttctattccctgcacaaa

SEQ ID NO: 7048677 - DNA, 22 bp, Homo sapiens
acactggttgttaatagtaaca

SEQ ID NO: 7048678 - DNA, 22 bp, Homo sapiens
acacttcaggactctggggcaa

SEQ ID NO: 7048679 - DNA, 22 bp, Homo sapiens
acacttcatagcaaggttggag

SEQ ID NO: 7048680 - DNA, 22 bp, Homo sapiens
aagatacagtgaaagggcattg

SEQ ID NO: 7048681 - DNA, 20 bp, Homo sapiens
acacatagataagaagctga

SEQ ID NO: 7048682 - DNA, 20 bp, Homo sapiens
acacatatagcagcataaac

SEQ ID NO: 7048683 - DNA, 22 bp, Homo sapiens
acagcagggtcacattccctct

SEQ ID NO: 7048684 - DNA, 22 bp, Homo sapiens
acagcagggtcacattccctct

SEQ ID NO: 7048685 - DNA, 22 bp, Homo sapiens
acagcaggggtggaataaacgt

SEQ ID NO: 7048686 - DNA, 19 bp, Homo sapiens
acagcaggtgtggggataa

SEQ ID NO: 7048687 - DNA, 21 bp, Homo sapiens
acagcagggctggcatgacag

SEQ ID NO: 7048688 - DNA, 22 bp, Homo sapiens
acagcagggggagctgttggac

SEQ ID NO: 7048689 - DNA, 22 bp, Homo sapiens
aagcagtgttcccagctggccc

SEQ ID NO: 7048690 - DNA, 22 bp, Homo sapiens
aagcaggcttggtgtggccgct

SEQ ID NO: 7048691 - DNA, 22 bp, Homo sapiens
aagcagggctccctggggactc

SEQ ID NO: 7048692 - DNA, 18 bp, Homo sapiens
aagcagggtccattgtgc

SEQ ID NO: 7048693 - DNA, 18 bp, Homo sapiens
aagcagggtccattgtgc

SEQ ID NO: 7048694 - DNA, 22 bp, Homo sapiens
aagcagggtgtcttgacccatg

SEQ ID NO: 7048695 - DNA, 22 bp, Homo sapiens
acagcaggttacagtggcacag

SEQ ID NO: 7048696 - DNA, 22 bp, Homo sapiens
acagcaggttacagtggcacag

SEQ ID NO: 7048697 - DNA, 22 bp, Homo sapiens
aagcccagtaccttcagtgagg

SEQ ID NO: 7048698 - DNA, 22 bp, Homo sapiens
aagccctgacctgagagtccgt

SEQ ID NO: 7048699 - DNA, 22 bp, Homo sapiens
acatctcagaactgagtaaccg

SEQ ID NO: 7048700 - DNA, 22 bp, Homo sapiens
acatgaatatatgaagttcaac

SEQ ID NO: 7048701 - DNA, 22 bp, Homo sapiens
acatgaatgcagccataacact

SEQ ID NO: 7048702 - DNA, 22 bp, Homo sapiens
acatgacaaaatgcacaggatt

SEQ ID NO: 7048703 - DNA, 22 bp, Homo sapiens
acatcccttgctcggggcccct

SEQ ID NO: 7048704 - DNA, 22 bp, Homo sapiens
acatcctcccgatctactggct

SEQ ID NO: 7048705 - DNA, 22 bp, Homo sapiens
acatcctcccgatctactggct

SEQ ID NO: 7048706 - DNA, 22 bp, Homo sapiens
acatgacagtgcttagcaaact

SEQ ID NO: 7048707 - DNA, 22 bp, Homo sapiens
acatgcatatacttaaatatgt

SEQ ID NO: 7048708 - DNA, 19 bp, Homo sapiens
acatgcatatggacagttg

SEQ ID NO: 7048709 - DNA, 22 bp, Homo sapiens
aaggcacaacacaagagggtga

SEQ ID NO: 7048710 - DNA, 22 bp, Homo sapiens
aaggcacacagttagatagagc

SEQ ID NO: 7048711 - DNA, 18 bp, Homo sapiens
aaggcacaggagaacatt

SEQ ID NO: 7048712 - DNA, 22 bp, Homo sapiens
aaggcacatattttagagtcac

SEQ ID NO: 7048713 - DNA, 22 bp, Homo sapiens
aaggcacatgacctaggcctgg

SEQ ID NO: 7048714 - DNA, 22 bp, Homo sapiens
aaggcacattcctgaaaacaat

SEQ ID NO: 7048715 - DNA, 22 bp, Homo sapiens
aaggcatgtgtcctcagagaga

SEQ ID NO: 7048716 - DNA, 22 bp, Homo sapiens
aaggccagagcgtgtcctgcct

SEQ ID NO: 7048717 - DNA, 22 bp, Homo sapiens
aaggccagattctctctagggg

SEQ ID NO: 7048718 - DNA, 22 bp, Homo sapiens
aaggatgtgactcagtcagcta

SEQ ID NO: 7048719 - DNA, 22 bp, Homo sapiens
aaggcaaatgtgttcttttagt

SEQ ID NO: 7048720 - DNA, 22 bp, Homo sapiens
aaggatgattggtaatgacact

SEQ ID NO: 7048721 - DNA, 22 bp, Homo sapiens
aaggagggaaagcagtgcttct

SEQ ID NO: 7048722 - DNA, 22 bp, Homo sapiens
aaggacagagagccattccaga

SEQ ID NO: 7048723 - DNA, 22 bp, Homo sapiens
aaggacaggagaaaacgggatc

SEQ ID NO: 7048724 - DNA, 22 bp, Homo sapiens
aaggacaggcacagtggtggag

SEQ ID NO: 7048725 - DNA, 22 bp, Homo sapiens
aaggacaggcacagtggtggag

SEQ ID NO: 7048726 - DNA, 22 bp, Homo sapiens
aaggaagggaaatagtgatgtc

SEQ ID NO: 7048727 - DNA, 22 bp, Homo sapiens
aaggaagggaaatagtgatgtc

SEQ ID NO: 7048728 - DNA, 22 bp, Homo sapiens
acagctggacaggggagagttt

SEQ ID NO: 7048729 - DNA, 22 bp, Homo sapiens
acagctggaggccccattgtcc

SEQ ID NO: 7048730 - DNA, 22 bp, Homo sapiens
acagctggaggtctgtgagcac

SEQ ID NO: 7048731 - DNA, 22 bp, Homo sapiens
acagctggagtgaggatggagt

SEQ ID NO: 7048732 - DNA, 22 bp, Homo sapiens
acagctggagtgaggatggagt

SEQ ID NO: 7048733 - DNA, 22 bp, Homo sapiens
aagctggatgtaggatccccct

SEQ ID NO: 7048734 - DNA, 22 bp, Homo sapiens
aagctgtgagctggatgctcca

SEQ ID NO: 7048735 - DNA, 22 bp, Homo sapiens
aagctgtgtaagttgcttggtt

SEQ ID NO: 7048736 - DNA, 21 bp, Homo sapiens
aagctgtgttccactgatagc

SEQ ID NO: 7048737 - DNA, 21 bp, Homo sapiens
aagcttccaaactgctggact

SEQ ID NO: 7048738 - DNA, 20 bp, Homo sapiens
aagcttccaggatctggtgt

SEQ ID NO: 7048739 - DNA, 22 bp, Homo sapiens
aagcttcctgaatgctcattta

SEQ ID NO: 7048740 - DNA, 22 bp, Homo sapiens
aagcttcctgcatgggactgct

SEQ ID NO: 7048741 - DNA, 23 bp, Homo sapiens
aagcttccttcacgtctcctggg

SEQ ID NO: 7048742 - DNA, 23 bp, Homo sapiens
aagcttccttgactggcccctag

SEQ ID NO: 7048743 - DNA, 22 bp, Homo sapiens
aagcttcttagaatgcatgtgc

SEQ ID NO: 7048744 - DNA, 22 bp, Homo sapiens
aagggttgaagataaataaggt

SEQ ID NO: 7048745 - DNA, 22 bp, Homo sapiens
aaggggtgggcattagagcagt

SEQ ID NO: 7048746 - DNA, 19 bp, Homo sapiens
aagggtcacaagcagcaga

SEQ ID NO: 7048747 - DNA, 22 bp, Homo sapiens
aagggtgaagggtggtggccta

SEQ ID NO: 7048748 - DNA, 22 bp, Homo sapiens
aagggtgggcaccgccaggtca

SEQ ID NO: 7048749 - DNA, 22 bp, Homo sapiens
aagggtgggccctggcagccat

SEQ ID NO: 7048750 - DNA, 22 bp, Homo sapiens
accagagtaatgtgtggaaatt

SEQ ID NO: 7048751 - DNA, 22 bp, Homo sapiens
accagagctggctctgagcacc

SEQ ID NO: 7048752 - DNA, 22 bp, Homo sapiens
aagggctgcaatccaaaacact

SEQ ID NO: 7048753 - DNA, 22 bp, Homo sapiens
aagggctgcaatccaaaacact

SEQ ID NO: 7048754 - DNA, 22 bp, Homo sapiens
aagggctggagaggaaaggttg

SEQ ID NO: 7048755 - DNA, 22 bp, Homo sapiens
acatttcagattcatgaagtga

SEQ ID NO: 7048756 - DNA, 22 bp, Homo sapiens
aagggctggatctctctgagca

SEQ ID NO: 7048757 - DNA, 22 bp, Homo sapiens
aagggctggatctctctgagca

SEQ ID NO: 7048758 - DNA, 22 bp, Homo sapiens
aagggctggccacattctgggt

SEQ ID NO: 7048759 - DNA, 22 bp, Homo sapiens
aagggctggccctgggaagagt

SEQ ID NO: 7048760 - DNA, 22 bp, Homo sapiens
aagggctggccctgggaagagt

SEQ ID NO: 7048761 - DNA, 18 bp, Homo sapiens
aagggctggcctttggag

SEQ ID NO: 7048762 - DNA, 19 bp, Homo sapiens
aagggctgggcacctcact

SEQ ID NO: 7048763 - DNA, 22 bp, Homo sapiens
aagggctgggtctggttaaccc

SEQ ID NO: 7048764 - DNA, 20 bp, Homo sapiens
aagggcagagggaacagact

SEQ ID NO: 7048765 - DNA, 22 bp, Homo sapiens
aagggcagagggaatcccacat

SEQ ID NO: 7048766 - DNA, 22 bp, Homo sapiens
acatttcagattcatgaagtga

SEQ ID NO: 7048767 - DNA, 22 bp, Homo sapiens
aagggagacagttgtgtgagga

SEQ ID NO: 7048768 - DNA, 22 bp, Homo sapiens
aagggagacagttgtgtgagga

SEQ ID NO: 7048769 - DNA, 22 bp, Homo sapiens
aagggcagaatagagaagatgg

SEQ ID NO: 7048770 - DNA, 22 bp, Homo sapiens
acctgcctatggagccacatgg

SEQ ID NO: 7048771 - DNA, 22 bp, Homo sapiens
acctgcctagttggttctgccc

SEQ ID NO: 7048772 - DNA, 22 bp, Homo sapiens
acctgcctatcagctgcctgct

SEQ ID NO: 7048773 - DNA, 22 bp, Homo sapiens
acctgcctatcagctgcctgct

SEQ ID NO: 7048774 - DNA, 22 bp, Homo sapiens
acctgccctggaggaagatatt

SEQ ID NO: 7048775 - DNA, 22 bp, Homo sapiens
acctgcctagttggttctgccc

SEQ ID NO: 7048776 - DNA, 20 bp, Homo sapiens
aagtccctaagtctctggcc

SEQ ID NO: 7048777 - DNA, 22 bp, Homo sapiens
aagtccctggtgctggctgcgc

SEQ ID NO: 7048778 - DNA, 22 bp, Homo sapiens
aagtccctggttcctagcaaaa

SEQ ID NO: 7048779 - DNA, 22 bp, Homo sapiens
aagtccctgtggggtggaggct

SEQ ID NO: 7048780 - DNA, 22 bp, Homo sapiens
aagtccctttaatcagtgcctt

SEQ ID NO: 7048781 - DNA, 22 bp, Homo sapiens
aagtatatactaaatgttaatc

SEQ ID NO: 7048782 - DNA, 22 bp, Homo sapiens
aagtaggaatccgaatgagtag

SEQ ID NO: 7048783 - DNA, 22 bp, Homo sapiens
aagtatatactaaatgttaatc

SEQ ID NO: 7048784 - DNA, 22 bp, Homo sapiens
aagtatatttagctgagcttgt

SEQ ID NO: 7048785 - DNA, 22 bp, Homo sapiens
aagtatattttttgaagcatat

SEQ ID NO: 7048786 - DNA, 22 bp, Homo sapiens
aagtcagtgctagctaatggct

SEQ ID NO: 7048787 - DNA, 22 bp, Homo sapiens
aagtcatcactcctctgaactt

SEQ ID NO: 7048788 - DNA, 22 bp, Homo sapiens
acctctctgggcctgcttcctg

SEQ ID NO: 7048789 - DNA, 22 bp, Homo sapiens
aaggtgtcactgggacaggaaa

SEQ ID NO: 7048790 - DNA, 22 bp, Homo sapiens
aaggtgtcaccagattggcagg

SEQ ID NO: 7048791 - DNA, 22 bp, Homo sapiens
acccagggtagaacctcagagc

SEQ ID NO: 7048792 - DNA, 19 bp, Homo sapiens
acccaggggtttatgtgtg

SEQ ID NO: 7048793 - DNA, 22 bp, Homo sapiens
acccagggtagaacctcagagc

SEQ ID NO: 7048794 - DNA, 22 bp, Homo sapiens
acccaggggcagccttgctgtg

SEQ ID NO: 7048795 - DNA, 22 bp, Homo sapiens
acccaggggcgaagctggccac

SEQ ID NO: 7048796 - DNA, 22 bp, Homo sapiens
acccaggggcgaagctggccac

SEQ ID NO: 7048797 - DNA, 22 bp, Homo sapiens
aaggtggttgtaggctggtctg

SEQ ID NO: 7048798 - DNA, 22 bp, Homo sapiens
acccagggagtgctcctgttct

SEQ ID NO: 7048799 - DNA, 22 bp, Homo sapiens
acccagggcagccagcggggag

SEQ ID NO: 7048800 - DNA, 22 bp, Homo sapiens
acccagggccacagcccgcagt

SEQ ID NO: 7048801 - DNA, 22 bp, Homo sapiens
acccagggctcaagcgtaggca

SEQ ID NO: 7048802 - DNA, 22 bp, Homo sapiens
acccagggctcaagcgtaggca

SEQ ID NO: 7048803 - DNA, 22 bp, Homo sapiens
acccagggcttaaggcggtgca

SEQ ID NO: 7048804 - DNA, 21 bp, Homo sapiens
acccaggggaagcagaaactg

SEQ ID NO: 7048805 - DNA, 22 bp, Homo sapiens
acccaggggcagccttgctgtg

SEQ ID NO: 7048806 - DNA, 22 bp, Homo sapiens
actgcaggccttggtgccagca

SEQ ID NO: 7048807 - DNA, 22 bp, Homo sapiens
actgcaggagacacagctgctg

SEQ ID NO: 7048808 - DNA, 22 bp, Homo sapiens
aagttcctgagctcatatagca

SEQ ID NO: 7048809 - DNA, 22 bp, Homo sapiens
aagttcccgaggaccacagttg

SEQ ID NO: 7048810 - DNA, 22 bp, Homo sapiens
actgaaaatgaattagaaacag

SEQ ID NO: 7048811 - DNA, 22 bp, Homo sapiens
actgaaaaagacatcttggtaa

SEQ ID NO: 7048812 - DNA, 22 bp, Homo sapiens
actgaaaaagtatgattcactg

SEQ ID NO: 7048813 - DNA, 22 bp, Homo sapiens
actgaaaatgaattagaaacag

SEQ ID NO: 7048814 - DNA, 22 bp, Homo sapiens
actgaaaaagacatcttggtaa

SEQ ID NO: 7048815 - DNA, 22 bp, Homo sapiens
acctgcctcagtgcagctggat

SEQ ID NO: 7048816 - DNA, 22 bp, Homo sapiens
acctgcctcagtgcagctggat

SEQ ID NO: 7048817 - DNA, 22 bp, Homo sapiens
acctgcctcagtgcagctggat

SEQ ID NO: 7048818 - DNA, 22 bp, Homo sapiens
acctgcctctaagcagcaggtg

SEQ ID NO: 7048819 - DNA, 22 bp, Homo sapiens
aagtgtctgctggctctaccct

SEQ ID NO: 7048820 - DNA, 22 bp, Homo sapiens
aagtgtcttttagccactttta

SEQ ID NO: 7048821 - DNA, 22 bp, Homo sapiens
actcttcttgctgctcattaat

SEQ ID NO: 7048822 - DNA, 22 bp, Homo sapiens
actctttacttaaactctaagt

SEQ ID NO: 7048823 - DNA, 22 bp, Homo sapiens
aatagcaaagttatcaaattaa

SEQ ID NO: 7048824 - DNA, 22 bp, Homo sapiens
aatagcacctgaggtagtttgt

SEQ ID NO: 7048825 - DNA, 22 bp, Homo sapiens
aatagcatagagttaaaatgca

SEQ ID NO: 7048826 - DNA, 22 bp, Homo sapiens
aatagcatcctaaaacatactt

SEQ ID NO: 7048827 - DNA, 23 bp, Homo sapiens
actgtctgatatgttttccatca

SEQ ID NO: 7048828 - DNA, 23 bp, Homo sapiens
actgtctgatatgttttccatca

SEQ ID NO: 7048829 - DNA, 22 bp, Homo sapiens
aatagaatgtaatctaatacat

SEQ ID NO: 7048830 - DNA, 22 bp, Homo sapiens
aagtttttggtagagaaaagta

SEQ ID NO: 7048831 - DNA, 21 bp, Homo sapiens
aataaaacagttggtgtcaat

SEQ ID NO: 7048832 - DNA, 22 bp, Homo sapiens
aagtttttcacattgctgttgt

SEQ ID NO: 7048833 - DNA, 20 bp, Homo sapiens
aataaaagaagccttcaccc

SEQ ID NO: 7048834 - DNA, 22 bp, Homo sapiens
aataaaatgaactggtagagtt

SEQ ID NO: 7048835 - DNA, 22 bp, Homo sapiens
actgggaggcatctggagctga

SEQ ID NO: 7048836 - DNA, 22 bp, Homo sapiens
actgggagggtcttgaagaggg

SEQ ID NO: 7048837 - DNA, 22 bp, Homo sapiens
actgggagtcatgaggaaggag

SEQ ID NO: 7048838 - DNA, 22 bp, Homo sapiens
aataatacatgagattaatgtt

SEQ ID NO: 7048839 - DNA, 22 bp, Homo sapiens
aataataagatactaagggagt

SEQ ID NO: 7048840 - DNA, 22 bp, Homo sapiens
aataatagcagagtttacaatc

SEQ ID NO: 7048841 - DNA, 22 bp, Homo sapiens
actgggagttctccatgtccct

SEQ ID NO: 7048842 - DNA, 22 bp, Homo sapiens
actgggattacaggtgggagtc

SEQ ID NO: 7048843 - DNA, 22 bp, Homo sapiens
actgggcaaggatatgatgggt

SEQ ID NO: 7048844 - DNA, 22 bp, Homo sapiens
actgggcaataaattcagagaa

SEQ ID NO: 7048845 - DNA, 22 bp, Homo sapiens
actgggcaccatcatgagatag

SEQ ID NO: 7048846 - DNA, 22 bp, Homo sapiens
actgggcaataaattcagagaa

SEQ ID NO: 7048847 - DNA, 22 bp, Homo sapiens
actgggcaccatcatgagatgg

SEQ ID NO: 7048848 - DNA, 22 bp, Homo sapiens
aataagttgcctgttgaatcat

SEQ ID NO: 7048849 - DNA, 22 bp, Homo sapiens
agaaagcttatgaatgggcaag

SEQ ID NO: 7048850 - DNA, 22 bp, Homo sapiens
agaaaggagaccagctctgccc

SEQ ID NO: 7048851 - DNA, 22 bp, Homo sapiens
agaaaggagcaccgtgggggat

SEQ ID NO: 7048852 - DNA, 22 bp, Homo sapiens
agaaaggaggaagaatgacctc

SEQ ID NO: 7048853 - DNA, 22 bp, Homo sapiens
agaaagggagcgtggatcaatt

SEQ ID NO: 7048854 - DNA, 22 bp, Homo sapiens
agaaagggctattttgaggtag

SEQ ID NO: 7048855 - DNA, 22 bp, Homo sapiens
aatcctgtgtgactctggggag

SEQ ID NO: 7048856 - DNA, 23 bp, Homo sapiens
aatagctggtaatgatagcacaa

SEQ ID NO: 7048857 - DNA, 22 bp, Homo sapiens
aatagctcactgatttctcttt

SEQ ID NO: 7048858 - DNA, 22 bp, Homo sapiens
aatagcatgtaagtttaaaaga

SEQ ID NO: 7048859 - DNA, 22 bp, Homo sapiens
aatagcatgttcatgataaaat

SEQ ID NO: 7048860 - DNA, 22 bp, Homo sapiens
aataggaaaatatttaacaaga

SEQ ID NO: 7048861 - DNA, 22 bp, Homo sapiens
aatagtaaaagatacagctaat

SEQ ID NO: 7048862 - DNA, 22 bp, Homo sapiens
acttttaaatgagtttcagttg

SEQ ID NO: 7048863 - DNA, 22 bp, Homo sapiens
acttttaaatgagtttcagttg

SEQ ID NO: 7048864 - DNA, 22 bp, Homo sapiens
actttgttgaagaatatgttag

SEQ ID NO: 7048865 - DNA, 22 bp, Homo sapiens
actttgttgatgaaatagtttt

SEQ ID NO: 7048866 - DNA, 22 bp, Homo sapiens
acttttatcaaggaagtgatct

SEQ ID NO: 7048867 - DNA, 22 bp, Homo sapiens
aatgcataccatgtcatctttg

SEQ ID NO: 7048868 - DNA, 22 bp, Homo sapiens
aatgcatacgtgtttgtggcaa

SEQ ID NO: 7048869 - DNA, 22 bp, Homo sapiens
aatgccagtgtgttgattccag

SEQ ID NO: 7048870 - DNA, 22 bp, Homo sapiens
agaagccagattgtagtgggac

SEQ ID NO: 7048871 - DNA, 22 bp, Homo sapiens
agaagccagcttcagctgcccg

SEQ ID NO: 7048872 - DNA, 22 bp, Homo sapiens
agaagccagcttcagctgcccg

SEQ ID NO: 7048873 - DNA, 22 bp, Homo sapiens
agaagccagtcgctctcccgca

SEQ ID NO: 7048874 - DNA, 22 bp, Homo sapiens
agaagcttgaaggagcagtgac

SEQ ID NO: 7048875 - DNA, 22 bp, Homo sapiens
agaaggaagccaggagggtgca

SEQ ID NO: 7048876 - DNA, 22 bp, Homo sapiens
agaaggaaggctgagtgctgat

SEQ ID NO: 7048877 - DNA, 18 bp, Homo sapiens
agaaggagctatgggcag

SEQ ID NO: 7048878 - DNA, 22 bp, Homo sapiens
agaactgtgaagtatgtgaaat

SEQ ID NO: 7048879 - DNA, 22 bp, Homo sapiens
agaagaaagattgaaggttcct

SEQ ID NO: 7048880 - DNA, 22 bp, Homo sapiens
aatgaagaaatggacatcttta

SEQ ID NO: 7048881 - DNA, 22 bp, Homo sapiens
aatgaagaaatggacatcttta

SEQ ID NO: 7048882 - DNA, 17 bp, Homo sapiens
agaactgtagtagctcc

SEQ ID NO: 7048883 - DNA, 21 bp, Homo sapiens
aatgaagtggctattttgagg

SEQ ID NO: 7048884 - DNA, 22 bp, Homo sapiens
aatgaataacaatcctctggag

SEQ ID NO: 7048885 - DNA, 18 bp, Homo sapiens
agaagccacgaggagtcc

SEQ ID NO: 7048886 - DNA, 22 bp, Homo sapiens
agaagccactggaggttgagat

SEQ ID NO: 7048887 - DNA, 22 bp, Homo sapiens
agaagccactggaggttgagat

SEQ ID NO: 7048888 - DNA, 22 bp, Homo sapiens
agaagccagaatattcatggat

SEQ ID NO: 7048889 - DNA, 22 bp, Homo sapiens
agaagccagaggcagtgggtac

SEQ ID NO: 7048890 - DNA, 22 bp, Homo sapiens
acacatcagaaatatgaatgag

SEQ ID NO: 7048891 - DNA, 22 bp, Homo sapiens
acacatcagcctcagctttggg

SEQ ID NO: 7048892 - DNA, 22 bp, Homo sapiens
acacatctatattgcatctgca

SEQ ID NO: 7048893 - DNA, 22 bp, Homo sapiens
agcaggctttcaagagtcttct

SEQ ID NO: 7048894 - DNA, 22 bp, Homo sapiens
acacagttcttagcaggtgtct

SEQ ID NO: 7048895 - DNA, 22 bp, Homo sapiens
acacagttcaggatcaaatagc

SEQ ID NO: 7048896 - DNA, 22 bp, Homo sapiens
acacacacaagcaggttgtgga

SEQ ID NO: 7048897 - DNA, 18 bp, Homo sapiens
acacacacacctgtgtat

SEQ ID NO: 7048898 - DNA, 22 bp, Homo sapiens
acacacaactcattgtgtaata

SEQ ID NO: 7048899 - DNA, 23 bp, Homo sapiens
acacaatagagtactattcagcc

SEQ ID NO: 7048900 - DNA, 22 bp, Homo sapiens
acacaagaataatgatgaaggt

SEQ ID NO: 7048901 - DNA, 22 bp, Homo sapiens
agccaggaaccagctacagtct

SEQ ID NO: 7048902 - DNA, 22 bp, Homo sapiens
agccagaggccagcctgcctca

SEQ ID NO: 7048903 - DNA, 22 bp, Homo sapiens
agccagagggaatctttgggga

SEQ ID NO: 7048904 - DNA, 22 bp, Homo sapiens
agccagaggtcatgagcacagg

SEQ ID NO: 7048905 - DNA, 22 bp, Homo sapiens
acactgttcctgaaattgttat

SEQ ID NO: 7048906 - DNA, 20 bp, Homo sapiens
acactgttcttcacacattt

SEQ ID NO: 7048907 - DNA, 22 bp, Homo sapiens
acactgttctttgcactgagaa

SEQ ID NO: 7048908 - DNA, 22 bp, Homo sapiens
acacttatttttgtccacttcc

SEQ ID NO: 7048909 - DNA, 22 bp, Homo sapiens
acacttcaaagggtgacttgat

SEQ ID NO: 7048910 - DNA, 22 bp, Homo sapiens
acacttcaaatggttggaaaat

SEQ ID NO: 7048911 - DNA, 22 bp, Homo sapiens
agccacagtctgatgcctgaga

SEQ ID NO: 7048912 - DNA, 23 bp, Homo sapiens
acacttcacccattgtgatagga

SEQ ID NO: 7048913 - DNA, 22 bp, Homo sapiens
agccagaggaacttgatgactg

SEQ ID NO: 7048914 - DNA, 22 bp, Homo sapiens
agccaatcatcctcagactctc

SEQ ID NO: 7048915 - DNA, 22 bp, Homo sapiens
agccaatctacaacaaaggata

SEQ ID NO: 7048916 - DNA, 22 bp, Homo sapiens
agccaaggcagctagagctctg

SEQ ID NO: 7048917 - DNA, 22 bp, Homo sapiens
agccaagggtcagctgcacaga

SEQ ID NO: 7048918 - DNA, 22 bp, Homo sapiens
agccaaggtatcatgagaggca

SEQ ID NO: 7048919 - DNA, 22 bp, Homo sapiens
agccaaggagtgcaggtggctt

SEQ ID NO: 7048920 - DNA, 22 bp, Homo sapiens
agcaggtgtcggcgagggtctt

SEQ ID NO: 7048921 - DNA, 22 bp, Homo sapiens
acaccagggcctagccagggcg

SEQ ID NO: 7048922 - DNA, 22 bp, Homo sapiens
acaccatggttcccaaactgtg

SEQ ID NO: 7048923 - DNA, 22 bp, Homo sapiens
acacccagagcgccagtgccga

SEQ ID NO: 7048924 - DNA, 22 bp, Homo sapiens
acacccagagcgccagtgccga

SEQ ID NO: 7048925 - DNA, 22 bp, Homo sapiens
agcaggtggtaggcagtcagca

SEQ ID NO: 7048926 - DNA, 21 bp, Homo sapiens
agcaggtgtaaaggaggaaat

SEQ ID NO: 7048927 - DNA, 22 bp, Homo sapiens
agcaggtgtagggctctttgta

SEQ ID NO: 7048928 - DNA, 22 bp, Homo sapiens
agcaggtgtatataaggctgag

SEQ ID NO: 7048929 - DNA, 22 bp, Homo sapiens
agcaggtgtatcggtcacctac

SEQ ID NO: 7048930 - DNA, 22 bp, Homo sapiens
acagaggcagtgtgagatactg

SEQ ID NO: 7048931 - DNA, 22 bp, Homo sapiens
acagaatattgtaagtgccact

SEQ ID NO: 7048932 - DNA, 22 bp, Homo sapiens
acagaacttccagggaacatac

SEQ ID NO: 7048933 - DNA, 19 bp, Homo sapiens
acagaagcatagaaaagga

SEQ ID NO: 7048934 - DNA, 22 bp, Homo sapiens
acagaggccgcctctctcacgg

SEQ ID NO: 7048935 - DNA, 23 bp, Homo sapiens
acagaggcttaaatgagtggcag

SEQ ID NO: 7048936 - DNA, 22 bp, Homo sapiens
acagaggtaggacatgagatat

SEQ ID NO: 7048937 - DNA, 22 bp, Homo sapiens
acagaggtaggacatgagatat

SEQ ID NO: 7048938 - DNA, 22 bp, Homo sapiens
acagaggtcacctttgtatctt

SEQ ID NO: 7048939 - DNA, 22 bp, Homo sapiens
acagaggtcacctttgtatctt

SEQ ID NO: 7048940 - DNA, 22 bp, Homo sapiens
acagataattagcataaatgct

SEQ ID NO: 7048941 - DNA, 22 bp, Homo sapiens
acagaggtcatggagagttctc

SEQ ID NO: 7048942 - DNA, 22 bp, Homo sapiens
acagaggtcatggagagttctc

SEQ ID NO: 7048943 - DNA, 23 bp, Homo sapiens
acagaggtccaaacagtataagc

SEQ ID NO: 7048944 - DNA, 22 bp, Homo sapiens
acagcagagtgtgagatagcca

SEQ ID NO: 7048945 - DNA, 22 bp, Homo sapiens
acagcagagtgtgagatagcca

SEQ ID NO: 7048946 - DNA, 22 bp, Homo sapiens
acagcagagttgagtagttgca

SEQ ID NO: 7048947 - DNA, 22 bp, Homo sapiens
acagatatttaagagcttttgt

SEQ ID NO: 7048948 - DNA, 22 bp, Homo sapiens
acagatacaaatatacaaatac

SEQ ID NO: 7048949 - DNA, 22 bp, Homo sapiens
acagcagatctgtggagcttat

SEQ ID NO: 7048950 - DNA, 22 bp, Homo sapiens
acagcagatttccctgggctcc

SEQ ID NO: 7048951 - DNA, 21 bp, Homo sapiens
acagcagcaatctgtctttcc

SEQ ID NO: 7048952 - DNA, 22 bp, Homo sapiens
acagcagcagaccagcatatgt

SEQ ID NO: 7048953 - DNA, 20 bp, Homo sapiens
acagcagccttgctagaaac

SEQ ID NO: 7048954 - DNA, 22 bp, Homo sapiens
acagcagccttgttggtttcga

SEQ ID NO: 7048955 - DNA, 18 bp, Homo sapiens
agctgaggggactgaaga

SEQ ID NO: 7048956 - DNA, 22 bp, Homo sapiens
agctgagggcaggatggggtga

SEQ ID NO: 7048957 - DNA, 22 bp, Homo sapiens
agctgagggcaggatggggtga

SEQ ID NO: 7048958 - DNA, 21 bp, Homo sapiens
agctgaggtaaggcaagagag

SEQ ID NO: 7048959 - DNA, 22 bp, Homo sapiens
agctgagggttcggtgtccaca

SEQ ID NO: 7048960 - DNA, 22 bp, Homo sapiens
agctgagggttcggtgtccaca

SEQ ID NO: 7048961 - DNA, 22 bp, Homo sapiens
agctgagcatttgatccacctc

SEQ ID NO: 7048962 - DNA, 22 bp, Homo sapiens
agctgagcacattcaaacaggt

SEQ ID NO: 7048963 - DNA, 22 bp, Homo sapiens
acagcagcgtcaacttaaaatt

SEQ ID NO: 7048964 - DNA, 22 bp, Homo sapiens
agctgagttaattcatcactta

SEQ ID NO: 7048965 - DNA, 22 bp, Homo sapiens
agctgaggttgaagagtgaacg

SEQ ID NO: 7048966 - DNA, 22 bp, Homo sapiens
agctgaggttgaagagtgaacg

SEQ ID NO: 7048967 - DNA, 22 bp, Homo sapiens
agctgatgccatgtggaacagt

SEQ ID NO: 7048968 - DNA, 21 bp, Homo sapiens
agctgaggtaaggcaagagag

SEQ ID NO: 7048969 - DNA, 21 bp, Homo sapiens
agctgaggtaaggcaagagag

SEQ ID NO: 7048970 - DNA, 21 bp, Homo sapiens
agctgaggtaaggcaagagag

SEQ ID NO: 7048971 - DNA, 23 bp, Homo sapiens
agctgaggtgcagatccaaagaa

SEQ ID NO: 7048972 - DNA, 23 bp, Homo sapiens
agctgaggtgcagatccaaagaa

SEQ ID NO: 7048973 - DNA, 22 bp, Homo sapiens
agctgaggttagtataaatgtg

SEQ ID NO: 7048974 - DNA, 22 bp, Homo sapiens
agctgaggttagtataaatgtg

SEQ ID NO: 7048975 - DNA, 22 bp, Homo sapiens
acagcaggcccatactggaagg

SEQ ID NO: 7048976 - DNA, 17 bp, Homo sapiens
acagcaggcccggaggg

SEQ ID NO: 7048977 - DNA, 17 bp, Homo sapiens
acagcaggcccggaggg

SEQ ID NO: 7048978 - DNA, 17 bp, Homo sapiens
acagcagggaagtgttg

SEQ ID NO: 7048979 - DNA, 22 bp, Homo sapiens
acagcagggaatatgggaattg

SEQ ID NO: 7048980 - DNA, 21 bp, Homo sapiens
acagcagggctggcatgacag

SEQ ID NO: 7048981 - DNA, 18 bp, Homo sapiens
acagcaggtttcattctt

SEQ ID NO: 7048982 - DNA, 22 bp, Homo sapiens
acagcaggttttaactttgaag

SEQ ID NO: 7048983 - DNA, 22 bp, Homo sapiens
acagcaggttttaactttgaag

SEQ ID NO: 7048984 - DNA, 23 bp, Homo sapiens
acaacaggaaatcagacctgaac

SEQ ID NO: 7048985 - DNA, 22 bp, Homo sapiens
agatgctgccaggcccctcagt

SEQ ID NO: 7048986 - DNA, 22 bp, Homo sapiens
agatgcagacttggttcaggca

SEQ ID NO: 7048987 - DNA, 21 bp, Homo sapiens
agatgcagtgacccactgggg

SEQ ID NO: 7048988 - DNA, 22 bp, Homo sapiens
agatgcatgtttatgtctttcc

SEQ ID NO: 7048989 - DNA, 22 bp, Homo sapiens
agagttcagaaagtgcaggttt

SEQ ID NO: 7048990 - DNA, 22 bp, Homo sapiens
acaaagtgctgacattacaggc

SEQ ID NO: 7048991 - DNA, 22 bp, Homo sapiens
aatttcttcagctctaaaatgg

SEQ ID NO: 7048992 - DNA, 22 bp, Homo sapiens
aatttcttgggagctcagagaa

SEQ ID NO: 7048993 - DNA, 22 bp, Homo sapiens
aatttcttgggagctcagagaa

SEQ ID NO: 7048994 - DNA, 22 bp, Homo sapiens
aatttctcggttttgatattgt

SEQ ID NO: 7048995 - DNA, 18 bp, Homo sapiens
aatttctttgacaactta

SEQ ID NO: 7048996 - DNA, 22 bp, Homo sapiens
aatttggagctttgtttctaga

SEQ ID NO: 7048997 - DNA, 22 bp, Homo sapiens
aatttggcagtgtcttgaagta

SEQ ID NO: 7048998 - DNA, 22 bp, Homo sapiens
agagtgaagttcatcgtgcagc

SEQ ID NO: 7048999 - DNA, 22 bp, Homo sapiens
agagtgaagtttttgaaagtga

SEQ ID NO: 7049000 - DNA, 22 bp, Homo sapiens
agagtgtgaagaaagtgcaatg

SEQ ID NO: 7049001 - DNA, 22 bp, Homo sapiens
agagtgtgtggggctgaggtca

SEQ ID NO: 7049002 - DNA, 22 bp, Homo sapiens
agcacagggcccagcctaggcc

SEQ ID NO: 7049003 - DNA, 22 bp, Homo sapiens
agcacagggacaatgccaggtg

SEQ ID NO: 7049004 - DNA, 22 bp, Homo sapiens
agcacaggctttggtgtgaggg

SEQ ID NO: 7049005 - DNA, 22 bp, Homo sapiens
agcacaggctttggtgtgaggg

SEQ ID NO: 7049006 - DNA, 22 bp, Homo sapiens
agcacaggacgtagagcttgga

SEQ ID NO: 7049007 - DNA, 22 bp, Homo sapiens
agcacaggtaatacagagtaac

SEQ ID NO: 7049008 - DNA, 22 bp, Homo sapiens
agcacaggtaatacagagtaac

SEQ ID NO: 7049009 - DNA, 22 bp, Homo sapiens
acaattttccccataggttatc

SEQ ID NO: 7049010 - DNA, 22 bp, Homo sapiens
acacaagaagttaatgggcaaa

SEQ ID NO: 7049011 - DNA, 22 bp, Homo sapiens
agcacacaggacttgattcatg

SEQ ID NO: 7049012 - DNA, 22 bp, Homo sapiens
agcacacagtattagccattgt

SEQ ID NO: 7049013 - DNA, 22 bp, Homo sapiens
agcacacagtcttccttcctcc

SEQ ID NO: 7049014 - DNA, 22 bp, Homo sapiens
agcacacatcacttctgctcat

SEQ ID NO: 7049015 - DNA, 23 bp, Homo sapiens
agcacacttgtacaatgccctag

SEQ ID NO: 7049016 - DNA, 22 bp, Homo sapiens
agcacaggaacatggagatggg

SEQ ID NO: 7049017 - DNA, 22 bp, Homo sapiens
agcacaggaacatggagatggg

SEQ ID NO: 7049018 - DNA, 22 bp, Homo sapiens
agcaaagtcagtggaaccatcc

SEQ ID NO: 7049019 - DNA, 22 bp, Homo sapiens
acaacatcagctgagaccttca

SEQ ID NO: 7049020 - DNA, 22 bp, Homo sapiens
acaacattatacatagaaagct

SEQ ID NO: 7049021 - DNA, 22 bp, Homo sapiens
agattttggctggctggagaga

SEQ ID NO: 7049022 - DNA, 22 bp, Homo sapiens
acaatacaggcttctggactta

SEQ ID NO: 7049023 - DNA, 19 bp, Homo sapiens
acaataactcattgattgc

SEQ ID NO: 7049024 - DNA, 22 bp, Homo sapiens
agagcaaatagagaagccagct

SEQ ID NO: 7049025 - DNA, 22 bp, Homo sapiens
agagatttctactgcactcttt

SEQ ID NO: 7049026 - DNA, 22 bp, Homo sapiens
agagatttgtcaatgatttcca

SEQ ID NO: 7049027 - DNA, 22 bp, Homo sapiens
agagcaattagcttaggtaaaa

SEQ ID NO: 7049028 - DNA, 22 bp, Homo sapiens
aatgtgtatactggcaattaag

SEQ ID NO: 7049029 - DNA, 19 bp, Homo sapiens
agagaaggatcctatggtt

SEQ ID NO: 7049030 - DNA, 21 bp, Homo sapiens
agagaagggactcttccagtc

SEQ ID NO: 7049031 - DNA, 21 bp, Homo sapiens
agagaagggattccaggccct

SEQ ID NO: 7049032 - DNA, 22 bp, Homo sapiens
agagaagggcctgtatgtaatc

SEQ ID NO: 7049033 - DNA, 22 bp, Homo sapiens
agagaaggggtaaagagtcctg

SEQ ID NO: 7049034 - DNA, 22 bp, Homo sapiens
aatgtgtagcatttaatgcagt

SEQ ID NO: 7049035 - DNA, 22 bp, Homo sapiens
aatgtatgtgtatatcaaatca

SEQ ID NO: 7049036 - DNA, 23 bp, Homo sapiens
aatgtatgttagtatcttagaga

SEQ ID NO: 7049037 - DNA, 22 bp, Homo sapiens
aatgtatgaaggttccagtttc

SEQ ID NO: 7049038 - DNA, 22 bp, Homo sapiens
aatgtatggattcatgtctgtg

SEQ ID NO: 7049039 - DNA, 22 bp, Homo sapiens
aatgtataatatttaatgcttt

SEQ ID NO: 7049040 - DNA, 20 bp, Homo sapiens
agacatggtagtgattcagg

SEQ ID NO: 7049041 - DNA, 22 bp, Homo sapiens
aatgctaaaatggcactaaagt

SEQ ID NO: 7049042 - DNA, 22 bp, Homo sapiens
aatgctacagaagtgatcttgg

SEQ ID NO: 7049043 - DNA, 22 bp, Homo sapiens
aatgctattcattaagcctact

SEQ ID NO: 7049044 - DNA, 22 bp, Homo sapiens
aatgctcaaaatgtttcatcta

SEQ ID NO: 7049045 - DNA, 22 bp, Homo sapiens
aatttcctgggataaaaagcca

SEQ ID NO: 7049046 - DNA, 22 bp, Homo sapiens
aatttcacagtgaactttgagg

SEQ ID NO: 7049047 - DNA, 22 bp, Homo sapiens
agaggattcactgcagaagaca

SEQ ID NO: 7049048 - DNA, 22 bp, Homo sapiens
agaggaggtggtgatgctttaa

SEQ ID NO: 7049049 - DNA, 22 bp, Homo sapiens
agaggaggtggtgatgctttaa

SEQ ID NO: 7049050 - DNA, 22 bp, Homo sapiens
agaggaggtggtgatgctttaa

SEQ ID NO: 7049051 - DNA, 22 bp, Homo sapiens
agaggaatttctggaaggaggc

SEQ ID NO: 7049052 - DNA, 22 bp, Homo sapiens
agaggacaaaatgagaagtgct

SEQ ID NO: 7049053 - DNA, 20 bp, Homo sapiens
aattccagcatgatatttat

SEQ ID NO: 7049054 - DNA, 22 bp, Homo sapiens
aattccagctgattgactttcc

SEQ ID NO: 7049055 - DNA, 22 bp, Homo sapiens
agagctgggtggtggtgactca

SEQ ID NO: 7049056 - DNA, 22 bp, Homo sapiens
agaggaagtaatcaggacctgc

SEQ ID NO: 7049057 - DNA, 21 bp, Homo sapiens
agaggaagtgattggtctggc

SEQ ID NO: 7049058 - DNA, 22 bp, Homo sapiens
agaggaataaatttctgtagtg

SEQ ID NO: 7049059 - DNA, 22 bp, Homo sapiens
agaggaatctgtctagacacaa

SEQ ID NO: 7049060 - DNA, 22 bp, Homo sapiens
agaggaatgtatttccctgcaa

SEQ ID NO: 7049061 - DNA, 22 bp, Homo sapiens
aattacacagggatcacttttt

SEQ ID NO: 7049062 - DNA, 22 bp, Homo sapiens
agagcctggctcccagctaccg

SEQ ID NO: 7049063 - DNA, 22 bp, Homo sapiens
agagctgaattcaagtgctggc

SEQ ID NO: 7049064 - DNA, 22 bp, Homo sapiens
agagcacagcagatctctgatg

SEQ ID NO: 7049065 - DNA, 22 bp, Homo sapiens
aattaagaaaatgttttatgat

SEQ ID NO: 7049066 - DNA, 22 bp, Homo sapiens
aattaagagagagttgaagcaa

SEQ ID NO: 7049067 - DNA, 22 bp, Homo sapiens
aattaatatttgtggaattaat

SEQ ID NO: 7049068 - DNA, 22 bp, Homo sapiens
aattaatggaaagtaaggaagg

SEQ ID NO: 7049069 - DNA, 22 bp, Homo sapiens
agagctgagcaccaagcatggt

SEQ ID NO: 7049070 - DNA, 22 bp, Homo sapiens
agagctgagcaccaagcatggt

SEQ ID NO: 7049071 - DNA, 22 bp, Homo sapiens
agagctgaggatccagctgagc

SEQ ID NO: 7049072 - DNA, 22 bp, Homo sapiens
agagctgaggatccagctgagc

SEQ ID NO: 7049073 - DNA, 22 bp, Homo sapiens
agagctgcagggtggacccagg

SEQ ID NO: 7049074 - DNA, 22 bp, Homo sapiens
agagctgccgagctggggccat

SEQ ID NO: 7049075 - DNA, 22 bp, Homo sapiens
taaattgatcgtttgggatgaa

SEQ ID NO: 7049076 - DNA, 22 bp, Homo sapiens
taaattgttttctagaagttgt

SEQ ID NO: 7049077 - DNA, 22 bp, Homo sapiens
taacattaaaagagataattga

SEQ ID NO: 7049078 - DNA, 22 bp, Homo sapiens
taaccatattttccattaagtt

SEQ ID NO: 7049079 - DNA, 22 bp, Homo sapiens
taacctacatgagaactttaaa

SEQ ID NO: 7049080 - DNA, 22 bp, Homo sapiens
taactacaagggcggtctctgt

SEQ ID NO: 7049081 - DNA, 22 bp, Homo sapiens
taactacatttcactgcaatta

SEQ ID NO: 7049082 - DNA, 22 bp, Homo sapiens
taactacatttcactgcaatta

SEQ ID NO: 7049083 - DNA, 22 bp, Homo sapiens
taactgaatgtattacaacaga

SEQ ID NO: 7049084 - DNA, 22 bp, Homo sapiens
taaaggttagtagcagggaaac

SEQ ID NO: 7049085 - DNA, 22 bp, Homo sapiens
taaaggttataaaggttagggg

SEQ ID NO: 7049086 - DNA, 22 bp, Homo sapiens
taaaggttattgcactggagtt

SEQ ID NO: 7049087 - DNA, 22 bp, Homo sapiens
taaaggttgaaaactgactgcc

SEQ ID NO: 7049088 - DNA, 22 bp, Homo sapiens
taaaggtttattcaacaaaata

SEQ ID NO: 7049089 - DNA, 22 bp, Homo sapiens
taaagtcaaggtactgtttcac

SEQ ID NO: 7049090 - DNA, 22 bp, Homo sapiens
taaagtgctggatttgagtaaa

SEQ ID NO: 7049091 - DNA, 22 bp, Homo sapiens
taaattaaagattggagaagga

SEQ ID NO: 7049092 - DNA, 20 bp, Homo sapiens
taaattagccttgaagatta

SEQ ID NO: 7049093 - DNA, 22 bp, Homo sapiens
taaattatggctggcagagcag

SEQ ID NO: 7049094 - DNA, 22 bp, Homo sapiens
taaattatgttccatgtccttt

SEQ ID NO: 7049095 - DNA, 22 bp, Homo sapiens
taaacactgccttggtgggtca

SEQ ID NO: 7049096 - DNA, 22 bp, Homo sapiens
taaagggtaggttttactgtaa

SEQ ID NO: 7049097 - DNA, 22 bp, Homo sapiens
taaacactcacttcatagccat

SEQ ID NO: 7049098 - DNA, 22 bp, Homo sapiens
taaacaagctggactgataagt

SEQ ID NO: 7049099 - DNA, 22 bp, Homo sapiens
taaaatgtttgcaagagaccag

SEQ ID NO: 7049100 - DNA, 22 bp, Homo sapiens
gtttttattgtgtaaatgtggg

SEQ ID NO: 7049101 - DNA, 22 bp, Homo sapiens
gtttttattgtgtaaatgtggg

SEQ ID NO: 7049102 - DNA, 22 bp, Homo sapiens
gtttttatctaatagcagttat

SEQ ID NO: 7049103 - DNA, 22 bp, Homo sapiens
gtttttatctaatagcagttat

SEQ ID NO: 7049104 - DNA, 19 bp, Homo sapiens
gttttgtttgcagaactta

SEQ ID NO: 7049105 - DNA, 22 bp, Homo sapiens
gtttttatatcctgtggagtgt

SEQ ID NO: 7049106 - DNA, 22 bp, Homo sapiens
gtttttatatcctgtggagtgt

SEQ ID NO: 7049107 - DNA, 22 bp, Homo sapiens
taaaatgatctctcatgttctt

SEQ ID NO: 7049108 - DNA, 22 bp, Homo sapiens
taaaatgtagcttctaggctgg

SEQ ID NO: 7049109 - DNA, 19 bp, Homo sapiens
taaaatgtctgtggtcagt

SEQ ID NO: 7049110 - DNA, 22 bp, Homo sapiens
taaaatgtgtttctgtatggtt

SEQ ID NO: 7049111 - DNA, 22 bp, Homo sapiens
gttttgaatactactagaactt

SEQ ID NO: 7049112 - DNA, 22 bp, Homo sapiens
gttttgaaatgaaagaaccaag

SEQ ID NO: 7049113 - DNA, 21 bp, Homo sapiens
gttttctttgatagagggaag

SEQ ID NO: 7049114 - DNA, 22 bp, Homo sapiens
gttttctttgaatgcttctaga

SEQ ID NO: 7049115 - DNA, 22 bp, Homo sapiens
gttttcattactgctgtgattt

SEQ ID NO: 7049116 - DNA, 22 bp, Homo sapiens
gttttcttcctgcaattggcat

SEQ ID NO: 7049117 - DNA, 18 bp, Homo sapiens
gttttgaattgtcttaca

SEQ ID NO: 7049118 - DNA, 22 bp, Homo sapiens
gtttccagagtgagggcacttg

SEQ ID NO: 7049119 - DNA, 22 bp, Homo sapiens
gtttccagcctagagatggtga

SEQ ID NO: 7049120 - DNA, 22 bp, Homo sapiens
gtttccaggctttggtatggtt

SEQ ID NO: 7049121 - DNA, 22 bp, Homo sapiens
gttacaaactcaggtgccaaaa

SEQ ID NO: 7049122 - DNA, 22 bp, Homo sapiens
gttaataaaggtatagaatcag

SEQ ID NO: 7049123 - DNA, 22 bp, Homo sapiens
gttaaggatcttgagatgagga

SEQ ID NO: 7049124 - DNA, 22 bp, Homo sapiens
gtgtgggacgggtgagtggcca

SEQ ID NO: 7049125 - DNA, 22 bp, Homo sapiens
gttaagaagctagagatgaaca

SEQ ID NO: 7049126 - DNA, 22 bp, Homo sapiens
gtgtgcctcccattagggtgta

SEQ ID NO: 7049127 - DNA, 22 bp, Homo sapiens
gtgctccctccttcctcaagga

SEQ ID NO: 7049128 - DNA, 22 bp, Homo sapiens
gtgctctccagccccacgtgga

SEQ ID NO: 7049129 - DNA, 22 bp, Homo sapiens
gtgctctcctggctgccctgac

SEQ ID NO: 7049130 - DNA, 22 bp, Homo sapiens
gtgctctgatctgtctgacatc

SEQ ID NO: 7049131 - DNA, 22 bp, Homo sapiens
gtgctctggctggtctcccggt

SEQ ID NO: 7049132 - DNA, 22 bp, Homo sapiens
gtgctctgggctgcctgacatg

SEQ ID NO: 7049133 - DNA, 22 bp, Homo sapiens
gtgctctgggctgcctgacatg

SEQ ID NO: 7049134 - DNA, 22 bp, Homo sapiens
gtgctctgtggattgagttgaa

SEQ ID NO: 7049135 - DNA, 22 bp, Homo sapiens
gtgctgaaatggacctcaggaa

SEQ ID NO: 7049136 - DNA, 18 bp, Homo sapiens
gtgtgcagttgcaggggt

SEQ ID NO: 7049137 - DNA, 22 bp, Homo sapiens
gtgtgccaccagtcaaggtgaa

SEQ ID NO: 7049138 - DNA, 18 bp, Homo sapiens
gtttcatgcatgtgaaac

SEQ ID NO: 7049139 - DNA, 22 bp, Homo sapiens
gtttcatacagattattcatgg

SEQ ID NO: 7049140 - DNA, 22 bp, Homo sapiens
gttggggtccaatgaagcgagc

SEQ ID NO: 7049141 - DNA, 22 bp, Homo sapiens
gttcataatttgaaggaatagg

SEQ ID NO: 7049142 - DNA, 22 bp, Homo sapiens
gttgagtgggttaggatgctga

SEQ ID NO: 7049143 - DNA, 22 bp, Homo sapiens
gttgaggtgatgccagccctgc

SEQ ID NO: 7049144 - DNA, 22 bp, Homo sapiens
gttcatgtggtttttaaaggat

SEQ ID NO: 7049145 - DNA, 22 bp, Homo sapiens
tacaaacttgttttaagtaagt

SEQ ID NO: 7049146 - DNA, 22 bp, Homo sapiens
tacaaactgttattattattgt

SEQ ID NO: 7049147 - DNA, 22 bp, Homo sapiens
tacaaactgttattattattgt

SEQ ID NO: 7049148 - DNA, 22 bp, Homo sapiens
tacaaaaaattgatactgacga

SEQ ID NO: 7049149 - DNA, 22 bp, Homo sapiens
tacaaactccgaagtttgtacc

SEQ ID NO: 7049150 - DNA, 22 bp, Homo sapiens
tacaaactctttatatttcata

SEQ ID NO: 7049151 - DNA, 22 bp, Homo sapiens
taattatagccgctattttgct

SEQ ID NO: 7049152 - DNA, 22 bp, Homo sapiens
taattacagaggtttgccagtt

SEQ ID NO: 7049153 - DNA, 22 bp, Homo sapiens
taattacaggtccaaaacaatc

SEQ ID NO: 7049154 - DNA, 23 bp, Homo sapiens
taattagatgttgattcctgaga

SEQ ID NO: 7049155 - DNA, 22 bp, Homo sapiens
taattataacagttacatctta

SEQ ID NO: 7049156 - DNA, 22 bp, Homo sapiens
taattataacagttacatctta

SEQ ID NO: 7049157 - DNA, 22 bp, Homo sapiens
taattataacagttacatctta

SEQ ID NO: 7049158 - DNA, 22 bp, Homo sapiens
taattatacaaaaaggcatgca

SEQ ID NO: 7049159 - DNA, 22 bp, Homo sapiens
taattatagccgctattttgct

SEQ ID NO: 7049160 - DNA, 22 bp, Homo sapiens
taatagaatagtggaaacattg

SEQ ID NO: 7049161 - DNA, 22 bp, Homo sapiens
taatagaatagtggaaacattg

SEQ ID NO: 7049162 - DNA, 22 bp, Homo sapiens
taataatagcagtagctgccac

SEQ ID NO: 7049163 - DNA, 22 bp, Homo sapiens
taagtgttattattctcacttt

SEQ ID NO: 7049164 - DNA, 22 bp, Homo sapiens
taataagcgtagaaggtatatc

SEQ ID NO: 7049165 - DNA, 22 bp, Homo sapiens
taatacatcattcatctaagga

SEQ ID NO: 7049166 - DNA, 22 bp, Homo sapiens
taaggtttggctgtctcttggt

SEQ ID NO: 7049167 - DNA, 22 bp, Homo sapiens
taaggtttgtggggagcaaaag

SEQ ID NO: 7049168 - DNA, 22 bp, Homo sapiens
taaggttttgagaccagaacgt

SEQ ID NO: 7049169 - DNA, 22 bp, Homo sapiens
taagtaaaacattcaagaagtc

SEQ ID NO: 7049170 - DNA, 22 bp, Homo sapiens
taagtaaatttataatgtgatt

SEQ ID NO: 7049171 - DNA, 22 bp, Homo sapiens
taagtaactgcataattaaatt

SEQ ID NO: 7049172 - DNA, 22 bp, Homo sapiens
taagggttcagaatgcagtggt

SEQ ID NO: 7049173 - DNA, 22 bp, Homo sapiens
taagggttcagaatgcagtggt

SEQ ID NO: 7049174 - DNA, 22 bp, Homo sapiens
taagggttcagaatgcagtggt

SEQ ID NO: 7049175 - DNA, 22 bp, Homo sapiens
taaggtttaacgccctgtctcg

SEQ ID NO: 7049176 - DNA, 19 bp, Homo sapiens
taaggtttaccagcaaaat

SEQ ID NO: 7049177 - DNA, 22 bp, Homo sapiens
taaggtttctagtttctaaact

SEQ ID NO: 7049178 - DNA, 22 bp, Homo sapiens
taaggtttcttcagatactagt

SEQ ID NO: 7049179 - DNA, 22 bp, Homo sapiens
taaggtttgaagaagactgagc

SEQ ID NO: 7049180 - DNA, 22 bp, Homo sapiens
taaggtttgcttatcttcgcct

SEQ ID NO: 7049181 - DNA, 22 bp, Homo sapiens
taaggcaaagtgatttcttaaa

SEQ ID NO: 7049182 - DNA, 22 bp, Homo sapiens
taaggcaatggcattcttgaca

SEQ ID NO: 7049183 - DNA, 22 bp, Homo sapiens
taaggcaggactggatagctat

SEQ ID NO: 7049184 - DNA, 22 bp, Homo sapiens
tacagataggaggaatctgaaa

SEQ ID NO: 7049185 - DNA, 22 bp, Homo sapiens
tacagatatgtatgcacttttt

SEQ ID NO: 7049186 - DNA, 22 bp, Homo sapiens
tacagaactgaagtagtgaaaa

SEQ ID NO: 7049187 - DNA, 22 bp, Homo sapiens
tacagaagctgagacactgaga

SEQ ID NO: 7049188 - DNA, 22 bp, Homo sapiens
tacagaaatcacatcgctttga

SEQ ID NO: 7049189 - DNA, 22 bp, Homo sapiens
tacagaaatactggggggttct

SEQ ID NO: 7049190 - DNA, 22 bp, Homo sapiens
tacagaaatacagtcaggccta

SEQ ID NO: 7049191 - DNA, 22 bp, Homo sapiens
tacagaaattgccaccagctct

SEQ ID NO: 7049192 - DNA, 22 bp, Homo sapiens
tacagaaacagcgtggttagaa

SEQ ID NO: 7049193 - DNA, 22 bp, Homo sapiens
tacagaaaaactggcattgaag

SEQ ID NO: 7049194 - DNA, 22 bp, Homo sapiens
tacagaaaaacttggaggcttt

SEQ ID NO: 7049195 - DNA, 20 bp, Homo sapiens
tacagaaacaggacttttgg

SEQ ID NO: 7049196 - DNA, 22 bp, Homo sapiens
tacagaaagggatgattgatct

SEQ ID NO: 7049197 - DNA, 22 bp, Homo sapiens
tacactcttaggaattggttat

SEQ ID NO: 7049198 - DNA, 22 bp, Homo sapiens
tacactgaagtgtcttggtata

SEQ ID NO: 7049199 - DNA, 22 bp, Homo sapiens
tacactttttactacagattct

SEQ ID NO: 7049200 - DNA, 22 bp, Homo sapiens
tacagaaaaacatctggagccg

SEQ ID NO: 7049201 - DNA, 22 bp, Homo sapiens
tacaaatcagatcatgagttta

SEQ ID NO: 7049202 - DNA, 22 bp, Homo sapiens
tacaacaatttccacattagaa

SEQ ID NO: 7049203 - DNA, 22 bp, Homo sapiens
tacatagagggtaatagcatca

SEQ ID NO: 7049204 - DNA, 22 bp, Homo sapiens
tacagtaataaaatgagctaca

SEQ ID NO: 7049205 - DNA, 22 bp, Homo sapiens
tacaggcactgaaatgcttatt

SEQ ID NO: 7049206 - DNA, 19 bp, Homo sapiens
tacaggcagtttctacaat

SEQ ID NO: 7049207 - DNA, 22 bp, Homo sapiens
tacaggcactgaaatgcttatt

SEQ ID NO: 7049208 - DNA, 19 bp, Homo sapiens
tacaggcagtttctacaat

SEQ ID NO: 7049209 - DNA, 22 bp, Homo sapiens
tacaggcatgaatgaaatctgt

SEQ ID NO: 7049210 - DNA, 22 bp, Homo sapiens
tacaggcatgtagcatggtgat

SEQ ID NO: 7049211 - DNA, 22 bp, Homo sapiens
tacaggcatgtagcatggtgat

SEQ ID NO: 7049212 - DNA, 22 bp, Homo sapiens
tacagggacatggaacaggctc

SEQ ID NO: 7049213 - DNA, 22 bp, Homo sapiens
tacagggactcccgcagagata

SEQ ID NO: 7049214 - DNA, 22 bp, Homo sapiens
tacatatactgagtgatttgct

SEQ ID NO: 7049215 - DNA, 22 bp, Homo sapiens
tacatatagacagttactctag

SEQ ID NO: 7049216 - DNA, 22 bp, Homo sapiens
tacatcatggtgagcaggaggc

SEQ ID NO: 7049217 - DNA, 22 bp, Homo sapiens
tacatagtattcacattgtttt

SEQ ID NO: 7049218 - DNA, 22 bp, Homo sapiens
tacatcatgtaagcagaatcat

SEQ ID NO: 7049219 - DNA, 22 bp, Homo sapiens
tacatctcatctgtgctctccg

SEQ ID NO: 7049220 - DNA, 22 bp, Homo sapiens
tacatctcatctgtgctctccg

SEQ ID NO: 7049221 - DNA, 22 bp, Homo sapiens
tacattcccccaattaccaatg

SEQ ID NO: 7049222 - DNA, 22 bp, Homo sapiens
tacattcctgttagcatctaag

SEQ ID NO: 7049223 - DNA, 22 bp, Homo sapiens
tacattcctgggctccacccta

SEQ ID NO: 7049224 - DNA, 22 bp, Homo sapiens
tacattccttcgtttagagatt

SEQ ID NO: 7049225 - DNA, 22 bp, Homo sapiens
tacattctatatctgttacatc

SEQ ID NO: 7049226 - DNA, 22 bp, Homo sapiens
tacattctgaaataaatggttt

SEQ ID NO: 7049227 - DNA, 22 bp, Homo sapiens
tacattctggaaaggcacagac

SEQ ID NO: 7049228 - DNA, 22 bp, Homo sapiens
tacattctggtggagaaagtaa

SEQ ID NO: 7049229 - DNA, 23 bp, Homo sapiens
tacattctgtatttttatagagt

SEQ ID NO: 7049230 - DNA, 19 bp, Homo sapiens
tactttttcaggacagagt

SEQ ID NO: 7049231 - DNA, 22 bp, Homo sapiens
tagaaaagaattttatttgata

SEQ ID NO: 7049232 - DNA, 22 bp, Homo sapiens
tactttttagcacagtgtgtgc

SEQ ID NO: 7049233 - DNA, 22 bp, Homo sapiens
tacttttagcctatttgattct

SEQ ID NO: 7049234 - DNA, 22 bp, Homo sapiens
tacttttatgtgatgaaatctg

SEQ ID NO: 7049235 - DNA, 22 bp, Homo sapiens
tacttttatgtgatgaaatctg

SEQ ID NO: 7049236 - DNA, 22 bp, Homo sapiens
tactttggttgaatatgtaatg

SEQ ID NO: 7049237 - DNA, 22 bp, Homo sapiens
tagaaaagccccagctggaggg

SEQ ID NO: 7049238 - DNA, 22 bp, Homo sapiens
tagaaacagaaaactgtaatag

SEQ ID NO: 7049239 - DNA, 22 bp, Homo sapiens
tagaaactgatagtcttgtgct

SEQ ID NO: 7049240 - DNA, 22 bp, Homo sapiens
tagaaacccatgtttattcagt

SEQ ID NO: 7049241 - DNA, 22 bp, Homo sapiens
tagaaacatcagctaaccaaaa

SEQ ID NO: 7049242 - DNA, 22 bp, Homo sapiens
tagaaacatcagctaaccaaaa

SEQ ID NO: 7049243 - DNA, 22 bp, Homo sapiens
tagaaatgattggttgagctct

SEQ ID NO: 7049244 - DNA, 22 bp, Homo sapiens
tagaaatgaatgtttaaaagtc

SEQ ID NO: 7049245 - DNA, 22 bp, Homo sapiens
tagaaagtgaaggttaattaat

SEQ ID NO: 7049246 - DNA, 22 bp, Homo sapiens
tagaaagtggttgagagtttag

SEQ ID NO: 7049247 - DNA, 22 bp, Homo sapiens
tagaaagtaaacacgaagtctc

SEQ ID NO: 7049248 - DNA, 22 bp, Homo sapiens
tagaaagtaaatcagttttatt

SEQ ID NO: 7049249 - DNA, 22 bp, Homo sapiens
tagaaagtactaaatttaactg

SEQ ID NO: 7049250 - DNA, 22 bp, Homo sapiens
tagaaagtagccacttacagag

SEQ ID NO: 7049251 - DNA, 22 bp, Homo sapiens
tagaaagtagggaaggtaggat

SEQ ID NO: 7049252 - DNA, 22 bp, Homo sapiens
tagaaagtcaaaacactgtgtt

SEQ ID NO: 7049253 - DNA, 21 bp, Homo sapiens
tagaaagtcaaagctatcagc

SEQ ID NO: 7049254 - DNA, 22 bp, Homo sapiens
tagaaagtcatgaattacacca

SEQ ID NO: 7049255 - DNA, 22 bp, Homo sapiens
tagaaaggatattgagatgaat

SEQ ID NO: 7049256 - DNA, 22 bp, Homo sapiens
tagacactgtatgagctgggtg

SEQ ID NO: 7049257 - DNA, 21 bp, Homo sapiens
tagaggcaggagggactgcag

SEQ ID NO: 7049258 - DNA, 22 bp, Homo sapiens
tagaggcataagagggaagcag

SEQ ID NO: 7049259 - DNA, 22 bp, Homo sapiens
tagaggcattaatgaataaaca

SEQ ID NO: 7049260 - DNA, 22 bp, Homo sapiens
tagaggctactagaggcacctg

SEQ ID NO: 7049261 - DNA, 22 bp, Homo sapiens
tagaggctcctgtgtgtaggtt

SEQ ID NO: 7049262 - DNA, 22 bp, Homo sapiens
tagaggctcttcattgcagtag

SEQ ID NO: 7049263 - DNA, 22 bp, Homo sapiens
tagaggctgggaattattttca

SEQ ID NO: 7049264 - DNA, 22 bp, Homo sapiens
tagaggcttctactgctcactt

SEQ ID NO: 7049265 - DNA, 22 bp, Homo sapiens
tagaggcttctactgctcactt

SEQ ID NO: 7049266 - DNA, 22 bp, Homo sapiens
tagaggctttcagcggtaggtc

SEQ ID NO: 7049267 - DNA, 22 bp, Homo sapiens
tagaatgtggaggtaacagact

SEQ ID NO: 7049268 - DNA, 23 bp, Homo sapiens
tagaatgtcattcaatgatatgg

SEQ ID NO: 7049269 - DNA, 22 bp, Homo sapiens
tagaatgttaagaatatgtata

SEQ ID NO: 7049270 - DNA, 22 bp, Homo sapiens
tagaattcaagattcaacaggc

SEQ ID NO: 7049271 - DNA, 22 bp, Homo sapiens
tagaattcatgttactgttagc

SEQ ID NO: 7049272 - DNA, 22 bp, Homo sapiens
tagaatgagaaagtgtagcagg

SEQ ID NO: 7049273 - DNA, 22 bp, Homo sapiens
tagacaactggagatagtctga

SEQ ID NO: 7049274 - DNA, 22 bp, Homo sapiens
tagacaatgccatcttgtggtt

SEQ ID NO: 7049275 - DNA, 22 bp, Homo sapiens
tagcttaaaccaatctgaataa

SEQ ID NO: 7049276 - DNA, 22 bp, Homo sapiens
tagctttaatgagttggtaaga

SEQ ID NO: 7049277 - DNA, 22 bp, Homo sapiens
tagctcttcatttcatctgatt

SEQ ID NO: 7049278 - DNA, 22 bp, Homo sapiens
tagctcttcaatcactgtctcc

SEQ ID NO: 7049279 - DNA, 22 bp, Homo sapiens
tagcccctgcctttgaacctgg

SEQ ID NO: 7049280 - DNA, 22 bp, Homo sapiens
tagcccctgcctttgaacctgg

SEQ ID NO: 7049281 - DNA, 19 bp, Homo sapiens
tagccctggccatcatgag

SEQ ID NO: 7049282 - DNA, 22 bp, Homo sapiens
tagccctgtccttggcctgtgc

SEQ ID NO: 7049283 - DNA, 23 bp, Homo sapiens
tagcagcatttttagcctctgtc

SEQ ID NO: 7049284 - DNA, 22 bp, Homo sapiens
tagcagcccagtttctggccaa

SEQ ID NO: 7049285 - DNA, 17 bp, Homo sapiens
tagcagcagtaattgtg

SEQ ID NO: 7049286 - DNA, 22 bp, Homo sapiens
tagcagagtgattggccatgag

SEQ ID NO: 7049287 - DNA, 22 bp, Homo sapiens
tagcagagggtagtgccggggc

SEQ ID NO: 7049288 - DNA, 22 bp, Homo sapiens
tagcagaggtaagtgtggcaat

SEQ ID NO: 7049289 - DNA, 22 bp, Homo sapiens
tagcagagtaatactttggagc

SEQ ID NO: 7049290 - DNA, 21 bp, Homo sapiens
tagcagagatcattttctcct

SEQ ID NO: 7049291 - DNA, 22 bp, Homo sapiens
tagcagagcacatcttcattct

SEQ ID NO: 7049292 - DNA, 22 bp, Homo sapiens
tagcagagcagggatcagagcc

SEQ ID NO: 7049293 - DNA, 22 bp, Homo sapiens
tagcagagcagggatcagagcc

SEQ ID NO: 7049294 - DNA, 22 bp, Homo sapiens
tagcagagcgggtgcgaggcgg

SEQ ID NO: 7049295 - DNA, 22 bp, Homo sapiens
tagcagagctgcaatatagacc

SEQ ID NO: 7049296 - DNA, 22 bp, Homo sapiens
tagcagaggcaaggatgtgaat

SEQ ID NO: 7049297 - DNA, 22 bp, Homo sapiens
tagcagaggctactgctccttg

SEQ ID NO: 7049298 - DNA, 22 bp, Homo sapiens
tagcagaggctgtctgacttaa

SEQ ID NO: 7049299 - DNA, 22 bp, Homo sapiens
tagcagagaggggacagtggca

SEQ ID NO: 7049300 - DNA, 22 bp, Homo sapiens
tagcagagaggggacagtggca

SEQ ID NO: 7049301 - DNA, 22 bp, Homo sapiens
tagcagagaggtttcagctaat

SEQ ID NO: 7049302 - DNA, 21 bp, Homo sapiens
tagcagagagttaacttctcc

SEQ ID NO: 7049303 - DNA, 20 bp, Homo sapiens
tagaggtgggatttgggttt

SEQ ID NO: 7049304 - DNA, 22 bp, Homo sapiens
tagaggtgtcactttgggaagt

SEQ ID NO: 7049305 - DNA, 22 bp, Homo sapiens
tagaggtgttcattctctccat

SEQ ID NO: 7049306 - DNA, 22 bp, Homo sapiens
tagaggtgttgacgccaaggta

SEQ ID NO: 7049307 - DNA, 22 bp, Homo sapiens
tagaggtgttgttgatatagaa

SEQ ID NO: 7049308 - DNA, 22 bp, Homo sapiens
tagaggtgacactgagaccata

SEQ ID NO: 7049309 - DNA, 22 bp, Homo sapiens
tagaggtataccaaaaaggcat

SEQ ID NO: 7049310 - DNA, 22 bp, Homo sapiens
tagaggtatttttgatggtcat

SEQ ID NO: 7049311 - DNA, 22 bp, Homo sapiens
tagaggtgacactgagaccata

SEQ ID NO: 7049312 - DNA, 22 bp, Homo sapiens
tagaggtgagacttcagtgaca

SEQ ID NO: 7049313 - DNA, 22 bp, Homo sapiens
tagaggtgagaggaactttgga

SEQ ID NO: 7049314 - DNA, 22 bp, Homo sapiens
tagaggtgagatattttatttt

SEQ ID NO: 7049315 - DNA, 22 bp, Homo sapiens
tagaggtgagatattttatttt

SEQ ID NO: 7049316 - DNA, 22 bp, Homo sapiens
tagaggtgagattgtggtgctg

SEQ ID NO: 7049317 - DNA, 22 bp, Homo sapiens
tagaggtgagccatcaaggggc

SEQ ID NO: 7049318 - DNA, 22 bp, Homo sapiens
tagaggtactcccctcaaagtt

SEQ ID NO: 7049319 - DNA, 22 bp, Homo sapiens
tagaggtagagttacattagtc

SEQ ID NO: 7049320 - DNA, 22 bp, Homo sapiens
tagaggtagatggtcagccaat

SEQ ID NO: 7049321 - DNA, 22 bp, Homo sapiens
tagaggtagcaacaggactaga

SEQ ID NO: 7049322 - DNA, 22 bp, Homo sapiens
tagggagaaacaccaatttatt

SEQ ID NO: 7049323 - DNA, 22 bp, Homo sapiens
taggctgggcctgccttccagg

SEQ ID NO: 7049324 - DNA, 22 bp, Homo sapiens
tagggagaggaagcaggccgct

SEQ ID NO: 7049325 - DNA, 20 bp, Homo sapiens
tagggagatatgctcttttc

SEQ ID NO: 7049326 - DNA, 22 bp, Homo sapiens
tagggagatgcaagggacggag

SEQ ID NO: 7049327 - DNA, 22 bp, Homo sapiens
taggcagaaaggaaggcaagtt

SEQ ID NO: 7049328 - DNA, 22 bp, Homo sapiens
taggctgggagcctgaggctag

SEQ ID NO: 7049329 - DNA, 22 bp, Homo sapiens
taggctgggagcctgaggctag

SEQ ID NO: 7049330 - DNA, 22 bp, Homo sapiens
taggctgggcattctggccagg

SEQ ID NO: 7049331 - DNA, 22 bp, Homo sapiens
taggctgggcattctggccagg

SEQ ID NO: 7049332 - DNA, 22 bp, Homo sapiens
tagggaggctacttcttgtagg

SEQ ID NO: 7049333 - DNA, 22 bp, Homo sapiens
tagggcagagtccaggatgggc

SEQ ID NO: 7049334 - DNA, 22 bp, Homo sapiens
tagctttccttgttgcctgtgc

SEQ ID NO: 7049335 - DNA, 22 bp, Homo sapiens
tagctttaggcacgtttgaatt

SEQ ID NO: 7049336 - DNA, 22 bp, Homo sapiens
tagctttagtgaaaaatatcag

SEQ ID NO: 7049337 - DNA, 22 bp, Homo sapiens
tagctttacaaagtgctgcacc

SEQ ID NO: 7049338 - DNA, 22 bp, Homo sapiens
tagctttaccatagaagagtat

SEQ ID NO: 7049339 - DNA, 22 bp, Homo sapiens
tagctttagaaatattctcaga

SEQ ID NO: 7049340 - DNA, 22 bp, Homo sapiens
tagctttaggatggttctcttg

SEQ ID NO: 7049341 - DNA, 22 bp, Homo sapiens
taggatacaaattctgtaattt

SEQ ID NO: 7049342 - DNA, 22 bp, Homo sapiens
taggatgatcttgtagagagat

SEQ ID NO: 7049343 - DNA, 22 bp, Homo sapiens
taggatttaataaaagaataga

SEQ ID NO: 7049344 - DNA, 22 bp, Homo sapiens
taggatttaggctttaacatct

SEQ ID NO: 7049345 - DNA, 22 bp, Homo sapiens
taggaaacaaagtaatgcaact

SEQ ID NO: 7049346 - DNA, 22 bp, Homo sapiens
taggaaactaatacagtctgga

SEQ ID NO: 7049347 - DNA, 22 bp, Homo sapiens
taggaaactcaaagggaagtgg

SEQ ID NO: 7049348 - DNA, 22 bp, Homo sapiens
tatgacattataaaggattatt

SEQ ID NO: 7049349 - DNA, 22 bp, Homo sapiens
tatgagaaaataaatatctgtt

SEQ ID NO: 7049350 - DNA, 22 bp, Homo sapiens
tatgagaaaataaatatctgtt

SEQ ID NO: 7049351 - DNA, 23 bp, Homo sapiens
tatcctaaaggcaacaggaagtc

SEQ ID NO: 7049352 - DNA, 22 bp, Homo sapiens
tatctaaaggatttaatttagt

SEQ ID NO: 7049353 - DNA, 22 bp, Homo sapiens
tatctaaaggatttaatttagt

SEQ ID NO: 7049354 - DNA, 20 bp, Homo sapiens
tatctaaatgcttacattac

SEQ ID NO: 7049355 - DNA, 22 bp, Homo sapiens
tatctagaaacagagttttact

SEQ ID NO: 7049356 - DNA, 19 bp, Homo sapiens
tatgacaagtactagttct

SEQ ID NO: 7049357 - DNA, 22 bp, Homo sapiens
tatatcatggagattaacattc

SEQ ID NO: 7049358 - DNA, 22 bp, Homo sapiens
tatatcatggagattaacattc

SEQ ID NO: 7049359 - DNA, 22 bp, Homo sapiens
tatatattcttaagtagtgtag

SEQ ID NO: 7049360 - DNA, 19 bp, Homo sapiens
tatatattttggggttgtg

SEQ ID NO: 7049361 - DNA, 22 bp, Homo sapiens
tatatcaccaaaaacagttctg

SEQ ID NO: 7049362 - DNA, 22 bp, Homo sapiens
tatatcaccaaaaacagttctg

SEQ ID NO: 7049363 - DNA, 22 bp, Homo sapiens
tatccaaagtggcatattatag

SEQ ID NO: 7049364 - DNA, 22 bp, Homo sapiens
tatccaattcaccattgatggg

SEQ ID NO: 7049365 - DNA, 22 bp, Homo sapiens
tatagccatttccagtggcatc

SEQ ID NO: 7049366 - DNA, 22 bp, Homo sapiens
tataggaaataggtcttctgtg

SEQ ID NO: 7049367 - DNA, 22 bp, Homo sapiens
tataggaaatttatctcctggg

SEQ ID NO: 7049368 - DNA, 22 bp, Homo sapiens
tataggaaggcagattttagct

SEQ ID NO: 7049369 - DNA, 22 bp, Homo sapiens
tatagtaaaattttcatttatg

SEQ ID NO: 7049370 - DNA, 22 bp, Homo sapiens
tatagtacacttaggtacttca

SEQ ID NO: 7049371 - DNA, 22 bp, Homo sapiens
tatagttagtttcataatcatg

SEQ ID NO: 7049372 - DNA, 22 bp, Homo sapiens
tatacacatttttacctatagt

SEQ ID NO: 7049373 - DNA, 23 bp, Homo sapiens
tatacacatgtggcagtatagtg

SEQ ID NO: 7049374 - DNA, 22 bp, Homo sapiens
tatacacatcctccaaagatag

SEQ ID NO: 7049375 - DNA, 22 bp, Homo sapiens
tatacacatcctccaaagatag

SEQ ID NO: 7049376 - DNA, 22 bp, Homo sapiens
tatacacatatcttctaggcct

SEQ ID NO: 7049377 - DNA, 17 bp, Homo sapiens
tatacacagacagactg

SEQ ID NO: 7049378 - DNA, 22 bp, Homo sapiens
tatacacaggaatctgtgaaaa

SEQ ID NO: 7049379 - DNA, 22 bp, Homo sapiens
tatacacacctccaaagcagga

SEQ ID NO: 7049380 - DNA, 22 bp, Homo sapiens
tatacacacctccaaagcagga

SEQ ID NO: 7049381 - DNA, 22 bp, Homo sapiens
tatacacaaggtgtgcatttgt

SEQ ID NO: 7049382 - DNA, 22 bp, Homo sapiens
tatacacaaggtgtgcatttgt

SEQ ID NO: 7049383 - DNA, 22 bp, Homo sapiens
tatacaatggctgaatcatcca

SEQ ID NO: 7049384 - DNA, 22 bp, Homo sapiens
tatacaatggctgaatcatcca

SEQ ID NO: 7049385 - DNA, 22 bp, Homo sapiens
tatacaatggctgaatcatcca

SEQ ID NO: 7049386 - DNA, 22 bp, Homo sapiens
tatacaatggctgaatcatcca

SEQ ID NO: 7049387 - DNA, 22 bp, Homo sapiens
tataagaaacaaggcaaatttt

SEQ ID NO: 7049388 - DNA, 20 bp, Homo sapiens
tataaattcagagctttggt

SEQ ID NO: 7049389 - DNA, 22 bp, Homo sapiens
tataaattaatgtgcccatgag

SEQ ID NO: 7049390 - DNA, 22 bp, Homo sapiens
tataaatgcacttttgaaatat

SEQ ID NO: 7049391 - DNA, 22 bp, Homo sapiens
tataaatgcacttttgaaatat

SEQ ID NO: 7049392 - DNA, 22 bp, Homo sapiens
taggtgctggataaagaatggt

SEQ ID NO: 7049393 - DNA, 22 bp, Homo sapiens
taggtgtctgctcttatttaac

SEQ ID NO: 7049394 - DNA, 22 bp, Homo sapiens
taggggtgaggccaggcatcag

SEQ ID NO: 7049395 - DNA, 22 bp, Homo sapiens
taggggtggagctaagagtccc

SEQ ID NO: 7049396 - DNA, 22 bp, Homo sapiens
taggggtgggatccaggaatta

SEQ ID NO: 7049397 - DNA, 22 bp, Homo sapiens
taggggtgtttcgagagaggtt

SEQ ID NO: 7049398 - DNA, 22 bp, Homo sapiens
taggggtgtttcgagagaggtt

SEQ ID NO: 7049399 - DNA, 22 bp, Homo sapiens
taggtctgtaaatgagagagac

SEQ ID NO: 7049400 - DNA, 22 bp, Homo sapiens
tattagaggaaccaaggtggag

SEQ ID NO: 7049401 - DNA, 22 bp, Homo sapiens
tattagattaactttaatgtct

SEQ ID NO: 7049402 - DNA, 22 bp, Homo sapiens
tatgtacacacacatgcatgta

SEQ ID NO: 7049403 - DNA, 22 bp, Homo sapiens
tatgaggcacttcattagctgg

SEQ ID NO: 7049404 - DNA, 22 bp, Homo sapiens
tatgagttcagttatcttaagt

SEQ ID NO: 7049405 - DNA, 22 bp, Homo sapiens
tatgtacagggatagaacttga

SEQ ID NO: 7049406 - DNA, 22 bp, Homo sapiens
tatgtacataacatgaaatgca

SEQ ID NO: 7049407 - DNA, 22 bp, Homo sapiens
tatttatattctgccttctgct

SEQ ID NO: 7049408 - DNA, 22 bp, Homo sapiens
tatttatcgagtgtctactatg

SEQ ID NO: 7049409 - DNA, 22 bp, Homo sapiens
tatttatcgagtgtctactatg

SEQ ID NO: 7049410 - DNA, 21 bp, Homo sapiens
tatttattaatttgtaaggct

SEQ ID NO: 7049411 - DNA, 22 bp, Homo sapiens
tatttataatctgccaaagaga

SEQ ID NO: 7049412 - DNA, 22 bp, Homo sapiens
tatttataatctgccaaagaga

SEQ ID NO: 7049413 - DNA, 22 bp, Homo sapiens
tattgacaatttgtgaaactat

SEQ ID NO: 7049414 - DNA, 22 bp, Homo sapiens
tattgacaggtgcctgcagaca

SEQ ID NO: 7049415 - DNA, 22 bp, Homo sapiens
tatttaattagtgattgtagag

SEQ ID NO: 7049416 - DNA, 22 bp, Homo sapiens
tatttattcattcagcaagcat

SEQ ID NO: 7049417 - DNA, 22 bp, Homo sapiens
tatttattcattcagcaagcat

SEQ ID NO: 7049418 - DNA, 22 bp, Homo sapiens
tatttattctttgtactgcctt

SEQ ID NO: 7049419 - DNA, 22 bp, Homo sapiens
tatttattctttgtactgcctt

SEQ ID NO: 7049420 - DNA, 22 bp, Homo sapiens
tatttattggacagtgttgctg

SEQ ID NO: 7049421 - DNA, 22 bp, Homo sapiens
tatttattggacagtgttgctg

SEQ ID NO: 7049422 - DNA, 22 bp, Homo sapiens
tatttctaagctgtaagtctga

SEQ ID NO: 7049423 - DNA, 22 bp, Homo sapiens
tatttctattccccaggcaagt

SEQ ID NO: 7049424 - DNA, 22 bp, Homo sapiens
tatttctcagcattttacatcc

SEQ ID NO: 7049425 - DNA, 22 bp, Homo sapiens
tatttctcttcaaaattgatgt

SEQ ID NO: 7049426 - DNA, 22 bp, Homo sapiens
tattaggtagattttactgatt

SEQ ID NO: 7049427 - DNA, 22 bp, Homo sapiens
tattattaaatggcagaatttt

SEQ ID NO: 7049428 - DNA, 22 bp, Homo sapiens
tattattatattggatgagact

SEQ ID NO: 7049429 - DNA, 22 bp, Homo sapiens
tattattgcaagtatataaagt

SEQ ID NO: 7049430 - DNA, 22 bp, Homo sapiens
tattctgggtaccaaacttcaa

SEQ ID NO: 7049431 - DNA, 22 bp, Homo sapiens
tattctggtttccggatctcta

SEQ ID NO: 7049432 - DNA, 22 bp, Homo sapiens
tattctcagcaacacacatgga

SEQ ID NO: 7049433 - DNA, 22 bp, Homo sapiens
tattctcagtgctataagtaga

SEQ ID NO: 7049434 - DNA, 22 bp, Homo sapiens
tattctcattagtctgtattcc

SEQ ID NO: 7049435 - DNA, 22 bp, Homo sapiens
tattctccccggatcagggcaa

SEQ ID NO: 7049436 - DNA, 22 bp, Homo sapiens
tattgacaataggcaactgagg

SEQ ID NO: 7049437 - DNA, 22 bp, Homo sapiens
tattgacaatttgtgaaactat

SEQ ID NO: 7049438 - DNA, 22 bp, Homo sapiens
tattcttactctcgactgcatt

SEQ ID NO: 7049439 - DNA, 22 bp, Homo sapiens
tcaataatggcaggataaattt

SEQ ID NO: 7049440 - DNA, 22 bp, Homo sapiens
tcaagtgcttgtgaggtatttg

SEQ ID NO: 7049441 - DNA, 22 bp, Homo sapiens
tcaagttaggtggttgttagga

SEQ ID NO: 7049442 - DNA, 22 bp, Homo sapiens
tcaataaaattgttttcctatc

SEQ ID NO: 7049443 - DNA, 22 bp, Homo sapiens
tcaataaaattgttttcctatc

SEQ ID NO: 7049444 - DNA, 22 bp, Homo sapiens
tcaaggctaaactttcagagta

SEQ ID NO: 7049445 - DNA, 19 bp, Homo sapiens
tcaaggctccctgagggat

SEQ ID NO: 7049446 - DNA, 22 bp, Homo sapiens
tcaagggaggagacacagccct

SEQ ID NO: 7049447 - DNA, 22 bp, Homo sapiens
tcaagggaggagacacagccct

SEQ ID NO: 7049448 - DNA, 22 bp, Homo sapiens
tcaagtatttatttctgctggc

SEQ ID NO: 7049449 - DNA, 22 bp, Homo sapiens
tcaagtcatttgactgtgtgtt

SEQ ID NO: 7049450 - DNA, 22 bp, Homo sapiens
tatttcttgagactcgtcttcc

SEQ ID NO: 7049451 - DNA, 22 bp, Homo sapiens
tatttcttcgggattcaagcta

SEQ ID NO: 7049452 - DNA, 22 bp, Homo sapiens
tatttcttgagtggtcagtttc

SEQ ID NO: 7049453 - DNA, 22 bp, Homo sapiens
tcaagaatttggataagaaatg

SEQ ID NO: 7049454 - DNA, 20 bp, Homo sapiens
tcaagacagacatggagttt

SEQ ID NO: 7049455 - DNA, 22 bp, Homo sapiens
tatttctgtttatttgtacatc

SEQ ID NO: 7049456 - DNA, 22 bp, Homo sapiens
tatttctgattgctcatgaggc

SEQ ID NO: 7049457 - DNA, 20 bp, Homo sapiens
tatttctgggcaaccattta

SEQ ID NO: 7049458 - DNA, 22 bp, Homo sapiens
tcaagacagatgggtaacttgg

SEQ ID NO: 7049459 - DNA, 21 bp, Homo sapiens
tcaagacagcatatttaagaa

SEQ ID NO: 7049460 - DNA, 22 bp, Homo sapiens
tcaagacagggtttaaggttga

SEQ ID NO: 7049461 - DNA, 22 bp, Homo sapiens
tcaagacagtgtgatactggcc

SEQ ID NO: 7049462 - DNA, 22 bp, Homo sapiens
tcaagacatattaaatgtgcga

SEQ ID NO: 7049463 - DNA, 22 bp, Homo sapiens
tcaagacatcactgtgcatttt

SEQ ID NO: 7049464 - DNA, 18 bp, Homo sapiens
tcaagacatcatgaaata

SEQ ID NO: 7049465 - DNA, 18 bp, Homo sapiens
tcaagacatcatgaaata

SEQ ID NO: 7049466 - DNA, 22 bp, Homo sapiens
tcaagagaaggggaaatagact

SEQ ID NO: 7049467 - DNA, 22 bp, Homo sapiens
tcaagagaaggggaaatagact

SEQ ID NO: 7049468 - DNA, 22 bp, Homo sapiens
tcaagagaagtgctccacagta

SEQ ID NO: 7049469 - DNA, 22 bp, Homo sapiens
tcaagagacaggacgtgtttca

SEQ ID NO: 7049470 - DNA, 22 bp, Homo sapiens
tcaagagagtgctgcttggggt

SEQ ID NO: 7049471 - DNA, 22 bp, Homo sapiens
tcaagagattgaataataactg

SEQ ID NO: 7049472 - DNA, 22 bp, Homo sapiens
tcaaggaaggtctgttgctcca

SEQ ID NO: 7049473 - DNA, 20 bp, Homo sapiens
tcaaggactccctgggaaga

SEQ ID NO: 7049474 - DNA, 22 bp, Homo sapiens
tcacagaagagcattaagatga

SEQ ID NO: 7049475 - DNA, 22 bp, Homo sapiens
tcacagaagaagtagattgcat

SEQ ID NO: 7049476 - DNA, 22 bp, Homo sapiens
tcacagaaataagatagttatt

SEQ ID NO: 7049477 - DNA, 22 bp, Homo sapiens
tcacaatactcactcaatggct

SEQ ID NO: 7049478 - DNA, 22 bp, Homo sapiens
tcacaatatttatcttccaatt

SEQ ID NO: 7049479 - DNA, 20 bp, Homo sapiens
tcaattttctacaacatttg

SEQ ID NO: 7049480 - DNA, 22 bp, Homo sapiens
tcacaaagggagggatagctgg

SEQ ID NO: 7049481 - DNA, 22 bp, Homo sapiens
tcacagaaggcatcacagaaga

SEQ ID NO: 7049482 - DNA, 19 bp, Homo sapiens
tcacaggcatctccccaga

SEQ ID NO: 7049483 - DNA, 22 bp, Homo sapiens
tcacagaataaatgtactggcc

SEQ ID NO: 7049484 - DNA, 22 bp, Homo sapiens
tcacagaataaattgagaagac

SEQ ID NO: 7049485 - DNA, 22 bp, Homo sapiens
tcacagctccagactgcaactc

SEQ ID NO: 7049486 - DNA, 22 bp, Homo sapiens
tcacagctccagactgcaactc

SEQ ID NO: 7049487 - DNA, 22 bp, Homo sapiens
tcacaggcctggggcagagggc

SEQ ID NO: 7049488 - DNA, 22 bp, Homo sapiens
tcacaggctccagggcctggat

SEQ ID NO: 7049489 - DNA, 22 bp, Homo sapiens
tcacaggctggtctccgaggac

SEQ ID NO: 7049490 - DNA, 22 bp, Homo sapiens
tcagaaaagaccacattattct

SEQ ID NO: 7049491 - DNA, 22 bp, Homo sapiens
tcacttttgatccctatgcagt

SEQ ID NO: 7049492 - DNA, 22 bp, Homo sapiens
tcagaaaagagaaaatcttata

SEQ ID NO: 7049493 - DNA, 22 bp, Homo sapiens
tcagaaaaggtagctgtgacaa

SEQ ID NO: 7049494 - DNA, 22 bp, Homo sapiens
tcagagaactccacaccttagg

SEQ ID NO: 7049495 - DNA, 22 bp, Homo sapiens
tcagagaagctgccaggcgagc

SEQ ID NO: 7049496 - DNA, 20 bp, Homo sapiens
tcagagaaggagctttcctg

SEQ ID NO: 7049497 - DNA, 20 bp, Homo sapiens
tcagagaaggagctttcctg

SEQ ID NO: 7049498 - DNA, 23 bp, Homo sapiens
tcagagaggccccctgcagagat

SEQ ID NO: 7049499 - DNA, 23 bp, Homo sapiens
tcagagaggccccctgcagagat

SEQ ID NO: 7049500 - DNA, 22 bp, Homo sapiens
tcagagaggttggtgataagaa

SEQ ID NO: 7049501 - DNA, 22 bp, Homo sapiens
tcagagcactggtgctaccttg

SEQ ID NO: 7049502 - DNA, 22 bp, Homo sapiens
tcagagctaaggggagagcaaa

SEQ ID NO: 7049503 - DNA, 22 bp, Homo sapiens
tcagagctgcccatgcaagggg

SEQ ID NO: 7049504 - DNA, 22 bp, Homo sapiens
tcagagctttggagaccaggaa

SEQ ID NO: 7049505 - DNA, 22 bp, Homo sapiens
tcagaggaaacaatctttagta

SEQ ID NO: 7049506 - DNA, 22 bp, Homo sapiens
tcagaggaaagggaacatagtc

SEQ ID NO: 7049507 - DNA, 22 bp, Homo sapiens
tcagaggaaagggaacatagtc

SEQ ID NO: 7049508 - DNA, 22 bp, Homo sapiens
tcagaggaaagggaacatagtc

SEQ ID NO: 7049509 - DNA, 22 bp, Homo sapiens
tcagaggaaaggtcagatggct

SEQ ID NO: 7049510 - DNA, 22 bp, Homo sapiens
tcagaggaaaggtcagatggct

SEQ ID NO: 7049511 - DNA, 22 bp, Homo sapiens
tcagaggaaaggtcagatggct

SEQ ID NO: 7049512 - DNA, 22 bp, Homo sapiens
tcagaggaacactgtttcatgc

SEQ ID NO: 7049513 - DNA, 22 bp, Homo sapiens
tcagaggaacactgtttcatgc

SEQ ID NO: 7049514 - DNA, 22 bp, Homo sapiens
tcagaggaactggactaaagcc

SEQ ID NO: 7049515 - DNA, 22 bp, Homo sapiens
tcagaggaagcatcaagttctc

SEQ ID NO: 7049516 - DNA, 22 bp, Homo sapiens
tcagcaatgtgatactgtgcaa

SEQ ID NO: 7049517 - DNA, 22 bp, Homo sapiens
tcagcacaggtcttgcaaaaca

SEQ ID NO: 7049518 - DNA, 22 bp, Homo sapiens
tcacattttctactactgtacg

SEQ ID NO: 7049519 - DNA, 22 bp, Homo sapiens
tcacagtagttgttctctgttt

SEQ ID NO: 7049520 - DNA, 22 bp, Homo sapiens
tcacagtataacctcatatagg

SEQ ID NO: 7049521 - DNA, 22 bp, Homo sapiens
tcacattttatctgagattgac

SEQ ID NO: 7049522 - DNA, 22 bp, Homo sapiens
tcacattttcaaaagctggtgc

SEQ ID NO: 7049523 - DNA, 22 bp, Homo sapiens
tcaccaataataacttgagaat

SEQ ID NO: 7049524 - DNA, 22 bp, Homo sapiens
tcaccactgaacagacctttgg

SEQ ID NO: 7049525 - DNA, 22 bp, Homo sapiens
tcaccaggattcctatcagtag

SEQ ID NO: 7049526 - DNA, 22 bp, Homo sapiens
tcaccaggattgggctgtaggc

SEQ ID NO: 7049527 - DNA, 22 bp, Homo sapiens
tcaccaggcaactatgtactcc

SEQ ID NO: 7049528 - DNA, 22 bp, Homo sapiens
tcaccaggctagagtgcagtgg

SEQ ID NO: 7049529 - DNA, 22 bp, Homo sapiens
tcacccagccttggcgggtttg

SEQ ID NO: 7049530 - DNA, 22 bp, Homo sapiens
tcacccaggctggactgcagtg

SEQ ID NO: 7049531 - DNA, 22 bp, Homo sapiens
tcactagcattgttgaaggact

SEQ ID NO: 7049532 - DNA, 20 bp, Homo sapiens
tcactagtaaccatctgctt

SEQ ID NO: 7049533 - DNA, 21 bp, Homo sapiens
tcactagtgccttctgtcatt

SEQ ID NO: 7049534 - DNA, 22 bp, Homo sapiens
tcactgaatttcaagctagtgg

SEQ ID NO: 7049535 - DNA, 22 bp, Homo sapiens
tcactgaagactgggctctaaa

SEQ ID NO: 7049536 - DNA, 22 bp, Homo sapiens
tcactgaagactgggctctaaa

SEQ ID NO: 7049537 - DNA, 21 bp, Homo sapiens
tcactgaagcctaagatgttt

SEQ ID NO: 7049538 - DNA, 21 bp, Homo sapiens
tcactgaagcctaagatgttt

SEQ ID NO: 7049539 - DNA, 22 bp, Homo sapiens
tcactgaaggaagacactgtca

SEQ ID NO: 7049540 - DNA, 22 bp, Homo sapiens
tcactgaagtcttcaagtagga

SEQ ID NO: 7049541 - DNA, 22 bp, Homo sapiens
tcactgaatacttgtctcatcc

SEQ ID NO: 7049542 - DNA, 22 bp, Homo sapiens
tcactgaatacttgtctcatcc

SEQ ID NO: 7049543 - DNA, 22 bp, Homo sapiens
tcactgaatgcagatacgtgac

SEQ ID NO: 7049544 - DNA, 22 bp, Homo sapiens
tcactctgtgtttgaactcaag

SEQ ID NO: 7049545 - DNA, 22 bp, Homo sapiens
tcactctgttttactcactgtt

SEQ ID NO: 7049546 - DNA, 22 bp, Homo sapiens
tcactctgttttactcactgtt

SEQ ID NO: 7049547 - DNA, 22 bp, Homo sapiens
tcactgaaaaccatacttcttt

SEQ ID NO: 7049548 - DNA, 22 bp, Homo sapiens
tcactgaaagaatgacattatg

SEQ ID NO: 7049549 - DNA, 22 bp, Homo sapiens
tcactgaaagtaattctagtga

SEQ ID NO: 7049550 - DNA, 22 bp, Homo sapiens
tcactgaaccagggatctctag

SEQ ID NO: 7049551 - DNA, 22 bp, Homo sapiens
tcactgaactctcatagagaaa

SEQ ID NO: 7049552 - DNA, 22 bp, Homo sapiens
tcactgaactctcatagagaaa

SEQ ID NO: 7049553 - DNA, 22 bp, Homo sapiens
tcactttacagatgggaaaact

SEQ ID NO: 7049554 - DNA, 22 bp, Homo sapiens
tcactttacagctaaggttgtt

SEQ ID NO: 7049555 - DNA, 22 bp, Homo sapiens
tcactttactttgttaatctgg

SEQ ID NO: 7049556 - DNA, 22 bp, Homo sapiens
tcactttactttgttaatctgg

SEQ ID NO: 7049557 - DNA, 22 bp, Homo sapiens
tcactttgacagagaaatgaat

SEQ ID NO: 7049558 - DNA, 22 bp, Homo sapiens
tcactttgacagagaaatgaat

SEQ ID NO: 7049559 - DNA, 22 bp, Homo sapiens
tcactttgatgacattgtagct

SEQ ID NO: 7049560 - DNA, 23 bp, Homo sapiens
tcactttgatgtaattgaaaagc

SEQ ID NO: 7049561 - DNA, 22 bp, Homo sapiens
tcactttgccctgtaccttggg

SEQ ID NO: 7049562 - DNA, 22 bp, Homo sapiens
tcactttggaagatagcacatc

SEQ ID NO: 7049563 - DNA, 22 bp, Homo sapiens
tcactttggattatgtaatttc

SEQ ID NO: 7049564 - DNA, 22 bp, Homo sapiens
tcactttggattatgtaatttc

SEQ ID NO: 7049565 - DNA, 22 bp, Homo sapiens
tcactttggattatgtaatttc

SEQ ID NO: 7049566 - DNA, 22 bp, Homo sapiens
tcaggaggtgtaacgaatacag

SEQ ID NO: 7049567 - DNA, 22 bp, Homo sapiens
tcaggagtaaagaagacttgac

SEQ ID NO: 7049568 - DNA, 22 bp, Homo sapiens
tcagctctgcaaggtcacctcc

SEQ ID NO: 7049569 - DNA, 22 bp, Homo sapiens
tcagctctgcaaggtcacctcc

SEQ ID NO: 7049570 - DNA, 22 bp, Homo sapiens
tcagctctacacacacctgtgt

SEQ ID NO: 7049571 - DNA, 22 bp, Homo sapiens
tcagctcctcatgcaggggata

SEQ ID NO: 7049572 - DNA, 22 bp, Homo sapiens
tcagccttgtggccctgctcca

SEQ ID NO: 7049573 - DNA, 22 bp, Homo sapiens
tcagcactttgaagcagaagga

SEQ ID NO: 7049574 - DNA, 21 bp, Homo sapiens
tcaggcagtgcaaatacatgg

SEQ ID NO: 7049575 - DNA, 20 bp, Homo sapiens
tcaggcagtggggaaaggca

SEQ ID NO: 7049576 - DNA, 20 bp, Homo sapiens
tcaggcagtggggaaaggca

SEQ ID NO: 7049577 - DNA, 22 bp, Homo sapiens
tcaggcagtggtaaatgagtta

SEQ ID NO: 7049578 - DNA, 19 bp, Homo sapiens
tcaggcagttattcacaaa

SEQ ID NO: 7049579 - DNA, 22 bp, Homo sapiens
tcagggaaattcaagggagatt

SEQ ID NO: 7049580 - DNA, 22 bp, Homo sapiens
tcagggaaatttccatgtgttt

SEQ ID NO: 7049581 - DNA, 22 bp, Homo sapiens
tcagggaacaatgttatggctt

SEQ ID NO: 7049582 - DNA, 22 bp, Homo sapiens
tcagggaaaagtcacactgggt

SEQ ID NO: 7049583 - DNA, 22 bp, Homo sapiens
tcagggaaacctaaggaagcca

SEQ ID NO: 7049584 - DNA, 22 bp, Homo sapiens
tcagggaaaggggagagtcatt

SEQ ID NO: 7049585 - DNA, 22 bp, Homo sapiens
tcagggaaatagcagggctgaa

SEQ ID NO: 7049586 - DNA, 17 bp, Homo sapiens
tcaggctgggtgcagtg

SEQ ID NO: 7049587 - DNA, 22 bp, Homo sapiens
tcaggctggggtgctaaggtgt

SEQ ID NO: 7049588 - DNA, 22 bp, Homo sapiens
tcaggctgggctcctctcccca

SEQ ID NO: 7049589 - DNA, 22 bp, Homo sapiens
tcaggctggagtgcagtggcgc

SEQ ID NO: 7049590 - DNA, 22 bp, Homo sapiens
tcaggctgggagacaatcactg

SEQ ID NO: 7049591 - DNA, 18 bp, Homo sapiens
tcaggctgggcctccttc

SEQ ID NO: 7049592 - DNA, 18 bp, Homo sapiens
tcaggctgggcctccttc

SEQ ID NO: 7049593 - DNA, 22 bp, Homo sapiens
tcaggctgggctcctctcccca

SEQ ID NO: 7049594 - DNA, 22 bp, Homo sapiens
tcaggctgaggtcatctgcatc

SEQ ID NO: 7049595 - DNA, 22 bp, Homo sapiens
tcaggctgataggaggaactga

SEQ ID NO: 7049596 - DNA, 21 bp, Homo sapiens
tcaggctgatgtcgatgttag

SEQ ID NO: 7049597 - DNA, 22 bp, Homo sapiens
tcaggctgctggccagcaggct

SEQ ID NO: 7049598 - DNA, 22 bp, Homo sapiens
tcaggctgctgtactgtgaatg

SEQ ID NO: 7049599 - DNA, 22 bp, Homo sapiens
tcaggctgctttcatgcttaga

SEQ ID NO: 7049600 - DNA, 22 bp, Homo sapiens
tcaggctgctttcatgcttaga

SEQ ID NO: 7049601 - DNA, 18 bp, Homo sapiens
tcaggctggaagtttgcc

SEQ ID NO: 7049602 - DNA, 22 bp, Homo sapiens
tcaggctggaatgcagtggggc

SEQ ID NO: 7049603 - DNA, 22 bp, Homo sapiens
tcaggctggaatgcagtggggc

SEQ ID NO: 7049604 - DNA, 22 bp, Homo sapiens
tcaggctggagtgcagtggcgc

SEQ ID NO: 7049605 - DNA, 22 bp, Homo sapiens
tcaggtggctggttgctggcta

SEQ ID NO: 7049606 - DNA, 22 bp, Homo sapiens
tcaggtggccaaatgggagcgc

SEQ ID NO: 7049607 - DNA, 22 bp, Homo sapiens
tcagggaatgatgcacacagtt

SEQ ID NO: 7049608 - DNA, 22 bp, Homo sapiens
tcagggacagggtgctgctgcg

SEQ ID NO: 7049609 - DNA, 22 bp, Homo sapiens
tcagggaccaccactcacccag

SEQ ID NO: 7049610 - DNA, 22 bp, Homo sapiens
tcagggaagacttcttagagga

SEQ ID NO: 7049611 - DNA, 22 bp, Homo sapiens
tcagggaataagtagatgagtg

SEQ ID NO: 7049612 - DNA, 22 bp, Homo sapiens
tcaggtgttagaagaaatttca

SEQ ID NO: 7049613 - DNA, 22 bp, Homo sapiens
tcaggtttttctcaaatcaggt

SEQ ID NO: 7049614 - DNA, 22 bp, Homo sapiens
tcagtctctggggcttctgttt

SEQ ID NO: 7049615 - DNA, 22 bp, Homo sapiens
tcagtcttccctccagtgcaac

SEQ ID NO: 7049616 - DNA, 22 bp, Homo sapiens
tcagtcttccctccagtgcaac

SEQ ID NO: 7049617 - DNA, 23 bp, Homo sapiens
tcagtcttccctgtcagtaatag

SEQ ID NO: 7049618 - DNA, 22 bp, Homo sapiens
tcagtgaagtaatggtgagaga

SEQ ID NO: 7049619 - DNA, 22 bp, Homo sapiens
tcagtgatttctggggtgaggg

SEQ ID NO: 7049620 - DNA, 22 bp, Homo sapiens
tcagtgcacagagatttttgtt

SEQ ID NO: 7049621 - DNA, 22 bp, Homo sapiens
tcagtgtgttactttctcctat

SEQ ID NO: 7049622 - DNA, 22 bp, Homo sapiens
tcatattagggtaatgataaga

SEQ ID NO: 7049623 - DNA, 22 bp, Homo sapiens
tcatattagggtaatgataaga

SEQ ID NO: 7049624 - DNA, 22 bp, Homo sapiens
tcatattagggtaatgataaga

SEQ ID NO: 7049625 - DNA, 22 bp, Homo sapiens
tcatatttaggcctttaattca

SEQ ID NO: 7049626 - DNA, 22 bp, Homo sapiens
tcatatttaggcctttaattca

SEQ ID NO: 7049627 - DNA, 22 bp, Homo sapiens
tcatatttatatgttggcacag

SEQ ID NO: 7049628 - DNA, 22 bp, Homo sapiens
tcatatttcaaaatggctggag

SEQ ID NO: 7049629 - DNA, 21 bp, Homo sapiens
tcatatttctcttgctattgt

SEQ ID NO: 7049630 - DNA, 21 bp, Homo sapiens
tcatatttctcttgctattgt

SEQ ID NO: 7049631 - DNA, 21 bp, Homo sapiens
tcatatttctcttgctattgt

SEQ ID NO: 7049632 - DNA, 21 bp, Homo sapiens
tcatatttctcttgctattgt

SEQ ID NO: 7049633 - DNA, 22 bp, Homo sapiens
tcatattaacaatgaaactcag

SEQ ID NO: 7049634 - DNA, 22 bp, Homo sapiens
tcatatatttagttgtgcaaca

SEQ ID NO: 7049635 - DNA, 22 bp, Homo sapiens
tcatataagtttaaaactatct

SEQ ID NO: 7049636 - DNA, 22 bp, Homo sapiens
tcatataccagagagtttatat

SEQ ID NO: 7049637 - DNA, 22 bp, Homo sapiens
tcataggagtagcagtgagagg

SEQ ID NO: 7049638 - DNA, 22 bp, Homo sapiens
tcatataactggatattttcaa

SEQ ID NO: 7049639 - DNA, 22 bp, Homo sapiens
tcatataagtttaaaactatct

SEQ ID NO: 7049640 - DNA, 22 bp, Homo sapiens
tcattcaggttgggcaagtgtc

SEQ ID NO: 7049641 - DNA, 22 bp, Homo sapiens
tcattacagtgtttatatgtct

SEQ ID NO: 7049642 - DNA, 22 bp, Homo sapiens
tcatgcttaaaagacacttgag

SEQ ID NO: 7049643 - DNA, 22 bp, Homo sapiens
tcatgcttattgcatatttgga

SEQ ID NO: 7049644 - DNA, 22 bp, Homo sapiens
tcatggcagtttaataagtggt

SEQ ID NO: 7049645 - DNA, 22 bp, Homo sapiens
tcatggctaaccaaggcctgat

SEQ ID NO: 7049646 - DNA, 22 bp, Homo sapiens
tccaggaggctctggttgacgt

SEQ ID NO: 7049647 - DNA, 19 bp, Homo sapiens
tccaggaggctgccattga

SEQ ID NO: 7049648 - DNA, 22 bp, Homo sapiens
tccagctttgagattttatgga

SEQ ID NO: 7049649 - DNA, 22 bp, Homo sapiens
tccagcttcttgacttggtggt

SEQ ID NO: 7049650 - DNA, 22 bp, Homo sapiens
tccagcttgacaaatgatttta

SEQ ID NO: 7049651 - DNA, 22 bp, Homo sapiens
tccagcttgcctggtcttttgg

SEQ ID NO: 7049652 - DNA, 22 bp, Homo sapiens
tccagcttataggtagatttaa

SEQ ID NO: 7049653 - DNA, 19 bp, Homo sapiens
tccagctgttttgagtcac

SEQ ID NO: 7049654 - DNA, 22 bp, Homo sapiens
tccagctgttgatattctaggt

SEQ ID NO: 7049655 - DNA, 22 bp, Homo sapiens
tccagctcctgagttcactgct

SEQ ID NO: 7049656 - DNA, 21 bp, Homo sapiens
tccagctcctgccactcctta

SEQ ID NO: 7049657 - DNA, 21 bp, Homo sapiens
tccagctctcatagtgttcca

SEQ ID NO: 7049658 - DNA, 22 bp, Homo sapiens
tccagctctgattctcactagc

SEQ ID NO: 7049659 - DNA, 18 bp, Homo sapiens
tccagctctgccacttac

SEQ ID NO: 7049660 - DNA, 22 bp, Homo sapiens
tccagctctgcttcacagtctc

SEQ ID NO: 7049661 - DNA, 22 bp, Homo sapiens
tccagctctgcttcacagtctc

SEQ ID NO: 7049662 - DNA, 22 bp, Homo sapiens
tccagcaggttggtcaggtgca

SEQ ID NO: 7049663 - DNA, 22 bp, Homo sapiens
tccagcctttctactcactgag

SEQ ID NO: 7049664 - DNA, 22 bp, Homo sapiens
tccagctcaaattcagcttcca

SEQ ID NO: 7049665 - DNA, 22 bp, Homo sapiens
tccagctcaaattcagcttcca

SEQ ID NO: 7049666 - DNA, 22 bp, Homo sapiens
tccagctcatctgtctccatta

SEQ ID NO: 7049667 - DNA, 22 bp, Homo sapiens
tccagctccacagcctccctgt

SEQ ID NO: 7049668 - DNA, 22 bp, Homo sapiens
tccagctcccactctcactgct

SEQ ID NO: 7049669 - DNA, 22 bp, Homo sapiens
tccagaggctccaaagggagat

SEQ ID NO: 7049670 - DNA, 22 bp, Homo sapiens
tccagaggcagctgcggtcagg

SEQ ID NO: 7049671 - DNA, 22 bp, Homo sapiens
tccagaggctccaaagggagat

SEQ ID NO: 7049672 - DNA, 22 bp, Homo sapiens
tccagaggctccaaagggagat

SEQ ID NO: 7049673 - DNA, 22 bp, Homo sapiens
tccagaggctctgagggagagt

SEQ ID NO: 7049674 - DNA, 22 bp, Homo sapiens
tccagaggctctgagggagagt

SEQ ID NO: 7049675 - DNA, 22 bp, Homo sapiens
tccagagggcgatggctggggg

SEQ ID NO: 7049676 - DNA, 22 bp, Homo sapiens
tccagagggcgatggctggggg

SEQ ID NO: 7049677 - DNA, 22 bp, Homo sapiens
tccagaggggcagccctgtgct

SEQ ID NO: 7049678 - DNA, 22 bp, Homo sapiens
tccagaggtatgtagagagtat

SEQ ID NO: 7049679 - DNA, 22 bp, Homo sapiens
tccagaggcaaaaaggtatgga

SEQ ID NO: 7049680 - DNA, 22 bp, Homo sapiens
tccagagctgtcctactgtgag

SEQ ID NO: 7049681 - DNA, 22 bp, Homo sapiens
tccagagctgggtctgtgctca

SEQ ID NO: 7049682 - DNA, 22 bp, Homo sapiens
tccagagctgggtctgtgctca

SEQ ID NO: 7049683 - DNA, 22 bp, Homo sapiens
tcattgagttgcacttttacta

SEQ ID NO: 7049684 - DNA, 22 bp, Homo sapiens
tccagagataactatttaggag

SEQ ID NO: 7049685 - DNA, 22 bp, Homo sapiens
tccagagcctatatgttcaact

SEQ ID NO: 7049686 - DNA, 22 bp, Homo sapiens
tccagagcctgcgcactggctg

SEQ ID NO: 7049687 - DNA, 22 bp, Homo sapiens
tccagagcctgcgcactggctg

SEQ ID NO: 7049688 - DNA, 18 bp, Homo sapiens
tccagagctactgtggtg

SEQ ID NO: 7049689 - DNA, 22 bp, Homo sapiens
tcccaaggataagagagtctga

SEQ ID NO: 7049690 - DNA, 20 bp, Homo sapiens
tcccaaggatgcctgggtgt

SEQ ID NO: 7049691 - DNA, 22 bp, Homo sapiens
tccatgccaggcagtcgatgca

SEQ ID NO: 7049692 - DNA, 22 bp, Homo sapiens
tcccaagcttagggctctcagt

SEQ ID NO: 7049693 - DNA, 22 bp, Homo sapiens
tcccaagtgtcttggaccaggg

SEQ ID NO: 7049694 - DNA, 22 bp, Homo sapiens
tcccacagatgctgtccagagt

SEQ ID NO: 7049695 - DNA, 21 bp, Homo sapiens
tcccacagcgccagctcctgt

SEQ ID NO: 7049696 - DNA, 22 bp, Homo sapiens
tccatccatgtaggaagatggt

SEQ ID NO: 7049697 - DNA, 18 bp, Homo sapiens
tccatcctctgctcttca

SEQ ID NO: 7049698 - DNA, 22 bp, Homo sapiens
tccatctcacctgcactctgcg

SEQ ID NO: 7049699 - DNA, 22 bp, Homo sapiens
tccatctcacctgcactctgcg

SEQ ID NO: 7049700 - DNA, 22 bp, Homo sapiens
tccatctggtggcttccttttg

SEQ ID NO: 7049701 - DNA, 22 bp, Homo sapiens
tccatctgtctttcccatccac

SEQ ID NO: 7049702 - DNA, 22 bp, Homo sapiens
tccatgagaacccttggagata

SEQ ID NO: 7049703 - DNA, 22 bp, Homo sapiens
tccatgagaggtaactttacaa

SEQ ID NO: 7049704 - DNA, 22 bp, Homo sapiens
tccatgagggacactggatgct

SEQ ID NO: 7049705 - DNA, 22 bp, Homo sapiens
tccaggctggaaatgtcaaact

SEQ ID NO: 7049706 - DNA, 22 bp, Homo sapiens
tccagggcagccgcgggtgcgc

SEQ ID NO: 7049707 - DNA, 22 bp, Homo sapiens
tccagggcagccgcgggtgcgc

SEQ ID NO: 7049708 - DNA, 22 bp, Homo sapiens
tccagggcagggtgcgcatggg

SEQ ID NO: 7049709 - DNA, 22 bp, Homo sapiens
tccagggcagggtgcgcatggg

SEQ ID NO: 7049710 - DNA, 22 bp, Homo sapiens
tccagggcagggtgcgcatggg

SEQ ID NO: 7049711 - DNA, 22 bp, Homo sapiens
tccagggccacagaggatgcta

SEQ ID NO: 7049712 - DNA, 22 bp, Homo sapiens
tccagggccacagaggatgcta

SEQ ID NO: 7049713 - DNA, 22 bp, Homo sapiens
tccagggccacagaggatgcta

SEQ ID NO: 7049714 - DNA, 22 bp, Homo sapiens
tccagggccacagaggatgcta

SEQ ID NO: 7049715 - DNA, 22 bp, Homo sapiens
tccagggccagtccttgtctgt

SEQ ID NO: 7049716 - DNA, 22 bp, Homo sapiens
tccagggccatgaagttgcaca

SEQ ID NO: 7049717 - DNA, 22 bp, Homo sapiens
tccagggccatgaagttgcaca

SEQ ID NO: 7049718 - DNA, 22 bp, Homo sapiens
tccagggccccccagttgcacg

SEQ ID NO: 7049719 - DNA, 22 bp, Homo sapiens
tccagggccccccagttgcacg

SEQ ID NO: 7049720 - DNA, 20 bp, Homo sapiens
tccagggccctggctcctct

SEQ ID NO: 7049721 - DNA, 20 bp, Homo sapiens
tccagggccctggctcctct

SEQ ID NO: 7049722 - DNA, 20 bp, Homo sapiens
tccagggccctggctcctct

SEQ ID NO: 7049723 - DNA, 22 bp, Homo sapiens
tccagggcctgaggttgaagtg

SEQ ID NO: 7049724 - DNA, 22 bp, Homo sapiens
tccagggcctgaggttgaagtg

SEQ ID NO: 7049725 - DNA, 22 bp, Homo sapiens
tccagggcgtgtgtgaaggaaa

SEQ ID NO: 7049726 - DNA, 22 bp, Homo sapiens
tccagggcgtgtgtgaaggaaa

SEQ ID NO: 7049727 - DNA, 22 bp, Homo sapiens
tccagggcgtgtgtgaaggaaa

SEQ ID NO: 7049728 - DNA, 22 bp, Homo sapiens
tccagggctacaaggcaccaga

SEQ ID NO: 7049729 - DNA, 22 bp, Homo sapiens
tccagggctacaaggcaccaga

SEQ ID NO: 7049730 - DNA, 20 bp, Homo sapiens
tccagggctagggagctcat

SEQ ID NO: 7049731 - DNA, 20 bp, Homo sapiens
tccagggctagggagctcat

SEQ ID NO: 7049732 - DNA, 22 bp, Homo sapiens
tccagggctcattccctctgca

SEQ ID NO: 7049733 - DNA, 22 bp, Homo sapiens
tccagttgcccatctctcttct

SEQ ID NO: 7049734 - DNA, 22 bp, Homo sapiens
tccatcaggctcgtgggctctc

SEQ ID NO: 7049735 - DNA, 22 bp, Homo sapiens
tccaggagtctagcctcaggcc

SEQ ID NO: 7049736 - DNA, 22 bp, Homo sapiens
tccaggagtgataaggccactg

SEQ ID NO: 7049737 - DNA, 22 bp, Homo sapiens
tccaggagtcctgggagtgatt

SEQ ID NO: 7049738 - DNA, 22 bp, Homo sapiens
tccaggagtcagacagatggtg

SEQ ID NO: 7049739 - DNA, 22 bp, Homo sapiens
tccaggagtcagacagatggtg

SEQ ID NO: 7049740 - DNA, 20 bp, Homo sapiens
tccaggaggttagtgtggct

SEQ ID NO: 7049741 - DNA, 22 bp, Homo sapiens
tccaggaggttgagactgcagt

SEQ ID NO: 7049742 - DNA, 22 bp, Homo sapiens
tccaggaggtatgagtggcccc

SEQ ID NO: 7049743 - DNA, 22 bp, Homo sapiens
tccaggagggggagccgtgccg

SEQ ID NO: 7049744 - DNA, 22 bp, Homo sapiens
tccaggaggggtaggcagtatg

SEQ ID NO: 7049745 - DNA, 22 bp, Homo sapiens
tccaggagtggggcagaggtct

SEQ ID NO: 7049746 - DNA, 22 bp, Homo sapiens
tccaggagtgtgtgctaatggg

SEQ ID NO: 7049747 - DNA, 22 bp, Homo sapiens
tccaggagtgataaggccactg

SEQ ID NO: 7049748 - DNA, 21 bp, Homo sapiens
tccaggagtggctgggcaggg

SEQ ID NO: 7049749 - DNA, 22 bp, Homo sapiens
tccaggagtttgagactgcagt

SEQ ID NO: 7049750 - DNA, 22 bp, Homo sapiens
tccaggcataagccttgagtgt

SEQ ID NO: 7049751 - DNA, 22 bp, Homo sapiens
tccaggccaatgtagcaggccc

SEQ ID NO: 7049752 - DNA, 22 bp, Homo sapiens
tccaggccaatgtagcaggccc

SEQ ID NO: 7049753 - DNA, 22 bp, Homo sapiens
tccaggccactgcagaggctct

SEQ ID NO: 7049754 - DNA, 22 bp, Homo sapiens
tccaggctctcaggtgtcagca

SEQ ID NO: 7049755 - DNA, 22 bp, Homo sapiens
tccaggctgatccatgaagaat

SEQ ID NO: 7049756 - DNA, 22 bp, Homo sapiens
tcccattgccatagataggaca

SEQ ID NO: 7049757 - DNA, 22 bp, Homo sapiens
tcccatctccaacatttttctt

SEQ ID NO: 7049758 - DNA, 20 bp, Homo sapiens
tcccatcacgcctgtgccag

SEQ ID NO: 7049759 - DNA, 18 bp, Homo sapiens
tcccatcatcctctccag

SEQ ID NO: 7049760 - DNA, 22 bp, Homo sapiens
tcccagtttttctccactaagg

SEQ ID NO: 7049761 - DNA, 22 bp, Homo sapiens
tcccagggtgcgcctgccctcg

SEQ ID NO: 7049762 - DNA, 22 bp, Homo sapiens
tcccagggttacagccagggca

SEQ ID NO: 7049763 - DNA, 22 bp, Homo sapiens
tcccagggattaggacatggat

SEQ ID NO: 7049764 - DNA, 22 bp, Homo sapiens
tcccagggatcctccgggtcgc

SEQ ID NO: 7049765 - DNA, 22 bp, Homo sapiens
tcccagggatcctccgggtcgc

SEQ ID NO: 7049766 - DNA, 21 bp, Homo sapiens
tcccagggtcttatgggatgt

SEQ ID NO: 7049767 - DNA, 22 bp, Homo sapiens
tcccagggtgaaatgcagtagg

SEQ ID NO: 7049768 - DNA, 22 bp, Homo sapiens
tcccagggtgaaatgcagtagg

SEQ ID NO: 7049769 - DNA, 22 bp, Homo sapiens
tcccacaggagcctgagtccca

SEQ ID NO: 7049770 - DNA, 22 bp, Homo sapiens
tcccacaggcccagggcggaaa

SEQ ID NO: 7049771 - DNA, 22 bp, Homo sapiens
tcccacagtgaagttcatgata

SEQ ID NO: 7049772 - DNA, 22 bp, Homo sapiens
tcccagggactggatgatgcag

SEQ ID NO: 7049773 - DNA, 22 bp, Homo sapiens
tcccagggactgggctaggctt

SEQ ID NO: 7049774 - DNA, 22 bp, Homo sapiens
tccccacacagatacagagtag

SEQ ID NO: 7049775 - DNA, 22 bp, Homo sapiens
tccccacacagatacagagtag

SEQ ID NO: 7049776 - DNA, 22 bp, Homo sapiens
tccccacatctctgcatcaggc

SEQ ID NO: 7049777 - DNA, 22 bp, Homo sapiens
tccccacctacacactgctcct

SEQ ID NO: 7049778 - DNA, 22 bp, Homo sapiens
tccccacctacacactgctcct

SEQ ID NO: 7049779 - DNA, 22 bp, Homo sapiens
tccccaggaaattctgattctt

SEQ ID NO: 7049780 - DNA, 22 bp, Homo sapiens
tccccaggaaattctgattctt

SEQ ID NO: 7049781 - DNA, 22 bp, Homo sapiens
tccccaggaaggcccttcctgg

SEQ ID NO: 7049782 - DNA, 22 bp, Homo sapiens
tccccaggaatcaggtggttgc

SEQ ID NO: 7049783 - DNA, 22 bp, Homo sapiens
tccccaggagcaatgattcagt

SEQ ID NO: 7049784 - DNA, 22 bp, Homo sapiens
tccccaggagcaatgattcagt

SEQ ID NO: 7049785 - DNA, 22 bp, Homo sapiens
tccccaggagttttactttgca

SEQ ID NO: 7049786 - DNA, 20 bp, Homo sapiens
tccccagggcatcaggagca

SEQ ID NO: 7049787 - DNA, 22 bp, Homo sapiens
tccccaggggcatctctctgct

SEQ ID NO: 7049788 - DNA, 22 bp, Homo sapiens
tccccaggggcatctctctgct

SEQ ID NO: 7049789 - DNA, 22 bp, Homo sapiens
tccccaggggcctgggcacagt

SEQ ID NO: 7049790 - DNA, 22 bp, Homo sapiens
tccccaggggcctgggcacagt

SEQ ID NO: 7049791 - DNA, 22 bp, Homo sapiens
tccccagggtccctgcttccat

SEQ ID NO: 7049792 - DNA, 22 bp, Homo sapiens
gggctgagttcctgcctcactc

SEQ ID NO: 7049793 - DNA, 22 bp, Homo sapiens
gggctgagtgtcccaggccgaa

SEQ ID NO: 7049794 - DNA, 22 bp, Homo sapiens
gggctgagttcctgcctcactc

SEQ ID NO: 7049795 - DNA, 22 bp, Homo sapiens
gggctgagggccaattcctact

SEQ ID NO: 7049796 - DNA, 22 bp, Homo sapiens
gggctgagggccaattcctact

SEQ ID NO: 7049797 - DNA, 22 bp, Homo sapiens
gggctgaggctaccactggtct

SEQ ID NO: 7049798 - DNA, 22 bp, Homo sapiens
gggctgaggctaccactggtct

SEQ ID NO: 7049799 - DNA, 22 bp, Homo sapiens
gggctgagggccaattcctact

SEQ ID NO: 7049800 - DNA, 22 bp, Homo sapiens
gggctgagtgtcccaggccgaa

SEQ ID NO: 7049801 - DNA, 22 bp, Homo sapiens
gggcttgggtattgtgagaggt

SEQ ID NO: 7049802 - DNA, 22 bp, Homo sapiens
gggctgaggctaccactggtct

SEQ ID NO: 7049803 - DNA, 22 bp, Homo sapiens
gggctgaggctaccactggtct

SEQ ID NO: 7049804 - DNA, 22 bp, Homo sapiens
gggctgaggaacatattttgtt

SEQ ID NO: 7049805 - DNA, 22 bp, Homo sapiens
gggctgagctgttctgagttta

SEQ ID NO: 7049806 - DNA, 22 bp, Homo sapiens
gggctgaggaacatattttgtt

SEQ ID NO: 7049807 - DNA, 22 bp, Homo sapiens
gggctgagctaagctgggttga

SEQ ID NO: 7049808 - DNA, 22 bp, Homo sapiens
gggctgagctgttctgagttta

SEQ ID NO: 7049809 - DNA, 22 bp, Homo sapiens
gggctgagccacagcttttgtt

SEQ ID NO: 7049810 - DNA, 22 bp, Homo sapiens
gggctgagccatttgaaccttg

SEQ ID NO: 7049811 - DNA, 22 bp, Homo sapiens
gggctgagccatttgaaccttg

SEQ ID NO: 7049812 - DNA, 22 bp, Homo sapiens
gggctgagctaagctgggttga

SEQ ID NO: 7049813 - DNA, 22 bp, Homo sapiens
gggctgagcacatactgacagc

SEQ ID NO: 7049814 - DNA, 22 bp, Homo sapiens
gggctgagccacagcttttgtt

SEQ ID NO: 7049815 - DNA, 22 bp, Homo sapiens
gggctgagccacagcttttgtt

SEQ ID NO: 7049816 - DNA, 22 bp, Homo sapiens
gggctgagagctggaatctgag

SEQ ID NO: 7049817 - DNA, 22 bp, Homo sapiens
gggctgagagctggaatctgag

SEQ ID NO: 7049818 - DNA, 22 bp, Homo sapiens
gggctgagagctggaatctgag

SEQ ID NO: 7049819 - DNA, 22 bp, Homo sapiens
gggctgagagtgactgttctgt

SEQ ID NO: 7049820 - DNA, 22 bp, Homo sapiens
gggctgagagtgactgttctgt

SEQ ID NO: 7049821 - DNA, 22 bp, Homo sapiens
gggctgagagtgactgttctgt

SEQ ID NO: 7049822 - DNA, 22 bp, Homo sapiens
gggctgagattggtgccctgtc

SEQ ID NO: 7049823 - DNA, 22 bp, Homo sapiens
gggctgagattggtgccctgtc

SEQ ID NO: 7049824 - DNA, 22 bp, Homo sapiens
gggctgagcacatactgacagc

SEQ ID NO: 7049825 - DNA, 22 bp, Homo sapiens
gggctgagcacatactgacagc

SEQ ID NO: 7049826 - DNA, 22 bp, Homo sapiens
gggcatggccaggtgaggggtc

SEQ ID NO: 7049827 - DNA, 22 bp, Homo sapiens
gggcatggcgtgtgctggattc

SEQ ID NO: 7049828 - DNA, 22 bp, Homo sapiens
gggcatggcgtgtgctggattc

SEQ ID NO: 7049829 - DNA, 22 bp, Homo sapiens
gggcatggggcggacctggttc

SEQ ID NO: 7049830 - DNA, 21 bp, Homo sapiens
gggccacaccttctgcagacc

SEQ ID NO: 7049831 - DNA, 22 bp, Homo sapiens
ggggctgggatttgaacccagg

SEQ ID NO: 7049832 - DNA, 22 bp, Homo sapiens
ggggctggctcactaagagact

SEQ ID NO: 7049833 - DNA, 22 bp, Homo sapiens
ggggctggctcactaagagact

SEQ ID NO: 7049834 - DNA, 20 bp, Homo sapiens
ggggctgcatgcagagaaga

SEQ ID NO: 7049835 - DNA, 22 bp, Homo sapiens
ggggctgatggaactcaggcct

SEQ ID NO: 7049836 - DNA, 22 bp, Homo sapiens
ggggctcagttcggacagcctg

SEQ ID NO: 7049837 - DNA, 22 bp, Homo sapiens
ggggccgaccgcggttcaggcc

SEQ ID NO: 7049838 - DNA, 22 bp, Homo sapiens
ggggaagagcattgcacggtgt

SEQ ID NO: 7049839 - DNA, 22 bp, Homo sapiens
ggggaagaggcgtgatggatcc

SEQ ID NO: 7049840 - DNA, 22 bp, Homo sapiens
ggggtggggttactcattgtgc

SEQ ID NO: 7049841 - DNA, 22 bp, Homo sapiens
ggggtgggcgtgcagggacacc

SEQ ID NO: 7049842 - DNA, 22 bp, Homo sapiens
ggggtgggcgtgcagggacacc

SEQ ID NO: 7049843 - DNA, 22 bp, Homo sapiens
ggggctggtggtggtttctcca

SEQ ID NO: 7049844 - DNA, 22 bp, Homo sapiens
gggtggaggtgggttttgagat

SEQ ID NO: 7049845 - DNA, 22 bp, Homo sapiens
gggtggagtagaaagatgaatt

SEQ ID NO: 7049846 - DNA, 22 bp, Homo sapiens
gggtagggtgacttaggctggc

SEQ ID NO: 7049847 - DNA, 22 bp, Homo sapiens
gggtaggagaggtgtctgtgtg

SEQ ID NO: 7049848 - DNA, 22 bp, Homo sapiens
gggtaggcaaagcaatgacgtt

SEQ ID NO: 7049849 - DNA, 22 bp, Homo sapiens
ggtctctgacttagagatggat

SEQ ID NO: 7049850 - DNA, 22 bp, Homo sapiens
ggtctcagtgaaggagtgtgct

SEQ ID NO: 7049851 - DNA, 22 bp, Homo sapiens
ggtctcaggagactggagagca

SEQ ID NO: 7049852 - DNA, 22 bp, Homo sapiens
ggtcagcaatttggactgggct

SEQ ID NO: 7049853 - DNA, 22 bp, Homo sapiens
ggtcagcagtgcagggcagagc

SEQ ID NO: 7049854 - DNA, 22 bp, Homo sapiens
ggtcagcagtgcagggcagagc

SEQ ID NO: 7049855 - DNA, 22 bp, Homo sapiens
ggtccctggggaactaggctgt

SEQ ID NO: 7049856 - DNA, 22 bp, Homo sapiens
ggtccctggttccctctgagct

SEQ ID NO: 7049857 - DNA, 22 bp, Homo sapiens
ggtcgctgtgtaggttcagcta

SEQ ID NO: 7049858 - DNA, 22 bp, Homo sapiens
gggtggcacaggtgcagagggt

SEQ ID NO: 7049859 - DNA, 22 bp, Homo sapiens
gggtggcatagggtgatggctt

SEQ ID NO: 7049860 - DNA, 22 bp, Homo sapiens
gggtggctcctatgggcatagc

SEQ ID NO: 7049861 - DNA, 19 bp, Homo sapiens
ggtcacaggggttacaagg

SEQ ID NO: 7049862 - DNA, 22 bp, Homo sapiens
ggtcacatatcctcggtttgga

SEQ ID NO: 7049863 - DNA, 22 bp, Homo sapiens
ggtcacatctaaatggagcatt

SEQ ID NO: 7049864 - DNA, 22 bp, Homo sapiens
ggtcacatgagatgctgccctc

SEQ ID NO: 7049865 - DNA, 22 bp, Homo sapiens
ggtcacatgcggggctgtagcc

SEQ ID NO: 7049866 - DNA, 22 bp, Homo sapiens
ggtcacatggttgagcttgatc

SEQ ID NO: 7049867 - DNA, 23 bp, Homo sapiens
ggtcacatgtgagattaaacttg

SEQ ID NO: 7049868 - DNA, 22 bp, Homo sapiens
ggtcacatgtgatttgagccaa

SEQ ID NO: 7049869 - DNA, 22 bp, Homo sapiens
ggtcacattctgaggaatcagg

SEQ ID NO: 7049870 - DNA, 22 bp, Homo sapiens
ggtcacattctgaggtattagg

SEQ ID NO: 7049871 - DNA, 22 bp, Homo sapiens
ggtcagagaaaagtagggtgtt

SEQ ID NO: 7049872 - DNA, 22 bp, Homo sapiens
ggtcagagccatggagcaactg

SEQ ID NO: 7049873 - DNA, 22 bp, Homo sapiens
ggtcagagctggagagataggg

SEQ ID NO: 7049874 - DNA, 22 bp, Homo sapiens
ggtcagagctggagagataggg

SEQ ID NO: 7049875 - DNA, 22 bp, Homo sapiens
ggtcagagctggagagataggg

SEQ ID NO: 7049876 - DNA, 22 bp, Homo sapiens
ggtcagaggtcacaagctggca

SEQ ID NO: 7049877 - DNA, 22 bp, Homo sapiens
ggtcagaggtcacaagctggca

SEQ ID NO: 7049878 - DNA, 22 bp, Homo sapiens
ggtgttggaacatggtgagatt

SEQ ID NO: 7049879 - DNA, 22 bp, Homo sapiens
ggtgtgtgaggagtcacttagt

SEQ ID NO: 7049880 - DNA, 19 bp, Homo sapiens
ggtgtgtgctggggcctgt

SEQ ID NO: 7049881 - DNA, 19 bp, Homo sapiens
ggtgtgtgctggggcctgt

SEQ ID NO: 7049882 - DNA, 22 bp, Homo sapiens
ggtgtgtggttttgatacagtc

SEQ ID NO: 7049883 - DNA, 22 bp, Homo sapiens
ggtgtgtgtggattagcatgcc

SEQ ID NO: 7049884 - DNA, 22 bp, Homo sapiens
ggtgtgggccctgatgtcagca

SEQ ID NO: 7049885 - DNA, 18 bp, Homo sapiens
ggtggcggggatggaggt

SEQ ID NO: 7049886 - DNA, 22 bp, Homo sapiens
ggtctgaattccagcccctctg

SEQ ID NO: 7049887 - DNA, 22 bp, Homo sapiens
ggtctgagagccactgaatccc

SEQ ID NO: 7049888 - DNA, 22 bp, Homo sapiens
gtcctgggcctgctgaggctga

SEQ ID NO: 7049889 - DNA, 22 bp, Homo sapiens
gtcctgggcatgcagggctttc

SEQ ID NO: 7049890 - DNA, 22 bp, Homo sapiens
gtcctgggcccaggggctgcct

SEQ ID NO: 7049891 - DNA, 22 bp, Homo sapiens
gtcctgggaggggctggtcctg

SEQ ID NO: 7049892 - DNA, 17 bp, Homo sapiens
gtcctgggaggagagag

SEQ ID NO: 7049893 - DNA, 22 bp, Homo sapiens
gtcctgggaaggaagccaggga

SEQ ID NO: 7049894 - DNA, 22 bp, Homo sapiens
gtcctgggaaggaagccaggga

SEQ ID NO: 7049895 - DNA, 22 bp, Homo sapiens
gtcctgggagatgggaccctga

SEQ ID NO: 7049896 - DNA, 22 bp, Homo sapiens
gtccctctgggccatcaggtcc

SEQ ID NO: 7049897 - DNA, 22 bp, Homo sapiens
gtccctctgtgtccctgcagtc

SEQ ID NO: 7049898 - DNA, 22 bp, Homo sapiens
gtccctgagcctggcatttccc

SEQ ID NO: 7049899 - DNA, 22 bp, Homo sapiens
gtatttccattagtgtgtgcac

SEQ ID NO: 7049900 - DNA, 22 bp, Homo sapiens
gtcattttctagaattatttga

SEQ ID NO: 7049901 - DNA, 22 bp, Homo sapiens
gtcattttctagaattatttga

SEQ ID NO: 7049902 - DNA, 22 bp, Homo sapiens
gtcattttgctgcatatttaga

SEQ ID NO: 7049903 - DNA, 22 bp, Homo sapiens
gtcattttgctgcatatttaga

SEQ ID NO: 7049904 - DNA, 22 bp, Homo sapiens
gtcatttttcactgcatataga

SEQ ID NO: 7049905 - DNA, 22 bp, Homo sapiens
gtcatttttgactttgaagtga

SEQ ID NO: 7049906 - DNA, 22 bp, Homo sapiens
gtcatttttttcgtaatagtgg

SEQ ID NO: 7049907 - DNA, 22 bp, Homo sapiens
gtccaaaagagccagccgggcg

SEQ ID NO: 7049908 - DNA, 18 bp, Homo sapiens
gtccacagattcttcact

SEQ ID NO: 7049909 - DNA, 22 bp, Homo sapiens
gtccacagctggccagggcctc

SEQ ID NO: 7049910 - DNA, 22 bp, Homo sapiens
gtccactgctgtgtgcttcacc

SEQ ID NO: 7049911 - DNA, 22 bp, Homo sapiens
gtatttataggggaatgagagt

SEQ ID NO: 7049912 - DNA, 22 bp, Homo sapiens
gtattctgggccgattacaaaa

SEQ ID NO: 7049913 - DNA, 22 bp, Homo sapiens
gtagaaatggtgtgtttcttct

SEQ ID NO: 7049914 - DNA, 22 bp, Homo sapiens
gtagaaattccatttactttga

SEQ ID NO: 7049915 - DNA, 22 bp, Homo sapiens
gtagaactaggacttcaggtat

SEQ ID NO: 7049916 - DNA, 22 bp, Homo sapiens
gtagaatatatggttagtattg

SEQ ID NO: 7049917 - DNA, 22 bp, Homo sapiens
gtagaatatatggttagtattg

SEQ ID NO: 7049918 - DNA, 22 bp, Homo sapiens
gtattagaagaaattataggta

SEQ ID NO: 7049919 - DNA, 22 bp, Homo sapiens
gtattagaagaaattataggta

SEQ ID NO: 7049920 - DNA, 22 bp, Homo sapiens
gtattagactgagaaatggagt

SEQ ID NO: 7049921 - DNA, 22 bp, Homo sapiens
gtattattctcagctttgggat

SEQ ID NO: 7049922 - DNA, 22 bp, Homo sapiens
ggtttgaacagctttggagaag

SEQ ID NO: 7049923 - DNA, 22 bp, Homo sapiens
ggtttctagcagagtctcttta

SEQ ID NO: 7049924 - DNA, 22 bp, Homo sapiens
ggttttatagcagtactatcag

SEQ ID NO: 7049925 - DNA, 22 bp, Homo sapiens
ggttttatcctacccacacagc

SEQ ID NO: 7049926 - DNA, 22 bp, Homo sapiens
ggttttatagcagtactatcag

SEQ ID NO: 7049927 - DNA, 22 bp, Homo sapiens
ggttttatcctacccacacagc

SEQ ID NO: 7049928 - DNA, 22 bp, Homo sapiens
ggttttattaactttaacatca

SEQ ID NO: 7049929 - DNA, 22 bp, Homo sapiens
ggttttattaccccttaaacac

SEQ ID NO: 7049930 - DNA, 22 bp, Homo sapiens
ggttttattaactttaacatca

SEQ ID NO: 7049931 - DNA, 22 bp, Homo sapiens
ggttttcaaagaggcatttcat

SEQ ID NO: 7049932 - DNA, 22 bp, Homo sapiens
ggttttattaccccttaaacac

SEQ ID NO: 7049933 - DNA, 22 bp, Homo sapiens
gtacatttctcttgttcttatt

SEQ ID NO: 7049934 - DNA, 22 bp, Homo sapiens
gtgaagatgcctcaggtgaccc

SEQ ID NO: 7049935 - DNA, 22 bp, Homo sapiens
gtgaagcagggaaggaaaggat

SEQ ID NO: 7049936 - DNA, 22 bp, Homo sapiens
gtgaagatctgagccctcaggt

SEQ ID NO: 7049937 - DNA, 22 bp, Homo sapiens
gtgaagaaggcaatacaaagaa

SEQ ID NO: 7049938 - DNA, 22 bp, Homo sapiens
gtgaagaccagggaacgctggc

SEQ ID NO: 7049939 - DNA, 22 bp, Homo sapiens
gtgaaggactagcatggagggc

SEQ ID NO: 7049940 - DNA, 22 bp, Homo sapiens
gtgaaggactagcatggagggc

SEQ ID NO: 7049941 - DNA, 22 bp, Homo sapiens
gtgaaggactagcatggagggc

SEQ ID NO: 7049942 - DNA, 22 bp, Homo sapiens
gtgaaggactgaatgaaaatgt

SEQ ID NO: 7049943 - DNA, 22 bp, Homo sapiens
gtgaaggaggggccacagatat

SEQ ID NO: 7049944 - DNA, 22 bp, Homo sapiens
gtgaaggagttatcagtggtta

SEQ ID NO: 7049945 - DNA, 22 bp, Homo sapiens
gtgaaggagttatcagtggtta

SEQ ID NO: 7049946 - DNA, 22 bp, Homo sapiens
gtgaccatcatctcagctagtt

SEQ ID NO: 7049947 - DNA, 22 bp, Homo sapiens
gtgaccatcatctcagctagtt

SEQ ID NO: 7049948 - DNA, 22 bp, Homo sapiens
gtgaaactgctttgtaaactgt

SEQ ID NO: 7049949 - DNA, 22 bp, Homo sapiens
gtgaaacttcacattttgatag

SEQ ID NO: 7049950 - DNA, 22 bp, Homo sapiens
gtgaaacttcacattttgatag

SEQ ID NO: 7049951 - DNA, 22 bp, Homo sapiens
gtgaaatattttgtttatgtca

SEQ ID NO: 7049952 - DNA, 22 bp, Homo sapiens
gtgaacaggagaaagtgatgga

SEQ ID NO: 7049953 - DNA, 22 bp, Homo sapiens
gtgaacagttcattttatcatg

SEQ ID NO: 7049954 - DNA, 22 bp, Homo sapiens
gtcctgggggcagctgtgtcca

SEQ ID NO: 7049955 - DNA, 22 bp, Homo sapiens
gtcctgggggcagctgtgtcca

SEQ ID NO: 7049956 - DNA, 22 bp, Homo sapiens
gtcctgggtccccgcaggtcag

SEQ ID NO: 7049957 - DNA, 22 bp, Homo sapiens
gtctgcccatctccgggcgggg

SEQ ID NO: 7049958 - DNA, 22 bp, Homo sapiens
gtctgccccacaggctcagttg

SEQ ID NO: 7049959 - DNA, 22 bp, Homo sapiens
gtctgcccggccttcctccacc

SEQ ID NO: 7049960 - DNA, 22 bp, Homo sapiens
gtctgccctcacatgcactctt

SEQ ID NO: 7049961 - DNA, 22 bp, Homo sapiens
gtctgccctcacgccagctggg

SEQ ID NO: 7049962 - DNA, 22 bp, Homo sapiens
gtctgcccttcctctccacgat

SEQ ID NO: 7049963 - DNA, 22 bp, Homo sapiens
gtcctgggcggagggctgctgt

SEQ ID NO: 7049964 - DNA, 22 bp, Homo sapiens
gtcctggggaatacagaagccg

SEQ ID NO: 7049965 - DNA, 22 bp, Homo sapiens
gtcctggggatacagaagtgaa

SEQ ID NO: 7049966 - DNA, 22 bp, Homo sapiens
gtcctggggatacagaagtgaa

SEQ ID NO: 7049967 - DNA, 22 bp, Homo sapiens
gtcctggggattatagagtgtt

SEQ ID NO: 7049968 - DNA, 22 bp, Homo sapiens
gtcctggggattatagagtgtt

SEQ ID NO: 7049969 - DNA, 22 bp, Homo sapiens
gtctgcccttggctcagccata

SEQ ID NO: 7049970 - DNA, 22 bp, Homo sapiens
gtctgcctcagccgggggccgc

SEQ ID NO: 7049971 - DNA, 22 bp, Homo sapiens
gtctgcctctattgcctacctg

SEQ ID NO: 7049972 - DNA, 22 bp, Homo sapiens
gtctgcctctttctttctgggt

SEQ ID NO: 7049973 - DNA, 22 bp, Homo sapiens
gtctgcctgctagtggctgcct

SEQ ID NO: 7049974 - DNA, 22 bp, Homo sapiens
gtctgcctgcaatccagagact

SEQ ID NO: 7049975 - DNA, 22 bp, Homo sapiens
gtctgcctggaggcagctgctg

SEQ ID NO: 7049976 - DNA, 22 bp, Homo sapiens
gtctgcctgggacgctgggagt

SEQ ID NO: 7049977 - DNA, 22 bp, Homo sapiens
gtctgcctgtctggatgacaga

SEQ ID NO: 7049978 - DNA, 18 bp, Homo sapiens
gtctgccttctcccttcc

SEQ ID NO: 7049979 - DNA, 22 bp, Homo sapiens
gtctgcctttatcatctcctta

SEQ ID NO: 7049980 - DNA, 22 bp, Homo sapiens
gtctgctcatgctaccgcgggc

SEQ ID NO: 7049981 - DNA, 22 bp, Homo sapiens
gtctgctgcagagcatggcttt

SEQ ID NO: 7049982 - DNA, 22 bp, Homo sapiens
gtctgctgcagtcgtggctcta

SEQ ID NO: 7049983 - DNA, 22 bp, Homo sapiens
gtctgctggtgcctggcctgcg

SEQ ID NO: 7049984 - DNA, 22 bp, Homo sapiens
gtctgctggtgcctggcctgcg

SEQ ID NO: 7049985 - DNA, 22 bp, Homo sapiens
gtgagaataccagcagtgagaa

SEQ ID NO: 7049986 - DNA, 22 bp, Homo sapiens
gtgagacacccaagagtcagat

SEQ ID NO: 7049987 - DNA, 22 bp, Homo sapiens
gtgagacacgtgtgtgacctgg

SEQ ID NO: 7049988 - DNA, 22 bp, Homo sapiens
gtgagactcgcctttgtgtagc

SEQ ID NO: 7049989 - DNA, 22 bp, Homo sapiens
gtgagagaatttgagttaaatt

SEQ ID NO: 7049990 - DNA, 22 bp, Homo sapiens
gtgagcaggataggggctccct

SEQ ID NO: 7049991 - DNA, 22 bp, Homo sapiens
gtgcaccagtcacatgggcaga

SEQ ID NO: 7049992 - DNA, 22 bp, Homo sapiens
gtgcagagaaatgagaagtcga

SEQ ID NO: 7049993 - DNA, 22 bp, Homo sapiens
gtgcagagaaatgagaagtcga

SEQ ID NO: 7049994 - DNA, 22 bp, Homo sapiens
gtgcagagaggtggagggactt

SEQ ID NO: 7049995 - DNA, 22 bp, Homo sapiens
gtgcagagcaagggctgagggc

SEQ ID NO: 7049996 - DNA, 22 bp, Homo sapiens
gtgcacagaagcagaagctaga

SEQ ID NO: 7049997 - DNA, 22 bp, Homo sapiens
gtgcacagagcccagggccgcg

SEQ ID NO: 7049998 - DNA, 22 bp, Homo sapiens
gtgcacagattcagaggttttg

SEQ ID NO: 7049999 - DNA, 22 bp, Homo sapiens
gtgcacagatttaattttattc

SEQ ID NO: 7050000 - DNA, 22 bp, Homo sapiens
gtgcacaggtgggaaaatgagt

SEQ ID NO: 7050001 - DNA, 23 bp, Homo sapiens
gtgcacagtcaagcccagcttag

SEQ ID NO: 7050002 - DNA, 21 bp, Homo sapiens
gtgcacagtcctgcacacagg

SEQ ID NO: 7050003 - DNA, 22 bp, Homo sapiens
gtgcacatcgtgcaggtttgtt

SEQ ID NO: 7050004 - DNA, 22 bp, Homo sapiens
gtgcacatcgtgcaggtttgtt

SEQ ID NO: 7050005 - DNA, 20 bp, Homo sapiens
gtgcagaggcagcctgtggg

SEQ ID NO: 7050006 - DNA, 22 bp, Homo sapiens
gtgcagaggtcacaaaagtgaa

SEQ ID NO: 7050007 - DNA, 22 bp, Homo sapiens
gtgcagatcctgattgcagttc

SEQ ID NO: 7050008 - DNA, 22 bp, Homo sapiens
gtgcaggtggatttgggctcaa

SEQ ID NO: 7050009 - DNA, 22 bp, Homo sapiens
gtgcagtgaccctggagagctg

SEQ ID NO: 7050010 - DNA, 22 bp, Homo sapiens
gtgcagtgaccctggagagctg

SEQ ID NO: 7050011 - DNA, 22 bp, Homo sapiens
gtgcagtgagcagtgcagcacc

SEQ ID NO: 7050012 - DNA, 22 bp, Homo sapiens
gtgcatatatatgggagggagc

SEQ ID NO: 7050013 - DNA, 22 bp, Homo sapiens
gtgcatatatgcacatatgtgt

SEQ ID NO: 7050014 - DNA, 22 bp, Homo sapiens
gtgcatatatgtgcagcatcaa

SEQ ID NO: 7050015 - DNA, 22 bp, Homo sapiens
gtgcatatggttacagcaccgc

SEQ ID NO: 7050016 - DNA, 22 bp, Homo sapiens
gtgcatatgtacctgtgatcat

SEQ ID NO: 7050017 - DNA, 22 bp, Homo sapiens
gtgcatatgtgtgtatacaaac

SEQ ID NO: 7050018 - DNA, 22 bp, Homo sapiens
gtgcatttaggtcacatgatgt

SEQ ID NO: 7050019 - DNA, 22 bp, Homo sapiens
gtgcatttatatttgcctttgg

SEQ ID NO: 7050020 - DNA, 20 bp, Homo sapiens
gtgcatttcacctgtactgt

SEQ ID NO: 7050021 - DNA, 22 bp, Homo sapiens
gtgcatttgacgaatactcact

SEQ ID NO: 7050022 - DNA, 22 bp, Homo sapiens
gtgcatttggtgactctcaccc

SEQ ID NO: 7050023 - DNA, 22 bp, Homo sapiens
gtgcatttgtgcatgcacatgt

SEQ ID NO: 7050024 - DNA, 22 bp, Homo sapiens
ggctctggaatgtgtagtcagg

SEQ ID NO: 7050025 - DNA, 22 bp, Homo sapiens
ggctccaggagatgctgggcag

SEQ ID NO: 7050026 - DNA, 22 bp, Homo sapiens
ggctccagatgtctcctggcaa

SEQ ID NO: 7050027 - DNA, 22 bp, Homo sapiens
ggcggaggttgcagtaagccga

SEQ ID NO: 7050028 - DNA, 22 bp, Homo sapiens
ggcgggagcagcagctctgagc

SEQ ID NO: 7050029 - DNA, 22 bp, Homo sapiens
ggcgggaggctgaggagttggt

SEQ ID NO: 7050030 - DNA, 22 bp, Homo sapiens
ggctgagacaacctgggaccca

SEQ ID NO: 7050031 - DNA, 22 bp, Homo sapiens
ggctgagaaggagtgggtgagg

SEQ ID NO: 7050032 - DNA, 23 bp, Homo sapiens
ggctgagaagtcccatgataggt

SEQ ID NO: 7050033 - DNA, 23 bp, Homo sapiens
ggctgagactacaggcgcttgcc

SEQ ID NO: 7050034 - DNA, 22 bp, Homo sapiens
ggctgagactagagtgaggcat

SEQ ID NO: 7050035 - DNA, 22 bp, Homo sapiens
ggctgagactagagtgaggcat

SEQ ID NO: 7050036 - DNA, 22 bp, Homo sapiens
ggctgagaacaggcccagcctc

SEQ ID NO: 7050037 - DNA, 22 bp, Homo sapiens
ggctgaaggatgaaagctgcag

SEQ ID NO: 7050038 - DNA, 22 bp, Homo sapiens
ggctgaagtgtagtggctcact

SEQ ID NO: 7050039 - DNA, 22 bp, Homo sapiens
ggctgaaggatgaaagctgcag

SEQ ID NO: 7050040 - DNA, 22 bp, Homo sapiens
ggctgaaggatgaaagctgcag

SEQ ID NO: 7050041 - DNA, 22 bp, Homo sapiens
ggctcttgttcgtaccatggct

SEQ ID NO: 7050042 - DNA, 22 bp, Homo sapiens
ggctctggctactccaccctgt

SEQ ID NO: 7050043 - DNA, 22 bp, Homo sapiens
ggctctgggcatagaaggaagc

SEQ ID NO: 7050044 - DNA, 22 bp, Homo sapiens
ggctctggcggctctttcaata

SEQ ID NO: 7050045 - DNA, 19 bp, Homo sapiens
ggctctggcggctgtagcc

SEQ ID NO: 7050046 - DNA, 22 bp, Homo sapiens
ggctctggcgtccaatggagcg

SEQ ID NO: 7050047 - DNA, 22 bp, Homo sapiens
ggctctggcaaggggaggctac

SEQ ID NO: 7050048 - DNA, 22 bp, Homo sapiens
ggctctggagcacagacgtctg

SEQ ID NO: 7050049 - DNA, 22 bp, Homo sapiens
ggctctggcaaggggaggctac

SEQ ID NO: 7050050 - DNA, 22 bp, Homo sapiens
ggctctggagacatgtggagag

SEQ ID NO: 7050051 - DNA, 22 bp, Homo sapiens
ggctctggagatgtccgacctg

SEQ ID NO: 7050052 - DNA, 22 bp, Homo sapiens
ggctgggctgctgggtcagagc

SEQ ID NO: 7050053 - DNA, 22 bp, Homo sapiens
ggcttctctcccccagctccac

SEQ ID NO: 7050054 - DNA, 22 bp, Homo sapiens
ggcttctctcttcacatggctt

SEQ ID NO: 7050055 - DNA, 22 bp, Homo sapiens
ggcttctgaaactgtattgaga

SEQ ID NO: 7050056 - DNA, 22 bp, Homo sapiens
ggcttctgagtgctctgctgtt

SEQ ID NO: 7050057 - DNA, 22 bp, Homo sapiens
ggctgggctccgggagcatgcg

SEQ ID NO: 7050058 - DNA, 22 bp, Homo sapiens
ggctgggccagggcctgtggac

SEQ ID NO: 7050059 - DNA, 22 bp, Homo sapiens
ggctgggcatccatccatgaga

SEQ ID NO: 7050060 - DNA, 22 bp, Homo sapiens
ggctgggcatccatccatgaga

SEQ ID NO: 7050061 - DNA, 22 bp, Homo sapiens
ggctgggcaggtctgcacaggg

SEQ ID NO: 7050062 - DNA, 22 bp, Homo sapiens
ggctgagagtttcctctggggc

SEQ ID NO: 7050063 - DNA, 21 bp, Homo sapiens
ggctgagatggcagaatcacc

SEQ ID NO: 7050064 - DNA, 22 bp, Homo sapiens
ggctgagaggacgtcgggctca

SEQ ID NO: 7050065 - DNA, 22 bp, Homo sapiens
ggctgagagtggatcccaggga

SEQ ID NO: 7050066 - DNA, 22 bp, Homo sapiens
ggctgagagtggatcccaggga

SEQ ID NO: 7050067 - DNA, 22 bp, Homo sapiens
ggctgagcaattttgatgacat

SEQ ID NO: 7050068 - DNA, 22 bp, Homo sapiens
ggctgagcaattttgatgacat

SEQ ID NO: 7050069 - DNA, 22 bp, Homo sapiens
ggctgagcactttaggcaggag

SEQ ID NO: 7050070 - DNA, 22 bp, Homo sapiens
ggctgctgaagtgtggcaatct

SEQ ID NO: 7050071 - DNA, 22 bp, Homo sapiens
ggctgctgacaaacatgatcat

SEQ ID NO: 7050072 - DNA, 22 bp, Homo sapiens
ggctgctgagtcacgacagtga

SEQ ID NO: 7050073 - DNA, 22 bp, Homo sapiens
ggctgctgagttggccaggaga

SEQ ID NO: 7050074 - DNA, 22 bp, Homo sapiens
ggctgctgcccacccctgcatg

SEQ ID NO: 7050075 - DNA, 22 bp, Homo sapiens
ggctgctggaagactgaacaag

SEQ ID NO: 7050076 - DNA, 22 bp, Homo sapiens
ggctgctggcattgaggtaggt

SEQ ID NO: 7050077 - DNA, 22 bp, Homo sapiens
ggctgctggccagcctaggagt

SEQ ID NO: 7050078 - DNA, 22 bp, Homo sapiens
ggctgctgggaatatgccagct

SEQ ID NO: 7050079 - DNA, 22 bp, Homo sapiens
ggctgggaggccgtgctgacct

SEQ ID NO: 7050080 - DNA, 22 bp, Homo sapiens
ggctgggaggccgtgctgacct

SEQ ID NO: 7050081 - DNA, 22 bp, Homo sapiens
ggctgggaggccgtgctgacct

SEQ ID NO: 7050082 - DNA, 22 bp, Homo sapiens
ggcttgggagcaggcatgtgac

SEQ ID NO: 7050083 - DNA, 22 bp, Homo sapiens
ggcttgggagcaggcatgtgac

SEQ ID NO: 7050084 - DNA, 23 bp, Homo sapiens
gggaccaggcccttcctggtttg

SEQ ID NO: 7050085 - DNA, 23 bp, Homo sapiens
gggaccagctagggctgtgacct

SEQ ID NO: 7050086 - DNA, 22 bp, Homo sapiens
gggacatctttctagtcagggt

SEQ ID NO: 7050087 - DNA, 22 bp, Homo sapiens
gggacatctttctagtcagggt

SEQ ID NO: 7050088 - DNA, 22 bp, Homo sapiens
gggacatgaggccatagtgatt

SEQ ID NO: 7050089 - DNA, 22 bp, Homo sapiens
gggacaggctgagacttgagct

SEQ ID NO: 7050090 - DNA, 22 bp, Homo sapiens
gggacaggctgagacttgagct

SEQ ID NO: 7050091 - DNA, 22 bp, Homo sapiens
gggagacacgctgcaggcataa

SEQ ID NO: 7050092 - DNA, 22 bp, Homo sapiens
gggagacagttcagatagtttc

SEQ ID NO: 7050093 - DNA, 22 bp, Homo sapiens
gggagacccccaatgccaggtc

SEQ ID NO: 7050094 - DNA, 22 bp, Homo sapiens
gggagaggttacccgagcaact

SEQ ID NO: 7050095 - DNA, 22 bp, Homo sapiens
gggagctgtaagggacaggtag

SEQ ID NO: 7050096 - DNA, 22 bp, Homo sapiens
gggaggaaggcttgggtgagta

SEQ ID NO: 7050097 - DNA, 19 bp, Homo sapiens
gggagctgtctgcccgtgg

SEQ ID NO: 7050098 - DNA, 22 bp, Homo sapiens
gggaggaaatgtgcagcgaatt

SEQ ID NO: 7050099 - DNA, 22 bp, Homo sapiens
gggaggagctgagtgtgtgtgc

SEQ ID NO: 7050100 - DNA, 22 bp, Homo sapiens
gggaggagctgagtgtgtgtgc

SEQ ID NO: 7050101 - DNA, 22 bp, Homo sapiens
gggaggagcttggagattcact

SEQ ID NO: 7050102 - DNA, 22 bp, Homo sapiens
gggatggggagctggaaagggg

SEQ ID NO: 7050103 - DNA, 22 bp, Homo sapiens
gggatggggagctggaaagggg

SEQ ID NO: 7050104 - DNA, 22 bp, Homo sapiens
gggatggggtcgggaccctgct

SEQ ID NO: 7050105 - DNA, 22 bp, Homo sapiens
gggatttgtgggatggccagtg

SEQ ID NO: 7050106 - DNA, 22 bp, Homo sapiens
gggcaagcacagcgagcgtgcg

SEQ ID NO: 7050107 - DNA, 22 bp, Homo sapiens
gggcaagcacagcgagcgtgcg

SEQ ID NO: 7050108 - DNA, 22 bp, Homo sapiens
gggcacagcccagtggggtccc

SEQ ID NO: 7050109 - DNA, 18 bp, Homo sapiens
gggcatggatgcagcatc

SEQ ID NO: 7050110 - DNA, 17 bp, Homo sapiens
gggcagggactcctggg

SEQ ID NO: 7050111 - DNA, 17 bp, Homo sapiens
gggcagggactcctggg

SEQ ID NO: 7050112 - DNA, 22 bp, Homo sapiens
gggcaggatgcagtttcagaga

SEQ ID NO: 7050113 - DNA, 22 bp, Homo sapiens
gggcaggagagaacagtcatgg

SEQ ID NO: 7050114 - DNA, 22 bp, Homo sapiens
gggcaggagagggccacctgga

SEQ ID NO: 7050115 - DNA, 22 bp, Homo sapiens
gggcaggaggctaattctgcat

SEQ ID NO: 7050116 - DNA, 22 bp, Homo sapiens
gggcacaggagaaggatctggc

SEQ ID NO: 7050117 - DNA, 22 bp, Homo sapiens
ggccagggggcttcagactcca

SEQ ID NO: 7050118 - DNA, 22 bp, Homo sapiens
ggccagggggcttcagactcca

SEQ ID NO: 7050119 - DNA, 22 bp, Homo sapiens
ggccaggctgccctgggagcag

SEQ ID NO: 7050120 - DNA, 22 bp, Homo sapiens
ggccagggcctggggactgtcc

SEQ ID NO: 7050121 - DNA, 22 bp, Homo sapiens
ggccagggggcttcagactcca

SEQ ID NO: 7050122 - DNA, 22 bp, Homo sapiens
ggccaggtaagagtgcagccgc

SEQ ID NO: 7050123 - DNA, 22 bp, Homo sapiens
ggccaggtgcggtggctcacac

SEQ ID NO: 7050124 - DNA, 22 bp, Homo sapiens
ggcattaactctgtttcaattt

SEQ ID NO: 7050125 - DNA, 18 bp, Homo sapiens
ggcatgtgagtgctgagg

SEQ ID NO: 7050126 - DNA, 18 bp, Homo sapiens
ggcatgtgagtgctgagg

SEQ ID NO: 7050127 - DNA, 22 bp, Homo sapiens
ggcatgtgcctgaggtcacaca

SEQ ID NO: 7050128 - DNA, 22 bp, Homo sapiens
ggccacacagatgactgctttc

SEQ ID NO: 7050129 - DNA, 22 bp, Homo sapiens
ggccacagaacagctacaggac

SEQ ID NO: 7050130 - DNA, 17 bp, Homo sapiens
ggccacagagcttgggg

SEQ ID NO: 7050131 - DNA, 19 bp, Homo sapiens
ggccaggctgactgtggtc

SEQ ID NO: 7050132 - DNA, 22 bp, Homo sapiens
ggcaggtgggaaccctccccac

SEQ ID NO: 7050133 - DNA, 22 bp, Homo sapiens
ggcaggtgtgagatcgaggcca

SEQ ID NO: 7050134 - DNA, 22 bp, Homo sapiens
ggcaggtgtgagatcgaggcca

SEQ ID NO: 7050135 - DNA, 22 bp, Homo sapiens
ggcagtcacttttgcttgtgcc

SEQ ID NO: 7050136 - DNA, 22 bp, Homo sapiens
ggcaggcagaggctgagacagg

SEQ ID NO: 7050137 - DNA, 22 bp, Homo sapiens
ggcaggtggaagttggcagagc

SEQ ID NO: 7050138 - DNA, 22 bp, Homo sapiens
ggcaggtggacgtgctaaagct

SEQ ID NO: 7050139 - DNA, 22 bp, Homo sapiens
ggcaggtggcactgctgctccc

SEQ ID NO: 7050140 - DNA, 22 bp, Homo sapiens
ggcatggggtgtatgtggcacg

SEQ ID NO: 7050141 - DNA, 22 bp, Homo sapiens
ggcatggggtgtatgtggcacg

SEQ ID NO: 7050142 - DNA, 22 bp, Homo sapiens
ggcatgggccgaggtgcctcct

SEQ ID NO: 7050143 - DNA, 22 bp, Homo sapiens
ggcatgggccgaggtgcctcct

SEQ ID NO: 7050144 - DNA, 22 bp, Homo sapiens
ggcatgggccgaggtgcctcct

SEQ ID NO: 7050145 - DNA, 22 bp, Homo sapiens
ggcagtgaatgaaacagaggct

SEQ ID NO: 7050146 - DNA, 22 bp, Homo sapiens
ggcagtgaatctgagagcctgg

SEQ ID NO: 7050147 - DNA, 22 bp, Homo sapiens
ggcagtgaatctgagagcctgg

SEQ ID NO: 7050148 - DNA, 22 bp, Homo sapiens
ggcagtgaatgaaacagaggct

SEQ ID NO: 7050149 - DNA, 22 bp, Homo sapiens
ggcagtgaatgaaacagaggct

SEQ ID NO: 7050150 - DNA, 22 bp, Homo sapiens
ggcagtgaaaaagtatgtttcc

SEQ ID NO: 7050151 - DNA, 22 bp, Homo sapiens
ggcagtgaacagaaatgcagaa

SEQ ID NO: 7050152 - DNA, 22 bp, Homo sapiens
ggcagtgaacagaaatgcagaa

SEQ ID NO: 7050153 - DNA, 22 bp, Homo sapiens
ggcagtgaacagaaatgcagaa

SEQ ID NO: 7050154 - DNA, 22 bp, Homo sapiens
ggcagtgaacagaaatgcagaa

SEQ ID NO: 7050155 - DNA, 22 bp, Homo sapiens
ggcagtgaatctgagagcctgg

SEQ ID NO: 7050156 - DNA, 21 bp, Homo sapiens
ggcctgagtataggacaggcc

SEQ ID NO: 7050157 - DNA, 22 bp, Homo sapiens
ggcctgagtcccacctggctgt

SEQ ID NO: 7050158 - DNA, 22 bp, Homo sapiens
ggcctgagtcccacctggctgt

SEQ ID NO: 7050159 - DNA, 22 bp, Homo sapiens
ggcctcttctgctcatactttc

SEQ ID NO: 7050160 - DNA, 22 bp, Homo sapiens
ggcctgagaaccatggggccaa

SEQ ID NO: 7050161 - DNA, 22 bp, Homo sapiens
ggcctgaggcgtcccagctgtg

SEQ ID NO: 7050162 - DNA, 22 bp, Homo sapiens
ggcctgagggtgggctctcagt

SEQ ID NO: 7050163 - DNA, 22 bp, Homo sapiens
ggcctctgtttggagccaggat

SEQ ID NO: 7050164 - DNA, 22 bp, Homo sapiens
ggcctctgttctgcattcctcc

SEQ ID NO: 7050165 - DNA, 23 bp, Homo sapiens
ggcctctgtgttctgcccacatg

SEQ ID NO: 7050166 - DNA, 22 bp, Homo sapiens
ggcctcagtttcttcaactgta

SEQ ID NO: 7050167 - DNA, 22 bp, Homo sapiens
ggccatggaccccgagctgacc

SEQ ID NO: 7050168 - DNA, 23 bp, Homo sapiens
ggccatggagacttagaatgggc

SEQ ID NO: 7050169 - DNA, 22 bp, Homo sapiens
ggccatggcgggagccggcgtc

SEQ ID NO: 7050170 - DNA, 18 bp, Homo sapiens
ggagtctcaggagaggaa

SEQ ID NO: 7050171 - DNA, 22 bp, Homo sapiens
ggagtgaggcatttgtagctga

SEQ ID NO: 7050172 - DNA, 22 bp, Homo sapiens
ggagtcaggatcctggggatgg

SEQ ID NO: 7050173 - DNA, 22 bp, Homo sapiens
ggagtcaggagcaggctgggct

SEQ ID NO: 7050174 - DNA, 21 bp, Homo sapiens
ggagtcagggtctggctgggg

SEQ ID NO: 7050175 - DNA, 22 bp, Homo sapiens
ggagtcagcctgtcagagtgta

SEQ ID NO: 7050176 - DNA, 22 bp, Homo sapiens
ggagtcagcctgtcagagtgta

SEQ ID NO: 7050177 - DNA, 22 bp, Homo sapiens
ggagtcagaatggcagggtggt

SEQ ID NO: 7050178 - DNA, 22 bp, Homo sapiens
ggagtcaccaagtaggagtctt

SEQ ID NO: 7050179 - DNA, 22 bp, Homo sapiens
ggagtcaccaagtaggagtctt

SEQ ID NO: 7050180 - DNA, 22 bp, Homo sapiens
ggagccagagcactggggagcc

SEQ ID NO: 7050181 - DNA, 22 bp, Homo sapiens
ggagccagagggatgcagttga

SEQ ID NO: 7050182 - DNA, 22 bp, Homo sapiens
ggagccagagtctgcagtgtaa

SEQ ID NO: 7050183 - DNA, 23 bp, Homo sapiens
ggagccagcctgtggggagcggg

SEQ ID NO: 7050184 - DNA, 19 bp, Homo sapiens
ggagccagctgtggaaggc

SEQ ID NO: 7050185 - DNA, 23 bp, Homo sapiens
ggagccagcctgtggggagcggg

SEQ ID NO: 7050186 - DNA, 19 bp, Homo sapiens
ggagccagctgtggaaggc

SEQ ID NO: 7050187 - DNA, 22 bp, Homo sapiens
ggagtattgtagcttccagttc

SEQ ID NO: 7050188 - DNA, 22 bp, Homo sapiens
ggcaaaggaaaacgtctcagct

SEQ ID NO: 7050189 - DNA, 22 bp, Homo sapiens
ggcaagaggtccaagaggtctc

SEQ ID NO: 7050190 - DNA, 22 bp, Homo sapiens
ggcaagagtgaggagtgtctct

SEQ ID NO: 7050191 - DNA, 22 bp, Homo sapiens
ggcaagcataacctgtacagcc

SEQ ID NO: 7050192 - DNA, 23 bp, Homo sapiens
ggagtgcaatggcgccatctcgg

SEQ ID NO: 7050193 - DNA, 23 bp, Homo sapiens
ggagtgcaatggcgccatctcgg

SEQ ID NO: 7050194 - DNA, 22 bp, Homo sapiens
ggattttagagtacctaagtgt

SEQ ID NO: 7050195 - DNA, 22 bp, Homo sapiens
ggcaggagggcggacaatgacc

SEQ ID NO: 7050196 - DNA, 22 bp, Homo sapiens
ggcagaggtgaagttcacaagg

SEQ ID NO: 7050197 - DNA, 22 bp, Homo sapiens
ggcaggaggtgagtggcgggtg

SEQ ID NO: 7050198 - DNA, 22 bp, Homo sapiens
ggcaggaggtgagtggcgggtg

SEQ ID NO: 7050199 - DNA, 22 bp, Homo sapiens
ggcaggaggtgagtggcgggtg

SEQ ID NO: 7050200 - DNA, 22 bp, Homo sapiens
ggcagaggtagctggaaccagg

SEQ ID NO: 7050201 - DNA, 20 bp, Homo sapiens
ggcagagggcctgggagaag

SEQ ID NO: 7050202 - DNA, 20 bp, Homo sapiens
ggcagagggcctgggagaag

SEQ ID NO: 7050203 - DNA, 22 bp, Homo sapiens
ggcagaggtagctggaaccagg

SEQ ID NO: 7050204 - DNA, 22 bp, Homo sapiens
ggcaggcaacggaccactagtc

SEQ ID NO: 7050205 - DNA, 22 bp, Homo sapiens
ggcaggcaatgaggatgggaag

SEQ ID NO: 7050206 - DNA, 22 bp, Homo sapiens
ggcaggcactgtgctaggcgct

SEQ ID NO: 7050207 - DNA, 22 bp, Homo sapiens
ggcaggcagaggctgagacagg

SEQ ID NO: 7050208 - DNA, 22 bp, Homo sapiens
ggcagaggaggggtgaatttgc

SEQ ID NO: 7050209 - DNA, 22 bp, Homo sapiens
ggcagaggagctggaaacatgg

SEQ ID NO: 7050210 - DNA, 22 bp, Homo sapiens
ggcagaggagctggaaacatgg

SEQ ID NO: 7050211 - DNA, 22 bp, Homo sapiens
ggcagaggaggggtgaatttgc

SEQ ID NO: 7050212 - DNA, 20 bp, Homo sapiens
ggcagagggcctgggagaag

SEQ ID NO: 7050213 - DNA, 22 bp, Homo sapiens
ggcagaggagctggaaacatgg

SEQ ID NO: 7050214 - DNA, 22 bp, Homo sapiens
ggcagaggaaggatgaattcac

SEQ ID NO: 7050215 - DNA, 22 bp, Homo sapiens
ggcagaggaaggatgaattcac

SEQ ID NO: 7050216 - DNA, 20 bp, Homo sapiens
ggcaccaggctaggattgga

SEQ ID NO: 7050217 - DNA, 22 bp, Homo sapiens
ggcaccaggctgggcataggcc

SEQ ID NO: 7050218 - DNA, 23 bp, Homo sapiens
ggcaccaggccatggagcgggag

SEQ ID NO: 7050219 - DNA, 17 bp, Homo sapiens
ggcaccagacggagagt

SEQ ID NO: 7050220 - DNA, 22 bp, Homo sapiens
ggcacaggaatctgtgaagtgc

SEQ ID NO: 7050221 - DNA, 17 bp, Homo sapiens
gctttccttgcccctcc

SEQ ID NO: 7050222 - DNA, 22 bp, Homo sapiens
gctttcctggccctgtccctgc

SEQ ID NO: 7050223 - DNA, 22 bp, Homo sapiens
gctttggagcctgtgttctgcc

SEQ ID NO: 7050224 - DNA, 19 bp, Homo sapiens
gctttggagggaggttcta

SEQ ID NO: 7050225 - DNA, 22 bp, Homo sapiens
ggaagacaagcagtggctgagc

SEQ ID NO: 7050226 - DNA, 22 bp, Homo sapiens
ggaagacagaagcctacagctt

SEQ ID NO: 7050227 - DNA, 22 bp, Homo sapiens
ggaagaggctctcattgagggc

SEQ ID NO: 7050228 - DNA, 22 bp, Homo sapiens
ggaagaggctctcattgagggc

SEQ ID NO: 7050229 - DNA, 22 bp, Homo sapiens
ggaagaggctgagccaggtccc

SEQ ID NO: 7050230 - DNA, 22 bp, Homo sapiens
ggaagaggctgagccaggtccc

SEQ ID NO: 7050231 - DNA, 22 bp, Homo sapiens
ggaagaggctggtagtgcccgt

SEQ ID NO: 7050232 - DNA, 22 bp, Homo sapiens
ggaatcagagcagaggctgtta

SEQ ID NO: 7050233 - DNA, 22 bp, Homo sapiens
ggaatgctcagttcttggtgct

SEQ ID NO: 7050234 - DNA, 22 bp, Homo sapiens
ggaattctgtagctcttcctct

SEQ ID NO: 7050235 - DNA, 22 bp, Homo sapiens
ggaattggtttcaagggaaagt

SEQ ID NO: 7050236 - DNA, 22 bp, Homo sapiens
ggagacagtatggcttgtagct

SEQ ID NO: 7050237 - DNA, 22 bp, Homo sapiens
ggagacagtatggcttgtagct

SEQ ID NO: 7050238 - DNA, 22 bp, Homo sapiens
ggaccatctctagccagagctt

SEQ ID NO: 7050239 - DNA, 22 bp, Homo sapiens
ggaccatctctagccagagctt

SEQ ID NO: 7050240 - DNA, 22 bp, Homo sapiens
ggagacagggttgaaccacgca

SEQ ID NO: 7050241 - DNA, 19 bp, Homo sapiens
ggaccaggtcctgggcagc

SEQ ID NO: 7050242 - DNA, 20 bp, Homo sapiens
ggaccaggtggggcggtggc

SEQ ID NO: 7050243 - DNA, 22 bp, Homo sapiens
ggaccagtttcaaactgtacca

SEQ ID NO: 7050244 - DNA, 22 bp, Homo sapiens
ggacatggaagtatggagtgga

SEQ ID NO: 7050245 - DNA, 22 bp, Homo sapiens
ggacagtccacctcagtgaaga

SEQ ID NO: 7050246 - DNA, 19 bp, Homo sapiens
ggacagtctcagcctcatg

SEQ ID NO: 7050247 - DNA, 20 bp, Homo sapiens
ggacagtgagacatatctca

SEQ ID NO: 7050248 - DNA, 19 bp, Homo sapiens
ggagactcagcccatgcct

SEQ ID NO: 7050249 - DNA, 22 bp, Homo sapiens
ggagactgatctgagtgataac

SEQ ID NO: 7050250 - DNA, 22 bp, Homo sapiens
ggagacagtggtagggcctaag

SEQ ID NO: 7050251 - DNA, 22 bp, Homo sapiens
ggagacagtggtagggcctaag

SEQ ID NO: 7050252 - DNA, 22 bp, Homo sapiens
ggagacagtgacttagagactg

SEQ ID NO: 7050253 - DNA, 22 bp, Homo sapiens
ggagcaggctctgtggtttcca

SEQ ID NO: 7050254 - DNA, 22 bp, Homo sapiens
ggagcagcactgccacacagag

SEQ ID NO: 7050255 - DNA, 22 bp, Homo sapiens
ggagcagggcagtgaattctgg

SEQ ID NO: 7050256 - DNA, 22 bp, Homo sapiens
ggagcatctgaacagggagaag

SEQ ID NO: 7050257 - DNA, 22 bp, Homo sapiens
ggagccagagcactggggagcc

SEQ ID NO: 7050258 - DNA, 20 bp, Homo sapiens
gcttgctttgtctgatgggc

SEQ ID NO: 7050259 - DNA, 22 bp, Homo sapiens
gcttgagttttgggacaaagcc

SEQ ID NO: 7050260 - DNA, 22 bp, Homo sapiens
gcttgcctatctggtggtcgtt

SEQ ID NO: 7050261 - DNA, 22 bp, Homo sapiens
gcttgcctggcatttctggggc

SEQ ID NO: 7050262 - DNA, 23 bp, Homo sapiens
gcttgcctggtgtgtggctgacc

SEQ ID NO: 7050263 - DNA, 17 bp, Homo sapiens
gcttgccttgtcttcct

SEQ ID NO: 7050264 - DNA, 22 bp, Homo sapiens
gctgtgtcctcacacagccttt

SEQ ID NO: 7050265 - DNA, 22 bp, Homo sapiens
gcttctggtgaggcctcaggaa

SEQ ID NO: 7050266 - DNA, 21 bp, Homo sapiens
gcttctgtatctagcaggaac

SEQ ID NO: 7050267 - DNA, 22 bp, Homo sapiens
gcttctgtatttattgtccttt

SEQ ID NO: 7050268 - DNA, 22 bp, Homo sapiens
gcttctgtcttagctacctccc

SEQ ID NO: 7050269 - DNA, 22 bp, Homo sapiens
gcttctgtgagtgcagatgctg

SEQ ID NO: 7050270 - DNA, 22 bp, Homo sapiens
gcttctgtggattggctggctt

SEQ ID NO: 7050271 - DNA, 22 bp, Homo sapiens
gcttctgtggtgaggtcacctt

SEQ ID NO: 7050272 - DNA, 22 bp, Homo sapiens
gcttctgtggtgcatctttgct

SEQ ID NO: 7050273 - DNA, 22 bp, Homo sapiens
gcttctgtggttgtcacgacta

SEQ ID NO: 7050274 - DNA, 22 bp, Homo sapiens
gcttctgttaacttatgttccc

SEQ ID NO: 7050275 - DNA, 22 bp, Homo sapiens
gcttctgttcaaggatataagg

SEQ ID NO: 7050276 - DNA, 19 bp, Homo sapiens
gcttctgtttgggcttaga

SEQ ID NO: 7050277 - DNA, 22 bp, Homo sapiens
gctggggaggcagcagagaaca

SEQ ID NO: 7050278 - DNA, 22 bp, Homo sapiens
gctggggagggcgtcaaggcca

SEQ ID NO: 7050279 - DNA, 19 bp, Homo sapiens
gctggggcctgaccagaca

SEQ ID NO: 7050280 - DNA, 22 bp, Homo sapiens
gctggggctgggctgaggaaga

SEQ ID NO: 7050281 - DNA, 22 bp, Homo sapiens
gctgtgggtaaacgctgagggt

SEQ ID NO: 7050282 - DNA, 22 bp, Homo sapiens
gctgtggtctgtgagctccaaa

SEQ ID NO: 7050283 - DNA, 22 bp, Homo sapiens
gctgtgggccacacggctgagt

SEQ ID NO: 7050284 - DNA, 19 bp, Homo sapiens
gctgtgggacagcagggtg

SEQ ID NO: 7050285 - DNA, 22 bp, Homo sapiens
gctgtggctgaagatgcaggga

SEQ ID NO: 7050286 - DNA, 21 bp, Homo sapiens
gctggagagccaggcaggggc

SEQ ID NO: 7050287 - DNA, 22 bp, Homo sapiens
gctggagagataggcatggggt

SEQ ID NO: 7050288 - DNA, 22 bp, Homo sapiens
gctggagagataggcatggggt

SEQ ID NO: 7050289 - DNA, 22 bp, Homo sapiens
gctgctttagaattgaaacaga

SEQ ID NO: 7050290 - DNA, 20 bp, Homo sapiens
gctgctttcaaatgacacgt

SEQ ID NO: 7050291 - DNA, 22 bp, Homo sapiens
gctggagaaactgcagctgagg

SEQ ID NO: 7050292 - DNA, 22 bp, Homo sapiens
gctggagaaactgcagctgagg

SEQ ID NO: 7050293 - DNA, 23 bp, Homo sapiens
gctggctggcagtaaaggttgtt

SEQ ID NO: 7050294 - DNA, 22 bp, Homo sapiens
gctggctggaggagggaggttg

SEQ ID NO: 7050295 - DNA, 22 bp, Homo sapiens
gctggctttgtggtctctcctc

SEQ ID NO: 7050296 - DNA, 22 bp, Homo sapiens
gctggcttttgaagtctagcta

SEQ ID NO: 7050297 - DNA, 22 bp, Homo sapiens
gctggctttatcgtcagactcc

SEQ ID NO: 7050298 - DNA, 22 bp, Homo sapiens
gctggctttatggggcttgtgg

SEQ ID NO: 7050299 - DNA, 21 bp, Homo sapiens
gctggctttattctgcgtttg

SEQ ID NO: 7050300 - DNA, 22 bp, Homo sapiens
gctggctttgatcttcccatct

SEQ ID NO: 7050301 - DNA, 22 bp, Homo sapiens
gctggctttgcactgggtgcat

SEQ ID NO: 7050302 - DNA, 22 bp, Homo sapiens
gctggctttgtcaagggcagca

SEQ ID NO: 7050303 - DNA, 22 bp, Homo sapiens
gctggctttgtcaagggcagca

SEQ ID NO: 7050304 - DNA, 22 bp, Homo sapiens
gctgggcttcacctccagagtt

SEQ ID NO: 7050305 - DNA, 22 bp, Homo sapiens
gctgggcttcacctccagagtt

SEQ ID NO: 7050306 - DNA, 22 bp, Homo sapiens
gctgggcttcacagagccttta

SEQ ID NO: 7050307 - DNA, 23 bp, Homo sapiens
gctgggcttactctttcagtgag

SEQ ID NO: 7050308 - DNA, 22 bp, Homo sapiens
gctgggctgtagtttgctgacc

SEQ ID NO: 7050309 - DNA, 21 bp, Homo sapiens
gctggctggctgaccggcctt

SEQ ID NO: 7050310 - DNA, 22 bp, Homo sapiens
gctggcttaatagggatgggct

SEQ ID NO: 7050311 - DNA, 22 bp, Homo sapiens
gctggcttccatcagagggtga

SEQ ID NO: 7050312 - DNA, 22 bp, Homo sapiens
gctggcttccctacctgcacct

SEQ ID NO: 7050313 - DNA, 21 bp, Homo sapiens
gctggcttcctgagggctgag

SEQ ID NO: 7050314 - DNA, 22 bp, Homo sapiens
gctggcttccttctgcagctag

SEQ ID NO: 7050315 - DNA, 17 bp, Homo sapiens
gctggcttctccttgct

SEQ ID NO: 7050316 - DNA, 22 bp, Homo sapiens
gctggcttgacagaggcctggg

SEQ ID NO: 7050317 - DNA, 22 bp, Homo sapiens
gctggcttgatagtttctgctt

SEQ ID NO: 7050318 - DNA, 22 bp, Homo sapiens
gctggcttgtcccaggacaaag

SEQ ID NO: 7050319 - DNA, 22 bp, Homo sapiens
gctacaggagataaaggcctct

SEQ ID NO: 7050320 - DNA, 22 bp, Homo sapiens
gctacaggagctgtcacatgct

SEQ ID NO: 7050321 - DNA, 22 bp, Homo sapiens
gctacagagctctgtgaagaga

SEQ ID NO: 7050322 - DNA, 22 bp, Homo sapiens
gctacaggggtcagtcctttgc

SEQ ID NO: 7050323 - DNA, 22 bp, Homo sapiens
gctacaggtatatagatgaaac

SEQ ID NO: 7050324 - DNA, 22 bp, Homo sapiens
gctacaggtgacagcctctgca

SEQ ID NO: 7050325 - DNA, 22 bp, Homo sapiens
gcgtggcttagagtggggtacc

SEQ ID NO: 7050326 - DNA, 22 bp, Homo sapiens
gcgtgggctggactgggatgaa

SEQ ID NO: 7050327 - DNA, 22 bp, Homo sapiens
gcggtggggaaaggaggtgctg

SEQ ID NO: 7050328 - DNA, 22 bp, Homo sapiens
gcggtgggggaaaggagcggtt

SEQ ID NO: 7050329 - DNA, 22 bp, Homo sapiens
gcctttggactgaggtagtcag

SEQ ID NO: 7050330 - DNA, 18 bp, Homo sapiens
gcctttggactgctccca

SEQ ID NO: 7050331 - DNA, 22 bp, Homo sapiens
gcctttggagaatccagtcatg

SEQ ID NO: 7050332 - DNA, 22 bp, Homo sapiens
gcctttggagatgtcataggat

SEQ ID NO: 7050333 - DNA, 22 bp, Homo sapiens
gcctttggatatattcagggat

SEQ ID NO: 7050334 - DNA, 22 bp, Homo sapiens
gcctttggatggtttttctatt

SEQ ID NO: 7050335 - DNA, 22 bp, Homo sapiens
gcctttggctctgtctgacctg

SEQ ID NO: 7050336 - DNA, 19 bp, Homo sapiens
gcctttgggcgttgttggg

SEQ ID NO: 7050337 - DNA, 22 bp, Homo sapiens
gcctttggtgacaggcatgtgt

SEQ ID NO: 7050338 - DNA, 21 bp, Homo sapiens
gcctttggtttcttgtcctgc

SEQ ID NO: 7050339 - DNA, 22 bp, Homo sapiens
gccttggccttcctaggcctga

SEQ ID NO: 7050340 - DNA, 22 bp, Homo sapiens
gccttgggattcttggatgctc

SEQ ID NO: 7050341 - DNA, 22 bp, Homo sapiens
gccttgggggtgaaagaggcta

SEQ ID NO: 7050342 - DNA, 22 bp, Homo sapiens
gcctgagccgcctgagcggcgg

SEQ ID NO: 7050343 - DNA, 20 bp, Homo sapiens
gcctgagctattgccaggat

SEQ ID NO: 7050344 - DNA, 20 bp, Homo sapiens
gcctgagctattgccaggat

SEQ ID NO: 7050345 - DNA, 20 bp, Homo sapiens
gcctgagctccgcctcctgt

SEQ ID NO: 7050346 - DNA, 22 bp, Homo sapiens
gcctctgggttggtgacaggct

SEQ ID NO: 7050347 - DNA, 22 bp, Homo sapiens
gcctctggggcagctgagtcat

SEQ ID NO: 7050348 - DNA, 22 bp, Homo sapiens
gcctctggtccctcatgctgtg

SEQ ID NO: 7050349 - DNA, 22 bp, Homo sapiens
gcctctgtaggagtgagagcat

SEQ ID NO: 7050350 - DNA, 22 bp, Homo sapiens
gcctctgtcatagctcatgtga

SEQ ID NO: 7050351 - DNA, 18 bp, Homo sapiens
gcctctgttgcttgcctg

SEQ ID NO: 7050352 - DNA, 22 bp, Homo sapiens
gcctgagcagctatacacacag

SEQ ID NO: 7050353 - DNA, 22 bp, Homo sapiens
gcctgagcaggcgtggaccatg

SEQ ID NO: 7050354 - DNA, 19 bp, Homo sapiens
gcctgagccagccatgcaa

SEQ ID NO: 7050355 - DNA, 19 bp, Homo sapiens
gcctgagccagccatgcaa

SEQ ID NO: 7050356 - DNA, 22 bp, Homo sapiens
gcctgagcccaggtgtgcagag

SEQ ID NO: 7050357 - DNA, 22 bp, Homo sapiens
gctccctggtagccatgctctc

SEQ ID NO: 7050358 - DNA, 22 bp, Homo sapiens
gctcccaactcaggcctcctcc

SEQ ID NO: 7050359 - DNA, 22 bp, Homo sapiens
gctcccacaaccttcttgctcc

SEQ ID NO: 7050360 - DNA, 22 bp, Homo sapiens
gctcccacaaccttcttgctcc

SEQ ID NO: 7050361 - DNA, 22 bp, Homo sapiens
gctcccaccaggcagacctacc

SEQ ID NO: 7050362 - DNA, 22 bp, Homo sapiens
gctcccaccaggcagacctacc

SEQ ID NO: 7050363 - DNA, 22 bp, Homo sapiens
gctcccaccgccgctatgggta

SEQ ID NO: 7050364 - DNA, 22 bp, Homo sapiens
gctcccaccgccgctatgggta

SEQ ID NO: 7050365 - DNA, 22 bp, Homo sapiens
gctcccacctccagcctgagtt

SEQ ID NO: 7050366 - DNA, 22 bp, Homo sapiens
gctcccacctccagcctgagtt

SEQ ID NO: 7050367 - DNA, 22 bp, Homo sapiens
gctcccaccttaaccttcacat

SEQ ID NO: 7050368 - DNA, 22 bp, Homo sapiens
gctcccaccttaaccttcacat

SEQ ID NO: 7050369 - DNA, 22 bp, Homo sapiens
gctcccacctttgctatcagta

SEQ ID NO: 7050370 - DNA, 22 bp, Homo sapiens
gctcccacgcaattcttttcag

SEQ ID NO: 7050371 - DNA, 22 bp, Homo sapiens
gctcccacctttgctatcagta

SEQ ID NO: 7050372 - DNA, 22 bp, Homo sapiens
gctcccacgcaattcttttcag

SEQ ID NO: 7050373 - DNA, 22 bp, Homo sapiens
gctcccactgcagccctgagcc

SEQ ID NO: 7050374 - DNA, 22 bp, Homo sapiens
gctcccactgcagccctgagcc

SEQ ID NO: 7050375 - DNA, 22 bp, Homo sapiens
gctcccagactgaccagaggtg

SEQ ID NO: 7050376 - DNA, 21 bp, Homo sapiens
gctcagagtattgcactgttt

SEQ ID NO: 7050377 - DNA, 19 bp, Homo sapiens
gctcagagtccccctgcgg

SEQ ID NO: 7050378 - DNA, 22 bp, Homo sapiens
gctcagagtggcctggctaggg

SEQ ID NO: 7050379 - DNA, 19 bp, Homo sapiens
gctcagagggccctgtgct

SEQ ID NO: 7050380 - DNA, 19 bp, Homo sapiens
gctcagagggccctgtgct

SEQ ID NO: 7050381 - DNA, 22 bp, Homo sapiens
gctcagaggttgttcttgggtt

SEQ ID NO: 7050382 - DNA, 23 bp, Homo sapiens
gctcagaggtttttctctggatg

SEQ ID NO: 7050383 - DNA, 22 bp, Homo sapiens
gctcagagcttgaagttccact

SEQ ID NO: 7050384 - DNA, 22 bp, Homo sapiens
gctcagaggccactgttggaaa

SEQ ID NO: 7050385 - DNA, 22 bp, Homo sapiens
gctcagagggaacaaggggctg

SEQ ID NO: 7050386 - DNA, 22 bp, Homo sapiens
gctccaggcagagcctctttcg

SEQ ID NO: 7050387 - DNA, 22 bp, Homo sapiens
gctcagagttaattggatgggt

SEQ ID NO: 7050388 - DNA, 22 bp, Homo sapiens
gctcagagttaattggatgggt

SEQ ID NO: 7050389 - DNA, 22 bp, Homo sapiens
gctgagactggcagcaggaagt

SEQ ID NO: 7050390 - DNA, 22 bp, Homo sapiens
gctgagactggcagcaggaagt

SEQ ID NO: 7050391 - DNA, 22 bp, Homo sapiens
gctgagactggcagcaggaagt

SEQ ID NO: 7050392 - DNA, 22 bp, Homo sapiens
gctgagagaaaagtgaggttct

SEQ ID NO: 7050393 - DNA, 22 bp, Homo sapiens
gctgagagatcaaggcaggatt

SEQ ID NO: 7050394 - DNA, 22 bp, Homo sapiens
gctgagagatcaaggcaggatt

SEQ ID NO: 7050395 - DNA, 22 bp, Homo sapiens
gctgagagatcaaggcaggatt

SEQ ID NO: 7050396 - DNA, 22 bp, Homo sapiens
gctgagagatcaaggcaggatt

SEQ ID NO: 7050397 - DNA, 22 bp, Homo sapiens
gctgagagcaaagcatgtctag

SEQ ID NO: 7050398 - DNA, 22 bp, Homo sapiens
gctgagagcaaggacaaagcat

SEQ ID NO: 7050399 - DNA, 22 bp, Homo sapiens
gctgagagcggccagctgggaa

SEQ ID NO: 7050400 - DNA, 17 bp, Homo sapiens
gctgagaggcagcacag

SEQ ID NO: 7050401 - DNA, 17 bp, Homo sapiens
gctgagaggcagcacag

SEQ ID NO: 7050402 - DNA, 22 bp, Homo sapiens
gctgagaggcagccagaccctc

SEQ ID NO: 7050403 - DNA, 22 bp, Homo sapiens
gctgagagtccaggaaaacatc

SEQ ID NO: 7050404 - DNA, 22 bp, Homo sapiens
gctgagagtgagcactggatat

SEQ ID NO: 7050405 - DNA, 22 bp, Homo sapiens
gctgagagtgggtgcagtgctt

SEQ ID NO: 7050406 - DNA, 22 bp, Homo sapiens
gctgaggccccagggtgatggg

SEQ ID NO: 7050407 - DNA, 22 bp, Homo sapiens
gctgaggcctcagaaggctgag

SEQ ID NO: 7050408 - DNA, 22 bp, Homo sapiens
gctgaggcggaaggattgctag

SEQ ID NO: 7050409 - DNA, 22 bp, Homo sapiens
gctgaggctgggagcagcctgt

SEQ ID NO: 7050410 - DNA, 22 bp, Homo sapiens
gctgagggaggctgaactgagt

SEQ ID NO: 7050411 - DNA, 22 bp, Homo sapiens
gctgagggaggctgaactgagt

SEQ ID NO: 7050412 - DNA, 22 bp, Homo sapiens
gctgaatgaatgtattttaaaa

SEQ ID NO: 7050413 - DNA, 22 bp, Homo sapiens
gctctgggctgccctctggaca

SEQ ID NO: 7050414 - DNA, 22 bp, Homo sapiens
gctctgggccatcctggccggg

SEQ ID NO: 7050415 - DNA, 22 bp, Homo sapiens
gctctgggattaccagccttag

SEQ ID NO: 7050416 - DNA, 22 bp, Homo sapiens
gctcctccctgtgcagacccag

SEQ ID NO: 7050417 - DNA, 22 bp, Homo sapiens
gctcctctattccccacatttt

SEQ ID NO: 7050418 - DNA, 22 bp, Homo sapiens
gctcctccaatatggactcctc

SEQ ID NO: 7050419 - DNA, 22 bp, Homo sapiens
gctctggctagttacctcttac

SEQ ID NO: 7050420 - DNA, 22 bp, Homo sapiens
gctctggctcaaaccaccggct

SEQ ID NO: 7050421 - DNA, 18 bp, Homo sapiens
gctctggctcacctccag

SEQ ID NO: 7050422 - DNA, 22 bp, Homo sapiens
gctctggcttggggcactcgtc

SEQ ID NO: 7050423 - DNA, 22 bp, Homo sapiens
gctgcttgattaggttgacact

SEQ ID NO: 7050424 - DNA, 22 bp, Homo sapiens
gctgcttcctttcctgctgacc

SEQ ID NO: 7050425 - DNA, 22 bp, Homo sapiens
gctgcttctctgatggagtcca

SEQ ID NO: 7050426 - DNA, 22 bp, Homo sapiens
gctgctgttgatttagtccaat

SEQ ID NO: 7050427 - DNA, 22 bp, Homo sapiens
gctgcttcagggacgtgccagc

SEQ ID NO: 7050428 - DNA, 22 bp, Homo sapiens
gctgcttcctttcctgctgacc

SEQ ID NO: 7050429 - DNA, 22 bp, Homo sapiens
gctgctgtgtgggagacaggcg

SEQ ID NO: 7050430 - DNA, 22 bp, Homo sapiens
gctgctgtgttggagagggact

SEQ ID NO: 7050431 - DNA, 22 bp, Homo sapiens
gctgctgtgttggccactgctt

SEQ ID NO: 7050432 - DNA, 22 bp, Homo sapiens
gctgctgttcctccagtggatc

SEQ ID NO: 7050433 - DNA, 22 bp, Homo sapiens
gctgctcagtgggcctgagcct

SEQ ID NO: 7050434 - DNA, 21 bp, Homo sapiens
gctgctcgagatccagtgctt

SEQ ID NO: 7050435 - DNA, 22 bp, Homo sapiens
gctgctgtgaattttttaaatg

SEQ ID NO: 7050436 - DNA, 22 bp, Homo sapiens
gctgctgtgcctggcgtcctgt

SEQ ID NO: 7050437 - DNA, 21 bp, Homo sapiens
gctgctgtgggccagggaggc

SEQ ID NO: 7050438 - DNA, 22 bp, Homo sapiens
gctgcctgtgtggccactcact

SEQ ID NO: 7050439 - DNA, 22 bp, Homo sapiens
gctgcctgtggcccttctgggt

SEQ ID NO: 7050440 - DNA, 22 bp, Homo sapiens
gctgcctgttgaagggtctgtg

SEQ ID NO: 7050441 - DNA, 22 bp, Homo sapiens
gctgcctgtcctgaggagtccg

SEQ ID NO: 7050442 - DNA, 22 bp, Homo sapiens
gctgccttatgtctattagtat

SEQ ID NO: 7050443 - DNA, 20 bp, Homo sapiens
gctgcctgtttctgtaagta

SEQ ID NO: 7050444 - DNA, 22 bp, Homo sapiens
gctgcgtcgagacagcctggca

SEQ ID NO: 7050445 - DNA, 22 bp, Homo sapiens
gctgctaagcgtttctgttcca

SEQ ID NO: 7050446 - DNA, 22 bp, Homo sapiens
gctgagggctgtaacagcagag

SEQ ID NO: 7050447 - DNA, 22 bp, Homo sapiens
gctgagggctgtaacagcagag

SEQ ID NO: 7050448 - DNA, 22 bp, Homo sapiens
gctgagggctgtaacagcagag

SEQ ID NO: 7050449 - DNA, 22 bp, Homo sapiens
gctgagggcatgtgtggcgact

SEQ ID NO: 7050450 - DNA, 22 bp, Homo sapiens
gctgagggcatgtgtggcgact

SEQ ID NO: 7050451 - DNA, 22 bp, Homo sapiens
gctgcccagggtggagccggct

SEQ ID NO: 7050452 - DNA, 22 bp, Homo sapiens
gctgcccagcaggccccagggg

SEQ ID NO: 7050453 - DNA, 22 bp, Homo sapiens
gctgcctcaggcacctcctggc

SEQ ID NO: 7050454 - DNA, 22 bp, Homo sapiens
gctgcctccaatctgtgccccg

SEQ ID NO: 7050455 - DNA, 22 bp, Homo sapiens
gctgcctcactccagcccaata

SEQ ID NO: 7050456 - DNA, 22 bp, Homo sapiens
gctgcctcaggcacctcctggc

SEQ ID NO: 7050457 - DNA, 22 bp, Homo sapiens
gcagaggtcaaatacctcattt

SEQ ID NO: 7050458 - DNA, 22 bp, Homo sapiens
gcagaggtcctagccaggagtc

SEQ ID NO: 7050459 - DNA, 22 bp, Homo sapiens
gcagagggtcctgtgccagcag

SEQ ID NO: 7050460 - DNA, 22 bp, Homo sapiens
gcagaggtctagcaccaagaat

SEQ ID NO: 7050461 - DNA, 22 bp, Homo sapiens
gcagaggtctagcaccaagaat

SEQ ID NO: 7050462 - DNA, 22 bp, Homo sapiens
gcagaggtctcttcaaaataat

SEQ ID NO: 7050463 - DNA, 22 bp, Homo sapiens
gcagaggtctcttcaaaataat

SEQ ID NO: 7050464 - DNA, 22 bp, Homo sapiens
gcagaggtgaccagcagcaggg

SEQ ID NO: 7050465 - DNA, 22 bp, Homo sapiens
gcagaggtgagaagggcctccc

SEQ ID NO: 7050466 - DNA, 22 bp, Homo sapiens
gcagaggtgagtttctcagctg

SEQ ID NO: 7050467 - DNA, 22 bp, Homo sapiens
gcagaggatagcatatgaacct

SEQ ID NO: 7050468 - DNA, 22 bp, Homo sapiens
gcagaggatcaggctctggaaa

SEQ ID NO: 7050469 - DNA, 22 bp, Homo sapiens
gcagaggatcaggctctggaaa

SEQ ID NO: 7050470 - DNA, 22 bp, Homo sapiens
gcagaggatcaggctctggaaa

SEQ ID NO: 7050471 - DNA, 22 bp, Homo sapiens
gcagaggatcaggctctggaaa

SEQ ID NO: 7050472 - DNA, 22 bp, Homo sapiens
gcagagcagagcctgcattggc

SEQ ID NO: 7050473 - DNA, 22 bp, Homo sapiens
gcagagcagaggtgcaggttgg

SEQ ID NO: 7050474 - DNA, 22 bp, Homo sapiens
gcagagcagcaaatggaaagga

SEQ ID NO: 7050475 - DNA, 22 bp, Homo sapiens
gcagagcaggaaggaagtcagg

SEQ ID NO: 7050476 - DNA, 22 bp, Homo sapiens
gcagaggagtgattatgccgtg

SEQ ID NO: 7050477 - DNA, 22 bp, Homo sapiens
gcagaggatagcatatgaacct

SEQ ID NO: 7050478 - DNA, 21 bp, Homo sapiens
gcagactgccctgctgtcccc

SEQ ID NO: 7050479 - DNA, 22 bp, Homo sapiens
gcagacgtcaccgagtcgatgg

SEQ ID NO: 7050480 - DNA, 22 bp, Homo sapiens
gcagagaaagttttgtcctcag

SEQ ID NO: 7050481 - DNA, 22 bp, Homo sapiens
gcagagaaagttttgtcctcag

SEQ ID NO: 7050482 - DNA, 22 bp, Homo sapiens
gcagagaacccagcagattggc

SEQ ID NO: 7050483 - DNA, 22 bp, Homo sapiens
gcagagaagatgcccaggcttc

SEQ ID NO: 7050484 - DNA, 22 bp, Homo sapiens
gcagagaagatgcccaggcttc

SEQ ID NO: 7050485 - DNA, 22 bp, Homo sapiens
gcagagcaccaaagtgaaagat

SEQ ID NO: 7050486 - DNA, 22 bp, Homo sapiens
gcagagcaccctgcagtggtat

SEQ ID NO: 7050487 - DNA, 21 bp, Homo sapiens
gcacatgagggagggcatgcc

SEQ ID NO: 7050488 - DNA, 22 bp, Homo sapiens
gcacatgagctgctgggatggg

SEQ ID NO: 7050489 - DNA, 22 bp, Homo sapiens
gcacatgactttgaggaaacca

SEQ ID NO: 7050490 - DNA, 23 bp, Homo sapiens
gcacatactacacagaaaatggc

SEQ ID NO: 7050491 - DNA, 22 bp, Homo sapiens
gcacatatgctgtaagcacatg

SEQ ID NO: 7050492 - DNA, 22 bp, Homo sapiens
gcaaagctgggtgtgaatgcac

SEQ ID NO: 7050493 - DNA, 22 bp, Homo sapiens
gaggcccacagggagtaccaag

SEQ ID NO: 7050494 - DNA, 20 bp, Homo sapiens
gaggcccagagaggtgaagc

SEQ ID NO: 7050495 - DNA, 20 bp, Homo sapiens
gaggcccagagaggtgaagc

SEQ ID NO: 7050496 - DNA, 22 bp, Homo sapiens
gcacacagaacatttggatcct

SEQ ID NO: 7050497 - DNA, 22 bp, Homo sapiens
gcacacagtactatatgctaca

SEQ ID NO: 7050498 - DNA, 22 bp, Homo sapiens
gcacacagtagggattcaatga

SEQ ID NO: 7050499 - DNA, 19 bp, Homo sapiens
gcacacatacaccctttgg

SEQ ID NO: 7050500 - DNA, 22 bp, Homo sapiens
gcacacatgcatgtgtgcatcc

SEQ ID NO: 7050501 - DNA, 22 bp, Homo sapiens
gcacacattcggattcttaacc

SEQ ID NO: 7050502 - DNA, 22 bp, Homo sapiens
gcacacattctagccttttgtg

SEQ ID NO: 7050503 - DNA, 22 bp, Homo sapiens
gcacaccctctcaccagcactg

SEQ ID NO: 7050504 - DNA, 19 bp, Homo sapiens
gcacaccctgcaccaccat

SEQ ID NO: 7050505 - DNA, 22 bp, Homo sapiens
gcaggaagcatagaagaatgcc

SEQ ID NO: 7050506 - DNA, 22 bp, Homo sapiens
gcaggaagcatagaagaatgcc

SEQ ID NO: 7050507 - DNA, 22 bp, Homo sapiens
gcagctttgtggagaggcccat

SEQ ID NO: 7050508 - DNA, 22 bp, Homo sapiens
gcagctttttggatgtcagtta

SEQ ID NO: 7050509 - DNA, 22 bp, Homo sapiens
gcaggaagaggctcgaagcccc

SEQ ID NO: 7050510 - DNA, 22 bp, Homo sapiens
gcaggaagatgagctcaggtaa

SEQ ID NO: 7050511 - DNA, 22 bp, Homo sapiens
gcaggaagatgagctcaggtaa

SEQ ID NO: 7050512 - DNA, 22 bp, Homo sapiens
gcagccctgcaggcagctccag

SEQ ID NO: 7050513 - DNA, 20 bp, Homo sapiens
gcagccgtggagactaggag

SEQ ID NO: 7050514 - DNA, 22 bp, Homo sapiens
gcagcctcaaactccccagctc

SEQ ID NO: 7050515 - DNA, 20 bp, Homo sapiens
gcagcctcaacaggcacagc

SEQ ID NO: 7050516 - DNA, 20 bp, Homo sapiens
gcagcctcaacaggcacagc

SEQ ID NO: 7050517 - DNA, 20 bp, Homo sapiens
gcagcctcaacaggcacagc

SEQ ID NO: 7050518 - DNA, 22 bp, Homo sapiens
gcagcctcagggcactcagatg

SEQ ID NO: 7050519 - DNA, 22 bp, Homo sapiens
gcagcctccgcactgcgagtcc

SEQ ID NO: 7050520 - DNA, 22 bp, Homo sapiens
gcagatggcagcccaggctggg

SEQ ID NO: 7050521 - DNA, 23 bp, Homo sapiens
gcagatggccccagagtgctgcc

SEQ ID NO: 7050522 - DNA, 22 bp, Homo sapiens
gcagatggctcagacactgggg

SEQ ID NO: 7050523 - DNA, 21 bp, Homo sapiens
gcagatgggagtcatcaggct

SEQ ID NO: 7050524 - DNA, 22 bp, Homo sapiens
gcagatggtggggcaggaaaat

SEQ ID NO: 7050525 - DNA, 22 bp, Homo sapiens
gcagcccaggagcaggcgaccc

SEQ ID NO: 7050526 - DNA, 22 bp, Homo sapiens
gcagcccaggctcgctcactgc

SEQ ID NO: 7050527 - DNA, 22 bp, Homo sapiens
gcagcccaggtctctctcactc

SEQ ID NO: 7050528 - DNA, 22 bp, Homo sapiens
gcagccccaggagacgcccagg

SEQ ID NO: 7050529 - DNA, 18 bp, Homo sapiens
gcagcccctcttccttcc

SEQ ID NO: 7050530 - DNA, 18 bp, Homo sapiens
gcagcccctcttccttcc

SEQ ID NO: 7050531 - DNA, 22 bp, Homo sapiens
gcagggacaactgtgcacctga

SEQ ID NO: 7050532 - DNA, 22 bp, Homo sapiens
gcagggaagacccggagcagcg

SEQ ID NO: 7050533 - DNA, 22 bp, Homo sapiens
gcagggaagatcttggagctgc

SEQ ID NO: 7050534 - DNA, 22 bp, Homo sapiens
gcagggaagggaaacagagacc

SEQ ID NO: 7050535 - DNA, 22 bp, Homo sapiens
gcagggaagggaaacagagacc

SEQ ID NO: 7050536 - DNA, 22 bp, Homo sapiens
gcaggcagtcatctttcatatt

SEQ ID NO: 7050537 - DNA, 19 bp, Homo sapiens
gcaggcagtggcattcgga

SEQ ID NO: 7050538 - DNA, 22 bp, Homo sapiens
gcaggcagttatttagtagaat

SEQ ID NO: 7050539 - DNA, 22 bp, Homo sapiens
gcagggaagacccggagcagcg

SEQ ID NO: 7050540 - DNA, 22 bp, Homo sapiens
gcaggacacagatgcaaggcca

SEQ ID NO: 7050541 - DNA, 22 bp, Homo sapiens
gcaggacacagatgcaaggcca

SEQ ID NO: 7050542 - DNA, 22 bp, Homo sapiens
gcaggcagaggtggaggagaca

SEQ ID NO: 7050543 - DNA, 22 bp, Homo sapiens
gcaggcagaggtggaggagaca

SEQ ID NO: 7050544 - DNA, 22 bp, Homo sapiens
gcaggcagaggtggaggagaca

SEQ ID NO: 7050545 - DNA, 22 bp, Homo sapiens
gcaggcagagtcaatttgatcc

SEQ ID NO: 7050546 - DNA, 16 bp, Homo sapiens
gcaggcagatcacatg

SEQ ID NO: 7050547 - DNA, 22 bp, Homo sapiens
gcaggcagatcacctgtcagga

SEQ ID NO: 7050548 - DNA, 22 bp, Homo sapiens
gcaggcagatcacctgtcagga

SEQ ID NO: 7050549 - DNA, 22 bp, Homo sapiens
gcaggcagatcacctgtcagga

SEQ ID NO: 7050550 - DNA, 19 bp, Homo sapiens
gcaggcagctggggtatcc

SEQ ID NO: 7050551 - DNA, 22 bp, Homo sapiens
gcaggcaggtggcatcttgtga

SEQ ID NO: 7050552 - DNA, 22 bp, Homo sapiens
gcagggctctgctgtagtccta

SEQ ID NO: 7050553 - DNA, 22 bp, Homo sapiens
gcagggctgaaggtcccaggcc

SEQ ID NO: 7050554 - DNA, 22 bp, Homo sapiens
gcagggctgtaatttgagcctg

SEQ ID NO: 7050555 - DNA, 22 bp, Homo sapiens
gcagggctgggtgggagacaga

SEQ ID NO: 7050556 - DNA, 22 bp, Homo sapiens
gcagggctgggtgggagacaga

SEQ ID NO: 7050557 - DNA, 22 bp, Homo sapiens
gcagggctgggtcctgtctcat

SEQ ID NO: 7050558 - DNA, 22 bp, Homo sapiens
gcagggctgactcagccaccct

SEQ ID NO: 7050559 - DNA, 22 bp, Homo sapiens
gcagggcttagaaatggtggct

SEQ ID NO: 7050560 - DNA, 22 bp, Homo sapiens
gcagggctgttcaggagggtgg

SEQ ID NO: 7050561 - DNA, 22 bp, Homo sapiens
gcagggctgttcaggagggtgg

SEQ ID NO: 7050562 - DNA, 22 bp, Homo sapiens
gcagggcttgcagcagctagac

SEQ ID NO: 7050563 - DNA, 22 bp, Homo sapiens
gcaggggagtccactctatgca

SEQ ID NO: 7050564 - DNA, 22 bp, Homo sapiens
gcagggctttttgaaacatggt

SEQ ID NO: 7050565 - DNA, 22 bp, Homo sapiens
gccagggaggctgtagggtcct

SEQ ID NO: 7050566 - DNA, 22 bp, Homo sapiens
gccagggaacccaagggcctca

SEQ ID NO: 7050567 - DNA, 22 bp, Homo sapiens
gccagggcaggggagcatctgc

SEQ ID NO: 7050568 - DNA, 22 bp, Homo sapiens
gccagggcaggggagcatctgc

SEQ ID NO: 7050569 - DNA, 22 bp, Homo sapiens
gccagggcaggggagcatctgc

SEQ ID NO: 7050570 - DNA, 22 bp, Homo sapiens
gccagggctcgcggtccctcgt

SEQ ID NO: 7050571 - DNA, 22 bp, Homo sapiens
gccagggctcgcggtccctcgt

SEQ ID NO: 7050572 - DNA, 22 bp, Homo sapiens
gccagggctcgcggtccctcgt

SEQ ID NO: 7050573 - DNA, 22 bp, Homo sapiens
gccagggctcgcggtccctcgt

SEQ ID NO: 7050574 - DNA, 22 bp, Homo sapiens
gccagggctgtgcaggtttgtt

SEQ ID NO: 7050575 - DNA, 22 bp, Homo sapiens
gccagggctgtgcaggtttgtt

SEQ ID NO: 7050576 - DNA, 22 bp, Homo sapiens
gccaggcagcagcgaggatggt

SEQ ID NO: 7050577 - DNA, 22 bp, Homo sapiens
gccaggcagctgggagggtgcc

SEQ ID NO: 7050578 - DNA, 22 bp, Homo sapiens
gcagtggcagctgagggggtat

SEQ ID NO: 7050579 - DNA, 22 bp, Homo sapiens
gcagtggcatgatgtgggctca

SEQ ID NO: 7050580 - DNA, 22 bp, Homo sapiens
gcagtggcagctgagggggtat

SEQ ID NO: 7050581 - DNA, 22 bp, Homo sapiens
gcagtggatggccagcaggggc

SEQ ID NO: 7050582 - DNA, 23 bp, Homo sapiens
gcagtggaatgtctctgtttgga

SEQ ID NO: 7050583 - DNA, 17 bp, Homo sapiens
gcagtggaggggtagtt

SEQ ID NO: 7050584 - DNA, 17 bp, Homo sapiens
gcagtggaggggtagtt

SEQ ID NO: 7050585 - DNA, 22 bp, Homo sapiens
gcagtggatccaatggtatctt

SEQ ID NO: 7050586 - DNA, 22 bp, Homo sapiens
gcagtggatggccagcaggggc

SEQ ID NO: 7050587 - DNA, 22 bp, Homo sapiens
gcaggggagtggatgatggatt

SEQ ID NO: 7050588 - DNA, 22 bp, Homo sapiens
gcaggggagtccactctatgca

SEQ ID NO: 7050589 - DNA, 22 bp, Homo sapiens
gcaggggagtggcaggcccgga

SEQ ID NO: 7050590 - DNA, 21 bp, Homo sapiens
gcaggggatagaaatggtctg

SEQ ID NO: 7050591 - DNA, 22 bp, Homo sapiens
gcagtgattggatcagagatgg

SEQ ID NO: 7050592 - DNA, 22 bp, Homo sapiens
gcagtggaagcctctttaagca

SEQ ID NO: 7050593 - DNA, 22 bp, Homo sapiens
gcagtggaagcctctttaagca

SEQ ID NO: 7050594 - DNA, 22 bp, Homo sapiens
gcagtggctaggagtctggcgt

SEQ ID NO: 7050595 - DNA, 22 bp, Homo sapiens
gcagtggcccagcttgcaggct

SEQ ID NO: 7050596 - DNA, 22 bp, Homo sapiens
gcagtggctaagctcgcatgca

SEQ ID NO: 7050597 - DNA, 22 bp, Homo sapiens
gcagtggccacatggaggagga

SEQ ID NO: 7050598 - DNA, 22 bp, Homo sapiens
gcagtggccacatggaggagga

SEQ ID NO: 7050599 - DNA, 22 bp, Homo sapiens
gccacaggcttaggagggaggt

SEQ ID NO: 7050600 - DNA, 22 bp, Homo sapiens
gccacaggcttaggagggaggt

SEQ ID NO: 7050601 - DNA, 22 bp, Homo sapiens
gccacatgcaattgcagcacgt

SEQ ID NO: 7050602 - DNA, 22 bp, Homo sapiens
gccacatgtcatgtgctcagta

SEQ ID NO: 7050603 - DNA, 22 bp, Homo sapiens
gccaccagcagaaaaggggcca

SEQ ID NO: 7050604 - DNA, 22 bp, Homo sapiens
gccaccaggagcccagtccaaa

SEQ ID NO: 7050605 - DNA, 22 bp, Homo sapiens
gccaccagggggctccagtgag

SEQ ID NO: 7050606 - DNA, 22 bp, Homo sapiens
gccaccagggggtgcaaggtcc

SEQ ID NO: 7050607 - DNA, 22 bp, Homo sapiens
gccaccagggggtgcaaggtcc

SEQ ID NO: 7050608 - DNA, 22 bp, Homo sapiens
gccaccagtgggggcctgggca

SEQ ID NO: 7050609 - DNA, 22 bp, Homo sapiens
gccagggtgagggctgagaggt

SEQ ID NO: 7050610 - DNA, 22 bp, Homo sapiens
gccaggggacgcggagcgacga

SEQ ID NO: 7050611 - DNA, 22 bp, Homo sapiens
gcccagctccattcttggtgag

SEQ ID NO: 7050612 - DNA, 22 bp, Homo sapiens
gcccagccctgaggtcacagct

SEQ ID NO: 7050613 - DNA, 22 bp, Homo sapiens
gcccatgggcctgaggccctag

SEQ ID NO: 7050614 - DNA, 22 bp, Homo sapiens
gcccatggcttccctaggcaca

SEQ ID NO: 7050615 - DNA, 22 bp, Homo sapiens
gccctggcctcctggaacaggc

SEQ ID NO: 7050616 - DNA, 22 bp, Homo sapiens
gccctggccttcatctcagaca

SEQ ID NO: 7050617 - DNA, 22 bp, Homo sapiens
gccctgtgccagtcacgctgtg

SEQ ID NO: 7050618 - DNA, 22 bp, Homo sapiens
gccctgtgcgactctagaggtt

SEQ ID NO: 7050619 - DNA, 22 bp, Homo sapiens
gccctgtgcttggatggcagat

SEQ ID NO: 7050620 - DNA, 22 bp, Homo sapiens
gccctgtggacagtgagaagtg

SEQ ID NO: 7050621 - DNA, 22 bp, Homo sapiens
gccctgtggacccaggaactct

SEQ ID NO: 7050622 - DNA, 22 bp, Homo sapiens
gccctgtggacccaggaactct

SEQ ID NO: 7050623 - DNA, 15 bp, Homo sapiens
gccccaggaatcaaa

SEQ ID NO: 7050624 - DNA, 22 bp, Homo sapiens
gccccaggataaatttgtaaga

SEQ ID NO: 7050625 - DNA, 22 bp, Homo sapiens
gccccaggggaggtgccctgca

SEQ ID NO: 7050626 - DNA, 22 bp, Homo sapiens
gccctggagggccagcgactgg

SEQ ID NO: 7050627 - DNA, 22 bp, Homo sapiens
gcctctgggctctgcccctggc

SEQ ID NO: 7050628 - DNA, 22 bp, Homo sapiens
gcctctgggctctgcccctggc

SEQ ID NO: 7050629 - DNA, 22 bp, Homo sapiens
gcctctgggctctgcccctggc

SEQ ID NO: 7050630 - DNA, 22 bp, Homo sapiens
gcctcctggcctttgctcctca

SEQ ID NO: 7050631 - DNA, 22 bp, Homo sapiens
gcctcctggggtgccatcatct

SEQ ID NO: 7050632 - DNA, 22 bp, Homo sapiens
gcctcctggttgcttctccaac

SEQ ID NO: 7050633 - DNA, 22 bp, Homo sapiens
gcctcctgagtagctgggattg

SEQ ID NO: 7050634 - DNA, 22 bp, Homo sapiens
gcctcctgcccagatgagtgat

SEQ ID NO: 7050635 - DNA, 22 bp, Homo sapiens
gcctcctggaagtcacatgttt

SEQ ID NO: 7050636 - DNA, 22 bp, Homo sapiens
gcctcctgaagtgctgggatta

SEQ ID NO: 7050637 - DNA, 22 bp, Homo sapiens
gcctcctaccacaccctcagtc

SEQ ID NO: 7050638 - DNA, 22 bp, Homo sapiens
gccctgtgtgtttgcactgatt

SEQ ID NO: 7050639 - DNA, 22 bp, Homo sapiens
gccctgtggttccaggaagcaa

SEQ ID NO: 7050640 - DNA, 22 bp, Homo sapiens
gccctgtgtatcccctgtgctt

SEQ ID NO: 7050641 - DNA, 22 bp, Homo sapiens
gccctgtgtatcccctgtgctt

SEQ ID NO: 7050642 - DNA, 22 bp, Homo sapiens
gccctgtgtgatcacatgaaca

SEQ ID NO: 7050643 - DNA, 20 bp, Homo sapiens
gaaatcagttaatgatggtt

SEQ ID NO: 7050644 - DNA, 22 bp, Homo sapiens
gaaatatttctcttgagcccct

SEQ ID NO: 7050645 - DNA, 22 bp, Homo sapiens
gaaatatttctcttgagcccct

SEQ ID NO: 7050646 - DNA, 22 bp, Homo sapiens
gaaatatttctcttgagcccct

SEQ ID NO: 7050647 - DNA, 22 bp, Homo sapiens
gaaatatttctcttgagcccct

SEQ ID NO: 7050648 - DNA, 22 bp, Homo sapiens
ctttcattcttagatattagtg

SEQ ID NO: 7050649 - DNA, 22 bp, Homo sapiens
ctttcattcttagatattagtg

SEQ ID NO: 7050650 - DNA, 22 bp, Homo sapiens
ctttccaactctagtgaaattt

SEQ ID NO: 7050651 - DNA, 22 bp, Homo sapiens
ctttcagttacagttacacaca

SEQ ID NO: 7050652 - DNA, 22 bp, Homo sapiens
ctttcacaagatttgagatgct

SEQ ID NO: 7050653 - DNA, 22 bp, Homo sapiens
ctttatgtgctgggcattaagg

SEQ ID NO: 7050654 - DNA, 22 bp, Homo sapiens
ctttcacagtcatatgatgaat

SEQ ID NO: 7050655 - DNA, 22 bp, Homo sapiens
gaacatttggatttgtaaattt

SEQ ID NO: 7050656 - DNA, 17 bp, Homo sapiens
gaacagtgtaagacact

SEQ ID NO: 7050657 - DNA, 20 bp, Homo sapiens
gaacagtcttctgagccaca

SEQ ID NO: 7050658 - DNA, 22 bp, Homo sapiens
gaacagtgccagcacacaataa

SEQ ID NO: 7050659 - DNA, 22 bp, Homo sapiens
gaacagctataatcatctgtcc

SEQ ID NO: 7050660 - DNA, 22 bp, Homo sapiens
gaacagctataatcatctgtcc

SEQ ID NO: 7050661 - DNA, 22 bp, Homo sapiens
gaacagctctgaagcagtaaat

SEQ ID NO: 7050662 - DNA, 22 bp, Homo sapiens
gaacagctgctagagatctgtg

SEQ ID NO: 7050663 - DNA, 22 bp, Homo sapiens
gaacagctgctagagatctgtg

SEQ ID NO: 7050664 - DNA, 22 bp, Homo sapiens
gaacagcttcttgggagctggg

SEQ ID NO: 7050665 - DNA, 22 bp, Homo sapiens
gaacagcttcttgggagctggg

SEQ ID NO: 7050666 - DNA, 22 bp, Homo sapiens
gaacagggtttgagaggcttag

SEQ ID NO: 7050667 - DNA, 22 bp, Homo sapiens
gaaatcatctgagtaataatct

SEQ ID NO: 7050668 - DNA, 22 bp, Homo sapiens
gaaatcattagcaaagatatgt

SEQ ID NO: 7050669 - DNA, 22 bp, Homo sapiens
gaaatgcatggatcttggcaga

SEQ ID NO: 7050670 - DNA, 22 bp, Homo sapiens
gaaatgtaattctcttgaagat

SEQ ID NO: 7050671 - DNA, 20 bp, Homo sapiens
gaaatgtacacattaccaca

SEQ ID NO: 7050672 - DNA, 22 bp, Homo sapiens
gaaatgtactttaaagccatcc

SEQ ID NO: 7050673 - DNA, 22 bp, Homo sapiens
gaacagcagcttcctgggaatt

SEQ ID NO: 7050674 - DNA, 22 bp, Homo sapiens
gaagacatgtttttaatatgta

SEQ ID NO: 7050675 - DNA, 22 bp, Homo sapiens
gaacatttggcatgagaatttg

SEQ ID NO: 7050676 - DNA, 21 bp, Homo sapiens
gaacatttgggttgtttctac

SEQ ID NO: 7050677 - DNA, 21 bp, Homo sapiens
gaacatttgggttgtttctac

SEQ ID NO: 7050678 - DNA, 22 bp, Homo sapiens
gaagaggatgacaggagccggt

SEQ ID NO: 7050679 - DNA, 22 bp, Homo sapiens
gaagaggactgtggcatcctag

SEQ ID NO: 7050680 - DNA, 22 bp, Homo sapiens
gaagaggactgtggcatcctag

SEQ ID NO: 7050681 - DNA, 22 bp, Homo sapiens
gaagaggatgacaggagccggt

SEQ ID NO: 7050682 - DNA, 22 bp, Homo sapiens
gaagaggcaattgaataagcta

SEQ ID NO: 7050683 - DNA, 22 bp, Homo sapiens
gaagaggctttcctagggcaag

SEQ ID NO: 7050684 - DNA, 22 bp, Homo sapiens
gaagaggactgtggcatcctag

SEQ ID NO: 7050685 - DNA, 22 bp, Homo sapiens
gaagagctccaaaaacagtgag

SEQ ID NO: 7050686 - DNA, 22 bp, Homo sapiens
gaagagctccaaaaacagtgag

SEQ ID NO: 7050687 - DNA, 22 bp, Homo sapiens
gaagatttataaggaccttatt

SEQ ID NO: 7050688 - DNA, 22 bp, Homo sapiens
gaagaggctttcctagggcaag

SEQ ID NO: 7050689 - DNA, 22 bp, Homo sapiens
gaagattttctcctttaaatga

SEQ ID NO: 7050690 - DNA, 22 bp, Homo sapiens
gaagatttggattccatgtcac

SEQ ID NO: 7050691 - DNA, 22 bp, Homo sapiens
gaagccagcagtggagaaagga

SEQ ID NO: 7050692 - DNA, 22 bp, Homo sapiens
gaagccagccttgtctgcctct

SEQ ID NO: 7050693 - DNA, 22 bp, Homo sapiens
gaagccaggggcctgacaggca

SEQ ID NO: 7050694 - DNA, 22 bp, Homo sapiens
gaagccagtactgtgctctgca

SEQ ID NO: 7050695 - DNA, 22 bp, Homo sapiens
gaagccagtgtttgaagaattt

SEQ ID NO: 7050696 - DNA, 22 bp, Homo sapiens
gaagcccagcaaactgtgatca

SEQ ID NO: 7050697 - DNA, 22 bp, Homo sapiens
gaatattagtatcagttatacc

SEQ ID NO: 7050698 - DNA, 22 bp, Homo sapiens
gaatatatttctcttaccttta

SEQ ID NO: 7050699 - DNA, 22 bp, Homo sapiens
gaatatatttctcttaccttta

SEQ ID NO: 7050700 - DNA, 22 bp, Homo sapiens
gacaagacacctctctccatcc

SEQ ID NO: 7050701 - DNA, 17 bp, Homo sapiens
gacaagacagaattcat

SEQ ID NO: 7050702 - DNA, 22 bp, Homo sapiens
gacaagacagcttgcagacaac

SEQ ID NO: 7050703 - DNA, 22 bp, Homo sapiens
gacaagacatgtgatgacatca

SEQ ID NO: 7050704 - DNA, 22 bp, Homo sapiens
gacaagacattggtaaagatat

SEQ ID NO: 7050705 - DNA, 22 bp, Homo sapiens
gacaagactatgtagaaagtat

SEQ ID NO: 7050706 - DNA, 22 bp, Homo sapiens
gacaagactggtttatttaagg

SEQ ID NO: 7050707 - DNA, 22 bp, Homo sapiens
gacaagcaggctcctgaagaaa

SEQ ID NO: 7050708 - DNA, 23 bp, Homo sapiens
gaatagttttagaaattggagaa

SEQ ID NO: 7050709 - DNA, 21 bp, Homo sapiens
gaatagttctgtggcagcagt

SEQ ID NO: 7050710 - DNA, 22 bp, Homo sapiens
gaatatattattcagcttttca

SEQ ID NO: 7050711 - DNA, 22 bp, Homo sapiens
gaatatattggtgaaaatagtt

SEQ ID NO: 7050712 - DNA, 22 bp, Homo sapiens
gaatatattggtgaaaatagtt

SEQ ID NO: 7050713 - DNA, 22 bp, Homo sapiens
gaatatattggtgaaaatagtt

SEQ ID NO: 7050714 - DNA, 22 bp, Homo sapiens
gaatatattggtgaaaatagtt

SEQ ID NO: 7050715 - DNA, 22 bp, Homo sapiens
gaatagctgtaggctagtgtct

SEQ ID NO: 7050716 - DNA, 22 bp, Homo sapiens
gaatagcttccttttttccaaa

SEQ ID NO: 7050717 - DNA, 22 bp, Homo sapiens
gaatagttctatggctgcaggg

SEQ ID NO: 7050718 - DNA, 22 bp, Homo sapiens
gaatacattggaaatcagaata

SEQ ID NO: 7050719 - DNA, 22 bp, Homo sapiens
gaatacaccaaggaatcagaat

SEQ ID NO: 7050720 - DNA, 22 bp, Homo sapiens
gaatacaccaaggaatcagaat

SEQ ID NO: 7050721 - DNA, 22 bp, Homo sapiens
gaatacacgaaggcaagagtcc

SEQ ID NO: 7050722 - DNA, 22 bp, Homo sapiens
gaatacacgaatagagcatggt

SEQ ID NO: 7050723 - DNA, 22 bp, Homo sapiens
gaatacacgcacgacacggggg

SEQ ID NO: 7050724 - DNA, 22 bp, Homo sapiens
gaataacagcaagtttgcaggc

SEQ ID NO: 7050725 - DNA, 22 bp, Homo sapiens
gaataacattggaaccctgaag

SEQ ID NO: 7050726 - DNA, 22 bp, Homo sapiens
gaataaactcctcagcttcctt

SEQ ID NO: 7050727 - DNA, 22 bp, Homo sapiens
gaagtttagagtgttgtaattt

SEQ ID NO: 7050728 - DNA, 22 bp, Homo sapiens
gaagtttatttcaatctattca

SEQ ID NO: 7050729 - DNA, 22 bp, Homo sapiens
gaagttcttagtctcatttgca

SEQ ID NO: 7050730 - DNA, 22 bp, Homo sapiens
gaagttgatagagtacatgatt

SEQ ID NO: 7050731 - DNA, 22 bp, Homo sapiens
gaagcttcgtggctcttcaaat

SEQ ID NO: 7050732 - DNA, 22 bp, Homo sapiens
gaaggaaaacagatctgcctga

SEQ ID NO: 7050733 - DNA, 17 bp, Homo sapiens
gacaggctcagtgacga

SEQ ID NO: 7050734 - DNA, 22 bp, Homo sapiens
gacacagaatgggtgctcagta

SEQ ID NO: 7050735 - DNA, 22 bp, Homo sapiens
gacaggggctttgcatgcttta

SEQ ID NO: 7050736 - DNA, 22 bp, Homo sapiens
gacagggacacagccagtgagg

SEQ ID NO: 7050737 - DNA, 22 bp, Homo sapiens
gacagggacgaggcttcaggca

SEQ ID NO: 7050738 - DNA, 22 bp, Homo sapiens
gacagggctgtgggaggagcag

SEQ ID NO: 7050739 - DNA, 21 bp, Homo sapiens
gacaggggaagaagcaaggag

SEQ ID NO: 7050740 - DNA, 22 bp, Homo sapiens
gacaggcttagggagggtgctc

SEQ ID NO: 7050741 - DNA, 22 bp, Homo sapiens
gacaggcttcatcctcagagtt

SEQ ID NO: 7050742 - DNA, 22 bp, Homo sapiens
gacaggcttcatgatggcagga

SEQ ID NO: 7050743 - DNA, 22 bp, Homo sapiens
gacaggcttcctaagtgccaga

SEQ ID NO: 7050744 - DNA, 22 bp, Homo sapiens
gacaggcttcctaagtgccaga

SEQ ID NO: 7050745 - DNA, 22 bp, Homo sapiens
gacagggaaacattgaagtgtc

SEQ ID NO: 7050746 - DNA, 22 bp, Homo sapiens
gaccctgtttctacaaataatt

SEQ ID NO: 7050747 - DNA, 22 bp, Homo sapiens
gaccctggtgggcactggcacc

SEQ ID NO: 7050748 - DNA, 22 bp, Homo sapiens
gacctcagctgtggggatgctg

SEQ ID NO: 7050749 - DNA, 22 bp, Homo sapiens
gacagtcccccagcagcaaacc

SEQ ID NO: 7050750 - DNA, 22 bp, Homo sapiens
gacagggtccaaaggcagggga

SEQ ID NO: 7050751 - DNA, 22 bp, Homo sapiens
gacagggtccaaaggcagggga

SEQ ID NO: 7050752 - DNA, 22 bp, Homo sapiens
gacagggtacgggctaggcaca

SEQ ID NO: 7050753 - DNA, 22 bp, Homo sapiens
gacaggtgaaacagcaaggtaa

SEQ ID NO: 7050754 - DNA, 22 bp, Homo sapiens
gacaggtgagatgaggaacacc

SEQ ID NO: 7050755 - DNA, 21 bp, Homo sapiens
gacaggtgattcagagcaggg

SEQ ID NO: 7050756 - DNA, 22 bp, Homo sapiens
gacaggtgctaagggacctggc

SEQ ID NO: 7050757 - DNA, 22 bp, Homo sapiens
gacaggtggggaaactaaggta

SEQ ID NO: 7050758 - DNA, 22 bp, Homo sapiens
gacaggtgggttctcgtatctg

SEQ ID NO: 7050759 - DNA, 22 bp, Homo sapiens
gagccaggggtcagctccgagg

SEQ ID NO: 7050760 - DNA, 22 bp, Homo sapiens
gagccagggctgtgagctgagc

SEQ ID NO: 7050761 - DNA, 22 bp, Homo sapiens
gagccagaaaagctgcctgact

SEQ ID NO: 7050762 - DNA, 22 bp, Homo sapiens
gagccagattttatgcaagaca

SEQ ID NO: 7050763 - DNA, 22 bp, Homo sapiens
gagccagccgcaagagctgtga

SEQ ID NO: 7050764 - DNA, 16 bp, Homo sapiens
gagcagcctgggcctt

SEQ ID NO: 7050765 - DNA, 22 bp, Homo sapiens
gagcatttttgtctgcatttta

SEQ ID NO: 7050766 - DNA, 22 bp, Homo sapiens
gagccacagtggtggcccacgt

SEQ ID NO: 7050767 - DNA, 22 bp, Homo sapiens
gagccaccttcaactcaggaat

SEQ ID NO: 7050768 - DNA, 18 bp, Homo sapiens
gagcagaggctcaactgg

SEQ ID NO: 7050769 - DNA, 20 bp, Homo sapiens
gagatggacagatgaagggg

SEQ ID NO: 7050770 - DNA, 22 bp, Homo sapiens
gagatggagtctttttctgtca

SEQ ID NO: 7050771 - DNA, 22 bp, Homo sapiens
gagattctaagtcgttggttag

SEQ ID NO: 7050772 - DNA, 22 bp, Homo sapiens
gagattctaatataaggatggg

SEQ ID NO: 7050773 - DNA, 22 bp, Homo sapiens
gagattctatgttgttgattat

SEQ ID NO: 7050774 - DNA, 22 bp, Homo sapiens
gagattctcagaagtactagga

SEQ ID NO: 7050775 - DNA, 23 bp, Homo sapiens
gagattctcctgttgtcaagtct

SEQ ID NO: 7050776 - DNA, 22 bp, Homo sapiens
gagattctcgagggcttccagc

SEQ ID NO: 7050777 - DNA, 22 bp, Homo sapiens
gagattctgagaagttaagtcc

SEQ ID NO: 7050778 - DNA, 22 bp, Homo sapiens
gagattctggttaggtgtattt

SEQ ID NO: 7050779 - DNA, 22 bp, Homo sapiens
gagattctgtagtcaggcatct

SEQ ID NO: 7050780 - DNA, 22 bp, Homo sapiens
gagattctgtgaaacggacatt

SEQ ID NO: 7050781 - DNA, 22 bp, Homo sapiens
gagattctttccagaactttga

SEQ ID NO: 7050782 - DNA, 22 bp, Homo sapiens
gagattgggtcttgctctgtca

SEQ ID NO: 7050783 - DNA, 22 bp, Homo sapiens
gagaaggatgaggaaatggtat

SEQ ID NO: 7050784 - DNA, 22 bp, Homo sapiens
gagaaggatgtggctcatagct

SEQ ID NO: 7050785 - DNA, 22 bp, Homo sapiens
gagaaggagctcaaatatggct

SEQ ID NO: 7050786 - DNA, 22 bp, Homo sapiens
gagaaggaggcgaagcgtgtgc

SEQ ID NO: 7050787 - DNA, 22 bp, Homo sapiens
gacctcttgcaccctggctctt

SEQ ID NO: 7050788 - DNA, 22 bp, Homo sapiens
gagaaggactacacatctggcc

SEQ ID NO: 7050789 - DNA, 22 bp, Homo sapiens
gacctcatgatccacctgcctt

SEQ ID NO: 7050790 - DNA, 22 bp, Homo sapiens
gacctccagcggccctgcagag

SEQ ID NO: 7050791 - DNA, 22 bp, Homo sapiens
gagaaggatgtggctcatagct

SEQ ID NO: 7050792 - DNA, 22 bp, Homo sapiens
gagaaggctgatccttggagtt

SEQ ID NO: 7050793 - DNA, 22 bp, Homo sapiens
gagaaggctggtcttaagtcga

SEQ ID NO: 7050794 - DNA, 22 bp, Homo sapiens
gagaagggggctcgagtgtcct

SEQ ID NO: 7050795 - DNA, 22 bp, Homo sapiens
gagaaggggtgatgtgggtaat

SEQ ID NO: 7050796 - DNA, 22 bp, Homo sapiens
gagaattttctagtagtttcat

SEQ ID NO: 7050797 - DNA, 22 bp, Homo sapiens
gagatgacatgcctgttgtagg

SEQ ID NO: 7050798 - DNA, 22 bp, Homo sapiens
gagatgagtgggggatctctca

SEQ ID NO: 7050799 - DNA, 18 bp, Homo sapiens
gagagggatccctcagga

SEQ ID NO: 7050800 - DNA, 22 bp, Homo sapiens
gagaggcttgtgtgaagaacaa

SEQ ID NO: 7050801 - DNA, 22 bp, Homo sapiens
gagaggcttaagggctgtgaag

SEQ ID NO: 7050802 - DNA, 22 bp, Homo sapiens
gagaggctgtgtgccattgttg

SEQ ID NO: 7050803 - DNA, 22 bp, Homo sapiens
gagaggctggtaaagtctgaac

SEQ ID NO: 7050804 - DNA, 22 bp, Homo sapiens
gagaggctccatgaccccggca

SEQ ID NO: 7050805 - DNA, 22 bp, Homo sapiens
gagaggctcagggacttgctga

SEQ ID NO: 7050806 - DNA, 22 bp, Homo sapiens
gagaggctatgaggttctgtgt

SEQ ID NO: 7050807 - DNA, 22 bp, Homo sapiens
gagaggcctgagaggctgcgga

SEQ ID NO: 7050808 - DNA, 22 bp, Homo sapiens
gagaggccatggggtgggatgc

SEQ ID NO: 7050809 - DNA, 18 bp, Homo sapiens
gagaggcccggctgtgcc

SEQ ID NO: 7050810 - DNA, 22 bp, Homo sapiens
gagaggcatggaacagattctt

SEQ ID NO: 7050811 - DNA, 22 bp, Homo sapiens
gagaggcatggaacagattctt

SEQ ID NO: 7050812 - DNA, 22 bp, Homo sapiens
gagccaggtttgaatctcagtc

SEQ ID NO: 7050813 - DNA, 22 bp, Homo sapiens
gagccctgttcaggcctcctca

SEQ ID NO: 7050814 - DNA, 22 bp, Homo sapiens
gagcctggacatctcaggccca

SEQ ID NO: 7050815 - DNA, 22 bp, Homo sapiens
gagcgggaggaacggctcgggc

SEQ ID NO: 7050816 - DNA, 22 bp, Homo sapiens
gagctaggggtagtcaggagac

SEQ ID NO: 7050817 - DNA, 22 bp, Homo sapiens
gagcttccagagacatcagagt

SEQ ID NO: 7050818 - DNA, 22 bp, Homo sapiens
gagcttccatccttactgtgtg

SEQ ID NO: 7050819 - DNA, 22 bp, Homo sapiens
gagcttccatccttactgtgtg

SEQ ID NO: 7050820 - DNA, 22 bp, Homo sapiens
gagcttccatggacgccatctg

SEQ ID NO: 7050821 - DNA, 22 bp, Homo sapiens
gagcttccctctgcagtccctg

SEQ ID NO: 7050822 - DNA, 22 bp, Homo sapiens
gagcttaaatggctaaatataa

SEQ ID NO: 7050823 - DNA, 22 bp, Homo sapiens
gagcttcctcagcctttctcac

SEQ ID NO: 7050824 - DNA, 22 bp, Homo sapiens
gagcttcctgcaggtcactgtg

SEQ ID NO: 7050825 - DNA, 22 bp, Homo sapiens
gagcttcctttttctgcatgac

SEQ ID NO: 7050826 - DNA, 22 bp, Homo sapiens
gagcttcttgtttcttcatctg

SEQ ID NO: 7050827 - DNA, 22 bp, Homo sapiens
gagcttggaagcagatcctcac

SEQ ID NO: 7050828 - DNA, 22 bp, Homo sapiens
gagctgtgttcatgaggagaaa

SEQ ID NO: 7050829 - DNA, 22 bp, Homo sapiens
gagctgtgttcatgaggagaaa

SEQ ID NO: 7050830 - DNA, 19 bp, Homo sapiens
gagctgagagtagcactgg

SEQ ID NO: 7050831 - DNA, 19 bp, Homo sapiens
gagctgagagtagcactgg

SEQ ID NO: 7050832 - DNA, 22 bp, Homo sapiens
gagctgagaagcagcgcttgat

SEQ ID NO: 7050833 - DNA, 22 bp, Homo sapiens
gagctgagacacactttggcaa

SEQ ID NO: 7050834 - DNA, 22 bp, Homo sapiens
gagctgagacacactttggcaa

SEQ ID NO: 7050835 - DNA, 19 bp, Homo sapiens
gagctgagagtagcactgg

SEQ ID NO: 7050836 - DNA, 18 bp, Homo sapiens
gagctgagaagaggatgc

SEQ ID NO: 7050837 - DNA, 18 bp, Homo sapiens
gagctgagaagaggatgc

SEQ ID NO: 7050838 - DNA, 22 bp, Homo sapiens
gagctcttccccatcttacatc

SEQ ID NO: 7050839 - DNA, 22 bp, Homo sapiens
gagctgaaatatgaagccaatt

SEQ ID NO: 7050840 - DNA, 22 bp, Homo sapiens
gaggccagctagtccaggaagt

SEQ ID NO: 7050841 - DNA, 22 bp, Homo sapiens
gaggccaggacatgaaagctga

SEQ ID NO: 7050842 - DNA, 22 bp, Homo sapiens
gaggccagcgcgcagcactttt

SEQ ID NO: 7050843 - DNA, 22 bp, Homo sapiens
gaggcagaggaaggtggtctct

SEQ ID NO: 7050844 - DNA, 22 bp, Homo sapiens
gaggccagatgtcatgtcttat

SEQ ID NO: 7050845 - DNA, 22 bp, Homo sapiens
gaggcacatcacttggtgcatt

SEQ ID NO: 7050846 - DNA, 22 bp, Homo sapiens
gaggcacatcacttggtgcatt

SEQ ID NO: 7050847 - DNA, 22 bp, Homo sapiens
gaggcaccagacatggcctcat

SEQ ID NO: 7050848 - DNA, 22 bp, Homo sapiens
gaggcaccagccccgctagcct

SEQ ID NO: 7050849 - DNA, 22 bp, Homo sapiens
gaggcacctcgcgggaggaggc

SEQ ID NO: 7050850 - DNA, 22 bp, Homo sapiens
gaggcactctcgacaagggtgg

SEQ ID NO: 7050851 - DNA, 22 bp, Homo sapiens
gaggcactgaatacttgagggt

SEQ ID NO: 7050852 - DNA, 22 bp, Homo sapiens
gaggcactgagagtgggggatg

SEQ ID NO: 7050853 - DNA, 22 bp, Homo sapiens
gaggcactgctgggcccctgta

SEQ ID NO: 7050854 - DNA, 22 bp, Homo sapiens
gaggcagaagttgcagtgagca

SEQ ID NO: 7050855 - DNA, 22 bp, Homo sapiens
gaggcagagaccttcaggacct

SEQ ID NO: 7050856 - DNA, 22 bp, Homo sapiens
gaggcagagactccaccttcag

SEQ ID NO: 7050857 - DNA, 22 bp, Homo sapiens
gaggcagagactccaccttcag

SEQ ID NO: 7050858 - DNA, 22 bp, Homo sapiens
gaggcagaggaaggtggtctct

SEQ ID NO: 7050859 - DNA, 22 bp, Homo sapiens
gaggaggaagttctctgtaggc

SEQ ID NO: 7050860 - DNA, 22 bp, Homo sapiens
gaggaggaagttctctgtaggc

SEQ ID NO: 7050861 - DNA, 19 bp, Homo sapiens
gaggaggaaaactagtgta

SEQ ID NO: 7050862 - DNA, 22 bp, Homo sapiens
gaggaggaagttctctgtaggc

SEQ ID NO: 7050863 - DNA, 22 bp, Homo sapiens
gaggaggaagttctctgtaggc

SEQ ID NO: 7050864 - DNA, 22 bp, Homo sapiens
gaggaggaggaagtggaaccca

SEQ ID NO: 7050865 - DNA, 22 bp, Homo sapiens
gaggaggctaagtgggctctgg

SEQ ID NO: 7050866 - DNA, 22 bp, Homo sapiens
gaggaggctaagtgggctctgg

SEQ ID NO: 7050867 - DNA, 22 bp, Homo sapiens
gaggagcttgaggctaggagcc

SEQ ID NO: 7050868 - DNA, 20 bp, Homo sapiens
gaggaaaagctgccaggcct

SEQ ID NO: 7050869 - DNA, 20 bp, Homo sapiens
gaggaaaagctgccaggcct

SEQ ID NO: 7050870 - DNA, 22 bp, Homo sapiens
gaggaaaataacaactaagggc

SEQ ID NO: 7050871 - DNA, 22 bp, Homo sapiens
gaggaaaataacaactaagggc

SEQ ID NO: 7050872 - DNA, 22 bp, Homo sapiens
gaggaaaatattcagggaggtt

SEQ ID NO: 7050873 - DNA, 22 bp, Homo sapiens
gaggaaaatattcagggaggtt

SEQ ID NO: 7050874 - DNA, 22 bp, Homo sapiens
gaggaaaatgcaacaggaatgc

SEQ ID NO: 7050875 - DNA, 22 bp, Homo sapiens
ctggccctcggagtccagctgc

SEQ ID NO: 7050876 - DNA, 22 bp, Homo sapiens
ctggccctcggagtccagctgc

SEQ ID NO: 7050877 - DNA, 22 bp, Homo sapiens
ctggccctgccagagatcaaca

SEQ ID NO: 7050878 - DNA, 22 bp, Homo sapiens
ctggccctgcctaatgtacttg

SEQ ID NO: 7050879 - DNA, 22 bp, Homo sapiens
ctggccctggagggctgtgcga

SEQ ID NO: 7050880 - DNA, 22 bp, Homo sapiens
ctggccctatgagcctcctgat

SEQ ID NO: 7050881 - DNA, 23 bp, Homo sapiens
ctggccctggctctgtgatcatg

SEQ ID NO: 7050882 - DNA, 22 bp, Homo sapiens
ctggccctgtaggatgtgagtt

SEQ ID NO: 7050883 - DNA, 22 bp, Homo sapiens
ctggccctgtggaggcaggaac

SEQ ID NO: 7050884 - DNA, 22 bp, Homo sapiens
ctggcctgtgggctgtctccgg

SEQ ID NO: 7050885 - DNA, 22 bp, Homo sapiens
ctggctcactagccctgccctg

SEQ ID NO: 7050886 - DNA, 22 bp, Homo sapiens
ctggctcaggaaagttgctgct

SEQ ID NO: 7050887 - DNA, 22 bp, Homo sapiens
ctggctgtgaaatggcagtgtc

SEQ ID NO: 7050888 - DNA, 22 bp, Homo sapiens
ctggctgtgcagtcttccagaa

SEQ ID NO: 7050889 - DNA, 22 bp, Homo sapiens
ctggctgcgctagtccagaaga

SEQ ID NO: 7050890 - DNA, 22 bp, Homo sapiens
ctggctcatagagcagctccaa

SEQ ID NO: 7050891 - DNA, 22 bp, Homo sapiens
ctggctcatccaggtgttgctc

SEQ ID NO: 7050892 - DNA, 23 bp, Homo sapiens
ctggctcatcctggttgcagtgg

SEQ ID NO: 7050893 - DNA, 22 bp, Homo sapiens
ctggctcttgcgactcagcttg

SEQ ID NO: 7050894 - DNA, 22 bp, Homo sapiens
ctggccagctgacagcagggct

SEQ ID NO: 7050895 - DNA, 22 bp, Homo sapiens
ctggcaggcggaggttgcagtg

SEQ ID NO: 7050896 - DNA, 22 bp, Homo sapiens
ctggcaggcagacttctgcaag

SEQ ID NO: 7050897 - DNA, 22 bp, Homo sapiens
ctgccagcagaggccagcgctg

SEQ ID NO: 7050898 - DNA, 22 bp, Homo sapiens
ctgcatccatgttgctgcaaag

SEQ ID NO: 7050899 - DNA, 18 bp, Homo sapiens
ctgccacttaatgtggtg

SEQ ID NO: 7050900 - DNA, 22 bp, Homo sapiens
ctgccactttggagtgctcaga

SEQ ID NO: 7050901 - DNA, 22 bp, Homo sapiens
ctgggaggcaccgcgtcgtgct

SEQ ID NO: 7050902 - DNA, 22 bp, Homo sapiens
ctgggaggattcattgaggtga

SEQ ID NO: 7050903 - DNA, 22 bp, Homo sapiens
ctgggaggcaccgcgtcgtgct

SEQ ID NO: 7050904 - DNA, 22 bp, Homo sapiens
ctgggaggattcattgaggtga

SEQ ID NO: 7050905 - DNA, 22 bp, Homo sapiens
ctgggaagaaattgtgggaggc

SEQ ID NO: 7050906 - DNA, 22 bp, Homo sapiens
ctggctttggtcccctgtgcct

SEQ ID NO: 7050907 - DNA, 22 bp, Homo sapiens
ctggcttttcaaactgttcagt

SEQ ID NO: 7050908 - DNA, 22 bp, Homo sapiens
ctggctgtgctgactgagaggg

SEQ ID NO: 7050909 - DNA, 22 bp, Homo sapiens
ctggctgtgctgcaggctttgg

SEQ ID NO: 7050910 - DNA, 22 bp, Homo sapiens
ctggcttgggtctacctgcctt

SEQ ID NO: 7050911 - DNA, 22 bp, Homo sapiens
ctggcttgttttaagaatacaa

SEQ ID NO: 7050912 - DNA, 22 bp, Homo sapiens
ctggctttacctcactggggct

SEQ ID NO: 7050913 - DNA, 22 bp, Homo sapiens
ctggctttaatgtcatctttct

SEQ ID NO: 7050914 - DNA, 22 bp, Homo sapiens
ctggctttaggttggagagctg

SEQ ID NO: 7050915 - DNA, 22 bp, Homo sapiens
ctggctttcattcattcaggcc

SEQ ID NO: 7050916 - DNA, 22 bp, Homo sapiens
ctggctttccttgtctgcatcc

SEQ ID NO: 7050917 - DNA, 22 bp, Homo sapiens
ctggctttctctgtggtgttca

SEQ ID NO: 7050918 - DNA, 22 bp, Homo sapiens
ctggctttctgaacatcagtga

SEQ ID NO: 7050919 - DNA, 22 bp, Homo sapiens
ctggctttctgcaaatctccat

SEQ ID NO: 7050920 - DNA, 22 bp, Homo sapiens
ctggctttgaggatcccctctt

SEQ ID NO: 7050921 - DNA, 22 bp, Homo sapiens
ctggctttgctggactgggagt

SEQ ID NO: 7050922 - DNA, 22 bp, Homo sapiens
ctgggccactccagatgcccac

SEQ ID NO: 7050923 - DNA, 22 bp, Homo sapiens
ctgggccacatcagatgaagac

SEQ ID NO: 7050924 - DNA, 22 bp, Homo sapiens
ctgggccacatcagatgaagac

SEQ ID NO: 7050925 - DNA, 22 bp, Homo sapiens
ctgggccacaagcctgtgtgat

SEQ ID NO: 7050926 - DNA, 23 bp, Homo sapiens
ctgggcatggagcttcagaggct

SEQ ID NO: 7050927 - DNA, 23 bp, Homo sapiens
ctgggcatggagcttcagaggct

SEQ ID NO: 7050928 - DNA, 22 bp, Homo sapiens
ctgggcatttttctctgttaca

SEQ ID NO: 7050929 - DNA, 22 bp, Homo sapiens
ctgggcatatacgtgcaagtca

SEQ ID NO: 7050930 - DNA, 22 bp, Homo sapiens
ctgggcagtttattcagttctg

SEQ ID NO: 7050931 - DNA, 22 bp, Homo sapiens
ctgggcaggagggctctatgga

SEQ ID NO: 7050932 - DNA, 22 bp, Homo sapiens
ctgggcaggagaggtggttgga

SEQ ID NO: 7050933 - DNA, 22 bp, Homo sapiens
ctgggaggcggagcttgcagtg

SEQ ID NO: 7050934 - DNA, 22 bp, Homo sapiens
ctgggaggcggagcttgcagtg

SEQ ID NO: 7050935 - DNA, 22 bp, Homo sapiens
ctgggaggcggagcttgcagtg

SEQ ID NO: 7050936 - DNA, 22 bp, Homo sapiens
ctgggaggcagtctctctagaa

SEQ ID NO: 7050937 - DNA, 22 bp, Homo sapiens
ctgggaggcagtctctctagaa

SEQ ID NO: 7050938 - DNA, 22 bp, Homo sapiens
ctgggaggcccacgttgggaag

SEQ ID NO: 7050939 - DNA, 22 bp, Homo sapiens
ctgggaggcccacgttgggaag

SEQ ID NO: 7050940 - DNA, 22 bp, Homo sapiens
ctgggaggcagtctctctagaa

SEQ ID NO: 7050941 - DNA, 22 bp, Homo sapiens
ctgggaggcagaggttgtagtg

SEQ ID NO: 7050942 - DNA, 22 bp, Homo sapiens
ctgggaggcagaggttgcagtg

SEQ ID NO: 7050943 - DNA, 22 bp, Homo sapiens
ctgggaggcagaggttgcagtg

SEQ ID NO: 7050944 - DNA, 22 bp, Homo sapiens
ctgggaggcagaggttgtagtg

SEQ ID NO: 7050945 - DNA, 22 bp, Homo sapiens
ctgggaggcactattcaggagg

SEQ ID NO: 7050946 - DNA, 22 bp, Homo sapiens
ctgggaggcactattcaggagg

SEQ ID NO: 7050947 - DNA, 22 bp, Homo sapiens
ctgggaggcagaggttgcagtg

SEQ ID NO: 7050948 - DNA, 22 bp, Homo sapiens
ctgggctgcatcaaagaggcat

SEQ ID NO: 7050949 - DNA, 22 bp, Homo sapiens
ctgggctgcatcaaagaggcat

SEQ ID NO: 7050950 - DNA, 22 bp, Homo sapiens
ctgggctgcaggagtggggcaa

SEQ ID NO: 7050951 - DNA, 22 bp, Homo sapiens
ctgggctgcagcgggagcgacg

SEQ ID NO: 7050952 - DNA, 22 bp, Homo sapiens
ctgggccagatccagcctcaca

SEQ ID NO: 7050953 - DNA, 22 bp, Homo sapiens
ctgggctctaggaaccattcct

SEQ ID NO: 7050954 - DNA, 22 bp, Homo sapiens
ctgggccagaccttgtggtctt

SEQ ID NO: 7050955 - DNA, 19 bp, Homo sapiens
ctgggccagagctgtcctc

SEQ ID NO: 7050956 - DNA, 22 bp, Homo sapiens
ctgggctggagtgcaatggcgc

SEQ ID NO: 7050957 - DNA, 22 bp, Homo sapiens
ctgggctgcttgctgaaggggt

SEQ ID NO: 7050958 - DNA, 20 bp, Homo sapiens
ctggggaggaggatgtgttc

SEQ ID NO: 7050959 - DNA, 22 bp, Homo sapiens
ctgggctgcttgctgaaggggt

SEQ ID NO: 7050960 - DNA, 22 bp, Homo sapiens
ctgggctgctgtccactagggt

SEQ ID NO: 7050961 - DNA, 20 bp, Homo sapiens
ctgggctgcccagctatggg

SEQ ID NO: 7050962 - DNA, 22 bp, Homo sapiens
ctggggcccgagccttgggcca

SEQ ID NO: 7050963 - DNA, 22 bp, Homo sapiens
ctggggccagtgaggaggcttt

SEQ ID NO: 7050964 - DNA, 22 bp, Homo sapiens
ctggggcccatcgagggctgag

SEQ ID NO: 7050965 - DNA, 22 bp, Homo sapiens
ctggggctgcggtggaggagcc

SEQ ID NO: 7050966 - DNA, 22 bp, Homo sapiens
ctggggtgtgctcagagcaggg

SEQ ID NO: 7050967 - DNA, 22 bp, Homo sapiens
ctggggctgcggacgggagccc

SEQ ID NO: 7050968 - DNA, 22 bp, Homo sapiens
ctgggtctggccacaggaagta

SEQ ID NO: 7050969 - DNA, 22 bp, Homo sapiens
ctgggtctggaggccaagggtg

SEQ ID NO: 7050970 - DNA, 22 bp, Homo sapiens
ctgggtctcttaccatgtgact

SEQ ID NO: 7050971 - DNA, 22 bp, Homo sapiens
ctgggtctggtgtcaggcgacg

SEQ ID NO: 7050972 - DNA, 22 bp, Homo sapiens
cttgtctgggcagcttgggagt

SEQ ID NO: 7050973 - DNA, 22 bp, Homo sapiens
cttgtctgtgtcggataaaact

SEQ ID NO: 7050974 - DNA, 21 bp, Homo sapiens
cttgtcttgcttagaatagac

SEQ ID NO: 7050975 - DNA, 22 bp, Homo sapiens
cttgtctttatttcatattcca

SEQ ID NO: 7050976 - DNA, 22 bp, Homo sapiens
cttgtcagccaattgtggattt

SEQ ID NO: 7050977 - DNA, 22 bp, Homo sapiens
cttgtcagccaattgtggattt

SEQ ID NO: 7050978 - DNA, 22 bp, Homo sapiens
cttgtattcccctatctctaaa

SEQ ID NO: 7050979 - DNA, 22 bp, Homo sapiens
cttgggtgctcagggaaagctt

SEQ ID NO: 7050980 - DNA, 22 bp, Homo sapiens
cttgggtgctggaggctgccgc

SEQ ID NO: 7050981 - DNA, 22 bp, Homo sapiens
cttgggtgtgaccttggcattg

SEQ ID NO: 7050982 - DNA, 22 bp, Homo sapiens
cttgtagaattgaaatggtctc

SEQ ID NO: 7050983 - DNA, 22 bp, Homo sapiens
cttgtagaattgaaatggtctc

SEQ ID NO: 7050984 - DNA, 22 bp, Homo sapiens
cttgtatacagtgtacacattg

SEQ ID NO: 7050985 - DNA, 23 bp, Homo sapiens
cttgcaggaagcagatggcacac

SEQ ID NO: 7050986 - DNA, 22 bp, Homo sapiens
cttgcaggcagggacactgtct

SEQ ID NO: 7050987 - DNA, 22 bp, Homo sapiens
cttgcaggcccagccttacaag

SEQ ID NO: 7050988 - DNA, 23 bp, Homo sapiens
cttgcagggctggaggcttagaa

SEQ ID NO: 7050989 - DNA, 22 bp, Homo sapiens
cttgacttcttctagaaataag

SEQ ID NO: 7050990 - DNA, 22 bp, Homo sapiens
cttgatgtataagttgatatgt

SEQ ID NO: 7050991 - DNA, 22 bp, Homo sapiens
cttcctgggtcagcctggaggt

SEQ ID NO: 7050992 - DNA, 22 bp, Homo sapiens
cttgacactgtcactcaggcca

SEQ ID NO: 7050993 - DNA, 22 bp, Homo sapiens
cttcctggctcggtgcctcacc

SEQ ID NO: 7050994 - DNA, 22 bp, Homo sapiens
cttcctgggacacctaactcta

SEQ ID NO: 7050995 - DNA, 22 bp, Homo sapiens
cttcctgcaacacctgtgttgc

SEQ ID NO: 7050996 - DNA, 22 bp, Homo sapiens
cttcctgcatggagtctgaatg

SEQ ID NO: 7050997 - DNA, 22 bp, Homo sapiens
cttcctgcattgtgccagagtt

SEQ ID NO: 7050998 - DNA, 22 bp, Homo sapiens
cttcctgcccacttcctgctgg

SEQ ID NO: 7050999 - DNA, 22 bp, Homo sapiens
cttcagtgaatgttgagtaagg

SEQ ID NO: 7051000 - DNA, 22 bp, Homo sapiens
cttcagtgatataggcttctcc

SEQ ID NO: 7051001 - DNA, 22 bp, Homo sapiens
cttcagcctcatctcagcccgt

SEQ ID NO: 7051002 - DNA, 20 bp, Homo sapiens
cttcaggacccatcctcccc

SEQ ID NO: 7051003 - DNA, 22 bp, Homo sapiens
cttcaggattaatttggggcct

SEQ ID NO: 7051004 - DNA, 22 bp, Homo sapiens
cttccctttttatgtcttcagc

SEQ ID NO: 7051005 - DNA, 22 bp, Homo sapiens
cttccctttttatgtcttcagc

SEQ ID NO: 7051006 - DNA, 22 bp, Homo sapiens
cttccgtgtcagttccaggtgg

SEQ ID NO: 7051007 - DNA, 22 bp, Homo sapiens
cttcctaaaagcttcaagagaa

SEQ ID NO: 7051008 - DNA, 22 bp, Homo sapiens
cttcctctgcctcccgtgctca

SEQ ID NO: 7051009 - DNA, 22 bp, Homo sapiens
cttcctctgcctcccgtgctca

SEQ ID NO: 7051010 - DNA, 22 bp, Homo sapiens
cttcctctgcggcgccgggcgc

SEQ ID NO: 7051011 - DNA, 22 bp, Homo sapiens
cttcctctgtggccagagtgta

SEQ ID NO: 7051012 - DNA, 22 bp, Homo sapiens
cttcctctgtgtcctgggcttc

SEQ ID NO: 7051013 - DNA, 22 bp, Homo sapiens
cttcctctgtgtcctgggcttg

SEQ ID NO: 7051014 - DNA, 16 bp, Homo sapiens
cttcctcttcactggc

SEQ ID NO: 7051015 - DNA, 16 bp, Homo sapiens
cttcctcttcactggc

SEQ ID NO: 7051016 - DNA, 22 bp, Homo sapiens
cttcctgaggtgctgagcacag

SEQ ID NO: 7051017 - DNA, 22 bp, Homo sapiens
cttattttgctgatgacccagg

SEQ ID NO: 7051018 - DNA, 22 bp, Homo sapiens
cttattttgctgatgacccagg

SEQ ID NO: 7051019 - DNA, 22 bp, Homo sapiens
cttattttgctgatgacccagg

SEQ ID NO: 7051020 - DNA, 22 bp, Homo sapiens
cttcagaagaaaagcagtgtgt

SEQ ID NO: 7051021 - DNA, 22 bp, Homo sapiens
cttcagccctgagtgccagcag

SEQ ID NO: 7051022 - DNA, 22 bp, Homo sapiens
cttattttaagtcagtttgggt

SEQ ID NO: 7051023 - DNA, 22 bp, Homo sapiens
cttattttaagtcagtttgggt

SEQ ID NO: 7051024 - DNA, 22 bp, Homo sapiens
cttatttcagccctgggcaccc

SEQ ID NO: 7051025 - DNA, 22 bp, Homo sapiens
cttatttcagccctgggcaccc

SEQ ID NO: 7051026 - DNA, 22 bp, Homo sapiens
cttatttcctgacatggaaaga

SEQ ID NO: 7051027 - DNA, 22 bp, Homo sapiens
cttatttctccatccagagtca

SEQ ID NO: 7051028 - DNA, 22 bp, Homo sapiens
cttatttctccatccagagtca

SEQ ID NO: 7051029 - DNA, 19 bp, Homo sapiens
cttatttctggttttgggt

SEQ ID NO: 7051030 - DNA, 22 bp, Homo sapiens
ctgtttaaccagatctcatatc

SEQ ID NO: 7051031 - DNA, 22 bp, Homo sapiens
cttatattttaggaacagacaa

SEQ ID NO: 7051032 - DNA, 22 bp, Homo sapiens
ctgttctctggcggtggctgtt

SEQ ID NO: 7051033 - DNA, 22 bp, Homo sapiens
ctgtgtctctccttacaagact

SEQ ID NO: 7051034 - DNA, 22 bp, Homo sapiens
ctgtgtctgtggaatagcgaat

SEQ ID NO: 7051035 - DNA, 22 bp, Homo sapiens
ctgtgtcttcaatgtactggga

SEQ ID NO: 7051036 - DNA, 22 bp, Homo sapiens
ctgttaatctgcttgcatgatg

SEQ ID NO: 7051037 - DNA, 22 bp, Homo sapiens
ctgtgtacccacgtgggcaccc

SEQ ID NO: 7051038 - DNA, 22 bp, Homo sapiens
ctgtggctgcagccttggtcct

SEQ ID NO: 7051039 - DNA, 20 bp, Homo sapiens
ctgtggctcatgcatctgcc

SEQ ID NO: 7051040 - DNA, 22 bp, Homo sapiens
ctgggtgagtataggaaaggga

SEQ ID NO: 7051041 - DNA, 22 bp, Homo sapiens
ctgggtgagttgatgaaggaga

SEQ ID NO: 7051042 - DNA, 22 bp, Homo sapiens
ctgggtgagttgatgaaggaga

SEQ ID NO: 7051043 - DNA, 22 bp, Homo sapiens
ctgggtgacagagtgagatggt

SEQ ID NO: 7051044 - DNA, 22 bp, Homo sapiens
ctgggtgattcctgtccaggca

SEQ ID NO: 7051045 - DNA, 22 bp, Homo sapiens
ctgggtctgtgcccagggacct

SEQ ID NO: 7051046 - DNA, 22 bp, Homo sapiens
ctgggtgaatttgaaggaaagg

SEQ ID NO: 7051047 - DNA, 22 bp, Homo sapiens
ctgggtgacagagtgagatggt

SEQ ID NO: 7051048 - DNA, 22 bp, Homo sapiens
ctgtcccttcattattcactac

SEQ ID NO: 7051049 - DNA, 22 bp, Homo sapiens
ctgtcctctgtcctcagcagga

SEQ ID NO: 7051050 - DNA, 22 bp, Homo sapiens
ctgtcctgaaagggagattggg

SEQ ID NO: 7051051 - DNA, 22 bp, Homo sapiens
ctgtcctgaggcaggtggcctg

SEQ ID NO: 7051052 - DNA, 22 bp, Homo sapiens
ctgtcctgagttcttggaggtc

SEQ ID NO: 7051053 - DNA, 22 bp, Homo sapiens
ctgtcctgatggtgccactggt

SEQ ID NO: 7051054 - DNA, 22 bp, Homo sapiens
ctgtcctgatggtgccactggt

SEQ ID NO: 7051055 - DNA, 22 bp, Homo sapiens
ctgtcctgatggtgccactggt

SEQ ID NO: 7051056 - DNA, 22 bp, Homo sapiens
ctgtcctgcagttgggggcagg

SEQ ID NO: 7051057 - DNA, 22 bp, Homo sapiens
ctgtcctgccagtcctggactc

SEQ ID NO: 7051058 - DNA, 22 bp, Homo sapiens
ctgtcctgccagtcctggactc

SEQ ID NO: 7051059 - DNA, 22 bp, Homo sapiens
ctgtcctgcccaccctgcaggg

SEQ ID NO: 7051060 - DNA, 22 bp, Homo sapiens
ctgtcctgcccaccctgcaggg

SEQ ID NO: 7051061 - DNA, 22 bp, Homo sapiens
ctgtcctgcccaccctgcaggg

SEQ ID NO: 7051062 - DNA, 22 bp, Homo sapiens
ctgtcctgcccaccctgcaggg

SEQ ID NO: 7051063 - DNA, 22 bp, Homo sapiens
ctgtcctggccgcccttgtgag

SEQ ID NO: 7051064 - DNA, 22 bp, Homo sapiens
ctgtcctggtgctggggatccc

SEQ ID NO: 7051065 - DNA, 22 bp, Homo sapiens
ctgtcctgtactttgaggccct

SEQ ID NO: 7051066 - DNA, 22 bp, Homo sapiens
ctgtcctgtagctccatcagtc

SEQ ID NO: 7051067 - DNA, 19 bp, Homo sapiens
ctgtgccctatgacttgta

SEQ ID NO: 7051068 - DNA, 22 bp, Homo sapiens
ctgtggccccaccctcttggcc

SEQ ID NO: 7051069 - DNA, 22 bp, Homo sapiens
ctgtgccagtgtattcctgtga

SEQ ID NO: 7051070 - DNA, 22 bp, Homo sapiens
ctgtcctgtagctccatcagtc

SEQ ID NO: 7051071 - DNA, 22 bp, Homo sapiens
ctgtgagggccagagtcagggc

SEQ ID NO: 7051072 - DNA, 22 bp, Homo sapiens
ctgtgagggccagagtcagggc

SEQ ID NO: 7051073 - DNA, 22 bp, Homo sapiens
ctgtgagggtcacagccatgcc

SEQ ID NO: 7051074 - DNA, 22 bp, Homo sapiens
ctgtgagtgaccctggtcagca

SEQ ID NO: 7051075 - DNA, 22 bp, Homo sapiens
ctgtgcagtggcagcgtgtggg

SEQ ID NO: 7051076 - DNA, 22 bp, Homo sapiens
ctgtgcattgtcttgtctgtag

SEQ ID NO: 7051077 - DNA, 22 bp, Homo sapiens
ctctgccatcttggagctcaag

SEQ ID NO: 7051078 - DNA, 21 bp, Homo sapiens
ctctgcccagggcctcctgcc

SEQ ID NO: 7051079 - DNA, 22 bp, Homo sapiens
ctctgcccagtgcccacaggag

SEQ ID NO: 7051080 - DNA, 22 bp, Homo sapiens
ctctgcccgcggatgccacgtc

SEQ ID NO: 7051081 - DNA, 22 bp, Homo sapiens
ctctgcccgtgcctttcccagt

SEQ ID NO: 7051082 - DNA, 22 bp, Homo sapiens
ctctgcctcagtgatttcttta

SEQ ID NO: 7051083 - DNA, 22 bp, Homo sapiens
ctctgcctcagtgatttcttta

SEQ ID NO: 7051084 - DNA, 19 bp, Homo sapiens
ctctgcctccctcctgggt

SEQ ID NO: 7051085 - DNA, 22 bp, Homo sapiens
ctctgcctcccaggttcaagcg

SEQ ID NO: 7051086 - DNA, 19 bp, Homo sapiens
ctctgcctccctcctgggt

SEQ ID NO: 7051087 - DNA, 19 bp, Homo sapiens
ctctgcctccctcctgggt

SEQ ID NO: 7051088 - DNA, 19 bp, Homo sapiens
ctctgcctccctcctgggt

SEQ ID NO: 7051089 - DNA, 19 bp, Homo sapiens
ctctgcctccctcctgggt

SEQ ID NO: 7051090 - DNA, 22 bp, Homo sapiens
tttgcaaagtgcttgcagagta

SEQ ID NO: 7051091 - DNA, 22 bp, Homo sapiens
tttgcaaagttatttagactca

SEQ ID NO: 7051092 - DNA, 22 bp, Homo sapiens
tttgcattttagatttaggcct

SEQ ID NO: 7051093 - DNA, 22 bp, Homo sapiens
ctctggaaaaccactagcagga

SEQ ID NO: 7051094 - DNA, 22 bp, Homo sapiens
ctctgcttttatgtgccggcgc

SEQ ID NO: 7051095 - DNA, 22 bp, Homo sapiens
ctctgcttttatgtgccggcgc

SEQ ID NO: 7051096 - DNA, 22 bp, Homo sapiens
ctctgctttttagggagcctag

SEQ ID NO: 7051097 - DNA, 20 bp, Homo sapiens
ctctgctttaggagagtcag

SEQ ID NO: 7051098 - DNA, 20 bp, Homo sapiens
ctctgctttccacctttcag

SEQ ID NO: 7051099 - DNA, 22 bp, Homo sapiens
ctctgctttctcaaaccctgtg

SEQ ID NO: 7051100 - DNA, 22 bp, Homo sapiens
tttgccttctctgaacctattt

SEQ ID NO: 7051101 - DNA, 21 bp, Homo sapiens
tttgccttcacgaagcatcct

SEQ ID NO: 7051102 - DNA, 22 bp, Homo sapiens
tttgcctctcagagtctacaca

SEQ ID NO: 7051103 - DNA, 22 bp, Homo sapiens
tttggaattggcattctattct

SEQ ID NO: 7051104 - DNA, 22 bp, Homo sapiens
ctctggaatgggtgtttctaac

SEQ ID NO: 7051105 - DNA, 22 bp, Homo sapiens
ctctggaatgtttacatgccct

SEQ ID NO: 7051106 - DNA, 22 bp, Homo sapiens
ctctggaattaaggaagcctgt

SEQ ID NO: 7051107 - DNA, 22 bp, Homo sapiens
tttgggaacttaattatgtctg

SEQ ID NO: 7051108 - DNA, 22 bp, Homo sapiens
tttgggcaattcagtgggacct

SEQ ID NO: 7051109 - DNA, 22 bp, Homo sapiens
ttttagcactaagtgatatgct

SEQ ID NO: 7051110 - DNA, 22 bp, Homo sapiens
ttttagcactaagtgatatgct

SEQ ID NO: 7051111 - DNA, 22 bp, Homo sapiens
ttttagaatcaggttgtctggg

SEQ ID NO: 7051112 - DNA, 22 bp, Homo sapiens
ttttagactccatctgattcag

SEQ ID NO: 7051113 - DNA, 22 bp, Homo sapiens
ttttagacttgtatgtaaagcc

SEQ ID NO: 7051114 - DNA, 22 bp, Homo sapiens
ttttagatagtttaactgcact

SEQ ID NO: 7051115 - DNA, 22 bp, Homo sapiens
ttttagattataagtctaattc

SEQ ID NO: 7051116 - DNA, 22 bp, Homo sapiens
ttttaagttggattgctaagta

SEQ ID NO: 7051117 - DNA, 22 bp, Homo sapiens
ttttaatactgctattgtagga

SEQ ID NO: 7051118 - DNA, 22 bp, Homo sapiens
ttttaatactgctattgtagga

SEQ ID NO: 7051119 - DNA, 22 bp, Homo sapiens
ttttaatactgctattgtagga

SEQ ID NO: 7051120 - DNA, 19 bp, Homo sapiens
ttttaagtgccctttcttc

SEQ ID NO: 7051121 - DNA, 22 bp, Homo sapiens
ttttaagttaatataattgagg

SEQ ID NO: 7051122 - DNA, 22 bp, Homo sapiens
ttttaagttaatataattgagg

SEQ ID NO: 7051123 - DNA, 19 bp, Homo sapiens
ttttaagtcctctctattc

SEQ ID NO: 7051124 - DNA, 22 bp, Homo sapiens
ttttaagatgctagtatttcag

SEQ ID NO: 7051125 - DNA, 22 bp, Homo sapiens
ttttaagatgctagtatttcag

SEQ ID NO: 7051126 - DNA, 22 bp, Homo sapiens
ttttaagaggaggctgtttgaa

SEQ ID NO: 7051127 - DNA, 22 bp, Homo sapiens
ttttaagaactgttctgtgctt

SEQ ID NO: 7051128 - DNA, 22 bp, Homo sapiens
tttgtacatatataaaatctgt

SEQ ID NO: 7051129 - DNA, 22 bp, Homo sapiens
tttgtacatatataaaatctgt

SEQ ID NO: 7051130 - DNA, 22 bp, Homo sapiens
tttgtacacaggtcattcaggg

SEQ ID NO: 7051131 - DNA, 22 bp, Homo sapiens
tttgtacacctacctaatacag

SEQ ID NO: 7051132 - DNA, 22 bp, Homo sapiens
tttgtacacctacctaatacag

SEQ ID NO: 7051133 - DNA, 22 bp, Homo sapiens
tttgtacacctacctaatacag

SEQ ID NO: 7051134 - DNA, 22 bp, Homo sapiens
tttgtacactgtctactatgaa

SEQ ID NO: 7051135 - DNA, 22 bp, Homo sapiens
tttgtacactgtctactatgaa

SEQ ID NO: 7051136 - DNA, 22 bp, Homo sapiens
tttgtacactgtctactatgaa

SEQ ID NO: 7051137 - DNA, 22 bp, Homo sapiens
tttgtacaggtgcaggcatttg

SEQ ID NO: 7051138 - DNA, 22 bp, Homo sapiens
ctcttatagacactcttctata

SEQ ID NO: 7051139 - DNA, 22 bp, Homo sapiens
ctcttcaaaagtctaatcctta

SEQ ID NO: 7051140 - DNA, 20 bp, Homo sapiens
ctcttcaaatattttattct

SEQ ID NO: 7051141 - DNA, 22 bp, Homo sapiens
ttttcagtaatgtctacataat

SEQ ID NO: 7051142 - DNA, 21 bp, Homo sapiens
ctcttgtgtcagagccagagg

SEQ ID NO: 7051143 - DNA, 22 bp, Homo sapiens
ctctttaagctcctaacagcca

SEQ ID NO: 7051144 - DNA, 22 bp, Homo sapiens
ctctttactgctactacaaaga

SEQ ID NO: 7051145 - DNA, 22 bp, Homo sapiens
ctctttctgattcgctgggacc

SEQ ID NO: 7051146 - DNA, 22 bp, Homo sapiens
ctctttgaaatccatcactgct

SEQ ID NO: 7051147 - DNA, 22 bp, Homo sapiens
ctgaatatcatttatcattggc

SEQ ID NO: 7051148 - DNA, 22 bp, Homo sapiens
ctctttcctcagccacagtcta

SEQ ID NO: 7051149 - DNA, 22 bp, Homo sapiens
ctctttcctcagccacagtcta

SEQ ID NO: 7051150 - DNA, 21 bp, Homo sapiens
ctctttatatagtaaagatat

SEQ ID NO: 7051151 - DNA, 22 bp, Homo sapiens
ctgaatccacacaaggtgatgg

SEQ ID NO: 7051152 - DNA, 22 bp, Homo sapiens
ctgacagatacttatgacataa

SEQ ID NO: 7051153 - DNA, 22 bp, Homo sapiens
ctgacagtctcattgatttgct

SEQ ID NO: 7051154 - DNA, 22 bp, Homo sapiens
ctgacatttactgagcacttac

SEQ ID NO: 7051155 - DNA, 22 bp, Homo sapiens
ctgaccctggtcaagttgcctc

SEQ ID NO: 7051156 - DNA, 22 bp, Homo sapiens
ctgaccctttagggtatgttta

SEQ ID NO: 7051157 - DNA, 22 bp, Homo sapiens
ctgactccctccccaaagctgg

SEQ ID NO: 7051158 - DNA, 22 bp, Homo sapiens
ctgactccctgattctgggttt

SEQ ID NO: 7051159 - DNA, 22 bp, Homo sapiens
ctgactccttaccatatgcttt

SEQ ID NO: 7051160 - DNA, 22 bp, Homo sapiens
ctgactgtaattctgttcttaa

SEQ ID NO: 7051161 - DNA, 22 bp, Homo sapiens
ctgagccaaggggacagtgaca

SEQ ID NO: 7051162 - DNA, 22 bp, Homo sapiens
ctgagccagtagtcagggacaa

SEQ ID NO: 7051163 - DNA, 22 bp, Homo sapiens
ctgagccataagggaggctggg

SEQ ID NO: 7051164 - DNA, 22 bp, Homo sapiens
ctgagccatccataccagctta

SEQ ID NO: 7051165 - DNA, 22 bp, Homo sapiens
ctgagccatgagcctgcgccca

SEQ ID NO: 7051166 - DNA, 22 bp, Homo sapiens
ctgagcccattgggtgctgtta

SEQ ID NO: 7051167 - DNA, 22 bp, Homo sapiens
ctgagccccatctgaggtgccc

SEQ ID NO: 7051168 - DNA, 22 bp, Homo sapiens
ctgagccccatctgaggtgccc

SEQ ID NO: 7051169 - DNA, 20 bp, Homo sapiens
ctgagcccccagcctgcagg

SEQ ID NO: 7051170 - DNA, 22 bp, Homo sapiens
ctgagcccctctgacctcagag

SEQ ID NO: 7051171 - DNA, 19 bp, Homo sapiens
ctgagcctcagtttcctag

SEQ ID NO: 7051172 - DNA, 22 bp, Homo sapiens
ctgaggcagagggcagaccaga

SEQ ID NO: 7051173 - DNA, 22 bp, Homo sapiens
ctgcacagagcagggcagacac

SEQ ID NO: 7051174 - DNA, 22 bp, Homo sapiens
ctgaggccggagcactgaagag

SEQ ID NO: 7051175 - DNA, 21 bp, Homo sapiens
ctgcaaatacctagttatctg

SEQ ID NO: 7051176 - DNA, 22 bp, Homo sapiens
ctgcacagctggccagggagag

SEQ ID NO: 7051177 - DNA, 22 bp, Homo sapiens
ctgcacagtggacagtgaagat

SEQ ID NO: 7051178 - DNA, 18 bp, Homo sapiens
ctgaggcccagagagggc

SEQ ID NO: 7051179 - DNA, 22 bp, Homo sapiens
ctgaggccagctgcagagctct

SEQ ID NO: 7051180 - DNA, 22 bp, Homo sapiens
ctgaggccagctgcagagctct

SEQ ID NO: 7051181 - DNA, 18 bp, Homo sapiens
ctgaggcccagagagggc

SEQ ID NO: 7051182 - DNA, 22 bp, Homo sapiens
ctgaggcccctctcttgagctt

SEQ ID NO: 7051183 - DNA, 22 bp, Homo sapiens
ctgaggcccctcttgtgagcat

SEQ ID NO: 7051184 - DNA, 22 bp, Homo sapiens
ctgaggcatgggaagttgggtg

SEQ ID NO: 7051185 - DNA, 22 bp, Homo sapiens
ctgaggcatgttacaggacata

SEQ ID NO: 7051186 - DNA, 22 bp, Homo sapiens
ctgaggcatgttacaggacata

SEQ ID NO: 7051187 - DNA, 22 bp, Homo sapiens
ctgaggcatgttacaggacata

SEQ ID NO: 7051188 - DNA, 22 bp, Homo sapiens
ctgcacagtgttggaagctgcc

SEQ ID NO: 7051189 - DNA, 22 bp, Homo sapiens
ctgcaggggcctcgagcacagg

SEQ ID NO: 7051190 - DNA, 22 bp, Homo sapiens
ctgcagggcagggcctcctggc

SEQ ID NO: 7051191 - DNA, 19 bp, Homo sapiens
ctgcagggatgtgcagagt

SEQ ID NO: 7051192 - DNA, 22 bp, Homo sapiens
ctcccaggccatgctctagcca

SEQ ID NO: 7051193 - DNA, 22 bp, Homo sapiens
tttaacagatgctatgtctacc

SEQ ID NO: 7051194 - DNA, 22 bp, Homo sapiens
ctcccaggcacagggaggagcc

SEQ ID NO: 7051195 - DNA, 22 bp, Homo sapiens
tttaatatccagtggatacaaa

SEQ ID NO: 7051196 - DNA, 22 bp, Homo sapiens
tttaatatccagtggatacaaa

SEQ ID NO: 7051197 - DNA, 22 bp, Homo sapiens
tttaatatctcacacttccatg

SEQ ID NO: 7051198 - DNA, 22 bp, Homo sapiens
tttaatatttctttcctgaagc

SEQ ID NO: 7051199 - DNA, 22 bp, Homo sapiens
ctcccaaggggtaagggagctg

SEQ ID NO: 7051200 - DNA, 22 bp, Homo sapiens
ctcccaaggggtaagggagctg

SEQ ID NO: 7051201 - DNA, 22 bp, Homo sapiens
ctcccactcctggctcaccaca

SEQ ID NO: 7051202 - DNA, 22 bp, Homo sapiens
ctcccactcctggctcaccaca

SEQ ID NO: 7051203 - DNA, 22 bp, Homo sapiens
ctcccagaaaattctcagacaa

SEQ ID NO: 7051204 - DNA, 22 bp, Homo sapiens
ctcccagagaccaagctgagaa

SEQ ID NO: 7051205 - DNA, 22 bp, Homo sapiens
ctcccagacatgtgcctccttg

SEQ ID NO: 7051206 - DNA, 22 bp, Homo sapiens
ctcccagattcctgctgtggga

SEQ ID NO: 7051207 - DNA, 22 bp, Homo sapiens
ctcccagccttcgccagtctga

SEQ ID NO: 7051208 - DNA, 22 bp, Homo sapiens
ttgtggttaaccgcacattttt

SEQ ID NO: 7051209 - DNA, 22 bp, Homo sapiens
ttgtgtaacttgagcaaacaca

SEQ ID NO: 7051210 - DNA, 22 bp, Homo sapiens
ctccatggggaaatgaaggtgg

SEQ ID NO: 7051211 - DNA, 22 bp, Homo sapiens
ttgtgaaaagccgcaagtatag

SEQ ID NO: 7051212 - DNA, 22 bp, Homo sapiens
ttgtgaaaagccgcaagtatag

SEQ ID NO: 7051213 - DNA, 22 bp, Homo sapiens
ttgtgaaatcgtgtttggaagc

SEQ ID NO: 7051214 - DNA, 22 bp, Homo sapiens
ttgtcttaaatggatggacaat

SEQ ID NO: 7051215 - DNA, 22 bp, Homo sapiens
ttgtctttggaaatttaatgtt

SEQ ID NO: 7051216 - DNA, 22 bp, Homo sapiens
ttgtacaacgttttaaatttga

SEQ ID NO: 7051217 - DNA, 22 bp, Homo sapiens
ttgtacaaatgcatattcctgg

SEQ ID NO: 7051218 - DNA, 22 bp, Homo sapiens
ctccagattccgtttattcagg

SEQ ID NO: 7051219 - DNA, 22 bp, Homo sapiens
ttgtaatttgcaaatgtattgt

SEQ ID NO: 7051220 - DNA, 22 bp, Homo sapiens
ttgtacaaagatttcacagctc

SEQ ID NO: 7051221 - DNA, 22 bp, Homo sapiens
ctccaacgaggctggggtacaa

SEQ ID NO: 7051222 - DNA, 22 bp, Homo sapiens
ctccacagcccctccagtggca

SEQ ID NO: 7051223 - DNA, 22 bp, Homo sapiens
ttcttttcccaatattttgctg

SEQ ID NO: 7051224 - DNA, 22 bp, Homo sapiens
ttcttttcctacacagcgattt

SEQ ID NO: 7051225 - DNA, 22 bp, Homo sapiens
ttcttttcctgtggctcatcca

SEQ ID NO: 7051226 - DNA, 23 bp, Homo sapiens
ttgaaaggtagctggcagctaga

SEQ ID NO: 7051227 - DNA, 23 bp, Homo sapiens
ttgaaaggtagctggcagctaga

SEQ ID NO: 7051228 - DNA, 22 bp, Homo sapiens
ttgaaaggtgaacatgatgcac

SEQ ID NO: 7051229 - DNA, 22 bp, Homo sapiens
ttgaaaggtgacattgttagag

SEQ ID NO: 7051230 - DNA, 22 bp, Homo sapiens
ttgaaaggtgctgtgtgctgat

SEQ ID NO: 7051231 - DNA, 22 bp, Homo sapiens
ttcttttacattaagatttcag

SEQ ID NO: 7051232 - DNA, 22 bp, Homo sapiens
ttctttcttagcaatctatggt

SEQ ID NO: 7051233 - DNA, 22 bp, Homo sapiens
ttgaaatactgcattgttcagt

SEQ ID NO: 7051234 - DNA, 22 bp, Homo sapiens
ctcatctgtatatagtgaatga

SEQ ID NO: 7051235 - DNA, 22 bp, Homo sapiens
ctcatctgtctgggctggtttt

SEQ ID NO: 7051236 - DNA, 22 bp, Homo sapiens
ctcatttactcatctgcaaaac

SEQ ID NO: 7051237 - DNA, 22 bp, Homo sapiens
tttatttaccttatgtcctcca

SEQ ID NO: 7051238 - DNA, 22 bp, Homo sapiens
tttattccatgtgtctatgacc

SEQ ID NO: 7051239 - DNA, 22 bp, Homo sapiens
tttattgttgttagtcataagt

SEQ ID NO: 7051240 - DNA, 22 bp, Homo sapiens
tttattgttgttagtcataagt

SEQ ID NO: 7051241 - DNA, 22 bp, Homo sapiens
tttattgttgttagtcataagt

SEQ ID NO: 7051242 - DNA, 22 bp, Homo sapiens
ctcctcccaattgccaagtgct

SEQ ID NO: 7051243 - DNA, 22 bp, Homo sapiens
ctcctccagtgggtccctcagg

SEQ ID NO: 7051244 - DNA, 22 bp, Homo sapiens
ctcctccagtgggtccctcagg

SEQ ID NO: 7051245 - DNA, 18 bp, Homo sapiens
ctcctccacagcccctgc

SEQ ID NO: 7051246 - DNA, 22 bp, Homo sapiens
tttagtgattcatttagaaaaa

SEQ ID NO: 7051247 - DNA, 22 bp, Homo sapiens
tttagtgataagaattatgaaa

SEQ ID NO: 7051248 - DNA, 22 bp, Homo sapiens
tttagtgagtgtgaatcaaatg

SEQ ID NO: 7051249 - DNA, 22 bp, Homo sapiens
tttagtcatagatacccaaggt

SEQ ID NO: 7051250 - DNA, 22 bp, Homo sapiens
tttagtattctctatttccatc

SEQ ID NO: 7051251 - DNA, 22 bp, Homo sapiens
ctcctccacagagtccttgcca

SEQ ID NO: 7051252 - DNA, 18 bp, Homo sapiens
ctcctccacagcccctgc

SEQ ID NO: 7051253 - DNA, 22 bp, Homo sapiens
tttagtaagttcactgcaaagc

SEQ ID NO: 7051254 - DNA, 22 bp, Homo sapiens
tttagtaccatcatttgcctct

SEQ ID NO: 7051255 - DNA, 22 bp, Homo sapiens
tttaggttaatcaacaaacatt

SEQ ID NO: 7051256 - DNA, 22 bp, Homo sapiens
ctccccatggcaacagttatgg

SEQ ID NO: 7051257 - DNA, 22 bp, Homo sapiens
tttaatctattccctaaacacc

SEQ ID NO: 7051258 - DNA, 23 bp, Homo sapiens
ctccccagtgtcctcatgcatct

SEQ ID NO: 7051259 - DNA, 23 bp, Homo sapiens
ctccccagtgtcctcatgcatct

SEQ ID NO: 7051260 - DNA, 22 bp, Homo sapiens
tttagacatggcttgctcactt

SEQ ID NO: 7051261 - DNA, 22 bp, Homo sapiens
tttagacatggcttgctcactt

SEQ ID NO: 7051262 - DNA, 19 bp, Homo sapiens
tttagacattgtctggtat

SEQ ID NO: 7051263 - DNA, 22 bp, Homo sapiens
tttagacatttgtggtttgcaa

SEQ ID NO: 7051264 - DNA, 22 bp, Homo sapiens
tttagactaattcctaaagggc

SEQ ID NO: 7051265 - DNA, 22 bp, Homo sapiens
tttcctacccttccaggcagag

SEQ ID NO: 7051266 - DNA, 20 bp, Homo sapiens
tttcctaagtggtttgctga

SEQ ID NO: 7051267 - DNA, 22 bp, Homo sapiens
tttcctaatcccaatgacattt

SEQ ID NO: 7051268 - DNA, 22 bp, Homo sapiens
tttcctaagggatgcggctcaa

SEQ ID NO: 7051269 - DNA, 22 bp, Homo sapiens
tttcctaaggtagtgataattt

SEQ ID NO: 7051270 - DNA, 22 bp, Homo sapiens
tttcctaaggctcattttaaaa

SEQ ID NO: 7051271 - DNA, 22 bp, Homo sapiens
tttcctaactcatcggatgtac

SEQ ID NO: 7051272 - DNA, 22 bp, Homo sapiens
tttcctaagatagatacttcag

SEQ ID NO: 7051273 - DNA, 22 bp, Homo sapiens
tttcacagtgctctgtaagtat

SEQ ID NO: 7051274 - DNA, 22 bp, Homo sapiens
tttcacataaatattatgccta

SEQ ID NO: 7051275 - DNA, 22 bp, Homo sapiens
tttcacatagaaagtgatttac

SEQ ID NO: 7051276 - DNA, 21 bp, Homo sapiens
tttcacaaaagtatgtgacaa

SEQ ID NO: 7051277 - DNA, 22 bp, Homo sapiens
tttcacaaactgaggagacaat

SEQ ID NO: 7051278 - DNA, 22 bp, Homo sapiens
tttccttgcctcctgtccttct

SEQ ID NO: 7051279 - DNA, 22 bp, Homo sapiens
ctctctgctgtatccttaggct

SEQ ID NO: 7051280 - DNA, 22 bp, Homo sapiens
ctctctctttagaagcgtctgg

SEQ ID NO: 7051281 - DNA, 22 bp, Homo sapiens
ctctctcttgtgttgctgcaga

SEQ ID NO: 7051282 - DNA, 17 bp, Homo sapiens
ctctccttcctctgagg

SEQ ID NO: 7051283 - DNA, 22 bp, Homo sapiens
ctctctctatgcgttgttccta

SEQ ID NO: 7051284 - DNA, 20 bp, Homo sapiens
ctctctctccattcccaggg

SEQ ID NO: 7051285 - DNA, 20 bp, Homo sapiens
ctctctctccattcccaggg

SEQ ID NO: 7051286 - DNA, 22 bp, Homo sapiens
tttcctcaactgtcaaatgggg

SEQ ID NO: 7051287 - DNA, 22 bp, Homo sapiens
tttcctcacacagaagatcttg

SEQ ID NO: 7051288 - DNA, 22 bp, Homo sapiens
tttcctcactcatgtcatcagt

SEQ ID NO: 7051289 - DNA, 22 bp, Homo sapiens
ctctccaggggtagatgccttc

SEQ ID NO: 7051290 - DNA, 22 bp, Homo sapiens
ctctccagtcaggaactctgac

SEQ ID NO: 7051291 - DNA, 22 bp, Homo sapiens
ctctccagtcatattctcagtc

SEQ ID NO: 7051292 - DNA, 22 bp, Homo sapiens
ctctccagtcatattctcagtc

SEQ ID NO: 7051293 - DNA, 22 bp, Homo sapiens
ctctcctggtgtggaggacagg

SEQ ID NO: 7051294 - DNA, 22 bp, Homo sapiens
ttcacacacagcttcctattgt

SEQ ID NO: 7051295 - DNA, 22 bp, Homo sapiens
cgcccaggctggagagcagtgg

SEQ ID NO: 7051296 - DNA, 22 bp, Homo sapiens
cgcccaggctggagtgcagtga

SEQ ID NO: 7051297 - DNA, 22 bp, Homo sapiens
cgcccaggctggagtgcagtgg

SEQ ID NO: 7051298 - DNA, 22 bp, Homo sapiens
cgcccagggcaggaggccgctc

SEQ ID NO: 7051299 - DNA, 22 bp, Homo sapiens
cgccctccacacagcccctggc

SEQ ID NO: 7051300 - DNA, 22 bp, Homo sapiens
ttcaagtctgaagaggactaat

SEQ ID NO: 7051301 - DNA, 22 bp, Homo sapiens
ttcaagtctggagatctggaac

SEQ ID NO: 7051302 - DNA, 22 bp, Homo sapiens
ttcaagtctgcccagagtcagc

SEQ ID NO: 7051303 - DNA, 22 bp, Homo sapiens
ttcaagtctgtttcattgcatg

SEQ ID NO: 7051304 - DNA, 22 bp, Homo sapiens
ttcaagtcttccatggtattct

SEQ ID NO: 7051305 - DNA, 22 bp, Homo sapiens
ttaggaggtctatggacatcct

SEQ ID NO: 7051306 - DNA, 17 bp, Homo sapiens
cctttctctttcatctc

SEQ ID NO: 7051307 - DNA, 22 bp, Homo sapiens
cctttctctttgctgatcatgt

SEQ ID NO: 7051308 - DNA, 22 bp, Homo sapiens
cctttctacagatgcctcttgc

SEQ ID NO: 7051309 - DNA, 22 bp, Homo sapiens
cgcccagctgaaatctccaggc

SEQ ID NO: 7051310 - DNA, 22 bp, Homo sapiens
cgccaggcttggtagctcatgc

SEQ ID NO: 7051311 - DNA, 22 bp, Homo sapiens
cgccaggcttggtagctcatgc

SEQ ID NO: 7051312 - DNA, 22 bp, Homo sapiens
ttaggagtccagatgtcttggg

SEQ ID NO: 7051313 - DNA, 22 bp, Homo sapiens
ttaggagtccagatgtcttggg

SEQ ID NO: 7051314 - DNA, 22 bp, Homo sapiens
ttcagaggttagagcagtggga

SEQ ID NO: 7051315 - DNA, 22 bp, Homo sapiens
ttcagaggtgggctgagaggat

SEQ ID NO: 7051316 - DNA, 22 bp, Homo sapiens
ttcagagggttttagggtcaga

SEQ ID NO: 7051317 - DNA, 22 bp, Homo sapiens
ttcagaggtaagggtctcagaa

SEQ ID NO: 7051318 - DNA, 22 bp, Homo sapiens
ttcagaggtagagaggatcttg

SEQ ID NO: 7051319 - DNA, 20 bp, Homo sapiens
ttcagaggtgaagttgtggt

SEQ ID NO: 7051320 - DNA, 22 bp, Homo sapiens
ttcacagacattgcagactgaa

SEQ ID NO: 7051321 - DNA, 22 bp, Homo sapiens
ttcagaggctgtatgactagat

SEQ ID NO: 7051322 - DNA, 22 bp, Homo sapiens
ttcagagggacattcaagggaa

SEQ ID NO: 7051323 - DNA, 22 bp, Homo sapiens
ttcagcaaacacgatgcttgtt

SEQ ID NO: 7051324 - DNA, 22 bp, Homo sapiens
cggtcaggtgcagcgttggcac

SEQ ID NO: 7051325 - DNA, 22 bp, Homo sapiens
ttcagggagagcgggacgggtg

SEQ ID NO: 7051326 - DNA, 22 bp, Homo sapiens
ttcagggagagcgggacgggtg

SEQ ID NO: 7051327 - DNA, 22 bp, Homo sapiens
ttcatgaaacttaactgttggg

SEQ ID NO: 7051328 - DNA, 22 bp, Homo sapiens
ttcatgaaacttaactgttggg

SEQ ID NO: 7051329 - DNA, 22 bp, Homo sapiens
cgtatttcatctcctttctgct

SEQ ID NO: 7051330 - DNA, 22 bp, Homo sapiens
cgtcactggcgtgaagtgagga

SEQ ID NO: 7051331 - DNA, 22 bp, Homo sapiens
ttcatccatatgcagagagctt

SEQ ID NO: 7051332 - DNA, 19 bp, Homo sapiens
cgtacctgacacagaacag

SEQ ID NO: 7051333 - DNA, 22 bp, Homo sapiens
ctaaataatccctctggtctta

SEQ ID NO: 7051334 - DNA, 22 bp, Homo sapiens
ttcatgaatatattgaattagc

SEQ ID NO: 7051335 - DNA, 22 bp, Homo sapiens
ttcatgaaattctcgtgtacct

SEQ ID NO: 7051336 - DNA, 22 bp, Homo sapiens
ttcatgaatgttccatgtgagt

SEQ ID NO: 7051337 - DNA, 22 bp, Homo sapiens
ctattaaatactcttcaaattg

SEQ ID NO: 7051338 - DNA, 22 bp, Homo sapiens
ctattacaatctgctactatga

SEQ ID NO: 7051339 - DNA, 22 bp, Homo sapiens
ctattaaacactactgtgcact

SEQ ID NO: 7051340 - DNA, 22 bp, Homo sapiens
ctattaaatactcttcaaattg

SEQ ID NO: 7051341 - DNA, 22 bp, Homo sapiens
ctatatatatcatcttccagtt

SEQ ID NO: 7051342 - DNA, 23 bp, Homo sapiens
ctatggaataccaatgattctca

SEQ ID NO: 7051343 - DNA, 22 bp, Homo sapiens
ctatggtgatagaaatcagaat

SEQ ID NO: 7051344 - DNA, 22 bp, Homo sapiens
ctagcacagtatggtatcagat

SEQ ID NO: 7051345 - DNA, 22 bp, Homo sapiens
ttctctggccatagctggctag

SEQ ID NO: 7051346 - DNA, 22 bp, Homo sapiens
ttctctggcctgaggcgaggcc

SEQ ID NO: 7051347 - DNA, 22 bp, Homo sapiens
ttctctggcgcgctgtgctatg

SEQ ID NO: 7051348 - DNA, 22 bp, Homo sapiens
ctattagaaagcatcttctata

SEQ ID NO: 7051349 - DNA, 22 bp, Homo sapiens
ctattagaaagcatcttctata

SEQ ID NO: 7051350 - DNA, 22 bp, Homo sapiens
ctattagacacaattagtgatt

SEQ ID NO: 7051351 - DNA, 22 bp, Homo sapiens
ctattatttcctcatctataaa

SEQ ID NO: 7051352 - DNA, 22 bp, Homo sapiens
ctcaagtcagaaataaaagcat

SEQ ID NO: 7051353 - DNA, 22 bp, Homo sapiens
ctcaagtccatagaatcaggaa

SEQ ID NO: 7051354 - DNA, 22 bp, Homo sapiens
ctcaagtcccgcagtgttcctc

SEQ ID NO: 7051355 - DNA, 22 bp, Homo sapiens
ctcaagtctattgataagtgca

SEQ ID NO: 7051356 - DNA, 22 bp, Homo sapiens
ctcaagtctgagtactggctct

SEQ ID NO: 7051357 - DNA, 22 bp, Homo sapiens
ctcaagtctgatgggttaggtt

SEQ ID NO: 7051358 - DNA, 22 bp, Homo sapiens
ctcacacacgaagcccttggcc

SEQ ID NO: 7051359 - DNA, 22 bp, Homo sapiens
ttcctggctgtcatgccctagt

SEQ ID NO: 7051360 - DNA, 22 bp, Homo sapiens
ttcctggctcacagcagtgggg

SEQ ID NO: 7051361 - DNA, 20 bp, Homo sapiens
ttcctggctctaggaccttg

SEQ ID NO: 7051362 - DNA, 22 bp, Homo sapiens
ttcctgggcaggacgagagtct

SEQ ID NO: 7051363 - DNA, 22 bp, Homo sapiens
ctacaggctcagggagccctct

SEQ ID NO: 7051364 - DNA, 22 bp, Homo sapiens
ctacagagtgaatgcagaaaat

SEQ ID NO: 7051365 - DNA, 22 bp, Homo sapiens
ctacagctgtgtgtttatgtgc

SEQ ID NO: 7051366 - DNA, 22 bp, Homo sapiens
ctacagctgtaaaaggaatgtc

SEQ ID NO: 7051367 - DNA, 22 bp, Homo sapiens
ctacaggaaggatcttgctcaa

SEQ ID NO: 7051368 - DNA, 22 bp, Homo sapiens
ctacagagaactcagctgccct

SEQ ID NO: 7051369 - DNA, 22 bp, Homo sapiens
ctacagagtatctaaagaggta

SEQ ID NO: 7051370 - DNA, 22 bp, Homo sapiens
ttccaggacttcatggctctga

SEQ ID NO: 7051371 - DNA, 22 bp, Homo sapiens
ctaaatgatattttggtttcct

SEQ ID NO: 7051372 - DNA, 22 bp, Homo sapiens
ctaaatgacaggtaccatagtg

SEQ ID NO: 7051373 - DNA, 22 bp, Homo sapiens
ctaaatgacttccagtggttat

SEQ ID NO: 7051374 - DNA, 22 bp, Homo sapiens
ctaccttcaagttcctccctct

SEQ ID NO: 7051375 - DNA, 22 bp, Homo sapiens
ctacccttaagtttctgtgggg

SEQ ID NO: 7051376 - DNA, 21 bp, Homo sapiens
ctaccctcactcccattcctc

SEQ ID NO: 7051377 - DNA, 22 bp, Homo sapiens
ttcctgggctgcagagagcacc

SEQ ID NO: 7051378 - DNA, 22 bp, Homo sapiens
ttcctgggctctggctggccta

SEQ ID NO: 7051379 - DNA, 22 bp, Homo sapiens
ttcctgggctgcagagagcacc

SEQ ID NO: 7051380 - DNA, 22 bp, Homo sapiens
ttcctgggctttcccctctggt

SEQ ID NO: 7051381 - DNA, 22 bp, Homo sapiens
ctaccttcaagttcctccctct

SEQ ID NO: 7051382 - DNA, 22 bp, Homo sapiens
ctactagatcagtatgcctcaa

SEQ ID NO: 7051383 - DNA, 22 bp, Homo sapiens
ctactgccattgtctctgccat

SEQ ID NO: 7051384 - DNA, 22 bp, Homo sapiens
ttctctggagagtatcttctta

SEQ ID NO: 7051385 - DNA, 22 bp, Homo sapiens
ttctctggatgtttctcagtca

SEQ ID NO: 7051386 - DNA, 21 bp, Homo sapiens
ctacttaagtaggggattagg

SEQ ID NO: 7051387 - DNA, 22 bp, Homo sapiens
ctacttctaagtacatggtgat

SEQ ID NO: 7051388 - DNA, 22 bp, Homo sapiens
ctacttctgtgatgaaactaca

SEQ ID NO: 7051389 - DNA, 22 bp, Homo sapiens
ctacttgttcactgtaggtcgc

SEQ ID NO: 7051390 - DNA, 22 bp, Homo sapiens
ttaaagtaatctgtgtgaattt

SEQ ID NO: 7051391 - DNA, 22 bp, Homo sapiens
ttaaagtatagaggacaaaaac

SEQ ID NO: 7051392 - DNA, 19 bp, Homo sapiens
ttaaagtgcgagaagtctt

SEQ ID NO: 7051393 - DNA, 22 bp, Homo sapiens
cctgtgtcaccggaacggagga

SEQ ID NO: 7051394 - DNA, 19 bp, Homo sapiens
cctgtgtcccacgtagatg

SEQ ID NO: 7051395 - DNA, 21 bp, Homo sapiens
ttaaagctatggtagtgggct

SEQ ID NO: 7051396 - DNA, 22 bp, Homo sapiens
ttaaagctgagccctcagaagc

SEQ ID NO: 7051397 - DNA, 22 bp, Homo sapiens
ttaaagctggcgttacagtttg

SEQ ID NO: 7051398 - DNA, 22 bp, Homo sapiens
cctgtgccatcctgagcatccc

SEQ ID NO: 7051399 - DNA, 19 bp, Homo sapiens
cctgtgctaggagctgacc

SEQ ID NO: 7051400 - DNA, 22 bp, Homo sapiens
tgtttataaattttcttgccat

SEQ ID NO: 7051401 - DNA, 22 bp, Homo sapiens
cctgtctctgttaccacatttg

SEQ ID NO: 7051402 - DNA, 22 bp, Homo sapiens
cctgtctctgttaccacatttg

SEQ ID NO: 7051403 - DNA, 22 bp, Homo sapiens
cctgtctgcagatatctcaggt

SEQ ID NO: 7051404 - DNA, 22 bp, Homo sapiens
cctgtctgcatgatccctgcca

SEQ ID NO: 7051405 - DNA, 22 bp, Homo sapiens
cctgtctgcatgatccctgcca

SEQ ID NO: 7051406 - DNA, 22 bp, Homo sapiens
cctgtctggccttccacggggg

SEQ ID NO: 7051407 - DNA, 18 bp, Homo sapiens
cctgtctggggtccccac

SEQ ID NO: 7051408 - DNA, 18 bp, Homo sapiens
cctgtctggggtccccac

SEQ ID NO: 7051409 - DNA, 22 bp, Homo sapiens
cctgtctgtcctctcatgagcc

SEQ ID NO: 7051410 - DNA, 22 bp, Homo sapiens
cctgtctgtcctttgcattctt

SEQ ID NO: 7051411 - DNA, 19 bp, Homo sapiens
cctgtctgtcttcagctag

SEQ ID NO: 7051412 - DNA, 19 bp, Homo sapiens
cctgtctgtcttcagctag

SEQ ID NO: 7051413 - DNA, 22 bp, Homo sapiens
cctgtctgtttgcccattcttg

SEQ ID NO: 7051414 - DNA, 23 bp, Homo sapiens
ttacttttgcaccaacctaatat

SEQ ID NO: 7051415 - DNA, 22 bp, Homo sapiens
ccttctcagccccagctcccgc

SEQ ID NO: 7051416 - DNA, 22 bp, Homo sapiens
ttagaatcaggtgttataatca

SEQ ID NO: 7051417 - DNA, 22 bp, Homo sapiens
ttagaatctaacattcttatct

SEQ ID NO: 7051418 - DNA, 22 bp, Homo sapiens
ttagacagagctccttgagggc

SEQ ID NO: 7051419 - DNA, 22 bp, Homo sapiens
cctgtgtccttggcagatatcc

SEQ ID NO: 7051420 - DNA, 22 bp, Homo sapiens
cctgtgtctgaccatgcacatg

SEQ ID NO: 7051421 - DNA, 23 bp, Homo sapiens
cctgtgtctgttgctgaataatg

SEQ ID NO: 7051422 - DNA, 22 bp, Homo sapiens
ccttcccaggctagaccaacat

SEQ ID NO: 7051423 - DNA, 19 bp, Homo sapiens
ccttccccttcagcctctg

SEQ ID NO: 7051424 - DNA, 22 bp, Homo sapiens
ccttcctcatccatttctcttg

SEQ ID NO: 7051425 - DNA, 17 bp, Homo sapiens
ccttcctcatctccttc

SEQ ID NO: 7051426 - DNA, 17 bp, Homo sapiens
ccttcctcatctccttc

SEQ ID NO: 7051427 - DNA, 17 bp, Homo sapiens
ccttcctcatctccttc

SEQ ID NO: 7051428 - DNA, 22 bp, Homo sapiens
ccttcctggagcccatgcagat

SEQ ID NO: 7051429 - DNA, 22 bp, Homo sapiens
ccttcctggctgtccgcctgat

SEQ ID NO: 7051430 - DNA, 22 bp, Homo sapiens
tgtgtctgaacatgctttgtaa

SEQ ID NO: 7051431 - DNA, 22 bp, Homo sapiens
tgtgtctgaactagttgctctc

SEQ ID NO: 7051432 - DNA, 23 bp, Homo sapiens
tgtgtctgaggatatatgtgcat

SEQ ID NO: 7051433 - DNA, 22 bp, Homo sapiens
tgtgtctgcactgagtcctcac

SEQ ID NO: 7051434 - DNA, 22 bp, Homo sapiens
cctgggcaatatagtgaggccc

SEQ ID NO: 7051435 - DNA, 22 bp, Homo sapiens
cctgggcaatatagtgaggccc

SEQ ID NO: 7051436 - DNA, 22 bp, Homo sapiens
cctgggcaacatagtgagacct

SEQ ID NO: 7051437 - DNA, 22 bp, Homo sapiens
cctgggcaacatagtgagacct

SEQ ID NO: 7051438 - DNA, 22 bp, Homo sapiens
cctgggcaacatagtgagacct

SEQ ID NO: 7051439 - DNA, 22 bp, Homo sapiens
cctgggcaacatagtgagaccc

SEQ ID NO: 7051440 - DNA, 22 bp, Homo sapiens
cctgggcaacatagggagaccc

SEQ ID NO: 7051441 - DNA, 22 bp, Homo sapiens
cctgggcaacatagtgagaccc

SEQ ID NO: 7051442 - DNA, 22 bp, Homo sapiens
cctgggcaacatagtgagaccc

SEQ ID NO: 7051443 - DNA, 22 bp, Homo sapiens
cctgggcaacatagggagaccc

SEQ ID NO: 7051444 - DNA, 22 bp, Homo sapiens
cctgggcaacatagggagaccc

SEQ ID NO: 7051445 - DNA, 22 bp, Homo sapiens
cctgggcaaattatgttactca

SEQ ID NO: 7051446 - DNA, 22 bp, Homo sapiens
cctgggcaaatgccagagacaa

SEQ ID NO: 7051447 - DNA, 22 bp, Homo sapiens
cctgggatttcctgagcactct

SEQ ID NO: 7051448 - DNA, 22 bp, Homo sapiens
cctgggatttcctgagcactct

SEQ ID NO: 7051449 - DNA, 22 bp, Homo sapiens
cctgggatttgcgccagacctt

SEQ ID NO: 7051450 - DNA, 22 bp, Homo sapiens
cctgggatttgcgccagacctt

SEQ ID NO: 7051451 - DNA, 19 bp, Homo sapiens
tggggctgtgttttgaccc

SEQ ID NO: 7051452 - DNA, 22 bp, Homo sapiens
tggggccacacatctctttcta

SEQ ID NO: 7051453 - DNA, 22 bp, Homo sapiens
tggggcagctccatctattcca

SEQ ID NO: 7051454 - DNA, 21 bp, Homo sapiens
tgggggagaattggttgcttt

SEQ ID NO: 7051455 - DNA, 22 bp, Homo sapiens
tgggggaactgttgcgcgcggg

SEQ ID NO: 7051456 - DNA, 22 bp, Homo sapiens
tgggggaagagcttgttaaagt

SEQ ID NO: 7051457 - DNA, 22 bp, Homo sapiens
cctgggagtggcactcacagca

SEQ ID NO: 7051458 - DNA, 22 bp, Homo sapiens
cctgggagtgtgccatctctgt

SEQ ID NO: 7051459 - DNA, 22 bp, Homo sapiens
cctgggagtgtgccatctctgt

SEQ ID NO: 7051460 - DNA, 22 bp, Homo sapiens
cctgggagtgtgccatctctgt

SEQ ID NO: 7051461 - DNA, 22 bp, Homo sapiens
cctgggctggagtacagcagtg

SEQ ID NO: 7051462 - DNA, 22 bp, Homo sapiens
cctgggctggagtacagcagtg

SEQ ID NO: 7051463 - DNA, 22 bp, Homo sapiens
cctgggctgctcatggggatga

SEQ ID NO: 7051464 - DNA, 22 bp, Homo sapiens
cctgggctgcatgatggcattt

SEQ ID NO: 7051465 - DNA, 22 bp, Homo sapiens
cctgggctctgaggagggagtc

SEQ ID NO: 7051466 - DNA, 22 bp, Homo sapiens
cctgggctctgaggagggagtc

SEQ ID NO: 7051467 - DNA, 22 bp, Homo sapiens
tgtgtctggataggtaatggat

SEQ ID NO: 7051468 - DNA, 22 bp, Homo sapiens
tgtgtctgcccttagtacatct

SEQ ID NO: 7051469 - DNA, 22 bp, Homo sapiens
tgtgtctggaccggggaggagc

SEQ ID NO: 7051470 - DNA, 22 bp, Homo sapiens
cctgggctgggcgtctcatggg

SEQ ID NO: 7051471 - DNA, 22 bp, Homo sapiens
tgttcatttggcccttttgtat

SEQ ID NO: 7051472 - DNA, 22 bp, Homo sapiens
cctgggtgtcatgggcagctgg

SEQ ID NO: 7051473 - DNA, 22 bp, Homo sapiens
cccaggctggagtgcaatggtg

SEQ ID NO: 7051474 - DNA, 22 bp, Homo sapiens
cccaggctggagtgcagtggcg

SEQ ID NO: 7051475 - DNA, 22 bp, Homo sapiens
cccaggctggagtgcaatggca

SEQ ID NO: 7051476 - DNA, 22 bp, Homo sapiens
tgccctggtgaagtgctctcct

SEQ ID NO: 7051477 - DNA, 22 bp, Homo sapiens
tgccctggtgaagtgctctcct

SEQ ID NO: 7051478 - DNA, 22 bp, Homo sapiens
cccaggctgagttagaggtgtc

SEQ ID NO: 7051479 - DNA, 22 bp, Homo sapiens
cccaggctggaattccaggcct

SEQ ID NO: 7051480 - DNA, 22 bp, Homo sapiens
cccaggctggagggcagtgtca

SEQ ID NO: 7051481 - DNA, 22 bp, Homo sapiens
cccaggctggatttcggtggca

SEQ ID NO: 7051482 - DNA, 22 bp, Homo sapiens
cccaggctggcctccgcagtgc

SEQ ID NO: 7051483 - DNA, 21 bp, Homo sapiens
cccagggaagccgcagtcacc

SEQ ID NO: 7051484 - DNA, 21 bp, Homo sapiens
cccagggaagccgcagtcacc

SEQ ID NO: 7051485 - DNA, 22 bp, Homo sapiens
cccagggaaggcagatggagga

SEQ ID NO: 7051486 - DNA, 22 bp, Homo sapiens
cccagggaagggctacctgagg

SEQ ID NO: 7051487 - DNA, 22 bp, Homo sapiens
cccagggaatgactctggcctt

SEQ ID NO: 7051488 - DNA, 23 bp, Homo sapiens
cccagggacacgatgacacctcc

SEQ ID NO: 7051489 - DNA, 22 bp, Homo sapiens
cccagggacagatgggcagcta

SEQ ID NO: 7051490 - DNA, 22 bp, Homo sapiens
cccagggacagatgggcagcta

SEQ ID NO: 7051491 - DNA, 22 bp, Homo sapiens
cccagggacagatgggcagcta

SEQ ID NO: 7051492 - DNA, 22 bp, Homo sapiens
cccagggacagctaggtggggc

SEQ ID NO: 7051493 - DNA, 17 bp, Homo sapiens
cccagggaccactgctt

SEQ ID NO: 7051494 - DNA, 17 bp, Homo sapiens
cccagggaccactgctt

SEQ ID NO: 7051495 - DNA, 17 bp, Homo sapiens
cccagggaccactgctt

SEQ ID NO: 7051496 - DNA, 22 bp, Homo sapiens
tgcctgtgttgattactttgtc

SEQ ID NO: 7051497 - DNA, 22 bp, Homo sapiens
tgcctgttattgttggcttagt

SEQ ID NO: 7051498 - DNA, 22 bp, Homo sapiens
cccagggattataaaggtgaaa

SEQ ID NO: 7051499 - DNA, 22 bp, Homo sapiens
cccagggccctggacagctaca

SEQ ID NO: 7051500 - DNA, 22 bp, Homo sapiens
cccaggggttcaaggctgcagt

SEQ ID NO: 7051501 - DNA, 22 bp, Homo sapiens
cccagggtagctgagctggcag

SEQ ID NO: 7051502 - DNA, 22 bp, Homo sapiens
cccagggtagctgagctggcag

SEQ ID NO: 7051503 - DNA, 22 bp, Homo sapiens
cccagggtccctgctctctgtg

SEQ ID NO: 7051504 - DNA, 22 bp, Homo sapiens
cccagggtccctgctctctgtg

SEQ ID NO: 7051505 - DNA, 22 bp, Homo sapiens
cccagggtccggataaccctgg

SEQ ID NO: 7051506 - DNA, 22 bp, Homo sapiens
cccagggttgcctgcctctgct

SEQ ID NO: 7051507 - DNA, 19 bp, Homo sapiens
cccagggtttcctctctcc

SEQ ID NO: 7051508 - DNA, 22 bp, Homo sapiens
tgccaggctaagtggaggactt

SEQ ID NO: 7051509 - DNA, 22 bp, Homo sapiens
tgccagtgggtgtgcagagact

SEQ ID NO: 7051510 - DNA, 22 bp, Homo sapiens
cccaggagagaggggataaagc

SEQ ID NO: 7051511 - DNA, 22 bp, Homo sapiens
cccaggagagaggccagttggc

SEQ ID NO: 7051512 - DNA, 22 bp, Homo sapiens
cccaggagacctgtgaaaggac

SEQ ID NO: 7051513 - DNA, 22 bp, Homo sapiens
cccaggagacctagatctgttt

SEQ ID NO: 7051514 - DNA, 22 bp, Homo sapiens
cccaggagacatatagaaggac

SEQ ID NO: 7051515 - DNA, 22 bp, Homo sapiens
tgccagcttttgactatcttag

SEQ ID NO: 7051516 - DNA, 21 bp, Homo sapiens
tgccagctgctgcatctgtct

SEQ ID NO: 7051517 - DNA, 22 bp, Homo sapiens
tgccagctcccttttctcctcc

SEQ ID NO: 7051518 - DNA, 22 bp, Homo sapiens
tgccagctccgaggagctgcag

SEQ ID NO: 7051519 - DNA, 21 bp, Homo sapiens
tgccctggggctcttccctca

SEQ ID NO: 7051520 - DNA, 22 bp, Homo sapiens
tgccctggggtctggagcagca

SEQ ID NO: 7051521 - DNA, 22 bp, Homo sapiens
tgccctggggagcccagccagg

SEQ ID NO: 7051522 - DNA, 22 bp, Homo sapiens
tgccctggggagcccagccagg

SEQ ID NO: 7051523 - DNA, 22 bp, Homo sapiens
tgccctggggagcccagccagg

SEQ ID NO: 7051524 - DNA, 22 bp, Homo sapiens
tgccctgggagttggagctgct

SEQ ID NO: 7051525 - DNA, 22 bp, Homo sapiens
cccaggctcccaggtgggacaa

SEQ ID NO: 7051526 - DNA, 22 bp, Homo sapiens
cccaggctcactgtccgcttcc

SEQ ID NO: 7051527 - DNA, 22 bp, Homo sapiens
cccaggctcagactggcttgtt

SEQ ID NO: 7051528 - DNA, 23 bp, Homo sapiens
cccaggctacaaattatgctctg

SEQ ID NO: 7051529 - DNA, 22 bp, Homo sapiens
tgcccagctgtcaaagtagata

SEQ ID NO: 7051530 - DNA, 22 bp, Homo sapiens
tgccatattgatgtgctgtacc

SEQ ID NO: 7051531 - DNA, 22 bp, Homo sapiens
tgccatattattgagcatatta

SEQ ID NO: 7051532 - DNA, 22 bp, Homo sapiens
tgccagtgtggaactaggaaga

SEQ ID NO: 7051533 - DNA, 23 bp, Homo sapiens
cccattttcatgttaactcctgg

SEQ ID NO: 7051534 - DNA, 23 bp, Homo sapiens
cccattttcatgttaactcctgg

SEQ ID NO: 7051535 - DNA, 22 bp, Homo sapiens
cccatttttgtgtgagtaatga

SEQ ID NO: 7051536 - DNA, 22 bp, Homo sapiens
cccattcatcctcgcttccttc

SEQ ID NO: 7051537 - DNA, 22 bp, Homo sapiens
cccattcatcctcgcttccttc

SEQ ID NO: 7051538 - DNA, 22 bp, Homo sapiens
cccagttgttgccggctctgga

SEQ ID NO: 7051539 - DNA, 23 bp, Homo sapiens
cccaggtcaaaattcacaggcct

SEQ ID NO: 7051540 - DNA, 22 bp, Homo sapiens
cccaggtccccacctgtctgct

SEQ ID NO: 7051541 - DNA, 22 bp, Homo sapiens
ccccaaggtgctcactgtctgg

SEQ ID NO: 7051542 - DNA, 22 bp, Homo sapiens
ccccacaactcatgttgaaact

SEQ ID NO: 7051543 - DNA, 22 bp, Homo sapiens
ccccaccatgtagaaactgaga

SEQ ID NO: 7051544 - DNA, 22 bp, Homo sapiens
ccccacctgtgcgtctgccgca

SEQ ID NO: 7051545 - DNA, 22 bp, Homo sapiens
tgctggctttgcgagatgcatt

SEQ ID NO: 7051546 - DNA, 22 bp, Homo sapiens
tgctggctttttggtccttgct

SEQ ID NO: 7051547 - DNA, 22 bp, Homo sapiens
tgctgggatatagcttctaggg

SEQ ID NO: 7051548 - DNA, 23 bp, Homo sapiens
cccctctggtggctcagctcctg

SEQ ID NO: 7051549 - DNA, 23 bp, Homo sapiens
cccctctggtggctcagctcctg

SEQ ID NO: 7051550 - DNA, 22 bp, Homo sapiens
cccgagcctcggtttcttttct

SEQ ID NO: 7051551 - DNA, 22 bp, Homo sapiens
ccctgagagtgagtgccacctt

SEQ ID NO: 7051552 - DNA, 22 bp, Homo sapiens
ccctgagatgcctcaccctagt

SEQ ID NO: 7051553 - DNA, 22 bp, Homo sapiens
ccctgagcaacaaactgaatac

SEQ ID NO: 7051554 - DNA, 22 bp, Homo sapiens
ccctgagcagtctgcagagagc

SEQ ID NO: 7051555 - DNA, 22 bp, Homo sapiens
ccctgagcattcatgtgagctt

SEQ ID NO: 7051556 - DNA, 22 bp, Homo sapiens
ccctgagccacacagagcaggt

SEQ ID NO: 7051557 - DNA, 22 bp, Homo sapiens
ccctgagcccatagttgacatt

SEQ ID NO: 7051558 - DNA, 22 bp, Homo sapiens
ccctgagccgctgctccaacct

SEQ ID NO: 7051559 - DNA, 22 bp, Homo sapiens
ccctgagcgtgaggaggaagta

SEQ ID NO: 7051560 - DNA, 22 bp, Homo sapiens
ccctgaggaaagggtggagggc

SEQ ID NO: 7051561 - DNA, 22 bp, Homo sapiens
tggagcaagctggagagaacat

SEQ ID NO: 7051562 - DNA, 22 bp, Homo sapiens
ccctctctcaggctgacagcct

SEQ ID NO: 7051563 - DNA, 22 bp, Homo sapiens
ccctctctcaggctgacagcct

SEQ ID NO: 7051564 - DNA, 18 bp, Homo sapiens
ccctctcctgctagtggg

SEQ ID NO: 7051565 - DNA, 22 bp, Homo sapiens
ccctctcctggctgcatggagc

SEQ ID NO: 7051566 - DNA, 20 bp, Homo sapiens
ccctgagacaaaggaggggc

SEQ ID NO: 7051567 - DNA, 20 bp, Homo sapiens
ccctgagaccagagagcagc

SEQ ID NO: 7051568 - DNA, 20 bp, Homo sapiens
ccctgagacgactgagctcc

SEQ ID NO: 7051569 - DNA, 22 bp, Homo sapiens
ccctccttaccaccacagctcc

SEQ ID NO: 7051570 - DNA, 22 bp, Homo sapiens
ccctcgccgcagctgcttcccg

SEQ ID NO: 7051571 - DNA, 22 bp, Homo sapiens
ccctcgctctaggcagccctgt

SEQ ID NO: 7051572 - DNA, 22 bp, Homo sapiens
ccctctacagggaagcgctttc

SEQ ID NO: 7051573 - DNA, 22 bp, Homo sapiens
ccctcctctccctaagagtcac

SEQ ID NO: 7051574 - DNA, 20 bp, Homo sapiens
tggaatgggtccttgaaaaa

SEQ ID NO: 7051575 - DNA, 22 bp, Homo sapiens
tggaatgtgctagggctgtggc

SEQ ID NO: 7051576 - DNA, 22 bp, Homo sapiens
tgctgtggcagtttatgtatag

SEQ ID NO: 7051577 - DNA, 22 bp, Homo sapiens
tgctgtggttcccagagtggat

SEQ ID NO: 7051578 - DNA, 22 bp, Homo sapiens
tgctgtggattcagagatgaaa

SEQ ID NO: 7051579 - DNA, 18 bp, Homo sapiens
cccggctaatttttggta

SEQ ID NO: 7051580 - DNA, 22 bp, Homo sapiens
tgctgtgtggatgtgaagaatc

SEQ ID NO: 7051581 - DNA, 22 bp, Homo sapiens
tgctgtgttcaccaatatgtgt

SEQ ID NO: 7051582 - DNA, 22 bp, Homo sapiens
tgctgtgttctcctgactcacc

SEQ ID NO: 7051583 - DNA, 22 bp, Homo sapiens
tgggaagctgcattttaacaag

SEQ ID NO: 7051584 - DNA, 22 bp, Homo sapiens
tgggaaggacgtgtcagtggca

SEQ ID NO: 7051585 - DNA, 22 bp, Homo sapiens
tgggaaggcagtcactgtccta

SEQ ID NO: 7051586 - DNA, 22 bp, Homo sapiens
cctcttcctcaccatctacaac

SEQ ID NO: 7051587 - DNA, 22 bp, Homo sapiens
tggcttccaaattatccctaga

SEQ ID NO: 7051588 - DNA, 22 bp, Homo sapiens
tggcttccactgtgtgccccct

SEQ ID NO: 7051589 - DNA, 22 bp, Homo sapiens
tggcttccagaactgagcaaca

SEQ ID NO: 7051590 - DNA, 22 bp, Homo sapiens
tggcttccagtaatcaggattt

SEQ ID NO: 7051591 - DNA, 22 bp, Homo sapiens
cctctgcctgcacatcatcctg

SEQ ID NO: 7051592 - DNA, 22 bp, Homo sapiens
cctctgcctgcacatcatcctg

SEQ ID NO: 7051593 - DNA, 20 bp, Homo sapiens
cctctgcctttctagtctga

SEQ ID NO: 7051594 - DNA, 19 bp, Homo sapiens
cctctgctccagtttcctt

SEQ ID NO: 7051595 - DNA, 22 bp, Homo sapiens
cctctgctctggtccatgtgct

SEQ ID NO: 7051596 - DNA, 22 bp, Homo sapiens
cctctgctgctgttgagcaccg

SEQ ID NO: 7051597 - DNA, 22 bp, Homo sapiens
tggctgggagctggaactgggc

SEQ ID NO: 7051598 - DNA, 22 bp, Homo sapiens
tggcttcatctgcagcactgcc

SEQ ID NO: 7051599 - DNA, 22 bp, Homo sapiens
tggcttcattattgtttttcct

SEQ ID NO: 7051600 - DNA, 16 bp, Homo sapiens
tggctgagagagggtt

SEQ ID NO: 7051601 - DNA, 22 bp, Homo sapiens
tggctgagagaagacggggaag

SEQ ID NO: 7051602 - DNA, 16 bp, Homo sapiens
tggctgagagagggtt

SEQ ID NO: 7051603 - DNA, 22 bp, Homo sapiens
tggctgagagcaattgactctg

SEQ ID NO: 7051604 - DNA, 22 bp, Homo sapiens
tggctgagagaagacggggaag

SEQ ID NO: 7051605 - DNA, 22 bp, Homo sapiens
tggctgagaccttcccaaattc

SEQ ID NO: 7051606 - DNA, 22 bp, Homo sapiens
tggctgagaccatcagggtgta

SEQ ID NO: 7051607 - DNA, 22 bp, Homo sapiens
tggctgagaccttcccaaattc

SEQ ID NO: 7051608 - DNA, 22 bp, Homo sapiens
tggctgctagccagagcttcag

SEQ ID NO: 7051609 - DNA, 22 bp, Homo sapiens
tggctgagaccatcagggtgta

SEQ ID NO: 7051610 - DNA, 22 bp, Homo sapiens
tggctgagaccatcagggtgta

SEQ ID NO: 7051611 - DNA, 22 bp, Homo sapiens
tggctgagaatgggatgatgcc

SEQ ID NO: 7051612 - DNA, 22 bp, Homo sapiens
tggctgagaatgggatgatgcc

SEQ ID NO: 7051613 - DNA, 17 bp, Homo sapiens
tggctctgtcctcagct

SEQ ID NO: 7051614 - DNA, 22 bp, Homo sapiens
cctcttctaggtttcagcctgc

SEQ ID NO: 7051615 - DNA, 22 bp, Homo sapiens
cctcttctcaactccagccaga

SEQ ID NO: 7051616 - DNA, 22 bp, Homo sapiens
cctcttctaggacgtccttgtg

SEQ ID NO: 7051617 - DNA, 22 bp, Homo sapiens
cctcttcctcaccatctacaac

SEQ ID NO: 7051618 - DNA, 17 bp, Homo sapiens
cctcttcctctcagctg

SEQ ID NO: 7051619 - DNA, 19 bp, Homo sapiens
cctcttcctctgacactat

SEQ ID NO: 7051620 - DNA, 19 bp, Homo sapiens
cctcttcctctgacactat

SEQ ID NO: 7051621 - DNA, 22 bp, Homo sapiens
cctcttcctgcactgacatttt

SEQ ID NO: 7051622 - DNA, 22 bp, Homo sapiens
tgggagtgttcttggcttgctt

SEQ ID NO: 7051623 - DNA, 22 bp, Homo sapiens
tgggagtggggcatagaaggta

SEQ ID NO: 7051624 - DNA, 19 bp, Homo sapiens
tgggagtggggaaggtcct

SEQ ID NO: 7051625 - DNA, 19 bp, Homo sapiens
tgggagtggggaaggtcct

SEQ ID NO: 7051626 - DNA, 22 bp, Homo sapiens
cctcttctgagtgagactccct

SEQ ID NO: 7051627 - DNA, 19 bp, Homo sapiens
tgggagtggggaaggtcct

SEQ ID NO: 7051628 - DNA, 22 bp, Homo sapiens
tgggccatttttggaagactgg

SEQ ID NO: 7051629 - DNA, 22 bp, Homo sapiens
cctgagcctgagtggtgcaggg

SEQ ID NO: 7051630 - DNA, 22 bp, Homo sapiens
cctgagcatcagcgcctcctta

SEQ ID NO: 7051631 - DNA, 22 bp, Homo sapiens
cctgagcatcagcgcctcctta

SEQ ID NO: 7051632 - DNA, 22 bp, Homo sapiens
cctgagaccaagttgcagccat

SEQ ID NO: 7051633 - DNA, 22 bp, Homo sapiens
cctgagcaacttcaagggcctg

SEQ ID NO: 7051634 - DNA, 22 bp, Homo sapiens
tgggctgctgttacaggggctg

SEQ ID NO: 7051635 - DNA, 22 bp, Homo sapiens
tgggctctagactttagtgtgg

SEQ ID NO: 7051636 - DNA, 23 bp, Homo sapiens
tgggccctggagtcgccagtctg

SEQ ID NO: 7051637 - DNA, 22 bp, Homo sapiens
tgggccctgcccttgtctgtcc

SEQ ID NO: 7051638 - DNA, 22 bp, Homo sapiens
cctgagcctggctcatgcactc

SEQ ID NO: 7051639 - DNA, 22 bp, Homo sapiens
tgggctggagcttgttgcttcc

SEQ ID NO: 7051640 - DNA, 22 bp, Homo sapiens
tgggctggcccaccacacctcg

SEQ ID NO: 7051641 - DNA, 22 bp, Homo sapiens
tggggaggaagtcagatttcag

SEQ ID NO: 7051642 - DNA, 22 bp, Homo sapiens
cctgagctgactctcctttcag

SEQ ID NO: 7051643 - DNA, 22 bp, Homo sapiens
cctgagctgcggggcagtgctc

SEQ ID NO: 7051644 - DNA, 22 bp, Homo sapiens
cctgagctgcggggcagtgctc

SEQ ID NO: 7051645 - DNA, 22 bp, Homo sapiens
cctgagctggaagagcttgtgc

SEQ ID NO: 7051646 - DNA, 22 bp, Homo sapiens
cctgagctagggaaggaagacc

SEQ ID NO: 7051647 - DNA, 22 bp, Homo sapiens
cctgagctcaaagggtgcctgg

SEQ ID NO: 7051648 - DNA, 22 bp, Homo sapiens
cctgagctcaagaaggtgacca

SEQ ID NO: 7051649 - DNA, 22 bp, Homo sapiens
cctgagctccagtagcagccag

SEQ ID NO: 7051650 - DNA, 22 bp, Homo sapiens
cctgagctccagtagcagccag

SEQ ID NO: 7051651 - DNA, 22 bp, Homo sapiens
tggcctggggacctgtgagacc

SEQ ID NO: 7051652 - DNA, 22 bp, Homo sapiens
tggcctggggaagaccatgggc

SEQ ID NO: 7051653 - DNA, 22 bp, Homo sapiens
tggcctgggcctgccggtgcaa

SEQ ID NO: 7051654 - DNA, 22 bp, Homo sapiens
cctcagggactccatgctgcag

SEQ ID NO: 7051655 - DNA, 22 bp, Homo sapiens
tggcctggctgccctgtctgga

SEQ ID NO: 7051656 - DNA, 22 bp, Homo sapiens
tggcctggctgccctgtctgga

SEQ ID NO: 7051657 - DNA, 22 bp, Homo sapiens
cctcagaggttttcattctgta

SEQ ID NO: 7051658 - DNA, 22 bp, Homo sapiens
cctcagagttggaatcacattt

SEQ ID NO: 7051659 - DNA, 22 bp, Homo sapiens
cctcaggctgctcacacttgtc

SEQ ID NO: 7051660 - DNA, 22 bp, Homo sapiens
cctcaggctgggctgcccctgg

SEQ ID NO: 7051661 - DNA, 22 bp, Homo sapiens
cctcaggctgtcttccttctgg

SEQ ID NO: 7051662 - DNA, 22 bp, Homo sapiens
cctcaggcttgtgagccttcag

SEQ ID NO: 7051663 - DNA, 22 bp, Homo sapiens
tggcagaggtaattcaaatccc

SEQ ID NO: 7051664 - DNA, 22 bp, Homo sapiens
tggcagaggctctgtgatgttg

SEQ ID NO: 7051665 - DNA, 22 bp, Homo sapiens
tggcagaggtaattcaaatccc

SEQ ID NO: 7051666 - DNA, 22 bp, Homo sapiens
tggcagaggtaattcaaatccc

SEQ ID NO: 7051667 - DNA, 18 bp, Homo sapiens
cctaagctccagccccag

SEQ ID NO: 7051668 - DNA, 19 bp, Homo sapiens
tggcagaggcagtttgtac

SEQ ID NO: 7051669 - DNA, 22 bp, Homo sapiens
tggcagaggctctgtgatgttg

SEQ ID NO: 7051670 - DNA, 22 bp, Homo sapiens
tggcagaggagaattaagatta

SEQ ID NO: 7051671 - DNA, 22 bp, Homo sapiens
tggcagaggaggctcagattga

SEQ ID NO: 7051672 - DNA, 22 bp, Homo sapiens
tggcagaggaggctcagattga

SEQ ID NO: 7051673 - DNA, 22 bp, Homo sapiens
cctagcagggaagcagtgagga

SEQ ID NO: 7051674 - DNA, 22 bp, Homo sapiens
cctagccccagatatctcacac

SEQ ID NO: 7051675 - DNA, 22 bp, Homo sapiens
tggcagggtgggcttcagcccc

SEQ ID NO: 7051676 - DNA, 18 bp, Homo sapiens
tggcaggtagactcaggt

SEQ ID NO: 7051677 - DNA, 22 bp, Homo sapiens
tggcaggtagagttctgagatg

SEQ ID NO: 7051678 - DNA, 22 bp, Homo sapiens
tggcaggtagtcagaggcgaca

SEQ ID NO: 7051679 - DNA, 22 bp, Homo sapiens
cctcagaaggacaagagacaaa

SEQ ID NO: 7051680 - DNA, 22 bp, Homo sapiens
cctcagaaggacaagagacaaa

SEQ ID NO: 7051681 - DNA, 22 bp, Homo sapiens
cctcagaatagtcctcagatca

SEQ ID NO: 7051682 - DNA, 19 bp, Homo sapiens
tggcagaggacaaggactt

SEQ ID NO: 7051683 - DNA, 19 bp, Homo sapiens
tggcagaggacaaggactt

SEQ ID NO: 7051684 - DNA, 19 bp, Homo sapiens
tggcagaggacaaggactt

SEQ ID NO: 7051685 - DNA, 22 bp, Homo sapiens
tggcagaggagaattaagatta

SEQ ID NO: 7051686 - DNA, 22 bp, Homo sapiens
tggcagaggagaattaagatta

SEQ ID NO: 7051687 - DNA, 22 bp, Homo sapiens
cccttctctttcactcactatt

SEQ ID NO: 7051688 - DNA, 22 bp, Homo sapiens
cccttcctcctcgcctgtcaga

SEQ ID NO: 7051689 - DNA, 22 bp, Homo sapiens
cccttcctcctcgcctgtcaga

SEQ ID NO: 7051690 - DNA, 22 bp, Homo sapiens
cccttcctcctcgcctgtcaga

SEQ ID NO: 7051691 - DNA, 22 bp, Homo sapiens
cccttcctggagtaccctctgt

SEQ ID NO: 7051692 - DNA, 22 bp, Homo sapiens
cccttcctgggtgtcccggagt

SEQ ID NO: 7051693 - DNA, 22 bp, Homo sapiens
ccctgcagccttgcatgccttc

SEQ ID NO: 7051694 - DNA, 18 bp, Homo sapiens
tggagcaggtaggcatga

SEQ ID NO: 7051695 - DNA, 22 bp, Homo sapiens
tggagcaggccggaagtggctt

SEQ ID NO: 7051696 - DNA, 22 bp, Homo sapiens
ccctgcaggggacctgcagcct

SEQ ID NO: 7051697 - DNA, 22 bp, Homo sapiens
tgaagttgttaaggttgccatt

SEQ ID NO: 7051698 - DNA, 22 bp, Homo sapiens
tgaagttgttaaggttgccatt

SEQ ID NO: 7051699 - DNA, 22 bp, Homo sapiens
tgaatgagtggattctgagtag

SEQ ID NO: 7051700 - DNA, 22 bp, Homo sapiens
tgaatgagtttggctgctgttc

SEQ ID NO: 7051701 - DNA, 22 bp, Homo sapiens
tgacaactttacaaaattcttc

SEQ ID NO: 7051702 - DNA, 22 bp, Homo sapiens
ccaggctggagtgcaatggtgc

SEQ ID NO: 7051703 - DNA, 22 bp, Homo sapiens
ccaggctggagtgcagtagtgt

SEQ ID NO: 7051704 - DNA, 22 bp, Homo sapiens
ccaggctggagtgcagtggcac

SEQ ID NO: 7051705 - DNA, 22 bp, Homo sapiens
ccaggctggagtgcagtggcac

SEQ ID NO: 7051706 - DNA, 22 bp, Homo sapiens
ccaggctggagtgtagtcgcat

SEQ ID NO: 7051707 - DNA, 22 bp, Homo sapiens
ccaggctggattttgcagttca

SEQ ID NO: 7051708 - DNA, 22 bp, Homo sapiens
ccaggctggattttgcagttca

SEQ ID NO: 7051709 - DNA, 20 bp, Homo sapiens
ccaggctggcaaatgggggc

SEQ ID NO: 7051710 - DNA, 20 bp, Homo sapiens
ccaggctggcaaatgggggc

SEQ ID NO: 7051711 - DNA, 21 bp, Homo sapiens
ccaggctggccatggtattga

SEQ ID NO: 7051712 - DNA, 22 bp, Homo sapiens
tgacataaaccagtgagcaaaa

SEQ ID NO: 7051713 - DNA, 22 bp, Homo sapiens
tgacataataatccaaacatac

SEQ ID NO: 7051714 - DNA, 22 bp, Homo sapiens
tgacataataatccaaacatac

SEQ ID NO: 7051715 - DNA, 22 bp, Homo sapiens
tgacataatgctttgaagttgc

SEQ ID NO: 7051716 - DNA, 22 bp, Homo sapiens
ccagggcttcagttagtggtga

SEQ ID NO: 7051717 - DNA, 22 bp, Homo sapiens
ccagggctggaccagtgcttgg

SEQ ID NO: 7051718 - DNA, 22 bp, Homo sapiens
ccagggctgctgtgggactcca

SEQ ID NO: 7051719 - DNA, 19 bp, Homo sapiens
ccagggctttaagttgagg

SEQ ID NO: 7051720 - DNA, 22 bp, Homo sapiens
ccagggcttggtggcttgtatc

SEQ ID NO: 7051721 - DNA, 22 bp, Homo sapiens
ccagggcttcccacgtgccctg

SEQ ID NO: 7051722 - DNA, 22 bp, Homo sapiens
ccagggcttcccacgtgccctg

SEQ ID NO: 7051723 - DNA, 22 bp, Homo sapiens
ccagggctttgccaaagtccag

SEQ ID NO: 7051724 - DNA, 22 bp, Homo sapiens
ccagggctttatctgcctttga

SEQ ID NO: 7051725 - DNA, 22 bp, Homo sapiens
ccagggctttatctgcctttga

SEQ ID NO: 7051726 - DNA, 22 bp, Homo sapiens
ccaggggaaacagggagcactc

SEQ ID NO: 7051727 - DNA, 22 bp, Homo sapiens
tgagacgaagtcttgctctgtt

SEQ ID NO: 7051728 - DNA, 22 bp, Homo sapiens
tgagacctgtaatgagaaattg

SEQ ID NO: 7051729 - DNA, 22 bp, Homo sapiens
tgagacctgtagcttcacagag

SEQ ID NO: 7051730 - DNA, 23 bp, Homo sapiens
tgagaccctaatttagcaagtgt

SEQ ID NO: 7051731 - DNA, 20 bp, Homo sapiens
tgagacccgctgacaagttc

SEQ ID NO: 7051732 - DNA, 22 bp, Homo sapiens
tgagacagttctgcagctgggt

SEQ ID NO: 7051733 - DNA, 22 bp, Homo sapiens
tgagacagttggtgaaatctaa

SEQ ID NO: 7051734 - DNA, 22 bp, Homo sapiens
tgagacagtttttctatttcca

SEQ ID NO: 7051735 - DNA, 22 bp, Homo sapiens
tgagacagtttttctatttcca

SEQ ID NO: 7051736 - DNA, 22 bp, Homo sapiens
tgagacgaagtcttgctctgtt

SEQ ID NO: 7051737 - DNA, 22 bp, Homo sapiens
tgagacgaagtcttgctctgtt

SEQ ID NO: 7051738 - DNA, 22 bp, Homo sapiens
ccaggtgggcgtgtcttcacct

SEQ ID NO: 7051739 - DNA, 22 bp, Homo sapiens
ccaggtgtagcactgctcacag

SEQ ID NO: 7051740 - DNA, 22 bp, Homo sapiens
ccaggtgtaggacaccaaggga

SEQ ID NO: 7051741 - DNA, 22 bp, Homo sapiens
ccaggtgtcatgcgtgtgaccc

SEQ ID NO: 7051742 - DNA, 22 bp, Homo sapiens
ccaggtgtctgtggccagccct

SEQ ID NO: 7051743 - DNA, 22 bp, Homo sapiens
ccaggtgtgatttggcagtgtc

SEQ ID NO: 7051744 - DNA, 22 bp, Homo sapiens
ccaggtgtgccagcagggactg

SEQ ID NO: 7051745 - DNA, 22 bp, Homo sapiens
ccaggtgtgctctgcagtggat

SEQ ID NO: 7051746 - DNA, 22 bp, Homo sapiens
ccaggtgtggggaggactcaca

SEQ ID NO: 7051747 - DNA, 23 bp, Homo sapiens
tgaggacctctcaggggccaggc

SEQ ID NO: 7051748 - DNA, 22 bp, Homo sapiens
tgaggactttccatgttaatgt

SEQ ID NO: 7051749 - DNA, 22 bp, Homo sapiens
tgaggcagaaaatagcagttca

SEQ ID NO: 7051750 - DNA, 22 bp, Homo sapiens
tgaggcagaaaatagcagttca

SEQ ID NO: 7051751 - DNA, 22 bp, Homo sapiens
tgaggcagagtaagatacatga

SEQ ID NO: 7051752 - DNA, 22 bp, Homo sapiens
tgaggcagcaattgattattca

SEQ ID NO: 7051753 - DNA, 22 bp, Homo sapiens
ccaggggctgcagatccatggt

SEQ ID NO: 7051754 - DNA, 22 bp, Homo sapiens
ccaggggctggtgctgagctgg

SEQ ID NO: 7051755 - DNA, 22 bp, Homo sapiens
ccaggggctctcagggtgtgtg

SEQ ID NO: 7051756 - DNA, 22 bp, Homo sapiens
tgagaatagcagactggtaact

SEQ ID NO: 7051757 - DNA, 22 bp, Homo sapiens
tgagaatgagggggtagaaggt

SEQ ID NO: 7051758 - DNA, 17 bp, Homo sapiens
tgagaagtaggcatcat

SEQ ID NO: 7051759 - DNA, 22 bp, Homo sapiens
ccaggggggcgtagatgctggg

SEQ ID NO: 7051760 - DNA, 22 bp, Homo sapiens
ccaggtgctagcaatcactgtc

SEQ ID NO: 7051761 - DNA, 22 bp, Homo sapiens
ccaggtgctcttgccagggctg

SEQ ID NO: 7051762 - DNA, 22 bp, Homo sapiens
ccaggtgctcttgccagggctg

SEQ ID NO: 7051763 - DNA, 19 bp, Homo sapiens
ccaggtggaactgaggtag

SEQ ID NO: 7051764 - DNA, 19 bp, Homo sapiens
ccaggtggaactgaggtag

SEQ ID NO: 7051765 - DNA, 22 bp, Homo sapiens
ccaggtggaaggtctgtgctct

SEQ ID NO: 7051766 - DNA, 22 bp, Homo sapiens
ccaggtggaaggtctgtgctct

SEQ ID NO: 7051767 - DNA, 22 bp, Homo sapiens
ccaggtggacaaggctttcaca

SEQ ID NO: 7051768 - DNA, 22 bp, Homo sapiens
ccaggtggacaaggctttcaca

SEQ ID NO: 7051769 - DNA, 22 bp, Homo sapiens
ccaggtggacggcgagtacagg

SEQ ID NO: 7051770 - DNA, 22 bp, Homo sapiens
tgcaaatagcctatatttatag

SEQ ID NO: 7051771 - DNA, 22 bp, Homo sapiens
cccactgtgttgcagtctagtg

SEQ ID NO: 7051772 - DNA, 22 bp, Homo sapiens
tgcaaatacaaaatggtacagc

SEQ ID NO: 7051773 - DNA, 22 bp, Homo sapiens
tgcaaataaatttctgttcatt

SEQ ID NO: 7051774 - DNA, 22 bp, Homo sapiens
tgattttattggtgaggaaatt

SEQ ID NO: 7051775 - DNA, 23 bp, Homo sapiens
tgattttaaaaagtaagttatca

SEQ ID NO: 7051776 - DNA, 23 bp, Homo sapiens
tgattttaaaaagtaagttatca

SEQ ID NO: 7051777 - DNA, 22 bp, Homo sapiens
tgatttctcatattgttcaaaa

SEQ ID NO: 7051778 - DNA, 20 bp, Homo sapiens
tgatttctcttctattcctt

SEQ ID NO: 7051779 - DNA, 20 bp, Homo sapiens
ccagtccctgagcaccaggg

SEQ ID NO: 7051780 - DNA, 22 bp, Homo sapiens
tgaggcagcctgcattaaagag

SEQ ID NO: 7051781 - DNA, 22 bp, Homo sapiens
ccagtcccgcatggtccagaat

SEQ ID NO: 7051782 - DNA, 22 bp, Homo sapiens
tgaggcagcaattgtattgtat

SEQ ID NO: 7051783 - DNA, 22 bp, Homo sapiens
tgaggcagcattcttcaagaca

SEQ ID NO: 7051784 - DNA, 22 bp, Homo sapiens
tgaggcagcattcttcaagaca

SEQ ID NO: 7051785 - DNA, 22 bp, Homo sapiens
tgaggcagcattcttcaagaca

SEQ ID NO: 7051786 - DNA, 22 bp, Homo sapiens
tgaggcagcccactttccttag

SEQ ID NO: 7051787 - DNA, 22 bp, Homo sapiens
tgagggctgacaggaggacagc

SEQ ID NO: 7051788 - DNA, 22 bp, Homo sapiens
tgagggctgcttccagagctag

SEQ ID NO: 7051789 - DNA, 22 bp, Homo sapiens
tgagggctgcttccagagctag

SEQ ID NO: 7051790 - DNA, 22 bp, Homo sapiens
tgagggctaaattgtggcaggt

SEQ ID NO: 7051791 - DNA, 23 bp, Homo sapiens
tgaggctgattgatttttgctca

SEQ ID NO: 7051792 - DNA, 22 bp, Homo sapiens
tgaggctgccttgggaagaggg

SEQ ID NO: 7051793 - DNA, 22 bp, Homo sapiens
tgaggctgccttgggaagaggg

SEQ ID NO: 7051794 - DNA, 22 bp, Homo sapiens
tgagggcagagcactggggagc

SEQ ID NO: 7051795 - DNA, 22 bp, Homo sapiens
ccatcctgcattgctattcaga

SEQ ID NO: 7051796 - DNA, 22 bp, Homo sapiens
ccatgcatgcctgaaattgctg

SEQ ID NO: 7051797 - DNA, 22 bp, Homo sapiens
tgaggtatggtaaggtaaaatc

SEQ ID NO: 7051798 - DNA, 22 bp, Homo sapiens
ccatgtggtgggaaggagaatg

SEQ ID NO: 7051799 - DNA, 22 bp, Homo sapiens
ccagagagagaggtcaatggca

SEQ ID NO: 7051800 - DNA, 22 bp, Homo sapiens
tctcagaagggtggtgctggag

SEQ ID NO: 7051801 - DNA, 22 bp, Homo sapiens
ccagagagagaggtcaatggca

SEQ ID NO: 7051802 - DNA, 22 bp, Homo sapiens
tctcagaagtgatcaggatgtt

SEQ ID NO: 7051803 - DNA, 22 bp, Homo sapiens
tctcagaataaattcctaactt

SEQ ID NO: 7051804 - DNA, 22 bp, Homo sapiens
ccagagagaaaatggagggcca

SEQ ID NO: 7051805 - DNA, 22 bp, Homo sapiens
tctcagaatcaggacctacttc

SEQ ID NO: 7051806 - DNA, 22 bp, Homo sapiens
tctcagaatccttgcccaggtg

SEQ ID NO: 7051807 - DNA, 19 bp, Homo sapiens
tctcagaattaagagtgct

SEQ ID NO: 7051808 - DNA, 19 bp, Homo sapiens
tctcagaattggcaatcat

SEQ ID NO: 7051809 - DNA, 22 bp, Homo sapiens
tctcagaattgtgtccactggg

SEQ ID NO: 7051810 - DNA, 22 bp, Homo sapiens
tctcagagaacagttggtgctt

SEQ ID NO: 7051811 - DNA, 22 bp, Homo sapiens
tctgctttcttgcgcagatgtg

SEQ ID NO: 7051812 - DNA, 22 bp, Homo sapiens
tctgctttgctgcctcctgatc

SEQ ID NO: 7051813 - DNA, 22 bp, Homo sapiens
tctgctttgctgcctcctgatc

SEQ ID NO: 7051814 - DNA, 22 bp, Homo sapiens
tctgctttttcattgactgaaa

SEQ ID NO: 7051815 - DNA, 22 bp, Homo sapiens
tctggaaaagcgataaaccatt

SEQ ID NO: 7051816 - DNA, 20 bp, Homo sapiens
ccagctgagccaaggggaga

SEQ ID NO: 7051817 - DNA, 22 bp, Homo sapiens
ccagctgaggcagccacacagg

SEQ ID NO: 7051818 - DNA, 22 bp, Homo sapiens
ccagctgattcggtggtggttg

SEQ ID NO: 7051819 - DNA, 22 bp, Homo sapiens
ccagctgcaggggagcagtgga

SEQ ID NO: 7051820 - DNA, 22 bp, Homo sapiens
ccagctgcaggtgttccagatg

SEQ ID NO: 7051821 - DNA, 22 bp, Homo sapiens
ccagctgcccaagaggcatcct

SEQ ID NO: 7051822 - DNA, 22 bp, Homo sapiens
ccagctgctgacatgggcaggt

SEQ ID NO: 7051823 - DNA, 22 bp, Homo sapiens
ccagctgctgtgaggaccacag

SEQ ID NO: 7051824 - DNA, 22 bp, Homo sapiens
tctggtaacctttatccctcct

SEQ ID NO: 7051825 - DNA, 22 bp, Homo sapiens
tctggtaacctttatccctcct

SEQ ID NO: 7051826 - DNA, 22 bp, Homo sapiens
tctggtcaagacatcctaacat

SEQ ID NO: 7051827 - DNA, 22 bp, Homo sapiens
tctgggagcctgaaagtgaatg

SEQ ID NO: 7051828 - DNA, 19 bp, Homo sapiens
tctgggagagtgaatctga

SEQ ID NO: 7051829 - DNA, 22 bp, Homo sapiens
tctgggagatccaagcagaact

SEQ ID NO: 7051830 - DNA, 22 bp, Homo sapiens
ccaggagaataatggcagatta

SEQ ID NO: 7051831 - DNA, 22 bp, Homo sapiens
tctggtggcacgtgtcttgcat

SEQ ID NO: 7051832 - DNA, 22 bp, Homo sapiens
tctggcaggggttctgcacttg

SEQ ID NO: 7051833 - DNA, 22 bp, Homo sapiens
tctggcagctatcctctggcca

SEQ ID NO: 7051834 - DNA, 22 bp, Homo sapiens
tctggcaggaccatgaagcgta

SEQ ID NO: 7051835 - DNA, 22 bp, Homo sapiens
tctggcaggcaatcggctctgg

SEQ ID NO: 7051836 - DNA, 21 bp, Homo sapiens
ccaggaaggactgagctccct

SEQ ID NO: 7051837 - DNA, 22 bp, Homo sapiens
ccaggacactgcttcacagcag

SEQ ID NO: 7051838 - DNA, 22 bp, Homo sapiens
ccaggacagtgaacatgtaaga

SEQ ID NO: 7051839 - DNA, 22 bp, Homo sapiens
ccaggagactgtactgatattt

SEQ ID NO: 7051840 - DNA, 22 bp, Homo sapiens
ccaggagacccagggaaggagc

SEQ ID NO: 7051841 - DNA, 22 bp, Homo sapiens
ccaggaggttgaggctgcagtg

SEQ ID NO: 7051842 - DNA, 22 bp, Homo sapiens
ccaggaggttgaggctgcagtg

SEQ ID NO: 7051843 - DNA, 22 bp, Homo sapiens
ccaggaggttgaggctgcagtg

SEQ ID NO: 7051844 - DNA, 22 bp, Homo sapiens
ccaggaggttgaggctgcagtg

SEQ ID NO: 7051845 - DNA, 22 bp, Homo sapiens
tcttagaatgtcaactgatgtt

SEQ ID NO: 7051846 - DNA, 22 bp, Homo sapiens
tcttcacgccaagtgcccctca

SEQ ID NO: 7051847 - DNA, 22 bp, Homo sapiens
ccaggccagagtgcagtggcac

SEQ ID NO: 7051848 - DNA, 22 bp, Homo sapiens
ccaggccagcaggcacacctgc

SEQ ID NO: 7051849 - DNA, 21 bp, Homo sapiens
tcttccctcaggatgtcctgc

SEQ ID NO: 7051850 - DNA, 21 bp, Homo sapiens
tcttccctcaggatgtcctgc

SEQ ID NO: 7051851 - DNA, 19 bp, Homo sapiens
tcttccctggctgtcagtc

SEQ ID NO: 7051852 - DNA, 22 bp, Homo sapiens
tcttcctatggggctgcaggaa

SEQ ID NO: 7051853 - DNA, 22 bp, Homo sapiens
tcttcagacccttagctgtgat

SEQ ID NO: 7051854 - DNA, 22 bp, Homo sapiens
tcttcagacccttagctgtgat

SEQ ID NO: 7051855 - DNA, 20 bp, Homo sapiens
tcttccaggtacagtctgca

SEQ ID NO: 7051856 - DNA, 22 bp, Homo sapiens
ccaggctgagcatgattggagc

SEQ ID NO: 7051857 - DNA, 22 bp, Homo sapiens
ccaggctgctgttggtgtccgc

SEQ ID NO: 7051858 - DNA, 22 bp, Homo sapiens
ccaggctggagtgcaatggcat

SEQ ID NO: 7051859 - DNA, 22 bp, Homo sapiens
ccaggctggagtgcaatggcat

SEQ ID NO: 7051860 - DNA, 22 bp, Homo sapiens
ccaggctggagtgcaatggcgt

SEQ ID NO: 7051861 - DNA, 22 bp, Homo sapiens
ccaggctggagtgcaatggcgt

SEQ ID NO: 7051862 - DNA, 22 bp, Homo sapiens
ccaggctggagtgcaatggtgc

SEQ ID NO: 7051863 - DNA, 22 bp, Homo sapiens
ccaggcctggacgggtggcctg

SEQ ID NO: 7051864 - DNA, 21 bp, Homo sapiens
ccaggctcctgaggctggtca

SEQ ID NO: 7051865 - DNA, 21 bp, Homo sapiens
ccaggctcctgaggctggtca

SEQ ID NO: 7051866 - DNA, 22 bp, Homo sapiens
ccaggctctgtctggtcagaag

SEQ ID NO: 7051867 - DNA, 22 bp, Homo sapiens
ccaggctctgtgtgggctagag

SEQ ID NO: 7051868 - DNA, 22 bp, Homo sapiens
ccaggctctgttccccgaggag

SEQ ID NO: 7051869 - DNA, 23 bp, Homo sapiens
ccaggctctttcacctgctattc

SEQ ID NO: 7051870 - DNA, 22 bp, Homo sapiens
ccaggctgaatatgttccaggg

SEQ ID NO: 7051871 - DNA, 22 bp, Homo sapiens
tctttcttggtattctgagcta

SEQ ID NO: 7051872 - DNA, 22 bp, Homo sapiens
tctttcttggtataaagcaggg

SEQ ID NO: 7051873 - DNA, 22 bp, Homo sapiens
tctttcttgcaaggatgcagga

SEQ ID NO: 7051874 - DNA, 22 bp, Homo sapiens
tctttgaaagctgttctagagt

SEQ ID NO: 7051875 - DNA, 22 bp, Homo sapiens
ccaggcctgcatctgctgcgca

SEQ ID NO: 7051876 - DNA, 22 bp, Homo sapiens
ccaggcctgcattccctctcag

SEQ ID NO: 7051877 - DNA, 22 bp, Homo sapiens
ccaggccagtgtttggtccagg

SEQ ID NO: 7051878 - DNA, 22 bp, Homo sapiens
ccaggcccaccttggccactta

SEQ ID NO: 7051879 - DNA, 22 bp, Homo sapiens
ccaggcccaccttggccactta

SEQ ID NO: 7051880 - DNA, 22 bp, Homo sapiens
ccaggcccagggtactgaccaa

SEQ ID NO: 7051881 - DNA, 22 bp, Homo sapiens
ccaggccccagggctggctttc

SEQ ID NO: 7051882 - DNA, 22 bp, Homo sapiens
tcagggagaggtgagagcctgt

SEQ ID NO: 7051883 - DNA, 22 bp, Homo sapiens
tcaggctgtgggcactggccat

SEQ ID NO: 7051884 - DNA, 22 bp, Homo sapiens
tcaggctgtgtctttaaacaat

SEQ ID NO: 7051885 - DNA, 17 bp, Homo sapiens
tcaggctgtgcctggta

SEQ ID NO: 7051886 - DNA, 22 bp, Homo sapiens
tcaggctgtggcttcagttctt

SEQ ID NO: 7051887 - DNA, 22 bp, Homo sapiens
tcaggctgtggctttgaccgca

SEQ ID NO: 7051888 - DNA, 22 bp, Homo sapiens
tcaggctgtgggcactggccat

SEQ ID NO: 7051889 - DNA, 22 bp, Homo sapiens
tcaggctgtgggcactggccat

SEQ ID NO: 7051890 - DNA, 22 bp, Homo sapiens
tcaggctgtgggcactggccat

SEQ ID NO: 7051891 - DNA, 22 bp, Homo sapiens
catagaatatgtgtgattgtta

SEQ ID NO: 7051892 - DNA, 22 bp, Homo sapiens
catagaatcatagcacatttga

SEQ ID NO: 7051893 - DNA, 22 bp, Homo sapiens
catagaatgcagcaggaaagtt

SEQ ID NO: 7051894 - DNA, 22 bp, Homo sapiens
catagaatggattgacaagatt

SEQ ID NO: 7051895 - DNA, 22 bp, Homo sapiens
tcaggctgcctatcagactgtg

SEQ ID NO: 7051896 - DNA, 22 bp, Homo sapiens
tcaggctgcctatcagactgtg

SEQ ID NO: 7051897 - DNA, 22 bp, Homo sapiens
tcaggctgctggccagcaggct

SEQ ID NO: 7051898 - DNA, 22 bp, Homo sapiens
tcaggctgtatatcttgcactc

SEQ ID NO: 7051899 - DNA, 21 bp, Homo sapiens
tcaggctgtctgctggttcca

SEQ ID NO: 7051900 - DNA, 17 bp, Homo sapiens
tcaggctgtgcctggta

SEQ ID NO: 7051901 - DNA, 17 bp, Homo sapiens
tcaggctgtgcctggta

SEQ ID NO: 7051902 - DNA, 22 bp, Homo sapiens
tcaggcccagagtcacggatcc

SEQ ID NO: 7051903 - DNA, 22 bp, Homo sapiens
tcaggccccatcccagacttat

SEQ ID NO: 7051904 - DNA, 22 bp, Homo sapiens
tcaggccccttgtcagctctgt

SEQ ID NO: 7051905 - DNA, 22 bp, Homo sapiens
tcaggccccttgtcagctctgt

SEQ ID NO: 7051906 - DNA, 22 bp, Homo sapiens
catagaaactgagacaaggatt

SEQ ID NO: 7051907 - DNA, 22 bp, Homo sapiens
cataatttgatatgcttgatgg

SEQ ID NO: 7051908 - DNA, 22 bp, Homo sapiens
cataattttccatggtttgcta

SEQ ID NO: 7051909 - DNA, 18 bp, Homo sapiens
cataattttctttcttta

SEQ ID NO: 7051910 - DNA, 22 bp, Homo sapiens
cataattaaattctgggcaaga

SEQ ID NO: 7051911 - DNA, 22 bp, Homo sapiens
cataattactgatatgctgatt

SEQ ID NO: 7051912 - DNA, 22 bp, Homo sapiens
cataattagagaattcatgtta

SEQ ID NO: 7051913 - DNA, 22 bp, Homo sapiens
cataattaggcagttgatcatt

SEQ ID NO: 7051914 - DNA, 22 bp, Homo sapiens
cataattagtcatgttatgcat

SEQ ID NO: 7051915 - DNA, 22 bp, Homo sapiens
cataattataaacgcaagttca

SEQ ID NO: 7051916 - DNA, 22 bp, Homo sapiens
cataatttcccaagagattgaa

SEQ ID NO: 7051917 - DNA, 22 bp, Homo sapiens
tcagcaggtggtgggcaggtga

SEQ ID NO: 7051918 - DNA, 22 bp, Homo sapiens
cataatatctccgattacttgc

SEQ ID NO: 7051919 - DNA, 22 bp, Homo sapiens
cataatatctccgattacttgc

SEQ ID NO: 7051920 - DNA, 22 bp, Homo sapiens
cagtttttgccattaagagtaa

SEQ ID NO: 7051921 - DNA, 22 bp, Homo sapiens
cagtttttcaaaattacatgat

SEQ ID NO: 7051922 - DNA, 22 bp, Homo sapiens
cagtttttgccattaagagtaa

SEQ ID NO: 7051923 - DNA, 23 bp, Homo sapiens
cataaaatattagtatggtagca

SEQ ID NO: 7051924 - DNA, 22 bp, Homo sapiens
cagtttttagattagttggtgg

SEQ ID NO: 7051925 - DNA, 22 bp, Homo sapiens
cagttttaaattgttagataat

SEQ ID NO: 7051926 - DNA, 22 bp, Homo sapiens
tcagatactagctctcagcctc

SEQ ID NO: 7051927 - DNA, 22 bp, Homo sapiens
tcagaggatgctgttctttaat

SEQ ID NO: 7051928 - DNA, 22 bp, Homo sapiens
tcagaggatgctgttctttaat

SEQ ID NO: 7051929 - DNA, 18 bp, Homo sapiens
tcagaggagatacctaaa

SEQ ID NO: 7051930 - DNA, 22 bp, Homo sapiens
tcagaggagatggttaccaggg

SEQ ID NO: 7051931 - DNA, 22 bp, Homo sapiens
tcagaggagcaaaagaggggat

SEQ ID NO: 7051932 - DNA, 22 bp, Homo sapiens
tcagaggagcaaaagaggggat

SEQ ID NO: 7051933 - DNA, 22 bp, Homo sapiens
tcagaggagccaaagttctgag

SEQ ID NO: 7051934 - DNA, 22 bp, Homo sapiens
tcagaggagccaaagttctgag

SEQ ID NO: 7051935 - DNA, 22 bp, Homo sapiens
tcagaggagctgcagaacgctg

SEQ ID NO: 7051936 - DNA, 22 bp, Homo sapiens
tcagaggaggcatttaaacaga

SEQ ID NO: 7051937 - DNA, 22 bp, Homo sapiens
tcagaggaggcatttaaacaga

SEQ ID NO: 7051938 - DNA, 22 bp, Homo sapiens
tcagaggagggactcagaccca

SEQ ID NO: 7051939 - DNA, 22 bp, Homo sapiens
tcagaggagggactcagaccca

SEQ ID NO: 7051940 - DNA, 22 bp, Homo sapiens
tcagaggatagaaatacttatt

SEQ ID NO: 7051941 - DNA, 22 bp, Homo sapiens
tcagaggatagaaatacttatt

SEQ ID NO: 7051942 - DNA, 23 bp, Homo sapiens
tcagaggatcatcaaacgttttc

SEQ ID NO: 7051943 - DNA, 22 bp, Homo sapiens
tcagaggatcatgtccctactc

SEQ ID NO: 7051944 - DNA, 22 bp, Homo sapiens
tcagaggatcatgtccctactc

SEQ ID NO: 7051945 - DNA, 21 bp, Homo sapiens
tcagagagtcacagtgaactg

SEQ ID NO: 7051946 - DNA, 21 bp, Homo sapiens
tcagagagtcacagtgaactg

SEQ ID NO: 7051947 - DNA, 22 bp, Homo sapiens
tcagagagtgcaaaatatagct

SEQ ID NO: 7051948 - DNA, 22 bp, Homo sapiens
cagttgctggatgtgcagctct

SEQ ID NO: 7051949 - DNA, 22 bp, Homo sapiens
tcagagagttacacaaattgtt

SEQ ID NO: 7051950 - DNA, 22 bp, Homo sapiens
cagttctggagtttcattcttt

SEQ ID NO: 7051951 - DNA, 22 bp, Homo sapiens
cagttataagactaagctattc

SEQ ID NO: 7051952 - DNA, 22 bp, Homo sapiens
cagttctttgtggggagttctc

SEQ ID NO: 7051953 - DNA, 22 bp, Homo sapiens
tcaatatttttatgagcataga

SEQ ID NO: 7051954 - DNA, 22 bp, Homo sapiens
tcaatatattccatgttttctc

SEQ ID NO: 7051955 - DNA, 22 bp, Homo sapiens
tcaatattcttctttagtagga

SEQ ID NO: 7051956 - DNA, 22 bp, Homo sapiens
tcaatcataatgaagtgaagaa

SEQ ID NO: 7051957 - DNA, 22 bp, Homo sapiens
tcagtgctcctaaagtgaatgc

SEQ ID NO: 7051958 - DNA, 22 bp, Homo sapiens
tcagggagatttggggactcaa

SEQ ID NO: 7051959 - DNA, 22 bp, Homo sapiens
tcagggattgcaaaattcatcc

SEQ ID NO: 7051960 - DNA, 22 bp, Homo sapiens
catctgaataaagacttgcaga

SEQ ID NO: 7051961 - DNA, 22 bp, Homo sapiens
catctgaatatcccaggcatat

SEQ ID NO: 7051962 - DNA, 22 bp, Homo sapiens
catctgctctgtctgccatgtt

SEQ ID NO: 7051963 - DNA, 22 bp, Homo sapiens
catctgctgttccttggactca

SEQ ID NO: 7051964 - DNA, 22 bp, Homo sapiens
catctgctgttccttggactca

SEQ ID NO: 7051965 - DNA, 19 bp, Homo sapiens
catctggatgattctcctg

SEQ ID NO: 7051966 - DNA, 22 bp, Homo sapiens
catcttaaattaaagcttaagg

SEQ ID NO: 7051967 - DNA, 22 bp, Homo sapiens
catgaaattgctcctttggtgc

SEQ ID NO: 7051968 - DNA, 22 bp, Homo sapiens
catgaagcatgttttgtcatga

SEQ ID NO: 7051969 - DNA, 22 bp, Homo sapiens
catgaatttatattattagtga

SEQ ID NO: 7051970 - DNA, 22 bp, Homo sapiens
catgaatatacatcctgatggc

SEQ ID NO: 7051971 - DNA, 22 bp, Homo sapiens
catgaatatttagtatttactt

SEQ ID NO: 7051972 - DNA, 22 bp, Homo sapiens
catgcagtgactcagacacagg

SEQ ID NO: 7051973 - DNA, 22 bp, Homo sapiens
catgcagtgactcagacacagg

SEQ ID NO: 7051974 - DNA, 22 bp, Homo sapiens
catgcagggagtgctcctatta

SEQ ID NO: 7051975 - DNA, 22 bp, Homo sapiens
catgcagggagcagaggagaca

SEQ ID NO: 7051976 - DNA, 22 bp, Homo sapiens
catgcagggagcagaggagaca

SEQ ID NO: 7051977 - DNA, 22 bp, Homo sapiens
catgcagggagcagaggagaca

SEQ ID NO: 7051978 - DNA, 22 bp, Homo sapiens
catgcagggactagagaacagg

SEQ ID NO: 7051979 - DNA, 22 bp, Homo sapiens
catgcagggactagagaacagg

SEQ ID NO: 7051980 - DNA, 22 bp, Homo sapiens
catgcatatgtcaaaaaagcta

SEQ ID NO: 7051981 - DNA, 22 bp, Homo sapiens
catggcagagcctgcaggtggg

SEQ ID NO: 7051982 - DNA, 22 bp, Homo sapiens
catggcagagcctgcaggtggg

SEQ ID NO: 7051983 - DNA, 22 bp, Homo sapiens
catggcagctttgggaggagga

SEQ ID NO: 7051984 - DNA, 22 bp, Homo sapiens
catggcagctttgggaggagga

SEQ ID NO: 7051985 - DNA, 22 bp, Homo sapiens
catggcaggaaaatgaacaggc

SEQ ID NO: 7051986 - DNA, 22 bp, Homo sapiens
catggcaggaaaatgaacaggc

SEQ ID NO: 7051987 - DNA, 22 bp, Homo sapiens
catggcaggaaggacatgcact

SEQ ID NO: 7051988 - DNA, 22 bp, Homo sapiens
tccaggagaaggccatccagcg

SEQ ID NO: 7051989 - DNA, 20 bp, Homo sapiens
tccagctgggaacagctgat

SEQ ID NO: 7051990 - DNA, 22 bp, Homo sapiens
catggcaggaggctgctggcag

SEQ ID NO: 7051991 - DNA, 22 bp, Homo sapiens
catggcagggctgtgggcaggt

SEQ ID NO: 7051992 - DNA, 22 bp, Homo sapiens
catggcagggctgtgggcaggt

SEQ ID NO: 7051993 - DNA, 22 bp, Homo sapiens
tccctgggttcccgtggaagtg

SEQ ID NO: 7051994 - DNA, 22 bp, Homo sapiens
tccctgggttacctttcaaggt

SEQ ID NO: 7051995 - DNA, 22 bp, Homo sapiens
tccctgggtcctgcttgctctc

SEQ ID NO: 7051996 - DNA, 22 bp, Homo sapiens
tccctgggtcctgcttgctctc

SEQ ID NO: 7051997 - DNA, 22 bp, Homo sapiens
tccctgggtcattctctggcac

SEQ ID NO: 7051998 - DNA, 22 bp, Homo sapiens
tccctgggttcccgtggaagtg

SEQ ID NO: 7051999 - DNA, 22 bp, Homo sapiens
tcctaactaatttgtagcaaaa

SEQ ID NO: 7052000 - DNA, 20 bp, Homo sapiens
tcctaactataaagtggctc

SEQ ID NO: 7052001 - DNA, 23 bp, Homo sapiens
tcctaactcaattcaggggtgtc

SEQ ID NO: 7052002 - DNA, 22 bp, Homo sapiens
tcctaactccactagccttggg

SEQ ID NO: 7052003 - DNA, 23 bp, Homo sapiens
tcctaactgattctgcagtctct

SEQ ID NO: 7052004 - DNA, 22 bp, Homo sapiens
tcctaactgccctgggcaaggt

SEQ ID NO: 7052005 - DNA, 16 bp, Homo sapiens
tcctaactggcagttc

SEQ ID NO: 7052006 - DNA, 18 bp, Homo sapiens
tcctaacttagatactcc

SEQ ID NO: 7052007 - DNA, 22 bp, Homo sapiens
tccctggggtatcgctgaggca

SEQ ID NO: 7052008 - DNA, 22 bp, Homo sapiens
tccctggggttcctccagccac

SEQ ID NO: 7052009 - DNA, 22 bp, Homo sapiens
tccctgggtcattctctggcac

SEQ ID NO: 7052010 - DNA, 22 bp, Homo sapiens
tccctggggtatcgctgaggca

SEQ ID NO: 7052011 - DNA, 22 bp, Homo sapiens
catttattgagtggccacagtg

SEQ ID NO: 7052012 - DNA, 22 bp, Homo sapiens
tccctctccctattgcctggag

SEQ ID NO: 7052013 - DNA, 22 bp, Homo sapiens
tccctctccctattgcctggag

SEQ ID NO: 7052014 - DNA, 22 bp, Homo sapiens
tccctctccctattgcctggag

SEQ ID NO: 7052015 - DNA, 22 bp, Homo sapiens
tccctctctagcctgttcagta

SEQ ID NO: 7052016 - DNA, 22 bp, Homo sapiens
tccctctctggctggggtgcgg

SEQ ID NO: 7052017 - DNA, 22 bp, Homo sapiens
tccctctcttgggcgtggctca

SEQ ID NO: 7052018 - DNA, 22 bp, Homo sapiens
tccctctcttgggcgtggctca

SEQ ID NO: 7052019 - DNA, 22 bp, Homo sapiens
catttattcagctcagtcggtt

SEQ ID NO: 7052020 - DNA, 22 bp, Homo sapiens
catttattcatgatctgtagct

SEQ ID NO: 7052021 - DNA, 22 bp, Homo sapiens
catttattcatgatctgtagct

SEQ ID NO: 7052022 - DNA, 22 bp, Homo sapiens
catttattcatgatctgtagct

SEQ ID NO: 7052023 - DNA, 22 bp, Homo sapiens
catttattcatttgctagggct

SEQ ID NO: 7052024 - DNA, 22 bp, Homo sapiens
catttattctcagatccttgtc

SEQ ID NO: 7052025 - DNA, 22 bp, Homo sapiens
catttattctcagatccttgtc

SEQ ID NO: 7052026 - DNA, 18 bp, Homo sapiens
tccctcctgcctgcttcc

SEQ ID NO: 7052027 - DNA, 22 bp, Homo sapiens
tccctcctggccgtcaccgctg

SEQ ID NO: 7052028 - DNA, 22 bp, Homo sapiens
tccctcctggtgatgatgcaaa

SEQ ID NO: 7052029 - DNA, 22 bp, Homo sapiens
catttacacttctaaccacaag

SEQ ID NO: 7052030 - DNA, 22 bp, Homo sapiens
catttacaatgtacaggttgtg

SEQ ID NO: 7052031 - DNA, 22 bp, Homo sapiens
catttacacacagaggtgtgct

SEQ ID NO: 7052032 - DNA, 22 bp, Homo sapiens
tcccactcccaggcaggcctct

SEQ ID NO: 7052033 - DNA, 18 bp, Homo sapiens
cattgtacaatgctttat

SEQ ID NO: 7052034 - DNA, 22 bp, Homo sapiens
cattgttcaacactgacttgca

SEQ ID NO: 7052035 - DNA, 22 bp, Homo sapiens
catttaaaggttgtgggtaaaa

SEQ ID NO: 7052036 - DNA, 22 bp, Homo sapiens
catgggcagttggcagggctca

SEQ ID NO: 7052037 - DNA, 22 bp, Homo sapiens
catgggctctctgagctccagg

SEQ ID NO: 7052038 - DNA, 22 bp, Homo sapiens
tccatcaccacagaggacagag

SEQ ID NO: 7052039 - DNA, 22 bp, Homo sapiens
tccatcaccatttctgcgagct

SEQ ID NO: 7052040 - DNA, 22 bp, Homo sapiens
tccattttagaagaaaatccac

SEQ ID NO: 7052041 - DNA, 22 bp, Homo sapiens
tccattttagaagaaaatccac

SEQ ID NO: 7052042 - DNA, 22 bp, Homo sapiens
tccattttagagatgaagaaac

SEQ ID NO: 7052043 - DNA, 22 bp, Homo sapiens
tccattttagagatgaagaaac

SEQ ID NO: 7052044 - DNA, 22 bp, Homo sapiens
tccattttagagatgaagaaac

SEQ ID NO: 7052045 - DNA, 22 bp, Homo sapiens
tccattttcatctcatgtataa

SEQ ID NO: 7052046 - DNA, 22 bp, Homo sapiens
tccattttcatctcatgtataa

SEQ ID NO: 7052047 - DNA, 22 bp, Homo sapiens
tccattttcatctcatgtataa

SEQ ID NO: 7052048 - DNA, 22 bp, Homo sapiens
tccattttcatctcatgtataa

SEQ ID NO: 7052049 - DNA, 22 bp, Homo sapiens
tccattttctaagtatcactta

SEQ ID NO: 7052050 - DNA, 22 bp, Homo sapiens
tccattttctaagtatcactta

SEQ ID NO: 7052051 - DNA, 22 bp, Homo sapiens
tccattttctaagtatcactta

SEQ ID NO: 7052052 - DNA, 22 bp, Homo sapiens
tccattttcttgctctaggtaa

SEQ ID NO: 7052053 - DNA, 22 bp, Homo sapiens
tccattttgtaggtatgctaca

SEQ ID NO: 7052054 - DNA, 22 bp, Homo sapiens
tccattttgtaggtatgctaca

SEQ ID NO: 7052055 - DNA, 22 bp, Homo sapiens
tccattttgtaggtatgctaca

SEQ ID NO: 7052056 - DNA, 22 bp, Homo sapiens
tccatttttcatgactcctcaa

SEQ ID NO: 7052057 - DNA, 22 bp, Homo sapiens
tccatttttcatgactcctcaa

SEQ ID NO: 7052058 - DNA, 22 bp, Homo sapiens
tccaggagatacactgcaccag

SEQ ID NO: 7052059 - DNA, 17 bp, Homo sapiens
tccaggagaggcaatgg

SEQ ID NO: 7052060 - DNA, 19 bp, Homo sapiens
tccaggagcaaagccagtt

SEQ ID NO: 7052061 - DNA, 22 bp, Homo sapiens
catgggaggcctgctgctggtg

SEQ ID NO: 7052062 - DNA, 22 bp, Homo sapiens
catgggcaccttaaaatgaggc

SEQ ID NO: 7052063 - DNA, 22 bp, Homo sapiens
catgggaggtctgcaaggtgct

SEQ ID NO: 7052064 - DNA, 22 bp, Homo sapiens
cattcttacacaatattttaat

SEQ ID NO: 7052065 - DNA, 17 bp, Homo sapiens
cattctgtaatctttct

SEQ ID NO: 7052066 - DNA, 22 bp, Homo sapiens
cattctctgatcttcacatacc

SEQ ID NO: 7052067 - DNA, 22 bp, Homo sapiens
cattctctctacttgttttcaa

SEQ ID NO: 7052068 - DNA, 22 bp, Homo sapiens
cattctgagtcactctttagca

SEQ ID NO: 7052069 - DNA, 22 bp, Homo sapiens
tcccaccaggtgaccatttcat

SEQ ID NO: 7052070 - DNA, 22 bp, Homo sapiens
tcccacccatcctgcatctctt

SEQ ID NO: 7052071 - DNA, 22 bp, Homo sapiens
cattctctacactcctgccctg

SEQ ID NO: 7052072 - DNA, 22 bp, Homo sapiens
cattctcaatagtagatgagta

SEQ ID NO: 7052073 - DNA, 22 bp, Homo sapiens
cattctcaatagtagatgagta

SEQ ID NO: 7052074 - DNA, 22 bp, Homo sapiens
cattctcaatagtagatgagta

SEQ ID NO: 7052075 - DNA, 22 bp, Homo sapiens
cattatattacagcactgttaa

SEQ ID NO: 7052076 - DNA, 22 bp, Homo sapiens
tcctgggcttaagtgatcctcc

SEQ ID NO: 7052077 - DNA, 22 bp, Homo sapiens
tcctgggagcatggtgccgtga

SEQ ID NO: 7052078 - DNA, 22 bp, Homo sapiens
tcctgggagcccttgctccacc

SEQ ID NO: 7052079 - DNA, 22 bp, Homo sapiens
tcctgggagagtttgattcatt

SEQ ID NO: 7052080 - DNA, 22 bp, Homo sapiens
tcctgggagacccagctgtgga

SEQ ID NO: 7052081 - DNA, 22 bp, Homo sapiens
tcctgggactctttatcagaga

SEQ ID NO: 7052082 - DNA, 22 bp, Homo sapiens
tcctggcagggtggcagcgggt

SEQ ID NO: 7052083 - DNA, 22 bp, Homo sapiens
tcctggcaggtcagcaggagca

SEQ ID NO: 7052084 - DNA, 22 bp, Homo sapiens
ccaagggaaaccgagaggctgg

SEQ ID NO: 7052085 - DNA, 22 bp, Homo sapiens
ccaaggcttcctgacctacatg

SEQ ID NO: 7052086 - DNA, 22 bp, Homo sapiens
ccaaggcttcccagagatgctc

SEQ ID NO: 7052087 - DNA, 22 bp, Homo sapiens
ccaaggcttcccagagatgctc

SEQ ID NO: 7052088 - DNA, 22 bp, Homo sapiens
ccaaggcttcccagagatgctc

SEQ ID NO: 7052089 - DNA, 22 bp, Homo sapiens
ccaaggcttcccagagatgctc

SEQ ID NO: 7052090 - DNA, 22 bp, Homo sapiens
ccaaggctcctcagctggtctt

SEQ ID NO: 7052091 - DNA, 22 bp, Homo sapiens
ccaaggctcctcagctggtctt

SEQ ID NO: 7052092 - DNA, 22 bp, Homo sapiens
ccaaggctggagggcttatgta

SEQ ID NO: 7052093 - DNA, 22 bp, Homo sapiens
ccaaggctggagtgcagtggcg

SEQ ID NO: 7052094 - DNA, 22 bp, Homo sapiens
ccaaggctgtcattcagtagct

SEQ ID NO: 7052095 - DNA, 20 bp, Homo sapiens
tcctaataacctgaagaaat

SEQ ID NO: 7052096 - DNA, 22 bp, Homo sapiens
tcctagaacagcccacctggaa

SEQ ID NO: 7052097 - DNA, 22 bp, Homo sapiens
tcctagaactccaggacagtcc

SEQ ID NO: 7052098 - DNA, 22 bp, Homo sapiens
ccactgctaacttgctgcagct

SEQ ID NO: 7052099 - DNA, 22 bp, Homo sapiens
tccttcctgcaggccaagtcct

SEQ ID NO: 7052100 - DNA, 22 bp, Homo sapiens
tccttcctgctctaacattcag

SEQ ID NO: 7052101 - DNA, 22 bp, Homo sapiens
tccttgggtcagtgagtgaggt

SEQ ID NO: 7052102 - DNA, 19 bp, Homo sapiens
tcctggggaggggcatggc

SEQ ID NO: 7052103 - DNA, 22 bp, Homo sapiens
tcctgggcttgctcctccagct

SEQ ID NO: 7052104 - DNA, 22 bp, Homo sapiens
tcctgggcttgctcctccagct

SEQ ID NO: 7052105 - DNA, 22 bp, Homo sapiens
tcctgggcttagtggctaggtc

SEQ ID NO: 7052106 - DNA, 22 bp, Homo sapiens
tcctgggcttcacagactctgt

SEQ ID NO: 7052107 - DNA, 22 bp, Homo sapiens
ccactgttggcccgaaggggtc

SEQ ID NO: 7052108 - DNA, 22 bp, Homo sapiens
ccactgtttttcagttaacttt

SEQ ID NO: 7052109 - DNA, 22 bp, Homo sapiens
ccacttcatcagtgctccattt

SEQ ID NO: 7052110 - DNA, 22 bp, Homo sapiens
ccacttgaaacttagtggcata

SEQ ID NO: 7052111 - DNA, 22 bp, Homo sapiens
ccactgctagagatgcatcccc

SEQ ID NO: 7052112 - DNA, 22 bp, Homo sapiens
ccactgctagagatgcatcccc

SEQ ID NO: 7052113 - DNA, 22 bp, Homo sapiens
ccactgtcttttccaggctgaa

SEQ ID NO: 7052114 - DNA, 22 bp, Homo sapiens
tctaagcctgtgtcctctgcag

SEQ ID NO: 7052115 - DNA, 22 bp, Homo sapiens
tctaaggagcgctccagaaaaa

SEQ ID NO: 7052116 - DNA, 22 bp, Homo sapiens
tctaatctacaaaaggaaattc

SEQ ID NO: 7052117 - DNA, 22 bp, Homo sapiens
ccagagaaccatctgcttgagg

SEQ ID NO: 7052118 - DNA, 19 bp, Homo sapiens
ccagagacattggcatctt

SEQ ID NO: 7052119 - DNA, 22 bp, Homo sapiens
taataattggcaatgttgagca

SEQ ID NO: 7052120 - DNA, 22 bp, Homo sapiens
taatacacaagggccagctctt

SEQ ID NO: 7052121 - DNA, 22 bp, Homo sapiens
taatacacactctcattcctaa

SEQ ID NO: 7052122 - DNA, 22 bp, Homo sapiens
taatacactgctttttgtaact

SEQ ID NO: 7052123 - DNA, 22 bp, Homo sapiens
caggcagatgctgacaagagtt

SEQ ID NO: 7052124 - DNA, 22 bp, Homo sapiens
caggcagcagccactctggtat

SEQ ID NO: 7052125 - DNA, 21 bp, Homo sapiens
taataattccactacagagta

SEQ ID NO: 7052126 - DNA, 22 bp, Homo sapiens
caggcagagttagtgatttagg

SEQ ID NO: 7052127 - DNA, 22 bp, Homo sapiens
caggcacctcacgtgggtccca

SEQ ID NO: 7052128 - DNA, 22 bp, Homo sapiens
caggcacctcacgtgggtccca

SEQ ID NO: 7052129 - DNA, 22 bp, Homo sapiens
caggcacctgtgtgtctcaggg

SEQ ID NO: 7052130 - DNA, 22 bp, Homo sapiens
caggcacctttgtgcatgggca

SEQ ID NO: 7052131 - DNA, 22 bp, Homo sapiens
caggcaccacactaggggctga

SEQ ID NO: 7052132 - DNA, 22 bp, Homo sapiens
caggcaccccaggtgagcactg

SEQ ID NO: 7052133 - DNA, 22 bp, Homo sapiens
caggcaccccaggtgagcactg

SEQ ID NO: 7052134 - DNA, 22 bp, Homo sapiens
caggcaccaatagggatcgtgg

SEQ ID NO: 7052135 - DNA, 22 bp, Homo sapiens
taagtcatcccataacagtgct

SEQ ID NO: 7052136 - DNA, 22 bp, Homo sapiens
cagctcagacgcaggtcgagca

SEQ ID NO: 7052137 - DNA, 22 bp, Homo sapiens
cagctattttgcctatcatggt

SEQ ID NO: 7052138 - DNA, 22 bp, Homo sapiens
cagctcaagtttcccaggtcag

SEQ ID NO: 7052139 - DNA, 22 bp, Homo sapiens
cagctattggcaagaagtggtg

SEQ ID NO: 7052140 - DNA, 22 bp, Homo sapiens
gtgcttctcttcacacccaact

SEQ ID NO: 7052141 - DNA, 22 bp, Homo sapiens
gtgcttaacctagtttctagta

SEQ ID NO: 7052142 - DNA, 22 bp, Homo sapiens
taatacagaagtgtattaaaat

SEQ ID NO: 7052143 - DNA, 22 bp, Homo sapiens
taatacagacaacttgccaaat

SEQ ID NO: 7052144 - DNA, 22 bp, Homo sapiens
taatacagatacaaaggaggac

SEQ ID NO: 7052145 - DNA, 22 bp, Homo sapiens
taatatctggcattcaaacatg

SEQ ID NO: 7052146 - DNA, 22 bp, Homo sapiens
taatatctggcattcaaacatg

SEQ ID NO: 7052147 - DNA, 22 bp, Homo sapiens
taatatttctaccctgctgcct

SEQ ID NO: 7052148 - DNA, 22 bp, Homo sapiens
taatcacaattcagatgtctta

SEQ ID NO: 7052149 - DNA, 22 bp, Homo sapiens
taatcatatgggtaatccaatg

SEQ ID NO: 7052150 - DNA, 22 bp, Homo sapiens
taatcatatgggtaatccaatg

SEQ ID NO: 7052151 - DNA, 22 bp, Homo sapiens
caggcatgcttctgtctgggca

SEQ ID NO: 7052152 - DNA, 22 bp, Homo sapiens
caggcatggagaggcagagact

SEQ ID NO: 7052153 - DNA, 22 bp, Homo sapiens
caggcatttcgcaaaggctgag

SEQ ID NO: 7052154 - DNA, 22 bp, Homo sapiens
tacaaaacagtgctctggtcct

SEQ ID NO: 7052155 - DNA, 22 bp, Homo sapiens
caggccagggttgagaagagaa

SEQ ID NO: 7052156 - DNA, 22 bp, Homo sapiens
caggccagtgtgcttcccaggc

SEQ ID NO: 7052157 - DNA, 22 bp, Homo sapiens
tactttattgtaaatgctgatg

SEQ ID NO: 7052158 - DNA, 22 bp, Homo sapiens
tactttacagtattagataatt

SEQ ID NO: 7052159 - DNA, 18 bp, Homo sapiens
tactgtggatcaggggtt

SEQ ID NO: 7052160 - DNA, 22 bp, Homo sapiens
tactgtgggatgttgtgattag

SEQ ID NO: 7052161 - DNA, 22 bp, Homo sapiens
caggctagattggggccagtag

SEQ ID NO: 7052162 - DNA, 22 bp, Homo sapiens
tacttgttatcatcttttcctt

SEQ ID NO: 7052163 - DNA, 22 bp, Homo sapiens
tactttaaaaactgataattca

SEQ ID NO: 7052164 - DNA, 22 bp, Homo sapiens
tacatttacagagccttctctg

SEQ ID NO: 7052165 - DNA, 22 bp, Homo sapiens
tacatttataaggcttctctgt

SEQ ID NO: 7052166 - DNA, 22 bp, Homo sapiens
tacatttataaggcttctctgt

SEQ ID NO: 7052167 - DNA, 22 bp, Homo sapiens
tacatttataaggcttctctgt

SEQ ID NO: 7052168 - DNA, 22 bp, Homo sapiens
caggcgagggccctgaggagcc

SEQ ID NO: 7052169 - DNA, 22 bp, Homo sapiens
caggcctgaccctgagcttcac

SEQ ID NO: 7052170 - DNA, 22 bp, Homo sapiens
caggcctgagacatctgagata

SEQ ID NO: 7052171 - DNA, 22 bp, Homo sapiens
caggcctgcaggaaaggctccc

SEQ ID NO: 7052172 - DNA, 22 bp, Homo sapiens
caggcctggagtgcaatggcac

SEQ ID NO: 7052173 - DNA, 22 bp, Homo sapiens
tacattgctttctaatacatct

SEQ ID NO: 7052174 - DNA, 22 bp, Homo sapiens
caggcctctccttagtctggca

SEQ ID NO: 7052175 - DNA, 22 bp, Homo sapiens
caggcctctatggtcagctgag

SEQ ID NO: 7052176 - DNA, 22 bp, Homo sapiens
caggcctcctatgagcactagc

SEQ ID NO: 7052177 - DNA, 22 bp, Homo sapiens
caggcccagggagggagaccaa

SEQ ID NO: 7052178 - DNA, 22 bp, Homo sapiens
caggctgccgtggggtccaggc

SEQ ID NO: 7052179 - DNA, 22 bp, Homo sapiens
caggctgccgtggggtccaggc

SEQ ID NO: 7052180 - DNA, 22 bp, Homo sapiens
caggctggagttcagtggtgtg

SEQ ID NO: 7052181 - DNA, 22 bp, Homo sapiens
caggctggcaatgcgtcaagca

SEQ ID NO: 7052182 - DNA, 22 bp, Homo sapiens
caggctgcagtgcagtggctat

SEQ ID NO: 7052183 - DNA, 22 bp, Homo sapiens
caggctgccaaggctggggagg

SEQ ID NO: 7052184 - DNA, 22 bp, Homo sapiens
caggctgccgtgaagcaggcct

SEQ ID NO: 7052185 - DNA, 22 bp, Homo sapiens
caggctgccgtgaagcaggcct

SEQ ID NO: 7052186 - DNA, 22 bp, Homo sapiens
caggctggcaatgcgtcaagca

SEQ ID NO: 7052187 - DNA, 22 bp, Homo sapiens
caggctgggaacgccacccgct

SEQ ID NO: 7052188 - DNA, 22 bp, Homo sapiens
caggctgggaacgccacccgct

SEQ ID NO: 7052189 - DNA, 22 bp, Homo sapiens
caggctgggaacgccacccgct

SEQ ID NO: 7052190 - DNA, 22 bp, Homo sapiens
caggctgggactgacccctgct

SEQ ID NO: 7052191 - DNA, 22 bp, Homo sapiens
caggctgggactgacccctgct

SEQ ID NO: 7052192 - DNA, 22 bp, Homo sapiens
caggctgggcagcctccccggc

SEQ ID NO: 7052193 - DNA, 22 bp, Homo sapiens
cagggacagagactgcaccttg

SEQ ID NO: 7052194 - DNA, 22 bp, Homo sapiens
cagggacagcactaaactcttg

SEQ ID NO: 7052195 - DNA, 22 bp, Homo sapiens
cagggacagcactaaactcttg

SEQ ID NO: 7052196 - DNA, 20 bp, Homo sapiens
cagggacagcagtgggtttt

SEQ ID NO: 7052197 - DNA, 22 bp, Homo sapiens
cagggacaatggcagagcctga

SEQ ID NO: 7052198 - DNA, 22 bp, Homo sapiens
cagggacaatggcagagcctga

SEQ ID NO: 7052199 - DNA, 22 bp, Homo sapiens
cagggacagccttggggtggcg

SEQ ID NO: 7052200 - DNA, 22 bp, Homo sapiens
tagattctaagattctaagaat

SEQ ID NO: 7052201 - DNA, 22 bp, Homo sapiens
tagattctacagctcagctgtc

SEQ ID NO: 7052202 - DNA, 22 bp, Homo sapiens
tagattctactgtcacttagtt

SEQ ID NO: 7052203 - DNA, 22 bp, Homo sapiens
tagattctcagaattttagaaa

SEQ ID NO: 7052204 - DNA, 22 bp, Homo sapiens
tagattctccacatgtagcaat

SEQ ID NO: 7052205 - DNA, 22 bp, Homo sapiens
tagattctcccacctgccaggc

SEQ ID NO: 7052206 - DNA, 22 bp, Homo sapiens
tagattctcccatcatgagatg

SEQ ID NO: 7052207 - DNA, 22 bp, Homo sapiens
tagattctctgctggctgacat

SEQ ID NO: 7052208 - DNA, 22 bp, Homo sapiens
tagattctgaccctctttttac

SEQ ID NO: 7052209 - DNA, 22 bp, Homo sapiens
tagattctggagagacagcagt

SEQ ID NO: 7052210 - DNA, 22 bp, Homo sapiens
tagattctgtaaataatcaagg

SEQ ID NO: 7052211 - DNA, 22 bp, Homo sapiens
tagattctgtatgtctgctctc

SEQ ID NO: 7052212 - DNA, 20 bp, Homo sapiens
tagattctgtctgtccaaac

SEQ ID NO: 7052213 - DNA, 22 bp, Homo sapiens
tagattctgtgagagtcaaagt

SEQ ID NO: 7052214 - DNA, 22 bp, Homo sapiens
tagattctgtttcctctggttt

SEQ ID NO: 7052215 - DNA, 22 bp, Homo sapiens
tagattcttagtttcatagaat

SEQ ID NO: 7052216 - DNA, 22 bp, Homo sapiens
tagattcttctaggtctttagc

SEQ ID NO: 7052217 - DNA, 22 bp, Homo sapiens
tagattcttcttttgagtctct

SEQ ID NO: 7052218 - DNA, 22 bp, Homo sapiens
tagattcttgaaccagtgcctc

SEQ ID NO: 7052219 - DNA, 22 bp, Homo sapiens
caggctgtctgaatggaggccc

SEQ ID NO: 7052220 - DNA, 22 bp, Homo sapiens
caggcttggagggcagtggcat

SEQ ID NO: 7052221 - DNA, 22 bp, Homo sapiens
caggcttggcagggaggctggt

SEQ ID NO: 7052222 - DNA, 22 bp, Homo sapiens
caggcttgggagcagagccact

SEQ ID NO: 7052223 - DNA, 22 bp, Homo sapiens
tcaagcagggtagcaagctggt

SEQ ID NO: 7052224 - DNA, 22 bp, Homo sapiens
tcaagcaaagatacaaatggaa

SEQ ID NO: 7052225 - DNA, 22 bp, Homo sapiens
tcaagcaaagtttagctggtta

SEQ ID NO: 7052226 - DNA, 22 bp, Homo sapiens
tcaagcaagtgtttggtgtaaa

SEQ ID NO: 7052227 - DNA, 22 bp, Homo sapiens
tcaagcaagttgcatattgcta

SEQ ID NO: 7052228 - DNA, 22 bp, Homo sapiens
tattttcaccatgtatccctgt

SEQ ID NO: 7052229 - DNA, 22 bp, Homo sapiens
tattttatctgccagagtggag

SEQ ID NO: 7052230 - DNA, 22 bp, Homo sapiens
tattttatctgccagagtggag

SEQ ID NO: 7052231 - DNA, 22 bp, Homo sapiens
tattttcaccatgtatccctgt

SEQ ID NO: 7052232 - DNA, 22 bp, Homo sapiens
tattttcaccatgtatccctgt

SEQ ID NO: 7052233 - DNA, 22 bp, Homo sapiens
tcaaaacactattacctttaat

SEQ ID NO: 7052234 - DNA, 22 bp, Homo sapiens
tattttacagactactttagat

SEQ ID NO: 7052235 - DNA, 22 bp, Homo sapiens
tattttacagactactttagat

SEQ ID NO: 7052236 - DNA, 22 bp, Homo sapiens
tattttaaagtgaagggtcttg

SEQ ID NO: 7052237 - DNA, 22 bp, Homo sapiens
tattttaaagtgaagggtcttg

SEQ ID NO: 7052238 - DNA, 22 bp, Homo sapiens
tattttaaagactgccagccta

SEQ ID NO: 7052239 - DNA, 22 bp, Homo sapiens
tattttaaagactgccagccta

SEQ ID NO: 7052240 - DNA, 20 bp, Homo sapiens
cagtccaatcagaggccacc

SEQ ID NO: 7052241 - DNA, 22 bp, Homo sapiens
cagtcactggaatagctgagga

SEQ ID NO: 7052242 - DNA, 22 bp, Homo sapiens
cagtcagggacaccagctagga

SEQ ID NO: 7052243 - DNA, 22 bp, Homo sapiens
cagtcagggacaccagctagga

SEQ ID NO: 7052244 - DNA, 22 bp, Homo sapiens
cagtcaacagagagcccgtcag

SEQ ID NO: 7052245 - DNA, 22 bp, Homo sapiens
cagtcaccaccaggtggcagta

SEQ ID NO: 7052246 - DNA, 22 bp, Homo sapiens
cagtcactggaatagctgagga

SEQ ID NO: 7052247 - DNA, 22 bp, Homo sapiens
caggtgggtgtatgaatgcaaa

SEQ ID NO: 7052248 - DNA, 19 bp, Homo sapiens
caggtggtaatctgagcct

SEQ ID NO: 7052249 - DNA, 22 bp, Homo sapiens
cagtattttcaggatttggaag

SEQ ID NO: 7052250 - DNA, 22 bp, Homo sapiens
cagggtttctgttgagaagtcc

SEQ ID NO: 7052251 - DNA, 22 bp, Homo sapiens
caggtaggatggaagggctcaa

SEQ ID NO: 7052252 - DNA, 22 bp, Homo sapiens
caggtaggcagccggtctctgg

SEQ ID NO: 7052253 - DNA, 22 bp, Homo sapiens
caggtcagaggcgcagccccca

SEQ ID NO: 7052254 - DNA, 22 bp, Homo sapiens
caggtcagcacttggaggtgca

SEQ ID NO: 7052255 - DNA, 18 bp, Homo sapiens
caggtcagcctggcctca

SEQ ID NO: 7052256 - DNA, 22 bp, Homo sapiens
caggtccacagcccatcactgc

SEQ ID NO: 7052257 - DNA, 22 bp, Homo sapiens
caggtgcccagctcctgctgtg

SEQ ID NO: 7052258 - DNA, 22 bp, Homo sapiens
caggtgccgggaatgcagcaat

SEQ ID NO: 7052259 - DNA, 22 bp, Homo sapiens
caggtgctctgctgcaggtaag

SEQ ID NO: 7052260 - DNA, 22 bp, Homo sapiens
caggtgctgtcctgcacatgtc

SEQ ID NO: 7052261 - DNA, 18 bp, Homo sapiens
caggtgggtctcctgccc

SEQ ID NO: 7052262 - DNA, 22 bp, Homo sapiens
caggtgggtacatcacagagac

SEQ ID NO: 7052263 - DNA, 20 bp, Homo sapiens
tattatgacctgtgttctgg

SEQ ID NO: 7052264 - DNA, 22 bp, Homo sapiens
tattatgagccaggtgctgtct

SEQ ID NO: 7052265 - DNA, 22 bp, Homo sapiens
tattatgaggactggtgtaagg

SEQ ID NO: 7052266 - DNA, 22 bp, Homo sapiens
tattatgaggcttagggatgac

SEQ ID NO: 7052267 - DNA, 22 bp, Homo sapiens
tattatgaggggcagagggcat

SEQ ID NO: 7052268 - DNA, 22 bp, Homo sapiens
tattatgaggtatttggacttt

SEQ ID NO: 7052269 - DNA, 22 bp, Homo sapiens
tattatgatcccagccctggag

SEQ ID NO: 7052270 - DNA, 22 bp, Homo sapiens
tattatgatcgtgactcaagga

SEQ ID NO: 7052271 - DNA, 22 bp, Homo sapiens
tattatgattcggacgtggcag

SEQ ID NO: 7052272 - DNA, 23 bp, Homo sapiens
caggtggctccacgaggggtggg

SEQ ID NO: 7052273 - DNA, 22 bp, Homo sapiens
caggtggctaacggcctcatag

SEQ ID NO: 7052274 - DNA, 19 bp, Homo sapiens
caggtggcgctctacaggg

SEQ ID NO: 7052275 - DNA, 22 bp, Homo sapiens
tattaaatgttatttgggttgt

SEQ ID NO: 7052276 - DNA, 22 bp, Homo sapiens
caggtggagctgactgagggca

SEQ ID NO: 7052277 - DNA, 22 bp, Homo sapiens
caggtggatctctaaggactga

SEQ ID NO: 7052278 - DNA, 22 bp, Homo sapiens
caggtggcagaggtctctggaa

SEQ ID NO: 7052279 - DNA, 22 bp, Homo sapiens
caggtggcagaggtctctggaa

SEQ ID NO: 7052280 - DNA, 22 bp, Homo sapiens
caggtggcagaggtctctggaa

SEQ ID NO: 7052281 - DNA, 22 bp, Homo sapiens
caggtggcagtgcctgcattct

SEQ ID NO: 7052282 - DNA, 22 bp, Homo sapiens
caggtggcatgactgcctacaa

SEQ ID NO: 7052283 - DNA, 22 bp, Homo sapiens
caggtggcattgtcccgccagc

SEQ ID NO: 7052284 - DNA, 22 bp, Homo sapiens
caggtggccagtactcaaggat

SEQ ID NO: 7052285 - DNA, 20 bp, Homo sapiens
cagggctctgggcctggcct

SEQ ID NO: 7052286 - DNA, 22 bp, Homo sapiens
cagggctgaaatcaaggtgtag

SEQ ID NO: 7052287 - DNA, 22 bp, Homo sapiens
cagggctgaaatcaaggtgtag

SEQ ID NO: 7052288 - DNA, 22 bp, Homo sapiens
cagggctgaactgagcttgtga

SEQ ID NO: 7052289 - DNA, 22 bp, Homo sapiens
cagggctgaagaaattcaaaag

SEQ ID NO: 7052290 - DNA, 22 bp, Homo sapiens
cagggctgaagaaattcaaaag

SEQ ID NO: 7052291 - DNA, 22 bp, Homo sapiens
cagggctgagaatttagagaca

SEQ ID NO: 7052292 - DNA, 22 bp, Homo sapiens
cagggctgagaatttagagaca

SEQ ID NO: 7052293 - DNA, 22 bp, Homo sapiens
taggctgggcctgccttccagg

SEQ ID NO: 7052294 - DNA, 22 bp, Homo sapiens
taggctgggctgagctggacgg

SEQ ID NO: 7052295 - DNA, 22 bp, Homo sapiens
taggctgggctgagctggacgg

SEQ ID NO: 7052296 - DNA, 22 bp, Homo sapiens
taggctgggctgagctggacgg

SEQ ID NO: 7052297 - DNA, 18 bp, Homo sapiens
taggctgggggctgtagt

SEQ ID NO: 7052298 - DNA, 18 bp, Homo sapiens
taggctgggggctgtagt

SEQ ID NO: 7052299 - DNA, 22 bp, Homo sapiens
taggctgggggtaggaattgag

SEQ ID NO: 7052300 - DNA, 22 bp, Homo sapiens
taggctgggggtaggaattgag

SEQ ID NO: 7052301 - DNA, 22 bp, Homo sapiens
cagggctggatttcatttctag

SEQ ID NO: 7052302 - DNA, 23 bp, Homo sapiens
cagggctggtagggaagagcgtg

SEQ ID NO: 7052303 - DNA, 23 bp, Homo sapiens
cagggctggtagggaagagcgtg

SEQ ID NO: 7052304 - DNA, 22 bp, Homo sapiens
cagggctggtttgtcgaagaaa

SEQ ID NO: 7052305 - DNA, 22 bp, Homo sapiens
cagggctggtttgtcgaagaaa

SEQ ID NO: 7052306 - DNA, 22 bp, Homo sapiens
cagggctgtaaattagtgctga

SEQ ID NO: 7052307 - DNA, 22 bp, Homo sapiens
cagggctgtctccaaaggcccc

SEQ ID NO: 7052308 - DNA, 22 bp, Homo sapiens
cagggctgtctccaaaggcccc

SEQ ID NO: 7052309 - DNA, 22 bp, Homo sapiens
caggggtggctgcagcagaggt

SEQ ID NO: 7052310 - DNA, 22 bp, Homo sapiens
caggggtgtttttggccaggag

SEQ ID NO: 7052311 - DNA, 22 bp, Homo sapiens
cagggtagacagtaggtgtctg

SEQ ID NO: 7052312 - DNA, 22 bp, Homo sapiens
cagggtagggcaagggaacctg

SEQ ID NO: 7052313 - DNA, 22 bp, Homo sapiens
cagggtagtaatttaatacaag

SEQ ID NO: 7052314 - DNA, 22 bp, Homo sapiens
cagggtcaagagactccagcag

SEQ ID NO: 7052315 - DNA, 22 bp, Homo sapiens
cagggtcatggcacctgcacgg

SEQ ID NO: 7052316 - DNA, 22 bp, Homo sapiens
cagggctgtgcccatcttcccc

SEQ ID NO: 7052317 - DNA, 22 bp, Homo sapiens
cagggctgtgcccatcttcccc

SEQ ID NO: 7052318 - DNA, 17 bp, Homo sapiens
cagggctgtctgcctag

SEQ ID NO: 7052319 - DNA, 17 bp, Homo sapiens
cagggctgtctgcctag

SEQ ID NO: 7052320 - DNA, 22 bp, Homo sapiens
cagggctgtggaaaactggtgc

SEQ ID NO: 7052321 - DNA, 22 bp, Homo sapiens
cagggctgtggaaaactggtgc

SEQ ID NO: 7052322 - DNA, 22 bp, Homo sapiens
cagggctgtggctttgtgctgt

SEQ ID NO: 7052323 - DNA, 22 bp, Homo sapiens
cagggggctcaaaggagagtgc

SEQ ID NO: 7052324 - DNA, 22 bp, Homo sapiens
cagggccattggcgtggctgtc

SEQ ID NO: 7052325 - DNA, 22 bp, Homo sapiens
cagggcccaggccactgggttg

SEQ ID NO: 7052326 - DNA, 22 bp, Homo sapiens
cagggcccagtccctgctgtca

SEQ ID NO: 7052327 - DNA, 22 bp, Homo sapiens
cagggcccagtccctgctgtca

SEQ ID NO: 7052328 - DNA, 22 bp, Homo sapiens
cagggcccatggctcaggtagg

SEQ ID NO: 7052329 - DNA, 22 bp, Homo sapiens
cagggccccagggatgtctgct

SEQ ID NO: 7052330 - DNA, 23 bp, Homo sapiens
cagggccctgctcaatttctcca

SEQ ID NO: 7052331 - DNA, 21 bp, Homo sapiens
tagcttccagctcaagctgag

SEQ ID NO: 7052332 - DNA, 22 bp, Homo sapiens
tagcttccctagctaaagaggt

SEQ ID NO: 7052333 - DNA, 22 bp, Homo sapiens
tagcttctaatacttaccaatt

SEQ ID NO: 7052334 - DNA, 22 bp, Homo sapiens
tagcttccctgctggatcataa

SEQ ID NO: 7052335 - DNA, 22 bp, Homo sapiens
tagctttaaaaatcatcaaagc

SEQ ID NO: 7052336 - DNA, 22 bp, Homo sapiens
tagctttaagacatggtgaatg

SEQ ID NO: 7052337 - DNA, 22 bp, Homo sapiens
taggagggccctgaaaatggca

SEQ ID NO: 7052338 - DNA, 22 bp, Homo sapiens
taggcatgcaaataaatgtgca

SEQ ID NO: 7052339 - DNA, 22 bp, Homo sapiens
cagggccactgtagatgaggag

SEQ ID NO: 7052340 - DNA, 22 bp, Homo sapiens
cagggagcaggctctgtccatc

SEQ ID NO: 7052341 - DNA, 22 bp, Homo sapiens
cagggagccccaattccatgcc

SEQ ID NO: 7052342 - DNA, 22 bp, Homo sapiens
cagggccagttctcgcagcagt

SEQ ID NO: 7052343 - DNA, 22 bp, Homo sapiens
cagggccagggctatggtgaag

SEQ ID NO: 7052344 - DNA, 22 bp, Homo sapiens
cagggccatgaggcacagggtc

SEQ ID NO: 7052345 - DNA, 22 bp, Homo sapiens
cagggccatgaggcacagggtc

SEQ ID NO: 7052346 - DNA, 22 bp, Homo sapiens
cagggccatatcttgtgcacca

SEQ ID NO: 7052347 - DNA, 22 bp, Homo sapiens
cagggccatatcttgtgcacca

SEQ ID NO: 7052348 - DNA, 22 bp, Homo sapiens
tagcttaaggagtaccagatca

SEQ ID NO: 7052349 - DNA, 22 bp, Homo sapiens
cagggccattggcgtggctgtc

SEQ ID NO: 7052350 - DNA, 22 bp, Homo sapiens
cagggccattggcgtggctgtc

SEQ ID NO: 7052351 - DNA, 22 bp, Homo sapiens
cagggagatcttggctcctggt

SEQ ID NO: 7052352 - DNA, 22 bp, Homo sapiens
cagggagcaggctctgtccatc

SEQ ID NO: 7052353 - DNA, 22 bp, Homo sapiens
cagggagcagcccctagaagta

SEQ ID NO: 7052354 - DNA, 22 bp, Homo sapiens
tagattctttgctagatcattg

SEQ ID NO: 7052355 - DNA, 22 bp, Homo sapiens
tagatttgatgtaagcatagtc

SEQ ID NO: 7052356 - DNA, 22 bp, Homo sapiens
tagatttgtgtttgggatgaga

SEQ ID NO: 7052357 - DNA, 22 bp, Homo sapiens
tagatttgtttccttctctcca

SEQ ID NO: 7052358 - DNA, 22 bp, Homo sapiens
ttggtttagagagtgtggttac

SEQ ID NO: 7052359 - DNA, 22 bp, Homo sapiens
ttggtttaggaactggcttgga

SEQ ID NO: 7052360 - DNA, 22 bp, Homo sapiens
ttggtttactaggattcaaatt

SEQ ID NO: 7052361 - DNA, 22 bp, Homo sapiens
ttgtctctgtgtggcttcccta

SEQ ID NO: 7052362 - DNA, 22 bp, Homo sapiens
ttgtctgaattcttctaggcag

SEQ ID NO: 7052363 - DNA, 22 bp, Homo sapiens
ttgtctgcatgattctaggcag

SEQ ID NO: 7052364 - DNA, 22 bp, Homo sapiens
ttgtctgcattgtttctatggg

SEQ ID NO: 7052365 - DNA, 22 bp, Homo sapiens
ttgtctgctcctcccagcctca

SEQ ID NO: 7052366 - DNA, 22 bp, Homo sapiens
ttgtctgcttgatgccaagcat

SEQ ID NO: 7052367 - DNA, 22 bp, Homo sapiens
ttgtctgcttgttcagatggaa

SEQ ID NO: 7052368 - DNA, 22 bp, Homo sapiens
ttgtgaaatgtttcaaaatagt

SEQ ID NO: 7052369 - DNA, 22 bp, Homo sapiens
ttgtgaatagtgccgcaataaa

SEQ ID NO: 7052370 - DNA, 22 bp, Homo sapiens
ttgtgaatagtgccgctataaa

SEQ ID NO: 7052371 - DNA, 22 bp, Homo sapiens
ttggtccctcatggacacatga

SEQ ID NO: 7052372 - DNA, 22 bp, Homo sapiens
ttggggtgttggatggagcaag

SEQ ID NO: 7052373 - DNA, 22 bp, Homo sapiens
ttggtcagtcagagaatggagt

SEQ ID NO: 7052374 - DNA, 22 bp, Homo sapiens
ttggtgagtatggacacagaga

SEQ ID NO: 7052375 - DNA, 22 bp, Homo sapiens
ttggtggagtcattggcatatg

SEQ ID NO: 7052376 - DNA, 22 bp, Homo sapiens
ttggttaaaatcaaattaatca

SEQ ID NO: 7052377 - DNA, 23 bp, Homo sapiens
ttgcaaatttcagttagttcatg

SEQ ID NO: 7052378 - DNA, 22 bp, Homo sapiens
ttgcaaattgcaagagttggat

SEQ ID NO: 7052379 - DNA, 22 bp, Homo sapiens
ttgcaaattccaatccaatatt

SEQ ID NO: 7052380 - DNA, 22 bp, Homo sapiens
ttgcaaattcatggatctgaat

SEQ ID NO: 7052381 - DNA, 22 bp, Homo sapiens
ttgcaaattattttagtccctt

SEQ ID NO: 7052382 - DNA, 22 bp, Homo sapiens
ttgcaatagccttatttccaaa

SEQ ID NO: 7052383 - DNA, 22 bp, Homo sapiens
ttgcaagacacttggaagcaca

SEQ ID NO: 7052384 - DNA, 22 bp, Homo sapiens
ttgttttaacctagtgtttatg

SEQ ID NO: 7052385 - DNA, 22 bp, Homo sapiens
ttgtttgaggtcactgatattt

SEQ ID NO: 7052386 - DNA, 20 bp, Homo sapiens
ttgtttctgctattttctaa

SEQ ID NO: 7052387 - DNA, 22 bp, Homo sapiens
ttgtttcctttctatacaggat

SEQ ID NO: 7052388 - DNA, 22 bp, Homo sapiens
ttgtttaagccacccaatctgt

SEQ ID NO: 7052389 - DNA, 22 bp, Homo sapiens
ttgtttccattgcagactgtgt

SEQ ID NO: 7052390 - DNA, 22 bp, Homo sapiens
ttgttacagcagtgatttcaga

SEQ ID NO: 7052391 - DNA, 22 bp, Homo sapiens
ttgttaaaaatagatttccagg

SEQ ID NO: 7052392 - DNA, 22 bp, Homo sapiens
ttgttaaaaatagatttccagg

SEQ ID NO: 7052393 - DNA, 20 bp, Homo sapiens
ttgttagaggaatgccatag

SEQ ID NO: 7052394 - DNA, 22 bp, Homo sapiens
ttgtgtgtttgtagaaaatcca

SEQ ID NO: 7052395 - DNA, 22 bp, Homo sapiens
ttgtgtgtgtaactttatgaga

SEQ ID NO: 7052396 - DNA, 22 bp, Homo sapiens
ttgtgaatggtgccgcaataaa

SEQ ID NO: 7052397 - DNA, 19 bp, Homo sapiens
ttgtgtgtcagtcagagtt

SEQ ID NO: 7052398 - DNA, 22 bp, Homo sapiens
ttgtgtgtcttcttcactgccc

SEQ ID NO: 7052399 - DNA, 22 bp, Homo sapiens
ttgtgtgtgagccttcaccaca

SEQ ID NO: 7052400 - DNA, 22 bp, Homo sapiens
tttatttcactctccggatact

SEQ ID NO: 7052401 - DNA, 22 bp, Homo sapiens
tttatttcttagtttgccacag

SEQ ID NO: 7052402 - DNA, 22 bp, Homo sapiens
tttatttggcatccagggagaa

SEQ ID NO: 7052403 - DNA, 22 bp, Homo sapiens
tttattatgatggacaccttcg

SEQ ID NO: 7052404 - DNA, 22 bp, Homo sapiens
tttattatgatggacaccttcg

SEQ ID NO: 7052405 - DNA, 22 bp, Homo sapiens
tttattatgtacaggcactata

SEQ ID NO: 7052406 - DNA, 22 bp, Homo sapiens
tttattatccagtgttgtcatg

SEQ ID NO: 7052407 - DNA, 22 bp, Homo sapiens
tttattatgatggacaccttcg

SEQ ID NO: 7052408 - DNA, 22 bp, Homo sapiens
tttattatgatggacaccttcg

SEQ ID NO: 7052409 - DNA, 22 bp, Homo sapiens
tttattatgtacaggcactata

SEQ ID NO: 7052410 - DNA, 22 bp, Homo sapiens
tttattattctctggagaatgt

SEQ ID NO: 7052411 - DNA, 22 bp, Homo sapiens
tttattattctgttctctctac

SEQ ID NO: 7052412 - DNA, 22 bp, Homo sapiens
tttattattctgttctctctac

SEQ ID NO: 7052413 - DNA, 22 bp, Homo sapiens
tttattaattagtgacccaatg

SEQ ID NO: 7052414 - DNA, 22 bp, Homo sapiens
tttattatagtggtggggactg

SEQ ID NO: 7052415 - DNA, 22 bp, Homo sapiens
tttattatagtggtggggactg

SEQ ID NO: 7052416 - DNA, 22 bp, Homo sapiens
tttattatagtggtggggactg

SEQ ID NO: 7052417 - DNA, 22 bp, Homo sapiens
tttatgtttgcattttcaaaga

SEQ ID NO: 7052418 - DNA, 22 bp, Homo sapiens
tttatgtttgcattttcaaaga

SEQ ID NO: 7052419 - DNA, 22 bp, Homo sapiens
tttattaaaactgttggctctg

SEQ ID NO: 7052420 - DNA, 22 bp, Homo sapiens
tttatagtagcatgatttataa

SEQ ID NO: 7052421 - DNA, 22 bp, Homo sapiens
tttatagtagcatgatttatag

SEQ ID NO: 7052422 - DNA, 20 bp, Homo sapiens
tttatagtgatcaatttata

SEQ ID NO: 7052423 - DNA, 22 bp, Homo sapiens
tttatataacagagactgctat

SEQ ID NO: 7052424 - DNA, 22 bp, Homo sapiens
tttataattatctctactctta

SEQ ID NO: 7052425 - DNA, 17 bp, Homo sapiens
tttataattggcctctt

SEQ ID NO: 7052426 - DNA, 22 bp, Homo sapiens
tttataattatctctactctta

SEQ ID NO: 7052427 - DNA, 23 bp, Homo sapiens
tttatacaagaaaccgctggcct

SEQ ID NO: 7052428 - DNA, 22 bp, Homo sapiens
tttatacatggagaatttttgc

SEQ ID NO: 7052429 - DNA, 22 bp, Homo sapiens
tttatacttcataatgtctatt

SEQ ID NO: 7052430 - DNA, 22 bp, Homo sapiens
tttatagatgtctgtattataa

SEQ ID NO: 7052431 - DNA, 22 bp, Homo sapiens
tttataaaatagactgggtcta

SEQ ID NO: 7052432 - DNA, 22 bp, Homo sapiens
tttataaacagtaccacggtgc

SEQ ID NO: 7052433 - DNA, 22 bp, Homo sapiens
tttactttctcaagtatatagg

SEQ ID NO: 7052434 - DNA, 22 bp, Homo sapiens
tttactttctcaagtatatagg

SEQ ID NO: 7052435 - DNA, 22 bp, Homo sapiens
tttactttgtgtcaagtcaaga

SEQ ID NO: 7052436 - DNA, 22 bp, Homo sapiens
tttacttttggtaaggtcattt

SEQ ID NO: 7052437 - DNA, 22 bp, Homo sapiens
tttactgaactgctagtacagg

SEQ ID NO: 7052438 - DNA, 22 bp, Homo sapiens
tttactgaatttggtatattcc

SEQ ID NO: 7052439 - DNA, 21 bp, Homo sapiens
tttactgagcacttactatgt

SEQ ID NO: 7052440 - DNA, 22 bp, Homo sapiens
tttactgagtgacctagaataa

SEQ ID NO: 7052441 - DNA, 22 bp, Homo sapiens
tttacaacctcatattctgatg

SEQ ID NO: 7052442 - DNA, 22 bp, Homo sapiens
tttacaacctcatattctgatg

SEQ ID NO: 7052443 - DNA, 22 bp, Homo sapiens
tttacaacctcatattctgatg

SEQ ID NO: 7052444 - DNA, 22 bp, Homo sapiens
tttacaacgttcctggtgctaa

SEQ ID NO: 7052445 - DNA, 22 bp, Homo sapiens
tttacaactttctgttctgtat

SEQ ID NO: 7052446 - DNA, 22 bp, Homo sapiens
tttacaaggcagaactgattaa

SEQ ID NO: 7052447 - DNA, 22 bp, Homo sapiens
tttacaaggcagttattttcct

SEQ ID NO: 7052448 - DNA, 22 bp, Homo sapiens
tttacgactgctaaatgcctgc

SEQ ID NO: 7052449 - DNA, 22 bp, Homo sapiens
tttactaacaccatacatgctg

SEQ ID NO: 7052450 - DNA, 21 bp, Homo sapiens
tttaatttgcatgtatgacgc

SEQ ID NO: 7052451 - DNA, 22 bp, Homo sapiens
tttacaacataggccccaagaa

SEQ ID NO: 7052452 - DNA, 22 bp, Homo sapiens
tttacaacccaagtccagagag

SEQ ID NO: 7052453 - DNA, 22 bp, Homo sapiens
tttaatgtttgagtcagtatat

SEQ ID NO: 7052454 - DNA, 22 bp, Homo sapiens
tttaattatatctgggcagtta

SEQ ID NO: 7052455 - DNA, 22 bp, Homo sapiens
tttaatgttaaatttgtagatg

SEQ ID NO: 7052456 - DNA, 22 bp, Homo sapiens
tttaaacatatctgttgaggga

SEQ ID NO: 7052457 - DNA, 22 bp, Homo sapiens
tttaaaatttagacctctccac

SEQ ID NO: 7052458 - DNA, 22 bp, Homo sapiens
tttaaaatcagatgggagttgg

SEQ ID NO: 7052459 - DNA, 23 bp, Homo sapiens
ttgtttttagaggtggcatgaga

SEQ ID NO: 7052460 - DNA, 22 bp, Homo sapiens
ttgtttttagagaagccctgaa

SEQ ID NO: 7052461 - DNA, 22 bp, Homo sapiens
tttctttatcatagcatctttg

SEQ ID NO: 7052462 - DNA, 22 bp, Homo sapiens
tttcttctctaatctcaatgat

SEQ ID NO: 7052463 - DNA, 22 bp, Homo sapiens
tttcttctgagatcagggagaa

SEQ ID NO: 7052464 - DNA, 22 bp, Homo sapiens
tttcttgtaagatgtttattaa

SEQ ID NO: 7052465 - DNA, 20 bp, Homo sapiens
tttcttgtcggctgttgctg

SEQ ID NO: 7052466 - DNA, 22 bp, Homo sapiens
tttcttctcacccaggacagag

SEQ ID NO: 7052467 - DNA, 22 bp, Homo sapiens
tttcttctcgacaccttatccc

SEQ ID NO: 7052468 - DNA, 22 bp, Homo sapiens
tttcttctcgacaccttatccc

SEQ ID NO: 7052469 - DNA, 22 bp, Homo sapiens
tttcttccttaccttactagag

SEQ ID NO: 7052470 - DNA, 22 bp, Homo sapiens
tttcttccccactgcaggctct

SEQ ID NO: 7052471 - DNA, 22 bp, Homo sapiens
tttcttcagccttcacaacctg

SEQ ID NO: 7052472 - DNA, 22 bp, Homo sapiens
tttcttatggggtagtccttta

SEQ ID NO: 7052473 - DNA, 22 bp, Homo sapiens
tttcttatgtgcagagtgagta

SEQ ID NO: 7052474 - DNA, 22 bp, Homo sapiens
tttcttcaattgctaacaagga

SEQ ID NO: 7052475 - DNA, 22 bp, Homo sapiens
tttctgttgtacttaaactagg

SEQ ID NO: 7052476 - DNA, 23 bp, Homo sapiens
tttctgttgggtatatatccaag

SEQ ID NO: 7052477 - DNA, 22 bp, Homo sapiens
tttctgtggtgggtagttcaga

SEQ ID NO: 7052478 - DNA, 19 bp, Homo sapiens
tttctgttagaaggataca

SEQ ID NO: 7052479 - DNA, 22 bp, Homo sapiens
tttctgttaggcatcattttaa

SEQ ID NO: 7052480 - DNA, 22 bp, Homo sapiens
tttctgtctgacatccctgcct

SEQ ID NO: 7052481 - DNA, 22 bp, Homo sapiens
tttctggcagcgggacaggggt

SEQ ID NO: 7052482 - DNA, 22 bp, Homo sapiens
tttctggcagcgggacaggggt

SEQ ID NO: 7052483 - DNA, 21 bp, Homo sapiens
tttctgggtggctgcatagtg

SEQ ID NO: 7052484 - DNA, 22 bp, Homo sapiens
tttctgggtttatgtcacagct

SEQ ID NO: 7052485 - DNA, 22 bp, Homo sapiens
tttctgctcgctctcaatcagg

SEQ ID NO: 7052486 - DNA, 22 bp, Homo sapiens
tttctgctgtgctttcttgcgt

SEQ ID NO: 7052487 - DNA, 22 bp, Homo sapiens
tttctgcatttacaaaatgagg

SEQ ID NO: 7052488 - DNA, 22 bp, Homo sapiens
tttctgccaaccatttaaactc

SEQ ID NO: 7052489 - DNA, 22 bp, Homo sapiens
tttctgccaggtttctggatga

SEQ ID NO: 7052490 - DNA, 22 bp, Homo sapiens
tttctgagaaattaaacacttt

SEQ ID NO: 7052491 - DNA, 22 bp, Homo sapiens
tttctgataattttgtgaaatc

SEQ ID NO: 7052492 - DNA, 22 bp, Homo sapiens
tttctgaagtcttctaacagat

SEQ ID NO: 7052493 - DNA, 22 bp, Homo sapiens
tttctgaaggttaaggaattag

SEQ ID NO: 7052494 - DNA, 23 bp, Homo sapiens
tttctgaagttgagatggacttt

SEQ ID NO: 7052495 - DNA, 22 bp, Homo sapiens
tttctgaataactctatgatat

SEQ ID NO: 7052496 - DNA, 21 bp, Homo sapiens
tttctgaaggcaacatctatc

SEQ ID NO: 7052497 - DNA, 22 bp, Homo sapiens
tttctgaagatacagctttgct

SEQ ID NO: 7052498 - DNA, 22 bp, Homo sapiens
tttctgaacaaagccattatca

SEQ ID NO: 7052499 - DNA, 22 bp, Homo sapiens
tttctgaacttggtactggagc

SEQ ID NO: 7052500 - DNA, 22 bp, Homo sapiens
tttctgaaatctcttttgagga

SEQ ID NO: 7052501 - DNA, 22 bp, Homo sapiens
tttctcttcactgtgtgcctca

SEQ ID NO: 7052502 - DNA, 22 bp, Homo sapiens
tttctcttgcgatatgctacac

SEQ ID NO: 7052503 - DNA, 22 bp, Homo sapiens
tttctctttcaatctgcagtac

SEQ ID NO: 7052504 - DNA, 22 bp, Homo sapiens
tttctctttgacaggaatcaga

SEQ ID NO: 7052505 - DNA, 22 bp, Homo sapiens
tttctctaaatagggaggctta

SEQ ID NO: 7052506 - DNA, 22 bp, Homo sapiens
tttctcggcagagatgatgggc

SEQ ID NO: 7052507 - DNA, 22 bp, Homo sapiens
tttctctgttctctaactgtaa

SEQ ID NO: 7052508 - DNA, 22 bp, Homo sapiens
tttctcttaatgtctctgtgct

SEQ ID NO: 7052509 - DNA, 22 bp, Homo sapiens
tttctcctgcccagatgcctgg

SEQ ID NO: 7052510 - DNA, 22 bp, Homo sapiens
tttctcctgtgaggtcagaagt

SEQ ID NO: 7052511 - DNA, 17 bp, Homo sapiens
tttctccttccatctca

SEQ ID NO: 7052512 - DNA, 22 bp, Homo sapiens
tttctccttgtgtctcctttga

SEQ ID NO: 7052513 - DNA, 22 bp, Homo sapiens
tttctcagtaatgtcctggaat

SEQ ID NO: 7052514 - DNA, 22 bp, Homo sapiens
tttctcagttactagctgtggt

SEQ ID NO: 7052515 - DNA, 22 bp, Homo sapiens
tttctcctcatgactggttgtg

SEQ ID NO: 7052516 - DNA, 22 bp, Homo sapiens
tttctcctccagagagacacag

SEQ ID NO: 7052517 - DNA, 22 bp, Homo sapiens
tttctcctctccagagtgcagt

SEQ ID NO: 7052518 - DNA, 19 bp, Homo sapiens
tttctaatgtgtttttctt

SEQ ID NO: 7052519 - DNA, 22 bp, Homo sapiens
tttctacatgttttctattgaa

SEQ ID NO: 7052520 - DNA, 22 bp, Homo sapiens
tttctacattcaaaaactacca

SEQ ID NO: 7052521 - DNA, 22 bp, Homo sapiens
tttctaagtaagattaacttct

SEQ ID NO: 7052522 - DNA, 22 bp, Homo sapiens
tttctaagtatcttgcagtttt

SEQ ID NO: 7052523 - DNA, 22 bp, Homo sapiens
tttctaagtatcttgcagtttt

SEQ ID NO: 7052524 - DNA, 22 bp, Homo sapiens
tttctaagtgtgattttagatt

SEQ ID NO: 7052525 - DNA, 22 bp, Homo sapiens
tttcctgcacccgctgatgcca

SEQ ID NO: 7052526 - DNA, 22 bp, Homo sapiens
tttcctgcctggacctctgctt

SEQ ID NO: 7052527 - DNA, 22 bp, Homo sapiens
tttcctctttgtaccttgacta

SEQ ID NO: 7052528 - DNA, 22 bp, Homo sapiens
tttcctctttgtaccttgacta

SEQ ID NO: 7052529 - DNA, 22 bp, Homo sapiens
tttcctctttgtgacacagctg

SEQ ID NO: 7052530 - DNA, 22 bp, Homo sapiens
tttcctggaccaactgagattg

SEQ ID NO: 7052531 - DNA, 22 bp, Homo sapiens
tttcctgtgactaatctggaca

SEQ ID NO: 7052532 - DNA, 22 bp, Homo sapiens
tttcctgttgccatcaagaatg

SEQ ID NO: 7052533 - DNA, 22 bp, Homo sapiens
tttccttctcagggagcttcaa

SEQ ID NO: 7052534 - DNA, 22 bp, Homo sapiens
tttctaaggtgatcctttctta

SEQ ID NO: 7052535 - DNA, 22 bp, Homo sapiens
tttcctcttcttcccatgtcat

SEQ ID NO: 7052536 - DNA, 22 bp, Homo sapiens
tttcctctgctgccattgcccc

SEQ ID NO: 7052537 - DNA, 22 bp, Homo sapiens
tttcctctgggccctgccaccc

SEQ ID NO: 7052538 - DNA, 22 bp, Homo sapiens
tttcctctgggccctgccaccc

SEQ ID NO: 7052539 - DNA, 22 bp, Homo sapiens
tttcctctgtcatgacagctga

SEQ ID NO: 7052540 - DNA, 22 bp, Homo sapiens
tttcattttggttatgccataa

SEQ ID NO: 7052541 - DNA, 22 bp, Homo sapiens
tttcattttggttatgccataa

SEQ ID NO: 7052542 - DNA, 22 bp, Homo sapiens
tttcattttggttatgccataa

SEQ ID NO: 7052543 - DNA, 22 bp, Homo sapiens
tttcattgcagagtctgtgtgc

SEQ ID NO: 7052544 - DNA, 22 bp, Homo sapiens
tttcattgtctacatatgacat

SEQ ID NO: 7052545 - DNA, 22 bp, Homo sapiens
tttcattgtctacatatgacat

SEQ ID NO: 7052546 - DNA, 20 bp, Homo sapiens
tttcaaaggcacctatgaag

SEQ ID NO: 7052547 - DNA, 22 bp, Homo sapiens
tttcaaagacagccatatttgt

SEQ ID NO: 7052548 - DNA, 22 bp, Homo sapiens
tttcaaagaccattaactatca

SEQ ID NO: 7052549 - DNA, 22 bp, Homo sapiens
tttcaaagcaactgaaaaggaa

SEQ ID NO: 7052550 - DNA, 22 bp, Homo sapiens
tttcaaaggaggctgagaggat

SEQ ID NO: 7052551 - DNA, 22 bp, Homo sapiens
tttcagctggtaaaggagtagc

SEQ ID NO: 7052552 - DNA, 22 bp, Homo sapiens
ttttatcaatcattaagacatt

SEQ ID NO: 7052553 - DNA, 22 bp, Homo sapiens
ttttatcagcagggataacaag

SEQ ID NO: 7052554 - DNA, 22 bp, Homo sapiens
ttttatcaatcattaagacatt

SEQ ID NO: 7052555 - DNA, 22 bp, Homo sapiens
ttttatcaatcattaagacatt

SEQ ID NO: 7052556 - DNA, 22 bp, Homo sapiens
ttttatcaatcattaagacatt

SEQ ID NO: 7052557 - DNA, 22 bp, Homo sapiens
ttttatcaatcattaagacatt

SEQ ID NO: 7052558 - DNA, 22 bp, Homo sapiens
ttttatattgagtgagagttcc

SEQ ID NO: 7052559 - DNA, 22 bp, Homo sapiens
ttttatattgagtgagagttcc

SEQ ID NO: 7052560 - DNA, 20 bp, Homo sapiens
ttttatatgtagggtatatg

SEQ ID NO: 7052561 - DNA, 22 bp, Homo sapiens
ttttatatggcacattggttgg

SEQ ID NO: 7052562 - DNA, 22 bp, Homo sapiens
ttttagaagttcatgtgggatt

SEQ ID NO: 7052563 - DNA, 22 bp, Homo sapiens
ttttagtttggatttctaaagc

SEQ ID NO: 7052564 - DNA, 22 bp, Homo sapiens
ttttagtttggatttctaaagc

SEQ ID NO: 7052565 - DNA, 22 bp, Homo sapiens
tttgtttagaaagagattggtg

SEQ ID NO: 7052566 - DNA, 22 bp, Homo sapiens
tttgtttagatggtaaatcagt

SEQ ID NO: 7052567 - DNA, 22 bp, Homo sapiens
tttgtttagatggtaaatcagt

SEQ ID NO: 7052568 - DNA, 22 bp, Homo sapiens
tttgttttcaatgtgtcattca

SEQ ID NO: 7052569 - DNA, 22 bp, Homo sapiens
ttttagaagttcacttgggttt

SEQ ID NO: 7052570 - DNA, 22 bp, Homo sapiens
tttgttgtgaacagaataatat

SEQ ID NO: 7052571 - DNA, 22 bp, Homo sapiens
tttgtttactcattcattgatg

SEQ ID NO: 7052572 - DNA, 22 bp, Homo sapiens
tttgttctgcatcacagaaaaa

SEQ ID NO: 7052573 - DNA, 18 bp, Homo sapiens
tttgttgggttgccttta

SEQ ID NO: 7052574 - DNA, 22 bp, Homo sapiens
tttgttcacctagcaaactttt

SEQ ID NO: 7052575 - DNA, 22 bp, Homo sapiens
tttgtcaagtttgcaaatacgt

SEQ ID NO: 7052576 - DNA, 22 bp, Homo sapiens
tttgtcaatcccttgaaaacct

SEQ ID NO: 7052577 - DNA, 22 bp, Homo sapiens
tttgtcaccagtggctttggta

SEQ ID NO: 7052578 - DNA, 22 bp, Homo sapiens
tttgtagcagcatgatttataa

SEQ ID NO: 7052579 - DNA, 22 bp, Homo sapiens
tttgtataagaacattctagca

SEQ ID NO: 7052580 - DNA, 22 bp, Homo sapiens
tttgtatgaactggtatgtagg

SEQ ID NO: 7052581 - DNA, 22 bp, Homo sapiens
tttgtatgggcagaaattagat

SEQ ID NO: 7052582 - DNA, 22 bp, Homo sapiens
tttgtatgtgataagactattc

SEQ ID NO: 7052583 - DNA, 22 bp, Homo sapiens
tttgtatgtgataagactattc

SEQ ID NO: 7052584 - DNA, 22 bp, Homo sapiens
tttgtactatggtttttcacta

SEQ ID NO: 7052585 - DNA, 22 bp, Homo sapiens
tttgtagaataatatctttctg

SEQ ID NO: 7052586 - DNA, 22 bp, Homo sapiens
tttgtagagggtaattgacaga

SEQ ID NO: 7052587 - DNA, 20 bp, Homo sapiens
tttgcaggaaggaaataggt

SEQ ID NO: 7052588 - DNA, 22 bp, Homo sapiens
tttgcagtagacatcttatttt

SEQ ID NO: 7052589 - DNA, 22 bp, Homo sapiens
tttgcagtcaaatttgctaaat

SEQ ID NO: 7052590 - DNA, 22 bp, Homo sapiens
tttgcaaatgaagctctgagga

SEQ ID NO: 7052591 - DNA, 22 bp, Homo sapiens
tttgcaaatgctctgcagagct

SEQ ID NO: 7052592 - DNA, 22 bp, Homo sapiens
tttgcaaattagccaccctgtt

SEQ ID NO: 7052593 - DNA, 23 bp, Homo sapiens
tttgcaaattggacacaaccaca

SEQ ID NO: 7052594 - DNA, 22 bp, Homo sapiens
tttgcaaatttcgtctcctcag

SEQ ID NO: 7052595 - DNA, 22 bp, Homo sapiens
tttgcaatttgtgctgcaaatg

SEQ ID NO: 7052596 - DNA, 22 bp, Homo sapiens
tttgcaatttgtgctgcaaatg

SEQ ID NO: 7052597 - DNA, 22 bp, Homo sapiens
tttctttccatgagcctatgta

SEQ ID NO: 7052598 - DNA, 22 bp, Homo sapiens
tttctttccatgagcctatgta

SEQ ID NO: 7052599 - DNA, 22 bp, Homo sapiens
tttgatttactggatattctca

SEQ ID NO: 7052600 - DNA, 22 bp, Homo sapiens
tttgcaaataaataagtgctcg

SEQ ID NO: 7052601 - DNA, 22 bp, Homo sapiens
tttgcaaatacagaggtcttgc

SEQ ID NO: 7052602 - DNA, 22 bp, Homo sapiens
tttgcaaataccatgaaacttg

SEQ ID NO: 7052603 - DNA, 22 bp, Homo sapiens
tttgcaaatatgtgtttctatt

SEQ ID NO: 7052604 - DNA, 22 bp, Homo sapiens
tttggacaaatgtctgactttc

SEQ ID NO: 7052605 - DNA, 22 bp, Homo sapiens
tttgcagtctggcctgctttgg

SEQ ID NO: 7052606 - DNA, 22 bp, Homo sapiens
tttggcactgttctaggtgcaa

SEQ ID NO: 7052607 - DNA, 22 bp, Homo sapiens
tttggcagagtcatttcagaaa

SEQ ID NO: 7052608 - DNA, 22 bp, Homo sapiens
tttgtacacaggatgttataat

SEQ ID NO: 7052609 - DNA, 22 bp, Homo sapiens
tttgtacatcctaattctgagt

SEQ ID NO: 7052610 - DNA, 22 bp, Homo sapiens
tttttcttgtgctggatctaat

SEQ ID NO: 7052611 - DNA, 22 bp, Homo sapiens
tttttgaaggctgatgtgatta

SEQ ID NO: 7052612 - DNA, 22 bp, Homo sapiens
tttttgatactcaagaggggta

SEQ ID NO: 7052613 - DNA, 22 bp, Homo sapiens
tttttgggtccaggctgtatct

SEQ ID NO: 7052614 - DNA, 22 bp, Homo sapiens
tttttgggtccaggctgtatct

SEQ ID NO: 7052615 - DNA, 22 bp, Homo sapiens
ttttttgtcttgaagaaatggt

SEQ ID NO: 7052616 - DNA, 20 bp, Homo sapiens
ttttccttctgagtatgttg

SEQ ID NO: 7052617 - DNA, 22 bp, Homo sapiens
ttttatctacctatgctcattt

SEQ ID NO: 7052618 - DNA, 22 bp, Homo sapiens
ttttatctgcttcattagttga

SEQ ID NO: 7052619 - DNA, 22 bp, Homo sapiens
ttttatcttcattcctatctac

SEQ ID NO: 7052620 - DNA, 22 bp, Homo sapiens
ttttatcttcattcctatctac

SEQ ID NO: 7052621 - DNA, 22 bp, Homo sapiens
ttttatgaagataattttctga

SEQ ID NO: 7052622 - DNA, 22 bp, Homo sapiens
ttttatgaagataattttctga

SEQ ID NO: 7052623 - DNA, 22 bp, Homo sapiens
ttttatgagaatgcgccacttg

SEQ ID NO: 7052624 - DNA, 22 bp, Homo sapiens
ttttcttctacctgctgtccaa

SEQ ID NO: 7052625 - DNA, 22 bp, Homo sapiens
ttttctattaactcattttgca

SEQ ID NO: 7052626 - DNA, 22 bp, Homo sapiens
ttttctaacatctagtaatttg

SEQ ID NO: 7052627 - DNA, 22 bp, Homo sapiens
ttttctaacatctagtaatttg

SEQ ID NO: 7052628 - DNA, 22 bp, Homo sapiens
ttttcgtttatttgacatgtaa

SEQ ID NO: 7052629 - DNA, 19 bp, Homo sapiens
ttttgaagtatgagacagg

SEQ ID NO: 7052630 - DNA, 22 bp, Homo sapiens
ttttgaataattcagaaacagc

SEQ ID NO: 7052631 - DNA, 22 bp, Homo sapiens
ttttgcctaagaatctctctga

SEQ ID NO: 7052632 - DNA, 22 bp, Homo sapiens
ttttgcaatgagatgcttgtca

SEQ ID NO: 7052633 - DNA, 22 bp, Homo sapiens
ttttgcagccacatctgacctg

SEQ ID NO: 7052634 - DNA, 20 bp, Homo sapiens
tttttccttctctacaggca

SEQ ID NO: 7052635 - DNA, 22 bp, Homo sapiens
tttttcctagcgatttgtcagc

SEQ ID NO: 7052636 - DNA, 22 bp, Homo sapiens
tttttccagggttagatgttta

SEQ ID NO: 7052637 - DNA, 22 bp, Homo sapiens
tttttcatgagactagaagtca

SEQ ID NO: 7052638 - DNA, 22 bp, Homo sapiens
ttgcaaattaaagaggatagca

SEQ ID NO: 7052639 - DNA, 22 bp, Homo sapiens
ttgcaaattatataagggatgc

SEQ ID NO: 7052640 - DNA, 22 bp, Homo sapiens
ttgcaaatgtgagtttagactg

SEQ ID NO: 7052641 - DNA, 22 bp, Homo sapiens
ttgcaaatgtggttagggcttt

SEQ ID NO: 7052642 - DNA, 22 bp, Homo sapiens
ttgcaaatgttatactgccagt

SEQ ID NO: 7052643 - DNA, 22 bp, Homo sapiens
ttgcaaatgaccattgccacat

SEQ ID NO: 7052644 - DNA, 22 bp, Homo sapiens
ttgcaaatgtgaataattacac

SEQ ID NO: 7052645 - DNA, 22 bp, Homo sapiens
ttgcaaatgtgaataattacac

SEQ ID NO: 7052646 - DNA, 22 bp, Homo sapiens
ttgcaaatctttgccagaaggc

SEQ ID NO: 7052647 - DNA, 22 bp, Homo sapiens
ttgcaaatcagaagtatagatt

SEQ ID NO: 7052648 - DNA, 22 bp, Homo sapiens
ttgcaaatattgtttacctttc

SEQ ID NO: 7052649 - DNA, 22 bp, Homo sapiens
ttgcaaataaacaagtatacat

SEQ ID NO: 7052650 - DNA, 22 bp, Homo sapiens
ttgcaaataaacaagtatacat

SEQ ID NO: 7052651 - DNA, 22 bp, Homo sapiens
ttgcaaataatagcctgaaact

SEQ ID NO: 7052652 - DNA, 20 bp, Homo sapiens
ttgcaaatatctattgattg

SEQ ID NO: 7052653 - DNA, 22 bp, Homo sapiens
ttgattttaaaatagtgacact

SEQ ID NO: 7052654 - DNA, 22 bp, Homo sapiens
ttgattttaaaatagtgacact

SEQ ID NO: 7052655 - DNA, 22 bp, Homo sapiens
ttgatttgattgtaatggctct

SEQ ID NO: 7052656 - DNA, 22 bp, Homo sapiens
ttgatttgcagaaggtgtagag

SEQ ID NO: 7052657 - DNA, 22 bp, Homo sapiens
ttgatttgggaatggtctggca

SEQ ID NO: 7052658 - DNA, 22 bp, Homo sapiens
ttgatttgtaggaatggagacc

SEQ ID NO: 7052659 - DNA, 22 bp, Homo sapiens
ttgatttctattcagatgtaga

SEQ ID NO: 7052660 - DNA, 23 bp, Homo sapiens
ttgatttagctgggattgcatgc

SEQ ID NO: 7052661 - DNA, 22 bp, Homo sapiens
ttgatttatagaatgttcaagc

SEQ ID NO: 7052662 - DNA, 22 bp, Homo sapiens
ttgatttatagaatgttcaagc

SEQ ID NO: 7052663 - DNA, 22 bp, Homo sapiens
ttgatgtacagaattgttcaca

SEQ ID NO: 7052664 - DNA, 22 bp, Homo sapiens
ttgatgtacagaattgttcaca

SEQ ID NO: 7052665 - DNA, 22 bp, Homo sapiens
ttgatgttgctcttaacagtat

SEQ ID NO: 7052666 - DNA, 22 bp, Homo sapiens
ttgattaaacaggcatattcaa

SEQ ID NO: 7052667 - DNA, 22 bp, Homo sapiens
ttgattactatgtgttgaaagc

SEQ ID NO: 7052668 - DNA, 20 bp, Homo sapiens
ttgattcaagggctgatgga

SEQ ID NO: 7052669 - DNA, 22 bp, Homo sapiens
ttgatgagaccattgccgcgtc

SEQ ID NO: 7052670 - DNA, 22 bp, Homo sapiens
ttgatgtaaagtgattcatggg

SEQ ID NO: 7052671 - DNA, 22 bp, Homo sapiens
ttgaggcagggcatggtggccc

SEQ ID NO: 7052672 - DNA, 22 bp, Homo sapiens
ttgaggcaggtccgggtccttc

SEQ ID NO: 7052673 - DNA, 20 bp, Homo sapiens
ttgaggcatgtctagaagta

SEQ ID NO: 7052674 - DNA, 22 bp, Homo sapiens
ttgagcccaggaggcctgggtg

SEQ ID NO: 7052675 - DNA, 23 bp, Homo sapiens
ttgaggcaaacatgtaagtagga

SEQ ID NO: 7052676 - DNA, 22 bp, Homo sapiens
ttgaggcacacacaggttgcat

SEQ ID NO: 7052677 - DNA, 22 bp, Homo sapiens
ttgaggcacagattttagtggc

SEQ ID NO: 7052678 - DNA, 22 bp, Homo sapiens
ttgaaggacatcctatttctag

SEQ ID NO: 7052679 - DNA, 22 bp, Homo sapiens
ttgaatgaatggtccatataga

SEQ ID NO: 7052680 - DNA, 22 bp, Homo sapiens
ttgaatgaatttgagcagagat

SEQ ID NO: 7052681 - DNA, 22 bp, Homo sapiens
ttgaatgaggaagagcactggc

SEQ ID NO: 7052682 - DNA, 22 bp, Homo sapiens
ttgaatgatcctatctagcaca

SEQ ID NO: 7052683 - DNA, 22 bp, Homo sapiens
ttgaatgtaggtcttggtgagc

SEQ ID NO: 7052684 - DNA, 22 bp, Homo sapiens
ttgaattagactttgctacagg

SEQ ID NO: 7052685 - DNA, 22 bp, Homo sapiens
ttgaattataagtgtgtctact

SEQ ID NO: 7052686 - DNA, 22 bp, Homo sapiens
ttgaagattattctattaaaag

SEQ ID NO: 7052687 - DNA, 22 bp, Homo sapiens
ttctttctcaacatgaatgttt

SEQ ID NO: 7052688 - DNA, 22 bp, Homo sapiens
ttctttcccttccagcagctcc

SEQ ID NO: 7052689 - DNA, 22 bp, Homo sapiens
ttctttccttgcctcagtgaag

SEQ ID NO: 7052690 - DNA, 22 bp, Homo sapiens
ttctttcccagaagatatgttt

SEQ ID NO: 7052691 - DNA, 19 bp, Homo sapiens
ttctttccacatcttctct

SEQ ID NO: 7052692 - DNA, 22 bp, Homo sapiens
ttctttcagaacacaagtgatt

SEQ ID NO: 7052693 - DNA, 22 bp, Homo sapiens
ttctttatgcttctgtttaggc

SEQ ID NO: 7052694 - DNA, 22 bp, Homo sapiens
ttctttatgcttctgtttaggc

SEQ ID NO: 7052695 - DNA, 22 bp, Homo sapiens
ttctttatgttaatgaatctat

SEQ ID NO: 7052696 - DNA, 22 bp, Homo sapiens
ttcttgctcaatgtctgtttaa

SEQ ID NO: 7052697 - DNA, 22 bp, Homo sapiens
ttctttaaaatagtgagaaaga

SEQ ID NO: 7052698 - DNA, 18 bp, Homo sapiens
ttctttaattcagtttga

SEQ ID NO: 7052699 - DNA, 22 bp, Homo sapiens
ttctttatcagttactcatagg

SEQ ID NO: 7052700 - DNA, 22 bp, Homo sapiens
ttcttgagtatctgcacagtgc

SEQ ID NO: 7052701 - DNA, 22 bp, Homo sapiens
ttcttgaatcactttagagata

SEQ ID NO: 7052702 - DNA, 22 bp, Homo sapiens
ttcttctttccaattacatggt

SEQ ID NO: 7052703 - DNA, 21 bp, Homo sapiens
ttcttcttggactgttttggc

SEQ ID NO: 7052704 - DNA, 22 bp, Homo sapiens
ttcttacattactttacatgtg

SEQ ID NO: 7052705 - DNA, 22 bp, Homo sapiens
ttcttacagatttggtgaatga

SEQ ID NO: 7052706 - DNA, 22 bp, Homo sapiens
ttcttacagagtttacagagcc

SEQ ID NO: 7052707 - DNA, 22 bp, Homo sapiens
ttcttacagccctattactaaa

SEQ ID NO: 7052708 - DNA, 22 bp, Homo sapiens
ttcttacatattttcatatggt

SEQ ID NO: 7052709 - DNA, 21 bp, Homo sapiens
ttctgttttttgtaccagggc

SEQ ID NO: 7052710 - DNA, 22 bp, Homo sapiens
ttctgttttagaaataagtagt

SEQ ID NO: 7052711 - DNA, 22 bp, Homo sapiens
ttctgttctgatacttgtttct

SEQ ID NO: 7052712 - DNA, 22 bp, Homo sapiens
ttctgttctgatacttgtttct

SEQ ID NO: 7052713 - DNA, 22 bp, Homo sapiens
ttctgttatcattaagcattat

SEQ ID NO: 7052714 - DNA, 22 bp, Homo sapiens
ttctgttacttgcaaccacagg

SEQ ID NO: 7052715 - DNA, 22 bp, Homo sapiens
ttctgggcctcctaggacaggc

SEQ ID NO: 7052716 - DNA, 22 bp, Homo sapiens
ttctgcttttctctgtctgagt

SEQ ID NO: 7052717 - DNA, 22 bp, Homo sapiens
ttctgcttttattgccagagtt

SEQ ID NO: 7052718 - DNA, 20 bp, Homo sapiens
ttctgcttgcaaatatcaag

SEQ ID NO: 7052719 - DNA, 22 bp, Homo sapiens
ttctggaaaccctcagccagtg

SEQ ID NO: 7052720 - DNA, 22 bp, Homo sapiens
ttctggaaagaaggctaaggtc

SEQ ID NO: 7052721 - DNA, 22 bp, Homo sapiens
ttctggaaagatttgcgtgtaa

SEQ ID NO: 7052722 - DNA, 22 bp, Homo sapiens
ttctggaaagcatttgaggccc

SEQ ID NO: 7052723 - DNA, 22 bp, Homo sapiens
ttctggaaatcagcagagggtg

SEQ ID NO: 7052724 - DNA, 21 bp, Homo sapiens
ttctgccttcgaggtctcagg

SEQ ID NO: 7052725 - DNA, 22 bp, Homo sapiens
ttctgccttggcagggtggtcc

SEQ ID NO: 7052726 - DNA, 22 bp, Homo sapiens
ttctgccttcagtcctctgact

SEQ ID NO: 7052727 - DNA, 22 bp, Homo sapiens
ttctgccttacgatattttcaa

SEQ ID NO: 7052728 - DNA, 22 bp, Homo sapiens
ttctgccttcagtcctctgact

SEQ ID NO: 7052729 - DNA, 22 bp, Homo sapiens
ttctgccttcagtcctctgact

SEQ ID NO: 7052730 - DNA, 21 bp, Homo sapiens
ttctgccttcccctagctggg

SEQ ID NO: 7052731 - DNA, 21 bp, Homo sapiens
ttctgccttcccctagctggg

SEQ ID NO: 7052732 - DNA, 22 bp, Homo sapiens
ttctgcctgatgtagtcatacc

SEQ ID NO: 7052733 - DNA, 22 bp, Homo sapiens
ttctgcctgccccagagaggcc

SEQ ID NO: 7052734 - DNA, 22 bp, Homo sapiens
ttctgcctggcaggaggactgt

SEQ ID NO: 7052735 - DNA, 22 bp, Homo sapiens
ttctgctcagtagtaagagtgc

SEQ ID NO: 7052736 - DNA, 22 bp, Homo sapiens
ttctgctccaccacttccagca

SEQ ID NO: 7052737 - DNA, 21 bp, Homo sapiens
ttctgctccagctcctctggg

SEQ ID NO: 7052738 - DNA, 22 bp, Homo sapiens
ttctgctctgacttgcaaggaa

SEQ ID NO: 7052739 - DNA, 22 bp, Homo sapiens
ttctgctctgacttgcaaggaa

SEQ ID NO: 7052740 - DNA, 22 bp, Homo sapiens
ttctgctcttggctttgctggt

SEQ ID NO: 7052741 - DNA, 22 bp, Homo sapiens
ttctgctgaagtcactgggagc

SEQ ID NO: 7052742 - DNA, 22 bp, Homo sapiens
ttctgctggtaactatgtttca

SEQ ID NO: 7052743 - DNA, 17 bp, Homo sapiens
ttctgctgtcgtcctct

SEQ ID NO: 7052744 - DNA, 21 bp, Homo sapiens
ttctgctgtgccatgcctctg

SEQ ID NO: 7052745 - DNA, 21 bp, Homo sapiens
ttctgctgtgccatgcctctg

SEQ ID NO: 7052746 - DNA, 19 bp, Homo sapiens
ttctgctgttcctaggctg

SEQ ID NO: 7052747 - DNA, 22 bp, Homo sapiens
ttctcttttcaccagttgctaa

SEQ ID NO: 7052748 - DNA, 22 bp, Homo sapiens
ttctataagactcatatttctt

SEQ ID NO: 7052749 - DNA, 22 bp, Homo sapiens
ttctagttttcagtccaccagg

SEQ ID NO: 7052750 - DNA, 22 bp, Homo sapiens
ttctagttgagggagacaaata

SEQ ID NO: 7052751 - DNA, 22 bp, Homo sapiens
ttctagtgtccttggacttgct

SEQ ID NO: 7052752 - DNA, 22 bp, Homo sapiens
ttctagttaatgtagcatcttg

SEQ ID NO: 7052753 - DNA, 22 bp, Homo sapiens
ttctgaatttctgtgtatctta

SEQ ID NO: 7052754 - DNA, 22 bp, Homo sapiens
ttctgacacattactacatgga

SEQ ID NO: 7052755 - DNA, 22 bp, Homo sapiens
ttctgacagtaatcagtttgct

SEQ ID NO: 7052756 - DNA, 22 bp, Homo sapiens
ttctgacatgtgagattttgtt

SEQ ID NO: 7052757 - DNA, 22 bp, Homo sapiens
ttctgagaaggctgtggacaca

SEQ ID NO: 7052758 - DNA, 22 bp, Homo sapiens
ttctgagaagggtgggtctggc

SEQ ID NO: 7052759 - DNA, 22 bp, Homo sapiens
ttctgagacaattgagagtcta

SEQ ID NO: 7052760 - DNA, 22 bp, Homo sapiens
ttctaattgtgtttgcatatct

SEQ ID NO: 7052761 - DNA, 22 bp, Homo sapiens
ttctaagttactgttatggtct

SEQ ID NO: 7052762 - DNA, 22 bp, Homo sapiens
ttctacaatatgaataatgaag

SEQ ID NO: 7052763 - DNA, 22 bp, Homo sapiens
ttctacttgccaaatgacacat

SEQ ID NO: 7052764 - DNA, 22 bp, Homo sapiens
ttccttctcagccctcgaggat

SEQ ID NO: 7052765 - DNA, 22 bp, Homo sapiens
ttccttctgaagcctttgtgtt

SEQ ID NO: 7052766 - DNA, 22 bp, Homo sapiens
ttcctgttcaggaaagttgtgt

SEQ ID NO: 7052767 - DNA, 22 bp, Homo sapiens
ttcctgttcaggaaagttgtgt

SEQ ID NO: 7052768 - DNA, 22 bp, Homo sapiens
ttccttaatgaatcaggccatt

SEQ ID NO: 7052769 - DNA, 22 bp, Homo sapiens
ttccttaggctgtttgcagtgc

SEQ ID NO: 7052770 - DNA, 22 bp, Homo sapiens
ttccttagtgttagattctgtg

SEQ ID NO: 7052771 - DNA, 22 bp, Homo sapiens
ttccttagttgactgtcttagt

SEQ ID NO: 7052772 - DNA, 22 bp, Homo sapiens
ttccttctagagcttgtttagg

SEQ ID NO: 7052773 - DNA, 22 bp, Homo sapiens
ttcctcttccatcttcccaggg

SEQ ID NO: 7052774 - DNA, 22 bp, Homo sapiens
ttcctctttagggctggccagg

SEQ ID NO: 7052775 - DNA, 22 bp, Homo sapiens
ttcctgaagtcaaagatctaaa

SEQ ID NO: 7052776 - DNA, 22 bp, Homo sapiens
ttcctgtccgcaatggcctggg

SEQ ID NO: 7052777 - DNA, 22 bp, Homo sapiens
ttcctgtgatattagccactgt

SEQ ID NO: 7052778 - DNA, 22 bp, Homo sapiens
ttcctgtggccttacatctgtg

SEQ ID NO: 7052779 - DNA, 22 bp, Homo sapiens
ttcctgtggctgtcactcctgg

SEQ ID NO: 7052780 - DNA, 22 bp, Homo sapiens
ttcctagggcagagccgctggg

SEQ ID NO: 7052781 - DNA, 22 bp, Homo sapiens
ttcctagctataaagctcttcc

SEQ ID NO: 7052782 - DNA, 22 bp, Homo sapiens
ttcctcagaaaatactgtccaa

SEQ ID NO: 7052783 - DNA, 22 bp, Homo sapiens
ttcctcagaccctcattgtgag

SEQ ID NO: 7052784 - DNA, 22 bp, Homo sapiens
ttcctcagagggcgctggggaa

SEQ ID NO: 7052785 - DNA, 22 bp, Homo sapiens
ttcctcagccaaggctgggatc

SEQ ID NO: 7052786 - DNA, 22 bp, Homo sapiens
ttcctcagccaaggctgggatc

SEQ ID NO: 7052787 - DNA, 22 bp, Homo sapiens
ttcctcagccagcacttagggg

SEQ ID NO: 7052788 - DNA, 22 bp, Homo sapiens
ttcctcagctggcctgattggg

SEQ ID NO: 7052789 - DNA, 22 bp, Homo sapiens
ttcctcagctgtttgggctcat

SEQ ID NO: 7052790 - DNA, 20 bp, Homo sapiens
ttcctcaggagaggatgtta

SEQ ID NO: 7052791 - DNA, 22 bp, Homo sapiens
ttcctcaggcttccctttgtcc

SEQ ID NO: 7052792 - DNA, 22 bp, Homo sapiens
ttcctcagggcggatgggcagg

SEQ ID NO: 7052793 - DNA, 22 bp, Homo sapiens
ttcctcagggcggatgggcagg

SEQ ID NO: 7052794 - DNA, 22 bp, Homo sapiens
ttcctcagttagtgcctgaggc

SEQ ID NO: 7052795 - DNA, 22 bp, Homo sapiens
ttcctcatctgtgcacctcact

SEQ ID NO: 7052796 - DNA, 22 bp, Homo sapiens
ttcctcatggggttccttcaga

SEQ ID NO: 7052797 - DNA, 22 bp, Homo sapiens
ttcctccagcctggagcacttc

SEQ ID NO: 7052798 - DNA, 22 bp, Homo sapiens
ttcctctgtagttgctgatgaa

SEQ ID NO: 7052799 - DNA, 22 bp, Homo sapiens
ttcctctgtagttgctgatgaa

SEQ ID NO: 7052800 - DNA, 22 bp, Homo sapiens
ttcctctgtatgctttgctgct

SEQ ID NO: 7052801 - DNA, 22 bp, Homo sapiens
ttcctctgtatgctttgctgct

SEQ ID NO: 7052802 - DNA, 22 bp, Homo sapiens
ttccagagcagttttcagatca

SEQ ID NO: 7052803 - DNA, 22 bp, Homo sapiens
ttccctggcatgagtgtaagat

SEQ ID NO: 7052804 - DNA, 22 bp, Homo sapiens
ttccctggctcttctacatcgt

SEQ ID NO: 7052805 - DNA, 22 bp, Homo sapiens
ttccctggggaaggtgaccttt

SEQ ID NO: 7052806 - DNA, 22 bp, Homo sapiens
ttcctaacaaggggtattcatc

SEQ ID NO: 7052807 - DNA, 22 bp, Homo sapiens
ttcctaacaagtctatctttga

SEQ ID NO: 7052808 - DNA, 22 bp, Homo sapiens
ttcctaacacagtgtaagcaag

SEQ ID NO: 7052809 - DNA, 22 bp, Homo sapiens
ttcctaacctctagctgcatat

SEQ ID NO: 7052810 - DNA, 22 bp, Homo sapiens
ttcctaacgccagtattttcat

SEQ ID NO: 7052811 - DNA, 22 bp, Homo sapiens
ttcctaactctggcacctagtc

SEQ ID NO: 7052812 - DNA, 22 bp, Homo sapiens
ttcctaactggcctttatggat

SEQ ID NO: 7052813 - DNA, 22 bp, Homo sapiens
ttcacagtcacccttctccatg

SEQ ID NO: 7052814 - DNA, 22 bp, Homo sapiens
ttcacaaagctggagcatttcc

SEQ ID NO: 7052815 - DNA, 18 bp, Homo sapiens
ttcacaagggcttggttt

SEQ ID NO: 7052816 - DNA, 22 bp, Homo sapiens
ttcacaagtcattagctgcata

SEQ ID NO: 7052817 - DNA, 22 bp, Homo sapiens
ttcacaataatgtccatcctct

SEQ ID NO: 7052818 - DNA, 22 bp, Homo sapiens
ttcacaaaaatgctgaacagtt

SEQ ID NO: 7052819 - DNA, 22 bp, Homo sapiens
ttcaattcaattctaaatatat

SEQ ID NO: 7052820 - DNA, 22 bp, Homo sapiens
ttcaattctaaactaatattct

SEQ ID NO: 7052821 - DNA, 22 bp, Homo sapiens
ttcaattctgctctgatcttag

SEQ ID NO: 7052822 - DNA, 22 bp, Homo sapiens
ttcaactttaggcaaagaaaac

SEQ ID NO: 7052823 - DNA, 17 bp, Homo sapiens
ttcaaagcttatcaagg

SEQ ID NO: 7052824 - DNA, 22 bp, Homo sapiens
ttagagtcaaaatggcatgtta

SEQ ID NO: 7052825 - DNA, 22 bp, Homo sapiens
ttagagtcaagctgcatgttct

SEQ ID NO: 7052826 - DNA, 23 bp, Homo sapiens
ttcaaagcttaagctctttccac

SEQ ID NO: 7052827 - DNA, 22 bp, Homo sapiens
ttcagtatacttcataacattt

SEQ ID NO: 7052828 - DNA, 22 bp, Homo sapiens
ttcaggagtgtcaggagtgcct

SEQ ID NO: 7052829 - DNA, 22 bp, Homo sapiens
ttcacattataatcagttctgc

SEQ ID NO: 7052830 - DNA, 22 bp, Homo sapiens
ttcacattccgcggctattttc

SEQ ID NO: 7052831 - DNA, 22 bp, Homo sapiens
ttcacattgaaggtgctttctt

SEQ ID NO: 7052832 - DNA, 19 bp, Homo sapiens
ttcacattggaagaagtag

SEQ ID NO: 7052833 - DNA, 19 bp, Homo sapiens
ttcacattggaagaagtag

SEQ ID NO: 7052834 - DNA, 22 bp, Homo sapiens
ttccaatttgtggtgagttaat

SEQ ID NO: 7052835 - DNA, 22 bp, Homo sapiens
ttcatgtgatcacagattgtaa

SEQ ID NO: 7052836 - DNA, 22 bp, Homo sapiens
ttcatgtgtatggaacattttt

SEQ ID NO: 7052837 - DNA, 20 bp, Homo sapiens
ttcatggtgtatttctttct

SEQ ID NO: 7052838 - DNA, 22 bp, Homo sapiens
ttcatgtaccgtgtaccaggca

SEQ ID NO: 7052839 - DNA, 22 bp, Homo sapiens
ttcatgtaggctgcaatgcaca

SEQ ID NO: 7052840 - DNA, 22 bp, Homo sapiens
ttcatgtgaatatatttgtctt

SEQ ID NO: 7052841 - DNA, 22 bp, Homo sapiens
ttcatgatagtattttttgtga

SEQ ID NO: 7052842 - DNA, 22 bp, Homo sapiens
ttaacacagggggagacaaagt

SEQ ID NO: 7052843 - DNA, 22 bp, Homo sapiens
ttaacaatagagtttcttcagg

SEQ ID NO: 7052844 - DNA, 22 bp, Homo sapiens
ttaacacagggggagacaaagt

SEQ ID NO: 7052845 - DNA, 22 bp, Homo sapiens
ttaacacatatttatcaattgc

SEQ ID NO: 7052846 - DNA, 22 bp, Homo sapiens
ttaacacatatttatcaattgc

SEQ ID NO: 7052847 - DNA, 22 bp, Homo sapiens
ttaacacatatttatcaattgc

SEQ ID NO: 7052848 - DNA, 22 bp, Homo sapiens
ttaacaatagagtttcttcagg

SEQ ID NO: 7052849 - DNA, 22 bp, Homo sapiens
ttaacaaggtgactgcattaaa

SEQ ID NO: 7052850 - DNA, 22 bp, Homo sapiens
ttaaatgtctgtagatgtgctg

SEQ ID NO: 7052851 - DNA, 22 bp, Homo sapiens
ttaaatgtgatcctggtatgca

SEQ ID NO: 7052852 - DNA, 22 bp, Homo sapiens
ttaaatgtgatttcatttatgt

SEQ ID NO: 7052853 - DNA, 22 bp, Homo sapiens
ttaaatgtgatttcatttatgt

SEQ ID NO: 7052854 - DNA, 22 bp, Homo sapiens
ttaaatgtttaatctaacttga

SEQ ID NO: 7052855 - DNA, 22 bp, Homo sapiens
ttaaattaggactctagttctg

SEQ ID NO: 7052856 - DNA, 22 bp, Homo sapiens
ttaaattaggactctagttctg

SEQ ID NO: 7052857 - DNA, 22 bp, Homo sapiens
ttaaatgctcacataaaggtag

SEQ ID NO: 7052858 - DNA, 22 bp, Homo sapiens
ttaaatgtcaatagattgcttg

SEQ ID NO: 7052859 - DNA, 22 bp, Homo sapiens
ttaaatgatgcatatcatttag

SEQ ID NO: 7052860 - DNA, 22 bp, Homo sapiens
ttaaatgatgcatatcatttag

SEQ ID NO: 7052861 - DNA, 22 bp, Homo sapiens
ttaaatgagatgttcagatatt

SEQ ID NO: 7052862 - DNA, 22 bp, Homo sapiens
ttaaatgagatgttcagatatt

SEQ ID NO: 7052863 - DNA, 22 bp, Homo sapiens
ttaaatgagatgttcagatatt

SEQ ID NO: 7052864 - DNA, 22 bp, Homo sapiens
ttaaatgaggctgatgtagatt

SEQ ID NO: 7052865 - DNA, 22 bp, Homo sapiens
ttaaatgaggctgatgtagatt

SEQ ID NO: 7052866 - DNA, 22 bp, Homo sapiens
ttaaatgaggctgatgtagatt

SEQ ID NO: 7052867 - DNA, 22 bp, Homo sapiens
ttaaatgaacgagatatgcaac

SEQ ID NO: 7052868 - DNA, 22 bp, Homo sapiens
ttaaatattttcagcagggtca

SEQ ID NO: 7052869 - DNA, 22 bp, Homo sapiens
ttaaatattttcagcagggtca

SEQ ID NO: 7052870 - DNA, 22 bp, Homo sapiens
ttaaatattttcagcagggtca

SEQ ID NO: 7052871 - DNA, 22 bp, Homo sapiens
ttaaatgacgggactgggtttt

SEQ ID NO: 7052872 - DNA, 22 bp, Homo sapiens
ttaaatgacttttattattctc

SEQ ID NO: 7052873 - DNA, 22 bp, Homo sapiens
ttaaatgacttttattattctc

SEQ ID NO: 7052874 - DNA, 22 bp, Homo sapiens
ttaaatgagatgttcagatatt

SEQ ID NO: 7052875 - DNA, 22 bp, Homo sapiens
tgtttttatctctgtgtacaac

SEQ ID NO: 7052876 - DNA, 22 bp, Homo sapiens
ttaaagccatctagattttgag

SEQ ID NO: 7052877 - DNA, 22 bp, Homo sapiens
tgtttttaaataatgatagaaa

SEQ ID NO: 7052878 - DNA, 22 bp, Homo sapiens
tgtttttaaataatgatagaaa

SEQ ID NO: 7052879 - DNA, 22 bp, Homo sapiens
tgtttttaaataatgatagaaa

SEQ ID NO: 7052880 - DNA, 21 bp, Homo sapiens
ttaaagcctccctcataagga

SEQ ID NO: 7052881 - DNA, 22 bp, Homo sapiens
ttaaatagtaggtctattttgg

SEQ ID NO: 7052882 - DNA, 22 bp, Homo sapiens
ttaaatagtcaaatcagtggca

SEQ ID NO: 7052883 - DNA, 22 bp, Homo sapiens
ttaaatattatgttgtctgcaa

SEQ ID NO: 7052884 - DNA, 22 bp, Homo sapiens
ttaaatattatgttgtctgcaa

SEQ ID NO: 7052885 - DNA, 22 bp, Homo sapiens
ttaaatattatgttgtctgcaa

SEQ ID NO: 7052886 - DNA, 22 bp, Homo sapiens
ttaaatattatgttgtctgcaa

SEQ ID NO: 7052887 - DNA, 22 bp, Homo sapiens
ttaaatattatgttgtctgcaa

SEQ ID NO: 7052888 - DNA, 22 bp, Homo sapiens
ttaaatattttcagcagggtca

SEQ ID NO: 7052889 - DNA, 22 bp, Homo sapiens
ttaaatattttcagcagggtca

SEQ ID NO: 7052890 - DNA, 22 bp, Homo sapiens
tgttttctgatggttaatgagt

SEQ ID NO: 7052891 - DNA, 22 bp, Homo sapiens
tgttttctgtgtagagatcaca

SEQ ID NO: 7052892 - DNA, 22 bp, Homo sapiens
tgttttgtctaatctaaattct

SEQ ID NO: 7052893 - DNA, 19 bp, Homo sapiens
tgttttgttaaagcagtcc

SEQ ID NO: 7052894 - DNA, 22 bp, Homo sapiens
tgttttgttcactgcattgtcc

SEQ ID NO: 7052895 - DNA, 22 bp, Homo sapiens
ttaatttatacataatcacagg

SEQ ID NO: 7052896 - DNA, 22 bp, Homo sapiens
ttaataaacaggtgcagctgaa

SEQ ID NO: 7052897 - DNA, 22 bp, Homo sapiens
ttaataaacaggtgcagctgaa

SEQ ID NO: 7052898 - DNA, 22 bp, Homo sapiens
ttaataaacaggtgcagctgaa

SEQ ID NO: 7052899 - DNA, 22 bp, Homo sapiens
ttaattatgagaaagggaaaag

SEQ ID NO: 7052900 - DNA, 22 bp, Homo sapiens
ttaagtgagcttgaataatctt

SEQ ID NO: 7052901 - DNA, 22 bp, Homo sapiens
ttaagggccattatggatgggt

SEQ ID NO: 7052902 - DNA, 22 bp, Homo sapiens
ttaacacatccctgctctaccc

SEQ ID NO: 7052903 - DNA, 22 bp, Homo sapiens
ttaacatgtcttgacttcatct

SEQ ID NO: 7052904 - DNA, 22 bp, Homo sapiens
ttaacatgtcttgacttcatct

SEQ ID NO: 7052905 - DNA, 22 bp, Homo sapiens
ttaagagacaggagaatgatgt

SEQ ID NO: 7052906 - DNA, 22 bp, Homo sapiens
ttaagagaagagtatctagaac

SEQ ID NO: 7052907 - DNA, 22 bp, Homo sapiens
ttaagagatttaggaacattat

SEQ ID NO: 7052908 - DNA, 22 bp, Homo sapiens
ttaagaaggtactcaaagatct

SEQ ID NO: 7052909 - DNA, 22 bp, Homo sapiens
ttaagacagtgtatttgttttc

SEQ ID NO: 7052910 - DNA, 22 bp, Homo sapiens
ttaacttgtcagaaaatacagt

SEQ ID NO: 7052911 - DNA, 22 bp, Homo sapiens
ttactttatgtgatggattagt

SEQ ID NO: 7052912 - DNA, 22 bp, Homo sapiens
ttactttgctttctcattacag

SEQ ID NO: 7052913 - DNA, 22 bp, Homo sapiens
ttactttgggtcctgcttataa

SEQ ID NO: 7052914 - DNA, 22 bp, Homo sapiens
ttagaaagctttccatagtcaa

SEQ ID NO: 7052915 - DNA, 21 bp, Homo sapiens
ttagaagctaatgcagctggt

SEQ ID NO: 7052916 - DNA, 22 bp, Homo sapiens
ttagaagtaaggtcagatttct

SEQ ID NO: 7052917 - DNA, 22 bp, Homo sapiens
ttagacatcaagaagccaatgt

SEQ ID NO: 7052918 - DNA, 22 bp, Homo sapiens
ttagacatgtttgctaaaatga

SEQ ID NO: 7052919 - DNA, 22 bp, Homo sapiens
ttagagagaaccatcaggatct

SEQ ID NO: 7052920 - DNA, 23 bp, Homo sapiens
ttagagatgattaaaaaatcttg

SEQ ID NO: 7052921 - DNA, 22 bp, Homo sapiens
ttagaggaaagtgactccgatg

SEQ ID NO: 7052922 - DNA, 22 bp, Homo sapiens
ttactttaagggtgtcttatta

SEQ ID NO: 7052923 - DNA, 19 bp, Homo sapiens
ttacttggcaaagtcagtc

SEQ ID NO: 7052924 - DNA, 22 bp, Homo sapiens
ttactgttcatgttgtacactt

SEQ ID NO: 7052925 - DNA, 22 bp, Homo sapiens
ttactgttggtgtatccatagc

SEQ ID NO: 7052926 - DNA, 22 bp, Homo sapiens
ttactgtttgaaaaatgaatgt

SEQ ID NO: 7052927 - DNA, 22 bp, Homo sapiens
ttactgttttggtacctcattg

SEQ ID NO: 7052928 - DNA, 22 bp, Homo sapiens
ttactcagtctcccatacattg

SEQ ID NO: 7052929 - DNA, 20 bp, Homo sapiens
ttactcagttcctgccatgc

SEQ ID NO: 7052930 - DNA, 22 bp, Homo sapiens
ttacacatgtctcagtggaaat

SEQ ID NO: 7052931 - DNA, 22 bp, Homo sapiens
ttacacattaacaggcagctaa

SEQ ID NO: 7052932 - DNA, 22 bp, Homo sapiens
ttacacattgcagatcaaaatg

SEQ ID NO: 7052933 - DNA, 22 bp, Homo sapiens
ttacacagtgcacaagcagagt

SEQ ID NO: 7052934 - DNA, 22 bp, Homo sapiens
ttacacagtggttaagtctggg

SEQ ID NO: 7052935 - DNA, 22 bp, Homo sapiens
ttacacagttggtaggggcaga

SEQ ID NO: 7052936 - DNA, 22 bp, Homo sapiens
ttacacatctagacccattttt

SEQ ID NO: 7052937 - DNA, 22 bp, Homo sapiens
ttacacatgaaggtccaatgtt

SEQ ID NO: 7052938 - DNA, 22 bp, Homo sapiens
ttacacatgctcacttatttgt

SEQ ID NO: 7052939 - DNA, 22 bp, Homo sapiens
ttacacatgctttgtgtgtatg

SEQ ID NO: 7052940 - DNA, 22 bp, Homo sapiens
ttacacagaaattttattgcct

SEQ ID NO: 7052941 - DNA, 22 bp, Homo sapiens
ttacacagacatggcatcatga

SEQ ID NO: 7052942 - DNA, 22 bp, Homo sapiens
ttacacactctgccctgctgtt

SEQ ID NO: 7052943 - DNA, 22 bp, Homo sapiens
ttacacagaaacactgttcaga

SEQ ID NO: 7052944 - DNA, 22 bp, Homo sapiens
ttacacacaattagcatagtaa

SEQ ID NO: 7052945 - DNA, 22 bp, Homo sapiens
ttacacagatggttagtagagg

SEQ ID NO: 7052946 - DNA, 22 bp, Homo sapiens
ttacacagcttctatccttgaa

SEQ ID NO: 7052947 - DNA, 17 bp, Homo sapiens
ttacacaggagagctct

SEQ ID NO: 7052948 - DNA, 22 bp, Homo sapiens
ttacacaggcacttaaaatgca

SEQ ID NO: 7052949 - DNA, 22 bp, Homo sapiens
ttacacaggcacttaaaatgca

SEQ ID NO: 7052950 - DNA, 22 bp, Homo sapiens
ttacacagtatccaaggttctt

SEQ ID NO: 7052951 - DNA, 22 bp, Homo sapiens
ttacacagtgaatttactcaag

SEQ ID NO: 7052952 - DNA, 22 bp, Homo sapiens
ttacaaagaaaattaggcattt

SEQ ID NO: 7052953 - DNA, 22 bp, Homo sapiens
ttacaaactgtcatatagtatt

SEQ ID NO: 7052954 - DNA, 22 bp, Homo sapiens
ttacaaacaacagacatttatt

SEQ ID NO: 7052955 - DNA, 22 bp, Homo sapiens
ttacaaacaacagacatttatt

SEQ ID NO: 7052956 - DNA, 22 bp, Homo sapiens
ttaattttaacctgtttgtgtc

SEQ ID NO: 7052957 - DNA, 22 bp, Homo sapiens
ttacatattatccaaaactgct

SEQ ID NO: 7052958 - DNA, 22 bp, Homo sapiens
ttacatcagaaggaaacagcgt

SEQ ID NO: 7052959 - DNA, 22 bp, Homo sapiens
ttacatcatgcttatccctttc

SEQ ID NO: 7052960 - DNA, 22 bp, Homo sapiens
ttacatgaatacataaccattc

SEQ ID NO: 7052961 - DNA, 22 bp, Homo sapiens
ttacactttggcaagctattaa

SEQ ID NO: 7052962 - DNA, 22 bp, Homo sapiens
ttacacttctaaaaaaagcagg

SEQ ID NO: 7052963 - DNA, 22 bp, Homo sapiens
ttacaggtgggaaaactaagct

SEQ ID NO: 7052964 - DNA, 22 bp, Homo sapiens
tgtttcttgagagtattaccct

SEQ ID NO: 7052965 - DNA, 22 bp, Homo sapiens
tgtttcctaagtgtctctgaag

SEQ ID NO: 7052966 - DNA, 22 bp, Homo sapiens
tgtttcctaagtgtctctgaag

SEQ ID NO: 7052967 - DNA, 18 bp, Homo sapiens
tgtttcctcctggaggct

SEQ ID NO: 7052968 - DNA, 18 bp, Homo sapiens
tgtttcctcctggaggct

SEQ ID NO: 7052969 - DNA, 22 bp, Homo sapiens
tgtttccttctgtctctttgga

SEQ ID NO: 7052970 - DNA, 22 bp, Homo sapiens
tgtttgaaaagtggagatttat

SEQ ID NO: 7052971 - DNA, 22 bp, Homo sapiens
tgtttgagttctagcgcattta

SEQ ID NO: 7052972 - DNA, 22 bp, Homo sapiens
tgtttgcaacaactagatggag

SEQ ID NO: 7052973 - DNA, 22 bp, Homo sapiens
tgttttcagtcatatagcaggt

SEQ ID NO: 7052974 - DNA, 22 bp, Homo sapiens
tgtttcatgtggacatagttgt

SEQ ID NO: 7052975 - DNA, 22 bp, Homo sapiens
tgtttcatgtggacatagttgt

SEQ ID NO: 7052976 - DNA, 22 bp, Homo sapiens
tgtttacatgcataagcttaag

SEQ ID NO: 7052977 - DNA, 22 bp, Homo sapiens
tgtttacaaggagtttatattg

SEQ ID NO: 7052978 - DNA, 22 bp, Homo sapiens
tgtttacaagccacttgttaag

SEQ ID NO: 7052979 - DNA, 22 bp, Homo sapiens
tgtttacaaggagaatttgagg

SEQ ID NO: 7052980 - DNA, 22 bp, Homo sapiens
tgtttacagggtgattttacct

SEQ ID NO: 7052981 - DNA, 22 bp, Homo sapiens
tgtttaataattctatgatagt

SEQ ID NO: 7052982 - DNA, 21 bp, Homo sapiens
tgttcctgttctctaggatcc

SEQ ID NO: 7052983 - DNA, 22 bp, Homo sapiens
tgttctcactggatgcttcaca

SEQ ID NO: 7052984 - DNA, 17 bp, Homo sapiens
tgttctcttcagaaatc

SEQ ID NO: 7052985 - DNA, 22 bp, Homo sapiens
tgttctcttttcctgctgagcc

SEQ ID NO: 7052986 - DNA, 22 bp, Homo sapiens
tgtgttgtgacattcttggatg

SEQ ID NO: 7052987 - DNA, 22 bp, Homo sapiens
tgtgttctggaaagctcactga

SEQ ID NO: 7052988 - DNA, 22 bp, Homo sapiens
tgtgtgcagcctctgtctttgg

SEQ ID NO: 7052989 - DNA, 22 bp, Homo sapiens
tgttatcacttagacatgctag

SEQ ID NO: 7052990 - DNA, 22 bp, Homo sapiens
tgttatcctcagctcacctcta

SEQ ID NO: 7052991 - DNA, 22 bp, Homo sapiens
tgttatctggttgtctgattac

SEQ ID NO: 7052992 - DNA, 22 bp, Homo sapiens
tgttatgaacttctagaaaaca

SEQ ID NO: 7052993 - DNA, 22 bp, Homo sapiens
tgttatgagtcctcatatacta

SEQ ID NO: 7052994 - DNA, 22 bp, Homo sapiens
tgttattctctgcctacaagtc

SEQ ID NO: 7052995 - DNA, 22 bp, Homo sapiens
tgttatttatctgagcatttat

SEQ ID NO: 7052996 - DNA, 22 bp, Homo sapiens
tgttatttctttgccatatctt

SEQ ID NO: 7052997 - DNA, 22 bp, Homo sapiens
tgttatttgggaaagttgtaca

SEQ ID NO: 7052998 - DNA, 22 bp, Homo sapiens
tgttcaaatcttttgcttattt

SEQ ID NO: 7052999 - DNA, 22 bp, Homo sapiens
tgttcagaacaaaggtaaatga

SEQ ID NO: 7053000 - DNA, 22 bp, Homo sapiens
tgttcccattttctgcataatc

SEQ ID NO: 7053001 - DNA, 22 bp, Homo sapiens
tgttcctgaatgcctggctggc

SEQ ID NO: 7053002 - DNA, 20 bp, Homo sapiens
tgtgtgaacacggactctgt

SEQ ID NO: 7053003 - DNA, 23 bp, Homo sapiens
tgtgtctgtttagggaggatgtg

SEQ ID NO: 7053004 - DNA, 22 bp, Homo sapiens
tgtgtctgttttgctcaccatt

SEQ ID NO: 7053005 - DNA, 22 bp, Homo sapiens
tgtgtgaattacgcgtgtcctg

SEQ ID NO: 7053006 - DNA, 22 bp, Homo sapiens
tgtgtgaattctgagcagttta

SEQ ID NO: 7053007 - DNA, 19 bp, Homo sapiens
tgtggtctctgttctcagg

SEQ ID NO: 7053008 - DNA, 22 bp, Homo sapiens
tgtggggaggctgcagtgctgc

SEQ ID NO: 7053009 - DNA, 19 bp, Homo sapiens
tgtggggagtcagggggct

SEQ ID NO: 7053010 - DNA, 22 bp, Homo sapiens
tgtggtggctattctggtctca

SEQ ID NO: 7053011 - DNA, 22 bp, Homo sapiens
tgtggtggggtctggtattcca

SEQ ID NO: 7053012 - DNA, 22 bp, Homo sapiens
tgtgtaaaagattagtttacta

SEQ ID NO: 7053013 - DNA, 22 bp, Homo sapiens
tgtgtaaaatctgattaatact

SEQ ID NO: 7053014 - DNA, 22 bp, Homo sapiens
tgtgtaaagcttgttccagaaa

SEQ ID NO: 7053015 - DNA, 22 bp, Homo sapiens
tgtgtaaatggactgtgaatta

SEQ ID NO: 7053016 - DNA, 22 bp, Homo sapiens
tgtgtaaatggcatctctcagc

SEQ ID NO: 7053017 - DNA, 22 bp, Homo sapiens
tccccaggtcctgtcggctcct

SEQ ID NO: 7053018 - DNA, 22 bp, Homo sapiens
tccccaggtcctgtcggctcct

SEQ ID NO: 7053019 - DNA, 22 bp, Homo sapiens
tcccccactctaaaggagcctt

SEQ ID NO: 7053020 - DNA, 22 bp, Homo sapiens
tcccccaggctggagtgcagtg

SEQ ID NO: 7053021 - DNA, 22 bp, Homo sapiens
tccccctcattacctcattcaa

SEQ ID NO: 7053022 - DNA, 22 bp, Homo sapiens
tcccctccaactccaactatgg

SEQ ID NO: 7053023 - DNA, 22 bp, Homo sapiens
tcccctccaactccaactatgg

SEQ ID NO: 7053024 - DNA, 22 bp, Homo sapiens
tcccctcccttccaacagagct

SEQ ID NO: 7053025 - DNA, 22 bp, Homo sapiens
tcccctcctctcctgatatggg

SEQ ID NO: 7053026 - DNA, 22 bp, Homo sapiens
tgtggactttagtaggtgagag

SEQ ID NO: 7053027 - DNA, 22 bp, Homo sapiens
tgtggactcgcatggctgaggc

SEQ ID NO: 7053028 - DNA, 22 bp, Homo sapiens
tgtggactgtgctgccacagtg

SEQ ID NO: 7053029 - DNA, 22 bp, Homo sapiens
tcccctgcagatgagggcagtg

SEQ ID NO: 7053030 - DNA, 22 bp, Homo sapiens
tcccctgcagcgcctgcttcta

SEQ ID NO: 7053031 - DNA, 18 bp, Homo sapiens
tcccctgctctggtgctc

SEQ ID NO: 7053032 - DNA, 22 bp, Homo sapiens
tgtggcatacacatgaggtggt

SEQ ID NO: 7053033 - DNA, 22 bp, Homo sapiens
tgtggcagtataagagctagaa

SEQ ID NO: 7053034 - DNA, 22 bp, Homo sapiens
tgtggccagccacaggcatggt

SEQ ID NO: 7053035 - DNA, 20 bp, Homo sapiens
tgtggatgaggtaaggatag

SEQ ID NO: 7053036 - DNA, 22 bp, Homo sapiens
tgtggcagaaccagaattcaaa

SEQ ID NO: 7053037 - DNA, 22 bp, Homo sapiens
tgtggcagagagagcttccttg

SEQ ID NO: 7053038 - DNA, 22 bp, Homo sapiens
tgtggcagaggaggcagcgtcc

SEQ ID NO: 7053039 - DNA, 21 bp, Homo sapiens
tgtggcagatgttgggaggca

SEQ ID NO: 7053040 - DNA, 22 bp, Homo sapiens
ggtcacagctttttcagcagca

SEQ ID NO: 7053041 - DNA, 22 bp, Homo sapiens
cagatgagcatgggcacaagca

SEQ ID NO: 7053042 - DNA, 23 bp, Homo sapiens
cagatgaggttggcagcatggtc

SEQ ID NO: 7053043 - DNA, 22 bp, Homo sapiens
cagatgcagcaaaatgacaggc

SEQ ID NO: 7053044 - DNA, 20 bp, Homo sapiens
gggtgtgggcccggccaggc

SEQ ID NO: 7053045 - DNA, 22 bp, Homo sapiens
gggtgtgtcttttgctcctgga

SEQ ID NO: 7053046 - DNA, 22 bp, Homo sapiens
gggtgggatgccgctgtctcca

SEQ ID NO: 7053047 - DNA, 22 bp, Homo sapiens
gggtgttgattttacactaaaa

SEQ ID NO: 7053048 - DNA, 22 bp, Homo sapiens
gggttaaaacaggaagatcagc

SEQ ID NO: 7053049 - DNA, 22 bp, Homo sapiens
gggttaaagcaggaagcatctt

SEQ ID NO: 7053050 - DNA, 22 bp, Homo sapiens
gggttaggtccctcccttctgg

SEQ ID NO: 7053051 - DNA, 22 bp, Homo sapiens
gggttcagactaaagctatgca

SEQ ID NO: 7053052 - DNA, 22 bp, Homo sapiens
gggttcagagtcaggtgtgata

SEQ ID NO: 7053053 - DNA, 22 bp, Homo sapiens
gggttcagtccctcttgctact

SEQ ID NO: 7053054 - DNA, 22 bp, Homo sapiens
gggttcagtccctcttgctact

SEQ ID NO: 7053055 - DNA, 19 bp, Homo sapiens
ggtatatgggcctcacttg

SEQ ID NO: 7053056 - DNA, 22 bp, Homo sapiens
gggtccctggaattacttgaca

SEQ ID NO: 7053057 - DNA, 22 bp, Homo sapiens
gggtccaggtcttcaggcagag

SEQ ID NO: 7053058 - DNA, 22 bp, Homo sapiens
gggtccagtttcatctgaggtt

SEQ ID NO: 7053059 - DNA, 22 bp, Homo sapiens
gggtacagttcttccagtgtca

SEQ ID NO: 7053060 - DNA, 22 bp, Homo sapiens
gggtacttaatatttacggggt

SEQ ID NO: 7053061 - DNA, 22 bp, Homo sapiens
gggtagcatgtgtcagagtttg

SEQ ID NO: 7053062 - DNA, 22 bp, Homo sapiens
ggggccttttctgaatgtggaa

SEQ ID NO: 7053063 - DNA, 22 bp, Homo sapiens
ggggtgagctgggcctgtgcct

SEQ ID NO: 7053064 - DNA, 22 bp, Homo sapiens
ggggtgagtgctcagccccgga

SEQ ID NO: 7053065 - DNA, 22 bp, Homo sapiens
ggggcctgtagagcttcaggga

SEQ ID NO: 7053066 - DNA, 23 bp, Homo sapiens
ggggcctgcaccggtctgcgcgg

SEQ ID NO: 7053067 - DNA, 22 bp, Homo sapiens
ggggcagctaccggaagtaggg

SEQ ID NO: 7053068 - DNA, 22 bp, Homo sapiens
gggctgtggagccgcgagggct

SEQ ID NO: 7053069 - DNA, 18 bp, Homo sapiens
gggctgtgagatgggaag

SEQ ID NO: 7053070 - DNA, 22 bp, Homo sapiens
gggctgtaggagctggaatggg

SEQ ID NO: 7053071 - DNA, 22 bp, Homo sapiens
cagagccagcagtggggacagg

SEQ ID NO: 7053072 - DNA, 22 bp, Homo sapiens
gggctgagtgggcctcttactt

SEQ ID NO: 7053073 - DNA, 22 bp, Homo sapiens
gggctgagtgggcctcttactt

SEQ ID NO: 7053074 - DNA, 22 bp, Homo sapiens
gggctggaggtgagcaggacag

SEQ ID NO: 7053075 - DNA, 22 bp, Homo sapiens
gggctggaggtgagcaggacag

SEQ ID NO: 7053076 - DNA, 18 bp, Homo sapiens
cagacactctgctctgca

SEQ ID NO: 7053077 - DNA, 22 bp, Homo sapiens
cagacacaccaggcccattctg

SEQ ID NO: 7053078 - DNA, 22 bp, Homo sapiens
gggaggcagtgctggaggctgg

SEQ ID NO: 7053079 - DNA, 22 bp, Homo sapiens
gggaggagtgaagattcacctg

SEQ ID NO: 7053080 - DNA, 21 bp, Homo sapiens
gggagctggaaactgggtgac

SEQ ID NO: 7053081 - DNA, 22 bp, Homo sapiens
ggctggcactgaggagagctct

SEQ ID NO: 7053082 - DNA, 22 bp, Homo sapiens
ggctggcactgaggagagctct

SEQ ID NO: 7053083 - DNA, 19 bp, Homo sapiens
ggctggcaagtgacagtgt

SEQ ID NO: 7053084 - DNA, 22 bp, Homo sapiens
cagaattatagttgctttttaa

SEQ ID NO: 7053085 - DNA, 22 bp, Homo sapiens
cagaatttaagtggattattct

SEQ ID NO: 7053086 - DNA, 22 bp, Homo sapiens
cagaatttagaaaacaacataa

SEQ ID NO: 7053087 - DNA, 22 bp, Homo sapiens
cagaatttagcacaatgtatgg

SEQ ID NO: 7053088 - DNA, 22 bp, Homo sapiens
cagaatttgaagtaatattcca

SEQ ID NO: 7053089 - DNA, 22 bp, Homo sapiens
cagacttgaaagagactcagtt

SEQ ID NO: 7053090 - DNA, 22 bp, Homo sapiens
cagacttgacggcagctgcttt

SEQ ID NO: 7053091 - DNA, 22 bp, Homo sapiens
cagagacaacctggtagagaaa

SEQ ID NO: 7053092 - DNA, 22 bp, Homo sapiens
cagagacaacctggtagagaaa

SEQ ID NO: 7053093 - DNA, 22 bp, Homo sapiens
cagagacacttaacaggaatgg

SEQ ID NO: 7053094 - DNA, 22 bp, Homo sapiens
cagagacacttaacaggaatgg

SEQ ID NO: 7053095 - DNA, 22 bp, Homo sapiens
cagagacacttaacaggaatgg

SEQ ID NO: 7053096 - DNA, 22 bp, Homo sapiens
gggatgacaaagtgtctgtccc

SEQ ID NO: 7053097 - DNA, 22 bp, Homo sapiens
gggatgagagctgggacagaag

SEQ ID NO: 7053098 - DNA, 22 bp, Homo sapiens
cagagcagaaacctgggtgatt

SEQ ID NO: 7053099 - DNA, 22 bp, Homo sapiens
cagagcagaagcggtcctcaca

SEQ ID NO: 7053100 - DNA, 22 bp, Homo sapiens
gggcaggtacaagatgcttctt

SEQ ID NO: 7053101 - DNA, 22 bp, Homo sapiens
gggcaggggtcagtggccccaa

SEQ ID NO: 7053102 - DNA, 22 bp, Homo sapiens
cagagcaggggtttcccaggtt

SEQ ID NO: 7053103 - DNA, 22 bp, Homo sapiens
cagagcaggggtttcccaggtt

SEQ ID NO: 7053104 - DNA, 22 bp, Homo sapiens
cagagcagtgaggagttgtgta

SEQ ID NO: 7053105 - DNA, 22 bp, Homo sapiens
gggcaggggtcagtggccccaa

SEQ ID NO: 7053106 - DNA, 18 bp, Homo sapiens
cagagcagaggtggagcg

SEQ ID NO: 7053107 - DNA, 22 bp, Homo sapiens
gggcaggggtagcattccaagt

SEQ ID NO: 7053108 - DNA, 22 bp, Homo sapiens
cagagcagacgttgagattaag

SEQ ID NO: 7053109 - DNA, 20 bp, Homo sapiens
cagagcagtgcccaggcggc

SEQ ID NO: 7053110 - DNA, 22 bp, Homo sapiens
cagagcagtggggttggtcaga

SEQ ID NO: 7053111 - DNA, 22 bp, Homo sapiens
cagagcataattgacatgaggt

SEQ ID NO: 7053112 - DNA, 22 bp, Homo sapiens
cagagccaaacctcagggcccg

SEQ ID NO: 7053113 - DNA, 22 bp, Homo sapiens
cagccaggcccagatcatgctg

SEQ ID NO: 7053114 - DNA, 22 bp, Homo sapiens
cagccaggcccccgagtcgttg

SEQ ID NO: 7053115 - DNA, 22 bp, Homo sapiens
cagccaggagcctctgcaacta

SEQ ID NO: 7053116 - DNA, 20 bp, Homo sapiens
gtccagagtaatgtgctgac

SEQ ID NO: 7053117 - DNA, 22 bp, Homo sapiens
gtccagagggctgcaggatgct

SEQ ID NO: 7053118 - DNA, 22 bp, Homo sapiens
gtccagagccggaagagtgaca

SEQ ID NO: 7053119 - DNA, 22 bp, Homo sapiens
gtccagagccggaagagtgaca

SEQ ID NO: 7053120 - DNA, 22 bp, Homo sapiens
gtccagagaggcaggaggctac

SEQ ID NO: 7053121 - DNA, 22 bp, Homo sapiens
cagcatccctcaggggcctctg

SEQ ID NO: 7053122 - DNA, 22 bp, Homo sapiens
cagcagtgtctccagcatcaca

SEQ ID NO: 7053123 - DNA, 22 bp, Homo sapiens
cagcagtgtctccagcatcaca

SEQ ID NO: 7053124 - DNA, 22 bp, Homo sapiens
gtcagcaaaaaatttatgtgag

SEQ ID NO: 7053125 - DNA, 19 bp, Homo sapiens
gtcagcaccatggacaggg

SEQ ID NO: 7053126 - DNA, 22 bp, Homo sapiens
gtcagcacctctttggggagct

SEQ ID NO: 7053127 - DNA, 22 bp, Homo sapiens
gtcagcacttttccgaggcaga

SEQ ID NO: 7053128 - DNA, 22 bp, Homo sapiens
gtcagcagaaacgccacatgca

SEQ ID NO: 7053129 - DNA, 21 bp, Homo sapiens
gtcagcagatccagcacttgt

SEQ ID NO: 7053130 - DNA, 22 bp, Homo sapiens
gtattttacttacgcatgactt

SEQ ID NO: 7053131 - DNA, 22 bp, Homo sapiens
gtattttatggcatgcagtggc

SEQ ID NO: 7053132 - DNA, 22 bp, Homo sapiens
gtcacacaatagtaagtggtcc

SEQ ID NO: 7053133 - DNA, 22 bp, Homo sapiens
gtcacacacatttctttggtgc

SEQ ID NO: 7053134 - DNA, 22 bp, Homo sapiens
gtcacacagagccctgtgctca

SEQ ID NO: 7053135 - DNA, 21 bp, Homo sapiens
gtcacacaggcctggagctga

SEQ ID NO: 7053136 - DNA, 22 bp, Homo sapiens
gtcacaggaaagggtgtaaggg

SEQ ID NO: 7053137 - DNA, 22 bp, Homo sapiens
gtagaaaaagcagtaagtctca

SEQ ID NO: 7053138 - DNA, 22 bp, Homo sapiens
gtagaaatatttatctctgaga

SEQ ID NO: 7053139 - DNA, 22 bp, Homo sapiens
gtaggcagggctgtggggagaa

SEQ ID NO: 7053140 - DNA, 22 bp, Homo sapiens
gtaggcaggtggaggagtgaag

SEQ ID NO: 7053141 - DNA, 22 bp, Homo sapiens
gtaggcagtctctcaggtgatc

SEQ ID NO: 7053142 - DNA, 22 bp, Homo sapiens
gtaggcagtgcttgattttcca

SEQ ID NO: 7053143 - DNA, 22 bp, Homo sapiens
gtaggcagtggttggaagagaa

SEQ ID NO: 7053144 - DNA, 22 bp, Homo sapiens
gtacacattatgcttctctaaa

SEQ ID NO: 7053145 - DNA, 22 bp, Homo sapiens
gtacacattgtctgtttacttc

SEQ ID NO: 7053146 - DNA, 20 bp, Homo sapiens
gtacacatatatgtatgtgt

SEQ ID NO: 7053147 - DNA, 22 bp, Homo sapiens
gtacacatatattaaaaattgt

SEQ ID NO: 7053148 - DNA, 22 bp, Homo sapiens
gtacacatatttccaagggtaa

SEQ ID NO: 7053149 - DNA, 23 bp, Homo sapiens
gtacacatagtgtagttatattt

SEQ ID NO: 7053150 - DNA, 22 bp, Homo sapiens
gtacacagagtggtggaagaaa

SEQ ID NO: 7053151 - DNA, 22 bp, Homo sapiens
gtacacagatgcttgagaatct

SEQ ID NO: 7053152 - DNA, 22 bp, Homo sapiens
gtacacaggcagcccagtgctg

SEQ ID NO: 7053153 - DNA, 21 bp, Homo sapiens
gtacacagtggttctgaggga

SEQ ID NO: 7053154 - DNA, 22 bp, Homo sapiens
gtacacatactattcaaagaga

SEQ ID NO: 7053155 - DNA, 22 bp, Homo sapiens
gtacacataggttactgattaa

SEQ ID NO: 7053156 - DNA, 22 bp, Homo sapiens
cagcagcctagggttccatcat

SEQ ID NO: 7053157 - DNA, 22 bp, Homo sapiens
cagcaaaatttgaggattgcct

SEQ ID NO: 7053158 - DNA, 22 bp, Homo sapiens
cagcagccactagagggctcac

SEQ ID NO: 7053159 - DNA, 22 bp, Homo sapiens
cagcagccatgtaccacactca

SEQ ID NO: 7053160 - DNA, 20 bp, Homo sapiens
cagcagccattctagtagta

SEQ ID NO: 7053161 - DNA, 22 bp, Homo sapiens
cagcagcctagaagctctacca

SEQ ID NO: 7053162 - DNA, 22 bp, Homo sapiens
cagatttaagatatttgtattg

SEQ ID NO: 7053163 - DNA, 22 bp, Homo sapiens
cagattccagtttgtggctccc

SEQ ID NO: 7053164 - DNA, 22 bp, Homo sapiens
cagattctcactgtattcaggt

SEQ ID NO: 7053165 - DNA, 20 bp, Homo sapiens
cagattctccactaacatat

SEQ ID NO: 7053166 - DNA, 22 bp, Homo sapiens
cagattctccaggggctgcaga

SEQ ID NO: 7053167 - DNA, 22 bp, Homo sapiens
cagattctgaagtctagctgct

SEQ ID NO: 7053168 - DNA, 22 bp, Homo sapiens
cagattctgcagtcaacttgct

SEQ ID NO: 7053169 - DNA, 22 bp, Homo sapiens
cagattctgggcccagcttgtc

SEQ ID NO: 7053170 - DNA, 22 bp, Homo sapiens
cagattcttaatttatgggatt

SEQ ID NO: 7053171 - DNA, 22 bp, Homo sapiens
cagattcttcattcattctaca

SEQ ID NO: 7053172 - DNA, 22 bp, Homo sapiens
cagattcttcattgccccattc

SEQ ID NO: 7053173 - DNA, 22 bp, Homo sapiens
cagattcttctgtatttttgct

SEQ ID NO: 7053174 - DNA, 22 bp, Homo sapiens
gtgagagtgtttggaaatagaa

SEQ ID NO: 7053175 - DNA, 18 bp, Homo sapiens
gtgagcagagagcatcac

SEQ ID NO: 7053176 - DNA, 22 bp, Homo sapiens
cagccctctgaagaggcgcttg

SEQ ID NO: 7053177 - DNA, 22 bp, Homo sapiens
cagccctcctttcactcccagg

SEQ ID NO: 7053178 - DNA, 22 bp, Homo sapiens
gtcctgtcccccaaggctgtgg

SEQ ID NO: 7053179 - DNA, 22 bp, Homo sapiens
gtgagagggctgggctcatgat

SEQ ID NO: 7053180 - DNA, 22 bp, Homo sapiens
gtgagagtaccacctcaacatc

SEQ ID NO: 7053181 - DNA, 22 bp, Homo sapiens
cagccctggtgccaaggttccc

SEQ ID NO: 7053182 - DNA, 22 bp, Homo sapiens
cagccctggtgccaaggttccc

SEQ ID NO: 7053183 - DNA, 22 bp, Homo sapiens
cagccctgtccaatgtctgctc

SEQ ID NO: 7053184 - DNA, 22 bp, Homo sapiens
cagccctgtccagcagagggtg

SEQ ID NO: 7053185 - DNA, 22 bp, Homo sapiens
cagccctgtctatgactgatga

SEQ ID NO: 7053186 - DNA, 22 bp, Homo sapiens
cacagtctctgttgctgggacc

SEQ ID NO: 7053187 - DNA, 22 bp, Homo sapiens
cacaggtgtatgaatatgtcca

SEQ ID NO: 7053188 - DNA, 22 bp, Homo sapiens
ggcaaggtactctagagcacat

SEQ ID NO: 7053189 - DNA, 22 bp, Homo sapiens
ggcaagtggtagaacatctgag

SEQ ID NO: 7053190 - DNA, 22 bp, Homo sapiens
cacaggagtgctgctattgttg

SEQ ID NO: 7053191 - DNA, 22 bp, Homo sapiens
cacaggagtgctgctattgttg

SEQ ID NO: 7053192 - DNA, 22 bp, Homo sapiens
ggagagctagtgcctgccagta

SEQ ID NO: 7053193 - DNA, 22 bp, Homo sapiens
cacaggcacccctgactgctca

SEQ ID NO: 7053194 - DNA, 22 bp, Homo sapiens
cacaggcacgcctctggccagg

SEQ ID NO: 7053195 - DNA, 23 bp, Homo sapiens
cacaggcagaaatcaagacggta

SEQ ID NO: 7053196 - DNA, 23 bp, Homo sapiens
cacaggcagaaatcaagacggta

SEQ ID NO: 7053197 - DNA, 22 bp, Homo sapiens
cacaggcagccttgtagaagaa

SEQ ID NO: 7053198 - DNA, 22 bp, Homo sapiens
cacaggcagccttgtagaagaa

SEQ ID NO: 7053199 - DNA, 22 bp, Homo sapiens
cacaggcaggaggttctccagt

SEQ ID NO: 7053200 - DNA, 18 bp, Homo sapiens
cacaggcaggtgataggt

SEQ ID NO: 7053201 - DNA, 22 bp, Homo sapiens
cacagggttgttctgaggattc

SEQ ID NO: 7053202 - DNA, 22 bp, Homo sapiens
cacaggtccttcctgccctggg

SEQ ID NO: 7053203 - DNA, 18 bp, Homo sapiens
cacaggcaggtgataggt

SEQ ID NO: 7053204 - DNA, 21 bp, Homo sapiens
cacattccatgggtctattta

SEQ ID NO: 7053205 - DNA, 22 bp, Homo sapiens
cacattccccagagctggggct

SEQ ID NO: 7053206 - DNA, 22 bp, Homo sapiens
cacattcctgagcttcgacctg

SEQ ID NO: 7053207 - DNA, 22 bp, Homo sapiens
cacattcctggtgctcagcagc

SEQ ID NO: 7053208 - DNA, 22 bp, Homo sapiens
cacattccttacattcatagag

SEQ ID NO: 7053209 - DNA, 22 bp, Homo sapiens
caccactgcttcctgccatctg

SEQ ID NO: 7053210 - DNA, 22 bp, Homo sapiens
caccactggaggtcttggcttt

SEQ ID NO: 7053211 - DNA, 22 bp, Homo sapiens
caccagctccaccagggcaggt

SEQ ID NO: 7053212 - DNA, 22 bp, Homo sapiens
cacatgcttagatttcagtgga

SEQ ID NO: 7053213 - DNA, 22 bp, Homo sapiens
cacatgttcttgaagccaactc

SEQ ID NO: 7053214 - DNA, 22 bp, Homo sapiens
ggcagaggtgacagtgtctttt

SEQ ID NO: 7053215 - DNA, 22 bp, Homo sapiens
ggcagagttggtggagtcagtt

SEQ ID NO: 7053216 - DNA, 22 bp, Homo sapiens
ggcagagttggtggagtcagtt

SEQ ID NO: 7053217 - DNA, 22 bp, Homo sapiens
cacatgaagagagtctagtaat

SEQ ID NO: 7053218 - DNA, 22 bp, Homo sapiens
cacttcattgggaccagggctg

SEQ ID NO: 7053219 - DNA, 19 bp, Homo sapiens
cacttcaatcctttatcaa

SEQ ID NO: 7053220 - DNA, 22 bp, Homo sapiens
cacttcaatctctgcctccatc

SEQ ID NO: 7053221 - DNA, 22 bp, Homo sapiens
cacttcaattaacttcagcatt

SEQ ID NO: 7053222 - DNA, 22 bp, Homo sapiens
cacttagatactagatcacaaa

SEQ ID NO: 7053223 - DNA, 22 bp, Homo sapiens
cacttcaaataagctcttctca

SEQ ID NO: 7053224 - DNA, 22 bp, Homo sapiens
cacttcaaatatggcttcatga

SEQ ID NO: 7053225 - DNA, 22 bp, Homo sapiens
cacttcaacagttatttcttag

SEQ ID NO: 7053226 - DNA, 22 bp, Homo sapiens
cacttcaacctctgagtcctgg

SEQ ID NO: 7053227 - DNA, 22 bp, Homo sapiens
cacttcaagagcaagggtgcca

SEQ ID NO: 7053228 - DNA, 22 bp, Homo sapiens
ggctctggaaagtgtccttgat

SEQ ID NO: 7053229 - DNA, 20 bp, Homo sapiens
ggctctggaatctggtgggc

SEQ ID NO: 7053230 - DNA, 22 bp, Homo sapiens
cacttctctgataatctcagtt

SEQ ID NO: 7053231 - DNA, 22 bp, Homo sapiens
cacttgggagcattgcacatgt

SEQ ID NO: 7053232 - DNA, 22 bp, Homo sapiens
cactgtattattaggaatgaca

SEQ ID NO: 7053233 - DNA, 21 bp, Homo sapiens
cactgtatagcaggagaaaac

SEQ ID NO: 7053234 - DNA, 22 bp, Homo sapiens
cactgggagtcgtaagacacgg

SEQ ID NO: 7053235 - DNA, 22 bp, Homo sapiens
cactgcactccagcttgggtga

SEQ ID NO: 7053236 - DNA, 22 bp, Homo sapiens
cactgcactccagcctgggtga

SEQ ID NO: 7053237 - DNA, 22 bp, Homo sapiens
cactgcactccagcctgggtga

SEQ ID NO: 7053238 - DNA, 22 bp, Homo sapiens
cactgcactccagcctgggtca

SEQ ID NO: 7053239 - DNA, 22 bp, Homo sapiens
cactgcactccagcctgggtca

SEQ ID NO: 7053240 - DNA, 22 bp, Homo sapiens
cactataatcctgttttagaac

SEQ ID NO: 7053241 - DNA, 22 bp, Homo sapiens
cactatatctctttcatctttt

SEQ ID NO: 7053242 - DNA, 21 bp, Homo sapiens
cactatttatatatgccagct

SEQ ID NO: 7053243 - DNA, 22 bp, Homo sapiens
cactctccagcacaccccattt

SEQ ID NO: 7053244 - DNA, 21 bp, Homo sapiens
cactctcccaatccttgctga

SEQ ID NO: 7053245 - DNA, 22 bp, Homo sapiens
cactgcactccagcctgggaga

SEQ ID NO: 7053246 - DNA, 22 bp, Homo sapiens
cactctctcaggctttccttgt

SEQ ID NO: 7053247 - DNA, 22 bp, Homo sapiens
cactctgacacatgaacttgat

SEQ ID NO: 7053248 - DNA, 22 bp, Homo sapiens
cactgcactccagcctgggaga

SEQ ID NO: 7053249 - DNA, 22 bp, Homo sapiens
caccaggctgcccaggacaggg

SEQ ID NO: 7053250 - DNA, 22 bp, Homo sapiens
caccaggctgaaccagagggga

SEQ ID NO: 7053251 - DNA, 22 bp, Homo sapiens
caccaggctgaaccagagggga

SEQ ID NO: 7053252 - DNA, 20 bp, Homo sapiens
caccaggcgctctgagaaca

SEQ ID NO: 7053253 - DNA, 22 bp, Homo sapiens
caccaggctgaaccagagggga

SEQ ID NO: 7053254 - DNA, 22 bp, Homo sapiens
caccaggctggagtgcagaggt

SEQ ID NO: 7053255 - DNA, 22 bp, Homo sapiens
caccaggctggagtgcagaggt

SEQ ID NO: 7053256 - DNA, 22 bp, Homo sapiens
caccaggctggagtgcagaggt

SEQ ID NO: 7053257 - DNA, 22 bp, Homo sapiens
caccctgggctgggcctgttaa

SEQ ID NO: 7053258 - DNA, 22 bp, Homo sapiens
ggccaggctggttccttgacct

SEQ ID NO: 7053259 - DNA, 22 bp, Homo sapiens
ggccaggctggtctcagacttc

SEQ ID NO: 7053260 - DNA, 22 bp, Homo sapiens
ggccaggctgccctgggagcag

SEQ ID NO: 7053261 - DNA, 22 bp, Homo sapiens
ggccaggctgctgggaccccgc

SEQ ID NO: 7053262 - DNA, 22 bp, Homo sapiens
ggccaggctggtctcagacttc

SEQ ID NO: 7053263 - DNA, 22 bp, Homo sapiens
cacctgctccctcagttccagc

SEQ ID NO: 7053264 - DNA, 22 bp, Homo sapiens
cacctgggctaaactatgcagg

SEQ ID NO: 7053265 - DNA, 22 bp, Homo sapiens
caacacattgaagctatgatga

SEQ ID NO: 7053266 - DNA, 22 bp, Homo sapiens
caacacattgaagctatgatga

SEQ ID NO: 7053267 - DNA, 22 bp, Homo sapiens
caacactgacaatggactgatt

SEQ ID NO: 7053268 - DNA, 22 bp, Homo sapiens
caacaatatgccagactcaatt

SEQ ID NO: 7053269 - DNA, 22 bp, Homo sapiens
caagaacattgtgatcacttca

SEQ ID NO: 7053270 - DNA, 22 bp, Homo sapiens
gctctggaagcatctgagagga

SEQ ID NO: 7053271 - DNA, 22 bp, Homo sapiens
gctctggagagccataggccct

SEQ ID NO: 7053272 - DNA, 23 bp, Homo sapiens
gctctggagctgggcctggcagg

SEQ ID NO: 7053273 - DNA, 22 bp, Homo sapiens
gctctggatccggctgggtctg

SEQ ID NO: 7053274 - DNA, 22 bp, Homo sapiens
caaagtgctaggattacaggcc

SEQ ID NO: 7053275 - DNA, 22 bp, Homo sapiens
caaagtgctaggattacaggcg

SEQ ID NO: 7053276 - DNA, 22 bp, Homo sapiens
gctgccctctctggccccacac

SEQ ID NO: 7053277 - DNA, 22 bp, Homo sapiens
gctgccctgcatctgtgccttc

SEQ ID NO: 7053278 - DNA, 18 bp, Homo sapiens
gctgcctgcattcctcac

SEQ ID NO: 7053279 - DNA, 22 bp, Homo sapiens
gctgcctgcacagagctgcttt

SEQ ID NO: 7053280 - DNA, 22 bp, Homo sapiens
gctgcctgcctagttccacagt

SEQ ID NO: 7053281 - DNA, 22 bp, Homo sapiens
gctgctttctgttaggaattgg

SEQ ID NO: 7053282 - DNA, 22 bp, Homo sapiens
gctgctttgacagtgggaacag

SEQ ID NO: 7053283 - DNA, 22 bp, Homo sapiens
gctgctttgacagtgggaacag

SEQ ID NO: 7053284 - DNA, 22 bp, Homo sapiens
gctgctttttggatttggcaca

SEQ ID NO: 7053285 - DNA, 22 bp, Homo sapiens
caagacaagatctaagcatgct

SEQ ID NO: 7053286 - DNA, 22 bp, Homo sapiens
caagaatataaatactttcaaa

SEQ ID NO: 7053287 - DNA, 22 bp, Homo sapiens
caagaaggctatatgggccagg

SEQ ID NO: 7053288 - DNA, 22 bp, Homo sapiens
gctggagaaacaggaggaggaa

SEQ ID NO: 7053289 - DNA, 22 bp, Homo sapiens
gctggacaggccacatggagga

SEQ ID NO: 7053290 - DNA, 22 bp, Homo sapiens
gctgggctcagacctagtgaac

SEQ ID NO: 7053291 - DNA, 22 bp, Homo sapiens
caagctgcagcgcctgcgccgg

SEQ ID NO: 7053292 - DNA, 22 bp, Homo sapiens
gctgggctcaccaggccactag

SEQ ID NO: 7053293 - DNA, 19 bp, Homo sapiens
gctggggaatggatattga

SEQ ID NO: 7053294 - DNA, 22 bp, Homo sapiens
gctggggaccagctgtctctga

SEQ ID NO: 7053295 - DNA, 22 bp, Homo sapiens
gctggggactccccaccatagc

SEQ ID NO: 7053296 - DNA, 22 bp, Homo sapiens
gctggggagaattgggttatct

SEQ ID NO: 7053297 - DNA, 22 bp, Homo sapiens
gctggggagcaagagtagtgag

SEQ ID NO: 7053298 - DNA, 22 bp, Homo sapiens
gctggggagcaagagtagtgag

SEQ ID NO: 7053299 - DNA, 22 bp, Homo sapiens
caagccctgttaggggtctcta

SEQ ID NO: 7053300 - DNA, 22 bp, Homo sapiens
gctggctgagttctgtcgtctg

SEQ ID NO: 7053301 - DNA, 22 bp, Homo sapiens
ggaccagagaagtgagcacctg

SEQ ID NO: 7053302 - DNA, 22 bp, Homo sapiens
ggacatggagcatgtagagaaa

SEQ ID NO: 7053303 - DNA, 19 bp, Homo sapiens
cacaacttcgcttgattcc

SEQ ID NO: 7053304 - DNA, 18 bp, Homo sapiens
ggacaggagacatgggtg

SEQ ID NO: 7053305 - DNA, 18 bp, Homo sapiens
ggacaggagacatgggtg

SEQ ID NO: 7053306 - DNA, 22 bp, Homo sapiens
cacaaatgactgaaacgactgt

SEQ ID NO: 7053307 - DNA, 22 bp, Homo sapiens
ggaagctggtaattgttgggac

SEQ ID NO: 7053308 - DNA, 22 bp, Homo sapiens
ggaagctgtgctctcaggcctc

SEQ ID NO: 7053309 - DNA, 20 bp, Homo sapiens
ggaagctgtgggtccccagg

SEQ ID NO: 7053310 - DNA, 22 bp, Homo sapiens
ggaagaggaggagccaggcttt

SEQ ID NO: 7053311 - DNA, 22 bp, Homo sapiens
ggaagaggaggagccaggcttt

SEQ ID NO: 7053312 - DNA, 23 bp, Homo sapiens
ggaagctcacgtagtcctgcact

SEQ ID NO: 7053313 - DNA, 22 bp, Homo sapiens
ggaagctgccagtccaccagct

SEQ ID NO: 7053314 - DNA, 21 bp, Homo sapiens
cacacagtgatctatccacat

SEQ ID NO: 7053315 - DNA, 22 bp, Homo sapiens
ggagaagggacagactcagctt

SEQ ID NO: 7053316 - DNA, 22 bp, Homo sapiens
ggaccagagctcgggcttctca

SEQ ID NO: 7053317 - DNA, 22 bp, Homo sapiens
cacacaggtaagcctctttcaa

SEQ ID NO: 7053318 - DNA, 22 bp, Homo sapiens
ggagagcagggaggctgctctg

SEQ ID NO: 7053319 - DNA, 22 bp, Homo sapiens
caatttcatgccatgtattgct

SEQ ID NO: 7053320 - DNA, 22 bp, Homo sapiens
caatttcaatacaaaatacatt

SEQ ID NO: 7053321 - DNA, 19 bp, Homo sapiens
caattctgcaacactgtcc

SEQ ID NO: 7053322 - DNA, 22 bp, Homo sapiens
caatcacaaagagacaagtgtc

SEQ ID NO: 7053323 - DNA, 22 bp, Homo sapiens
caatatataatgagtactttcc

SEQ ID NO: 7053324 - DNA, 22 bp, Homo sapiens
caatatataatgagtactttcc

SEQ ID NO: 7053325 - DNA, 22 bp, Homo sapiens
caatatataggaacaacttagg

SEQ ID NO: 7053326 - DNA, 22 bp, Homo sapiens
caatatataggaacaacttagg

SEQ ID NO: 7053327 - DNA, 19 bp, Homo sapiens
caatatatagtgagtggat

SEQ ID NO: 7053328 - DNA, 19 bp, Homo sapiens
caatatatagtgagtggat

SEQ ID NO: 7053329 - DNA, 22 bp, Homo sapiens
caatagttcggtcctgaaggcc

SEQ ID NO: 7053330 - DNA, 22 bp, Homo sapiens
caatagcaggtctacagagaga

SEQ ID NO: 7053331 - DNA, 18 bp, Homo sapiens
caatagaaacagtaggaa

SEQ ID NO: 7053332 - DNA, 22 bp, Homo sapiens
caatagaaggcacagataggta

SEQ ID NO: 7053333 - DNA, 20 bp, Homo sapiens
caatagaatgtggagataag

SEQ ID NO: 7053334 - DNA, 22 bp, Homo sapiens
caatagcagacctagaaagcaa

SEQ ID NO: 7053335 - DNA, 22 bp, Homo sapiens
caaggctgctgcgggtcgcacc

SEQ ID NO: 7053336 - DNA, 22 bp, Homo sapiens
caaggctgctgcgggtcgcacc

SEQ ID NO: 7053337 - DNA, 22 bp, Homo sapiens
caaggctgcaaaactacatggg

SEQ ID NO: 7053338 - DNA, 22 bp, Homo sapiens
gctggggagctagacctcagca

SEQ ID NO: 7053339 - DNA, 22 bp, Homo sapiens
gctggggaggcagcagagaaca

SEQ ID NO: 7053340 - DNA, 22 bp, Homo sapiens
caaggctgctggcttctgagct

SEQ ID NO: 7053341 - DNA, 22 bp, Homo sapiens
caaggctgcttcagactagtga

SEQ ID NO: 7053342 - DNA, 22 bp, Homo sapiens
caaggctgcttcagactagtga

SEQ ID NO: 7053343 - DNA, 22 bp, Homo sapiens
caaggctgtctccagcttccaa

SEQ ID NO: 7053344 - DNA, 22 bp, Homo sapiens
caaggctgtgcagggtccatat

SEQ ID NO: 7053345 - DNA, 22 bp, Homo sapiens
caaggctgtgcagggtccatat

SEQ ID NO: 7053346 - DNA, 22 bp, Homo sapiens
caaggctgtgcagggtccatat

SEQ ID NO: 7053347 - DNA, 22 bp, Homo sapiens
caataagatgtattgagcagag

SEQ ID NO: 7053348 - DNA, 22 bp, Homo sapiens
atttgtcagtggaagtgattca

SEQ ID NO: 7053349 - DNA, 22 bp, Homo sapiens
atttgtcactgagagagttaga

SEQ ID NO: 7053350 - DNA, 22 bp, Homo sapiens
atttgtcatatataatactctt

SEQ ID NO: 7053351 - DNA, 22 bp, Homo sapiens
atttgtcatgtatgtaaagttg

SEQ ID NO: 7053352 - DNA, 22 bp, Homo sapiens
atttgtcaaaacacagagaaca

SEQ ID NO: 7053353 - DNA, 22 bp, Homo sapiens
atttgtcaataagatgaacata

SEQ ID NO: 7053354 - DNA, 22 bp, Homo sapiens
atttgtatcttctaatattatc

SEQ ID NO: 7053355 - DNA, 22 bp, Homo sapiens
atttgtatcaatctcaatatat

SEQ ID NO: 7053356 - DNA, 22 bp, Homo sapiens
atttgtaagctagagccatgat

SEQ ID NO: 7053357 - DNA, 22 bp, Homo sapiens
gccttccttacacctgctcagc

SEQ ID NO: 7053358 - DNA, 22 bp, Homo sapiens
gccttccttacacctgctcagc

SEQ ID NO: 7053359 - DNA, 22 bp, Homo sapiens
gccttccctctcatcctgctgg

SEQ ID NO: 7053360 - DNA, 22 bp, Homo sapiens
gccttccctggctaggcaagca

SEQ ID NO: 7053361 - DNA, 22 bp, Homo sapiens
gccttcctgcagctctgagcgt

SEQ ID NO: 7053362 - DNA, 22 bp, Homo sapiens
gccttcccaccctgcgaggctg

SEQ ID NO: 7053363 - DNA, 22 bp, Homo sapiens
attttcctagtcatgtgcttct

SEQ ID NO: 7053364 - DNA, 22 bp, Homo sapiens
attttcctcaagcctctggaag

SEQ ID NO: 7053365 - DNA, 22 bp, Homo sapiens
attttcctccatgtgagcagtt

SEQ ID NO: 7053366 - DNA, 22 bp, Homo sapiens
attttcctccatgtgagcagtt

SEQ ID NO: 7053367 - DNA, 22 bp, Homo sapiens
attttccttctaagaggaaggt

SEQ ID NO: 7053368 - DNA, 22 bp, Homo sapiens
attttccaaaataattgttact

SEQ ID NO: 7053369 - DNA, 22 bp, Homo sapiens
attttccaaaataattgttact

SEQ ID NO: 7053370 - DNA, 22 bp, Homo sapiens
attttccagcctttctagaact

SEQ ID NO: 7053371 - DNA, 22 bp, Homo sapiens
attttcattttgcagggtgaga

SEQ ID NO: 7053372 - DNA, 22 bp, Homo sapiens
attttcagttgaaaaagttggt

SEQ ID NO: 7053373 - DNA, 22 bp, Homo sapiens
attttcatcatgggtttaacat

SEQ ID NO: 7053374 - DNA, 22 bp, Homo sapiens
attttcatcatgggtttaacat

SEQ ID NO: 7053375 - DNA, 22 bp, Homo sapiens
caaagaatcactcatctttagc

SEQ ID NO: 7053376 - DNA, 22 bp, Homo sapiens
caaagactgcataacacatgaa

SEQ ID NO: 7053377 - DNA, 22 bp, Homo sapiens
gctcccaggatgaggagccagg

SEQ ID NO: 7053378 - DNA, 22 bp, Homo sapiens
gctcccaggcatggaggtaatt

SEQ ID NO: 7053379 - DNA, 22 bp, Homo sapiens
gctcccaggcatggaggtaatt

SEQ ID NO: 7053380 - DNA, 22 bp, Homo sapiens
gctcccagggacactggccact

SEQ ID NO: 7053381 - DNA, 22 bp, Homo sapiens
gctcccagggcagcgcagaaga

SEQ ID NO: 7053382 - DNA, 22 bp, Homo sapiens
gctcccagggcagcgcagaaga

SEQ ID NO: 7053383 - DNA, 22 bp, Homo sapiens
gctcccagggcagcgcagaaga

SEQ ID NO: 7053384 - DNA, 22 bp, Homo sapiens
gctcccagtctgatggaggaga

SEQ ID NO: 7053385 - DNA, 22 bp, Homo sapiens
gctcccagtctgatggaggaga

SEQ ID NO: 7053386 - DNA, 22 bp, Homo sapiens
caaaagaagctcttggggctag

SEQ ID NO: 7053387 - DNA, 22 bp, Homo sapiens
gctcagagaagttaaggaattt

SEQ ID NO: 7053388 - DNA, 22 bp, Homo sapiens
gctcagagaatttactgctgcc

SEQ ID NO: 7053389 - DNA, 19 bp, Homo sapiens
gctcagagacacctgttgc

SEQ ID NO: 7053390 - DNA, 22 bp, Homo sapiens
gctcagagaaaactggggcttg

SEQ ID NO: 7053391 - DNA, 22 bp, Homo sapiens
gctcagagaaattataggaatt

SEQ ID NO: 7053392 - DNA, 22 bp, Homo sapiens
attttgctggtctgaattactt

SEQ ID NO: 7053393 - DNA, 17 bp, Homo sapiens
gccttccttcctccaca

SEQ ID NO: 7053394 - DNA, 17 bp, Homo sapiens
gccttccttcctccaca

SEQ ID NO: 7053395 - DNA, 17 bp, Homo sapiens
gccttccttcctccaca

SEQ ID NO: 7053396 - DNA, 22 bp, Homo sapiens
attttgaatcaccttggaagaa

SEQ ID NO: 7053397 - DNA, 22 bp, Homo sapiens
attttgactgcattacagaaca

SEQ ID NO: 7053398 - DNA, 22 bp, Homo sapiens
attttgataatcatgttagaga

SEQ ID NO: 7053399 - DNA, 22 bp, Homo sapiens
attttgataatcatgttagaga

SEQ ID NO: 7053400 - DNA, 22 bp, Homo sapiens
attttgataatcatgttagaga

SEQ ID NO: 7053401 - DNA, 22 bp, Homo sapiens
atttatgtatctgtgtagatca

SEQ ID NO: 7053402 - DNA, 22 bp, Homo sapiens
atttatgactggtgaatagaac

SEQ ID NO: 7053403 - DNA, 22 bp, Homo sapiens
atttatgagctgaaccatgaaa

SEQ ID NO: 7053404 - DNA, 22 bp, Homo sapiens
atttatgatagctgcattaaag

SEQ ID NO: 7053405 - DNA, 22 bp, Homo sapiens
atttatgattagcctattgttg

SEQ ID NO: 7053406 - DNA, 22 bp, Homo sapiens
atttatgcatcccagcatgtga

SEQ ID NO: 7053407 - DNA, 22 bp, Homo sapiens
atttattacctcggagtttctg

SEQ ID NO: 7053408 - DNA, 22 bp, Homo sapiens
atttattatgggatttggcaca

SEQ ID NO: 7053409 - DNA, 22 bp, Homo sapiens
atttattatgggatttggcaca

SEQ ID NO: 7053410 - DNA, 22 bp, Homo sapiens
atttatcaccagttagctgact

SEQ ID NO: 7053411 - DNA, 22 bp, Homo sapiens
atttatattttgggagctcctg

SEQ ID NO: 7053412 - DNA, 22 bp, Homo sapiens
atttatgacaaccaaagagtga

SEQ ID NO: 7053413 - DNA, 22 bp, Homo sapiens
atttatgacagaagatatgctg

SEQ ID NO: 7053414 - DNA, 22 bp, Homo sapiens
atttatgacgtgttcggtcaat

SEQ ID NO: 7053415 - DNA, 22 bp, Homo sapiens
gccagctggagtgagagtgggc

SEQ ID NO: 7053416 - DNA, 21 bp, Homo sapiens
atttagaaggaaattttgcaa

SEQ ID NO: 7053417 - DNA, 22 bp, Homo sapiens
atttagaagttggagggcaaga

SEQ ID NO: 7053418 - DNA, 22 bp, Homo sapiens
gcatggcattaacaagatggaa

SEQ ID NO: 7053419 - DNA, 22 bp, Homo sapiens
gcatggcatttgaaggtagaag

SEQ ID NO: 7053420 - DNA, 22 bp, Homo sapiens
attgtacataaaatgtatgtct

SEQ ID NO: 7053421 - DNA, 22 bp, Homo sapiens
attgtacatatgatgtatgtaa

SEQ ID NO: 7053422 - DNA, 22 bp, Homo sapiens
gccagctgctggaacagcgcga

SEQ ID NO: 7053423 - DNA, 22 bp, Homo sapiens
gccatcctctgagcactaggca

SEQ ID NO: 7053424 - DNA, 20 bp, Homo sapiens
gccatgaggggaggtgactg

SEQ ID NO: 7053425 - DNA, 22 bp, Homo sapiens
gccatgcttggtatgctgtgag

SEQ ID NO: 7053426 - DNA, 23 bp, Homo sapiens
gccatggctgccccacaggcctc

SEQ ID NO: 7053427 - DNA, 22 bp, Homo sapiens
atttcaacgttagatgtaatag

SEQ ID NO: 7053428 - DNA, 19 bp, Homo sapiens
atttcaagaggtttattgg

SEQ ID NO: 7053429 - DNA, 19 bp, Homo sapiens
gcccaggggcccgatgctg

SEQ ID NO: 7053430 - DNA, 22 bp, Homo sapiens
gcccagggtctacaaaaatatt

SEQ ID NO: 7053431 - DNA, 22 bp, Homo sapiens
gcccagggtgaagtgcagttgt

SEQ ID NO: 7053432 - DNA, 22 bp, Homo sapiens
gcccagggtgcttagaacccat

SEQ ID NO: 7053433 - DNA, 22 bp, Homo sapiens
gcccaggttggagagcagtggc

SEQ ID NO: 7053434 - DNA, 22 bp, Homo sapiens
gcccagtctcttctggccctgt

SEQ ID NO: 7053435 - DNA, 21 bp, Homo sapiens
gcccagtgatttcttcacagt

SEQ ID NO: 7053436 - DNA, 22 bp, Homo sapiens
gccctgggctccctgctccaca

SEQ ID NO: 7053437 - DNA, 23 bp, Homo sapiens
atttcctaaaagataatcattac

SEQ ID NO: 7053438 - DNA, 22 bp, Homo sapiens
atttcctaacagaggcaacagt

SEQ ID NO: 7053439 - DNA, 22 bp, Homo sapiens
atttcctaatttagggatagac

SEQ ID NO: 7053440 - DNA, 22 bp, Homo sapiens
atttcctaatttatgcaggagt

SEQ ID NO: 7053441 - DNA, 23 bp, Homo sapiens
atttcctactataaaagaggtaa

SEQ ID NO: 7053442 - DNA, 22 bp, Homo sapiens
gcccagtgctgagggtgctgct

SEQ ID NO: 7053443 - DNA, 22 bp, Homo sapiens
gcccagtggtaaaagcaggcct

SEQ ID NO: 7053444 - DNA, 22 bp, Homo sapiens
atttcccactctactacatgct

SEQ ID NO: 7053445 - DNA, 22 bp, Homo sapiens
atttcttatctgaggtctacat

SEQ ID NO: 7053446 - DNA, 22 bp, Homo sapiens
atttcttacataacaaattgtt

SEQ ID NO: 7053447 - DNA, 22 bp, Homo sapiens
atttcttaaaacttcagggaga

SEQ ID NO: 7053448 - DNA, 22 bp, Homo sapiens
atttctgtttgctactataagt

SEQ ID NO: 7053449 - DNA, 22 bp, Homo sapiens
atttcttatgaatattgactgt

SEQ ID NO: 7053450 - DNA, 22 bp, Homo sapiens
atttcttcaggtcagaaataga

SEQ ID NO: 7053451 - DNA, 22 bp, Homo sapiens
gccctgtgccagtcacgctgtg

SEQ ID NO: 7053452 - DNA, 22 bp, Homo sapiens
gccctgtgagtcatgcggcaga

SEQ ID NO: 7053453 - DNA, 22 bp, Homo sapiens
gccctgtgatggagactagagg

SEQ ID NO: 7053454 - DNA, 22 bp, Homo sapiens
gccctgtgagattagaacagca

SEQ ID NO: 7053455 - DNA, 22 bp, Homo sapiens
gccctggttttagaggagcagg

SEQ ID NO: 7053456 - DNA, 22 bp, Homo sapiens
gcaggcaattttggaaggtcag

SEQ ID NO: 7053457 - DNA, 22 bp, Homo sapiens
gcagcttggtgaaaggtgatgg

SEQ ID NO: 7053458 - DNA, 22 bp, Homo sapiens
gcagctgttcagctggccagat

SEQ ID NO: 7053459 - DNA, 22 bp, Homo sapiens
gcagcttggatttctgtagttt

SEQ ID NO: 7053460 - DNA, 22 bp, Homo sapiens
gcaggcaggagcccaactgcct

SEQ ID NO: 7053461 - DNA, 22 bp, Homo sapiens
gcaggcaggcttccttgaactg

SEQ ID NO: 7053462 - DNA, 22 bp, Homo sapiens
attctgagtccatgggggcagg

SEQ ID NO: 7053463 - DNA, 21 bp, Homo sapiens
attctgagtcttggggtctca

SEQ ID NO: 7053464 - DNA, 22 bp, Homo sapiens
attctgagttagagtcagccag

SEQ ID NO: 7053465 - DNA, 22 bp, Homo sapiens
attctcataggagcgtgaacct

SEQ ID NO: 7053466 - DNA, 22 bp, Homo sapiens
attctctttgtataacatcttg

SEQ ID NO: 7053467 - DNA, 22 bp, Homo sapiens
attctgagaaatgcattgtcag

SEQ ID NO: 7053468 - DNA, 22 bp, Homo sapiens
attccaattgtacttgctttta

SEQ ID NO: 7053469 - DNA, 22 bp, Homo sapiens
attcacaaagaagggaagtaca

SEQ ID NO: 7053470 - DNA, 22 bp, Homo sapiens
attcacaactgatccttgctca

SEQ ID NO: 7053471 - DNA, 22 bp, Homo sapiens
attctttccagacactgattgc

SEQ ID NO: 7053472 - DNA, 22 bp, Homo sapiens
attctttccagacactgattgc

SEQ ID NO: 7053473 - DNA, 22 bp, Homo sapiens
gcagggcatagaggcacggagg

SEQ ID NO: 7053474 - DNA, 22 bp, Homo sapiens
gcagggcatccctgagcgggtg

SEQ ID NO: 7053475 - DNA, 20 bp, Homo sapiens
gcaggcagggaatgggggtg

SEQ ID NO: 7053476 - DNA, 22 bp, Homo sapiens
attctgcaactgttgttggtgg

SEQ ID NO: 7053477 - DNA, 22 bp, Homo sapiens
attctgcacatccaagaacagg

SEQ ID NO: 7053478 - DNA, 22 bp, Homo sapiens
attctgcacatccaagaacagg

SEQ ID NO: 7053479 - DNA, 22 bp, Homo sapiens
attctgcacttcctttgcttcc

SEQ ID NO: 7053480 - DNA, 22 bp, Homo sapiens
attctgcaggtggaggatggca

SEQ ID NO: 7053481 - DNA, 22 bp, Homo sapiens
attctgcataatttcctggcag

SEQ ID NO: 7053482 - DNA, 22 bp, Homo sapiens
attctgcatggtggtgtctctg

SEQ ID NO: 7053483 - DNA, 22 bp, Homo sapiens
attctgcaggtggaggatggca

SEQ ID NO: 7053484 - DNA, 22 bp, Homo sapiens
attctgcatggtggtgtctctg

SEQ ID NO: 7053485 - DNA, 22 bp, Homo sapiens
attctgcatgtaggtttgctca

SEQ ID NO: 7053486 - DNA, 22 bp, Homo sapiens
attctgctggtaactctataaa

SEQ ID NO: 7053487 - DNA, 22 bp, Homo sapiens
attctggaaagctattctctct

SEQ ID NO: 7053488 - DNA, 22 bp, Homo sapiens
gcagggcagtgtgtctgtgggg

SEQ ID NO: 7053489 - DNA, 22 bp, Homo sapiens
attgcaaatgagtcttaatata

SEQ ID NO: 7053490 - DNA, 22 bp, Homo sapiens
attgcaaaggtcccattcaaga

SEQ ID NO: 7053491 - DNA, 22 bp, Homo sapiens
attgcaaaggtcccattcaaga

SEQ ID NO: 7053492 - DNA, 19 bp, Homo sapiens
gcaggtggatgtggtcagc

SEQ ID NO: 7053493 - DNA, 22 bp, Homo sapiens
gcagtaaaaaaggatatgtgca

SEQ ID NO: 7053494 - DNA, 22 bp, Homo sapiens
gcatggcagtgaggatggtgct

SEQ ID NO: 7053495 - DNA, 22 bp, Homo sapiens
gcatggcagccagtacatggtg

SEQ ID NO: 7053496 - DNA, 22 bp, Homo sapiens
gcatggcaagatcaggagacca

SEQ ID NO: 7053497 - DNA, 22 bp, Homo sapiens
gcatggcaaatatcgagggcag

SEQ ID NO: 7053498 - DNA, 22 bp, Homo sapiens
gcatggcaaatatcgagggcag

SEQ ID NO: 7053499 - DNA, 22 bp, Homo sapiens
gcatggaattcccttatgggcc

SEQ ID NO: 7053500 - DNA, 22 bp, Homo sapiens
attaacagaattttacatgctt

SEQ ID NO: 7053501 - DNA, 22 bp, Homo sapiens
attaaattggatctgcatagtt

SEQ ID NO: 7053502 - DNA, 18 bp, Homo sapiens
gattctgattctggaggc

SEQ ID NO: 7053503 - DNA, 22 bp, Homo sapiens
gattctgcgatgaggacgagct

SEQ ID NO: 7053504 - DNA, 22 bp, Homo sapiens
gattcactcatattttacgttt

SEQ ID NO: 7053505 - DNA, 22 bp, Homo sapiens
gattcataccgtttcttctcca

SEQ ID NO: 7053506 - DNA, 22 bp, Homo sapiens
atgttatttctgaaagatcatt

SEQ ID NO: 7053507 - DNA, 21 bp, Homo sapiens
gatgatggcaggcagcactgg

SEQ ID NO: 7053508 - DNA, 21 bp, Homo sapiens
gatgatggcaggcagcactgg

SEQ ID NO: 7053509 - DNA, 22 bp, Homo sapiens
gatgatgggatccagcaatgta

SEQ ID NO: 7053510 - DNA, 22 bp, Homo sapiens
gatggaggagatggcagggtgc

SEQ ID NO: 7053511 - DNA, 22 bp, Homo sapiens
gatggagtctgaagctgggaac

SEQ ID NO: 7053512 - DNA, 22 bp, Homo sapiens
gatggagtgccagggtggaact

SEQ ID NO: 7053513 - DNA, 22 bp, Homo sapiens
gatggcagcagcagccagggat

SEQ ID NO: 7053514 - DNA, 22 bp, Homo sapiens
gatggcagcatattgacagcat

SEQ ID NO: 7053515 - DNA, 22 bp, Homo sapiens
gatggcaggcaggtgagtagag

SEQ ID NO: 7053516 - DNA, 22 bp, Homo sapiens
gatggcaggtagtggtctcatc

SEQ ID NO: 7053517 - DNA, 22 bp, Homo sapiens
atgttatgtgcaagatacataa

SEQ ID NO: 7053518 - DNA, 22 bp, Homo sapiens
atgttattaaagtacagattct

SEQ ID NO: 7053519 - DNA, 22 bp, Homo sapiens
gagtggggcgaagtcggcgagt

SEQ ID NO: 7053520 - DNA, 22 bp, Homo sapiens
gagtggggcgtggatccagcgt

SEQ ID NO: 7053521 - DNA, 22 bp, Homo sapiens
gagtggggctttaaaggctcag

SEQ ID NO: 7053522 - DNA, 22 bp, Homo sapiens
gagtggggcccactgctgggtg

SEQ ID NO: 7053523 - DNA, 22 bp, Homo sapiens
gagtggggcccactgctgggtg

SEQ ID NO: 7053524 - DNA, 22 bp, Homo sapiens
gagtggggcccactgctgggtg

SEQ ID NO: 7053525 - DNA, 23 bp, Homo sapiens
gagtggggagaaattggttaaac

SEQ ID NO: 7053526 - DNA, 23 bp, Homo sapiens
gagtggggagaaattggttaaac

SEQ ID NO: 7053527 - DNA, 22 bp, Homo sapiens
gagtggggaaagccaggacaga

SEQ ID NO: 7053528 - DNA, 22 bp, Homo sapiens
gagtggggaaagccaggacaga

SEQ ID NO: 7053529 - DNA, 22 bp, Homo sapiens
gcagacaatttattagcagatt

SEQ ID NO: 7053530 - DNA, 22 bp, Homo sapiens
gcagagaaggattgaaaccaga

SEQ ID NO: 7053531 - DNA, 22 bp, Homo sapiens
gcacccagaataaggacaggac

SEQ ID NO: 7053532 - DNA, 22 bp, Homo sapiens
attatcttgataaaatggcagt

SEQ ID NO: 7053533 - DNA, 22 bp, Homo sapiens
attatgaagttgagggaccctg

SEQ ID NO: 7053534 - DNA, 21 bp, Homo sapiens
gcagagaatgaactttggctt

SEQ ID NO: 7053535 - DNA, 21 bp, Homo sapiens
gcagagaatgaactttggctt

SEQ ID NO: 7053536 - DNA, 22 bp, Homo sapiens
gcagagagttgggctgcgccag

SEQ ID NO: 7053537 - DNA, 22 bp, Homo sapiens
gcagagatccttgctggatgac

SEQ ID NO: 7053538 - DNA, 22 bp, Homo sapiens
gcagagatggctgcctctgagt

SEQ ID NO: 7053539 - DNA, 22 bp, Homo sapiens
gcagagattatgccatggaaag

SEQ ID NO: 7053540 - DNA, 22 bp, Homo sapiens
gcagagattggtgcactgatga

SEQ ID NO: 7053541 - DNA, 22 bp, Homo sapiens
attcaagtccagcttctctaca

SEQ ID NO: 7053542 - DNA, 22 bp, Homo sapiens
attcaagtggctgctatgttaa

SEQ ID NO: 7053543 - DNA, 22 bp, Homo sapiens
attcaagttcttctgtctttgc

SEQ ID NO: 7053544 - DNA, 22 bp, Homo sapiens
attatatgtgggatagaattta

SEQ ID NO: 7053545 - DNA, 22 bp, Homo sapiens
attatataggacttgcccttcc

SEQ ID NO: 7053546 - DNA, 22 bp, Homo sapiens
attatattgagtataaccagag

SEQ ID NO: 7053547 - DNA, 22 bp, Homo sapiens
attatattgagtataaccagag

SEQ ID NO: 7053548 - DNA, 22 bp, Homo sapiens
attatatttgaaaggttggaag

SEQ ID NO: 7053549 - DNA, 22 bp, Homo sapiens
attatccaacacccagttacat

SEQ ID NO: 7053550 - DNA, 22 bp, Homo sapiens
gcacacagaattgattcactgt

SEQ ID NO: 7053551 - DNA, 22 bp, Homo sapiens
attaagatcattgtagaagatt

SEQ ID NO: 7053552 - DNA, 22 bp, Homo sapiens
attataggcttgagccaccgtg

SEQ ID NO: 7053553 - DNA, 22 bp, Homo sapiens
attatataaaattctggaagct

SEQ ID NO: 7053554 - DNA, 22 bp, Homo sapiens
gcaccaggcagctgagcaggcc

SEQ ID NO: 7053555 - DNA, 22 bp, Homo sapiens
gcaccaggcttagagccccagg

SEQ ID NO: 7053556 - DNA, 22 bp, Homo sapiens
gcaccaggcagctgagcaggcc

SEQ ID NO: 7053557 - DNA, 22 bp, Homo sapiens
gcacagggctgccaggcggctt

SEQ ID NO: 7053558 - DNA, 22 bp, Homo sapiens
gcacacagaattgattcactgt

SEQ ID NO: 7053559 - DNA, 22 bp, Homo sapiens
gcacacagctagattaccattc

SEQ ID NO: 7053560 - DNA, 22 bp, Homo sapiens
gcacacaggcagtttccagcca

SEQ ID NO: 7053561 - DNA, 22 bp, Homo sapiens
gcacacaggcagtttccagcca

SEQ ID NO: 7053562 - DNA, 22 bp, Homo sapiens
ctttacattaatttctactgat

SEQ ID NO: 7053563 - DNA, 22 bp, Homo sapiens
ctttacttctcaaaataaagca

SEQ ID NO: 7053564 - DNA, 22 bp, Homo sapiens
ctttagaaatctggatgtattt

SEQ ID NO: 7053565 - DNA, 22 bp, Homo sapiens
ctttatgttggggtgtcttagt

SEQ ID NO: 7053566 - DNA, 22 bp, Homo sapiens
cttgttttctaaaacatcattt

SEQ ID NO: 7053567 - DNA, 22 bp, Homo sapiens
ctttacataaggataaacctgg

SEQ ID NO: 7053568 - DNA, 22 bp, Homo sapiens
ctttacataaggataaacctgg

SEQ ID NO: 7053569 - DNA, 22 bp, Homo sapiens
ctttacataaggataaacctgg

SEQ ID NO: 7053570 - DNA, 22 bp, Homo sapiens
atctttctctgcactatacaat

SEQ ID NO: 7053571 - DNA, 22 bp, Homo sapiens
atctttctctgcactatacaat

SEQ ID NO: 7053572 - DNA, 22 bp, Homo sapiens
atctttctccatatacatcttt

SEQ ID NO: 7053573 - DNA, 22 bp, Homo sapiens
atctttctccatatacatcttt

SEQ ID NO: 7053574 - DNA, 22 bp, Homo sapiens
atctttctatggtactttctcc

SEQ ID NO: 7053575 - DNA, 22 bp, Homo sapiens
atctttctatggtactttctcc

SEQ ID NO: 7053576 - DNA, 22 bp, Homo sapiens
atctttcctgttttcagacagc

SEQ ID NO: 7053577 - DNA, 22 bp, Homo sapiens
cttctccttatatgtcccgttc

SEQ ID NO: 7053578 - DNA, 22 bp, Homo sapiens
atctttcagggccatttgtatt

SEQ ID NO: 7053579 - DNA, 22 bp, Homo sapiens
atctttcagggccatttgtatt

SEQ ID NO: 7053580 - DNA, 22 bp, Homo sapiens
atctttcatctctattatttga

SEQ ID NO: 7053581 - DNA, 22 bp, Homo sapiens
cttctcctctgagtcctgggag

SEQ ID NO: 7053582 - DNA, 22 bp, Homo sapiens
cttctccctggcttctgcacac

SEQ ID NO: 7053583 - DNA, 22 bp, Homo sapiens
cttctccctggcttctgcacac

SEQ ID NO: 7053584 - DNA, 22 bp, Homo sapiens
cttctccctggcttctgcacac

SEQ ID NO: 7053585 - DNA, 22 bp, Homo sapiens
atctggaattaagagaaagtga

SEQ ID NO: 7053586 - DNA, 22 bp, Homo sapiens
cttctccagccacgcccactcc

SEQ ID NO: 7053587 - DNA, 22 bp, Homo sapiens
atgagagtctcagagtctcttc

SEQ ID NO: 7053588 - DNA, 22 bp, Homo sapiens
atgagagctctatgatctgttt

SEQ ID NO: 7053589 - DNA, 22 bp, Homo sapiens
atgagatgtgtctaatggaacc

SEQ ID NO: 7053590 - DNA, 22 bp, Homo sapiens
atgagaaagttaatcatcatga

SEQ ID NO: 7053591 - DNA, 22 bp, Homo sapiens
atgagaaggacataaattatag

SEQ ID NO: 7053592 - DNA, 19 bp, Homo sapiens
ctttttcaccttctagaag

SEQ ID NO: 7053593 - DNA, 22 bp, Homo sapiens
ctttttatctcttaatgatgtt

SEQ ID NO: 7053594 - DNA, 22 bp, Homo sapiens
ctttttatagctatgtcctatg

SEQ ID NO: 7053595 - DNA, 22 bp, Homo sapiens
ctttttatctcttaatgatgtt

SEQ ID NO: 7053596 - DNA, 22 bp, Homo sapiens
ctttttatctcttaatgatgtt

SEQ ID NO: 7053597 - DNA, 22 bp, Homo sapiens
ctttttataccgtgccagttga

SEQ ID NO: 7053598 - DNA, 22 bp, Homo sapiens
cttttgttgcccttgtcgcagg

SEQ ID NO: 7053599 - DNA, 22 bp, Homo sapiens
atgacagatagtcttcatttgc

SEQ ID NO: 7053600 - DNA, 22 bp, Homo sapiens
ctttgcttctccaacctgctca

SEQ ID NO: 7053601 - DNA, 22 bp, Homo sapiens
ctttgcttgacactgtgattgt

SEQ ID NO: 7053602 - DNA, 22 bp, Homo sapiens
ctttctttgcagtgagccagag

SEQ ID NO: 7053603 - DNA, 23 bp, Homo sapiens
ctttgccacccagagcctgacag

SEQ ID NO: 7053604 - DNA, 22 bp, Homo sapiens
ctttgccatgttgcctgcagaa

SEQ ID NO: 7053605 - DNA, 20 bp, Homo sapiens
ctttgcctattctctgcctg

SEQ ID NO: 7053606 - DNA, 22 bp, Homo sapiens
atgacactgtcctagtaaggaa

SEQ ID NO: 7053607 - DNA, 22 bp, Homo sapiens
atgaatttttctaagcttttgt

SEQ ID NO: 7053608 - DNA, 22 bp, Homo sapiens
atgcctggactgtatcccagat

SEQ ID NO: 7053609 - DNA, 22 bp, Homo sapiens
atgcctggatttgggactcaaa

SEQ ID NO: 7053610 - DNA, 22 bp, Homo sapiens
atgctaaggcccaggagaaaat

SEQ ID NO: 7053611 - DNA, 22 bp, Homo sapiens
gacagcttagtgaaaatgtaaa

SEQ ID NO: 7053612 - DNA, 22 bp, Homo sapiens
gacagcttcgaggaggtgagct

SEQ ID NO: 7053613 - DNA, 22 bp, Homo sapiens
gacagcttctagaaatggtcac

SEQ ID NO: 7053614 - DNA, 22 bp, Homo sapiens
gacagcttctagaggaattggt

SEQ ID NO: 7053615 - DNA, 22 bp, Homo sapiens
gacagcttctatgtgacgagca

SEQ ID NO: 7053616 - DNA, 22 bp, Homo sapiens
gacagcttcttgggccgggcct

SEQ ID NO: 7053617 - DNA, 22 bp, Homo sapiens
gacagcttgcctggtactgcaa

SEQ ID NO: 7053618 - DNA, 20 bp, Homo sapiens
gacagcttggggtgtcacct

SEQ ID NO: 7053619 - DNA, 22 bp, Homo sapiens
atgctctgggcttttgaagtgg

SEQ ID NO: 7053620 - DNA, 16 bp, Homo sapiens
atgctgctattagagg

SEQ ID NO: 7053621 - DNA, 22 bp, Homo sapiens
atgccactgcactccagcctgg

SEQ ID NO: 7053622 - DNA, 22 bp, Homo sapiens
gaagtctgctgctcaggagttt

SEQ ID NO: 7053623 - DNA, 22 bp, Homo sapiens
gaagtctgagtgggggccaggc

SEQ ID NO: 7053624 - DNA, 22 bp, Homo sapiens
atgcagtttatctccaaatcat

SEQ ID NO: 7053625 - DNA, 22 bp, Homo sapiens
atgcataaagaaagctatctgg

SEQ ID NO: 7053626 - DNA, 22 bp, Homo sapiens
gaagcgcggcgtcggcgtgggt

SEQ ID NO: 7053627 - DNA, 22 bp, Homo sapiens
gaagcctggttcgctggccacc

SEQ ID NO: 7053628 - DNA, 22 bp, Homo sapiens
gaagcctggagaccagatgttg

SEQ ID NO: 7053629 - DNA, 22 bp, Homo sapiens
gaagctgagctgaggcatgttg

SEQ ID NO: 7053630 - DNA, 22 bp, Homo sapiens
gaagctgaggtcaggtgggtgg

SEQ ID NO: 7053631 - DNA, 22 bp, Homo sapiens
gaagctgatgaggaccagattg

SEQ ID NO: 7053632 - DNA, 22 bp, Homo sapiens
gaagctccgtactatgactttt

SEQ ID NO: 7053633 - DNA, 22 bp, Homo sapiens
gaagctgacccaggagcgtgtg

SEQ ID NO: 7053634 - DNA, 22 bp, Homo sapiens
gaaggagggagcggcgcggatt

SEQ ID NO: 7053635 - DNA, 22 bp, Homo sapiens
gaaggagggtgcggatctgagc

SEQ ID NO: 7053636 - DNA, 22 bp, Homo sapiens
gaaggaggtgtcagttggactg

SEQ ID NO: 7053637 - DNA, 22 bp, Homo sapiens
gaaggatttgagattatcctag

SEQ ID NO: 7053638 - DNA, 22 bp, Homo sapiens
gaaggcaacaccaggatgcact

SEQ ID NO: 7053639 - DNA, 22 bp, Homo sapiens
atgcagtaaaataggaggtaat

SEQ ID NO: 7053640 - DNA, 22 bp, Homo sapiens
atgcagtaaatgttaagaaaaa

SEQ ID NO: 7053641 - DNA, 22 bp, Homo sapiens
atgcagtaaatgttctagtttg

SEQ ID NO: 7053642 - DNA, 22 bp, Homo sapiens
atgcagtacagataattctaca

SEQ ID NO: 7053643 - DNA, 22 bp, Homo sapiens
atgcagtacagataattctaca

SEQ ID NO: 7053644 - DNA, 22 bp, Homo sapiens
atgcagtacatacaaacactga

SEQ ID NO: 7053645 - DNA, 22 bp, Homo sapiens
atgcagtactgatacatgccac

SEQ ID NO: 7053646 - DNA, 22 bp, Homo sapiens
atgcagtagataggcactttta

SEQ ID NO: 7053647 - DNA, 22 bp, Homo sapiens
atgcagtataaatcatttctgg

SEQ ID NO: 7053648 - DNA, 23 bp, Homo sapiens
atgcagtatatgtcagtagttta

SEQ ID NO: 7053649 - DNA, 22 bp, Homo sapiens
atgcagtgtttggaagcttaag

SEQ ID NO: 7053650 - DNA, 22 bp, Homo sapiens
atgagcatccagaacagtgcct

SEQ ID NO: 7053651 - DNA, 22 bp, Homo sapiens
gaagagagaacattacataaac

SEQ ID NO: 7053652 - DNA, 22 bp, Homo sapiens
gaagagagccgcgggacatcag

SEQ ID NO: 7053653 - DNA, 21 bp, Homo sapiens
gaagagagtcctcatcctgag

SEQ ID NO: 7053654 - DNA, 21 bp, Homo sapiens
gaagagagtcctcatcctgag

SEQ ID NO: 7053655 - DNA, 22 bp, Homo sapiens
gaagagatgacaaaggagcatg

SEQ ID NO: 7053656 - DNA, 22 bp, Homo sapiens
gaagagcatttgcccaggctgt

SEQ ID NO: 7053657 - DNA, 22 bp, Homo sapiens
gaagagctaaaggcacaggctt

SEQ ID NO: 7053658 - DNA, 22 bp, Homo sapiens
atgatggaggccgtgatggacg

SEQ ID NO: 7053659 - DNA, 22 bp, Homo sapiens
atgatggaggtgtcctggattt

SEQ ID NO: 7053660 - DNA, 22 bp, Homo sapiens
atgatggaggtgtcctggattt

SEQ ID NO: 7053661 - DNA, 22 bp, Homo sapiens
atgatgttggtttaatttgagt

SEQ ID NO: 7053662 - DNA, 22 bp, Homo sapiens
gaggtgtgaggaatgaatgggg

SEQ ID NO: 7053663 - DNA, 22 bp, Homo sapiens
atgttataaatagagacactgg

SEQ ID NO: 7053664 - DNA, 22 bp, Homo sapiens
atgttatggctcaaacatttgg

SEQ ID NO: 7053665 - DNA, 22 bp, Homo sapiens
gaggttgggatgagggatacag

SEQ ID NO: 7053666 - DNA, 22 bp, Homo sapiens
gagtgcagtatcttctgtgtcc

SEQ ID NO: 7053667 - DNA, 22 bp, Homo sapiens
gagtgcagtatgagaggctgct

SEQ ID NO: 7053668 - DNA, 22 bp, Homo sapiens
atgttacagttgagtaaattaa

SEQ ID NO: 7053669 - DNA, 22 bp, Homo sapiens
atgttacatagtccttatttgt

SEQ ID NO: 7053670 - DNA, 22 bp, Homo sapiens
atgttacatagtccttatttgt

SEQ ID NO: 7053671 - DNA, 22 bp, Homo sapiens
atgttacatgaaacggcctact

SEQ ID NO: 7053672 - DNA, 22 bp, Homo sapiens
atgttacagaaagcaaagatga

SEQ ID NO: 7053673 - DNA, 22 bp, Homo sapiens
atgttacctctattagaatatt

SEQ ID NO: 7053674 - DNA, 22 bp, Homo sapiens
atgttactgtgatcatgatact

SEQ ID NO: 7053675 - DNA, 22 bp, Homo sapiens
atgttagaaggaatgttaaaag

SEQ ID NO: 7053676 - DNA, 22 bp, Homo sapiens
atgttagaatctctgaatgtgg

SEQ ID NO: 7053677 - DNA, 23 bp, Homo sapiens
atgttaaacataactgaagagcc

SEQ ID NO: 7053678 - DNA, 22 bp, Homo sapiens
gaggctgaacaggttctcatga

SEQ ID NO: 7053679 - DNA, 22 bp, Homo sapiens
gaggctgaacaggttctcatga

SEQ ID NO: 7053680 - DNA, 22 bp, Homo sapiens
atgtcactgtgaggcagctgtc

SEQ ID NO: 7053681 - DNA, 22 bp, Homo sapiens
atgtcacttttgagactaggtt

SEQ ID NO: 7053682 - DNA, 22 bp, Homo sapiens
atgtcaggaccctactgcattg

SEQ ID NO: 7053683 - DNA, 20 bp, Homo sapiens
atgtgaggggttgaagtggg

SEQ ID NO: 7053684 - DNA, 22 bp, Homo sapiens
atgtgaggtagataggatgcag

SEQ ID NO: 7053685 - DNA, 22 bp, Homo sapiens
atgtggaatgaacaaaggaggc

SEQ ID NO: 7053686 - DNA, 22 bp, Homo sapiens
atgtggatttgggagtgatcag

SEQ ID NO: 7053687 - DNA, 22 bp, Homo sapiens
atgtggcctagtatagaaatga

SEQ ID NO: 7053688 - DNA, 23 bp, Homo sapiens
atgtatttaaatttcagtgatga

SEQ ID NO: 7053689 - DNA, 22 bp, Homo sapiens
gaggctccagcgacacctaggc

SEQ ID NO: 7053690 - DNA, 22 bp, Homo sapiens
gaggctccgtgctgctgccctg

SEQ ID NO: 7053691 - DNA, 22 bp, Homo sapiens
gaggctcctcattcagtatgct

SEQ ID NO: 7053692 - DNA, 20 bp, Homo sapiens
gaggctctgggcatggcgcc

SEQ ID NO: 7053693 - DNA, 22 bp, Homo sapiens
atgtatcacagcaatgtagtca

SEQ ID NO: 7053694 - DNA, 22 bp, Homo sapiens
atgtatcagataaagcatgtgg

SEQ ID NO: 7053695 - DNA, 23 bp, Homo sapiens
atgtatctcatccaaggaagctc

SEQ ID NO: 7053696 - DNA, 22 bp, Homo sapiens
atgggcaggcactggctctcag

SEQ ID NO: 7053697 - DNA, 22 bp, Homo sapiens
atgggcagctgcagcagtggtg

SEQ ID NO: 7053698 - DNA, 22 bp, Homo sapiens
gaggagggagctggaagctctt

SEQ ID NO: 7053699 - DNA, 22 bp, Homo sapiens
gaggagggcagttcctctttta

SEQ ID NO: 7053700 - DNA, 22 bp, Homo sapiens
gaggagggcctggtgtcccttc

SEQ ID NO: 7053701 - DNA, 22 bp, Homo sapiens
gaggagggctttgttgatgtta

SEQ ID NO: 7053702 - DNA, 22 bp, Homo sapiens
gaggaggggacagtacttgtgc

SEQ ID NO: 7053703 - DNA, 22 bp, Homo sapiens
gaggaggggcacttgtctccta

SEQ ID NO: 7053704 - DNA, 22 bp, Homo sapiens
gaggcacaatacatgtctcaag

SEQ ID NO: 7053705 - DNA, 23 bp, Homo sapiens
gaggagggtctgacaagtgtagc

SEQ ID NO: 7053706 - DNA, 22 bp, Homo sapiens
gaggcacaccagggagtcttgt

SEQ ID NO: 7053707 - DNA, 22 bp, Homo sapiens
gaggcacagagtaggtgcacac

SEQ ID NO: 7053708 - DNA, 22 bp, Homo sapiens
gaggcacagtgtttggtcagtg

SEQ ID NO: 7053709 - DNA, 22 bp, Homo sapiens
gaggcacagtgtttggtcagtg

SEQ ID NO: 7053710 - DNA, 22 bp, Homo sapiens
gaggcacagtgtttggtcagtg

SEQ ID NO: 7053711 - DNA, 18 bp, Homo sapiens
gaggcacatagttggggc

SEQ ID NO: 7053712 - DNA, 22 bp, Homo sapiens
gaggcacatatatacagagccc

SEQ ID NO: 7053713 - DNA, 22 bp, Homo sapiens
gaggcacatatatacagagccc

SEQ ID NO: 7053714 - DNA, 22 bp, Homo sapiens
gaggcacatatatacagagccc

SEQ ID NO: 7053715 - DNA, 22 bp, Homo sapiens
atgtaggattgagtgatagagg

SEQ ID NO: 7053716 - DNA, 22 bp, Homo sapiens
atgtaggattgagtgatagagg

SEQ ID NO: 7053717 - DNA, 22 bp, Homo sapiens
atgggcagagtggggacaggaa

SEQ ID NO: 7053718 - DNA, 22 bp, Homo sapiens
gagctgccctgagctttgcatg

SEQ ID NO: 7053719 - DNA, 22 bp, Homo sapiens
gagctgccggcccacagtacta

SEQ ID NO: 7053720 - DNA, 22 bp, Homo sapiens
gagctgcagagtaacctttgca

SEQ ID NO: 7053721 - DNA, 22 bp, Homo sapiens
gagctgcagcggctgacgcaac

SEQ ID NO: 7053722 - DNA, 22 bp, Homo sapiens
gagctgcagcggctgacgcaac

SEQ ID NO: 7053723 - DNA, 22 bp, Homo sapiens
gagctgccagacatgggaatga

SEQ ID NO: 7053724 - DNA, 22 bp, Homo sapiens
gagctgagttacctccagatca

SEQ ID NO: 7053725 - DNA, 22 bp, Homo sapiens
gagctgagtgtcctaggcatgg

SEQ ID NO: 7053726 - DNA, 22 bp, Homo sapiens
gagctgagtgtcctaggcatgg

SEQ ID NO: 7053727 - DNA, 20 bp, Homo sapiens
gagctgagtgtggtcatggg

SEQ ID NO: 7053728 - DNA, 20 bp, Homo sapiens
gagctgagtgtggtcatggg

SEQ ID NO: 7053729 - DNA, 21 bp, Homo sapiens
atgggcagaggcagagaggct

SEQ ID NO: 7053730 - DNA, 22 bp, Homo sapiens
atgggcagacagggagctcacg

SEQ ID NO: 7053731 - DNA, 22 bp, Homo sapiens
atgggatgcatggctgtggcca

SEQ ID NO: 7053732 - DNA, 22 bp, Homo sapiens
gagccccaggacagctctagtt

SEQ ID NO: 7053733 - DNA, 17 bp, Homo sapiens
gagcccctttccaagtt

SEQ ID NO: 7053734 - DNA, 22 bp, Homo sapiens
atgggaggaagagaagatgtct

SEQ ID NO: 7053735 - DNA, 22 bp, Homo sapiens
atgggagggtggaaaggctctg

SEQ ID NO: 7053736 - DNA, 22 bp, Homo sapiens
atgggagggtggaaaggctctg

SEQ ID NO: 7053737 - DNA, 22 bp, Homo sapiens
gagcacagggaatagacagata

SEQ ID NO: 7053738 - DNA, 22 bp, Homo sapiens
gagcacagctggaggtagcatt

SEQ ID NO: 7053739 - DNA, 22 bp, Homo sapiens
gagcacagctggaggtagcatt

SEQ ID NO: 7053740 - DNA, 22 bp, Homo sapiens
gagcacaggctgctgtgaactg

SEQ ID NO: 7053741 - DNA, 22 bp, Homo sapiens
atggcagacctgggctggagaa

SEQ ID NO: 7053742 - DNA, 22 bp, Homo sapiens
atggcagagaaagcgagccaca

SEQ ID NO: 7053743 - DNA, 22 bp, Homo sapiens
atggctgagatgggctccaggc

SEQ ID NO: 7053744 - DNA, 22 bp, Homo sapiens
atggctgagatgggctccaggc

SEQ ID NO: 7053745 - DNA, 22 bp, Homo sapiens
gagacaggccaggtggtactta

SEQ ID NO: 7053746 - DNA, 22 bp, Homo sapiens
gagacaggccaggtggtactta

SEQ ID NO: 7053747 - DNA, 22 bp, Homo sapiens
gagacaggccaggtggtactta

SEQ ID NO: 7053748 - DNA, 22 bp, Homo sapiens
gagacaggcagctagtgggtca

SEQ ID NO: 7053749 - DNA, 22 bp, Homo sapiens
gagacaggatttaaccaaagct

SEQ ID NO: 7053750 - DNA, 21 bp, Homo sapiens
gagaatcaggaaggattgatg

SEQ ID NO: 7053751 - DNA, 21 bp, Homo sapiens
gagaatcaggaaggattgatg

SEQ ID NO: 7053752 - DNA, 22 bp, Homo sapiens
atggatgaaggcgaggatgagg

SEQ ID NO: 7053753 - DNA, 22 bp, Homo sapiens
atggatgaaggcgaggatgagg

SEQ ID NO: 7053754 - DNA, 22 bp, Homo sapiens
atggatgagtccttgagacaca

SEQ ID NO: 7053755 - DNA, 22 bp, Homo sapiens
atggatgagtccttgagacaca

SEQ ID NO: 7053756 - DNA, 22 bp, Homo sapiens
atggattggatttttatggacc

SEQ ID NO: 7053757 - DNA, 22 bp, Homo sapiens
atggcaagcaagctgaagagat

SEQ ID NO: 7053758 - DNA, 22 bp, Homo sapiens
atggcactaagagggagctgga

SEQ ID NO: 7053759 - DNA, 22 bp, Homo sapiens
atgctgtgtcctagtgaaagaa

SEQ ID NO: 7053760 - DNA, 22 bp, Homo sapiens
atgctgtgtctagcaggaacac

SEQ ID NO: 7053761 - DNA, 22 bp, Homo sapiens
atgctgtgtggccacctccatg

SEQ ID NO: 7053762 - DNA, 22 bp, Homo sapiens
atgctgtgtggtcaagttaatt

SEQ ID NO: 7053763 - DNA, 22 bp, Homo sapiens
atgctgtgtttgagaacctagg

SEQ ID NO: 7053764 - DNA, 22 bp, Homo sapiens
atgctgtgttttaaatggaaat

SEQ ID NO: 7053765 - DNA, 22 bp, Homo sapiens
gagaaggtggacctgaaggagc

SEQ ID NO: 7053766 - DNA, 22 bp, Homo sapiens
gagaagttgtaggagaattttg

SEQ ID NO: 7053767 - DNA, 22 bp, Homo sapiens
gagaagttgtaggagaattttg

SEQ ID NO: 7053768 - DNA, 22 bp, Homo sapiens
gagaagttgtgtggatttaaag

SEQ ID NO: 7053769 - DNA, 22 bp, Homo sapiens
gagaagtttctggtttgcatag

SEQ ID NO: 7053770 - DNA, 22 bp, Homo sapiens
gagaagtttggagtgaaggttt

SEQ ID NO: 7053771 - DNA, 22 bp, Homo sapiens
gagaagtttggagtgaaggttt

SEQ ID NO: 7053772 - DNA, 22 bp, Homo sapiens
atgctggttgctaagcagcgat

SEQ ID NO: 7053773 - DNA, 22 bp, Homo sapiens
atgctgtcagtattatgtgcag

SEQ ID NO: 7053774 - DNA, 22 bp, Homo sapiens
atgctgtccactcttggtgttt

SEQ ID NO: 7053775 - DNA, 22 bp, Homo sapiens
atgctgggaagacaaggtggag

SEQ ID NO: 7053776 - DNA, 22 bp, Homo sapiens
atgctgtggggagtgagggtag

SEQ ID NO: 7053777 - DNA, 22 bp, Homo sapiens
atgctgtggatgccttgcccca

SEQ ID NO: 7053778 - DNA, 22 bp, Homo sapiens
atgctgtggccagagttcaact

SEQ ID NO: 7053779 - DNA, 22 bp, Homo sapiens
atgctgtggtagacagcattcc

SEQ ID NO: 7053780 - DNA, 22 bp, Homo sapiens
atgctgtgtattttactctttc

SEQ ID NO: 7053781 - DNA, 22 bp, Homo sapiens
atgctgtgtcaccttaggattt

SEQ ID NO: 7053782 - DNA, 22 bp, Homo sapiens
atgctgtgtcaggaatttgata

SEQ ID NO: 7053783 - DNA, 22 bp, Homo sapiens
atgctgtgaaaaagaaggctga

SEQ ID NO: 7053784 - DNA, 22 bp, Homo sapiens
atgctgtgagtgtgccgcagag

SEQ ID NO: 7053785 - DNA, 22 bp, Homo sapiens
atgctgtgattgtagaaatatt

SEQ ID NO: 7053786 - DNA, 22 bp, Homo sapiens
atgctgtgcctggaaagcggct

SEQ ID NO: 7053787 - DNA, 22 bp, Homo sapiens
atgctgtgccttctctgtgcca

SEQ ID NO: 7053788 - DNA, 22 bp, Homo sapiens
atgctgtgctggctaaccatgg

SEQ ID NO: 7053789 - DNA, 22 bp, Homo sapiens
atgctgtggaagttcctgaagc

SEQ ID NO: 7053790 - DNA, 22 bp, Homo sapiens
agttttattgtcccagaggtga

SEQ ID NO: 7053791 - DNA, 22 bp, Homo sapiens
agttttattccaatgtgcagca

SEQ ID NO: 7053792 - DNA, 22 bp, Homo sapiens
agttttattgtcccagaggtga

SEQ ID NO: 7053793 - DNA, 22 bp, Homo sapiens
agttttattccaatgtgcagca

SEQ ID NO: 7053794 - DNA, 22 bp, Homo sapiens
agttttattaaatccacagaag

SEQ ID NO: 7053795 - DNA, 22 bp, Homo sapiens
agttttattccaatgtgcagca

SEQ ID NO: 7053796 - DNA, 22 bp, Homo sapiens
agttttatgttcacagaaggat

SEQ ID NO: 7053797 - DNA, 22 bp, Homo sapiens
agttttattaaatccacagaag

SEQ ID NO: 7053798 - DNA, 22 bp, Homo sapiens
ctgatacaatgtctgctttata

SEQ ID NO: 7053799 - DNA, 22 bp, Homo sapiens
ctgagtgaggggagcttgatgg

SEQ ID NO: 7053800 - DNA, 22 bp, Homo sapiens
ctgagtgatagcgatggggaac

SEQ ID NO: 7053801 - DNA, 22 bp, Homo sapiens
ctgagtgttttcagccacggcc

SEQ ID NO: 7053802 - DNA, 22 bp, Homo sapiens
agtttcttgaagactgatgttt

SEQ ID NO: 7053803 - DNA, 22 bp, Homo sapiens
ctgagtctcccggcagtggagg

SEQ ID NO: 7053804 - DNA, 22 bp, Homo sapiens
agtttctctttgacaccaaaat

SEQ ID NO: 7053805 - DNA, 22 bp, Homo sapiens
agtttctctagagtctttgaaa

SEQ ID NO: 7053806 - DNA, 22 bp, Homo sapiens
agtttctctcagtatagaatag

SEQ ID NO: 7053807 - DNA, 22 bp, Homo sapiens
agtttctcttaatctagtatct

SEQ ID NO: 7053808 - DNA, 22 bp, Homo sapiens
agtttctagcctcactgtttag

SEQ ID NO: 7053809 - DNA, 22 bp, Homo sapiens
agtttcacatgcatggatgtgt

SEQ ID NO: 7053810 - DNA, 22 bp, Homo sapiens
agtttcacagaatatgaaggtt

SEQ ID NO: 7053811 - DNA, 22 bp, Homo sapiens
agtttatgttgtttataagcca

SEQ ID NO: 7053812 - DNA, 22 bp, Homo sapiens
agtttatgtctttacttcagct

SEQ ID NO: 7053813 - DNA, 22 bp, Homo sapiens
agtttatgtgtaagacagctgt

SEQ ID NO: 7053814 - DNA, 22 bp, Homo sapiens
ctgagaggcggaggttgcagtg

SEQ ID NO: 7053815 - DNA, 22 bp, Homo sapiens
agtgttaatggtgtatattagg

SEQ ID NO: 7053816 - DNA, 22 bp, Homo sapiens
ataataatgaaagccactgtgt

SEQ ID NO: 7053817 - DNA, 23 bp, Homo sapiens
ataataattatggcagcaaagtg

SEQ ID NO: 7053818 - DNA, 18 bp, Homo sapiens
ctgcctgctctccagctt

SEQ ID NO: 7053819 - DNA, 18 bp, Homo sapiens
ctgcctgctctccagctt

SEQ ID NO: 7053820 - DNA, 22 bp, Homo sapiens
ctgcctgctgacattctttata

SEQ ID NO: 7053821 - DNA, 22 bp, Homo sapiens
ctgcctgctgattagtattgtc

SEQ ID NO: 7053822 - DNA, 22 bp, Homo sapiens
ctgcctgctgccctccagagcc

SEQ ID NO: 7053823 - DNA, 22 bp, Homo sapiens
ctgcctgctgcctgtggagggt

SEQ ID NO: 7053824 - DNA, 23 bp, Homo sapiens
ctgcctgctggggagacagatct

SEQ ID NO: 7053825 - DNA, 22 bp, Homo sapiens
ctgcctgcttaccatgcatcag

SEQ ID NO: 7053826 - DNA, 22 bp, Homo sapiens
ctgcctgcttaccatgcatcag

SEQ ID NO: 7053827 - DNA, 22 bp, Homo sapiens
ctgcctgcttctgagccagagg

SEQ ID NO: 7053828 - DNA, 22 bp, Homo sapiens
ctgcctgcttttctgggagccg

SEQ ID NO: 7053829 - DNA, 22 bp, Homo sapiens
ctgcctgcttttctgggagccg

SEQ ID NO: 7053830 - DNA, 22 bp, Homo sapiens
ataagtttgtctttgtaaagat

SEQ ID NO: 7053831 - DNA, 22 bp, Homo sapiens
ataataaaccaggatgggtctg

SEQ ID NO: 7053832 - DNA, 22 bp, Homo sapiens
ctgccctgtatcttctcccaat

SEQ ID NO: 7053833 - DNA, 22 bp, Homo sapiens
agttttgaaatgaaatgtagtt

SEQ ID NO: 7053834 - DNA, 20 bp, Homo sapiens
agttttcagcagaacaccca

SEQ ID NO: 7053835 - DNA, 18 bp, Homo sapiens
ctgcccagagcacttgtg

SEQ ID NO: 7053836 - DNA, 18 bp, Homo sapiens
ctgcccagagcatttcat

SEQ ID NO: 7053837 - DNA, 22 bp, Homo sapiens
ctgccctctagaggaggactga

SEQ ID NO: 7053838 - DNA, 22 bp, Homo sapiens
ctgccctctagggatgcactgg

SEQ ID NO: 7053839 - DNA, 22 bp, Homo sapiens
ctgccctgacctgcctcagagt

SEQ ID NO: 7053840 - DNA, 22 bp, Homo sapiens
ctgccctggtcccatggctgat

SEQ ID NO: 7053841 - DNA, 20 bp, Homo sapiens
atacacattcatagaaaaat

SEQ ID NO: 7053842 - DNA, 20 bp, Homo sapiens
atacacattcatagaaaaat

SEQ ID NO: 7053843 - DNA, 22 bp, Homo sapiens
ataatttacaactgcttttaat

SEQ ID NO: 7053844 - DNA, 22 bp, Homo sapiens
ataatttacaactgcttttaat

SEQ ID NO: 7053845 - DNA, 20 bp, Homo sapiens
ataatttaccctgcaccact

SEQ ID NO: 7053846 - DNA, 22 bp, Homo sapiens
ataatttaaattagtatgtgat

SEQ ID NO: 7053847 - DNA, 22 bp, Homo sapiens
ataatttaattttcacagtggt

SEQ ID NO: 7053848 - DNA, 22 bp, Homo sapiens
ataatttaaattagtatgtgat

SEQ ID NO: 7053849 - DNA, 20 bp, Homo sapiens
ataattatttacttttgtgc

SEQ ID NO: 7053850 - DNA, 22 bp, Homo sapiens
ataattatctcagacacttgtt

SEQ ID NO: 7053851 - DNA, 22 bp, Homo sapiens
ataattatctcagacacttgtt

SEQ ID NO: 7053852 - DNA, 22 bp, Homo sapiens
ataattatctcagacacttgtt

SEQ ID NO: 7053853 - DNA, 22 bp, Homo sapiens
ataatcattcacataaggtgct

SEQ ID NO: 7053854 - DNA, 21 bp, Homo sapiens
ataatgtacaaaaactgtctt

SEQ ID NO: 7053855 - DNA, 22 bp, Homo sapiens
ctggagctgctgtccttgggtg

SEQ ID NO: 7053856 - DNA, 22 bp, Homo sapiens
ctggagctgggctagggtagga

SEQ ID NO: 7053857 - DNA, 22 bp, Homo sapiens
ctggagctgtcttcacaggcct

SEQ ID NO: 7053858 - DNA, 22 bp, Homo sapiens
atacatgactcacacattctgc

SEQ ID NO: 7053859 - DNA, 22 bp, Homo sapiens
ctggaaatcactactagtcaat

SEQ ID NO: 7053860 - DNA, 22 bp, Homo sapiens
ctggaaattggagatgatgttt

SEQ ID NO: 7053861 - DNA, 22 bp, Homo sapiens
ctggaagaactccagttctgtg

SEQ ID NO: 7053862 - DNA, 22 bp, Homo sapiens
ctggaagaactccagttctgtg

SEQ ID NO: 7053863 - DNA, 22 bp, Homo sapiens
ctggaagaccccccaggactca

SEQ ID NO: 7053864 - DNA, 22 bp, Homo sapiens
ctggaagacgtttgaagccatg

SEQ ID NO: 7053865 - DNA, 22 bp, Homo sapiens
atacatatatggtacttcctgg

SEQ ID NO: 7053866 - DNA, 22 bp, Homo sapiens
atagaatatgacttttagatcc

SEQ ID NO: 7053867 - DNA, 22 bp, Homo sapiens
atagaatatgacttttagatcc

SEQ ID NO: 7053868 - DNA, 22 bp, Homo sapiens
atagaatagcatagaaaattga

SEQ ID NO: 7053869 - DNA, 22 bp, Homo sapiens
atagaatagcatagaaaattga

SEQ ID NO: 7053870 - DNA, 22 bp, Homo sapiens
atagaatagcatagaaaattga

SEQ ID NO: 7053871 - DNA, 22 bp, Homo sapiens
atagaatatgacttttagatcc

SEQ ID NO: 7053872 - DNA, 22 bp, Homo sapiens
atagaaaggtctttggcagaca

SEQ ID NO: 7053873 - DNA, 22 bp, Homo sapiens
atacttttaattccttctgagt

SEQ ID NO: 7053874 - DNA, 22 bp, Homo sapiens
atactttggtcactattattgg

SEQ ID NO: 7053875 - DNA, 22 bp, Homo sapiens
atagaaaacagatgtccttaaa

SEQ ID NO: 7053876 - DNA, 17 bp, Homo sapiens
ctggagctgtgtaacct

SEQ ID NO: 7053877 - DNA, 22 bp, Homo sapiens
ctggagctgttttttcaggaaa

SEQ ID NO: 7053878 - DNA, 22 bp, Homo sapiens
ctggagcttattgggagcagaa

SEQ ID NO: 7053879 - DNA, 22 bp, Homo sapiens
ctggaggaaaacaactgcagac

SEQ ID NO: 7053880 - DNA, 22 bp, Homo sapiens
ctggccaggttttgaacagttg

SEQ ID NO: 7053881 - DNA, 22 bp, Homo sapiens
atagaattctttgaaatttatg

SEQ ID NO: 7053882 - DNA, 22 bp, Homo sapiens
atagaatttgcactaaatctgc

SEQ ID NO: 7053883 - DNA, 22 bp, Homo sapiens
atagacatggtcttttgtcatt

SEQ ID NO: 7053884 - DNA, 22 bp, Homo sapiens
atagacattataacacagagct

SEQ ID NO: 7053885 - DNA, 22 bp, Homo sapiens
atagtaactggcatgtttatga

SEQ ID NO: 7053886 - DNA, 22 bp, Homo sapiens
ataggtacagcagatattctta

SEQ ID NO: 7053887 - DNA, 22 bp, Homo sapiens
atagtacaatcagttaattagt

SEQ ID NO: 7053888 - DNA, 22 bp, Homo sapiens
atagcatataagttataaaact

SEQ ID NO: 7053889 - DNA, 21 bp, Homo sapiens
atctggaaattctgccagaga

SEQ ID NO: 7053890 - DNA, 21 bp, Homo sapiens
atctggaagaactggtaagtg

SEQ ID NO: 7053891 - DNA, 22 bp, Homo sapiens
atctggaagccagatactcagt

SEQ ID NO: 7053892 - DNA, 17 bp, Homo sapiens
atctggaagctagctga

SEQ ID NO: 7053893 - DNA, 22 bp, Homo sapiens
cttcagttatgtgccaaggaca

SEQ ID NO: 7053894 - DNA, 22 bp, Homo sapiens
atctccagtcctggtttcctgg

SEQ ID NO: 7053895 - DNA, 22 bp, Homo sapiens
atctccagttagcagtactgat

SEQ ID NO: 7053896 - DNA, 22 bp, Homo sapiens
atctatttctgctaataacaat

SEQ ID NO: 7053897 - DNA, 22 bp, Homo sapiens
atccttccagagttattctcaa

SEQ ID NO: 7053898 - DNA, 22 bp, Homo sapiens
atccttcagctgccctgttacc

SEQ ID NO: 7053899 - DNA, 22 bp, Homo sapiens
ctgtttcagaacttcttaaaaa

SEQ ID NO: 7053900 - DNA, 22 bp, Homo sapiens
ctgtttcaagtgaagtcagaca

SEQ ID NO: 7053901 - DNA, 22 bp, Homo sapiens
cttcacagaataaactcattat

SEQ ID NO: 7053902 - DNA, 22 bp, Homo sapiens
cttcagaagcctgcagcctttg

SEQ ID NO: 7053903 - DNA, 22 bp, Homo sapiens
cttcagaatgggactgtgtttg

SEQ ID NO: 7053904 - DNA, 22 bp, Homo sapiens
cttcagagagtccagggactgc

SEQ ID NO: 7053905 - DNA, 22 bp, Homo sapiens
cttcagaggggactcaaagtca

SEQ ID NO: 7053906 - DNA, 22 bp, Homo sapiens
ctgtttatctctaacctgttta

SEQ ID NO: 7053907 - DNA, 21 bp, Homo sapiens
atcattaattgctgagtgaca

SEQ ID NO: 7053908 - DNA, 23 bp, Homo sapiens
atcattaacagtgcaggggtagg

SEQ ID NO: 7053909 - DNA, 22 bp, Homo sapiens
atcattcagcctaagcaagtac

SEQ ID NO: 7053910 - DNA, 22 bp, Homo sapiens
atcattctagctgttgtgttga

SEQ ID NO: 7053911 - DNA, 22 bp, Homo sapiens
ctgtccagtcagaacgtcatta

SEQ ID NO: 7053912 - DNA, 22 bp, Homo sapiens
ctgtgcagtaggtcagggctgg

SEQ ID NO: 7053913 - DNA, 22 bp, Homo sapiens
ctgtgcctaagatgcatgtctc

SEQ ID NO: 7053914 - DNA, 22 bp, Homo sapiens
ctgtgcctccaagtggtctctg

SEQ ID NO: 7053915 - DNA, 22 bp, Homo sapiens
ctgtgcctccagtctcgcttct

SEQ ID NO: 7053916 - DNA, 22 bp, Homo sapiens
ctgtgcctccagtctcgcttct

SEQ ID NO: 7053917 - DNA, 22 bp, Homo sapiens
ctgtgcctccctttactttgag

SEQ ID NO: 7053918 - DNA, 22 bp, Homo sapiens
ctgtgcctgcaggccacatcaa

SEQ ID NO: 7053919 - DNA, 22 bp, Homo sapiens
ctgtgcctgccttgttcactga

SEQ ID NO: 7053920 - DNA, 22 bp, Homo sapiens
ctgtgccttctacttcactcta

SEQ ID NO: 7053921 - DNA, 22 bp, Homo sapiens
ctgtgccttctgcctggaacat

SEQ ID NO: 7053922 - DNA, 22 bp, Homo sapiens
ctgtgccttggcgctgtgccac

SEQ ID NO: 7053923 - DNA, 22 bp, Homo sapiens
ctgtgcctttgtagctgtgcct

SEQ ID NO: 7053924 - DNA, 22 bp, Homo sapiens
atcaggaaatacttatttataa

SEQ ID NO: 7053925 - DNA, 22 bp, Homo sapiens
atcaggaagaagaatgtgttgg

SEQ ID NO: 7053926 - DNA, 22 bp, Homo sapiens
atcaggaagccagtctaatgga

SEQ ID NO: 7053927 - DNA, 22 bp, Homo sapiens
atcaggaatgaatacttttgga

SEQ ID NO: 7053928 - DNA, 22 bp, Homo sapiens
atatcacagctctttcattgct

SEQ ID NO: 7053929 - DNA, 22 bp, Homo sapiens
atatcacagtagttgtttagtt

SEQ ID NO: 7053930 - DNA, 22 bp, Homo sapiens
atatcacagtagttgtttagtt

SEQ ID NO: 7053931 - DNA, 22 bp, Homo sapiens
atatcataaatcggtgcatgaa

SEQ ID NO: 7053932 - DNA, 22 bp, Homo sapiens
atatcattatgttatgagcaca

SEQ ID NO: 7053933 - DNA, 22 bp, Homo sapiens
atatcattatgttatgagcaca

SEQ ID NO: 7053934 - DNA, 22 bp, Homo sapiens
atatcattatgttatgagcaca

SEQ ID NO: 7053935 - DNA, 23 bp, Homo sapiens
atatcacacccagtacagtctcc

SEQ ID NO: 7053936 - DNA, 21 bp, Homo sapiens
atatcacaaacatatggtctg

SEQ ID NO: 7053937 - DNA, 22 bp, Homo sapiens
atatcaaagctagtggaaattt

SEQ ID NO: 7053938 - DNA, 22 bp, Homo sapiens
atatcaaacgaagttattttaa

SEQ ID NO: 7053939 - DNA, 22 bp, Homo sapiens
atatcaaaataaacagcatgca

SEQ ID NO: 7053940 - DNA, 22 bp, Homo sapiens
atatattttgcggtcacgtggc

SEQ ID NO: 7053941 - DNA, 22 bp, Homo sapiens
atatattttttgagacagagtc

SEQ ID NO: 7053942 - DNA, 22 bp, Homo sapiens
atagtcttagatcagataaagt

SEQ ID NO: 7053943 - DNA, 22 bp, Homo sapiens
ctgggcagtttattcagttctg

SEQ ID NO: 7053944 - DNA, 22 bp, Homo sapiens
ctgggccagggaggtgtctgta

SEQ ID NO: 7053945 - DNA, 22 bp, Homo sapiens
atatcattctgatgtatatctt

SEQ ID NO: 7053946 - DNA, 22 bp, Homo sapiens
ctgggccatgggccagcgaggc

SEQ ID NO: 7053947 - DNA, 22 bp, Homo sapiens
ctgggccatgggccagcgaggc

SEQ ID NO: 7053948 - DNA, 22 bp, Homo sapiens
ctgggccatctctctgcaagtg

SEQ ID NO: 7053949 - DNA, 22 bp, Homo sapiens
ctgggcctgggaggccaggtct

SEQ ID NO: 7053950 - DNA, 22 bp, Homo sapiens
ctgggcctggcgttccaggctg

SEQ ID NO: 7053951 - DNA, 22 bp, Homo sapiens
ctgggctgcagcgggagcgacg

SEQ ID NO: 7053952 - DNA, 22 bp, Homo sapiens
ctgggcctggggctgttgagag

SEQ ID NO: 7053953 - DNA, 22 bp, Homo sapiens
ctgtattcaagcttctgcccaa

SEQ ID NO: 7053954 - DNA, 22 bp, Homo sapiens
ctgtatttagttaaaatgctaa

SEQ ID NO: 7053955 - DNA, 22 bp, Homo sapiens
ctgtatttcccacattctctat

SEQ ID NO: 7053956 - DNA, 22 bp, Homo sapiens
ctgtcatttaagacattctgga

SEQ ID NO: 7053957 - DNA, 22 bp, Homo sapiens
ctgtatatgtgcatacacacac

SEQ ID NO: 7053958 - DNA, 22 bp, Homo sapiens
ctgtatatgtgcatacacacac

SEQ ID NO: 7053959 - DNA, 22 bp, Homo sapiens
ctgtatgaggatcagactggac

SEQ ID NO: 7053960 - DNA, 22 bp, Homo sapiens
atattttctggaactatgcctg

SEQ ID NO: 7053961 - DNA, 22 bp, Homo sapiens
atattttccgaacttgaggtag

SEQ ID NO: 7053962 - DNA, 22 bp, Homo sapiens
atattttctggaactatgcctg

SEQ ID NO: 7053963 - DNA, 22 bp, Homo sapiens
atattttcactgaaccaaagta

SEQ ID NO: 7053964 - DNA, 22 bp, Homo sapiens
atattttccgaacttgaggtag

SEQ ID NO: 7053965 - DNA, 22 bp, Homo sapiens
atattttcacagaacttgcaaa

SEQ ID NO: 7053966 - DNA, 22 bp, Homo sapiens
atattttcacagaacttgcaaa

SEQ ID NO: 7053967 - DNA, 22 bp, Homo sapiens
atatttgttagagtctatgtgt

SEQ ID NO: 7053968 - DNA, 23 bp, Homo sapiens
ctgggctgtcctgaggtcacctc

SEQ ID NO: 7053969 - DNA, 22 bp, Homo sapiens
ctgggctgtcccagggcggcag

SEQ ID NO: 7053970 - DNA, 17 bp, Homo sapiens
ctggggatgtgggactc

SEQ ID NO: 7053971 - DNA, 22 bp, Homo sapiens
ctggtggagagtgggctctgga

SEQ ID NO: 7053972 - DNA, 22 bp, Homo sapiens
ctggtggagatgcctggcccct

SEQ ID NO: 7053973 - DNA, 22 bp, Homo sapiens
ctggtgggagcagcaggcagct

SEQ ID NO: 7053974 - DNA, 22 bp, Homo sapiens
agtctgccaagccagatcatgt

SEQ ID NO: 7053975 - DNA, 22 bp, Homo sapiens
agtctgagtatctctgagccag

SEQ ID NO: 7053976 - DNA, 21 bp, Homo sapiens
agtctgaggtggggcctagga

SEQ ID NO: 7053977 - DNA, 22 bp, Homo sapiens
agtctctttaatcacagtgtct

SEQ ID NO: 7053978 - DNA, 22 bp, Homo sapiens
agtctctttgtggactctgcct

SEQ ID NO: 7053979 - DNA, 22 bp, Homo sapiens
agtctcttttgcgaagagtgtt

SEQ ID NO: 7053980 - DNA, 22 bp, Homo sapiens
agtctctccacattgttataaa

SEQ ID NO: 7053981 - DNA, 21 bp, Homo sapiens
agtctctctaataaatgcttg

SEQ ID NO: 7053982 - DNA, 22 bp, Homo sapiens
agtcattttgccagtcttcagg

SEQ ID NO: 7053983 - DNA, 22 bp, Homo sapiens
agtcattttctgcctgtaatct

SEQ ID NO: 7053984 - DNA, 22 bp, Homo sapiens
agtcatttctgtagtcatgttt

SEQ ID NO: 7053985 - DNA, 22 bp, Homo sapiens
agtcattttctgcctgtaatct

SEQ ID NO: 7053986 - DNA, 22 bp, Homo sapiens
agtccaagaccaaggtgtcacc

SEQ ID NO: 7053987 - DNA, 22 bp, Homo sapiens
agtccaagatcaaggtgtcaac

SEQ ID NO: 7053988 - DNA, 22 bp, Homo sapiens
agtccaagatcaaggtgtcagg

SEQ ID NO: 7053989 - DNA, 20 bp, Homo sapiens
agtctgcctgctccttctcc

SEQ ID NO: 7053990 - DNA, 22 bp, Homo sapiens
agtctgcctttccaatcccgtg

SEQ ID NO: 7053991 - DNA, 22 bp, Homo sapiens
agtctgtctacttaaagtctgt

SEQ ID NO: 7053992 - DNA, 19 bp, Homo sapiens
agtctgtctgctttccctc

SEQ ID NO: 7053993 - DNA, 22 bp, Homo sapiens
agtctgtctgtcacttctgcag

SEQ ID NO: 7053994 - DNA, 22 bp, Homo sapiens
agtctgtctttggcttcaccac

SEQ ID NO: 7053995 - DNA, 21 bp, Homo sapiens
agtctgttaggatgactctga

SEQ ID NO: 7053996 - DNA, 22 bp, Homo sapiens
ctcaggagttggaggctacagt

SEQ ID NO: 7053997 - DNA, 22 bp, Homo sapiens
ctcctctcaaaagtaggttgac

SEQ ID NO: 7053998 - DNA, 22 bp, Homo sapiens
ctcctctcaggctggatggcgc

SEQ ID NO: 7053999 - DNA, 22 bp, Homo sapiens
agtgcaggagcctggccagagc

SEQ ID NO: 7054000 - DNA, 22 bp, Homo sapiens
agtgcaggagcctggccagagc

SEQ ID NO: 7054001 - DNA, 22 bp, Homo sapiens
ctcctccctgcgattgctctgc

SEQ ID NO: 7054002 - DNA, 22 bp, Homo sapiens
ctcctcccacggtctcaggaag

SEQ ID NO: 7054003 - DNA, 22 bp, Homo sapiens
ctcctccctctttgccacacat

SEQ ID NO: 7054004 - DNA, 22 bp, Homo sapiens
ctcctccctctttgccacacat

SEQ ID NO: 7054005 - DNA, 22 bp, Homo sapiens
ctcctccctctttgccacacat

SEQ ID NO: 7054006 - DNA, 22 bp, Homo sapiens
agtgcagccgagatcaggtgct

SEQ ID NO: 7054007 - DNA, 22 bp, Homo sapiens
ctcccaggggaactatcaagta

SEQ ID NO: 7054008 - DNA, 22 bp, Homo sapiens
ctcccagggtagggagagacta

SEQ ID NO: 7054009 - DNA, 22 bp, Homo sapiens
ctcccagggtctaggctgctgg

SEQ ID NO: 7054010 - DNA, 22 bp, Homo sapiens
ctcccaggtgtcccttctgcca

SEQ ID NO: 7054011 - DNA, 22 bp, Homo sapiens
ctcccaggttacatctgagcct

SEQ ID NO: 7054012 - DNA, 22 bp, Homo sapiens
ctcccaggttccgacgcctctt

SEQ ID NO: 7054013 - DNA, 22 bp, Homo sapiens
ctcccaggttccgacgcctctt

SEQ ID NO: 7054014 - DNA, 22 bp, Homo sapiens
agtgcactggcaccatctcagc

SEQ ID NO: 7054015 - DNA, 22 bp, Homo sapiens
agtgcacaccttagtacaaagt

SEQ ID NO: 7054016 - DNA, 22 bp, Homo sapiens
agtgcagagacctggtcaggca

SEQ ID NO: 7054017 - DNA, 22 bp, Homo sapiens
agtgcagagagcaatactctac

SEQ ID NO: 7054018 - DNA, 22 bp, Homo sapiens
agtgcagagtacatttgtggca

SEQ ID NO: 7054019 - DNA, 22 bp, Homo sapiens
agtgactgggcagggcagggcc

SEQ ID NO: 7054020 - DNA, 22 bp, Homo sapiens
ctccagggagctgcgggagcca

SEQ ID NO: 7054021 - DNA, 22 bp, Homo sapiens
ctccagtgggggtgagcctaga

SEQ ID NO: 7054022 - DNA, 22 bp, Homo sapiens
ctccagtggtgatggggaagaa

SEQ ID NO: 7054023 - DNA, 22 bp, Homo sapiens
ctccagttggccccagttggtt

SEQ ID NO: 7054024 - DNA, 22 bp, Homo sapiens
ctccagttggccccagttggtt

SEQ ID NO: 7054025 - DNA, 22 bp, Homo sapiens
ctgagagcctcctgttggctag

SEQ ID NO: 7054026 - DNA, 22 bp, Homo sapiens
ctgagaggcagccagagaaaat

SEQ ID NO: 7054027 - DNA, 22 bp, Homo sapiens
ctgagaggcggagcttgcagtg

SEQ ID NO: 7054028 - DNA, 22 bp, Homo sapiens
ctgagaggcggagcttgcagtg

SEQ ID NO: 7054029 - DNA, 21 bp, Homo sapiens
agtgtgtgataggcaggaaga

SEQ ID NO: 7054030 - DNA, 22 bp, Homo sapiens
agtgtgtgcatgcattcgtgca

SEQ ID NO: 7054031 - DNA, 22 bp, Homo sapiens
agtgtgtgcctttggatacctg

SEQ ID NO: 7054032 - DNA, 21 bp, Homo sapiens
agtgtgtgtggaatgagaata

SEQ ID NO: 7054033 - DNA, 22 bp, Homo sapiens
agtgtgtgtttgggcggtttat

SEQ ID NO: 7054034 - DNA, 22 bp, Homo sapiens
ctgaagcagatgtggctgagat

SEQ ID NO: 7054035 - DNA, 18 bp, Homo sapiens
ctcttaagcctttgtcaa

SEQ ID NO: 7054036 - DNA, 22 bp, Homo sapiens
ctcttaaagcttccagtttcaa

SEQ ID NO: 7054037 - DNA, 22 bp, Homo sapiens
ctcttaaagaatgttccagctg

SEQ ID NO: 7054038 - DNA, 22 bp, Homo sapiens
agtgtctgcctatttttcaagc

SEQ ID NO: 7054039 - DNA, 22 bp, Homo sapiens
agtgtctgatgcacagttgtcc

SEQ ID NO: 7054040 - DNA, 22 bp, Homo sapiens
agtgtctgcaaaatgaaagagc

SEQ ID NO: 7054041 - DNA, 22 bp, Homo sapiens
agtgtctgcagtgatgtctctt

SEQ ID NO: 7054042 - DNA, 22 bp, Homo sapiens
agtgtctgccaactgcatggtc

SEQ ID NO: 7054043 - DNA, 22 bp, Homo sapiens
agtgtctgccagctgccaggtg

SEQ ID NO: 7054044 - DNA, 20 bp, Homo sapiens
agtggggagtcaggagtgcc

SEQ ID NO: 7054045 - DNA, 22 bp, Homo sapiens
agtggggaggtccaggccaccc

SEQ ID NO: 7054046 - DNA, 22 bp, Homo sapiens
agtggggacttatgccagcatt

SEQ ID NO: 7054047 - DNA, 20 bp, Homo sapiens
agtggggagtcaggagtgcc

SEQ ID NO: 7054048 - DNA, 20 bp, Homo sapiens
agtggggagtcaggagtgcc

SEQ ID NO: 7054049 - DNA, 22 bp, Homo sapiens
agtggggacaatgagagcaggt

SEQ ID NO: 7054050 - DNA, 22 bp, Homo sapiens
agtgtctgaacctgcagtggga

SEQ ID NO: 7054051 - DNA, 22 bp, Homo sapiens
agtgtctgaactgggtgctgac

SEQ ID NO: 7054052 - DNA, 22 bp, Homo sapiens
agtgtctgaagcctcagcccga

SEQ ID NO: 7054053 - DNA, 22 bp, Homo sapiens
agtgtctgaaggatttggcttc

SEQ ID NO: 7054054 - DNA, 22 bp, Homo sapiens
agtgtctgagccagaattagaa

SEQ ID NO: 7054055 - DNA, 21 bp, Homo sapiens
agtgtctgagcgctgcttctg

SEQ ID NO: 7054056 - DNA, 22 bp, Homo sapiens
agtgtctgagctatcattaggg

SEQ ID NO: 7054057 - DNA, 22 bp, Homo sapiens
agtgtctgagtaaatttctcat

SEQ ID NO: 7054058 - DNA, 23 bp, Homo sapiens
agtgtctgagtgcaggctgtgca

SEQ ID NO: 7054059 - DNA, 22 bp, Homo sapiens
agtgtctgatcagttgactaga

SEQ ID NO: 7054060 - DNA, 22 bp, Homo sapiens
agtggctggcataggaacagac

SEQ ID NO: 7054061 - DNA, 19 bp, Homo sapiens
agtggctgggcagaagcaa

SEQ ID NO: 7054062 - DNA, 17 bp, Homo sapiens
agtggcaggcagatggg

SEQ ID NO: 7054063 - DNA, 22 bp, Homo sapiens
agtggcaggcggagatgtagga

SEQ ID NO: 7054064 - DNA, 22 bp, Homo sapiens
agtggcagctgtcatgccctag

SEQ ID NO: 7054065 - DNA, 22 bp, Homo sapiens
agtggcaggaaagtggaagaga

SEQ ID NO: 7054066 - DNA, 17 bp, Homo sapiens
agtggcaggcagatggg

SEQ ID NO: 7054067 - DNA, 22 bp, Homo sapiens
ctctctggtacatagagtttgg

SEQ ID NO: 7054068 - DNA, 22 bp, Homo sapiens
ctctctgggtcctcttttatag

SEQ ID NO: 7054069 - DNA, 22 bp, Homo sapiens
ctctctggggttccagacgtgg

SEQ ID NO: 7054070 - DNA, 18 bp, Homo sapiens
ctctctgggtgaggacaa

SEQ ID NO: 7054071 - DNA, 22 bp, Homo sapiens
ctctctggggttccagacgtgg

SEQ ID NO: 7054072 - DNA, 22 bp, Homo sapiens
agtgcaggccccaggccaggcc

SEQ ID NO: 7054073 - DNA, 22 bp, Homo sapiens
agtgcagggcctgcccagcagg

SEQ ID NO: 7054074 - DNA, 22 bp, Homo sapiens
ctctctccttagctgcagacca

SEQ ID NO: 7054075 - DNA, 22 bp, Homo sapiens
ctctgacattctgtgactctga

SEQ ID NO: 7054076 - DNA, 22 bp, Homo sapiens
ctctgagaatatgagctctttg

SEQ ID NO: 7054077 - DNA, 22 bp, Homo sapiens
agtgggcaggcagggtgcgcag

SEQ ID NO: 7054078 - DNA, 20 bp, Homo sapiens
agtgggagagggcagactgc

SEQ ID NO: 7054079 - DNA, 20 bp, Homo sapiens
agtgggagagggcagactgc

SEQ ID NO: 7054080 - DNA, 22 bp, Homo sapiens
agtgggagggccatatggtgaa

SEQ ID NO: 7054081 - DNA, 22 bp, Homo sapiens
agtgggagggccatatggtgaa

SEQ ID NO: 7054082 - DNA, 22 bp, Homo sapiens
agtgggagagaagcaagtagta

SEQ ID NO: 7054083 - DNA, 22 bp, Homo sapiens
agtgggctggtggcagggagaa

SEQ ID NO: 7054084 - DNA, 22 bp, Homo sapiens
cctggagcatcaggaggaaggg

SEQ ID NO: 7054085 - DNA, 22 bp, Homo sapiens
cctggagcaggagctgcagagg

SEQ ID NO: 7054086 - DNA, 22 bp, Homo sapiens
cctggagcccaaggcagtgaga

SEQ ID NO: 7054087 - DNA, 22 bp, Homo sapiens
cctgcctgctttctgctttgca

SEQ ID NO: 7054088 - DNA, 22 bp, Homo sapiens
cctgcctggagctgagtgtgga

SEQ ID NO: 7054089 - DNA, 22 bp, Homo sapiens
cctgcctggatcagccatcctg

SEQ ID NO: 7054090 - DNA, 22 bp, Homo sapiens
cctgcctggatcagccatcctg

SEQ ID NO: 7054091 - DNA, 22 bp, Homo sapiens
cctgcctggcacatagtactct

SEQ ID NO: 7054092 - DNA, 22 bp, Homo sapiens
cctgcctggcccaccttgccac

SEQ ID NO: 7054093 - DNA, 22 bp, Homo sapiens
cctgcctggcccaccttgccac

SEQ ID NO: 7054094 - DNA, 22 bp, Homo sapiens
agggtggaagatggcactatct

SEQ ID NO: 7054095 - DNA, 19 bp, Homo sapiens
agggtggcaaaggagggtg

SEQ ID NO: 7054096 - DNA, 19 bp, Homo sapiens
agggtggcaaaggagggtg

SEQ ID NO: 7054097 - DNA, 20 bp, Homo sapiens
agggtggcaagttagtgaca

SEQ ID NO: 7054098 - DNA, 22 bp, Homo sapiens
agggtggcacctggaagggatg

SEQ ID NO: 7054099 - DNA, 22 bp, Homo sapiens
agggtggcagttactggagcaa

SEQ ID NO: 7054100 - DNA, 22 bp, Homo sapiens
agggtggcagttactggagcaa

SEQ ID NO: 7054101 - DNA, 22 bp, Homo sapiens
cctgcctgcgtcctctgagggc

SEQ ID NO: 7054102 - DNA, 20 bp, Homo sapiens
cctggagcctggaaggagtc

SEQ ID NO: 7054103 - DNA, 22 bp, Homo sapiens
cctggagcccctctggccagcc

SEQ ID NO: 7054104 - DNA, 22 bp, Homo sapiens
cctggagctcactgggagccgg

SEQ ID NO: 7054105 - DNA, 22 bp, Homo sapiens
cctggagctcactgggagccgg

SEQ ID NO: 7054106 - DNA, 22 bp, Homo sapiens
agggtggctgagtagatggaag

SEQ ID NO: 7054107 - DNA, 22 bp, Homo sapiens
cctggctcaggcacgcatggct

SEQ ID NO: 7054108 - DNA, 17 bp, Homo sapiens
aggtataaaatggtagc

SEQ ID NO: 7054109 - DNA, 22 bp, Homo sapiens
aggtataagtctcatttctgtt

SEQ ID NO: 7054110 - DNA, 22 bp, Homo sapiens
aggtataagtctcatttctgtt

SEQ ID NO: 7054111 - DNA, 22 bp, Homo sapiens
aggtatcaacagcagagtctga

SEQ ID NO: 7054112 - DNA, 22 bp, Homo sapiens
aggtatctggtaagaggcagac

SEQ ID NO: 7054113 - DNA, 22 bp, Homo sapiens
aggtggagtgtgcagggagagc

SEQ ID NO: 7054114 - DNA, 21 bp, Homo sapiens
aggtggagtgcttagcatcca

SEQ ID NO: 7054115 - DNA, 22 bp, Homo sapiens
aggtggagtgtgcagggagagc

SEQ ID NO: 7054116 - DNA, 22 bp, Homo sapiens
aggtggagtgtgcagggagagc

SEQ ID NO: 7054117 - DNA, 23 bp, Homo sapiens
aggtggagctgtgcagccggggc

SEQ ID NO: 7054118 - DNA, 23 bp, Homo sapiens
aggtggagctgtgcagccggggc

SEQ ID NO: 7054119 - DNA, 22 bp, Homo sapiens
aggtggagtgaaggaaaggcag

SEQ ID NO: 7054120 - DNA, 22 bp, Homo sapiens
aggtggagtgaaggaaaggcag

SEQ ID NO: 7054121 - DNA, 22 bp, Homo sapiens
aggtggagtgaaggaaaggcag

SEQ ID NO: 7054122 - DNA, 22 bp, Homo sapiens
aggtggagttaagtgtgaactg

SEQ ID NO: 7054123 - DNA, 22 bp, Homo sapiens
aggtggagttggctgtagttca

SEQ ID NO: 7054124 - DNA, 22 bp, Homo sapiens
aggtggagttggctgtagttca

SEQ ID NO: 7054125 - DNA, 22 bp, Homo sapiens
cctgggtgtcatgggcagctgg

SEQ ID NO: 7054126 - DNA, 22 bp, Homo sapiens
cctgggcataaatcactccaag

SEQ ID NO: 7054127 - DNA, 22 bp, Homo sapiens
cctgggcagtgctggagttgaa

SEQ ID NO: 7054128 - DNA, 22 bp, Homo sapiens
cctgggcagtgctggagttgaa

SEQ ID NO: 7054129 - DNA, 22 bp, Homo sapiens
cctgggcaggtgtggcttcccc

SEQ ID NO: 7054130 - DNA, 22 bp, Homo sapiens
cctgggcagggagaccaggctc

SEQ ID NO: 7054131 - DNA, 22 bp, Homo sapiens
cctgggcaggccggacgctggg

SEQ ID NO: 7054132 - DNA, 22 bp, Homo sapiens
cctgggcaggccggacgctggg

SEQ ID NO: 7054133 - DNA, 22 bp, Homo sapiens
cctgggcagggctggactctca

SEQ ID NO: 7054134 - DNA, 22 bp, Homo sapiens
cctgggcagggagaccaggctc

SEQ ID NO: 7054135 - DNA, 22 bp, Homo sapiens
aggtgagtcctgggcacaggta

SEQ ID NO: 7054136 - DNA, 22 bp, Homo sapiens
aggtgcacctgagggtgtcatc

SEQ ID NO: 7054137 - DNA, 21 bp, Homo sapiens
aggtgcagagccagggaccag

SEQ ID NO: 7054138 - DNA, 21 bp, Homo sapiens
aggtgcagagccagggaccag

SEQ ID NO: 7054139 - DNA, 22 bp, Homo sapiens
cctgggcaggatgggcccggtg

SEQ ID NO: 7054140 - DNA, 20 bp, Homo sapiens
aggtctgaatgtcagggctg

SEQ ID NO: 7054141 - DNA, 17 bp, Homo sapiens
aggtctgagagtatctg

SEQ ID NO: 7054142 - DNA, 22 bp, Homo sapiens
aggtctgagcaggggagaacag

SEQ ID NO: 7054143 - DNA, 18 bp, Homo sapiens
aggtctgaggaagagcct

SEQ ID NO: 7054144 - DNA, 22 bp, Homo sapiens
aggtctgagtagagaaaaggca

SEQ ID NO: 7054145 - DNA, 22 bp, Homo sapiens
aggtctgagtatggcctgagaa

SEQ ID NO: 7054146 - DNA, 22 bp, Homo sapiens
aggtctgagtcccaggggtacc

SEQ ID NO: 7054147 - DNA, 20 bp, Homo sapiens
aggtctgattccagaatcag

SEQ ID NO: 7054148 - DNA, 19 bp, Homo sapiens
aggtctgcagctgcagttt

SEQ ID NO: 7054149 - DNA, 22 bp, Homo sapiens
aggtctggaggcggagtcagga

SEQ ID NO: 7054150 - DNA, 22 bp, Homo sapiens
aggtctggtgagagcaggtgct

SEQ ID NO: 7054151 - DNA, 22 bp, Homo sapiens
aggtctggtgagagcaggtgct

SEQ ID NO: 7054152 - DNA, 22 bp, Homo sapiens
aggtctggtgagagcaggtgct

SEQ ID NO: 7054153 - DNA, 22 bp, Homo sapiens
aggtctggtgttgggcctgaaa

SEQ ID NO: 7054154 - DNA, 22 bp, Homo sapiens
aggtgagggtgccagtgcatgg

SEQ ID NO: 7054155 - DNA, 20 bp, Homo sapiens
ctacacagggttcgctgggc

SEQ ID NO: 7054156 - DNA, 21 bp, Homo sapiens
ctacacagctttctataggaa

SEQ ID NO: 7054157 - DNA, 22 bp, Homo sapiens
agtcagttaaactttgtaaagt

SEQ ID NO: 7054158 - DNA, 19 bp, Homo sapiens
agtcagttctgaggaggaa

SEQ ID NO: 7054159 - DNA, 22 bp, Homo sapiens
agtcagttgtggagatttaact

SEQ ID NO: 7054160 - DNA, 22 bp, Homo sapiens
agtcataattataaacatcagt

SEQ ID NO: 7054161 - DNA, 22 bp, Homo sapiens
agtcaccaacatggttcccagg

SEQ ID NO: 7054162 - DNA, 22 bp, Homo sapiens
agtcagagaataaagaatgcat

SEQ ID NO: 7054163 - DNA, 22 bp, Homo sapiens
agtcagagaatgttttcatgga

SEQ ID NO: 7054164 - DNA, 23 bp, Homo sapiens
agtcagagagtgtgagacaactg

SEQ ID NO: 7054165 - DNA, 23 bp, Homo sapiens
agtcagagagtgtgagacaactg

SEQ ID NO: 7054166 - DNA, 23 bp, Homo sapiens
agtcagagagtgtgagacaactg

SEQ ID NO: 7054167 - DNA, 22 bp, Homo sapiens
agtcagagcaaactggacagac

SEQ ID NO: 7054168 - DNA, 23 bp, Homo sapiens
agtcagagcagaagggctgcttg

SEQ ID NO: 7054169 - DNA, 22 bp, Homo sapiens
agtcagagctatgttgttatat

SEQ ID NO: 7054170 - DNA, 22 bp, Homo sapiens
agtcagaggaatgggccaggct

SEQ ID NO: 7054171 - DNA, 17 bp, Homo sapiens
agtcagaggagtatctg

SEQ ID NO: 7054172 - DNA, 22 bp, Homo sapiens
agtcagagtcgccgacagtcaa

SEQ ID NO: 7054173 - DNA, 22 bp, Homo sapiens
agtcagagtctattgctgtggt

SEQ ID NO: 7054174 - DNA, 22 bp, Homo sapiens
agtcagagtgtgcaggccggct

SEQ ID NO: 7054175 - DNA, 22 bp, Homo sapiens
agtcagagttcttggggagaca

SEQ ID NO: 7054176 - DNA, 22 bp, Homo sapiens
agtcagagttttgaggtgtgac

SEQ ID NO: 7054177 - DNA, 22 bp, Homo sapiens
agtcagatttagatgtagcaag

SEQ ID NO: 7054178 - DNA, 22 bp, Homo sapiens
cgcgctgcagacagcggaggcc

SEQ ID NO: 7054179 - DNA, 22 bp, Homo sapiens
cggtcaggtgcagcgttggcac

SEQ ID NO: 7054180 - DNA, 22 bp, Homo sapiens
cggtcaggtgcagcgttggcac

SEQ ID NO: 7054181 - DNA, 17 bp, Homo sapiens
cgtgagcagcaggtgcc

SEQ ID NO: 7054182 - DNA, 20 bp, Homo sapiens
cgtgctgtgaccttgagcat

SEQ ID NO: 7054183 - DNA, 22 bp, Homo sapiens
cgtgctctggactcgtggcaca

SEQ ID NO: 7054184 - DNA, 22 bp, Homo sapiens
ctaaacatcttgcaatgcacag

SEQ ID NO: 7054185 - DNA, 22 bp, Homo sapiens
ctaaacatgaactacatttagg

SEQ ID NO: 7054186 - DNA, 22 bp, Homo sapiens
ctaaacatgcaagagcttctgg

SEQ ID NO: 7054187 - DNA, 22 bp, Homo sapiens
ctaaacatggcttagaacactc

SEQ ID NO: 7054188 - DNA, 22 bp, Homo sapiens
ctaaacatgtagcttttgtggt

SEQ ID NO: 7054189 - DNA, 22 bp, Homo sapiens
ctaaacatgttggtgctttaaa

SEQ ID NO: 7054190 - DNA, 22 bp, Homo sapiens
ctaaacctttgtgcttgcaatt

SEQ ID NO: 7054191 - DNA, 22 bp, Homo sapiens
agtaatcaatttttcggtggat

SEQ ID NO: 7054192 - DNA, 21 bp, Homo sapiens
agtacaaaaattcctttctca

SEQ ID NO: 7054193 - DNA, 22 bp, Homo sapiens
cgcctgctctgtttccatgtgg

SEQ ID NO: 7054194 - DNA, 21 bp, Homo sapiens
aggtttctcttttatggaggg

SEQ ID NO: 7054195 - DNA, 22 bp, Homo sapiens
aggtttctatgctgtttatctt

SEQ ID NO: 7054196 - DNA, 19 bp, Homo sapiens
aggtttctaactattcaag

SEQ ID NO: 7054197 - DNA, 22 bp, Homo sapiens
aggtttattaagtaaatagagc

SEQ ID NO: 7054198 - DNA, 21 bp, Homo sapiens
aggtttatttcaacttcagga

SEQ ID NO: 7054199 - DNA, 22 bp, Homo sapiens
aggttggccaagctgctggccc

SEQ ID NO: 7054200 - DNA, 22 bp, Homo sapiens
aggttggcctcagggaggctct

SEQ ID NO: 7054201 - DNA, 22 bp, Homo sapiens
aggtttactgagggtgctggtt

SEQ ID NO: 7054202 - DNA, 22 bp, Homo sapiens
aggtttataggaaatttgttcc

SEQ ID NO: 7054203 - DNA, 23 bp, Homo sapiens
aggttatgattatagagcgagga

SEQ ID NO: 7054204 - DNA, 22 bp, Homo sapiens
aggtgtctgggctttggagtca

SEQ ID NO: 7054205 - DNA, 22 bp, Homo sapiens
aggtgtctgtgatgggagcgat

SEQ ID NO: 7054206 - DNA, 22 bp, Homo sapiens
aggtgtcttcagggtgagacag

SEQ ID NO: 7054207 - DNA, 22 bp, Homo sapiens
aggtgtctttgcggcccgccgc

SEQ ID NO: 7054208 - DNA, 22 bp, Homo sapiens
cccaggagttggaggctgcagt

SEQ ID NO: 7054209 - DNA, 22 bp, Homo sapiens
cccaggaggtggagcttgcagt

SEQ ID NO: 7054210 - DNA, 22 bp, Homo sapiens
cccaggaggtggaggctgcagt

SEQ ID NO: 7054211 - DNA, 22 bp, Homo sapiens
cccaggagttggaggctacggt

SEQ ID NO: 7054212 - DNA, 21 bp, Homo sapiens
aggcttggatctagacaggcc

SEQ ID NO: 7054213 - DNA, 21 bp, Homo sapiens
aggcttggatctagacaggcc

SEQ ID NO: 7054214 - DNA, 22 bp, Homo sapiens
aggcttcttgagccccacaggc

SEQ ID NO: 7054215 - DNA, 18 bp, Homo sapiens
aggcttcttggctcagtc

SEQ ID NO: 7054216 - DNA, 22 bp, Homo sapiens
aggcttcttgggcttcattctg

SEQ ID NO: 7054217 - DNA, 22 bp, Homo sapiens
aggcttcttttagaggggatgg

SEQ ID NO: 7054218 - DNA, 22 bp, Homo sapiens
aggcttcacctgcacctgagct

SEQ ID NO: 7054219 - DNA, 22 bp, Homo sapiens
aggcttcacgatgggtgaggtg

SEQ ID NO: 7054220 - DNA, 22 bp, Homo sapiens
aggcttcactcgacatgccaat

SEQ ID NO: 7054221 - DNA, 22 bp, Homo sapiens
aggctggctggcaggggacaca

SEQ ID NO: 7054222 - DNA, 22 bp, Homo sapiens
aggctggctggcaggggacaca

SEQ ID NO: 7054223 - DNA, 22 bp, Homo sapiens
aggctggctgagctgcagcctg

SEQ ID NO: 7054224 - DNA, 22 bp, Homo sapiens
aggcttctgtgagctcatacaa

SEQ ID NO: 7054225 - DNA, 22 bp, Homo sapiens
cccaggggaggtcctcagggaa

SEQ ID NO: 7054226 - DNA, 22 bp, Homo sapiens
cccagggctgtagaatgtccaa

SEQ ID NO: 7054227 - DNA, 22 bp, Homo sapiens
cccagggcttttctcactagac

SEQ ID NO: 7054228 - DNA, 23 bp, Homo sapiens
agggaagaaacatgaagggctgt

SEQ ID NO: 7054229 - DNA, 22 bp, Homo sapiens
cccagggaagccatttctgact

SEQ ID NO: 7054230 - DNA, 21 bp, Homo sapiens
cccagggaagccgcagtcacc

SEQ ID NO: 7054231 - DNA, 22 bp, Homo sapiens
cccagggctgcagatggaggct

SEQ ID NO: 7054232 - DNA, 22 bp, Homo sapiens
cccagggctgcagatggaggct

SEQ ID NO: 7054233 - DNA, 20 bp, Homo sapiens
cccaggagtttgctcttact

SEQ ID NO: 7054234 - DNA, 22 bp, Homo sapiens
cccaggagtttgagttcagcat

SEQ ID NO: 7054235 - DNA, 23 bp, Homo sapiens
cccaggagtttcactgcaaaggt

SEQ ID NO: 7054236 - DNA, 22 bp, Homo sapiens
agggaacagtgaaaggcatcag

SEQ ID NO: 7054237 - DNA, 23 bp, Homo sapiens
agggaacaagcaagctgctagtc

SEQ ID NO: 7054238 - DNA, 23 bp, Homo sapiens
agggaacaagcaagctgctagtc

SEQ ID NO: 7054239 - DNA, 20 bp, Homo sapiens
agggaacaatggacgctgtc

SEQ ID NO: 7054240 - DNA, 22 bp, Homo sapiens
agggagaaggtttagctgtgag

SEQ ID NO: 7054241 - DNA, 22 bp, Homo sapiens
agggagaaggtccatgcctgtc

SEQ ID NO: 7054242 - DNA, 22 bp, Homo sapiens
agggagtggttaagaaggtgca

SEQ ID NO: 7054243 - DNA, 22 bp, Homo sapiens
agggagaaaattggatgcacaa

SEQ ID NO: 7054244 - DNA, 22 bp, Homo sapiens
agggagaaaattggatgcacaa

SEQ ID NO: 7054245 - DNA, 22 bp, Homo sapiens
agggactggctctctgagcagg

SEQ ID NO: 7054246 - DNA, 22 bp, Homo sapiens
cccaggggttcaaggctgcagt

SEQ ID NO: 7054247 - DNA, 22 bp, Homo sapiens
agggatgatggaaagaagcagg

SEQ ID NO: 7054248 - DNA, 22 bp, Homo sapiens
agggatgatggaaagaagcagg

SEQ ID NO: 7054249 - DNA, 22 bp, Homo sapiens
agggatgatttcagtgtctgcc

SEQ ID NO: 7054250 - DNA, 22 bp, Homo sapiens
agggatggatcttggccctgga

SEQ ID NO: 7054251 - DNA, 22 bp, Homo sapiens
agggatcagcagagggtgtggt

SEQ ID NO: 7054252 - DNA, 22 bp, Homo sapiens
agggatcagtagggacggcagc

SEQ ID NO: 7054253 - DNA, 22 bp, Homo sapiens
agggatgactcttggctgattc

SEQ ID NO: 7054254 - DNA, 22 bp, Homo sapiens
agggatgactcttggctgattc

SEQ ID NO: 7054255 - DNA, 22 bp, Homo sapiens
agggatgatcagggtagaggct

SEQ ID NO: 7054256 - DNA, 22 bp, Homo sapiens
ccctggaggagcttagagcttg

SEQ ID NO: 7054257 - DNA, 22 bp, Homo sapiens
agggatgggtctaacccagaac

SEQ ID NO: 7054258 - DNA, 22 bp, Homo sapiens
ccctcccaggagtggccagaga

SEQ ID NO: 7054259 - DNA, 22 bp, Homo sapiens
ccctcccaggagtggccagaga

SEQ ID NO: 7054260 - DNA, 22 bp, Homo sapiens
ccctcccaggagtggccagaga

SEQ ID NO: 7054261 - DNA, 22 bp, Homo sapiens
ccctctctcggttgctgtggtt

SEQ ID NO: 7054262 - DNA, 22 bp, Homo sapiens
ccctctctctatcgggccccag

SEQ ID NO: 7054263 - DNA, 22 bp, Homo sapiens
ccctctctgacttctgaacttg

SEQ ID NO: 7054264 - DNA, 22 bp, Homo sapiens
ccctctcttagaagaaacacag

SEQ ID NO: 7054265 - DNA, 22 bp, Homo sapiens
ccctctgcctgcgccctggtgt

SEQ ID NO: 7054266 - DNA, 17 bp, Homo sapiens
ccctctggggagggagg

SEQ ID NO: 7054267 - DNA, 22 bp, Homo sapiens
ccctctggtttgcccttgggtg

SEQ ID NO: 7054268 - DNA, 18 bp, Homo sapiens
agggctctctgctgggtt

SEQ ID NO: 7054269 - DNA, 22 bp, Homo sapiens
agggctctggggtggcagagat

SEQ ID NO: 7054270 - DNA, 22 bp, Homo sapiens
agggctctgtccccagaggccc

SEQ ID NO: 7054271 - DNA, 22 bp, Homo sapiens
agggctctgtccccagaggccc

SEQ ID NO: 7054272 - DNA, 22 bp, Homo sapiens
agggctctgtgactatcactgc

SEQ ID NO: 7054273 - DNA, 22 bp, Homo sapiens
agggctctgttggggtcagcac

SEQ ID NO: 7054274 - DNA, 22 bp, Homo sapiens
agggctcagttgcctggagccc

SEQ ID NO: 7054275 - DNA, 22 bp, Homo sapiens
agggctcataattcctgacttc

SEQ ID NO: 7054276 - DNA, 22 bp, Homo sapiens
agggctcataattcctgacttc

SEQ ID NO: 7054277 - DNA, 22 bp, Homo sapiens
agggctccaaggaagtgtagct

SEQ ID NO: 7054278 - DNA, 23 bp, Homo sapiens
agggcctcaggagggctgcatgg

SEQ ID NO: 7054279 - DNA, 22 bp, Homo sapiens
agggcccttacgcaggcccttc

SEQ ID NO: 7054280 - DNA, 22 bp, Homo sapiens
agggccctggggtgcactgaca

SEQ ID NO: 7054281 - DNA, 22 bp, Homo sapiens
agggcccttacgcaggcccttc

SEQ ID NO: 7054282 - DNA, 22 bp, Homo sapiens
agggccctctggcaggccaggc

SEQ ID NO: 7054283 - DNA, 22 bp, Homo sapiens
agggccctccccgctcagggca

SEQ ID NO: 7054284 - DNA, 22 bp, Homo sapiens
ccctggaggctggaggcagtag

SEQ ID NO: 7054285 - DNA, 22 bp, Homo sapiens
ccctggaggcggagcttgcagt

SEQ ID NO: 7054286 - DNA, 22 bp, Homo sapiens
agggccagaatccctcagtcta

SEQ ID NO: 7054287 - DNA, 22 bp, Homo sapiens
agggccagagtctgtgtagata

SEQ ID NO: 7054288 - DNA, 22 bp, Homo sapiens
agggccagagtacatcagggct

SEQ ID NO: 7054289 - DNA, 22 bp, Homo sapiens
agggccagagtacatcagggct

SEQ ID NO: 7054290 - DNA, 22 bp, Homo sapiens
ccctttggcatttccaggatat

SEQ ID NO: 7054291 - DNA, 22 bp, Homo sapiens
ccctttggaagaggctcactga

SEQ ID NO: 7054292 - DNA, 22 bp, Homo sapiens
ccctttgggttccccaagcctg

SEQ ID NO: 7054293 - DNA, 22 bp, Homo sapiens
ccgaggctggagtgcagtggcg

SEQ ID NO: 7054294 - DNA, 22 bp, Homo sapiens
ccgaggtcctggacttggccct

SEQ ID NO: 7054295 - DNA, 22 bp, Homo sapiens
ccgaggtcctggacttggccct

SEQ ID NO: 7054296 - DNA, 22 bp, Homo sapiens
agggccctaaggaaggcacaca

SEQ ID NO: 7054297 - DNA, 22 bp, Homo sapiens
agggccctaaggaaggcacaca

SEQ ID NO: 7054298 - DNA, 22 bp, Homo sapiens
cctctgggcggagatctgctgc

SEQ ID NO: 7054299 - DNA, 16 bp, Homo sapiens
cctctgggcctgcaag

SEQ ID NO: 7054300 - DNA, 22 bp, Homo sapiens
cctctgggcaggtagcagcagc

SEQ ID NO: 7054301 - DNA, 22 bp, Homo sapiens
agggctgcaggcaagatatggc

SEQ ID NO: 7054302 - DNA, 22 bp, Homo sapiens
cctctggcttactgttgggttt

SEQ ID NO: 7054303 - DNA, 21 bp, Homo sapiens
cctctggcttgtgctgtgccc

SEQ ID NO: 7054304 - DNA, 22 bp, Homo sapiens
agggctgagtggtgcagtcaaa

SEQ ID NO: 7054305 - DNA, 22 bp, Homo sapiens
agggctgagtggtgcagtcaaa

SEQ ID NO: 7054306 - DNA, 18 bp, Homo sapiens
agggctgatgagtttggg

SEQ ID NO: 7054307 - DNA, 22 bp, Homo sapiens
agggctgatgcaccatgtagcc

SEQ ID NO: 7054308 - DNA, 22 bp, Homo sapiens
agggctgatgcaccatgtagcc

SEQ ID NO: 7054309 - DNA, 23 bp, Homo sapiens
agggctgatgccattgcagctct

SEQ ID NO: 7054310 - DNA, 23 bp, Homo sapiens
agggctgatgccattgcagctct

SEQ ID NO: 7054311 - DNA, 23 bp, Homo sapiens
agggctgatgccattgcagctct

SEQ ID NO: 7054312 - DNA, 22 bp, Homo sapiens
cctcctggaggctctaagggag

SEQ ID NO: 7054313 - DNA, 22 bp, Homo sapiens
cctcctgcacttgctttccttc

SEQ ID NO: 7054314 - DNA, 21 bp, Homo sapiens
cctcctgcccgcaagctaggg

SEQ ID NO: 7054315 - DNA, 22 bp, Homo sapiens
aggggctggcttatctgagagt

SEQ ID NO: 7054316 - DNA, 22 bp, Homo sapiens
aggggctggagttcgaggttac

SEQ ID NO: 7054317 - DNA, 22 bp, Homo sapiens
cctgaggcccctgaggatagca

SEQ ID NO: 7054318 - DNA, 22 bp, Homo sapiens
cctgaggcaaggacttggtggc

SEQ ID NO: 7054319 - DNA, 22 bp, Homo sapiens
cctgaggagattgtggctgggg

SEQ ID NO: 7054320 - DNA, 22 bp, Homo sapiens
cctgaggagattgtggctgggg

SEQ ID NO: 7054321 - DNA, 22 bp, Homo sapiens
cctgaggattgttggtgcttcc

SEQ ID NO: 7054322 - DNA, 17 bp, Homo sapiens
aggggagagtgggaaga

SEQ ID NO: 7054323 - DNA, 22 bp, Homo sapiens
cctgagagtggtgtacaggaga

SEQ ID NO: 7054324 - DNA, 22 bp, Homo sapiens
cctgagctttaaaagccatgta

SEQ ID NO: 7054325 - DNA, 22 bp, Homo sapiens
cctgaggacacacgctgcagga

SEQ ID NO: 7054326 - DNA, 22 bp, Homo sapiens
cctgaggaccagcacccatctg

SEQ ID NO: 7054327 - DNA, 21 bp, Homo sapiens
aggggacagagtagctccagg

SEQ ID NO: 7054328 - DNA, 22 bp, Homo sapiens
ccagcagagggcgcttcacacc

SEQ ID NO: 7054329 - DNA, 22 bp, Homo sapiens
ccagcagagctggaagtgtgct

SEQ ID NO: 7054330 - DNA, 22 bp, Homo sapiens
ccagcagagctcaaacttcctg

SEQ ID NO: 7054331 - DNA, 22 bp, Homo sapiens
ccagcagagcatggggaggaag

SEQ ID NO: 7054332 - DNA, 19 bp, Homo sapiens
ccagcagaagccactcctg

SEQ ID NO: 7054333 - DNA, 22 bp, Homo sapiens
ccagcagacacacaggcgtggg

SEQ ID NO: 7054334 - DNA, 22 bp, Homo sapiens
ccagcagacacacaggcgtggg

SEQ ID NO: 7054335 - DNA, 22 bp, Homo sapiens
aggcatggacatttcggcagct

SEQ ID NO: 7054336 - DNA, 22 bp, Homo sapiens
aggcatggatgtagcagtgacc

SEQ ID NO: 7054337 - DNA, 22 bp, Homo sapiens
aggcatggatgtagcagtgacc

SEQ ID NO: 7054338 - DNA, 23 bp, Homo sapiens
aggcatggcatggatggtggctc

SEQ ID NO: 7054339 - DNA, 20 bp, Homo sapiens
ccagagagtaggttagtgat

SEQ ID NO: 7054340 - DNA, 17 bp, Homo sapiens
ccagagagtagttagga

SEQ ID NO: 7054341 - DNA, 22 bp, Homo sapiens
ccagagaggggaagggcttgcc

SEQ ID NO: 7054342 - DNA, 17 bp, Homo sapiens
ccagagagtagttagga

SEQ ID NO: 7054343 - DNA, 22 bp, Homo sapiens
ccagagagtatcatggagagta

SEQ ID NO: 7054344 - DNA, 22 bp, Homo sapiens
ccagagagtcgatgggggacac

SEQ ID NO: 7054345 - DNA, 22 bp, Homo sapiens
aggcagggtgatgataatgatt

SEQ ID NO: 7054346 - DNA, 22 bp, Homo sapiens
aggcagggtgatgataatgatt

SEQ ID NO: 7054347 - DNA, 22 bp, Homo sapiens
aggcagggtgatgataatgatt

SEQ ID NO: 7054348 - DNA, 22 bp, Homo sapiens
aggcagggtcttgctatgttgc

SEQ ID NO: 7054349 - DNA, 22 bp, Homo sapiens
aggcagggtcttgctatgttgc

SEQ ID NO: 7054350 - DNA, 22 bp, Homo sapiens
aggcaggggagctggaagggta

SEQ ID NO: 7054351 - DNA, 22 bp, Homo sapiens
aggcaggggagctggaagggta

SEQ ID NO: 7054352 - DNA, 22 bp, Homo sapiens
ccaggagcgggaaaaggaagaa

SEQ ID NO: 7054353 - DNA, 17 bp, Homo sapiens
ccaggagcgtgggtctc

SEQ ID NO: 7054354 - DNA, 22 bp, Homo sapiens
ccaggagagcaggcgtgcagct

SEQ ID NO: 7054355 - DNA, 22 bp, Homo sapiens
ccaggagagcagaagcccaggc

SEQ ID NO: 7054356 - DNA, 22 bp, Homo sapiens
aggccctggcccccagagattc

SEQ ID NO: 7054357 - DNA, 22 bp, Homo sapiens
aggccctgggcagttctgtagc

SEQ ID NO: 7054358 - DNA, 22 bp, Homo sapiens
aggcccagcccgtcctcgtgct

SEQ ID NO: 7054359 - DNA, 22 bp, Homo sapiens
ccagcctggactgggtcttgtg

SEQ ID NO: 7054360 - DNA, 22 bp, Homo sapiens
ccagcttgaagatgtgctggtt

SEQ ID NO: 7054361 - DNA, 22 bp, Homo sapiens
ccagcttgtttgaagctcgtca

SEQ ID NO: 7054362 - DNA, 22 bp, Homo sapiens
ccagcctccatgtagatagctg

SEQ ID NO: 7054363 - DNA, 22 bp, Homo sapiens
ccagcctgaaatgcctcatcct

SEQ ID NO: 7054364 - DNA, 22 bp, Homo sapiens
ccagcctcatcgcctgcctgtc

SEQ ID NO: 7054365 - DNA, 22 bp, Homo sapiens
ccatgggcactgggtggaggta

SEQ ID NO: 7054366 - DNA, 22 bp, Homo sapiens
ccatgggcactgggtggaggta

SEQ ID NO: 7054367 - DNA, 22 bp, Homo sapiens
ccatgggacctacctcctgtgc

SEQ ID NO: 7054368 - DNA, 22 bp, Homo sapiens
ccatgggagatgatggggagtg

SEQ ID NO: 7054369 - DNA, 22 bp, Homo sapiens
aggctgcgttagcctcactccc

SEQ ID NO: 7054370 - DNA, 21 bp, Homo sapiens
cccagagcctagggagggcac

SEQ ID NO: 7054371 - DNA, 22 bp, Homo sapiens
aggctggcgtcaggggctgtac

SEQ ID NO: 7054372 - DNA, 17 bp, Homo sapiens
aggctggctcacaggga

SEQ ID NO: 7054373 - DNA, 22 bp, Homo sapiens
aggctggctcggcttttctgtc

SEQ ID NO: 7054374 - DNA, 22 bp, Homo sapiens
aggctgagtcaagttagggtga

SEQ ID NO: 7054375 - DNA, 22 bp, Homo sapiens
aggctgagtcaagttagggtga

SEQ ID NO: 7054376 - DNA, 22 bp, Homo sapiens
aggctgaggtgtgctgtgatcg

SEQ ID NO: 7054377 - DNA, 22 bp, Homo sapiens
aggctgagtcaagttagggtga

SEQ ID NO: 7054378 - DNA, 22 bp, Homo sapiens
aggctgagtcgggaggatcact

SEQ ID NO: 7054379 - DNA, 22 bp, Homo sapiens
aggctgagtcgggaggatcact

SEQ ID NO: 7054380 - DNA, 22 bp, Homo sapiens
aggctgaggtgtgctgtgatcg

SEQ ID NO: 7054381 - DNA, 22 bp, Homo sapiens
aggctgaggtgtgctgtgatcg

SEQ ID NO: 7054382 - DNA, 22 bp, Homo sapiens
aggctgaggtgtgctgtgatcg

SEQ ID NO: 7054383 - DNA, 22 bp, Homo sapiens
aggctgaggtaggaggatcgct

SEQ ID NO: 7054384 - DNA, 22 bp, Homo sapiens
aggctgaggtaggaggatcgct

SEQ ID NO: 7054385 - DNA, 22 bp, Homo sapiens
aggctgagtcgggaggatcact

SEQ ID NO: 7054386 - DNA, 22 bp, Homo sapiens
aggctgagtcgggaggatcact

SEQ ID NO: 7054387 - DNA, 22 bp, Homo sapiens
aggctgagtcgggaggatcact

SEQ ID NO: 7054388 - DNA, 22 bp, Homo sapiens
ccatggcttacagatggagcat

SEQ ID NO: 7054389 - DNA, 22 bp, Homo sapiens
ccatggcttctttctctgccag

SEQ ID NO: 7054390 - DNA, 22 bp, Homo sapiens
ccatggcttttgagtctcaaga

SEQ ID NO: 7054391 - DNA, 22 bp, Homo sapiens
ccatggcttttgagtctcaaga

SEQ ID NO: 7054392 - DNA, 22 bp, Homo sapiens
aggctgaggtaggaggatcgct

SEQ ID NO: 7054393 - DNA, 22 bp, Homo sapiens
aggctgaggtaggaggatcgct

SEQ ID NO: 7054394 - DNA, 22 bp, Homo sapiens
aggctgaggtaggaggatcgct

SEQ ID NO: 7054395 - DNA, 20 bp, Homo sapiens
aggctgagggtgattgtgtc

SEQ ID NO: 7054396 - DNA, 20 bp, Homo sapiens
aggctgagggtgattgtgtc

SEQ ID NO: 7054397 - DNA, 20 bp, Homo sapiens
aggctgagggtgattgtgtc

SEQ ID NO: 7054398 - DNA, 22 bp, Homo sapiens
aggctgaggggcgagggaccct

SEQ ID NO: 7054399 - DNA, 22 bp, Homo sapiens
aggctctgttattctagagggc

SEQ ID NO: 7054400 - DNA, 22 bp, Homo sapiens
aggctgaggcgggtagatcacc

SEQ ID NO: 7054401 - DNA, 22 bp, Homo sapiens
aggctgaggcgggtagatcacc

SEQ ID NO: 7054402 - DNA, 22 bp, Homo sapiens
aggctgaggggcgagggaccct

SEQ ID NO: 7054403 - DNA, 22 bp, Homo sapiens
aggctgaggggcgagggaccct

SEQ ID NO: 7054404 - DNA, 22 bp, Homo sapiens
aggctctgtgatgtgccaggca

SEQ ID NO: 7054405 - DNA, 22 bp, Homo sapiens
ccagggtggaggctggatggag

SEQ ID NO: 7054406 - DNA, 22 bp, Homo sapiens
aggctctgtgacaatcaagctg

SEQ ID NO: 7054407 - DNA, 22 bp, Homo sapiens
aggctcattcttgcctctgagc

SEQ ID NO: 7054408 - DNA, 22 bp, Homo sapiens
aggctccaaattaccaagctct

SEQ ID NO: 7054409 - DNA, 22 bp, Homo sapiens
aggctccaccagtcaggtgcat

SEQ ID NO: 7054410 - DNA, 22 bp, Homo sapiens
aggctccaccctacagagctcc

SEQ ID NO: 7054411 - DNA, 22 bp, Homo sapiens
ccaggctgtaaacaccttcaaa

SEQ ID NO: 7054412 - DNA, 22 bp, Homo sapiens
aggctcagcctgggcctagagc

SEQ ID NO: 7054413 - DNA, 22 bp, Homo sapiens
ccaggaggaaattctaaaggta

SEQ ID NO: 7054414 - DNA, 17 bp, Homo sapiens
aggctcctcctaaggtc

SEQ ID NO: 7054415 - DNA, 17 bp, Homo sapiens
ccagggaggggccgcgc

SEQ ID NO: 7054416 - DNA, 22 bp, Homo sapiens
ccagggagcctggtgtgtcagc

SEQ ID NO: 7054417 - DNA, 22 bp, Homo sapiens
ccagggcttcagaggttttggc

SEQ ID NO: 7054418 - DNA, 22 bp, Homo sapiens
ccagggcttaacttttcaggag

SEQ ID NO: 7054419 - DNA, 22 bp, Homo sapiens
ccagggtcttggagaggagtgc

SEQ ID NO: 7054420 - DNA, 22 bp, Homo sapiens
ccagggtgagaaaaggctggat

SEQ ID NO: 7054421 - DNA, 22 bp, Homo sapiens
cagtggccatggtggcaggggt

SEQ ID NO: 7054422 - DNA, 22 bp, Homo sapiens
cagtggagaggcatgcttggca

SEQ ID NO: 7054423 - DNA, 22 bp, Homo sapiens
cagtggagaggcatgcttggca

SEQ ID NO: 7054424 - DNA, 18 bp, Homo sapiens
cagtggcatagttgagta

SEQ ID NO: 7054425 - DNA, 22 bp, Homo sapiens
aggagaaggaagtgcatcacta

SEQ ID NO: 7054426 - DNA, 22 bp, Homo sapiens
aggagaaggaggcccctcacac

SEQ ID NO: 7054427 - DNA, 22 bp, Homo sapiens
aggagaagtaaggctagatgat

SEQ ID NO: 7054428 - DNA, 22 bp, Homo sapiens
aggagaagtaaggctagatgat

SEQ ID NO: 7054429 - DNA, 22 bp, Homo sapiens
aggagaagtaaggctagatgat

SEQ ID NO: 7054430 - DNA, 19 bp, Homo sapiens
aggagaagtagcagaaatt

SEQ ID NO: 7054431 - DNA, 22 bp, Homo sapiens
cagtgcaggtggcagaggacag

SEQ ID NO: 7054432 - DNA, 22 bp, Homo sapiens
cagtgcccttccaggactgcag

SEQ ID NO: 7054433 - DNA, 22 bp, Homo sapiens
aggactgacttttgccatgaaa

SEQ ID NO: 7054434 - DNA, 22 bp, Homo sapiens
cagtgcaggtggcagaggacag

SEQ ID NO: 7054435 - DNA, 22 bp, Homo sapiens
aggagaaggaagtgcatcacta

SEQ ID NO: 7054436 - DNA, 22 bp, Homo sapiens
aggaccagtgagtctggcaagt

SEQ ID NO: 7054437 - DNA, 22 bp, Homo sapiens
aggaccagaggccagagtcagc

SEQ ID NO: 7054438 - DNA, 22 bp, Homo sapiens
aggaccagaccgaactagctaa

SEQ ID NO: 7054439 - DNA, 22 bp, Homo sapiens
aggacccacgcacaggaacccc

SEQ ID NO: 7054440 - DNA, 22 bp, Homo sapiens
aggacccacgcacaggaacccc

SEQ ID NO: 7054441 - DNA, 22 bp, Homo sapiens
aggaccttggaataacaaattc

SEQ ID NO: 7054442 - DNA, 22 bp, Homo sapiens
caggtgggagcgaggagctact

SEQ ID NO: 7054443 - DNA, 22 bp, Homo sapiens
aggacaggattgagctgaactg

SEQ ID NO: 7054444 - DNA, 22 bp, Homo sapiens
caggtgggaccatgatagggca

SEQ ID NO: 7054445 - DNA, 22 bp, Homo sapiens
caggtggcttctctgcagcctt

SEQ ID NO: 7054446 - DNA, 22 bp, Homo sapiens
caggtggcttctccctaggcca

SEQ ID NO: 7054447 - DNA, 22 bp, Homo sapiens
caggtggcttctccctaggcca

SEQ ID NO: 7054448 - DNA, 22 bp, Homo sapiens
caggtgccatagacgggcctgg

SEQ ID NO: 7054449 - DNA, 22 bp, Homo sapiens
cagttttatacactgcagctcc

SEQ ID NO: 7054450 - DNA, 22 bp, Homo sapiens
cagttttagggcaatgtgaaga

SEQ ID NO: 7054451 - DNA, 22 bp, Homo sapiens
cagttttagctagagcaaacca

SEQ ID NO: 7054452 - DNA, 22 bp, Homo sapiens
cagttttaggacatgtggatgt

SEQ ID NO: 7054453 - DNA, 22 bp, Homo sapiens
cagttttacccaagcttatttt

SEQ ID NO: 7054454 - DNA, 22 bp, Homo sapiens
cagttttagctagagcaaacca

SEQ ID NO: 7054455 - DNA, 16 bp, Homo sapiens
cagttttaaggcccaa

SEQ ID NO: 7054456 - DNA, 22 bp, Homo sapiens
cagttttaaattttgaatgtct

SEQ ID NO: 7054457 - DNA, 22 bp, Homo sapiens
cagtttctatggctgggctctg

SEQ ID NO: 7054458 - DNA, 22 bp, Homo sapiens
cagtttcctgaagagaaagaat

SEQ ID NO: 7054459 - DNA, 22 bp, Homo sapiens
cagtttccttgtttacctactg

SEQ ID NO: 7054460 - DNA, 22 bp, Homo sapiens
cagtttctacgaaggtcaaccc

SEQ ID NO: 7054461 - DNA, 22 bp, Homo sapiens
cagtttatttccaagatgacaa

SEQ ID NO: 7054462 - DNA, 22 bp, Homo sapiens
cagtggtggaatgaggaattgt

SEQ ID NO: 7054463 - DNA, 22 bp, Homo sapiens
cagtggttatacttactgtttc

SEQ ID NO: 7054464 - DNA, 18 bp, Homo sapiens
cagtggtgctgggatgtg

SEQ ID NO: 7054465 - DNA, 22 bp, Homo sapiens
cagtggtgaagagcaggggctc

SEQ ID NO: 7054466 - DNA, 22 bp, Homo sapiens
cagttctggaggatagaagtct

SEQ ID NO: 7054467 - DNA, 22 bp, Homo sapiens
cagtttatattctagtgctgtt

SEQ ID NO: 7054468 - DNA, 20 bp, Homo sapiens
cagtttatctttccggagct

SEQ ID NO: 7054469 - DNA, 22 bp, Homo sapiens
cagtggtatttgagagaatgga

SEQ ID NO: 7054470 - DNA, 22 bp, Homo sapiens
cagtggcgtgatctctgctcac

SEQ ID NO: 7054471 - DNA, 22 bp, Homo sapiens
catataaatacaacatgtgtta

SEQ ID NO: 7054472 - DNA, 22 bp, Homo sapiens
catataaatacaacatgtgtta

SEQ ID NO: 7054473 - DNA, 22 bp, Homo sapiens
cagttttatgtcgaatgtatac

SEQ ID NO: 7054474 - DNA, 22 bp, Homo sapiens
catacattacctaacttaatgc

SEQ ID NO: 7054475 - DNA, 22 bp, Homo sapiens
cagttttatgaatgcttattag

SEQ ID NO: 7054476 - DNA, 22 bp, Homo sapiens
cagttttatcatctgtgaaatg

SEQ ID NO: 7054477 - DNA, 22 bp, Homo sapiens
catagagtgatgtaaggtatgt

SEQ ID NO: 7054478 - DNA, 22 bp, Homo sapiens
catagagtgatgtaaggtatgt

SEQ ID NO: 7054479 - DNA, 22 bp, Homo sapiens
catagcaacagcatcaagtcaa

SEQ ID NO: 7054480 - DNA, 22 bp, Homo sapiens
catagcaagatcacattctgta

SEQ ID NO: 7054481 - DNA, 22 bp, Homo sapiens
catattaaggtctgtaaggggt

SEQ ID NO: 7054482 - DNA, 22 bp, Homo sapiens
catattagacacttatgtccac

SEQ ID NO: 7054483 - DNA, 22 bp, Homo sapiens
catattagcctccactgggaca

SEQ ID NO: 7054484 - DNA, 22 bp, Homo sapiens
catatttagtgtttggagatcg

SEQ ID NO: 7054485 - DNA, 22 bp, Homo sapiens
catatttatagatctggcattt

SEQ ID NO: 7054486 - DNA, 22 bp, Homo sapiens
catattttagttgctgaacagc

SEQ ID NO: 7054487 - DNA, 22 bp, Homo sapiens
catatttattcttctgccagtg

SEQ ID NO: 7054488 - DNA, 22 bp, Homo sapiens
catatttcagtctaagatgtgt

SEQ ID NO: 7054489 - DNA, 22 bp, Homo sapiens
aggagggagcttaagccaggca

SEQ ID NO: 7054490 - DNA, 22 bp, Homo sapiens
aggagggagcttaagccaggca

SEQ ID NO: 7054491 - DNA, 22 bp, Homo sapiens
aggagggagcttaagccaggca

SEQ ID NO: 7054492 - DNA, 22 bp, Homo sapiens
aggagggatagaaaaatacttg

SEQ ID NO: 7054493 - DNA, 21 bp, Homo sapiens
aggagggcacaaggccaggaa

SEQ ID NO: 7054494 - DNA, 21 bp, Homo sapiens
aggagggcacaaggccaggaa

SEQ ID NO: 7054495 - DNA, 22 bp, Homo sapiens
aggagggcaggctggctgccta

SEQ ID NO: 7054496 - DNA, 22 bp, Homo sapiens
aggagggcaggctggctgccta

SEQ ID NO: 7054497 - DNA, 22 bp, Homo sapiens
aggagggcaggctggctgccta

SEQ ID NO: 7054498 - DNA, 22 bp, Homo sapiens
aggagggctaggaaaaccagga

SEQ ID NO: 7054499 - DNA, 22 bp, Homo sapiens
aggagggctaggaaaaccagga

SEQ ID NO: 7054500 - DNA, 22 bp, Homo sapiens
aggaggggcaatgatagtctgg

SEQ ID NO: 7054501 - DNA, 22 bp, Homo sapiens
aggaggggcaatgatagtctgg

SEQ ID NO: 7054502 - DNA, 22 bp, Homo sapiens
catggcactgagcaggtatgca

SEQ ID NO: 7054503 - DNA, 22 bp, Homo sapiens
catggcagaaacctgagctgct

SEQ ID NO: 7054504 - DNA, 22 bp, Homo sapiens
catggcagaaacctgagctgct

SEQ ID NO: 7054505 - DNA, 22 bp, Homo sapiens
aggatgtgttcatagctgacgc

SEQ ID NO: 7054506 - DNA, 22 bp, Homo sapiens
aggatgtgttttgagctgacta

SEQ ID NO: 7054507 - DNA, 22 bp, Homo sapiens
aggattcatggtgcagacaaag

SEQ ID NO: 7054508 - DNA, 22 bp, Homo sapiens
aggattctgtaatctgtgaaat

SEQ ID NO: 7054509 - DNA, 22 bp, Homo sapiens
catggaggaccctcagggagct

SEQ ID NO: 7054510 - DNA, 22 bp, Homo sapiens
aggcactggtctaccccttagt

SEQ ID NO: 7054511 - DNA, 22 bp, Homo sapiens
catgtatagttggaactacatc

SEQ ID NO: 7054512 - DNA, 22 bp, Homo sapiens
catgggggctgaggctgctgta

SEQ ID NO: 7054513 - DNA, 22 bp, Homo sapiens
catgggggtctggacaacaggc

SEQ ID NO: 7054514 - DNA, 22 bp, Homo sapiens
catgggggtctggacaacaggc

SEQ ID NO: 7054515 - DNA, 22 bp, Homo sapiens
catgggctgctgacaggggctc

SEQ ID NO: 7054516 - DNA, 22 bp, Homo sapiens
catggggagacacctagggaaa

SEQ ID NO: 7054517 - DNA, 21 bp, Homo sapiens
aggatttctgtcatttcagat

SEQ ID NO: 7054518 - DNA, 22 bp, Homo sapiens
catggctgaaattcttcgcttg

SEQ ID NO: 7054519 - DNA, 22 bp, Homo sapiens
ccaagtgatacacccgcctcgg

SEQ ID NO: 7054520 - DNA, 22 bp, Homo sapiens
ccaatacttagattaaaatagt

SEQ ID NO: 7054521 - DNA, 22 bp, Homo sapiens
ccaagcatggggttcagtagga

SEQ ID NO: 7054522 - DNA, 22 bp, Homo sapiens
ccaagcatttctagccagtcac

SEQ ID NO: 7054523 - DNA, 22 bp, Homo sapiens
ccaagctacttaggagtctgag

SEQ ID NO: 7054524 - DNA, 23 bp, Homo sapiens
aggcagcaggttgtccagggtga

SEQ ID NO: 7054525 - DNA, 22 bp, Homo sapiens
aggcagcagtcatgaggaaaga

SEQ ID NO: 7054526 - DNA, 19 bp, Homo sapiens
aggcagcaggccagggatg

SEQ ID NO: 7054527 - DNA, 19 bp, Homo sapiens
aggcagcaggccagggatg

SEQ ID NO: 7054528 - DNA, 22 bp, Homo sapiens
catttgtttagaagtctttata

SEQ ID NO: 7054529 - DNA, 22 bp, Homo sapiens
catttgttggtcagattgtagt

SEQ ID NO: 7054530 - DNA, 17 bp, Homo sapiens
catttgttgatcagttg

SEQ ID NO: 7054531 - DNA, 22 bp, Homo sapiens
catttgaaattcttagaacaaa

SEQ ID NO: 7054532 - DNA, 22 bp, Homo sapiens
catttgttaaccagtgtggatt

SEQ ID NO: 7054533 - DNA, 22 bp, Homo sapiens
catttgttaattactattatct

SEQ ID NO: 7054534 - DNA, 20 bp, Homo sapiens
catttgttagctttctactg

SEQ ID NO: 7054535 - DNA, 22 bp, Homo sapiens
aggcactgtgggtgtggccgga

SEQ ID NO: 7054536 - DNA, 22 bp, Homo sapiens
cattaaacaaccttgaatcaat

SEQ ID NO: 7054537 - DNA, 22 bp, Homo sapiens
aggcactgtactaggtacaggg

SEQ ID NO: 7054538 - DNA, 22 bp, Homo sapiens
aggcactgtgcagtcccaagca

SEQ ID NO: 7054539 - DNA, 22 bp, Homo sapiens
aggcactgtgctgatgtcttat

SEQ ID NO: 7054540 - DNA, 22 bp, Homo sapiens
aggcactgtgctgatgtcttat

SEQ ID NO: 7054541 - DNA, 22 bp, Homo sapiens
aggcactgtgcttcttatatgt

SEQ ID NO: 7054542 - DNA, 22 bp, Homo sapiens
aggcactgtggaagacatggtt

SEQ ID NO: 7054543 - DNA, 15 bp, Homo sapiens
aggcactgtgggacc

SEQ ID NO: 7054544 - DNA, 22 bp, Homo sapiens
agctgcaacatctgcttgtccc

SEQ ID NO: 7054545 - DNA, 23 bp, Homo sapiens
agctgcaagactccctgtctgag

SEQ ID NO: 7054546 - DNA, 22 bp, Homo sapiens
agctgattccactttttcccca

SEQ ID NO: 7054547 - DNA, 22 bp, Homo sapiens
agctgattccactttttcccca

SEQ ID NO: 7054548 - DNA, 22 bp, Homo sapiens
cagctgagaccagaatgcaggt

SEQ ID NO: 7054549 - DNA, 22 bp, Homo sapiens
cagctgagagacaatgagtcat

SEQ ID NO: 7054550 - DNA, 23 bp, Homo sapiens
agctgaggctgtgggtgtcagag

SEQ ID NO: 7054551 - DNA, 23 bp, Homo sapiens
agctgaggctgtgggtgtcagag

SEQ ID NO: 7054552 - DNA, 22 bp, Homo sapiens
cagctgagaaaggcaggctcac

SEQ ID NO: 7054553 - DNA, 22 bp, Homo sapiens
cagctgagaaaggcaggctcac

SEQ ID NO: 7054554 - DNA, 22 bp, Homo sapiens
cagctgagaaatggggaaaggg

SEQ ID NO: 7054555 - DNA, 22 bp, Homo sapiens
cagctgagaaggtctgatcagg

SEQ ID NO: 7054556 - DNA, 22 bp, Homo sapiens
cagctgagaagtgatagctgca

SEQ ID NO: 7054557 - DNA, 22 bp, Homo sapiens
cagctgagaagtgatagctgca

SEQ ID NO: 7054558 - DNA, 22 bp, Homo sapiens
cagctgagaccagaatgcaggt

SEQ ID NO: 7054559 - DNA, 22 bp, Homo sapiens
cagctgaattcttcagactcca

SEQ ID NO: 7054560 - DNA, 22 bp, Homo sapiens
cagctctgtaaattccttcatc

SEQ ID NO: 7054561 - DNA, 22 bp, Homo sapiens
caggaagagaacatggaggctg

SEQ ID NO: 7054562 - DNA, 22 bp, Homo sapiens
agctgcagcactccagtagccg

SEQ ID NO: 7054563 - DNA, 22 bp, Homo sapiens
agctgcagaggtttgtgcaaca

SEQ ID NO: 7054564 - DNA, 22 bp, Homo sapiens
agctgcagtcaagctgggccac

SEQ ID NO: 7054565 - DNA, 22 bp, Homo sapiens
caggaaggcgcggctgtgcctg

SEQ ID NO: 7054566 - DNA, 22 bp, Homo sapiens
caggaaggcgcggctgtgcctg

SEQ ID NO: 7054567 - DNA, 22 bp, Homo sapiens
caggaaggggctcactctggcc

SEQ ID NO: 7054568 - DNA, 22 bp, Homo sapiens
agctgggctgggctgagctgag

SEQ ID NO: 7054569 - DNA, 22 bp, Homo sapiens
caggccaggctgcatttgcccc

SEQ ID NO: 7054570 - DNA, 19 bp, Homo sapiens
agctgggctgtcacagtga

SEQ ID NO: 7054571 - DNA, 22 bp, Homo sapiens
agctgggcttggccaggtcgct

SEQ ID NO: 7054572 - DNA, 22 bp, Homo sapiens
caggccagcagggcctccgtgg

SEQ ID NO: 7054573 - DNA, 22 bp, Homo sapiens
agctggcctccgggtgcctggg

SEQ ID NO: 7054574 - DNA, 20 bp, Homo sapiens
caggcagtttgtggttaggg

SEQ ID NO: 7054575 - DNA, 18 bp, Homo sapiens
agctggccctggctgccg

SEQ ID NO: 7054576 - DNA, 22 bp, Homo sapiens
caggcactgtgttaggcactgt

SEQ ID NO: 7054577 - DNA, 22 bp, Homo sapiens
caggcacttctgctgcttgtct

SEQ ID NO: 7054578 - DNA, 22 bp, Homo sapiens
caggcactttgctgggggcgca

SEQ ID NO: 7054579 - DNA, 22 bp, Homo sapiens
caggaggagcattagcgtctca

SEQ ID NO: 7054580 - DNA, 22 bp, Homo sapiens
caggaggagcattagcgtctca

SEQ ID NO: 7054581 - DNA, 22 bp, Homo sapiens
caggaggacatactggctcaca

SEQ ID NO: 7054582 - DNA, 22 bp, Homo sapiens
caggaggacatactggctcaca

SEQ ID NO: 7054583 - DNA, 22 bp, Homo sapiens
caggaggattgcttgaggccag

SEQ ID NO: 7054584 - DNA, 22 bp, Homo sapiens
caggaggattgcttgaggccag

SEQ ID NO: 7054585 - DNA, 22 bp, Homo sapiens
caggaggattgcttgaggccag

SEQ ID NO: 7054586 - DNA, 22 bp, Homo sapiens
caggaggagctggccgcctcat

SEQ ID NO: 7054587 - DNA, 22 bp, Homo sapiens
caggaggagggtacaccatcag

SEQ ID NO: 7054588 - DNA, 22 bp, Homo sapiens
caggaggagggtacaccatcag

SEQ ID NO: 7054589 - DNA, 22 bp, Homo sapiens
agctgctgcggaaagatgccac

SEQ ID NO: 7054590 - DNA, 22 bp, Homo sapiens
caggcactcattcagagaggtg

SEQ ID NO: 7054591 - DNA, 22 bp, Homo sapiens
caggcactgcactaccactttt

SEQ ID NO: 7054592 - DNA, 22 bp, Homo sapiens
caggcactggggatgctgggat

SEQ ID NO: 7054593 - DNA, 22 bp, Homo sapiens
caggcactgtgctagatccttg

SEQ ID NO: 7054594 - DNA, 22 bp, Homo sapiens
cagggccaggctgatggcctgg

SEQ ID NO: 7054595 - DNA, 22 bp, Homo sapiens
cagggatgtctctggaagggag

SEQ ID NO: 7054596 - DNA, 22 bp, Homo sapiens
cagggatgtctctggaagggag

SEQ ID NO: 7054597 - DNA, 22 bp, Homo sapiens
cagggatgtgatgagctgagcc

SEQ ID NO: 7054598 - DNA, 22 bp, Homo sapiens
cagggcctctgtgggctctctc

SEQ ID NO: 7054599 - DNA, 22 bp, Homo sapiens
cagggcctgagggctgctctgc

SEQ ID NO: 7054600 - DNA, 22 bp, Homo sapiens
cagggcttgatctgcatcctgc

SEQ ID NO: 7054601 - DNA, 22 bp, Homo sapiens
cagggcttggatctgtggtcag

SEQ ID NO: 7054602 - DNA, 22 bp, Homo sapiens
cagggctcgctcgctcgctcgc

SEQ ID NO: 7054603 - DNA, 22 bp, Homo sapiens
cagggctccccagagagcctct

SEQ ID NO: 7054604 - DNA, 22 bp, Homo sapiens
cagggctccctctggctcccag

SEQ ID NO: 7054605 - DNA, 22 bp, Homo sapiens
caggggctgtggcacatggtgt

SEQ ID NO: 7054606 - DNA, 22 bp, Homo sapiens
cagggtgcagagctagggtagt

SEQ ID NO: 7054607 - DNA, 22 bp, Homo sapiens
cagggtgcagtgtcgctgctag

SEQ ID NO: 7054608 - DNA, 22 bp, Homo sapiens
caggggctgtttgcctcaggcc

SEQ ID NO: 7054609 - DNA, 22 bp, Homo sapiens
caggtgacttctgaggccttca

SEQ ID NO: 7054610 - DNA, 22 bp, Homo sapiens
caggtgagaggcggtcctgcat

SEQ ID NO: 7054611 - DNA, 22 bp, Homo sapiens
caggtgagctctatctagggag

SEQ ID NO: 7054612 - DNA, 22 bp, Homo sapiens
cagggtgcctcccgctcgccgg

SEQ ID NO: 7054613 - DNA, 22 bp, Homo sapiens
cagggtgcctgtcctcagcaaa

SEQ ID NO: 7054614 - DNA, 22 bp, Homo sapiens
cagggtgcctgtcctcagcaaa

SEQ ID NO: 7054615 - DNA, 22 bp, Homo sapiens
cagggtgcgccactcagatgta

SEQ ID NO: 7054616 - DNA, 22 bp, Homo sapiens
cagggtgcgccactcagatgta

SEQ ID NO: 7054617 - DNA, 22 bp, Homo sapiens
caggtgaccctcagtgtggact

SEQ ID NO: 7054618 - DNA, 22 bp, Homo sapiens
caggtgaccctctcacctgctt

SEQ ID NO: 7054619 - DNA, 22 bp, Homo sapiens
caggtgaccctctcacctgctt

SEQ ID NO: 7054620 - DNA, 22 bp, Homo sapiens
caggtgacctatggtcactaca

SEQ ID NO: 7054621 - DNA, 17 bp, Homo sapiens
caggtgacctggtgatg

SEQ ID NO: 7054622 - DNA, 22 bp, Homo sapiens
cagggatggcgctggctgcccg

SEQ ID NO: 7054623 - DNA, 19 bp, Homo sapiens
cagggatgggtagggactc

SEQ ID NO: 7054624 - DNA, 22 bp, Homo sapiens
cagggatgggatggagtcagtt

SEQ ID NO: 7054625 - DNA, 22 bp, Homo sapiens
cagggagctggctggcgtgagt

SEQ ID NO: 7054626 - DNA, 22 bp, Homo sapiens
cagggagctggctggctgtgcc

SEQ ID NO: 7054627 - DNA, 22 bp, Homo sapiens
cagggagctgacaaccaaggag

SEQ ID NO: 7054628 - DNA, 22 bp, Homo sapiens
caggctgctgtccacaaagcat

SEQ ID NO: 7054629 - DNA, 22 bp, Homo sapiens
caggctggacattagatacata

SEQ ID NO: 7054630 - DNA, 22 bp, Homo sapiens
caggctggacattagatacata

SEQ ID NO: 7054631 - DNA, 22 bp, Homo sapiens
caggctggagtacaattgtgtg

SEQ ID NO: 7054632 - DNA, 22 bp, Homo sapiens
caggctggagtgcagtggtgcc

SEQ ID NO: 7054633 - DNA, 22 bp, Homo sapiens
caggctggagtgcagtgtcgcc

SEQ ID NO: 7054634 - DNA, 22 bp, Homo sapiens
caggctggagtgcagtgtcgcc

SEQ ID NO: 7054635 - DNA, 22 bp, Homo sapiens
caggctggagtgcagttgtgca

SEQ ID NO: 7054636 - DNA, 22 bp, Homo sapiens
caggctggagtgcagttgtgca

SEQ ID NO: 7054637 - DNA, 22 bp, Homo sapiens
caggctggagttacctttaggg

SEQ ID NO: 7054638 - DNA, 22 bp, Homo sapiens
caggctggagttacctttaggg

SEQ ID NO: 7054639 - DNA, 22 bp, Homo sapiens
cagggagaaatctccaggaggt

SEQ ID NO: 7054640 - DNA, 22 bp, Homo sapiens
agctgtggaagactgtcagggt

SEQ ID NO: 7054641 - DNA, 22 bp, Homo sapiens
agctgtgctgccaagttgctga

SEQ ID NO: 7054642 - DNA, 22 bp, Homo sapiens
agctgtggaagactgtcagggt

SEQ ID NO: 7054643 - DNA, 22 bp, Homo sapiens
agctgtggaagactgtcagggt

SEQ ID NO: 7054644 - DNA, 22 bp, Homo sapiens
caggctgagctctggcctgggc

SEQ ID NO: 7054645 - DNA, 22 bp, Homo sapiens
caggctgcggccgtgtgagcat

SEQ ID NO: 7054646 - DNA, 22 bp, Homo sapiens
caggctgcggccgtgtgagcat

SEQ ID NO: 7054647 - DNA, 22 bp, Homo sapiens
caggctgcggtcggctctggtc

SEQ ID NO: 7054648 - DNA, 22 bp, Homo sapiens
caggctgcggtcggctctggtc

SEQ ID NO: 7054649 - DNA, 19 bp, Homo sapiens
agctggggcggtgtgtgtt

SEQ ID NO: 7054650 - DNA, 18 bp, Homo sapiens
agctggggcctctggtcc

SEQ ID NO: 7054651 - DNA, 22 bp, Homo sapiens
agctggggcatttatccactaa

SEQ ID NO: 7054652 - DNA, 22 bp, Homo sapiens
caggcctgtctgcacatgaggc

SEQ ID NO: 7054653 - DNA, 22 bp, Homo sapiens
caggctcactttctcagtcaca

SEQ ID NO: 7054654 - DNA, 22 bp, Homo sapiens
agcccaggctggagtgcagtgg

SEQ ID NO: 7054655 - DNA, 22 bp, Homo sapiens
agcccagggaaccaggaagtgg

SEQ ID NO: 7054656 - DNA, 22 bp, Homo sapiens
agcccaggctggagtgcagtgg

SEQ ID NO: 7054657 - DNA, 22 bp, Homo sapiens
cagaggctcttcctcactgccc

SEQ ID NO: 7054658 - DNA, 22 bp, Homo sapiens
cagaggctcttcctcactgccc

SEQ ID NO: 7054659 - DNA, 22 bp, Homo sapiens
cagaggctgacaaaatattgct

SEQ ID NO: 7054660 - DNA, 22 bp, Homo sapiens
cagagggaccagaacatactgt

SEQ ID NO: 7054661 - DNA, 22 bp, Homo sapiens
cagagggagccctccaggagca

SEQ ID NO: 7054662 - DNA, 23 bp, Homo sapiens
cagaggcatcggattcaacatca

SEQ ID NO: 7054663 - DNA, 22 bp, Homo sapiens
cagaggcattactgaaaaggtg

SEQ ID NO: 7054664 - DNA, 20 bp, Homo sapiens
cagaggcattttcagactct

SEQ ID NO: 7054665 - DNA, 23 bp, Homo sapiens
cagaggcatcggattcaacatca

SEQ ID NO: 7054666 - DNA, 23 bp, Homo sapiens
cagaggcatcggattcaacatca

SEQ ID NO: 7054667 - DNA, 21 bp, Homo sapiens
cagaggcaggtcctgggacgg

SEQ ID NO: 7054668 - DNA, 22 bp, Homo sapiens
cagaggcagtggggttgctcct

SEQ ID NO: 7054669 - DNA, 22 bp, Homo sapiens
cagaggcatactcccagtcttg

SEQ ID NO: 7054670 - DNA, 22 bp, Homo sapiens
agcccactgttttcatttctct

SEQ ID NO: 7054671 - DNA, 22 bp, Homo sapiens
cagagaaagggtgaattccttc

SEQ ID NO: 7054672 - DNA, 22 bp, Homo sapiens
cagagaaagaagcccattcatt

SEQ ID NO: 7054673 - DNA, 22 bp, Homo sapiens
cagagaaagacttgcccttagt

SEQ ID NO: 7054674 - DNA, 22 bp, Homo sapiens
cagacttttgacattaatacag

SEQ ID NO: 7054675 - DNA, 22 bp, Homo sapiens
cagactttctgactcccttgcc

SEQ ID NO: 7054676 - DNA, 22 bp, Homo sapiens
cagagaaaaaatcctgctctca

SEQ ID NO: 7054677 - DNA, 22 bp, Homo sapiens
cagagaaactcagatagctgat

SEQ ID NO: 7054678 - DNA, 22 bp, Homo sapiens
cagagaaagaagcccattcatt

SEQ ID NO: 7054679 - DNA, 22 bp, Homo sapiens
cagacaggtagggacagaacat

SEQ ID NO: 7054680 - DNA, 22 bp, Homo sapiens
cagacaggtagggacagaacat

SEQ ID NO: 7054681 - DNA, 22 bp, Homo sapiens
cagacagtggacttgataaagg

SEQ ID NO: 7054682 - DNA, 22 bp, Homo sapiens
cagacaggaagttcagaagaaa

SEQ ID NO: 7054683 - DNA, 22 bp, Homo sapiens
agccagagagccccaggttcta

SEQ ID NO: 7054684 - DNA, 22 bp, Homo sapiens
agccagagaacagcaggaaatg

SEQ ID NO: 7054685 - DNA, 22 bp, Homo sapiens
agccagagactgtgtctgtaat

SEQ ID NO: 7054686 - DNA, 22 bp, Homo sapiens
cagaatgagtagcatcttcacc

SEQ ID NO: 7054687 - DNA, 22 bp, Homo sapiens
agccactgtgagaggaccaggg

SEQ ID NO: 7054688 - DNA, 22 bp, Homo sapiens
agccactgtgcaggagcagtgt

SEQ ID NO: 7054689 - DNA, 22 bp, Homo sapiens
agccaccaccactgaaaggtta

SEQ ID NO: 7054690 - DNA, 20 bp, Homo sapiens
agccacctcatttccctacc

SEQ ID NO: 7054691 - DNA, 22 bp, Homo sapiens
agccactccttcagcgtctgct

SEQ ID NO: 7054692 - DNA, 22 bp, Homo sapiens
cagaaatatcacctggactcta

SEQ ID NO: 7054693 - DNA, 22 bp, Homo sapiens
cagaaatatcagttgaaagtgc

SEQ ID NO: 7054694 - DNA, 22 bp, Homo sapiens
cagaaggcaaacaaaaggattt

SEQ ID NO: 7054695 - DNA, 22 bp, Homo sapiens
cagctcaggctctccatgctcc

SEQ ID NO: 7054696 - DNA, 22 bp, Homo sapiens
agctcagagataatcaagagac

SEQ ID NO: 7054697 - DNA, 22 bp, Homo sapiens
cagctccaaagccccactgtcc

SEQ ID NO: 7054698 - DNA, 23 bp, Homo sapiens
agctcctgaggccagcctctcct

SEQ ID NO: 7054699 - DNA, 22 bp, Homo sapiens
agctcctgatacatgcaggaat

SEQ ID NO: 7054700 - DNA, 22 bp, Homo sapiens
cagccctgagagaaccatctat

SEQ ID NO: 7054701 - DNA, 22 bp, Homo sapiens
cagccctgagttagcccacgga

SEQ ID NO: 7054702 - DNA, 22 bp, Homo sapiens
cagccctgagttagcccacgga

SEQ ID NO: 7054703 - DNA, 22 bp, Homo sapiens
cagccctgcacgctgcctccgc

SEQ ID NO: 7054704 - DNA, 22 bp, Homo sapiens
cagccctgcagagggcgctcct

SEQ ID NO: 7054705 - DNA, 22 bp, Homo sapiens
cagcaggggtgtcattgtagtt

SEQ ID NO: 7054706 - DNA, 22 bp, Homo sapiens
cagcagggttaagtgactcacc

SEQ ID NO: 7054707 - DNA, 18 bp, Homo sapiens
agcctctggcagagagaa

SEQ ID NO: 7054708 - DNA, 22 bp, Homo sapiens
agcctctgctggccctggcact

SEQ ID NO: 7054709 - DNA, 22 bp, Homo sapiens
agcctctgctggccctggcact

SEQ ID NO: 7054710 - DNA, 22 bp, Homo sapiens
agcctctgcacgggcacgggtg

SEQ ID NO: 7054711 - DNA, 20 bp, Homo sapiens
agcctctgcccttcccactg

SEQ ID NO: 7054712 - DNA, 22 bp, Homo sapiens
agcctctgggggagctgggagc

SEQ ID NO: 7054713 - DNA, 22 bp, Homo sapiens
agcctctgggggagctgggagc

SEQ ID NO: 7054714 - DNA, 22 bp, Homo sapiens
agcctctggtcctccctcagct

SEQ ID NO: 7054715 - DNA, 22 bp, Homo sapiens
agcctctgtagaaagcagtgtg

SEQ ID NO: 7054716 - DNA, 22 bp, Homo sapiens
agcctctgtcaagcttttcaaa

SEQ ID NO: 7054717 - DNA, 22 bp, Homo sapiens
cagaggtattgcaaaagcctag

SEQ ID NO: 7054718 - DNA, 22 bp, Homo sapiens
cagaggtattttgataaacgcc

SEQ ID NO: 7054719 - DNA, 22 bp, Homo sapiens
cagaggtcaagatctgaagtga

SEQ ID NO: 7054720 - DNA, 22 bp, Homo sapiens
cagagggagtttctgaggttgc

SEQ ID NO: 7054721 - DNA, 22 bp, Homo sapiens
cagagggatcatcttcctgaag

SEQ ID NO: 7054722 - DNA, 22 bp, Homo sapiens
cagaggtcaagatctgaagtga

SEQ ID NO: 7054723 - DNA, 21 bp, Homo sapiens
cagaggtcatcctgaggacaa

SEQ ID NO: 7054724 - DNA, 21 bp, Homo sapiens
cagaggtcatcctgaggacaa

SEQ ID NO: 7054725 - DNA, 22 bp, Homo sapiens
cagaggtctgacactgaatggt

SEQ ID NO: 7054726 - DNA, 22 bp, Homo sapiens
cagaggtgacccatagtacctc

SEQ ID NO: 7054727 - DNA, 19 bp, Homo sapiens
cagaggtgatatatgccca

SEQ ID NO: 7054728 - DNA, 22 bp, Homo sapiens
cagaggtgcatacaggtcatta

SEQ ID NO: 7054729 - DNA, 22 bp, Homo sapiens
cagaggtgctggagtgagtcct

SEQ ID NO: 7054730 - DNA, 23 bp, Homo sapiens
agcctcttttctcctgccctgca

SEQ ID NO: 7054731 - DNA, 22 bp, Homo sapiens
agcctgagccccatccagctga

SEQ ID NO: 7054732 - DNA, 22 bp, Homo sapiens
cagcagctcagtctctcagtag

SEQ ID NO: 7054733 - DNA, 22 bp, Homo sapiens
cagcagggcccccgggtgcgcc

SEQ ID NO: 7054734 - DNA, 22 bp, Homo sapiens
cagcaggggaactgtgggccag

SEQ ID NO: 7054735 - DNA, 22 bp, Homo sapiens
caagcagagaagtctctaggct

SEQ ID NO: 7054736 - DNA, 22 bp, Homo sapiens
caagatttccaaccctgggtaa

SEQ ID NO: 7054737 - DNA, 22 bp, Homo sapiens
caagatttgacttcgtggtttg

SEQ ID NO: 7054738 - DNA, 22 bp, Homo sapiens
caagatttggcaactttgtcat

SEQ ID NO: 7054739 - DNA, 19 bp, Homo sapiens
caagatttgttcacacatg

SEQ ID NO: 7054740 - DNA, 22 bp, Homo sapiens
caagatttagcctgctgcctgt

SEQ ID NO: 7054741 - DNA, 22 bp, Homo sapiens
caagatttatattttcacacaa

SEQ ID NO: 7054742 - DNA, 22 bp, Homo sapiens
caagagacttatgtggaaacct

SEQ ID NO: 7054743 - DNA, 22 bp, Homo sapiens
agcagcaggaggctgtccacca

SEQ ID NO: 7054744 - DNA, 22 bp, Homo sapiens
agcagcaggctgtgtggactga

SEQ ID NO: 7054745 - DNA, 22 bp, Homo sapiens
agcagcagggctctgcccgtgc

SEQ ID NO: 7054746 - DNA, 22 bp, Homo sapiens
agcagcagggtgatagtgccca

SEQ ID NO: 7054747 - DNA, 21 bp, Homo sapiens
cacaagacacatagggtgttt

SEQ ID NO: 7054748 - DNA, 22 bp, Homo sapiens
cacaagacttatttgtgtagaa

SEQ ID NO: 7054749 - DNA, 22 bp, Homo sapiens
agcagccaaggtaacctgtgct

SEQ ID NO: 7054750 - DNA, 22 bp, Homo sapiens
agcagccacacgcctccttctc

SEQ ID NO: 7054751 - DNA, 22 bp, Homo sapiens
agcagccacagtctgggacagg

SEQ ID NO: 7054752 - DNA, 22 bp, Homo sapiens
agcagccacccagctgctcatt

SEQ ID NO: 7054753 - DNA, 22 bp, Homo sapiens
agcagccacccagctgctcatt

SEQ ID NO: 7054754 - DNA, 22 bp, Homo sapiens
agcagccagaaagggcagtcga

SEQ ID NO: 7054755 - DNA, 22 bp, Homo sapiens
agcagccagaaatccagaggtg

SEQ ID NO: 7054756 - DNA, 22 bp, Homo sapiens
agcacatgcacagtgctacact

SEQ ID NO: 7054757 - DNA, 22 bp, Homo sapiens
caaatagattgttcaatcctga

SEQ ID NO: 7054758 - DNA, 22 bp, Homo sapiens
caaatagtatgagcaatgattc

SEQ ID NO: 7054759 - DNA, 22 bp, Homo sapiens
agcacaggtgaaacagtcaggt

SEQ ID NO: 7054760 - DNA, 22 bp, Homo sapiens
agcacagtggcttctatgtcta

SEQ ID NO: 7054761 - DNA, 19 bp, Homo sapiens
agcacagtttccacatgca

SEQ ID NO: 7054762 - DNA, 22 bp, Homo sapiens
agcacagtttcttttccttgtc

SEQ ID NO: 7054763 - DNA, 22 bp, Homo sapiens
caaatagtgtcacattgtgagg

SEQ ID NO: 7054764 - DNA, 22 bp, Homo sapiens
caaatatctttggcaaagagaa

SEQ ID NO: 7054765 - DNA, 20 bp, Homo sapiens
caacactgcccattgtttgc

SEQ ID NO: 7054766 - DNA, 22 bp, Homo sapiens
caacagctcagacacgggacct

SEQ ID NO: 7054767 - DNA, 22 bp, Homo sapiens
caacagctgatctttgatgaag

SEQ ID NO: 7054768 - DNA, 22 bp, Homo sapiens
caacagctgatctttgatgaag

SEQ ID NO: 7054769 - DNA, 22 bp, Homo sapiens
caacagctggaggcttggcccg

SEQ ID NO: 7054770 - DNA, 23 bp, Homo sapiens
caacagctgttagatatgggctt

SEQ ID NO: 7054771 - DNA, 22 bp, Homo sapiens
caacagctttagaaacactttc

SEQ ID NO: 7054772 - DNA, 22 bp, Homo sapiens
agcacattaagtgagttcatgt

SEQ ID NO: 7054773 - DNA, 22 bp, Homo sapiens
caacagagagaccagaaacagg

SEQ ID NO: 7054774 - DNA, 22 bp, Homo sapiens
agcacattctgccttgctttgc

SEQ ID NO: 7054775 - DNA, 21 bp, Homo sapiens
caagacatatgagtactctgg

SEQ ID NO: 7054776 - DNA, 22 bp, Homo sapiens
caagacatgcaattgccacttt

SEQ ID NO: 7054777 - DNA, 22 bp, Homo sapiens
caagacattgattttgtacaga

SEQ ID NO: 7054778 - DNA, 22 bp, Homo sapiens
caagacattgattttgtacaga

SEQ ID NO: 7054779 - DNA, 22 bp, Homo sapiens
agcaggcacaagaaagggaggt

SEQ ID NO: 7054780 - DNA, 22 bp, Homo sapiens
agcaggcaccagggctcgtcct

SEQ ID NO: 7054781 - DNA, 22 bp, Homo sapiens
agcaggcacgctccctgcgcga

SEQ ID NO: 7054782 - DNA, 17 bp, Homo sapiens
agcaggcacgtcagcac

SEQ ID NO: 7054783 - DNA, 21 bp, Homo sapiens
agcaggcaaaggtgaagtctt

SEQ ID NO: 7054784 - DNA, 22 bp, Homo sapiens
agcaggcaagcgtgagttctct

SEQ ID NO: 7054785 - DNA, 22 bp, Homo sapiens
agcaggcaagcgtgagttctct

SEQ ID NO: 7054786 - DNA, 22 bp, Homo sapiens
agcaggagtttgatgcttttat

SEQ ID NO: 7054787 - DNA, 22 bp, Homo sapiens
cacacacagttttgtattctgt

SEQ ID NO: 7054788 - DNA, 22 bp, Homo sapiens
cacacactgacaccttatcttg

SEQ ID NO: 7054789 - DNA, 22 bp, Homo sapiens
cacacagaaccgctcgccactt

SEQ ID NO: 7054790 - DNA, 22 bp, Homo sapiens
cacagttatatgttcacaagga

SEQ ID NO: 7054791 - DNA, 22 bp, Homo sapiens
agcaggcagcctaggaagtgaa

SEQ ID NO: 7054792 - DNA, 22 bp, Homo sapiens
agcaggcagctgggggagttga

SEQ ID NO: 7054793 - DNA, 22 bp, Homo sapiens
agcaggcaggaaggcagcactg

SEQ ID NO: 7054794 - DNA, 22 bp, Homo sapiens
agcaggcagcatgggaccctcc

SEQ ID NO: 7054795 - DNA, 22 bp, Homo sapiens
agcaggcagccatttggaaggc

SEQ ID NO: 7054796 - DNA, 22 bp, Homo sapiens
agcaggcaggaatggtggaaca

SEQ ID NO: 7054797 - DNA, 22 bp, Homo sapiens
agcaggcaggaaggcagcactg

SEQ ID NO: 7054798 - DNA, 22 bp, Homo sapiens
agcaggcaggaggctactaagg

SEQ ID NO: 7054799 - DNA, 22 bp, Homo sapiens
agcaggcaggcccagcggctgg

SEQ ID NO: 7054800 - DNA, 22 bp, Homo sapiens
agcaggggcagggttttgtgct

SEQ ID NO: 7054801 - DNA, 22 bp, Homo sapiens
agcaggggctcctccacagcca

SEQ ID NO: 7054802 - DNA, 22 bp, Homo sapiens
agcagggctggggcacgagcca

SEQ ID NO: 7054803 - DNA, 22 bp, Homo sapiens
agcagggggagttagactagat

SEQ ID NO: 7054804 - DNA, 22 bp, Homo sapiens
agcaggggtaacagaaggaaag

SEQ ID NO: 7054805 - DNA, 22 bp, Homo sapiens
agcagggggccacagtcacagc

SEQ ID NO: 7054806 - DNA, 22 bp, Homo sapiens
agcagggggccacagtcacagc

SEQ ID NO: 7054807 - DNA, 22 bp, Homo sapiens
agcagggtcctgaggtgagtca

SEQ ID NO: 7054808 - DNA, 22 bp, Homo sapiens
agcagggtcctgaggtgagtca

SEQ ID NO: 7054809 - DNA, 22 bp, Homo sapiens
agcagggttccaggagttgcag

SEQ ID NO: 7054810 - DNA, 22 bp, Homo sapiens
agcagggtttggggattggcac

SEQ ID NO: 7054811 - DNA, 22 bp, Homo sapiens
agcaggggtctctgctaatgaa

SEQ ID NO: 7054812 - DNA, 22 bp, Homo sapiens
agcaggggtctctgctaatgaa

SEQ ID NO: 7054813 - DNA, 22 bp, Homo sapiens
caccaggttccgggcagagctg

SEQ ID NO: 7054814 - DNA, 22 bp, Homo sapiens
cacccaggctggagagcagtgg

SEQ ID NO: 7054815 - DNA, 22 bp, Homo sapiens
cacccaggctggagagcagtgg

SEQ ID NO: 7054816 - DNA, 22 bp, Homo sapiens
cacccaggctggagtgcagggg

SEQ ID NO: 7054817 - DNA, 22 bp, Homo sapiens
cacccaggctggagtgcagggg

SEQ ID NO: 7054818 - DNA, 22 bp, Homo sapiens
cacccaggctggagtgcagtga

SEQ ID NO: 7054819 - DNA, 22 bp, Homo sapiens
cacccaggctggagtgcagtgg

SEQ ID NO: 7054820 - DNA, 22 bp, Homo sapiens
cacctagggcatccctgcccca

SEQ ID NO: 7054821 - DNA, 20 bp, Homo sapiens
cacctctgaaagtttccagc

SEQ ID NO: 7054822 - DNA, 22 bp, Homo sapiens
cactgcagatcagaggctgaga

SEQ ID NO: 7054823 - DNA, 22 bp, Homo sapiens
cactgctacctctgcctcccgg

SEQ ID NO: 7054824 - DNA, 22 bp, Homo sapiens
cactgctcgctgcagcatggcc

SEQ ID NO: 7054825 - DNA, 22 bp, Homo sapiens
cactgcttagttggtaaatgtg

SEQ ID NO: 7054826 - DNA, 22 bp, Homo sapiens
cactgcttgcagtatgagtgga

SEQ ID NO: 7054827 - DNA, 22 bp, Homo sapiens
agcatacttgacacttctctat

SEQ ID NO: 7054828 - DNA, 22 bp, Homo sapiens
agacagaccatggctattcaga

SEQ ID NO: 7054829 - DNA, 21 bp, Homo sapiens
agacagactgcctgacccacg

SEQ ID NO: 7054830 - DNA, 17 bp, Homo sapiens
atgcacatgtaagagga

SEQ ID NO: 7054831 - DNA, 22 bp, Homo sapiens
atgcacctgaactccatcagct

SEQ ID NO: 7054832 - DNA, 21 bp, Homo sapiens
agacagcagtctccaaacccc

SEQ ID NO: 7054833 - DNA, 22 bp, Homo sapiens
agacagcatgatacatgatgct

SEQ ID NO: 7054834 - DNA, 22 bp, Homo sapiens
agacagcatggagctgataaca

SEQ ID NO: 7054835 - DNA, 22 bp, Homo sapiens
agacagcatggagctgataaca

SEQ ID NO: 7054836 - DNA, 22 bp, Homo sapiens
agacagctctgggttccacact

SEQ ID NO: 7054837 - DNA, 22 bp, Homo sapiens
agacagctgctcgcagagctat

SEQ ID NO: 7054838 - DNA, 22 bp, Homo sapiens
agacagctgctcgcagagctat

SEQ ID NO: 7054839 - DNA, 22 bp, Homo sapiens
agacagctgttccttcatgttt

SEQ ID NO: 7054840 - DNA, 22 bp, Homo sapiens
agacaggacacaagctgcataa

SEQ ID NO: 7054841 - DNA, 22 bp, Homo sapiens
agacaggagagggaactgccgg

SEQ ID NO: 7054842 - DNA, 22 bp, Homo sapiens
agacaggatgcatactcttggt

SEQ ID NO: 7054843 - DNA, 22 bp, Homo sapiens
atctcagaaacatatctaatcc

SEQ ID NO: 7054844 - DNA, 22 bp, Homo sapiens
atctcagagaaatttgaatgca

SEQ ID NO: 7054845 - DNA, 22 bp, Homo sapiens
atctcagatctacagatctaca

SEQ ID NO: 7054846 - DNA, 22 bp, Homo sapiens
agaagtgagtgtgactcagcag

SEQ ID NO: 7054847 - DNA, 22 bp, Homo sapiens
agaagtgccgaaaggaagacag

SEQ ID NO: 7054848 - DNA, 22 bp, Homo sapiens
agaagtgctccagtgagttggg

SEQ ID NO: 7054849 - DNA, 22 bp, Homo sapiens
agaagtggtctgtcttccagat

SEQ ID NO: 7054850 - DNA, 22 bp, Homo sapiens
agaagttaccacatacttctct

SEQ ID NO: 7054851 - DNA, 19 bp, Homo sapiens
agaagttagacattgcaat

SEQ ID NO: 7054852 - DNA, 22 bp, Homo sapiens
agaagtttcacaatgggtttta

SEQ ID NO: 7054853 - DNA, 20 bp, Homo sapiens
agaagtttgggggtgtggag

SEQ ID NO: 7054854 - DNA, 22 bp, Homo sapiens
agaagtttggtcctataaactc

SEQ ID NO: 7054855 - DNA, 22 bp, Homo sapiens
agaagtttggtccttttcaagg

SEQ ID NO: 7054856 - DNA, 22 bp, Homo sapiens
atctttgttgctctcatttctg

SEQ ID NO: 7054857 - DNA, 22 bp, Homo sapiens
atctttgttgctctcatttctg

SEQ ID NO: 7054858 - DNA, 22 bp, Homo sapiens
agacaaatgaacaaatatgtga

SEQ ID NO: 7054859 - DNA, 22 bp, Homo sapiens
atgaaagtacctgtaatatgtt

SEQ ID NO: 7054860 - DNA, 22 bp, Homo sapiens
atgaaatttgaccaattattta

SEQ ID NO: 7054861 - DNA, 22 bp, Homo sapiens
atgaaatttgctgctaagttcc

SEQ ID NO: 7054862 - DNA, 22 bp, Homo sapiens
atgaaattttaattatacctct

SEQ ID NO: 7054863 - DNA, 22 bp, Homo sapiens
agagaagagcaatgataaattt

SEQ ID NO: 7054864 - DNA, 22 bp, Homo sapiens
agagaagagcaatgataaattt

SEQ ID NO: 7054865 - DNA, 22 bp, Homo sapiens
atggccagcttataggggctca

SEQ ID NO: 7054866 - DNA, 22 bp, Homo sapiens
atggccagggtggcactgtggt

SEQ ID NO: 7054867 - DNA, 22 bp, Homo sapiens
agacccagagggctgctgggag

SEQ ID NO: 7054868 - DNA, 22 bp, Homo sapiens
agacattttgatacccctaccg

SEQ ID NO: 7054869 - DNA, 22 bp, Homo sapiens
agaccactaaaactttctctat

SEQ ID NO: 7054870 - DNA, 22 bp, Homo sapiens
agagacagggttttgtcgtgtt

SEQ ID NO: 7054871 - DNA, 22 bp, Homo sapiens
agagacagggttttgtcgtgtt

SEQ ID NO: 7054872 - DNA, 22 bp, Homo sapiens
agagacagggttttgtcgtgtt

SEQ ID NO: 7054873 - DNA, 19 bp, Homo sapiens
agagaccacagagctgcct

SEQ ID NO: 7054874 - DNA, 22 bp, Homo sapiens
agagaccagaatccagctgcct

SEQ ID NO: 7054875 - DNA, 22 bp, Homo sapiens
agagaagattcttatatgtctt

SEQ ID NO: 7054876 - DNA, 22 bp, Homo sapiens
agagaagagtcttgtcaaatta

SEQ ID NO: 7054877 - DNA, 22 bp, Homo sapiens
agagaaggaaagctgacatggg

SEQ ID NO: 7054878 - DNA, 22 bp, Homo sapiens
agagaaggaaagctgacatggg

SEQ ID NO: 7054879 - DNA, 22 bp, Homo sapiens
agagacagaggcaatatagctt

SEQ ID NO: 7054880 - DNA, 22 bp, Homo sapiens
agagacagaggcaatatagctt

SEQ ID NO: 7054881 - DNA, 22 bp, Homo sapiens
atggctcagcgcctttctgtgg

SEQ ID NO: 7054882 - DNA, 22 bp, Homo sapiens
agagactgatggagctcactct

SEQ ID NO: 7054883 - DNA, 22 bp, Homo sapiens
atggggtgcatgcagattggga

SEQ ID NO: 7054884 - DNA, 22 bp, Homo sapiens
atggggtgagactaggattaaa

SEQ ID NO: 7054885 - DNA, 22 bp, Homo sapiens
atgggggaaagtacgagcatgg

SEQ ID NO: 7054886 - DNA, 22 bp, Homo sapiens
agagatgactgatggctgatta

SEQ ID NO: 7054887 - DNA, 22 bp, Homo sapiens
agagatgagaacatgcttggat

SEQ ID NO: 7054888 - DNA, 22 bp, Homo sapiens
agagatggagagcactggggct

SEQ ID NO: 7054889 - DNA, 22 bp, Homo sapiens
agagatggatgttattatgggt

SEQ ID NO: 7054890 - DNA, 22 bp, Homo sapiens
agagcatccatttttgtcacat

SEQ ID NO: 7054891 - DNA, 22 bp, Homo sapiens
agagccacggcaggcctaggaa

SEQ ID NO: 7054892 - DNA, 22 bp, Homo sapiens
agagccactgggagacagagca

SEQ ID NO: 7054893 - DNA, 19 bp, Homo sapiens
agagccagacagcatagga

SEQ ID NO: 7054894 - DNA, 22 bp, Homo sapiens
agagccagaccattgccgtgca

SEQ ID NO: 7054895 - DNA, 22 bp, Homo sapiens
agagccagatggagccgtgtgt

SEQ ID NO: 7054896 - DNA, 22 bp, Homo sapiens
atgtgtaaagttagatgtctga

SEQ ID NO: 7054897 - DNA, 22 bp, Homo sapiens
atgtgtaaaaagtgcttaatat

SEQ ID NO: 7054898 - DNA, 22 bp, Homo sapiens
atgtgggccgtgcgggtgtcct

SEQ ID NO: 7054899 - DNA, 22 bp, Homo sapiens
agagcctggttcaaattttacc

SEQ ID NO: 7054900 - DNA, 22 bp, Homo sapiens
agagcctgtcaattgtaaagag

SEQ ID NO: 7054901 - DNA, 22 bp, Homo sapiens
agagcctgtctgcctttctacc

SEQ ID NO: 7054902 - DNA, 22 bp, Homo sapiens
agagcctgtgattgtcatcacc

SEQ ID NO: 7054903 - DNA, 22 bp, Homo sapiens
agagcctgggcagctcctctgg

SEQ ID NO: 7054904 - DNA, 22 bp, Homo sapiens
agagcctggggattggcaaggg

SEQ ID NO: 7054905 - DNA, 22 bp, Homo sapiens
atgtatttgcttgttatggatt

SEQ ID NO: 7054906 - DNA, 22 bp, Homo sapiens
atgtatttgcgtatggacatac

SEQ ID NO: 7054907 - DNA, 22 bp, Homo sapiens
agagccagcaactctagccctg

SEQ ID NO: 7054908 - DNA, 22 bp, Homo sapiens
agagccagcaactctagccctg

SEQ ID NO: 7054909 - DNA, 22 bp, Homo sapiens
atttcactcattcatgttactt

SEQ ID NO: 7054910 - DNA, 22 bp, Homo sapiens
atttcacattaatttgatgctc

SEQ ID NO: 7054911 - DNA, 22 bp, Homo sapiens
atttcacagctgtcagtgttac

SEQ ID NO: 7054912 - DNA, 22 bp, Homo sapiens
agatacagtgttacatttttat

SEQ ID NO: 7054913 - DNA, 22 bp, Homo sapiens
agagtttgaattttgaaaagat

SEQ ID NO: 7054914 - DNA, 22 bp, Homo sapiens
agagtttggagagggtgaggca

SEQ ID NO: 7054915 - DNA, 22 bp, Homo sapiens
agagtttggaggtgttcctgga

SEQ ID NO: 7054916 - DNA, 22 bp, Homo sapiens
agagtttggattttaggacatc

SEQ ID NO: 7054917 - DNA, 22 bp, Homo sapiens
agagtttggggtatgattgttt

SEQ ID NO: 7054918 - DNA, 20 bp, Homo sapiens
agagtttggggtcattttgg

SEQ ID NO: 7054919 - DNA, 22 bp, Homo sapiens
agagtttgggtgggacagcttg

SEQ ID NO: 7054920 - DNA, 22 bp, Homo sapiens
agagtttggtgaagcaatttga

SEQ ID NO: 7054921 - DNA, 22 bp, Homo sapiens
agagtttgtactttaccctgag

SEQ ID NO: 7054922 - DNA, 22 bp, Homo sapiens
agagtttgtagtggtgaatgta

SEQ ID NO: 7054923 - DNA, 22 bp, Homo sapiens
agagtttgtatttttcagtgaa

SEQ ID NO: 7054924 - DNA, 22 bp, Homo sapiens
agagtttgtgggcttttcctcc

SEQ ID NO: 7054925 - DNA, 22 bp, Homo sapiens
agagtttgtgtcctttatcagg

SEQ ID NO: 7054926 - DNA, 22 bp, Homo sapiens
agagtttgttgaatttacttgg

SEQ ID NO: 7054927 - DNA, 23 bp, Homo sapiens
agagtttgtttctaatgagtgag

SEQ ID NO: 7054928 - DNA, 17 bp, Homo sapiens
agagttttaagaaattt

SEQ ID NO: 7054929 - DNA, 22 bp, Homo sapiens
atttcacagctgctgttcaggt

SEQ ID NO: 7054930 - DNA, 22 bp, Homo sapiens
agagttggccaaaaggggcatt

SEQ ID NO: 7054931 - DNA, 22 bp, Homo sapiens
agagttggcccacgtgtaggcg

SEQ ID NO: 7054932 - DNA, 22 bp, Homo sapiens
agagtttgaagttatctttgac

SEQ ID NO: 7054933 - DNA, 22 bp, Homo sapiens
agagttctgctcttctcagtga

SEQ ID NO: 7054934 - DNA, 22 bp, Homo sapiens
agagttctgctcttctcagtga

SEQ ID NO: 7054935 - DNA, 22 bp, Homo sapiens
agagttctgtctgccacacgaa

SEQ ID NO: 7054936 - DNA, 22 bp, Homo sapiens
agagttctgctcttctcagtga

SEQ ID NO: 7054937 - DNA, 22 bp, Homo sapiens
agaggtgacataggagaggctc

SEQ ID NO: 7054938 - DNA, 22 bp, Homo sapiens
attgctgaaagtattttatgac

SEQ ID NO: 7054939 - DNA, 22 bp, Homo sapiens
agaggtattagatttgcatagg

SEQ ID NO: 7054940 - DNA, 22 bp, Homo sapiens
agaggtattaggtaattcagta

SEQ ID NO: 7054941 - DNA, 22 bp, Homo sapiens
agaggtcagaggtcgccaggtc

SEQ ID NO: 7054942 - DNA, 21 bp, Homo sapiens
agaggtcattgggctggttct

SEQ ID NO: 7054943 - DNA, 22 bp, Homo sapiens
agaggtctatgctaggggaact

SEQ ID NO: 7054944 - DNA, 22 bp, Homo sapiens
atttgcttttactatgttaaaa

SEQ ID NO: 7054945 - DNA, 22 bp, Homo sapiens
atttgcttttactatgttaaaa

SEQ ID NO: 7054946 - DNA, 22 bp, Homo sapiens
atttccttcagtgtttaatact

SEQ ID NO: 7054947 - DNA, 22 bp, Homo sapiens
atttctcattttgcttcaaagg

SEQ ID NO: 7054948 - DNA, 22 bp, Homo sapiens
atttctcctccagatggtggtt

SEQ ID NO: 7054949 - DNA, 22 bp, Homo sapiens
atttctccttgttgcaatgcag

SEQ ID NO: 7054950 - DNA, 22 bp, Homo sapiens
atttctctcattgttagctagg

SEQ ID NO: 7054951 - DNA, 17 bp, Homo sapiens
atttcctcagggctgag

SEQ ID NO: 7054952 - DNA, 22 bp, Homo sapiens
atttcctatacagttgtccata

SEQ ID NO: 7054953 - DNA, 22 bp, Homo sapiens
atttcctatagatatggtgagt

SEQ ID NO: 7054954 - DNA, 22 bp, Homo sapiens
atttcctatcctggtcttaaaa

SEQ ID NO: 7054955 - DNA, 22 bp, Homo sapiens
atttcctatggatacaggcaga

SEQ ID NO: 7054956 - DNA, 22 bp, Homo sapiens
atttcctatttcttgtccccta

SEQ ID NO: 7054957 - DNA, 21 bp, Homo sapiens
agatagttgggcatgcagctg

SEQ ID NO: 7054958 - DNA, 22 bp, Homo sapiens
caaaagtaccttgtgtgctttg

SEQ ID NO: 7054959 - DNA, 22 bp, Homo sapiens
atttgttgctagcagcactgat

SEQ ID NO: 7054960 - DNA, 22 bp, Homo sapiens
atttgtttatcgtcgattgtag

SEQ ID NO: 7054961 - DNA, 22 bp, Homo sapiens
atttgtttcagggccttggtat

SEQ ID NO: 7054962 - DNA, 20 bp, Homo sapiens
atttgtttctactctctgac

SEQ ID NO: 7054963 - DNA, 22 bp, Homo sapiens
agaggctcctcggtgcctcgtg

SEQ ID NO: 7054964 - DNA, 22 bp, Homo sapiens
agaggctccaccttctctgtcc

SEQ ID NO: 7054965 - DNA, 22 bp, Homo sapiens
agaggctaggaccatgtatcat

SEQ ID NO: 7054966 - DNA, 22 bp, Homo sapiens
agaggcggagcttgcagtgagc

SEQ ID NO: 7054967 - DNA, 22 bp, Homo sapiens
agaggcggaggttgcagtgagc

SEQ ID NO: 7054968 - DNA, 22 bp, Homo sapiens
attcatttgctattgtgtatgg

SEQ ID NO: 7054969 - DNA, 22 bp, Homo sapiens
attcatttgctattgtgtatgg

SEQ ID NO: 7054970 - DNA, 22 bp, Homo sapiens
attcatttagagggattaagca

SEQ ID NO: 7054971 - DNA, 22 bp, Homo sapiens
attcatttaggtattcacttac

SEQ ID NO: 7054972 - DNA, 22 bp, Homo sapiens
attcagtagaagttagctatta

SEQ ID NO: 7054973 - DNA, 22 bp, Homo sapiens
agaggcaggaggttgacttgag

SEQ ID NO: 7054974 - DNA, 20 bp, Homo sapiens
attcatgtctttataaaagc

SEQ ID NO: 7054975 - DNA, 22 bp, Homo sapiens
attcattccaggtcagtcagac

SEQ ID NO: 7054976 - DNA, 22 bp, Homo sapiens
agaggcagcagtcatactacag

SEQ ID NO: 7054977 - DNA, 22 bp, Homo sapiens
agaggcagccgtatttcaaagg

SEQ ID NO: 7054978 - DNA, 22 bp, Homo sapiens
agaggcaggaagagctgatttt

SEQ ID NO: 7054979 - DNA, 22 bp, Homo sapiens
agaggcaggaagagctgatttt

SEQ ID NO: 7054980 - DNA, 22 bp, Homo sapiens
attgataaattgcaatggggct

SEQ ID NO: 7054981 - DNA, 22 bp, Homo sapiens
attccattgtgtaaggatatcg

SEQ ID NO: 7054982 - DNA, 22 bp, Homo sapiens
agaggctgtgcagagggagtgc

SEQ ID NO: 7054983 - DNA, 22 bp, Homo sapiens
agagggaaaaactcatgtcatt

SEQ ID NO: 7054984 - DNA, 22 bp, Homo sapiens
agagggaaatccaggagtgctt

SEQ ID NO: 7054985 - DNA, 22 bp, Homo sapiens
agagggaatgtgattgcaccat

SEQ ID NO: 7054986 - DNA, 22 bp, Homo sapiens
attattattgttgatgttaggg

SEQ ID NO: 7054987 - DNA, 21 bp, Homo sapiens
attattatttctgtgtccagc

SEQ ID NO: 7054988 - DNA, 22 bp, Homo sapiens
attattattgttgatgttaggg

SEQ ID NO: 7054989 - DNA, 22 bp, Homo sapiens
agaggcagaagtgttcaaaccc

SEQ ID NO: 7054990 - DNA, 22 bp, Homo sapiens
attataggcttgagccaccgtg

SEQ ID NO: 7054991 - DNA, 22 bp, Homo sapiens
agaggaggccaggcccacacct

SEQ ID NO: 7054992 - DNA, 22 bp, Homo sapiens
agaggaggctctgggatcgtcc

SEQ ID NO: 7054993 - DNA, 22 bp, Homo sapiens
agaggaggcagcttaactcagt

SEQ ID NO: 7054994 - DNA, 22 bp, Homo sapiens
agaggaggctctgggatcgtcc

SEQ ID NO: 7054995 - DNA, 22 bp, Homo sapiens
agaggaggctgggtccagataa

SEQ ID NO: 7054996 - DNA, 22 bp, Homo sapiens
agaggaggctgggtccagataa

SEQ ID NO: 7054997 - DNA, 22 bp, Homo sapiens
attataggcttgagccaccgtg

SEQ ID NO: 7054998 - DNA, 22 bp, Homo sapiens
agaggacaggttttccatgggc

SEQ ID NO: 7054999 - DNA, 22 bp, Homo sapiens
agaggacaggttttccatgggc

SEQ ID NO: 7055000 - DNA, 22 bp, Homo sapiens
agaggacaggttttccatgggc

SEQ ID NO: 7055001 - DNA, 22 bp, Homo sapiens
agaggagaatccgtttccttgc

SEQ ID NO: 7055002 - DNA, 22 bp, Homo sapiens
agaggaggaagagctttaaaat

SEQ ID NO: 7055003 - DNA, 20 bp, Homo sapiens
agaggaggattattttattc

SEQ ID NO: 7055004 - DNA, 22 bp, Homo sapiens
agaggaggatttgtaaaggtct

SEQ ID NO: 7055005 - DNA, 22 bp, Homo sapiens
atgtttatgacctccataagga

SEQ ID NO: 7055006 - DNA, 22 bp, Homo sapiens
atgtttagtcattcagctcctt

SEQ ID NO: 7055007 - DNA, 19 bp, Homo sapiens
atgtttacactcaggggct

SEQ ID NO: 7055008 - DNA, 22 bp, Homo sapiens
atgtttacaaaaaggaggcttg

SEQ ID NO: 7055009 - DNA, 22 bp, Homo sapiens
atgtttacaattcagtattaca

SEQ ID NO: 7055010 - DNA, 22 bp, Homo sapiens
atgtttatggagcaggtattag

SEQ ID NO: 7055011 - DNA, 22 bp, Homo sapiens
atgtttatggagcaggtattag

SEQ ID NO: 7055012 - DNA, 22 bp, Homo sapiens
atgtttatggagcaggtattag

SEQ ID NO: 7055013 - DNA, 22 bp, Homo sapiens
atgtttatgttgggctatattt

SEQ ID NO: 7055014 - DNA, 22 bp, Homo sapiens
agaggacagacggaaagtgcca

SEQ ID NO: 7055015 - DNA, 22 bp, Homo sapiens
agaggacagagtgctggattta

SEQ ID NO: 7055016 - DNA, 22 bp, Homo sapiens
agaggacaggttttccatgggc

SEQ ID NO: 7055017 - DNA, 22 bp, Homo sapiens
agaggacaggttttccatgggc

SEQ ID NO: 7055018 - DNA, 22 bp, Homo sapiens
agagctggtttactcaggaatt

SEQ ID NO: 7055019 - DNA, 22 bp, Homo sapiens
agagctggtgcatattcagaaa

SEQ ID NO: 7055020 - DNA, 21 bp, Homo sapiens
agagctggtaggtaggtaggt

SEQ ID NO: 7055021 - DNA, 22 bp, Homo sapiens
agagctgggacttggactcaat

SEQ ID NO: 7055022 - DNA, 21 bp, Homo sapiens
agagctggtaggtaggtaggt

SEQ ID NO: 7055023 - DNA, 21 bp, Homo sapiens
agagctgggacttgcctgaga

SEQ ID NO: 7055024 - DNA, 22 bp, Homo sapiens
atgtgtacactggacttctgat

SEQ ID NO: 7055025 - DNA, 22 bp, Homo sapiens
agagctgtatccccttaccagt

SEQ ID NO: 7055026 - DNA, 22 bp, Homo sapiens
agctgaaggctagaacagctgg

SEQ ID NO: 7055027 - DNA, 22 bp, Homo sapiens
agctctggggtggagcccagga

SEQ ID NO: 7055028 - DNA, 22 bp, Homo sapiens
agctctgggtcacggctgccga

SEQ ID NO: 7055029 - DNA, 22 bp, Homo sapiens
agctggaggggccagcaggtgt

SEQ ID NO: 7055030 - DNA, 22 bp, Homo sapiens
acagctgggtgctgctcagagc

SEQ ID NO: 7055031 - DNA, 22 bp, Homo sapiens
acagctgtatccccagagctca

SEQ ID NO: 7055032 - DNA, 22 bp, Homo sapiens
agctgagaggtggcaagctgta

SEQ ID NO: 7055033 - DNA, 22 bp, Homo sapiens
acagctggcaggggggcatgaa

SEQ ID NO: 7055034 - DNA, 22 bp, Homo sapiens
acagctggcaggggggcatgaa

SEQ ID NO: 7055035 - DNA, 22 bp, Homo sapiens
acagctggccgaggctcaggga

SEQ ID NO: 7055036 - DNA, 22 bp, Homo sapiens
acaggagttaaggctgagttga

SEQ ID NO: 7055037 - DNA, 22 bp, Homo sapiens
agctggtggggaagctgcaggt

SEQ ID NO: 7055038 - DNA, 18 bp, Homo sapiens
agctggtggggagacagc

SEQ ID NO: 7055039 - DNA, 21 bp, Homo sapiens
agctggtgtcagagctctggg

SEQ ID NO: 7055040 - DNA, 22 bp, Homo sapiens
agctggtgtcctcctggagctg

SEQ ID NO: 7055041 - DNA, 22 bp, Homo sapiens
agctggtgtcctcctggagctg

SEQ ID NO: 7055042 - DNA, 22 bp, Homo sapiens
agctggtgtgccagttccagtt

SEQ ID NO: 7055043 - DNA, 22 bp, Homo sapiens
acaggcagagtcaggttgggtt

SEQ ID NO: 7055044 - DNA, 22 bp, Homo sapiens
acaggagaattatctggaacaa

SEQ ID NO: 7055045 - DNA, 22 bp, Homo sapiens
acaggaggggcatgaaagacgg

SEQ ID NO: 7055046 - DNA, 22 bp, Homo sapiens
acaggagtggagaggtgcctct

SEQ ID NO: 7055047 - DNA, 22 bp, Homo sapiens
agctggcacagaccaggagatc

SEQ ID NO: 7055048 - DNA, 22 bp, Homo sapiens
acagggaatggagggatcagta

SEQ ID NO: 7055049 - DNA, 22 bp, Homo sapiens
acaggcaggcttcggccagagc

SEQ ID NO: 7055050 - DNA, 22 bp, Homo sapiens
acaggcagggacctcttgagtt

SEQ ID NO: 7055051 - DNA, 22 bp, Homo sapiens
acaggcagggaccttggctaag

SEQ ID NO: 7055052 - DNA, 22 bp, Homo sapiens
acagggaagctcaggggctctg

SEQ ID NO: 7055053 - DNA, 22 bp, Homo sapiens
acaggctgttggggtccagggt

SEQ ID NO: 7055054 - DNA, 22 bp, Homo sapiens
acaggcagattaagggtaggca

SEQ ID NO: 7055055 - DNA, 22 bp, Homo sapiens
acaggcagattaagggtaggca

SEQ ID NO: 7055056 - DNA, 22 bp, Homo sapiens
acaggcagcaaaatcagcctca

SEQ ID NO: 7055057 - DNA, 22 bp, Homo sapiens
acaggcagcaaaatcagcctca

SEQ ID NO: 7055058 - DNA, 22 bp, Homo sapiens
acaggcaggagctccccattcc

SEQ ID NO: 7055059 - DNA, 22 bp, Homo sapiens
acaggcaggcgggacagcccga

SEQ ID NO: 7055060 - DNA, 22 bp, Homo sapiens
acaggcaggcgggacagcccga

SEQ ID NO: 7055061 - DNA, 22 bp, Homo sapiens
acaggcaggcttcggccagagc

SEQ ID NO: 7055062 - DNA, 22 bp, Homo sapiens
aggaagagcattcacatggtag

SEQ ID NO: 7055063 - DNA, 22 bp, Homo sapiens
aggaagagcattcacatggtag

SEQ ID NO: 7055064 - DNA, 22 bp, Homo sapiens
acagggctatattcctcagagt

SEQ ID NO: 7055065 - DNA, 23 bp, Homo sapiens
aggaagagagagtgcctctttct

SEQ ID NO: 7055066 - DNA, 22 bp, Homo sapiens
aggaagagcatctttgggtctg

SEQ ID NO: 7055067 - DNA, 22 bp, Homo sapiens
aggaagaacctaagaaagtctc

SEQ ID NO: 7055068 - DNA, 18 bp, Homo sapiens
acagggagggcgctgggg

SEQ ID NO: 7055069 - DNA, 22 bp, Homo sapiens
aggacacactgcaagagcctgg

SEQ ID NO: 7055070 - DNA, 22 bp, Homo sapiens
acaggggaatttactgtcatta

SEQ ID NO: 7055071 - DNA, 22 bp, Homo sapiens
acaggggacctaggaccctcgg

SEQ ID NO: 7055072 - DNA, 20 bp, Homo sapiens
acaggggcagcacaataatg

SEQ ID NO: 7055073 - DNA, 22 bp, Homo sapiens
acaggggcaggcaggacccttt

SEQ ID NO: 7055074 - DNA, 22 bp, Homo sapiens
acagtctgcatatgacctgtag

SEQ ID NO: 7055075 - DNA, 17 bp, Homo sapiens
acagtctgcctgacagt

SEQ ID NO: 7055076 - DNA, 22 bp, Homo sapiens
acagtctgcttgtctccatggt

SEQ ID NO: 7055077 - DNA, 22 bp, Homo sapiens
acagtctgcttgtctccatggt

SEQ ID NO: 7055078 - DNA, 22 bp, Homo sapiens
acagtctgcttgtctccatggt

SEQ ID NO: 7055079 - DNA, 22 bp, Homo sapiens
acagtctggaagcagggggcaa

SEQ ID NO: 7055080 - DNA, 22 bp, Homo sapiens
acagtgtggggtgagatggaac

SEQ ID NO: 7055081 - DNA, 22 bp, Homo sapiens
acagtgtggtttgagcactggg

SEQ ID NO: 7055082 - DNA, 22 bp, Homo sapiens
acagtgtgtgggaaatgtgact

SEQ ID NO: 7055083 - DNA, 22 bp, Homo sapiens
acagtctctccacactgcaggg

SEQ ID NO: 7055084 - DNA, 21 bp, Homo sapiens
acagtctccccagatctctcc

SEQ ID NO: 7055085 - DNA, 22 bp, Homo sapiens
acagtcctagctgcaaagaagt

SEQ ID NO: 7055086 - DNA, 22 bp, Homo sapiens
acagtcatagcagcctttgtta

SEQ ID NO: 7055087 - DNA, 22 bp, Homo sapiens
aggagcagaccgtagtcctgca

SEQ ID NO: 7055088 - DNA, 22 bp, Homo sapiens
aggagcagaccgtagtcctgca

SEQ ID NO: 7055089 - DNA, 22 bp, Homo sapiens
aggagcagaccgtagtcctgca

SEQ ID NO: 7055090 - DNA, 22 bp, Homo sapiens
acagtaaatcaacagaatatct

SEQ ID NO: 7055091 - DNA, 22 bp, Homo sapiens
aggagcagaactgattctgact

SEQ ID NO: 7055092 - DNA, 22 bp, Homo sapiens
aggagcagaactgttgtggagg

SEQ ID NO: 7055093 - DNA, 22 bp, Homo sapiens
aggagcagaatttaatgtgcag

SEQ ID NO: 7055094 - DNA, 21 bp, Homo sapiens
aggacacagagacacctattg

SEQ ID NO: 7055095 - DNA, 22 bp, Homo sapiens
aggacacagctcttcagtaaga

SEQ ID NO: 7055096 - DNA, 22 bp, Homo sapiens
aggacacaggtaagccagtgga

SEQ ID NO: 7055097 - DNA, 22 bp, Homo sapiens
acatattaactgcactacacta

SEQ ID NO: 7055098 - DNA, 23 bp, Homo sapiens
acatattgaatgctgagaatttt

SEQ ID NO: 7055099 - DNA, 22 bp, Homo sapiens
acatattgagctctaaaagtac

SEQ ID NO: 7055100 - DNA, 22 bp, Homo sapiens
aggcagctgccctctccttcct

SEQ ID NO: 7055101 - DNA, 22 bp, Homo sapiens
acatagaacttcccagtgagca

SEQ ID NO: 7055102 - DNA, 22 bp, Homo sapiens
acatagaacttcccagtgagca

SEQ ID NO: 7055103 - DNA, 22 bp, Homo sapiens
acatagaacttcccagtgagca

SEQ ID NO: 7055104 - DNA, 22 bp, Homo sapiens
acatagaaggaagagtagtagg

SEQ ID NO: 7055105 - DNA, 22 bp, Homo sapiens
acatagaaggaagagtagtagg

SEQ ID NO: 7055106 - DNA, 22 bp, Homo sapiens
acatagaagtgatgcttatcca

SEQ ID NO: 7055107 - DNA, 20 bp, Homo sapiens
acatagatcagtgattgaca

SEQ ID NO: 7055108 - DNA, 22 bp, Homo sapiens
acagtttaggatgagagaacac

SEQ ID NO: 7055109 - DNA, 22 bp, Homo sapiens
acagtttagagcatgatgacca

SEQ ID NO: 7055110 - DNA, 20 bp, Homo sapiens
acagtttatccagttagcag

SEQ ID NO: 7055111 - DNA, 22 bp, Homo sapiens
acagtttatcgattcacctacc

SEQ ID NO: 7055112 - DNA, 22 bp, Homo sapiens
aggatgagccgcgcaagctgac

SEQ ID NO: 7055113 - DNA, 22 bp, Homo sapiens
aggatgaggctggacacttctt

SEQ ID NO: 7055114 - DNA, 22 bp, Homo sapiens
aggatgaggctggcaggtcttg

SEQ ID NO: 7055115 - DNA, 20 bp, Homo sapiens
aggatgcagggagtctgcag

SEQ ID NO: 7055116 - DNA, 22 bp, Homo sapiens
aggatgagagatacatggagca

SEQ ID NO: 7055117 - DNA, 22 bp, Homo sapiens
aggatgagattccagggtcaat

SEQ ID NO: 7055118 - DNA, 22 bp, Homo sapiens
aggatgagattgctgtgttgta

SEQ ID NO: 7055119 - DNA, 21 bp, Homo sapiens
acagtttattagagtaagtgc

SEQ ID NO: 7055120 - DNA, 22 bp, Homo sapiens
aggcactgcttctaagtaggaa

SEQ ID NO: 7055121 - DNA, 18 bp, Homo sapiens
aggcactggaattaaggg

SEQ ID NO: 7055122 - DNA, 20 bp, Homo sapiens
aggcactggatttcttatat

SEQ ID NO: 7055123 - DNA, 22 bp, Homo sapiens
aggcactgggaatatgctgagg

SEQ ID NO: 7055124 - DNA, 20 bp, Homo sapiens
aggcactggggataggtaag

SEQ ID NO: 7055125 - DNA, 22 bp, Homo sapiens
aggcactgggggatgagcaagg

SEQ ID NO: 7055126 - DNA, 22 bp, Homo sapiens
aggcactgggtaattagtagct

SEQ ID NO: 7055127 - DNA, 22 bp, Homo sapiens
acatttcttttcatctctatat

SEQ ID NO: 7055128 - DNA, 22 bp, Homo sapiens
aggctgaggagggatgttgctt

SEQ ID NO: 7055129 - DNA, 22 bp, Homo sapiens
aggctgaggatccctgtgttct

SEQ ID NO: 7055130 - DNA, 22 bp, Homo sapiens
acatttctttctattcagtagc

SEQ ID NO: 7055131 - DNA, 22 bp, Homo sapiens
acatttctttctattcagtagc

SEQ ID NO: 7055132 - DNA, 22 bp, Homo sapiens
aggctgaggagggatgttgctt

SEQ ID NO: 7055133 - DNA, 22 bp, Homo sapiens
aggctgagctggtagtgagtac

SEQ ID NO: 7055134 - DNA, 22 bp, Homo sapiens
aggctgaggagggatgttgctt

SEQ ID NO: 7055135 - DNA, 22 bp, Homo sapiens
aggctgagctggtagtgagtac

SEQ ID NO: 7055136 - DNA, 22 bp, Homo sapiens
aggctgagctggtagtgagtac

SEQ ID NO: 7055137 - DNA, 22 bp, Homo sapiens
aggctgagctggtagtgagtac

SEQ ID NO: 7055138 - DNA, 22 bp, Homo sapiens
aggctgagctggcccttgaaat

SEQ ID NO: 7055139 - DNA, 22 bp, Homo sapiens
aggctgagctggcccttgaaat

SEQ ID NO: 7055140 - DNA, 22 bp, Homo sapiens
aggctgagctggcccttgaaat

SEQ ID NO: 7055141 - DNA, 22 bp, Homo sapiens
aggctgagctggcccttgaaat

SEQ ID NO: 7055142 - DNA, 22 bp, Homo sapiens
acatttgaaattctgaacagat

SEQ ID NO: 7055143 - DNA, 22 bp, Homo sapiens
acatttgacatttagtatcagc

SEQ ID NO: 7055144 - DNA, 22 bp, Homo sapiens
acatttgacatttagtatcagc

SEQ ID NO: 7055145 - DNA, 22 bp, Homo sapiens
acatttgactgtagatacttgc

SEQ ID NO: 7055146 - DNA, 22 bp, Homo sapiens
acatttgataattataaagaca

SEQ ID NO: 7055147 - DNA, 22 bp, Homo sapiens
acatttggcaagaaagagaaac

SEQ ID NO: 7055148 - DNA, 22 bp, Homo sapiens
acattgatgtgatgcagaagtg

SEQ ID NO: 7055149 - DNA, 22 bp, Homo sapiens
aggctgagactgtgcattagtg

SEQ ID NO: 7055150 - DNA, 22 bp, Homo sapiens
aggctgagactgtgcattagtg

SEQ ID NO: 7055151 - DNA, 22 bp, Homo sapiens
aggctgagaaagtgggaagatg

SEQ ID NO: 7055152 - DNA, 22 bp, Homo sapiens
aggctgagactgtgcattagtg

SEQ ID NO: 7055153 - DNA, 22 bp, Homo sapiens
aggctgagaaagtgggaagatg

SEQ ID NO: 7055154 - DNA, 22 bp, Homo sapiens
aggctgagaaagtgggaagatg

SEQ ID NO: 7055155 - DNA, 22 bp, Homo sapiens
aggctgagaaagtgggaagatg

SEQ ID NO: 7055156 - DNA, 22 bp, Homo sapiens
aggctgagaaagtgggaagatg

SEQ ID NO: 7055157 - DNA, 22 bp, Homo sapiens
aggctgaaaacgagatggcaat

SEQ ID NO: 7055158 - DNA, 22 bp, Homo sapiens
aggctgaaaacgagatggcaat

SEQ ID NO: 7055159 - DNA, 22 bp, Homo sapiens
acattgctgcattctccttccc

SEQ ID NO: 7055160 - DNA, 19 bp, Homo sapiens
acattggacatggatcttg

SEQ ID NO: 7055161 - DNA, 22 bp, Homo sapiens
acatttcactgttcacagcagg

SEQ ID NO: 7055162 - DNA, 22 bp, Homo sapiens
acatttctaatttaatgtaaca

SEQ ID NO: 7055163 - DNA, 22 bp, Homo sapiens
acatttctagttgttcatctcc

SEQ ID NO: 7055164 - DNA, 22 bp, Homo sapiens
acatttctagttgttcatctcc

SEQ ID NO: 7055165 - DNA, 22 bp, Homo sapiens
aggcctcttgtcttcctcacat

SEQ ID NO: 7055166 - DNA, 22 bp, Homo sapiens
aggcctgagccccaggtttgtt

SEQ ID NO: 7055167 - DNA, 22 bp, Homo sapiens
aggcctctgggtctcctctgac

SEQ ID NO: 7055168 - DNA, 22 bp, Homo sapiens
aggccaggcgagacacccggct

SEQ ID NO: 7055169 - DNA, 22 bp, Homo sapiens
aggccagggcactgctctttag

SEQ ID NO: 7055170 - DNA, 22 bp, Homo sapiens
aggccagggccagattagccac

SEQ ID NO: 7055171 - DNA, 22 bp, Homo sapiens
aggccaggggtgagcacttctg

SEQ ID NO: 7055172 - DNA, 22 bp, Homo sapiens
aggccaggggtgagcacttctg

SEQ ID NO: 7055173 - DNA, 22 bp, Homo sapiens
acatgttaaacatcatggaatg

SEQ ID NO: 7055174 - DNA, 22 bp, Homo sapiens
acatgttagaaatgcagaatct

SEQ ID NO: 7055175 - DNA, 22 bp, Homo sapiens
acatattttgaaagctttctaa

SEQ ID NO: 7055176 - DNA, 22 bp, Homo sapiens
acatcagagggctcacatgatc

SEQ ID NO: 7055177 - DNA, 22 bp, Homo sapiens
acatcattgtccgttgtcatga

SEQ ID NO: 7055178 - DNA, 22 bp, Homo sapiens
acatcatttctagttcctgtca

SEQ ID NO: 7055179 - DNA, 22 bp, Homo sapiens
acatgccagcctcagcagcagt

SEQ ID NO: 7055180 - DNA, 22 bp, Homo sapiens
acatgctatgagagattacttc

SEQ ID NO: 7055181 - DNA, 22 bp, Homo sapiens
aggccaggcctttctccattcc

SEQ ID NO: 7055182 - DNA, 22 bp, Homo sapiens
agggcagcagcggcccaggcct

SEQ ID NO: 7055183 - DNA, 22 bp, Homo sapiens
agggcagcaatgcagctgctgc

SEQ ID NO: 7055184 - DNA, 22 bp, Homo sapiens
agggcagcacaaggcatggact

SEQ ID NO: 7055185 - DNA, 22 bp, Homo sapiens
agggcagcacaaggcatggact

SEQ ID NO: 7055186 - DNA, 22 bp, Homo sapiens
agggcagcacaaggcatggact

SEQ ID NO: 7055187 - DNA, 22 bp, Homo sapiens
agggcagcaatgcagctgctgc

SEQ ID NO: 7055188 - DNA, 22 bp, Homo sapiens
accagcctggccaacatggcaa

SEQ ID NO: 7055189 - DNA, 22 bp, Homo sapiens
accagagctggctctgagcacc

SEQ ID NO: 7055190 - DNA, 20 bp, Homo sapiens
aggcttggcttggcaggaac

SEQ ID NO: 7055191 - DNA, 22 bp, Homo sapiens
aggcttgtggattggagcgagt

SEQ ID NO: 7055192 - DNA, 22 bp, Homo sapiens
aggctttaagcaagcatattgt

SEQ ID NO: 7055193 - DNA, 22 bp, Homo sapiens
aggctttaagtggcctacagct

SEQ ID NO: 7055194 - DNA, 22 bp, Homo sapiens
aggctttaattatctacaggag

SEQ ID NO: 7055195 - DNA, 22 bp, Homo sapiens
agggagacaaaagcagctgcca

SEQ ID NO: 7055196 - DNA, 22 bp, Homo sapiens
agggagacaaaagcagctgcca

SEQ ID NO: 7055197 - DNA, 22 bp, Homo sapiens
acccagctaaccctaccctgga

SEQ ID NO: 7055198 - DNA, 20 bp, Homo sapiens
acccagctctgtgccctggg

SEQ ID NO: 7055199 - DNA, 22 bp, Homo sapiens
agggctgacagtgaggagtcaa

SEQ ID NO: 7055200 - DNA, 22 bp, Homo sapiens
agggctgcccagtgtgagagct

SEQ ID NO: 7055201 - DNA, 22 bp, Homo sapiens
accaggctggagtgcagtggcg

SEQ ID NO: 7055202 - DNA, 22 bp, Homo sapiens
accaggctggagtgcagtggcg

SEQ ID NO: 7055203 - DNA, 22 bp, Homo sapiens
accaggctggagtgcagtggcg

SEQ ID NO: 7055204 - DNA, 22 bp, Homo sapiens
accaggctgtgaagtgagacta

SEQ ID NO: 7055205 - DNA, 22 bp, Homo sapiens
accaggctgtgaagtgagacta

SEQ ID NO: 7055206 - DNA, 22 bp, Homo sapiens
acccagataaatgacagggctt

SEQ ID NO: 7055207 - DNA, 22 bp, Homo sapiens
agggctgctgaggaagccttgc

SEQ ID NO: 7055208 - DNA, 22 bp, Homo sapiens
acccaggctggagtgcagtgat

SEQ ID NO: 7055209 - DNA, 22 bp, Homo sapiens
agggctgctcctccttcaggcc

SEQ ID NO: 7055210 - DNA, 19 bp, Homo sapiens
agggctgctctggcctggg

SEQ ID NO: 7055211 - DNA, 22 bp, Homo sapiens
agggctgcctgactccagagcc

SEQ ID NO: 7055212 - DNA, 22 bp, Homo sapiens
agggctgcctgactccagagcc

SEQ ID NO: 7055213 - DNA, 22 bp, Homo sapiens
acccaggctggagtgcagtggc

SEQ ID NO: 7055214 - DNA, 22 bp, Homo sapiens
acccaggctggagtgcagtggg

SEQ ID NO: 7055215 - DNA, 22 bp, Homo sapiens
acccaggctggagtgcagtggt

SEQ ID NO: 7055216 - DNA, 22 bp, Homo sapiens
acccaggctggagtgcagtgtc

SEQ ID NO: 7055217 - DNA, 22 bp, Homo sapiens
acccaggctggcgtgcagtggc

SEQ ID NO: 7055218 - DNA, 22 bp, Homo sapiens
agggggaggctgtgctgcgtct

SEQ ID NO: 7055219 - DNA, 22 bp, Homo sapiens
agggggaggctgtgctgcgtct

SEQ ID NO: 7055220 - DNA, 22 bp, Homo sapiens
actgtgagtgatttccttctgg

SEQ ID NO: 7055221 - DNA, 22 bp, Homo sapiens
ataaaatggtaaacgaagctga

SEQ ID NO: 7055222 - DNA, 22 bp, Homo sapiens
ataaaatttgctactgttaaat

SEQ ID NO: 7055223 - DNA, 22 bp, Homo sapiens
ataaaatttgctactgttaaat

SEQ ID NO: 7055224 - DNA, 22 bp, Homo sapiens
ataaggttggtcttaactacct

SEQ ID NO: 7055225 - DNA, 22 bp, Homo sapiens
ataatcttgtatttcctaaagt

SEQ ID NO: 7055226 - DNA, 22 bp, Homo sapiens
ataatgcacctttgagtatggc

SEQ ID NO: 7055227 - DNA, 22 bp, Homo sapiens
actgtattctagtcatgtttgt

SEQ ID NO: 7055228 - DNA, 22 bp, Homo sapiens
actgtattttgggtgtattttc

SEQ ID NO: 7055229 - DNA, 22 bp, Homo sapiens
actgtaaattttggttgcaggt

SEQ ID NO: 7055230 - DNA, 22 bp, Homo sapiens
actgtagctgccactggatgca

SEQ ID NO: 7055231 - DNA, 22 bp, Homo sapiens
actgggaagagagaattctgtc

SEQ ID NO: 7055232 - DNA, 22 bp, Homo sapiens
atacaggtgtacacacatgcaa

SEQ ID NO: 7055233 - DNA, 22 bp, Homo sapiens
atacaggtggacttcagttagt

SEQ ID NO: 7055234 - DNA, 22 bp, Homo sapiens
atacaggttctctagggaacag

SEQ ID NO: 7055235 - DNA, 22 bp, Homo sapiens
atacagtaaccacattctatag

SEQ ID NO: 7055236 - DNA, 22 bp, Homo sapiens
atacagattgctatacttacaa

SEQ ID NO: 7055237 - DNA, 22 bp, Homo sapiens
atacagcagtgaataagataaa

SEQ ID NO: 7055238 - DNA, 22 bp, Homo sapiens
atacagcttacagttctaatgc

SEQ ID NO: 7055239 - DNA, 22 bp, Homo sapiens
atacagcttatgcatatatctc

SEQ ID NO: 7055240 - DNA, 22 bp, Homo sapiens
atacagctttctttcacatgag

SEQ ID NO: 7055241 - DNA, 22 bp, Homo sapiens
atacaggtaatttgaataatag

SEQ ID NO: 7055242 - DNA, 22 bp, Homo sapiens
atacaggtaggggacatacatc

SEQ ID NO: 7055243 - DNA, 22 bp, Homo sapiens
atacacttgtacattttttaat

SEQ ID NO: 7055244 - DNA, 22 bp, Homo sapiens
atacagatgttaaagcaatttc

SEQ ID NO: 7055245 - DNA, 22 bp, Homo sapiens
acttaacagacattatttacct

SEQ ID NO: 7055246 - DNA, 22 bp, Homo sapiens
ataatgcatttagaataattca

SEQ ID NO: 7055247 - DNA, 22 bp, Homo sapiens
ataatgcatttagaataattca

SEQ ID NO: 7055248 - DNA, 22 bp, Homo sapiens
atacattagctcatatgattaa

SEQ ID NO: 7055249 - DNA, 22 bp, Homo sapiens
atacatgttgtaccatatgttt

SEQ ID NO: 7055250 - DNA, 22 bp, Homo sapiens
acttcttgggaccctggcaccg

SEQ ID NO: 7055251 - DNA, 22 bp, Homo sapiens
atacatgttgagaaaatatctg

SEQ ID NO: 7055252 - DNA, 22 bp, Homo sapiens
acttctggtgtcatactgcatt

SEQ ID NO: 7055253 - DNA, 22 bp, Homo sapiens
acttctgtatgtcctgcattca

SEQ ID NO: 7055254 - DNA, 22 bp, Homo sapiens
acttctgtcctccaagccacgt

SEQ ID NO: 7055255 - DNA, 22 bp, Homo sapiens
atatggaaatagcaatatggtt

SEQ ID NO: 7055256 - DNA, 22 bp, Homo sapiens
atatggaactattctgtgtaga

SEQ ID NO: 7055257 - DNA, 22 bp, Homo sapiens
atatggaagttacctgacttca

SEQ ID NO: 7055258 - DNA, 18 bp, Homo sapiens
atatggaatgcctggcta

SEQ ID NO: 7055259 - DNA, 22 bp, Homo sapiens
actttctattcccacagagata

SEQ ID NO: 7055260 - DNA, 22 bp, Homo sapiens
actttctattcccacagagata

SEQ ID NO: 7055261 - DNA, 22 bp, Homo sapiens
actttcctggccctgtcctctg

SEQ ID NO: 7055262 - DNA, 22 bp, Homo sapiens
actttcctagacttcagtgaca

SEQ ID NO: 7055263 - DNA, 22 bp, Homo sapiens
actttcatttgtaataaacttc

SEQ ID NO: 7055264 - DNA, 22 bp, Homo sapiens
actttcaagccctctagagaca

SEQ ID NO: 7055265 - DNA, 22 bp, Homo sapiens
actttcaagccctctagagaca

SEQ ID NO: 7055266 - DNA, 22 bp, Homo sapiens
atatttataaggcaggcaagta

SEQ ID NO: 7055267 - DNA, 22 bp, Homo sapiens
atatttcatggggttccatact

SEQ ID NO: 7055268 - DNA, 23 bp, Homo sapiens
atatttccaggttagtgaggtaa

SEQ ID NO: 7055269 - DNA, 21 bp, Homo sapiens
atatttctcataaggttatgg

SEQ ID NO: 7055270 - DNA, 22 bp, Homo sapiens
atatttataagcaagcaggact

SEQ ID NO: 7055271 - DNA, 22 bp, Homo sapiens
atattcttccaaaacatcattt

SEQ ID NO: 7055272 - DNA, 22 bp, Homo sapiens
atatttataagcaagcaggact

SEQ ID NO: 7055273 - DNA, 22 bp, Homo sapiens
atatttataaggcaggcaagta

SEQ ID NO: 7055274 - DNA, 22 bp, Homo sapiens
atattcttccaaaacatcattt

SEQ ID NO: 7055275 - DNA, 22 bp, Homo sapiens
atattcttccaaaacatcattt

SEQ ID NO: 7055276 - DNA, 22 bp, Homo sapiens
atattcttatccttttctctgt

SEQ ID NO: 7055277 - DNA, 22 bp, Homo sapiens
atattcttatccttttctctgt

SEQ ID NO: 7055278 - DNA, 22 bp, Homo sapiens
atattcttatccttttctctgt

SEQ ID NO: 7055279 - DNA, 22 bp, Homo sapiens
atattcattgaacacctactac

SEQ ID NO: 7055280 - DNA, 22 bp, Homo sapiens
atattacacacggtatcacggg

SEQ ID NO: 7055281 - DNA, 22 bp, Homo sapiens
atattacataaacatgagtgaa

SEQ ID NO: 7055282 - DNA, 22 bp, Homo sapiens
atattctgcctcactacagttg

SEQ ID NO: 7055283 - DNA, 22 bp, Homo sapiens
atattctctgctgcttttgtgt

SEQ ID NO: 7055284 - DNA, 21 bp, Homo sapiens
agaaaagtatttgaatcaaga

SEQ ID NO: 7055285 - DNA, 22 bp, Homo sapiens
agaaaagttttctgagactgac

SEQ ID NO: 7055286 - DNA, 22 bp, Homo sapiens
agaaagtttattcctatctagc

SEQ ID NO: 7055287 - DNA, 22 bp, Homo sapiens
agaaagtttatttcttgatgga

SEQ ID NO: 7055288 - DNA, 22 bp, Homo sapiens
agaaagtttgagaactgtagat

SEQ ID NO: 7055289 - DNA, 22 bp, Homo sapiens
agaaagtttgagaactgtagat

SEQ ID NO: 7055290 - DNA, 22 bp, Homo sapiens
agaaagtttggggctgggcacg

SEQ ID NO: 7055291 - DNA, 23 bp, Homo sapiens
agaaagtttgtgccttgtgacac

SEQ ID NO: 7055292 - DNA, 22 bp, Homo sapiens
agaaagttgttggaggaaatga

SEQ ID NO: 7055293 - DNA, 22 bp, Homo sapiens
agaaagttgttttagccaaacc

SEQ ID NO: 7055294 - DNA, 22 bp, Homo sapiens
agaaagttctgtgagttgttca

SEQ ID NO: 7055295 - DNA, 22 bp, Homo sapiens
agaaagttatcacaaaattgag

SEQ ID NO: 7055296 - DNA, 22 bp, Homo sapiens
agaaagttcactggtatatttt

SEQ ID NO: 7055297 - DNA, 22 bp, Homo sapiens
agaaagttagcagactcttggc

SEQ ID NO: 7055298 - DNA, 22 bp, Homo sapiens
agaaagttagcagactcttggc

SEQ ID NO: 7055299 - DNA, 22 bp, Homo sapiens
agaaagttaaacagtgataaga

SEQ ID NO: 7055300 - DNA, 22 bp, Homo sapiens
agaaagttaaacagtgataaga

SEQ ID NO: 7055301 - DNA, 22 bp, Homo sapiens
agaaagggtcactgaaagagga

SEQ ID NO: 7055302 - DNA, 22 bp, Homo sapiens
agaaagggttctctgaggtgct

SEQ ID NO: 7055303 - DNA, 22 bp, Homo sapiens
agaaaggtcaaaatcgtgacat

SEQ ID NO: 7055304 - DNA, 22 bp, Homo sapiens
agaaaggtcacttagcctcagc

SEQ ID NO: 7055305 - DNA, 22 bp, Homo sapiens
agaaaggtggatgctctggaat

SEQ ID NO: 7055306 - DNA, 23 bp, Homo sapiens
agaaagtcatggccaggtttgat

SEQ ID NO: 7055307 - DNA, 22 bp, Homo sapiens
atctcaaagcatggagcagaat

SEQ ID NO: 7055308 - DNA, 21 bp, Homo sapiens
atctcacagcccagagaagcc

SEQ ID NO: 7055309 - DNA, 21 bp, Homo sapiens
atctcacagcccagagaagcc

SEQ ID NO: 7055310 - DNA, 22 bp, Homo sapiens
atcggggaaaagggaggctgtg

SEQ ID NO: 7055311 - DNA, 22 bp, Homo sapiens
atcatcttgctttctgtttact

SEQ ID NO: 7055312 - DNA, 22 bp, Homo sapiens
atcatcttaaatctagaatgtg

SEQ ID NO: 7055313 - DNA, 22 bp, Homo sapiens
atcatcttaaggtatctcaagc

SEQ ID NO: 7055314 - DNA, 22 bp, Homo sapiens
atcatcttcgaaaaaagtcaga

SEQ ID NO: 7055315 - DNA, 22 bp, Homo sapiens
atcatcttgaaagtctatgttt

SEQ ID NO: 7055316 - DNA, 22 bp, Homo sapiens
agaacagggactggaggcttca

SEQ ID NO: 7055317 - DNA, 22 bp, Homo sapiens
atcatccaagcgtagttcttct

SEQ ID NO: 7055318 - DNA, 22 bp, Homo sapiens
atcatccatggctgatcataaa

SEQ ID NO: 7055319 - DNA, 19 bp, Homo sapiens
agtcttgtatttttcaagc

SEQ ID NO: 7055320 - DNA, 22 bp, Homo sapiens
agtcttgtcttattttaataga

SEQ ID NO: 7055321 - DNA, 23 bp, Homo sapiens
actcgtggaattctctgcgatcg

SEQ ID NO: 7055322 - DNA, 22 bp, Homo sapiens
agtcttcttgatcttttcagtg

SEQ ID NO: 7055323 - DNA, 22 bp, Homo sapiens
agtcttctttcatttactcagt

SEQ ID NO: 7055324 - DNA, 22 bp, Homo sapiens
agtcttgcattttctgaagatg

SEQ ID NO: 7055325 - DNA, 22 bp, Homo sapiens
agtcttgctcttgcatctgctt

SEQ ID NO: 7055326 - DNA, 22 bp, Homo sapiens
agtcccagcttcccccatgcag

SEQ ID NO: 7055327 - DNA, 22 bp, Homo sapiens
agtcccaggcagccgagccggt

SEQ ID NO: 7055328 - DNA, 19 bp, Homo sapiens
agtcccaggcccgaaagag

SEQ ID NO: 7055329 - DNA, 21 bp, Homo sapiens
agtcccaggggtgagtgatgt

SEQ ID NO: 7055330 - DNA, 22 bp, Homo sapiens
agtcccagtgacttggccagaa

SEQ ID NO: 7055331 - DNA, 22 bp, Homo sapiens
agtcccagtgagatgaaccagg

SEQ ID NO: 7055332 - DNA, 22 bp, Homo sapiens
agtcccagtgagatgagccacg

SEQ ID NO: 7055333 - DNA, 22 bp, Homo sapiens
agtcccagttcggttcttcctc

SEQ ID NO: 7055334 - DNA, 21 bp, Homo sapiens
actctgtcttgagccatctgt

SEQ ID NO: 7055335 - DNA, 22 bp, Homo sapiens
agtgcagtggttaggagccagg

SEQ ID NO: 7055336 - DNA, 22 bp, Homo sapiens
agtgcatatatgaagagtatga

SEQ ID NO: 7055337 - DNA, 22 bp, Homo sapiens
agtgcatgccttcctgtggatg

SEQ ID NO: 7055338 - DNA, 22 bp, Homo sapiens
actgagctcttgactgggagtt

SEQ ID NO: 7055339 - DNA, 20 bp, Homo sapiens
actgagctgcatggagagga

SEQ ID NO: 7055340 - DNA, 22 bp, Homo sapiens
actgaggaacatatataagatg

SEQ ID NO: 7055341 - DNA, 22 bp, Homo sapiens
actgaggattagcccaggctag

SEQ ID NO: 7055342 - DNA, 20 bp, Homo sapiens
agtgtacagacactagaaat

SEQ ID NO: 7055343 - DNA, 22 bp, Homo sapiens
agtgtagggtggtcagagcaga

SEQ ID NO: 7055344 - DNA, 21 bp, Homo sapiens
agtggggtctctgtggaggcc

SEQ ID NO: 7055345 - DNA, 21 bp, Homo sapiens
agtggggtctctgtggaggcc

SEQ ID NO: 7055346 - DNA, 22 bp, Homo sapiens
agtggcagtggctgggcagagc

SEQ ID NO: 7055347 - DNA, 22 bp, Homo sapiens
agtggcagtagatgagctggtt

SEQ ID NO: 7055348 - DNA, 20 bp, Homo sapiens
agtgtttagaatactattat

SEQ ID NO: 7055349 - DNA, 22 bp, Homo sapiens
actggctttgcctctgcctctc

SEQ ID NO: 7055350 - DNA, 22 bp, Homo sapiens
actgggaaaaactgctttgagg

SEQ ID NO: 7055351 - DNA, 22 bp, Homo sapiens
agtgttgcatgaggcagtacca

SEQ ID NO: 7055352 - DNA, 21 bp, Homo sapiens
agtgtaggtcattagctgttg

SEQ ID NO: 7055353 - DNA, 20 bp, Homo sapiens
agtgtatgaatctggatggg

SEQ ID NO: 7055354 - DNA, 22 bp, Homo sapiens
actgctttatctgagaagtcct

SEQ ID NO: 7055355 - DNA, 22 bp, Homo sapiens
actgctttatctgagaagtcct

SEQ ID NO: 7055356 - DNA, 22 bp, Homo sapiens
actggaaaacactactacatgc

SEQ ID NO: 7055357 - DNA, 22 bp, Homo sapiens
actggaaatgagatgatatcag

SEQ ID NO: 7055358 - DNA, 21 bp, Homo sapiens
actggaagtgggtcaggaagt

SEQ ID NO: 7055359 - DNA, 22 bp, Homo sapiens
agtgtgtgaccttttaatttaa

SEQ ID NO: 7055360 - DNA, 22 bp, Homo sapiens
acctctttgaacctcagtgtga

SEQ ID NO: 7055361 - DNA, 22 bp, Homo sapiens
acctgaaaccaacttgtgtact

SEQ ID NO: 7055362 - DNA, 22 bp, Homo sapiens
accctcccatttccatgtagca

SEQ ID NO: 7055363 - DNA, 22 bp, Homo sapiens
accctccccaagaggtcgtgcc

SEQ ID NO: 7055364 - DNA, 19 bp, Homo sapiens
accctctcagtgcctgagg

SEQ ID NO: 7055365 - DNA, 19 bp, Homo sapiens
accctctccccactgggtc

SEQ ID NO: 7055366 - DNA, 19 bp, Homo sapiens
accctctccccactgggtc

SEQ ID NO: 7055367 - DNA, 22 bp, Homo sapiens
accctctgagaggcacactttg

SEQ ID NO: 7055368 - DNA, 19 bp, Homo sapiens
accctctgccacaagcctc

SEQ ID NO: 7055369 - DNA, 22 bp, Homo sapiens
acctgaggcctccccagcagac

SEQ ID NO: 7055370 - DNA, 22 bp, Homo sapiens
acctgagacctaatctgactgt

SEQ ID NO: 7055371 - DNA, 22 bp, Homo sapiens
acctgaggctgttagtctaggt

SEQ ID NO: 7055372 - DNA, 22 bp, Homo sapiens
acctgagggcccaaacttggta

SEQ ID NO: 7055373 - DNA, 22 bp, Homo sapiens
acctgcaggggtgctctctggg

SEQ ID NO: 7055374 - DNA, 22 bp, Homo sapiens
aggtctcaatctcaggtggtca

SEQ ID NO: 7055375 - DNA, 22 bp, Homo sapiens
aggtcgagtttcggggctactt

SEQ ID NO: 7055376 - DNA, 22 bp, Homo sapiens
aggtctcactttgtggaagtga

SEQ ID NO: 7055377 - DNA, 22 bp, Homo sapiens
aggtctcttgctgtctctgggc

SEQ ID NO: 7055378 - DNA, 18 bp, Homo sapiens
aggtggcctgggagcttt

SEQ ID NO: 7055379 - DNA, 22 bp, Homo sapiens
aggtggcatttacaccatggga

SEQ ID NO: 7055380 - DNA, 22 bp, Homo sapiens
acctggcataagggcttgagtc

SEQ ID NO: 7055381 - DNA, 22 bp, Homo sapiens
aggtggagatcagggactaagg

SEQ ID NO: 7055382 - DNA, 22 bp, Homo sapiens
agtcaaagatgaccgagttcct

SEQ ID NO: 7055383 - DNA, 22 bp, Homo sapiens
agtcaaagatgaccgagttcct

SEQ ID NO: 7055384 - DNA, 22 bp, Homo sapiens
actagggaaagttatgttcaca

SEQ ID NO: 7055385 - DNA, 22 bp, Homo sapiens
actaggggctcaggcccaggga

SEQ ID NO: 7055386 - DNA, 22 bp, Homo sapiens
agtcaacaaaaatgtggagcct

SEQ ID NO: 7055387 - DNA, 22 bp, Homo sapiens
agtcccagctcagaaccactag

SEQ ID NO: 7055388 - DNA, 22 bp, Homo sapiens
agtcccagctctgccacttact

SEQ ID NO: 7055389 - DNA, 22 bp, Homo sapiens
agtaaacagaaagcaagatgat

SEQ ID NO: 7055390 - DNA, 20 bp, Homo sapiens
aggtggctcctgctgggggt

SEQ ID NO: 7055391 - DNA, 22 bp, Homo sapiens
acgcagtttgtggacatttttt

SEQ ID NO: 7055392 - DNA, 22 bp, Homo sapiens
acgcccagactcccatactttg

SEQ ID NO: 7055393 - DNA, 22 bp, Homo sapiens
acggcaggctcagagctggaat

SEQ ID NO: 7055394 - DNA, 22 bp, Homo sapiens
acggcttcttgactgtgggttg

SEQ ID NO: 7055395 - DNA, 22 bp, Homo sapiens
aaacaagtgtaaactagtctgt

SEQ ID NO: 7055396 - DNA, 22 bp, Homo sapiens
aaacaatgaaatatttttatgg

SEQ ID NO: 7055397 - DNA, 22 bp, Homo sapiens
aaaatcagtacactttattttg

SEQ ID NO: 7055398 - DNA, 22 bp, Homo sapiens
aaagacatggcaagagatgggg

SEQ ID NO: 7055399 - DNA, 22 bp, Homo sapiens
aaagacattagattaacgtaca

SEQ ID NO: 7055400 - DNA, 22 bp, Homo sapiens
aaagacattagattaacgtaca

SEQ ID NO: 7055401 - DNA, 22 bp, Homo sapiens
aaagacattagcttagatgtca

SEQ ID NO: 7055402 - DNA, 22 bp, Homo sapiens
aaagacattgaagaaggactta

SEQ ID NO: 7055403 - DNA, 22 bp, Homo sapiens
aaaagtatggtggtccttttta

SEQ ID NO: 7055404 - DNA, 22 bp, Homo sapiens
aaaagtatggtggtccttttta

SEQ ID NO: 7055405 - DNA, 22 bp, Homo sapiens
aaaagtattggccaccatttct

SEQ ID NO: 7055406 - DNA, 22 bp, Homo sapiens
aaagaaggggtctacatccaat

SEQ ID NO: 7055407 - DNA, 22 bp, Homo sapiens
aaagaaggtagggctggtgact

SEQ ID NO: 7055408 - DNA, 22 bp, Homo sapiens
aaagacatggaactagagatgg

SEQ ID NO: 7055409 - DNA, 22 bp, Homo sapiens
aaactctagctactaggataac

SEQ ID NO: 7055410 - DNA, 22 bp, Homo sapiens
aaaagtactattttaacaaagt

SEQ ID NO: 7055411 - DNA, 22 bp, Homo sapiens
aaaagagaaagtggcaggcttt

SEQ ID NO: 7055412 - DNA, 22 bp, Homo sapiens
aaaagagaaagtggcaggcttt

SEQ ID NO: 7055413 - DNA, 22 bp, Homo sapiens
aaaagagaatcctgtacagaga

SEQ ID NO: 7055414 - DNA, 22 bp, Homo sapiens
aaaagagaatcctgtacagaga

SEQ ID NO: 7055415 - DNA, 22 bp, Homo sapiens
aaaagagaatcctgtacagaga

SEQ ID NO: 7055416 - DNA, 22 bp, Homo sapiens
aaaagagagctgaggagctcca

SEQ ID NO: 7055417 - DNA, 22 bp, Homo sapiens
aaaagagagctgaggagctcca

SEQ ID NO: 7055418 - DNA, 22 bp, Homo sapiens
aaaagagagttgccagtctgta

SEQ ID NO: 7055419 - DNA, 22 bp, Homo sapiens
aaaagagagttgccagtctgta

SEQ ID NO: 7055420 - DNA, 22 bp, Homo sapiens
aaaagagagttgccagtctgta

SEQ ID NO: 7055421 - DNA, 22 bp, Homo sapiens
aaacccagagactagaaagacc

SEQ ID NO: 7055422 - DNA, 19 bp, Homo sapiens
aaactcatagactcatatt

SEQ ID NO: 7055423 - DNA, 19 bp, Homo sapiens
aaactcatagactcatatt

SEQ ID NO: 7055424 - DNA, 22 bp, Homo sapiens
aaactcatgccattaatccttt

SEQ ID NO: 7055425 - DNA, 22 bp, Homo sapiens
aaaagagaaagtggcaggcttt

SEQ ID NO: 7055426 - DNA, 22 bp, Homo sapiens
aaacagagagatgtatgtggag

SEQ ID NO: 7055427 - DNA, 22 bp, Homo sapiens
aaacagagggccactgaggctc

SEQ ID NO: 7055428 - DNA, 22 bp, Homo sapiens
aaacactttagaaagggacttg

SEQ ID NO: 7055429 - DNA, 22 bp, Homo sapiens
aaaatgaataagttaacccagg

SEQ ID NO: 7055430 - DNA, 22 bp, Homo sapiens
aaaatgaataagttaacccagg

SEQ ID NO: 7055431 - DNA, 22 bp, Homo sapiens
aaaaatagcttctcttgtccct

SEQ ID NO: 7055432 - DNA, 22 bp, Homo sapiens
aaacacatcattcatgtcgtca

SEQ ID NO: 7055433 - DNA, 22 bp, Homo sapiens
aaaatcttgtgacttaggaagg

SEQ ID NO: 7055434 - DNA, 22 bp, Homo sapiens
aaaatgaacagaacaatgggga

SEQ ID NO: 7055435 - DNA, 20 bp, Homo sapiens
aaaaacagtaatgctgaaga

SEQ ID NO: 7055436 - DNA, 22 bp, Homo sapiens
aaaaaattatcatagttcctga

SEQ ID NO: 7055437 - DNA, 22 bp, Homo sapiens
aaagggctgtcaaataagcaac

SEQ ID NO: 7055438 - DNA, 22 bp, Homo sapiens
aaacagtttcattttcatgacc

SEQ ID NO: 7055439 - DNA, 22 bp, Homo sapiens
aaacagtttataacatgatact

SEQ ID NO: 7055440 - DNA, 22 bp, Homo sapiens
aaacaatgttcctatattagag

SEQ ID NO: 7055441 - DNA, 22 bp, Homo sapiens
aaacagcttgtaaggtgtaatt

SEQ ID NO: 7055442 - DNA, 22 bp, Homo sapiens
aaacagtgactggtacataata

SEQ ID NO: 7055443 - DNA, 22 bp, Homo sapiens
aaacaatgtagattaccattta

SEQ ID NO: 7055444 - DNA, 21 bp, Homo sapiens
aaagttcatgctttaatattc

SEQ ID NO: 7055445 - DNA, 22 bp, Homo sapiens
aaagttcactgaccagcactgg

SEQ ID NO: 7055446 - DNA, 22 bp, Homo sapiens
aaacctattggcaagaataata

SEQ ID NO: 7055447 - DNA, 22 bp, Homo sapiens
aaacattgtacattctgtagct

SEQ ID NO: 7055448 - DNA, 22 bp, Homo sapiens
aaacccagggttttgtcttccc

SEQ ID NO: 7055449 - DNA, 22 bp, Homo sapiens
aaaggtcttttttctaacacca

SEQ ID NO: 7055450 - DNA, 22 bp, Homo sapiens
aaattaagggtgagaagagttg

SEQ ID NO: 7055451 - DNA, 22 bp, Homo sapiens
aaattaagggtgagaagagttg

SEQ ID NO: 7055452 - DNA, 22 bp, Homo sapiens
aaattagaaatactttcaaagc

SEQ ID NO: 7055453 - DNA, 22 bp, Homo sapiens
aaattagaagtgctcaggaata

SEQ ID NO: 7055454 - DNA, 22 bp, Homo sapiens
aaattagaccagggctcctgga

SEQ ID NO: 7055455 - DNA, 22 bp, Homo sapiens
aaagagtctggcgttttaatgg

SEQ ID NO: 7055456 - DNA, 22 bp, Homo sapiens
aaagagttgaggcagttatcca

SEQ ID NO: 7055457 - DNA, 22 bp, Homo sapiens
aaattaagagtaactctgtaga

SEQ ID NO: 7055458 - DNA, 22 bp, Homo sapiens
aaatgcagaatgatttcatcta

SEQ ID NO: 7055459 - DNA, 22 bp, Homo sapiens
aaatgcagatccctgaatctca

SEQ ID NO: 7055460 - DNA, 22 bp, Homo sapiens
aaatgcagattcatgagcccca

SEQ ID NO: 7055461 - DNA, 22 bp, Homo sapiens
aaatgcagattgtcattcagga

SEQ ID NO: 7055462 - DNA, 22 bp, Homo sapiens
aaatgcagattgtcattcagga

SEQ ID NO: 7055463 - DNA, 22 bp, Homo sapiens
aaatgcagcagctaattgaaaa

SEQ ID NO: 7055464 - DNA, 22 bp, Homo sapiens
aaagaggatggagtagtcagct

SEQ ID NO: 7055465 - DNA, 22 bp, Homo sapiens
aaagaggatggagtagtcagct

SEQ ID NO: 7055466 - DNA, 22 bp, Homo sapiens
aaagaggcaatcaatgtagcaa

SEQ ID NO: 7055467 - DNA, 22 bp, Homo sapiens
aaagaggcaatcaatgtagcaa

SEQ ID NO: 7055468 - DNA, 22 bp, Homo sapiens
aaagaggcaggtgttactggaa

SEQ ID NO: 7055469 - DNA, 22 bp, Homo sapiens
aaagaggctcaaggtgggccag

SEQ ID NO: 7055470 - DNA, 22 bp, Homo sapiens
aaagaggctcaaggtgggccag

SEQ ID NO: 7055471 - DNA, 17 bp, Homo sapiens
aaactgaaaaattcact

SEQ ID NO: 7055472 - DNA, 22 bp, Homo sapiens
aaactctgttgagataatattt

SEQ ID NO: 7055473 - DNA, 22 bp, Homo sapiens
aaactgaattcaagtatccagt

SEQ ID NO: 7055474 - DNA, 21 bp, Homo sapiens
aaactgaccttgcctgagaca

SEQ ID NO: 7055475 - DNA, 21 bp, Homo sapiens
aaactgaccttgcctgagaca

SEQ ID NO: 7055476 - DNA, 22 bp, Homo sapiens
aaactgaggagttagactaggg

SEQ ID NO: 7055477 - DNA, 21 bp, Homo sapiens
aaactgaggcttcaagcagtg

SEQ ID NO: 7055478 - DNA, 22 bp, Homo sapiens
aaagaatactccttttgccttg

SEQ ID NO: 7055479 - DNA, 22 bp, Homo sapiens
aaagaatagcctttgtccaaat

SEQ ID NO: 7055480 - DNA, 22 bp, Homo sapiens
aaagaatagcctttgtccaaat

SEQ ID NO: 7055481 - DNA, 22 bp, Homo sapiens
aaagctgctgccaatcaggctt

SEQ ID NO: 7055482 - DNA, 22 bp, Homo sapiens
aaagctggcttttacaggggct

SEQ ID NO: 7055483 - DNA, 22 bp, Homo sapiens
aaagctttctagctatgttcta

SEQ ID NO: 7055484 - DNA, 22 bp, Homo sapiens
aacagcagaaactgcaagctac

SEQ ID NO: 7055485 - DNA, 22 bp, Homo sapiens
aacagcagaaactgcaagctac

SEQ ID NO: 7055486 - DNA, 22 bp, Homo sapiens
aacagcagcaagtaagcaggtc

SEQ ID NO: 7055487 - DNA, 22 bp, Homo sapiens
aacagatataggcagaactttg

SEQ ID NO: 7055488 - DNA, 22 bp, Homo sapiens
aaagccatgaatgttatagagg

SEQ ID NO: 7055489 - DNA, 22 bp, Homo sapiens
aaagccacgtggcctggggagc

SEQ ID NO: 7055490 - DNA, 22 bp, Homo sapiens
aaagccactgcatgtgtagtat

SEQ ID NO: 7055491 - DNA, 22 bp, Homo sapiens
aaagatcagaggatagctgagt

SEQ ID NO: 7055492 - DNA, 22 bp, Homo sapiens
aaagatcaatagataaagctac

SEQ ID NO: 7055493 - DNA, 22 bp, Homo sapiens
aaagatcaatagataaagctac

SEQ ID NO: 7055494 - DNA, 22 bp, Homo sapiens
aaagccagtggtatgagagaaa

SEQ ID NO: 7055495 - DNA, 22 bp, Homo sapiens
aaagccagttcttagagaaagc

SEQ ID NO: 7055496 - DNA, 22 bp, Homo sapiens
aaagccagttcttttatattgg

SEQ ID NO: 7055497 - DNA, 22 bp, Homo sapiens
aaagccataagcctaatactaa

SEQ ID NO: 7055498 - DNA, 22 bp, Homo sapiens
aaagccatcagtaaaatgattt

SEQ ID NO: 7055499 - DNA, 22 bp, Homo sapiens
aaattttcagagcactagagaa

SEQ ID NO: 7055500 - DNA, 22 bp, Homo sapiens
aaattttagtaaggaagttgag

SEQ ID NO: 7055501 - DNA, 22 bp, Homo sapiens
aacaaaacatttgtcttgtttc

SEQ ID NO: 7055502 - DNA, 22 bp, Homo sapiens
aaagagtttggagacaagatca

SEQ ID NO: 7055503 - DNA, 22 bp, Homo sapiens
aaagtgggaacaatggagagtg

SEQ ID NO: 7055504 - DNA, 22 bp, Homo sapiens
aaagtgcttcctttttgagggt

SEQ ID NO: 7055505 - DNA, 22 bp, Homo sapiens
aaagtattcttgactgtttttc

SEQ ID NO: 7055506 - DNA, 22 bp, Homo sapiens
aaagtatttgtgatttttacca

SEQ ID NO: 7055507 - DNA, 22 bp, Homo sapiens
aactaacagtcattaaaagaac

SEQ ID NO: 7055508 - DNA, 22 bp, Homo sapiens
aaaggttttctagggttgaggg

SEQ ID NO: 7055509 - DNA, 18 bp, Homo sapiens
aactaaagatctttaagc

SEQ ID NO: 7055510 - DNA, 22 bp, Homo sapiens
aactaaagtaaccaaggatatc

SEQ ID NO: 7055511 - DNA, 22 bp, Homo sapiens
aactaaatctggcatttagagc

SEQ ID NO: 7055512 - DNA, 22 bp, Homo sapiens
aactaaatctggcatttagagc

SEQ ID NO: 7055513 - DNA, 22 bp, Homo sapiens
aaagggcagagttcactagaaa

SEQ ID NO: 7055514 - DNA, 22 bp, Homo sapiens
aaagggcctccgcctgggcagg

SEQ ID NO: 7055515 - DNA, 22 bp, Homo sapiens
aaagcttttgttttcgtaactg

SEQ ID NO: 7055516 - DNA, 22 bp, Homo sapiens
aaaggtttattgattctgctct

SEQ ID NO: 7055517 - DNA, 22 bp, Homo sapiens
aaaggtttattgctatggttgt

SEQ ID NO: 7055518 - DNA, 22 bp, Homo sapiens
aaaggtttatttaatcagggag

SEQ ID NO: 7055519 - DNA, 22 bp, Homo sapiens
aaaggtttatttgttgctcaca

SEQ ID NO: 7055520 - DNA, 22 bp, Homo sapiens
aaaggtttccgagctttaattt

SEQ ID NO: 7055521 - DNA, 22 bp, Homo sapiens
aaaggtttgaggtgggaagagg

SEQ ID NO: 7055522 - DNA, 22 bp, Homo sapiens
aaaggtttgcatggaatttacc

SEQ ID NO: 7055523 - DNA, 22 bp, Homo sapiens
aaaggtttgccgacctctgctt

SEQ ID NO: 7055524 - DNA, 22 bp, Homo sapiens
aaaggttttatgttttccactt

SEQ ID NO: 7055525 - DNA, 22 bp, Homo sapiens
aaaggttttattctgagctctg

SEQ ID NO: 7055526 - DNA, 22 bp, Homo sapiens
aaaggttttcatcacagcaaga

SEQ ID NO: 7055527 - DNA, 22 bp, Homo sapiens
aaataagttaaactagaatgat

SEQ ID NO: 7055528 - DNA, 22 bp, Homo sapiens
aaagttttattcaagcattagt

SEQ ID NO: 7055529 - DNA, 23 bp, Homo sapiens
aaagtgtagccaggttaagaacc

SEQ ID NO: 7055530 - DNA, 22 bp, Homo sapiens
aaataattatagcgagtctatc

SEQ ID NO: 7055531 - DNA, 22 bp, Homo sapiens
aaataattatagcgagtctatc

SEQ ID NO: 7055532 - DNA, 22 bp, Homo sapiens
aaataattgagttggtcaatat

SEQ ID NO: 7055533 - DNA, 22 bp, Homo sapiens
aaatactgtagataatagagtt

SEQ ID NO: 7055534 - DNA, 22 bp, Homo sapiens
aaatagacaggcttaaatagga

SEQ ID NO: 7055535 - DNA, 22 bp, Homo sapiens
aaatagagctgggttaaacttt

SEQ ID NO: 7055536 - DNA, 22 bp, Homo sapiens
aaatagatttcctagcattgga

SEQ ID NO: 7055537 - DNA, 22 bp, Homo sapiens
aaatagcaatgtgaaaagagga

SEQ ID NO: 7055538 - DNA, 22 bp, Homo sapiens
aaatagcagcctttagttaaca

SEQ ID NO: 7055539 - DNA, 22 bp, Homo sapiens
aaatagcagctttgacagcaca

SEQ ID NO: 7055540 - DNA, 22 bp, Homo sapiens
aaatagctacatgatctctagg

SEQ ID NO: 7055541 - DNA, 22 bp, Homo sapiens
aaatagcttttcataattctca

SEQ ID NO: 7055542 - DNA, 22 bp, Homo sapiens
aaataggaatgtggtcctggga

SEQ ID NO: 7055543 - DNA, 22 bp, Homo sapiens
aaataggagcttaagcacttct

SEQ ID NO: 7055544 - DNA, 23 bp, Homo sapiens
aaataggagtatctggatcatga

SEQ ID NO: 7055545 - DNA, 23 bp, Homo sapiens
aaataggagtatctggatcatga

SEQ ID NO: 7055546 - DNA, 22 bp, Homo sapiens
aaatccatcaaatcttctagaa

SEQ ID NO: 7055547 - DNA, 22 bp, Homo sapiens
aaatgtcaaagacgtgtttttg

SEQ ID NO: 7055548 - DNA, 22 bp, Homo sapiens
aaatgtatcctacttcctgagt

SEQ ID NO: 7055549 - DNA, 22 bp, Homo sapiens
aaatgtattgcataggatattt

SEQ ID NO: 7055550 - DNA, 22 bp, Homo sapiens
aaatgtacgggagtagaattag

SEQ ID NO: 7055551 - DNA, 22 bp, Homo sapiens
aaatgtacaacatccatatata

SEQ ID NO: 7055552 - DNA, 22 bp, Homo sapiens
aaatggcaggctctttgctagt

SEQ ID NO: 7055553 - DNA, 22 bp, Homo sapiens
aaatgtaagtctttgtttctta

SEQ ID NO: 7055554 - DNA, 20 bp, Homo sapiens
aagcatggtcaaaacttatg

SEQ ID NO: 7055555 - DNA, 22 bp, Homo sapiens
aagcatgcaatctgtgataagg

SEQ ID NO: 7055556 - DNA, 20 bp, Homo sapiens
aagcatctggatgtagcaat

SEQ ID NO: 7055557 - DNA, 22 bp, Homo sapiens
aagcatctcctcatcatttggg

SEQ ID NO: 7055558 - DNA, 22 bp, Homo sapiens
aaatgcaggaaattatgctttt

SEQ ID NO: 7055559 - DNA, 22 bp, Homo sapiens
aaatgcaggaaattatgctttt

SEQ ID NO: 7055560 - DNA, 22 bp, Homo sapiens
aagcacagataaaacaggattc

SEQ ID NO: 7055561 - DNA, 22 bp, Homo sapiens
aaatgcatgagaaagtattctg

SEQ ID NO: 7055562 - DNA, 22 bp, Homo sapiens
aaatgcatgagaaagtattctg

SEQ ID NO: 7055563 - DNA, 22 bp, Homo sapiens
aaatgcagtttcctgagaccca

SEQ ID NO: 7055564 - DNA, 22 bp, Homo sapiens
aaatgcaggttcttgagccaag

SEQ ID NO: 7055565 - DNA, 22 bp, Homo sapiens
aaatctcaaaggcttagcatct

SEQ ID NO: 7055566 - DNA, 22 bp, Homo sapiens
aagcacagagaggtaaagtaac

SEQ ID NO: 7055567 - DNA, 22 bp, Homo sapiens
aagcacagagatgggcacgcct

SEQ ID NO: 7055568 - DNA, 22 bp, Homo sapiens
aaattgcattcaggatgcagga

SEQ ID NO: 7055569 - DNA, 22 bp, Homo sapiens
aaattgcaggtaggtgggtgat

SEQ ID NO: 7055570 - DNA, 22 bp, Homo sapiens
aaattgcattcaggatgcagga

SEQ ID NO: 7055571 - DNA, 22 bp, Homo sapiens
aaattgcaaaagtacttttagg

SEQ ID NO: 7055572 - DNA, 22 bp, Homo sapiens
aaattctttcatggctaataag

SEQ ID NO: 7055573 - DNA, 22 bp, Homo sapiens
aaattgaatttgggaaacattg

SEQ ID NO: 7055574 - DNA, 22 bp, Homo sapiens
aaattctaaggtcacaatgttg

SEQ ID NO: 7055575 - DNA, 22 bp, Homo sapiens
aaattctatgtcaatgtttatt

SEQ ID NO: 7055576 - DNA, 22 bp, Homo sapiens
aaattctcaagtgatcctgttg

SEQ ID NO: 7055577 - DNA, 22 bp, Homo sapiens
aaattctggcctatcacagtga

SEQ ID NO: 7055578 - DNA, 22 bp, Homo sapiens
aaatgtgcttcttactctcaat

SEQ ID NO: 7055579 - DNA, 22 bp, Homo sapiens
aaatgtgcttgtgatcagctgt

SEQ ID NO: 7055580 - DNA, 19 bp, Homo sapiens
aaatgtgatggtacaattc

SEQ ID NO: 7055581 - DNA, 22 bp, Homo sapiens
aagctgaggctcccctgaggga

SEQ ID NO: 7055582 - DNA, 22 bp, Homo sapiens
aagctgaggcccatggcaaggt

SEQ ID NO: 7055583 - DNA, 22 bp, Homo sapiens
aagctgaggtcaagtagctagt

SEQ ID NO: 7055584 - DNA, 22 bp, Homo sapiens
aagctgagccagtggcaagtgc

SEQ ID NO: 7055585 - DNA, 22 bp, Homo sapiens
aagctgaggcccatggcaaggt

SEQ ID NO: 7055586 - DNA, 22 bp, Homo sapiens
aaatgttcccaatatgaagctg

SEQ ID NO: 7055587 - DNA, 22 bp, Homo sapiens
aaatgttccgggtaaggagaaa

SEQ ID NO: 7055588 - DNA, 22 bp, Homo sapiens
aaatgttctaaattacatgtga

SEQ ID NO: 7055589 - DNA, 22 bp, Homo sapiens
aaatgtttctacttgtgagcat

SEQ ID NO: 7055590 - DNA, 22 bp, Homo sapiens
aaattcagatggctttcttttc

SEQ ID NO: 7055591 - DNA, 22 bp, Homo sapiens
aacactctctgttggtaaggct

SEQ ID NO: 7055592 - DNA, 22 bp, Homo sapiens
aacactctctgttggtaaggct

SEQ ID NO: 7055593 - DNA, 22 bp, Homo sapiens
aacaaatgacctgatttcttcc

SEQ ID NO: 7055594 - DNA, 22 bp, Homo sapiens
aacactgagaacaatacagagt

SEQ ID NO: 7055595 - DNA, 22 bp, Homo sapiens
aacactgagaggggagtggcac

SEQ ID NO: 7055596 - DNA, 22 bp, Homo sapiens
aaggtcactgatcagttgagta

SEQ ID NO: 7055597 - DNA, 22 bp, Homo sapiens
aacagcataagtatttatttca

SEQ ID NO: 7055598 - DNA, 22 bp, Homo sapiens
aacagcatatttcatatattga

SEQ ID NO: 7055599 - DNA, 22 bp, Homo sapiens
aacagcagggaaattccaagtc

SEQ ID NO: 7055600 - DNA, 22 bp, Homo sapiens
aacagcagggacttgaatggaa

SEQ ID NO: 7055601 - DNA, 22 bp, Homo sapiens
aacagcagggacttgaatggaa

SEQ ID NO: 7055602 - DNA, 22 bp, Homo sapiens
aacagcaggtcctggcatgggt

SEQ ID NO: 7055603 - DNA, 23 bp, Homo sapiens
aacagcaggatgatagaggaggt

SEQ ID NO: 7055604 - DNA, 22 bp, Homo sapiens
aacagcaggcaccaaggctatg

SEQ ID NO: 7055605 - DNA, 22 bp, Homo sapiens
aacagcaggcaccaaggctatg

SEQ ID NO: 7055606 - DNA, 22 bp, Homo sapiens
aacagcaggcatttcttagctc

SEQ ID NO: 7055607 - DNA, 22 bp, Homo sapiens
aaggtctgagttttgccaggcc

SEQ ID NO: 7055608 - DNA, 22 bp, Homo sapiens
aagtcatcttgagtctaagatt

SEQ ID NO: 7055609 - DNA, 22 bp, Homo sapiens
aagtcatgagtcctcttctgtg

SEQ ID NO: 7055610 - DNA, 22 bp, Homo sapiens
aagtccaaggtcaccattcaca

SEQ ID NO: 7055611 - DNA, 22 bp, Homo sapiens
aacagcttgaggaatatcatca

SEQ ID NO: 7055612 - DNA, 22 bp, Homo sapiens
aacaggcagcagactgaatctg

SEQ ID NO: 7055613 - DNA, 22 bp, Homo sapiens
aacaggcaggagaattctgcct

SEQ ID NO: 7055614 - DNA, 15 bp, Homo sapiens
aacaggcatttatat

SEQ ID NO: 7055615 - DNA, 22 bp, Homo sapiens
aacaggagtcattgtcattatt

SEQ ID NO: 7055616 - DNA, 22 bp, Homo sapiens
aacaggaggccttccagtccag

SEQ ID NO: 7055617 - DNA, 22 bp, Homo sapiens
aacaggcaaactgtgggatccc

SEQ ID NO: 7055618 - DNA, 22 bp, Homo sapiens
aacaggcaaactgtgggatccc

SEQ ID NO: 7055619 - DNA, 22 bp, Homo sapiens
aacaggcaacagttgactctga

SEQ ID NO: 7055620 - DNA, 22 bp, Homo sapiens
aacaggcaacagttgactctga

SEQ ID NO: 7055621 - DNA, 22 bp, Homo sapiens
aacaggcaatttaggactcttt

SEQ ID NO: 7055622 - DNA, 22 bp, Homo sapiens
aacaggcactaagcatgtgggg

SEQ ID NO: 7055623 - DNA, 22 bp, Homo sapiens
aacagtaaaaatcatttagttg

SEQ ID NO: 7055624 - DNA, 22 bp, Homo sapiens
aacatgctctgtttcttggatg

SEQ ID NO: 7055625 - DNA, 22 bp, Homo sapiens
aacatgctgcctttctacgagt

SEQ ID NO: 7055626 - DNA, 22 bp, Homo sapiens
aataacttcatgtaacatttaa

SEQ ID NO: 7055627 - DNA, 22 bp, Homo sapiens
aacatgtaaatatcattgtact

SEQ ID NO: 7055628 - DNA, 22 bp, Homo sapiens
aacatttcataacttgactttt

SEQ ID NO: 7055629 - DNA, 22 bp, Homo sapiens
aatataaattcctgggcccagc

SEQ ID NO: 7055630 - DNA, 22 bp, Homo sapiens
aactgaaacttaggaagtaatc

SEQ ID NO: 7055631 - DNA, 22 bp, Homo sapiens
aactgcaagtggggcttgtcat

SEQ ID NO: 7055632 - DNA, 22 bp, Homo sapiens
aatcatcctgaagtcaataaag

SEQ ID NO: 7055633 - DNA, 22 bp, Homo sapiens
aatcatctccgaaaaaagagta

SEQ ID NO: 7055634 - DNA, 22 bp, Homo sapiens
aatcatgtttacgtgacatgtc

SEQ ID NO: 7055635 - DNA, 22 bp, Homo sapiens
aatcatgtttcagatgagtttt

SEQ ID NO: 7055636 - DNA, 22 bp, Homo sapiens
aatcattctcatgccagtttcc

SEQ ID NO: 7055637 - DNA, 22 bp, Homo sapiens
aatcattcttatttcacagcaa

SEQ ID NO: 7055638 - DNA, 22 bp, Homo sapiens
aatcattgagacaaattagctt

SEQ ID NO: 7055639 - DNA, 22 bp, Homo sapiens
aatccaatcctactcagaaagt

SEQ ID NO: 7055640 - DNA, 22 bp, Homo sapiens
aactacattgtcctttctgaag

SEQ ID NO: 7055641 - DNA, 19 bp, Homo sapiens
aactacagcgcactgtcct

SEQ ID NO: 7055642 - DNA, 22 bp, Homo sapiens
aactacagctcttgtctttctg

SEQ ID NO: 7055643 - DNA, 22 bp, Homo sapiens
aactacagggggtggcaggcgg

SEQ ID NO: 7055644 - DNA, 22 bp, Homo sapiens
aactacagtagtttgcccttct

SEQ ID NO: 7055645 - DNA, 22 bp, Homo sapiens
aactacagtatgtccaaagaat

SEQ ID NO: 7055646 - DNA, 22 bp, Homo sapiens
aactacagtgggcagaggcaat

SEQ ID NO: 7055647 - DNA, 21 bp, Homo sapiens
aactacagttgttccttcatt

SEQ ID NO: 7055648 - DNA, 22 bp, Homo sapiens
aactacaatatgtatgtatgta

SEQ ID NO: 7055649 - DNA, 22 bp, Homo sapiens
aactacagaaaaggtaagctct

SEQ ID NO: 7055650 - DNA, 22 bp, Homo sapiens
aactacagaatcatagaaaata

SEQ ID NO: 7055651 - DNA, 22 bp, Homo sapiens
aactacagcatctatacaaata

SEQ ID NO: 7055652 - DNA, 22 bp, Homo sapiens
aatgatcattataaagtgctct

SEQ ID NO: 7055653 - DNA, 22 bp, Homo sapiens
aatgatcacctggtaaagagag

SEQ ID NO: 7055654 - DNA, 22 bp, Homo sapiens
aatgatatttattgaatagatg

SEQ ID NO: 7055655 - DNA, 22 bp, Homo sapiens
aatgatatgcaaattatcatca

SEQ ID NO: 7055656 - DNA, 22 bp, Homo sapiens
aatgatatagcagacatagcct

SEQ ID NO: 7055657 - DNA, 22 bp, Homo sapiens
aatgatatagcagacatagcct

SEQ ID NO: 7055658 - DNA, 22 bp, Homo sapiens
aactgcttcttactgctgggca

SEQ ID NO: 7055659 - DNA, 22 bp, Homo sapiens
aactgcttatctttggtagatg

SEQ ID NO: 7055660 - DNA, 22 bp, Homo sapiens
aactgctgtggcctagtactta

SEQ ID NO: 7055661 - DNA, 22 bp, Homo sapiens
aactgtttcagaaatattgttg

SEQ ID NO: 7055662 - DNA, 22 bp, Homo sapiens
aacttaaacccactcatgtaga

SEQ ID NO: 7055663 - DNA, 22 bp, Homo sapiens
aacttaaacccactcatgtaga

SEQ ID NO: 7055664 - DNA, 22 bp, Homo sapiens
acaaggacatgcaatttggatt

SEQ ID NO: 7055665 - DNA, 22 bp, Homo sapiens
aagagattggttataagagatt

SEQ ID NO: 7055666 - DNA, 22 bp, Homo sapiens
acaaagctagagaagagaattg

SEQ ID NO: 7055667 - DNA, 22 bp, Homo sapiens
aagagagaactcccttcgccag

SEQ ID NO: 7055668 - DNA, 22 bp, Homo sapiens
aagacatgcagtttgttccatt

SEQ ID NO: 7055669 - DNA, 22 bp, Homo sapiens
aagacattactggaatctgact

SEQ ID NO: 7055670 - DNA, 22 bp, Homo sapiens
acaaggcactttatgaagagga

SEQ ID NO: 7055671 - DNA, 22 bp, Homo sapiens
acaaggctgaacagtgaagccg

SEQ ID NO: 7055672 - DNA, 22 bp, Homo sapiens
acaaggctgtgggagaacctct

SEQ ID NO: 7055673 - DNA, 22 bp, Homo sapiens
aagagctccaggcaatgcggtc

SEQ ID NO: 7055674 - DNA, 20 bp, Homo sapiens
aagagctgactcacagtggt

SEQ ID NO: 7055675 - DNA, 22 bp, Homo sapiens
aagagctggagtttgcagccct

SEQ ID NO: 7055676 - DNA, 22 bp, Homo sapiens
aagagctggctcttgcagcagc

SEQ ID NO: 7055677 - DNA, 22 bp, Homo sapiens
aagagctgtgggtggtagtcct

SEQ ID NO: 7055678 - DNA, 22 bp, Homo sapiens
aagacaggaacatagcaaatcc

SEQ ID NO: 7055679 - DNA, 22 bp, Homo sapiens
aagacaggaaaagctccaggcc

SEQ ID NO: 7055680 - DNA, 22 bp, Homo sapiens
aagacagtgtgtcaggcaggtg

SEQ ID NO: 7055681 - DNA, 20 bp, Homo sapiens
aagacaccagtggcagcccc

SEQ ID NO: 7055682 - DNA, 22 bp, Homo sapiens
aagacagcagcacctctcgttt

SEQ ID NO: 7055683 - DNA, 22 bp, Homo sapiens
aattggaaaatgctacatatca

SEQ ID NO: 7055684 - DNA, 22 bp, Homo sapiens
aattggaaaatgctacatatca

SEQ ID NO: 7055685 - DNA, 22 bp, Homo sapiens
aagaataagtagatgggagaag

SEQ ID NO: 7055686 - DNA, 22 bp, Homo sapiens
aagaatacgtatcaacaatggt

SEQ ID NO: 7055687 - DNA, 22 bp, Homo sapiens
aagaataaattaagatacttag

SEQ ID NO: 7055688 - DNA, 22 bp, Homo sapiens
aatgttttctgactgctaactt

SEQ ID NO: 7055689 - DNA, 22 bp, Homo sapiens
aatgttttctctgtgaacacat

SEQ ID NO: 7055690 - DNA, 22 bp, Homo sapiens
aatgttttctgactgctaactt

SEQ ID NO: 7055691 - DNA, 22 bp, Homo sapiens
aatgttttcattatcctaactg

SEQ ID NO: 7055692 - DNA, 22 bp, Homo sapiens
aatgttttcattatcctaactg

SEQ ID NO: 7055693 - DNA, 22 bp, Homo sapiens
aatgttttcccagtgcagacga

SEQ ID NO: 7055694 - DNA, 22 bp, Homo sapiens
aagaaatgcacacaactgctgg

SEQ ID NO: 7055695 - DNA, 22 bp, Homo sapiens
aagaaatgctgatgttggatgg

SEQ ID NO: 7055696 - DNA, 22 bp, Homo sapiens
aatgttttagattactgctggg

SEQ ID NO: 7055697 - DNA, 22 bp, Homo sapiens
aagaaatattgggccttataaa

SEQ ID NO: 7055698 - DNA, 22 bp, Homo sapiens
aagaaatcatatcatttcttgg

SEQ ID NO: 7055699 - DNA, 22 bp, Homo sapiens
aacttcaaatgtgactttgcat

SEQ ID NO: 7055700 - DNA, 18 bp, Homo sapiens
aacttcaactacaatgga

SEQ ID NO: 7055701 - DNA, 22 bp, Homo sapiens
aacttcaagcttcgtcccttcg

SEQ ID NO: 7055702 - DNA, 22 bp, Homo sapiens
aacttcagagctgtgtggtttg

SEQ ID NO: 7055703 - DNA, 22 bp, Homo sapiens
aacttcagggggcacattcaag

SEQ ID NO: 7055704 - DNA, 22 bp, Homo sapiens
aacttcagttgagaaaggcatg

SEQ ID NO: 7055705 - DNA, 22 bp, Homo sapiens
aacttcatgtaatttaaaacag

SEQ ID NO: 7055706 - DNA, 22 bp, Homo sapiens
aagcatttcaatataatattca

SEQ ID NO: 7055707 - DNA, 22 bp, Homo sapiens
aagcatttcaggtagagatatt

SEQ ID NO: 7055708 - DNA, 22 bp, Homo sapiens
acagcagctgccttcaggctct

SEQ ID NO: 7055709 - DNA, 22 bp, Homo sapiens
acagcagcttgcgtgtctggtc

SEQ ID NO: 7055710 - DNA, 22 bp, Homo sapiens
acagcagcttgtctgttcttta

SEQ ID NO: 7055711 - DNA, 22 bp, Homo sapiens
acagcaggaagctggagggaaa

SEQ ID NO: 7055712 - DNA, 22 bp, Homo sapiens
aagccaagttggaagactgaat

SEQ ID NO: 7055713 - DNA, 22 bp, Homo sapiens
aagccaatcgtgtgaacttagt

SEQ ID NO: 7055714 - DNA, 22 bp, Homo sapiens
aagccaatgagagaggcctcag

SEQ ID NO: 7055715 - DNA, 22 bp, Homo sapiens
aagcagagtccccttcccatgg

SEQ ID NO: 7055716 - DNA, 18 bp, Homo sapiens
acagacaaaatggaaatg

SEQ ID NO: 7055717 - DNA, 18 bp, Homo sapiens
acagacaaaatggaaatg

SEQ ID NO: 7055718 - DNA, 22 bp, Homo sapiens
aagcagctgatttcacagctca

SEQ ID NO: 7055719 - DNA, 22 bp, Homo sapiens
acagaggtgtgtgtaggacagt

SEQ ID NO: 7055720 - DNA, 22 bp, Homo sapiens
acagaggtgttccagacctagg

SEQ ID NO: 7055721 - DNA, 22 bp, Homo sapiens
acagaggttaggatgggttgta

SEQ ID NO: 7055722 - DNA, 22 bp, Homo sapiens
acagaggtttccattgaggttt

SEQ ID NO: 7055723 - DNA, 17 bp, Homo sapiens
acagaggttatacagac

SEQ ID NO: 7055724 - DNA, 22 bp, Homo sapiens
acagaggtttccattgaggttt

SEQ ID NO: 7055725 - DNA, 22 bp, Homo sapiens
acagagtaggtgctcagtaaat

SEQ ID NO: 7055726 - DNA, 22 bp, Homo sapiens
aagaggctttcagtgaacttgt

SEQ ID NO: 7055727 - DNA, 22 bp, Homo sapiens
aagaggcttcagatccttcaga

SEQ ID NO: 7055728 - DNA, 22 bp, Homo sapiens
aagaggcttatagtcttcctgt

SEQ ID NO: 7055729 - DNA, 22 bp, Homo sapiens
aagaggcttcagatccttcaga

SEQ ID NO: 7055730 - DNA, 18 bp, Homo sapiens
aagaggctgttctgtggg

SEQ ID NO: 7055731 - DNA, 18 bp, Homo sapiens
aagaggctgttctgtggg

SEQ ID NO: 7055732 - DNA, 22 bp, Homo sapiens
aagaggctggcattgatggtag

SEQ ID NO: 7055733 - DNA, 22 bp, Homo sapiens
aagaggctggcattgatggtag

SEQ ID NO: 7055734 - DNA, 20 bp, Homo sapiens
aagaggctgtggatcctact

SEQ ID NO: 7055735 - DNA, 22 bp, Homo sapiens
aagaggctggaggatactgcgc

SEQ ID NO: 7055736 - DNA, 22 bp, Homo sapiens
aagaggctgaatgagaaagtac

SEQ ID NO: 7055737 - DNA, 22 bp, Homo sapiens
aagaggctagccggctcactaa

SEQ ID NO: 7055738 - DNA, 20 bp, Homo sapiens
aagattctgatttgtagcgt

SEQ ID NO: 7055739 - DNA, 18 bp, Homo sapiens
aagattctgcttctctct

SEQ ID NO: 7055740 - DNA, 22 bp, Homo sapiens
aagattctgtatttctaacaat

SEQ ID NO: 7055741 - DNA, 22 bp, Homo sapiens
aagattctgtcagttaggagga

SEQ ID NO: 7055742 - DNA, 22 bp, Homo sapiens
aagattcttaaatttgtttctc

SEQ ID NO: 7055743 - DNA, 22 bp, Homo sapiens
aagattcttacctatacccagt

SEQ ID NO: 7055744 - DNA, 22 bp, Homo sapiens
aagattcttattaggtaatttt

SEQ ID NO: 7055745 - DNA, 22 bp, Homo sapiens
aagattcttgactagaatgatt

SEQ ID NO: 7055746 - DNA, 22 bp, Homo sapiens
aagattctttgaggattttact

SEQ ID NO: 7055747 - DNA, 22 bp, Homo sapiens
aagaggccacagctgacagcac

SEQ ID NO: 7055748 - DNA, 22 bp, Homo sapiens
acactgcttctctggcagagcc

SEQ ID NO: 7055749 - DNA, 18 bp, Homo sapiens
acactgcagcagtctgct

SEQ ID NO: 7055750 - DNA, 22 bp, Homo sapiens
aagcacaggagacgcacagcca

SEQ ID NO: 7055751 - DNA, 22 bp, Homo sapiens
acactggtaggaagagatggct

SEQ ID NO: 7055752 - DNA, 22 bp, Homo sapiens
aagcacagtaaaagcagatttt

SEQ ID NO: 7055753 - DNA, 22 bp, Homo sapiens
aagcacagtgggcagagcagcc

SEQ ID NO: 7055754 - DNA, 22 bp, Homo sapiens
acagttctgaagactagagcct

SEQ ID NO: 7055755 - DNA, 22 bp, Homo sapiens
acagttcttaaaacttgaatta

SEQ ID NO: 7055756 - DNA, 22 bp, Homo sapiens
aaggcagatataaagactagag

SEQ ID NO: 7055757 - DNA, 22 bp, Homo sapiens
aaggcagccgtgtgactgcatg

SEQ ID NO: 7055758 - DNA, 22 bp, Homo sapiens
aaggcagccttttgagttgatt

SEQ ID NO: 7055759 - DNA, 22 bp, Homo sapiens
aaggcaggatgggaaaagattt

SEQ ID NO: 7055760 - DNA, 22 bp, Homo sapiens
aaggcagtggctggaaaacctg

SEQ ID NO: 7055761 - DNA, 22 bp, Homo sapiens
aaggcagttcactcacgcagcc

SEQ ID NO: 7055762 - DNA, 22 bp, Homo sapiens
aaggcagtttgggccaccatct

SEQ ID NO: 7055763 - DNA, 22 bp, Homo sapiens
acagtataccattgtgactttg

SEQ ID NO: 7055764 - DNA, 22 bp, Homo sapiens
aaggaacactacaaggctggga

SEQ ID NO: 7055765 - DNA, 22 bp, Homo sapiens
aaggaaccatttgtgtgcatgg

SEQ ID NO: 7055766 - DNA, 22 bp, Homo sapiens
aaggaacctggagtagagggag

SEQ ID NO: 7055767 - DNA, 22 bp, Homo sapiens
aaggaagaagactctttactcc

SEQ ID NO: 7055768 - DNA, 22 bp, Homo sapiens
aaggcactacgctgctggggcg

SEQ ID NO: 7055769 - DNA, 22 bp, Homo sapiens
aaggcactagcaagctgcctgg

SEQ ID NO: 7055770 - DNA, 22 bp, Homo sapiens
aaggcagaaagggatgtgagtg

SEQ ID NO: 7055771 - DNA, 22 bp, Homo sapiens
aaggcagaaagggatgtgagtg

SEQ ID NO: 7055772 - DNA, 22 bp, Homo sapiens
aaggcagaaattcaactactgg

SEQ ID NO: 7055773 - DNA, 19 bp, Homo sapiens
aaggcagaagttggatatg

SEQ ID NO: 7055774 - DNA, 23 bp, Homo sapiens
acagggcttatctgtcactcatc

SEQ ID NO: 7055775 - DNA, 22 bp, Homo sapiens
acagggcttagaacttggcctc

SEQ ID NO: 7055776 - DNA, 22 bp, Homo sapiens
acagggcttagaacttggcctc

SEQ ID NO: 7055777 - DNA, 22 bp, Homo sapiens
acagggctggggcacttggctg

SEQ ID NO: 7055778 - DNA, 22 bp, Homo sapiens
acagggctggcgttgggacaga

SEQ ID NO: 7055779 - DNA, 22 bp, Homo sapiens
aaggaaaggatgagcatgcatt

SEQ ID NO: 7055780 - DNA, 22 bp, Homo sapiens
aaggaaagattctctctctaga

SEQ ID NO: 7055781 - DNA, 22 bp, Homo sapiens
aaggaaaggatgagcatgcatt

SEQ ID NO: 7055782 - DNA, 22 bp, Homo sapiens
aaggaaagacatataaatgact

SEQ ID NO: 7055783 - DNA, 22 bp, Homo sapiens
aagctgcagaccccctgtctca

SEQ ID NO: 7055784 - DNA, 22 bp, Homo sapiens
aagctgccaatggtaagctgct

SEQ ID NO: 7055785 - DNA, 22 bp, Homo sapiens
aagctgccacacggtgagtact

SEQ ID NO: 7055786 - DNA, 22 bp, Homo sapiens
aagctgccagctgagctgaggc

SEQ ID NO: 7055787 - DNA, 23 bp, Homo sapiens
aagctgccagtctgaagcctggg

SEQ ID NO: 7055788 - DNA, 22 bp, Homo sapiens
aagctgcccaagactgaagcat

SEQ ID NO: 7055789 - DNA, 18 bp, Homo sapiens
aagctgccctcaggcagg

SEQ ID NO: 7055790 - DNA, 22 bp, Homo sapiens
acaggcaggtcctgtcccagct

SEQ ID NO: 7055791 - DNA, 22 bp, Homo sapiens
acaggcaggttgagaaacattt

SEQ ID NO: 7055792 - DNA, 22 bp, Homo sapiens
acaggcaggttgagaaacattt

SEQ ID NO: 7055793 - DNA, 22 bp, Homo sapiens
aagccaggccattctctggttc

SEQ ID NO: 7055794 - DNA, 22 bp, Homo sapiens
aagccaggctgcacttgctggg

SEQ ID NO: 7055795 - DNA, 22 bp, Homo sapiens
aagccagggtcaggggcctcct

SEQ ID NO: 7055796 - DNA, 22 bp, Homo sapiens
accatgggtcagccacctcagc

SEQ ID NO: 7055797 - DNA, 22 bp, Homo sapiens
accatgccagtggcagccagac

SEQ ID NO: 7055798 - DNA, 22 bp, Homo sapiens
accatgtcatttattggccaaa

SEQ ID NO: 7055799 - DNA, 22 bp, Homo sapiens
accatgtcatttattggccaaa

SEQ ID NO: 7055800 - DNA, 22 bp, Homo sapiens
accatgttggccaagctggtct

SEQ ID NO: 7055801 - DNA, 19 bp, Homo sapiens
aaggtggcagcaggtatta

SEQ ID NO: 7055802 - DNA, 22 bp, Homo sapiens
aaggtggccctgagcatgacaa

SEQ ID NO: 7055803 - DNA, 22 bp, Homo sapiens
aaggtggcgctggagctggtcc

SEQ ID NO: 7055804 - DNA, 22 bp, Homo sapiens
aagggctgagcacagtgagcca

SEQ ID NO: 7055805 - DNA, 22 bp, Homo sapiens
aagggctgagcacagtgagcca

SEQ ID NO: 7055806 - DNA, 22 bp, Homo sapiens
aagggctgatctcactttcttt

SEQ ID NO: 7055807 - DNA, 22 bp, Homo sapiens
aagggctgaatgaagggttgaa

SEQ ID NO: 7055808 - DNA, 22 bp, Homo sapiens
aagggctgaatgaagggttgaa

SEQ ID NO: 7055809 - DNA, 22 bp, Homo sapiens
aagggctgagaagtggggctgg

SEQ ID NO: 7055810 - DNA, 18 bp, Homo sapiens
aaggtctgtctggtaggt

SEQ ID NO: 7055811 - DNA, 22 bp, Homo sapiens
aaggtctgttctaggtgagggt

SEQ ID NO: 7055812 - DNA, 22 bp, Homo sapiens
aagtacatatatttatgattct

SEQ ID NO: 7055813 - DNA, 22 bp, Homo sapiens
aagtacatttttaacttacagc

SEQ ID NO: 7055814 - DNA, 22 bp, Homo sapiens
aagtagaaaaccgcactggact

SEQ ID NO: 7055815 - DNA, 22 bp, Homo sapiens
accccaggagctgtgcctagtc

SEQ ID NO: 7055816 - DNA, 23 bp, Homo sapiens
accccaggcatcgcattcctctt

SEQ ID NO: 7055817 - DNA, 22 bp, Homo sapiens
accccaggcccagggaagaggc

SEQ ID NO: 7055818 - DNA, 22 bp, Homo sapiens
accccagggctgccagcctcct

SEQ ID NO: 7055819 - DNA, 22 bp, Homo sapiens
accccaggtcatctgagagtcc

SEQ ID NO: 7055820 - DNA, 22 bp, Homo sapiens
accccaggtccaggttacagag

SEQ ID NO: 7055821 - DNA, 22 bp, Homo sapiens
accccaggtctccaggctctgg

SEQ ID NO: 7055822 - DNA, 22 bp, Homo sapiens
aagtatgacatttaagacaatt

SEQ ID NO: 7055823 - DNA, 22 bp, Homo sapiens
aagggagaaaacttgtggctta

SEQ ID NO: 7055824 - DNA, 22 bp, Homo sapiens
aagggagaaaacttgtggctta

SEQ ID NO: 7055825 - DNA, 22 bp, Homo sapiens
aagggacatagactgtacatct

SEQ ID NO: 7055826 - DNA, 22 bp, Homo sapiens
aagggccattgctgagagcagt

SEQ ID NO: 7055827 - DNA, 22 bp, Homo sapiens
aagggccatcccagaacagaaa

SEQ ID NO: 7055828 - DNA, 22 bp, Homo sapiens
aagggccataacttgcagtgtt

SEQ ID NO: 7055829 - DNA, 22 bp, Homo sapiens
aagggctgaaagaccttgggca

SEQ ID NO: 7055830 - DNA, 22 bp, Homo sapiens
aagggcccattctctcagaaaa

SEQ ID NO: 7055831 - DNA, 22 bp, Homo sapiens
aaggctggggtgcagacggcct

SEQ ID NO: 7055832 - DNA, 22 bp, Homo sapiens
aaggctggggtgcagacggcct

SEQ ID NO: 7055833 - DNA, 22 bp, Homo sapiens
aaggctggtttccttgatgttt

SEQ ID NO: 7055834 - DNA, 22 bp, Homo sapiens
aaggctgtggttctatacagaa

SEQ ID NO: 7055835 - DNA, 22 bp, Homo sapiens
aaggctgtgtcagaagctccct

SEQ ID NO: 7055836 - DNA, 22 bp, Homo sapiens
aaggctgtttgagcactggagc

SEQ ID NO: 7055837 - DNA, 22 bp, Homo sapiens
aaggcttggaccagctacagtg

SEQ ID NO: 7055838 - DNA, 22 bp, Homo sapiens
aaggcatgatgtaatcaatgat

SEQ ID NO: 7055839 - DNA, 22 bp, Homo sapiens
aaggctcttggagtgaatgcag

SEQ ID NO: 7055840 - DNA, 22 bp, Homo sapiens
aaggctgaggagggcctgcagg

SEQ ID NO: 7055841 - DNA, 22 bp, Homo sapiens
aaggctgaggagggcctgcagg

SEQ ID NO: 7055842 - DNA, 22 bp, Homo sapiens
aaggctgaggcagtgaggcaga

SEQ ID NO: 7055843 - DNA, 22 bp, Homo sapiens
aaggctgaggctggagaattac

SEQ ID NO: 7055844 - DNA, 22 bp, Homo sapiens
aaggctgagggctgtacctggc

SEQ ID NO: 7055845 - DNA, 22 bp, Homo sapiens
aaggctgaggtagggcctaaaa

SEQ ID NO: 7055846 - DNA, 22 bp, Homo sapiens
aaggctgagtaaaacagagaac

SEQ ID NO: 7055847 - DNA, 22 bp, Homo sapiens
aaggctgattagactgatagct

SEQ ID NO: 7055848 - DNA, 16 bp, Homo sapiens
aaggctgattttccct

SEQ ID NO: 7055849 - DNA, 16 bp, Homo sapiens
aaggctgattttccct

SEQ ID NO: 7055850 - DNA, 22 bp, Homo sapiens
aaggctgcttttaacatgcata

SEQ ID NO: 7055851 - DNA, 22 bp, Homo sapiens
acatgtgtacatatatatgtgc

SEQ ID NO: 7055852 - DNA, 22 bp, Homo sapiens
aataattttagctcagagttgt

SEQ ID NO: 7055853 - DNA, 22 bp, Homo sapiens
aataattttgagagcctggaaa

SEQ ID NO: 7055854 - DNA, 22 bp, Homo sapiens
aataattttgagagcctggaaa

SEQ ID NO: 7055855 - DNA, 22 bp, Homo sapiens
aataattatttgagagcagacc

SEQ ID NO: 7055856 - DNA, 22 bp, Homo sapiens
aataattatttgagagcagacc

SEQ ID NO: 7055857 - DNA, 22 bp, Homo sapiens
aataatttccagccaactggaa

SEQ ID NO: 7055858 - DNA, 19 bp, Homo sapiens
aataatgttcatgagattg

SEQ ID NO: 7055859 - DNA, 22 bp, Homo sapiens
aataatgtttatttgtattctc

SEQ ID NO: 7055860 - DNA, 22 bp, Homo sapiens
aataattacccatctttttgta

SEQ ID NO: 7055861 - DNA, 22 bp, Homo sapiens
aataattagtgggacagagaac

SEQ ID NO: 7055862 - DNA, 22 bp, Homo sapiens
aataattagtgggacagagaac

SEQ ID NO: 7055863 - DNA, 22 bp, Homo sapiens
aataagcaagcctgtgtgcaag

SEQ ID NO: 7055864 - DNA, 23 bp, Homo sapiens
actgcctgtgccgatctctctca

SEQ ID NO: 7055865 - DNA, 22 bp, Homo sapiens
aataagatcttaaaggttatat

SEQ ID NO: 7055866 - DNA, 22 bp, Homo sapiens
aataagatgtgcttgagtttgg

SEQ ID NO: 7055867 - DNA, 22 bp, Homo sapiens
aataatagttgcaaagtgttta

SEQ ID NO: 7055868 - DNA, 22 bp, Homo sapiens
aataagatcctgaagatatgtt

SEQ ID NO: 7055869 - DNA, 22 bp, Homo sapiens
aataagatcctgaagatatgtt

SEQ ID NO: 7055870 - DNA, 22 bp, Homo sapiens
aagtttatgttggtaagatatc

SEQ ID NO: 7055871 - DNA, 22 bp, Homo sapiens
aagtttcaaatgttgattatgc

SEQ ID NO: 7055872 - DNA, 22 bp, Homo sapiens
aagtttcatgacttggttatta

SEQ ID NO: 7055873 - DNA, 22 bp, Homo sapiens
aagtttatgttctttgaaggca

SEQ ID NO: 7055874 - DNA, 22 bp, Homo sapiens
aagtttagtgaaactctagggg

SEQ ID NO: 7055875 - DNA, 22 bp, Homo sapiens
aagtttagtggtggtgttccat

SEQ ID NO: 7055876 - DNA, 22 bp, Homo sapiens
aagtttagttaagtaaactctt

SEQ ID NO: 7055877 - DNA, 20 bp, Homo sapiens
aagtttaggggaaagtgaca

SEQ ID NO: 7055878 - DNA, 22 bp, Homo sapiens
aagtttagtagggacagatgga

SEQ ID NO: 7055879 - DNA, 22 bp, Homo sapiens
aagtttagtattagggaaaagt

SEQ ID NO: 7055880 - DNA, 22 bp, Homo sapiens
aagtttagtcttgtcttagtaa

SEQ ID NO: 7055881 - DNA, 22 bp, Homo sapiens
aagtttagaactataagagtga

SEQ ID NO: 7055882 - DNA, 22 bp, Homo sapiens
aagtttagatataggtattctg

SEQ ID NO: 7055883 - DNA, 22 bp, Homo sapiens
aagtttagcgctctctcaagga

SEQ ID NO: 7055884 - DNA, 22 bp, Homo sapiens
aagtttagcttgagatggaaag

SEQ ID NO: 7055885 - DNA, 22 bp, Homo sapiens
aagtttaggccaaattagattt

SEQ ID NO: 7055886 - DNA, 22 bp, Homo sapiens
aagtttagggaagtctgagcgc

SEQ ID NO: 7055887 - DNA, 22 bp, Homo sapiens
aagttggtaggagacagaaggt

SEQ ID NO: 7055888 - DNA, 22 bp, Homo sapiens
aagttggtgtatgagacagaag

SEQ ID NO: 7055889 - DNA, 23 bp, Homo sapiens
aagttgtttttggccagggaaag

SEQ ID NO: 7055890 - DNA, 22 bp, Homo sapiens
aagtttaacttgaattctttct

SEQ ID NO: 7055891 - DNA, 22 bp, Homo sapiens
aagtttacataagtgatgatga

SEQ ID NO: 7055892 - DNA, 20 bp, Homo sapiens
actccaggtggcatgaggac

SEQ ID NO: 7055893 - DNA, 22 bp, Homo sapiens
actcccactccagagtagaagc

SEQ ID NO: 7055894 - DNA, 22 bp, Homo sapiens
actcccactccagagtagaagc

SEQ ID NO: 7055895 - DNA, 22 bp, Homo sapiens
aagttactggcaagggctgcag

SEQ ID NO: 7055896 - DNA, 22 bp, Homo sapiens
aagttatatcatctcattgacg

SEQ ID NO: 7055897 - DNA, 22 bp, Homo sapiens
actacaatactcttagtaaaag

SEQ ID NO: 7055898 - DNA, 22 bp, Homo sapiens
aagtggaagagaagttatctta

SEQ ID NO: 7055899 - DNA, 21 bp, Homo sapiens
aagtcagtcagttctatacta

SEQ ID NO: 7055900 - DNA, 22 bp, Homo sapiens
aagtcagtgaaaaggcatcatc

SEQ ID NO: 7055901 - DNA, 22 bp, Homo sapiens
aagtggactaatacaaggacta

SEQ ID NO: 7055902 - DNA, 21 bp, Homo sapiens
aagtggagaagaaaagctgga

SEQ ID NO: 7055903 - DNA, 21 bp, Homo sapiens
aagtggagaagaaaagctgga

SEQ ID NO: 7055904 - DNA, 22 bp, Homo sapiens
aagtggagagccctggaggtct

SEQ ID NO: 7055905 - DNA, 22 bp, Homo sapiens
aagtggagagccctggaggtct

SEQ ID NO: 7055906 - DNA, 22 bp, Homo sapiens
aagtggagccagggaaactgaa

SEQ ID NO: 7055907 - DNA, 22 bp, Homo sapiens
aagtggagccagggaaactgaa

SEQ ID NO: 7055908 - DNA, 22 bp, Homo sapiens
aagtggagctataggctcagat

SEQ ID NO: 7055909 - DNA, 22 bp, Homo sapiens
actaacatgttaatcaaaagaa

SEQ ID NO: 7055910 - DNA, 22 bp, Homo sapiens
aagtcacagaacccattgtaac

SEQ ID NO: 7055911 - DNA, 22 bp, Homo sapiens
aagtcacttgattgttgacaga

SEQ ID NO: 7055912 - DNA, 22 bp, Homo sapiens
aagtcagaaatatctgccatca

SEQ ID NO: 7055913 - DNA, 22 bp, Homo sapiens
aagtcagagcaactgagacatt

SEQ ID NO: 7055914 - DNA, 22 bp, Homo sapiens
aagtcagcactccaggaagcca

SEQ ID NO: 7055915 - DNA, 22 bp, Homo sapiens
aatatttgttagtgttttaatg

SEQ ID NO: 7055916 - DNA, 22 bp, Homo sapiens
aatatcacaggaggagaccaag

SEQ ID NO: 7055917 - DNA, 22 bp, Homo sapiens
aatatatttgaatcaggaacaa

SEQ ID NO: 7055918 - DNA, 22 bp, Homo sapiens
aatatatagaagtacccgttgt

SEQ ID NO: 7055919 - DNA, 22 bp, Homo sapiens
aatatatagaagtacccgttgt

SEQ ID NO: 7055920 - DNA, 19 bp, Homo sapiens
acttgaaagcagagagttt

SEQ ID NO: 7055921 - DNA, 22 bp, Homo sapiens
acttgaaaccttggcaaacaat

SEQ ID NO: 7055922 - DNA, 22 bp, Homo sapiens
acttgaaaccctgagatgataa

SEQ ID NO: 7055923 - DNA, 22 bp, Homo sapiens
aatacaatcaaattcactagca

SEQ ID NO: 7055924 - DNA, 22 bp, Homo sapiens
aatacagagaatgttatttgga

SEQ ID NO: 7055925 - DNA, 22 bp, Homo sapiens
acttcctgctatgagcttctgt

SEQ ID NO: 7055926 - DNA, 22 bp, Homo sapiens
acttcctggattcccaagggct

SEQ ID NO: 7055927 - DNA, 19 bp, Homo sapiens
acttcttttcaacacagga

SEQ ID NO: 7055928 - DNA, 22 bp, Homo sapiens
acttgtttacaagcagttctga

SEQ ID NO: 7055929 - DNA, 22 bp, Homo sapiens
aatcaacattgttttaagtcaa

SEQ ID NO: 7055930 - DNA, 22 bp, Homo sapiens
aatatttttgaggccctgttat

SEQ ID NO: 7055931 - DNA, 22 bp, Homo sapiens
aatatttttgaggccctgttat

SEQ ID NO: 7055932 - DNA, 22 bp, Homo sapiens
aatattttaggctttccaggct

SEQ ID NO: 7055933 - DNA, 19 bp, Homo sapiens
aatattttagcctcttcct

SEQ ID NO: 7055934 - DNA, 22 bp, Homo sapiens
aatccagggtgtggcctttcca

SEQ ID NO: 7055935 - DNA, 22 bp, Homo sapiens
aatccatttactctttacaaga

SEQ ID NO: 7055936 - DNA, 22 bp, Homo sapiens
aatcccagctactcaggaagtt

SEQ ID NO: 7055937 - DNA, 20 bp, Homo sapiens
agaaatacatgcatgcatga

SEQ ID NO: 7055938 - DNA, 22 bp, Homo sapiens
agaaatactaggaatattcata

SEQ ID NO: 7055939 - DNA, 22 bp, Homo sapiens
agaaaactctacatctgtatgt

SEQ ID NO: 7055940 - DNA, 22 bp, Homo sapiens
agaaaactgcagagtagcctca

SEQ ID NO: 7055941 - DNA, 22 bp, Homo sapiens
aatgaacacagccctctacttt

SEQ ID NO: 7055942 - DNA, 22 bp, Homo sapiens
aatgaacacagccctctacttt

SEQ ID NO: 7055943 - DNA, 22 bp, Homo sapiens
agaaaacactgccccctctctc

SEQ ID NO: 7055944 - DNA, 22 bp, Homo sapiens
aatgagacacgtgaagcagatg

SEQ ID NO: 7055945 - DNA, 22 bp, Homo sapiens
aatgagaagcctaggtgtactg

SEQ ID NO: 7055946 - DNA, 19 bp, Homo sapiens
aatgactgagtacattgtc

SEQ ID NO: 7055947 - DNA, 22 bp, Homo sapiens
aatgactgtagtcatattaagg

SEQ ID NO: 7055948 - DNA, 22 bp, Homo sapiens
acacatatggttgctgcagtga

SEQ ID NO: 7055949 - DNA, 22 bp, Homo sapiens
acacatatgtatgcatcatgtg

SEQ ID NO: 7055950 - DNA, 20 bp, Homo sapiens
agcaggaaaagtgccagtct

SEQ ID NO: 7055951 - DNA, 23 bp, Homo sapiens
agcaggaaaccgagggtgatgtt

SEQ ID NO: 7055952 - DNA, 22 bp, Homo sapiens
agcagcaggtgcttctggatct

SEQ ID NO: 7055953 - DNA, 22 bp, Homo sapiens
agcagcagtacatataagacta

SEQ ID NO: 7055954 - DNA, 22 bp, Homo sapiens
agcagcagtcctttgtgtaatt

SEQ ID NO: 7055955 - DNA, 22 bp, Homo sapiens
agcagcagtgttctggaattct

SEQ ID NO: 7055956 - DNA, 22 bp, Homo sapiens
acacaggagaaaagatctccca

SEQ ID NO: 7055957 - DNA, 22 bp, Homo sapiens
acacaggacagggatgtgtttt

SEQ ID NO: 7055958 - DNA, 22 bp, Homo sapiens
acacaggaagtcagcactgatg

SEQ ID NO: 7055959 - DNA, 22 bp, Homo sapiens
acacaggaagagagataataat

SEQ ID NO: 7055960 - DNA, 22 bp, Homo sapiens
acacagcaacttgcagtatgga

SEQ ID NO: 7055961 - DNA, 22 bp, Homo sapiens
acaattttaagccagagtgggt

SEQ ID NO: 7055962 - DNA, 22 bp, Homo sapiens
agcaccatgaccttgccattga

SEQ ID NO: 7055963 - DNA, 22 bp, Homo sapiens
agcaccattgcaaatatggcag

SEQ ID NO: 7055964 - DNA, 22 bp, Homo sapiens
agcacctgcacagtggaggaaa

SEQ ID NO: 7055965 - DNA, 22 bp, Homo sapiens
agcacctgcctgcattggctat

SEQ ID NO: 7055966 - DNA, 22 bp, Homo sapiens
acaattctgatggtttcccagt

SEQ ID NO: 7055967 - DNA, 22 bp, Homo sapiens
agccacaggccatgagatacca

SEQ ID NO: 7055968 - DNA, 22 bp, Homo sapiens
agccacagggggtgagggacaa

SEQ ID NO: 7055969 - DNA, 22 bp, Homo sapiens
agcagtggtgtgaggagggctc

SEQ ID NO: 7055970 - DNA, 22 bp, Homo sapiens
agcagtggtgtgaggagggctc

SEQ ID NO: 7055971 - DNA, 22 bp, Homo sapiens
acagaaagataggcacaaggtc

SEQ ID NO: 7055972 - DNA, 22 bp, Homo sapiens
agcagtgggggagtgttagttt

SEQ ID NO: 7055973 - DNA, 22 bp, Homo sapiens
agcagtggctggatggtgtgct

SEQ ID NO: 7055974 - DNA, 22 bp, Homo sapiens
agcagtggctggatggtgtgct

SEQ ID NO: 7055975 - DNA, 22 bp, Homo sapiens
agcagtgggtgacagagctgag

SEQ ID NO: 7055976 - DNA, 22 bp, Homo sapiens
agcagtgggtggtttttgagca

SEQ ID NO: 7055977 - DNA, 22 bp, Homo sapiens
agcagtggtgtgaggagggctc

SEQ ID NO: 7055978 - DNA, 22 bp, Homo sapiens
acactgtgcatgcatatacaca

SEQ ID NO: 7055979 - DNA, 23 bp, Homo sapiens
acacatttttcccgttctgaggt

SEQ ID NO: 7055980 - DNA, 23 bp, Homo sapiens
acacatttttcccgttctgaggt

SEQ ID NO: 7055981 - DNA, 23 bp, Homo sapiens
acacatttttcccgttctgaggt

SEQ ID NO: 7055982 - DNA, 22 bp, Homo sapiens
acacattttcaacactgtcaag

SEQ ID NO: 7055983 - DNA, 22 bp, Homo sapiens
acacattttctaacagggatca

SEQ ID NO: 7055984 - DNA, 19 bp, Homo sapiens
acacatttgcacaatccac

SEQ ID NO: 7055985 - DNA, 22 bp, Homo sapiens
acacatttgcataatacctcat

SEQ ID NO: 7055986 - DNA, 23 bp, Homo sapiens
agcaggaaaccgagggtgatgtt

SEQ ID NO: 7055987 - DNA, 22 bp, Homo sapiens
acacatttctctttttgtaagt

SEQ ID NO: 7055988 - DNA, 22 bp, Homo sapiens
agcagggcccactaggggagat

SEQ ID NO: 7055989 - DNA, 22 bp, Homo sapiens
agcagggcagttaaagggtcct

SEQ ID NO: 7055990 - DNA, 18 bp, Homo sapiens
acactgcagcagtctgct

SEQ ID NO: 7055991 - DNA, 22 bp, Homo sapiens
agccccccaagggccttctctt

SEQ ID NO: 7055992 - DNA, 23 bp, Homo sapiens
agcccctcatatctgctttctct

SEQ ID NO: 7055993 - DNA, 22 bp, Homo sapiens
acagagcagttctggagctggc

SEQ ID NO: 7055994 - DNA, 22 bp, Homo sapiens
agcccctctgtggctctgcctc

SEQ ID NO: 7055995 - DNA, 22 bp, Homo sapiens
agcccctgctgggtgtagctca

SEQ ID NO: 7055996 - DNA, 22 bp, Homo sapiens
agcccctgggagtagctgctgc

SEQ ID NO: 7055997 - DNA, 22 bp, Homo sapiens
agcccctgtaccctgagtgctt

SEQ ID NO: 7055998 - DNA, 23 bp, Homo sapiens
acagaggtccaaacagtataagc

SEQ ID NO: 7055999 - DNA, 22 bp, Homo sapiens
acagaggtggacctcagcaggc

SEQ ID NO: 7056000 - DNA, 22 bp, Homo sapiens
acagataatacattgtgctaca

SEQ ID NO: 7056001 - DNA, 22 bp, Homo sapiens
agcctgagtgcttaggactgtt

SEQ ID NO: 7056002 - DNA, 22 bp, Homo sapiens
acagagcactgccctgtgccgc

SEQ ID NO: 7056003 - DNA, 22 bp, Homo sapiens
agcccagctgcctgcctgctgt

SEQ ID NO: 7056004 - DNA, 22 bp, Homo sapiens
agccacagtctgatgcctgaga

SEQ ID NO: 7056005 - DNA, 22 bp, Homo sapiens
agctagggcaaatatgagatac

SEQ ID NO: 7056006 - DNA, 22 bp, Homo sapiens
agctaggggaccaaggtggccc

SEQ ID NO: 7056007 - DNA, 23 bp, Homo sapiens
acagcaagaggaccagatgtgag

SEQ ID NO: 7056008 - DNA, 21 bp, Homo sapiens
acagcaagccttcacatgagt

SEQ ID NO: 7056009 - DNA, 22 bp, Homo sapiens
agcctgccttgggctgcttgag

SEQ ID NO: 7056010 - DNA, 22 bp, Homo sapiens
acagcaagacccctagcatggt

SEQ ID NO: 7056011 - DNA, 22 bp, Homo sapiens
acagcaggcatgaagaaatgtt

SEQ ID NO: 7056012 - DNA, 22 bp, Homo sapiens
acagcaggcacacaaggataga

SEQ ID NO: 7056013 - DNA, 22 bp, Homo sapiens
acagcaggcacacaaggataga

SEQ ID NO: 7056014 - DNA, 22 bp, Homo sapiens
acagcaggcatgaagaaatgtt

SEQ ID NO: 7056015 - DNA, 22 bp, Homo sapiens
acagcaggcatgaatgacactg

SEQ ID NO: 7056016 - DNA, 22 bp, Homo sapiens
acagcaggcatgaatgacactg

SEQ ID NO: 7056017 - DNA, 22 bp, Homo sapiens
acagcaggcatgaatgacactg

SEQ ID NO: 7056018 - DNA, 22 bp, Homo sapiens
agctcctgtgtgcccacctgct

SEQ ID NO: 7056019 - DNA, 22 bp, Homo sapiens
agctcaagagtagttcgagggg

SEQ ID NO: 7056020 - DNA, 22 bp, Homo sapiens
acagcagcgtgaagtgtgttat

SEQ ID NO: 7056021 - DNA, 22 bp, Homo sapiens
acagcagctaaaggtgtctcct

SEQ ID NO: 7056022 - DNA, 22 bp, Homo sapiens
acagcaggaattaacatataag

SEQ ID NO: 7056023 - DNA, 22 bp, Homo sapiens
acagcaggagccttcatatgct

SEQ ID NO: 7056024 - DNA, 22 bp, Homo sapiens
acagcaggatttggcgatgttg

SEQ ID NO: 7056025 - DNA, 22 bp, Homo sapiens
agctctggggcctgtcccacat

SEQ ID NO: 7056026 - DNA, 22 bp, Homo sapiens
agctctgggggaaagtctgctc

SEQ ID NO: 7056027 - DNA, 19 bp, Homo sapiens
agctcctgttcagcagctc

SEQ ID NO: 7056028 - DNA, 19 bp, Homo sapiens
agctcctgttcagcagctc

SEQ ID NO: 7056029 - DNA, 22 bp, Homo sapiens
agatggggctcagtgtggaggc

SEQ ID NO: 7056030 - DNA, 22 bp, Homo sapiens
agatggggctcagtgtggaggc

SEQ ID NO: 7056031 - DNA, 22 bp, Homo sapiens
agatggggcagaatggagccat

SEQ ID NO: 7056032 - DNA, 22 bp, Homo sapiens
acaagtctttttcatgtcttct

SEQ ID NO: 7056033 - DNA, 22 bp, Homo sapiens
acaagtgggtcctacataaagc

SEQ ID NO: 7056034 - DNA, 22 bp, Homo sapiens
acaaggaacaagcatgtagttt

SEQ ID NO: 7056035 - DNA, 22 bp, Homo sapiens
acaaattctacaatcatatgat

SEQ ID NO: 7056036 - DNA, 18 bp, Homo sapiens
acaaatgtgtcacaggaa

SEQ ID NO: 7056037 - DNA, 22 bp, Homo sapiens
agcaaggcagtcagctggctgg

SEQ ID NO: 7056038 - DNA, 22 bp, Homo sapiens
agcaaggattatcctgggaagg

SEQ ID NO: 7056039 - DNA, 22 bp, Homo sapiens
agcacaggtacggagatgctac

SEQ ID NO: 7056040 - DNA, 22 bp, Homo sapiens
agcacaggtacggagatgctac

SEQ ID NO: 7056041 - DNA, 22 bp, Homo sapiens
agcaagatttttcaggttagta

SEQ ID NO: 7056042 - DNA, 22 bp, Homo sapiens
agcaagcagaaatgccatggca

SEQ ID NO: 7056043 - DNA, 22 bp, Homo sapiens
agcaaggaaactatggagagat

SEQ ID NO: 7056044 - DNA, 22 bp, Homo sapiens
acaattcaagatgagattcagg

SEQ ID NO: 7056045 - DNA, 22 bp, Homo sapiens
agatggggctgaaagttccaat

SEQ ID NO: 7056046 - DNA, 22 bp, Homo sapiens
agatggggctcagtgtggaggc

SEQ ID NO: 7056047 - DNA, 22 bp, Homo sapiens
acaatgtttttgttcaaagagt

SEQ ID NO: 7056048 - DNA, 22 bp, Homo sapiens
acaaatgagaatgtagacagag

SEQ ID NO: 7056049 - DNA, 22 bp, Homo sapiens
acaaacttcccagacaagctcc

SEQ ID NO: 7056050 - DNA, 22 bp, Homo sapiens
acaaaattgtgttaaactttat

SEQ ID NO: 7056051 - DNA, 22 bp, Homo sapiens
acaaacatcttgacctcagatt

SEQ ID NO: 7056052 - DNA, 21 bp, Homo sapiens
agaggccctcggactgggcgt

SEQ ID NO: 7056053 - DNA, 22 bp, Homo sapiens
acaaaaagggagatgaggtaga

SEQ ID NO: 7056054 - DNA, 22 bp, Homo sapiens
agaggccatgctagaggcctgg

SEQ ID NO: 7056055 - DNA, 20 bp, Homo sapiens
agaggccagttaggagtcta

SEQ ID NO: 7056056 - DNA, 22 bp, Homo sapiens
aattttctgcctagcaaaaact

SEQ ID NO: 7056057 - DNA, 22 bp, Homo sapiens
aattttctaaggtgatgatctg

SEQ ID NO: 7056058 - DNA, 22 bp, Homo sapiens
aattttctgatgatgaagcacg

SEQ ID NO: 7056059 - DNA, 22 bp, Homo sapiens
aattttattaactggatgtagc

SEQ ID NO: 7056060 - DNA, 22 bp, Homo sapiens
aattttatgccttgcacgttgg

SEQ ID NO: 7056061 - DNA, 22 bp, Homo sapiens
aattttattaactggatgtagc

SEQ ID NO: 7056062 - DNA, 22 bp, Homo sapiens
aattttattagaaggcaagggg

SEQ ID NO: 7056063 - DNA, 22 bp, Homo sapiens
aattttattagaaggcaagggg

SEQ ID NO: 7056064 - DNA, 22 bp, Homo sapiens
aattttcacagtgctgtgagat

SEQ ID NO: 7056065 - DNA, 22 bp, Homo sapiens
aattttcacagtgctgtgagat

SEQ ID NO: 7056066 - DNA, 22 bp, Homo sapiens
agagctgggtgaagtgccatca

SEQ ID NO: 7056067 - DNA, 22 bp, Homo sapiens
agagctgggtggtggtgactca

SEQ ID NO: 7056068 - DNA, 22 bp, Homo sapiens
agagctgggtggtggtgactca

SEQ ID NO: 7056069 - DNA, 22 bp, Homo sapiens
aatttgttaaaagtgagtgaca

SEQ ID NO: 7056070 - DNA, 22 bp, Homo sapiens
aatgtcactctgtttcctctgc

SEQ ID NO: 7056071 - DNA, 22 bp, Homo sapiens
agacagggtcttgatcagagct

SEQ ID NO: 7056072 - DNA, 22 bp, Homo sapiens
agacagggtcttgatcagagct

SEQ ID NO: 7056073 - DNA, 22 bp, Homo sapiens
agacagggtcttgatcagagct

SEQ ID NO: 7056074 - DNA, 22 bp, Homo sapiens
agacagggccactcatcctcac

SEQ ID NO: 7056075 - DNA, 22 bp, Homo sapiens
agacagggtgatcgcttgagcc

SEQ ID NO: 7056076 - DNA, 22 bp, Homo sapiens
agacagggtgatcgcttgagcc

SEQ ID NO: 7056077 - DNA, 22 bp, Homo sapiens
aatgtattcctcatgcaagagt

SEQ ID NO: 7056078 - DNA, 22 bp, Homo sapiens
aatgtctgccagaactgatcat

SEQ ID NO: 7056079 - DNA, 22 bp, Homo sapiens
aatgtctgagtctctgtatccc

SEQ ID NO: 7056080 - DNA, 22 bp, Homo sapiens
aatgtctgctctactcaggagg

SEQ ID NO: 7056081 - DNA, 22 bp, Homo sapiens
agaagggctacacgggctctcc

SEQ ID NO: 7056082 - DNA, 22 bp, Homo sapiens
agaagggccagctggacacctg

SEQ ID NO: 7056083 - DNA, 22 bp, Homo sapiens
aatgcaaacttcttgttacttg

SEQ ID NO: 7056084 - DNA, 21 bp, Homo sapiens
agacactggtttagcattcat

SEQ ID NO: 7056085 - DNA, 19 bp, Homo sapiens
agacagagactgaaataga

SEQ ID NO: 7056086 - DNA, 22 bp, Homo sapiens
agacagagatactatgttgtca

SEQ ID NO: 7056087 - DNA, 19 bp, Homo sapiens
agacagagctcagtgggtt

SEQ ID NO: 7056088 - DNA, 19 bp, Homo sapiens
agacagagctcagtgggtt

SEQ ID NO: 7056089 - DNA, 21 bp, Homo sapiens
agacagagtgcagtctacata

SEQ ID NO: 7056090 - DNA, 22 bp, Homo sapiens
agacaggccactctggtctggt

SEQ ID NO: 7056091 - DNA, 22 bp, Homo sapiens
agacaggctgctgtctgctagg

SEQ ID NO: 7056092 - DNA, 22 bp, Homo sapiens
aattagtattgcgattcattag

SEQ ID NO: 7056093 - DNA, 22 bp, Homo sapiens
aatgttgaggatatcagaaaat

SEQ ID NO: 7056094 - DNA, 22 bp, Homo sapiens
aatgttattgtcctttccaaaa

SEQ ID NO: 7056095 - DNA, 22 bp, Homo sapiens
aatgttatttctgcatagtagt

SEQ ID NO: 7056096 - DNA, 22 bp, Homo sapiens
aattggaaaaagacttaattgc

SEQ ID NO: 7056097 - DNA, 22 bp, Homo sapiens
aattatatgttaatcttcaatt

SEQ ID NO: 7056098 - DNA, 22 bp, Homo sapiens
aattatacattgaacaatctag

SEQ ID NO: 7056099 - DNA, 20 bp, Homo sapiens
aattatataactccaacatt

SEQ ID NO: 7056100 - DNA, 20 bp, Homo sapiens
aatttactcacagaatgaat

SEQ ID NO: 7056101 - DNA, 22 bp, Homo sapiens
aatttacagttgctgatggtac

SEQ ID NO: 7056102 - DNA, 22 bp, Homo sapiens
aatttacacttcatttggaggg

SEQ ID NO: 7056103 - DNA, 22 bp, Homo sapiens
aatttacaggtgcactcgccat

SEQ ID NO: 7056104 - DNA, 22 bp, Homo sapiens
agagctggggccagagtcaagg

SEQ ID NO: 7056105 - DNA, 22 bp, Homo sapiens
agagctggggcataaatgccac

SEQ ID NO: 7056106 - DNA, 22 bp, Homo sapiens
agagctgggacttggactcaat

SEQ ID NO: 7056107 - DNA, 22 bp, Homo sapiens
tcacatttatttcaaagttact

SEQ ID NO: 7056108 - DNA, 22 bp, Homo sapiens
tcacatttatttcaaagttact

SEQ ID NO: 7056109 - DNA, 22 bp, Homo sapiens
tcacatttcaagtgctcaaaag

SEQ ID NO: 7056110 - DNA, 21 bp, Homo sapiens
tcacatttctcatgggtaaat

SEQ ID NO: 7056111 - DNA, 22 bp, Homo sapiens
tcacatttctgattataccaaa

SEQ ID NO: 7056112 - DNA, 22 bp, Homo sapiens
tcacatttctttatgtagtctt

SEQ ID NO: 7056113 - DNA, 22 bp, Homo sapiens
tcacatgctgtgtgtggagatc

SEQ ID NO: 7056114 - DNA, 18 bp, Homo sapiens
tcacagtgctcttgccta

SEQ ID NO: 7056115 - DNA, 22 bp, Homo sapiens
tcacagtattcatgaacatgga

SEQ ID NO: 7056116 - DNA, 22 bp, Homo sapiens
tcaactgcaagtttgcttagtt

SEQ ID NO: 7056117 - DNA, 22 bp, Homo sapiens
tcaaccagagtttttcttaata

SEQ ID NO: 7056118 - DNA, 22 bp, Homo sapiens
tcagaaagaacacaggcagtag

SEQ ID NO: 7056119 - DNA, 22 bp, Homo sapiens
tcagaaagaacacaggcagtag

SEQ ID NO: 7056120 - DNA, 22 bp, Homo sapiens
tcagaaagacgaaacagatggg

SEQ ID NO: 7056121 - DNA, 22 bp, Homo sapiens
tcagaaagctatatggtgtgtc

SEQ ID NO: 7056122 - DNA, 22 bp, Homo sapiens
tcagaaagctgattcttgatac

SEQ ID NO: 7056123 - DNA, 22 bp, Homo sapiens
tcagaaagcttagtgtcttgca

SEQ ID NO: 7056124 - DNA, 22 bp, Homo sapiens
tcagaaagcttttacttaaaca

SEQ ID NO: 7056125 - DNA, 22 bp, Homo sapiens
tcagaaagcttttacttaaaca

SEQ ID NO: 7056126 - DNA, 22 bp, Homo sapiens
tcagaaaggagttagaggtctc

SEQ ID NO: 7056127 - DNA, 22 bp, Homo sapiens
tcagaaaggccacatggtgcag

SEQ ID NO: 7056128 - DNA, 22 bp, Homo sapiens
tcagaaaggttctatgttttac

SEQ ID NO: 7056129 - DNA, 22 bp, Homo sapiens
tcagaaaggttgagtcatgtgc

SEQ ID NO: 7056130 - DNA, 22 bp, Homo sapiens
tcagaagccggaagtgctcctc

SEQ ID NO: 7056131 - DNA, 22 bp, Homo sapiens
tcagaataagttatgaaatgaa

SEQ ID NO: 7056132 - DNA, 22 bp, Homo sapiens
tcactgcaacctccacctcctg

SEQ ID NO: 7056133 - DNA, 22 bp, Homo sapiens
tcactgcaacctccacctcctg

SEQ ID NO: 7056134 - DNA, 22 bp, Homo sapiens
tcactgcaacctccacctcctg

SEQ ID NO: 7056135 - DNA, 22 bp, Homo sapiens
tcactgcaacctccacctcctg

SEQ ID NO: 7056136 - DNA, 22 bp, Homo sapiens
tcactgcaacctccacctcctg

SEQ ID NO: 7056137 - DNA, 22 bp, Homo sapiens
tcactgcaacctccacctcctg

SEQ ID NO: 7056138 - DNA, 23 bp, Homo sapiens
tcactgctactcagcctgagatt

SEQ ID NO: 7056139 - DNA, 23 bp, Homo sapiens
tcactgctactcagcctgagatt

SEQ ID NO: 7056140 - DNA, 22 bp, Homo sapiens
tcactgctatattggatactga

SEQ ID NO: 7056141 - DNA, 22 bp, Homo sapiens
tcactgctcagtctgtactaca

SEQ ID NO: 7056142 - DNA, 22 bp, Homo sapiens
tcactgctcagtctgtactaca

SEQ ID NO: 7056143 - DNA, 22 bp, Homo sapiens
tcactgctctccaatgtggagt

SEQ ID NO: 7056144 - DNA, 22 bp, Homo sapiens
tcactgctctctaagcatcgcc

SEQ ID NO: 7056145 - DNA, 22 bp, Homo sapiens
tcactgctctgaaagtacaggg

SEQ ID NO: 7056146 - DNA, 22 bp, Homo sapiens
tcactgctgctgccatgatgga

SEQ ID NO: 7056147 - DNA, 22 bp, Homo sapiens
tcactgctgctgccatgatgga

SEQ ID NO: 7056148 - DNA, 22 bp, Homo sapiens
tcactgcttaactcaagatctc

SEQ ID NO: 7056149 - DNA, 22 bp, Homo sapiens
tcactgcttcttggagaatgtc

SEQ ID NO: 7056150 - DNA, 22 bp, Homo sapiens
tcactgcaacctccacctcccg

SEQ ID NO: 7056151 - DNA, 22 bp, Homo sapiens
tcactgcaacctccacctcccg

SEQ ID NO: 7056152 - DNA, 22 bp, Homo sapiens
tcactgcaacctccacctcccg

SEQ ID NO: 7056153 - DNA, 22 bp, Homo sapiens
tcacattttatatctctggttt

SEQ ID NO: 7056154 - DNA, 22 bp, Homo sapiens
tcacattttatctattttaagt

SEQ ID NO: 7056155 - DNA, 22 bp, Homo sapiens
tcacattttatctattttaagt

SEQ ID NO: 7056156 - DNA, 22 bp, Homo sapiens
tcacattttatctattttaagt

SEQ ID NO: 7056157 - DNA, 22 bp, Homo sapiens
tcactgcaacctccacctcccg

SEQ ID NO: 7056158 - DNA, 22 bp, Homo sapiens
tcactgcaacctccacctcccg

SEQ ID NO: 7056159 - DNA, 22 bp, Homo sapiens
tcactgcaacctccacctcccg

SEQ ID NO: 7056160 - DNA, 22 bp, Homo sapiens
tcacatttgcaattgcattgtt

SEQ ID NO: 7056161 - DNA, 22 bp, Homo sapiens
tcacatttgcaattgcattgtt

SEQ ID NO: 7056162 - DNA, 22 bp, Homo sapiens
tcacatttgtgttttattagag

SEQ ID NO: 7056163 - DNA, 22 bp, Homo sapiens
tcacatttgtgttttattagag

SEQ ID NO: 7056164 - DNA, 22 bp, Homo sapiens
tcacatttgttcctctgcactt

SEQ ID NO: 7056165 - DNA, 22 bp, Homo sapiens
tcacatttgttcttgaatctaa

SEQ ID NO: 7056166 - DNA, 22 bp, Homo sapiens
tcagatttctagcgtttggcca

SEQ ID NO: 7056167 - DNA, 22 bp, Homo sapiens
tcagattttattttcctgttac

SEQ ID NO: 7056168 - DNA, 22 bp, Homo sapiens
tcagattttgcacgaggttttg

SEQ ID NO: 7056169 - DNA, 18 bp, Homo sapiens
tcagatttaactgtatcc

SEQ ID NO: 7056170 - DNA, 22 bp, Homo sapiens
tcagaattaagctcttggtcag

SEQ ID NO: 7056171 - DNA, 22 bp, Homo sapiens
tcagaattagagctcttcttga

SEQ ID NO: 7056172 - DNA, 23 bp, Homo sapiens
tcagaattccagtttctttgaag

SEQ ID NO: 7056173 - DNA, 19 bp, Homo sapiens
tcagaattctgtctcttga

SEQ ID NO: 7056174 - DNA, 22 bp, Homo sapiens
tcagcaagaagctgtgggcttc

SEQ ID NO: 7056175 - DNA, 22 bp, Homo sapiens
tcagcaagcagggggatgttca

SEQ ID NO: 7056176 - DNA, 22 bp, Homo sapiens
tcagcaggctgtcagcaggggc

SEQ ID NO: 7056177 - DNA, 22 bp, Homo sapiens
tcagcaggctgtcagcaggggc

SEQ ID NO: 7056178 - DNA, 17 bp, Homo sapiens
tcagcaggggccaagct

SEQ ID NO: 7056179 - DNA, 18 bp, Homo sapiens
tcaggagacacagacgca

SEQ ID NO: 7056180 - DNA, 22 bp, Homo sapiens
tcaggagacaaagggtgcggag

SEQ ID NO: 7056181 - DNA, 22 bp, Homo sapiens
tcaggagaaggcaatgtggaaa

SEQ ID NO: 7056182 - DNA, 22 bp, Homo sapiens
tcaggagaacttccttctaccc

SEQ ID NO: 7056183 - DNA, 22 bp, Homo sapiens
tcaggagaacttccttctaccc

SEQ ID NO: 7056184 - DNA, 22 bp, Homo sapiens
tcaggacacttggcacaaggtc

SEQ ID NO: 7056185 - DNA, 19 bp, Homo sapiens
tcagctggcaggcctcctc

SEQ ID NO: 7056186 - DNA, 22 bp, Homo sapiens
tcagctggtgagtggatagaca

SEQ ID NO: 7056187 - DNA, 22 bp, Homo sapiens
tcagctctgcactccactgtgg

SEQ ID NO: 7056188 - DNA, 22 bp, Homo sapiens
tcagctgctcaaatttatgtca

SEQ ID NO: 7056189 - DNA, 22 bp, Homo sapiens
tcagctgctcaaatttatgtca

SEQ ID NO: 7056190 - DNA, 22 bp, Homo sapiens
tcagctgctgtggtatgtacat

SEQ ID NO: 7056191 - DNA, 22 bp, Homo sapiens
tccaactttctcctccggcttg

SEQ ID NO: 7056192 - DNA, 22 bp, Homo sapiens
tccaactttctcctccggcttg

SEQ ID NO: 7056193 - DNA, 22 bp, Homo sapiens
tccaagcttgctttagccacag

SEQ ID NO: 7056194 - DNA, 22 bp, Homo sapiens
tcatttttttccggtaggaata

SEQ ID NO: 7056195 - DNA, 22 bp, Homo sapiens
tcatttttcacacagggtcacc

SEQ ID NO: 7056196 - DNA, 22 bp, Homo sapiens
tcatttttctcttacacgtaga

SEQ ID NO: 7056197 - DNA, 22 bp, Homo sapiens
tcatttttgaccatgggtagga

SEQ ID NO: 7056198 - DNA, 22 bp, Homo sapiens
tcatttgtacttgtgtgcttgt

SEQ ID NO: 7056199 - DNA, 21 bp, Homo sapiens
tcatttgtgatctgatttcca

SEQ ID NO: 7056200 - DNA, 22 bp, Homo sapiens
tcatttgttcatctgctcttct

SEQ ID NO: 7056201 - DNA, 21 bp, Homo sapiens
tcatttttattgctaccttgc

SEQ ID NO: 7056202 - DNA, 22 bp, Homo sapiens
tcatttctctgagtctgataat

SEQ ID NO: 7056203 - DNA, 22 bp, Homo sapiens
tcatttctcctaagtgaaatat

SEQ ID NO: 7056204 - DNA, 22 bp, Homo sapiens
tcatttctattgctactgtctg

SEQ ID NO: 7056205 - DNA, 22 bp, Homo sapiens
tcatttctcccggccaaaaact

SEQ ID NO: 7056206 - DNA, 22 bp, Homo sapiens
tcatttctccgacctgctgtcc

SEQ ID NO: 7056207 - DNA, 22 bp, Homo sapiens
tcatttctccgacctgctgtcc

SEQ ID NO: 7056208 - DNA, 22 bp, Homo sapiens
tcatttctctgagtctgataat

SEQ ID NO: 7056209 - DNA, 22 bp, Homo sapiens
tcatttctgagccttccatgat

SEQ ID NO: 7056210 - DNA, 20 bp, Homo sapiens
tcatttcttggggttccaag

SEQ ID NO: 7056211 - DNA, 22 bp, Homo sapiens
tcatttctatctatgcagcttc

SEQ ID NO: 7056212 - DNA, 22 bp, Homo sapiens
tcatttctattgctactgtctg

SEQ ID NO: 7056213 - DNA, 22 bp, Homo sapiens
tcatttacgcgcctccttcctt

SEQ ID NO: 7056214 - DNA, 22 bp, Homo sapiens
tcatttactggatccataagca

SEQ ID NO: 7056215 - DNA, 22 bp, Homo sapiens
tcattgttgcgttaatgtcttc

SEQ ID NO: 7056216 - DNA, 19 bp, Homo sapiens
tcattgttggtttgtcggg

SEQ ID NO: 7056217 - DNA, 22 bp, Homo sapiens
tcatttaataatttttgagtag

SEQ ID NO: 7056218 - DNA, 22 bp, Homo sapiens
tcatttaataatttttgagtag

SEQ ID NO: 7056219 - DNA, 22 bp, Homo sapiens
tcatttaatagcttttgtcttt

SEQ ID NO: 7056220 - DNA, 22 bp, Homo sapiens
tcattgtattcagaactgaaga

SEQ ID NO: 7056221 - DNA, 23 bp, Homo sapiens
tcattgtgactgtgccacataac

SEQ ID NO: 7056222 - DNA, 20 bp, Homo sapiens
tcattgtgttgccaattccc

SEQ ID NO: 7056223 - DNA, 22 bp, Homo sapiens
tcattgttatgttttgctgtct

SEQ ID NO: 7056224 - DNA, 22 bp, Homo sapiens
tcagtagcagaaagcaatgagt

SEQ ID NO: 7056225 - DNA, 22 bp, Homo sapiens
tcagtaaatgaatgaatatatg

SEQ ID NO: 7056226 - DNA, 22 bp, Homo sapiens
tcagggctgcagaagaggcagg

SEQ ID NO: 7056227 - DNA, 22 bp, Homo sapiens
tcagggctccggaagtggcctc

SEQ ID NO: 7056228 - DNA, 22 bp, Homo sapiens
tcaggctgtagggcccctggag

SEQ ID NO: 7056229 - DNA, 22 bp, Homo sapiens
tcaggctgtatatcttgcactc

SEQ ID NO: 7056230 - DNA, 22 bp, Homo sapiens
tcaggctgttagccacctcctc

SEQ ID NO: 7056231 - DNA, 22 bp, Homo sapiens
tcaggctgttcctgtccaaaat

SEQ ID NO: 7056232 - DNA, 17 bp, Homo sapiens
tcaggctgggtgcagtg

SEQ ID NO: 7056233 - DNA, 21 bp, Homo sapiens
tcaggagagcccatctacaaa

SEQ ID NO: 7056234 - DNA, 21 bp, Homo sapiens
tcaggagagcccatctacaaa

SEQ ID NO: 7056235 - DNA, 21 bp, Homo sapiens
tcaggagagcccatctacaaa

SEQ ID NO: 7056236 - DNA, 17 bp, Homo sapiens
tcaggctgggtgcagtg

SEQ ID NO: 7056237 - DNA, 22 bp, Homo sapiens
tcaggagagagttgggtaggct

SEQ ID NO: 7056238 - DNA, 22 bp, Homo sapiens
tcaggagagagaaattggggct

SEQ ID NO: 7056239 - DNA, 22 bp, Homo sapiens
tcaggagagaaagaatacaatt

SEQ ID NO: 7056240 - DNA, 22 bp, Homo sapiens
tcaggagagaaagaatacaatt

SEQ ID NO: 7056241 - DNA, 22 bp, Homo sapiens
tcaggctggtccccacagtgga

SEQ ID NO: 7056242 - DNA, 22 bp, Homo sapiens
tcaggctggtccccacagtgga

SEQ ID NO: 7056243 - DNA, 20 bp, Homo sapiens
tcaggctggtgggctttccc

SEQ ID NO: 7056244 - DNA, 22 bp, Homo sapiens
tcaggctggtggtcagatggct

SEQ ID NO: 7056245 - DNA, 22 bp, Homo sapiens
tcaggctggtggtcagatggct

SEQ ID NO: 7056246 - DNA, 22 bp, Homo sapiens
tcaggctggtggtcagatggct

SEQ ID NO: 7056247 - DNA, 22 bp, Homo sapiens
tcaggctgtaaatggtgtgggt

SEQ ID NO: 7056248 - DNA, 22 bp, Homo sapiens
tcaggctgtagggcccctggag

SEQ ID NO: 7056249 - DNA, 22 bp, Homo sapiens
tcagtctcatcaactctattcc

SEQ ID NO: 7056250 - DNA, 22 bp, Homo sapiens
tcagttaacaactatttattga

SEQ ID NO: 7056251 - DNA, 22 bp, Homo sapiens
tcataaagttatcaccaaatcc

SEQ ID NO: 7056252 - DNA, 23 bp, Homo sapiens
tcataaatattagcacagtagga

SEQ ID NO: 7056253 - DNA, 23 bp, Homo sapiens
tcataaatattagcacagtagga

SEQ ID NO: 7056254 - DNA, 22 bp, Homo sapiens
tcataaatcatactccatttgc

SEQ ID NO: 7056255 - DNA, 22 bp, Homo sapiens
tcatctttcctcaaaagatcca

SEQ ID NO: 7056256 - DNA, 22 bp, Homo sapiens
tcatctttaccccttgcttcaa

SEQ ID NO: 7056257 - DNA, 22 bp, Homo sapiens
tcatcttctattaatagggaga

SEQ ID NO: 7056258 - DNA, 22 bp, Homo sapiens
tcatcttctattaatagggaga

SEQ ID NO: 7056259 - DNA, 22 bp, Homo sapiens
tcatcttgctgccattgcttta

SEQ ID NO: 7056260 - DNA, 23 bp, Homo sapiens
tcatctgtaagtatctgtggagt

SEQ ID NO: 7056261 - DNA, 22 bp, Homo sapiens
tcatctgtcatccacaaagctg

SEQ ID NO: 7056262 - DNA, 22 bp, Homo sapiens
tcatctgtcccaggcttttttc

SEQ ID NO: 7056263 - DNA, 22 bp, Homo sapiens
tcatagaaatggaaagtatatt

SEQ ID NO: 7056264 - DNA, 22 bp, Homo sapiens
tcataaatgcagtgtcataaat

SEQ ID NO: 7056265 - DNA, 22 bp, Homo sapiens
tcataaatgcagtgtcataaat

SEQ ID NO: 7056266 - DNA, 22 bp, Homo sapiens
tcataaattgattatgtgcttt

SEQ ID NO: 7056267 - DNA, 22 bp, Homo sapiens
tcctaaaggctgcttttatatt

SEQ ID NO: 7056268 - DNA, 16 bp, Homo sapiens
tccctgggagtggtgg

SEQ ID NO: 7056269 - DNA, 22 bp, Homo sapiens
tccctgggaccggcagctcaca

SEQ ID NO: 7056270 - DNA, 22 bp, Homo sapiens
tcctagaataatctttgactgc

SEQ ID NO: 7056271 - DNA, 22 bp, Homo sapiens
tcctagaatagtgtgtctggag

SEQ ID NO: 7056272 - DNA, 22 bp, Homo sapiens
tcctagaatctttgtaagattg

SEQ ID NO: 7056273 - DNA, 22 bp, Homo sapiens
tcctagaatgcacctctgctgt

SEQ ID NO: 7056274 - DNA, 22 bp, Homo sapiens
tccctgggaacaaaggatgaga

SEQ ID NO: 7056275 - DNA, 22 bp, Homo sapiens
tccctggctgggggctgccttg

SEQ ID NO: 7056276 - DNA, 22 bp, Homo sapiens
tccctggcacaagaaggctgtc

SEQ ID NO: 7056277 - DNA, 22 bp, Homo sapiens
tcctcagcaaacacttcactct

SEQ ID NO: 7056278 - DNA, 23 bp, Homo sapiens
tcctcagcatgttttgtcatgta

SEQ ID NO: 7056279 - DNA, 22 bp, Homo sapiens
tcctcagacttccctttgtgta

SEQ ID NO: 7056280 - DNA, 22 bp, Homo sapiens
tcctcagcattagcacagacat

SEQ ID NO: 7056281 - DNA, 21 bp, Homo sapiens
tcctcagggccccagagcact

SEQ ID NO: 7056282 - DNA, 22 bp, Homo sapiens
tcctcacaagcatcctgtctca

SEQ ID NO: 7056283 - DNA, 22 bp, Homo sapiens
tcctcacagcatgaccaggcag

SEQ ID NO: 7056284 - DNA, 22 bp, Homo sapiens
tcctcacagctggttcattcag

SEQ ID NO: 7056285 - DNA, 22 bp, Homo sapiens
tcctcacatggtgagccacaca

SEQ ID NO: 7056286 - DNA, 22 bp, Homo sapiens
tcctcagaaacccctgtgaggt

SEQ ID NO: 7056287 - DNA, 20 bp, Homo sapiens
tcccaggctgggctccagct

SEQ ID NO: 7056288 - DNA, 22 bp, Homo sapiens
tcccaggctggggccaggtgac

SEQ ID NO: 7056289 - DNA, 22 bp, Homo sapiens
tcccaggctgggggcctgaagt

SEQ ID NO: 7056290 - DNA, 22 bp, Homo sapiens
tcccaggctgggggcctgaagt

SEQ ID NO: 7056291 - DNA, 23 bp, Homo sapiens
tcccagggaaggtgagcgaggct

SEQ ID NO: 7056292 - DNA, 22 bp, Homo sapiens
tcccagggacaccaagctgttt

SEQ ID NO: 7056293 - DNA, 22 bp, Homo sapiens
tcccagggacaccaagctgttt

SEQ ID NO: 7056294 - DNA, 22 bp, Homo sapiens
tcccaggctaggcctctgcgtt

SEQ ID NO: 7056295 - DNA, 20 bp, Homo sapiens
tcccaggctccaccctagac

SEQ ID NO: 7056296 - DNA, 22 bp, Homo sapiens
tcccaggctggcaggcagcagt

SEQ ID NO: 7056297 - DNA, 22 bp, Homo sapiens
tcccagggacccagcctgatac

SEQ ID NO: 7056298 - DNA, 22 bp, Homo sapiens
tcccagggacccagcctgatac

SEQ ID NO: 7056299 - DNA, 22 bp, Homo sapiens
tcccagggactctctgccttcc

SEQ ID NO: 7056300 - DNA, 22 bp, Homo sapiens
tcccagggactggatgatgcag

SEQ ID NO: 7056301 - DNA, 21 bp, Homo sapiens
tccctcagacagggtgcctat

SEQ ID NO: 7056302 - DNA, 22 bp, Homo sapiens
tccctcagagaccgtggtgcag

SEQ ID NO: 7056303 - DNA, 22 bp, Homo sapiens
tccctcagagggcaagcgcaga

SEQ ID NO: 7056304 - DNA, 22 bp, Homo sapiens
tccctcagatgagctcctagca

SEQ ID NO: 7056305 - DNA, 20 bp, Homo sapiens
tccctcagcacttctacctc

SEQ ID NO: 7056306 - DNA, 22 bp, Homo sapiens
tccctcagcttgtctccatgca

SEQ ID NO: 7056307 - DNA, 22 bp, Homo sapiens
tccctcagcttgtctccatgca

SEQ ID NO: 7056308 - DNA, 22 bp, Homo sapiens
tccctcagggtgcagttgcttt

SEQ ID NO: 7056309 - DNA, 22 bp, Homo sapiens
tccctcagtccctggacaggca

SEQ ID NO: 7056310 - DNA, 20 bp, Homo sapiens
tccctcagtcctggctttgt

SEQ ID NO: 7056311 - DNA, 20 bp, Homo sapiens
tccctcagtttccagccctg

SEQ ID NO: 7056312 - DNA, 22 bp, Homo sapiens
tccctccccacttctgagcttt

SEQ ID NO: 7056313 - DNA, 20 bp, Homo sapiens
tccctccctccagctctggg

SEQ ID NO: 7056314 - DNA, 18 bp, Homo sapiens
tccctccctgctgtggcc

SEQ ID NO: 7056315 - DNA, 19 bp, Homo sapiens
tccctccctgtaatctcac

SEQ ID NO: 7056316 - DNA, 22 bp, Homo sapiens
tccctctcttgggcgtggctca

SEQ ID NO: 7056317 - DNA, 22 bp, Homo sapiens
tccctgaaccactagtgatgag

SEQ ID NO: 7056318 - DNA, 22 bp, Homo sapiens
tccctgcctcctggcagtgcca

SEQ ID NO: 7056319 - DNA, 22 bp, Homo sapiens
tccaggccttgacaggtcagtt

SEQ ID NO: 7056320 - DNA, 20 bp, Homo sapiens
tccaggccttgttctcagat

SEQ ID NO: 7056321 - DNA, 22 bp, Homo sapiens
tccaggctaattttgcattgtt

SEQ ID NO: 7056322 - DNA, 22 bp, Homo sapiens
tccaggctagaagtcacaggcc

SEQ ID NO: 7056323 - DNA, 22 bp, Homo sapiens
tccaggctaggtttacaggaca

SEQ ID NO: 7056324 - DNA, 22 bp, Homo sapiens
tccaggctggacatgaggcggg

SEQ ID NO: 7056325 - DNA, 22 bp, Homo sapiens
tccaggctggcctcgcgtgaca

SEQ ID NO: 7056326 - DNA, 22 bp, Homo sapiens
tccagggaagagcagaggctac

SEQ ID NO: 7056327 - DNA, 21 bp, Homo sapiens
tccagggaacttctcaggaat

SEQ ID NO: 7056328 - DNA, 22 bp, Homo sapiens
tccaggctgggctgaagggtgc

SEQ ID NO: 7056329 - DNA, 22 bp, Homo sapiens
tccaggctgggctgaagggtgc

SEQ ID NO: 7056330 - DNA, 22 bp, Homo sapiens
tccagggaaggtgtgaggctgg

SEQ ID NO: 7056331 - DNA, 22 bp, Homo sapiens
tccagggacacagagtccttct

SEQ ID NO: 7056332 - DNA, 22 bp, Homo sapiens
tccagggacagcgctggagcta

SEQ ID NO: 7056333 - DNA, 22 bp, Homo sapiens
tccagggctgacttgggagagg

SEQ ID NO: 7056334 - DNA, 22 bp, Homo sapiens
tccagggctgacttgggagagg

SEQ ID NO: 7056335 - DNA, 22 bp, Homo sapiens
tccagggctgacttgggagagg

SEQ ID NO: 7056336 - DNA, 22 bp, Homo sapiens
tccagggctgggttggctcagc

SEQ ID NO: 7056337 - DNA, 18 bp, Homo sapiens
tccagggcttcctcctct

SEQ ID NO: 7056338 - DNA, 18 bp, Homo sapiens
tccagggcttcctcctct

SEQ ID NO: 7056339 - DNA, 22 bp, Homo sapiens
tccagggcttgacagggtgcct

SEQ ID NO: 7056340 - DNA, 22 bp, Homo sapiens
tccagggcttgacagggtgcct

SEQ ID NO: 7056341 - DNA, 22 bp, Homo sapiens
tccagggcttgacagggtgcct

SEQ ID NO: 7056342 - DNA, 22 bp, Homo sapiens
tccagggcttgacagggtgcct

SEQ ID NO: 7056343 - DNA, 22 bp, Homo sapiens
tccagggcttggctgggacggt

SEQ ID NO: 7056344 - DNA, 22 bp, Homo sapiens
tccagggcttggctgggacggt

SEQ ID NO: 7056345 - DNA, 19 bp, Homo sapiens
tccagggctttatggcttt

SEQ ID NO: 7056346 - DNA, 19 bp, Homo sapiens
tccagggctttatggcttt

SEQ ID NO: 7056347 - DNA, 21 bp, Homo sapiens
tccagggctttgattctctca

SEQ ID NO: 7056348 - DNA, 21 bp, Homo sapiens
tccagggctttgattctctca

SEQ ID NO: 7056349 - DNA, 22 bp, Homo sapiens
tccaggtgacagagacaggata

SEQ ID NO: 7056350 - DNA, 22 bp, Homo sapiens
tccaggtgagtgcaggtgcaga

SEQ ID NO: 7056351 - DNA, 22 bp, Homo sapiens
tccaggtgccggggactgaggc

SEQ ID NO: 7056352 - DNA, 19 bp, Homo sapiens
tccaggtggagagacaccc

SEQ ID NO: 7056353 - DNA, 22 bp, Homo sapiens
tccaggtgggctgcacccaggc

SEQ ID NO: 7056354 - DNA, 22 bp, Homo sapiens
tccaggtgtatttactgaagta

SEQ ID NO: 7056355 - DNA, 22 bp, Homo sapiens
tccattcattcattgatgaaca

SEQ ID NO: 7056356 - DNA, 22 bp, Homo sapiens
tccattatacttctgattcaaa

SEQ ID NO: 7056357 - DNA, 22 bp, Homo sapiens
tccatggggcccaggatgagag

SEQ ID NO: 7056358 - DNA, 22 bp, Homo sapiens
tccatgggaagattttgagtgg

SEQ ID NO: 7056359 - DNA, 22 bp, Homo sapiens
tccatggggcccaggatgagag

SEQ ID NO: 7056360 - DNA, 22 bp, Homo sapiens
tcccaaagtattagcatttcaa

SEQ ID NO: 7056361 - DNA, 22 bp, Homo sapiens
tcccaagagctctgggataagg

SEQ ID NO: 7056362 - DNA, 19 bp, Homo sapiens
tcccaagatttctgtatca

SEQ ID NO: 7056363 - DNA, 22 bp, Homo sapiens
tcccagagaagagctggatgga

SEQ ID NO: 7056364 - DNA, 22 bp, Homo sapiens
tcccagagacagagcctcctcc

SEQ ID NO: 7056365 - DNA, 22 bp, Homo sapiens
tcccagagacagagcctcctcc

SEQ ID NO: 7056366 - DNA, 22 bp, Homo sapiens
tcccagagacatcatttctccg

SEQ ID NO: 7056367 - DNA, 22 bp, Homo sapiens
tcccagagacatcatttctccg

SEQ ID NO: 7056368 - DNA, 22 bp, Homo sapiens
tcccagagatttcctctccttc

SEQ ID NO: 7056369 - DNA, 22 bp, Homo sapiens
tcccagagatttcctctccttc

SEQ ID NO: 7056370 - DNA, 22 bp, Homo sapiens
tcccagagcagatgtgctaaag

SEQ ID NO: 7056371 - DNA, 22 bp, Homo sapiens
tcccagagcagatgtgctaaag

SEQ ID NO: 7056372 - DNA, 22 bp, Homo sapiens
tcccagagcagtactccaggag

SEQ ID NO: 7056373 - DNA, 22 bp, Homo sapiens
tcccagagcagtactccaggag

SEQ ID NO: 7056374 - DNA, 22 bp, Homo sapiens
tcccagagccaagctatggatg

SEQ ID NO: 7056375 - DNA, 22 bp, Homo sapiens
tcccagcctggaccctgccagt

SEQ ID NO: 7056376 - DNA, 22 bp, Homo sapiens
tcccaggccataaaactcagag

SEQ ID NO: 7056377 - DNA, 22 bp, Homo sapiens
tcccaggcgcctggtggggagc

SEQ ID NO: 7056378 - DNA, 22 bp, Homo sapiens
tcccagagccaagctatggatg

SEQ ID NO: 7056379 - DNA, 22 bp, Homo sapiens
tcccagaggactgttggtgcta

SEQ ID NO: 7056380 - DNA, 22 bp, Homo sapiens
tcccagaggcagttggtaactt

SEQ ID NO: 7056381 - DNA, 22 bp, Homo sapiens
tcccagaggctccagtctctat

SEQ ID NO: 7056382 - DNA, 22 bp, Homo sapiens
tcccagaggctccagtctctat

SEQ ID NO: 7056383 - DNA, 22 bp, Homo sapiens
tcccagaggtctctgctggttc

SEQ ID NO: 7056384 - DNA, 22 bp, Homo sapiens
tcccagaggttgagtcacttat

SEQ ID NO: 7056385 - DNA, 22 bp, Homo sapiens
tcccagaggttgagtcacttat

SEQ ID NO: 7056386 - DNA, 22 bp, Homo sapiens
tcccagagtattagcaattgct

SEQ ID NO: 7056387 - DNA, 22 bp, Homo sapiens
tcccagcataacaaactgcccg

SEQ ID NO: 7056388 - DNA, 22 bp, Homo sapiens
tcccagcataacaaactgcccg

SEQ ID NO: 7056389 - DNA, 22 bp, Homo sapiens
tcccagccggtgcctgggtccc

SEQ ID NO: 7056390 - DNA, 22 bp, Homo sapiens
tcctctggtcttcggtgtggac

SEQ ID NO: 7056391 - DNA, 22 bp, Homo sapiens
tcctctgggctccctgcaacag

SEQ ID NO: 7056392 - DNA, 22 bp, Homo sapiens
tcctctggggcgtggtcctgga

SEQ ID NO: 7056393 - DNA, 22 bp, Homo sapiens
tcctcttcaaaaggatttcctt

SEQ ID NO: 7056394 - DNA, 22 bp, Homo sapiens
tcctcttcaaaatagctctgaa

SEQ ID NO: 7056395 - DNA, 22 bp, Homo sapiens
tcctcttcagagggacctcggg

SEQ ID NO: 7056396 - DNA, 22 bp, Homo sapiens
tcctcttctgcccatcagaggc

SEQ ID NO: 7056397 - DNA, 22 bp, Homo sapiens
tcctcttctgcccatcagaggc

SEQ ID NO: 7056398 - DNA, 22 bp, Homo sapiens
tcctcttctgcctatatctgcc

SEQ ID NO: 7056399 - DNA, 22 bp, Homo sapiens
tcctcttctgtggattccctga

SEQ ID NO: 7056400 - DNA, 22 bp, Homo sapiens
tcctcttgggaatacctttcta

SEQ ID NO: 7056401 - DNA, 22 bp, Homo sapiens
tcctgaacattatgcaagcttc

SEQ ID NO: 7056402 - DNA, 22 bp, Homo sapiens
tcctgaagaacgaagtcatgta

SEQ ID NO: 7056403 - DNA, 22 bp, Homo sapiens
tcctgaagaaggcagatatttg

SEQ ID NO: 7056404 - DNA, 22 bp, Homo sapiens
tcctgaagagccctgctctgtg

SEQ ID NO: 7056405 - DNA, 22 bp, Homo sapiens
tcctgaagatgaaaagagaggt

SEQ ID NO: 7056406 - DNA, 22 bp, Homo sapiens
tcctgaagcagttagcatgagc

SEQ ID NO: 7056407 - DNA, 22 bp, Homo sapiens
tcctgaagcctgagtgatgact

SEQ ID NO: 7056408 - DNA, 22 bp, Homo sapiens
tcctgaagctctcttaaggaaa

SEQ ID NO: 7056409 - DNA, 22 bp, Homo sapiens
tcctgaaggagcagttgctggg

SEQ ID NO: 7056410 - DNA, 22 bp, Homo sapiens
tcctgaaggcagatggggatca

SEQ ID NO: 7056411 - DNA, 22 bp, Homo sapiens
tcctgagacatctctgctggtc

SEQ ID NO: 7056412 - DNA, 20 bp, Homo sapiens
tcctgagacctgggaaggtt

SEQ ID NO: 7056413 - DNA, 22 bp, Homo sapiens
tcctgagagcagctgctttgga

SEQ ID NO: 7056414 - DNA, 22 bp, Homo sapiens
tcctgaggctaaagtgcagtgg

SEQ ID NO: 7056415 - DNA, 22 bp, Homo sapiens
tcctgaggccctgttagggtct

SEQ ID NO: 7056416 - DNA, 22 bp, Homo sapiens
tcctgaggatggttgaagtgca

SEQ ID NO: 7056417 - DNA, 22 bp, Homo sapiens
tcctgaggcacaatcctagaat

SEQ ID NO: 7056418 - DNA, 22 bp, Homo sapiens
tcctgaggatggttgaagtgca

SEQ ID NO: 7056419 - DNA, 22 bp, Homo sapiens
tcctgaggactaacaggaagga

SEQ ID NO: 7056420 - DNA, 22 bp, Homo sapiens
tcctgaggaccctgtcaggggc

SEQ ID NO: 7056421 - DNA, 22 bp, Homo sapiens
tcctgaggactaacaggaagga

SEQ ID NO: 7056422 - DNA, 23 bp, Homo sapiens
tcctgaggaatggcatctcacat

SEQ ID NO: 7056423 - DNA, 22 bp, Homo sapiens
tcctgaggaatgtgaagagaac

SEQ ID NO: 7056424 - DNA, 22 bp, Homo sapiens
tcctgaggaccctgtcaggggc

SEQ ID NO: 7056425 - DNA, 22 bp, Homo sapiens
tcctgaggaaagttcatgaatg

SEQ ID NO: 7056426 - DNA, 22 bp, Homo sapiens
tcctgagctttacagtaaggac

SEQ ID NO: 7056427 - DNA, 22 bp, Homo sapiens
tcctgagctacagtagtatgat

SEQ ID NO: 7056428 - DNA, 22 bp, Homo sapiens
tcctgagctcccatgaacaggc

SEQ ID NO: 7056429 - DNA, 22 bp, Homo sapiens
tcctgagctgacacttggggag

SEQ ID NO: 7056430 - DNA, 22 bp, Homo sapiens
tcctgagagtcaagaatgcagg

SEQ ID NO: 7056431 - DNA, 22 bp, Homo sapiens
tcctgagataaatctcatgtga

SEQ ID NO: 7056432 - DNA, 22 bp, Homo sapiens
tcctgagataggagttgaaggc

SEQ ID NO: 7056433 - DNA, 20 bp, Homo sapiens
tcctgagatttaaggggttc

SEQ ID NO: 7056434 - DNA, 22 bp, Homo sapiens
tcctgagcaacacagctaagtg

SEQ ID NO: 7056435 - DNA, 22 bp, Homo sapiens
tcctgagcacagagacaaggaa

SEQ ID NO: 7056436 - DNA, 22 bp, Homo sapiens
tcctgagcacctatgccatggc

SEQ ID NO: 7056437 - DNA, 22 bp, Homo sapiens
tcctgagccctggggtcagtgt

SEQ ID NO: 7056438 - DNA, 23 bp, Homo sapiens
tcctgcagataagctggttgaca

SEQ ID NO: 7056439 - DNA, 22 bp, Homo sapiens
tcctgcagctgaagctcatgtg

SEQ ID NO: 7056440 - DNA, 22 bp, Homo sapiens
tcctgcagccttgggctggagc

SEQ ID NO: 7056441 - DNA, 22 bp, Homo sapiens
tcctgcagctctgagaagcatc

SEQ ID NO: 7056442 - DNA, 21 bp, Homo sapiens
tcctgcaggaggcctgagagg

SEQ ID NO: 7056443 - DNA, 22 bp, Homo sapiens
tcctgcaggccagaggggtgag

SEQ ID NO: 7056444 - DNA, 21 bp, Homo sapiens
tcctgcagggcagcagagtgg

SEQ ID NO: 7056445 - DNA, 19 bp, Homo sapiens
tcctgcaggtggcttgcag

SEQ ID NO: 7056446 - DNA, 22 bp, Homo sapiens
tcctgcccagagctctccactc

SEQ ID NO: 7056447 - DNA, 22 bp, Homo sapiens
tcctgcctaccttgcggaggtg

SEQ ID NO: 7056448 - DNA, 22 bp, Homo sapiens
tcctgcctaccttgcggaggtg

SEQ ID NO: 7056449 - DNA, 22 bp, Homo sapiens
tcctgcctagcaggtgacctat

SEQ ID NO: 7056450 - DNA, 22 bp, Homo sapiens
tcctgcctagcaggtgacctat

SEQ ID NO: 7056451 - DNA, 22 bp, Homo sapiens
tcctgcctagcaggtgacctat

SEQ ID NO: 7056452 - DNA, 22 bp, Homo sapiens
tcctgcctcacagttgaagttt

SEQ ID NO: 7056453 - DNA, 22 bp, Homo sapiens
tcctgcctcacagttgaagttt

SEQ ID NO: 7056454 - DNA, 22 bp, Homo sapiens
tcctgcctcacagttgaagttt

SEQ ID NO: 7056455 - DNA, 22 bp, Homo sapiens
tcctgcctcaggctctggagta

SEQ ID NO: 7056456 - DNA, 22 bp, Homo sapiens
tcctgcctcaggctctggagta

SEQ ID NO: 7056457 - DNA, 22 bp, Homo sapiens
tcctgcctctccatgctaacta

SEQ ID NO: 7056458 - DNA, 22 bp, Homo sapiens
tcctgcctctccatgctaacta

SEQ ID NO: 7056459 - DNA, 22 bp, Homo sapiens
tcctgcctcttgccttcttcac

SEQ ID NO: 7056460 - DNA, 22 bp, Homo sapiens
tcctgcctcttgccttcttcac

SEQ ID NO: 7056461 - DNA, 22 bp, Homo sapiens
tcctgcctcttttcttattcca

SEQ ID NO: 7056462 - DNA, 22 bp, Homo sapiens
tcctgcctcttttcttattcca

SEQ ID NO: 7056463 - DNA, 22 bp, Homo sapiens
tcctgcctgagcgtggaggagg

SEQ ID NO: 7056464 - DNA, 22 bp, Homo sapiens
tcctgcctgagcgtggaggagg

SEQ ID NO: 7056465 - DNA, 22 bp, Homo sapiens
tcctgcctgcaatcccagcact

SEQ ID NO: 7056466 - DNA, 22 bp, Homo sapiens
tcctgcctgcaatcccagcact

SEQ ID NO: 7056467 - DNA, 22 bp, Homo sapiens
tcctgcctgcaatcccagcact

SEQ ID NO: 7056468 - DNA, 22 bp, Homo sapiens
taagaggatatttggccagaag

SEQ ID NO: 7056469 - DNA, 22 bp, Homo sapiens
taagaggcaaaagatactcaga

SEQ ID NO: 7056470 - DNA, 22 bp, Homo sapiens
taagcatggtggtaaaagaggt

SEQ ID NO: 7056471 - DNA, 18 bp, Homo sapiens
taagagcagactgtaggc

SEQ ID NO: 7056472 - DNA, 22 bp, Homo sapiens
taagagatgcttttctaaataa

SEQ ID NO: 7056473 - DNA, 22 bp, Homo sapiens
taagagatggttatcaaaagca

SEQ ID NO: 7056474 - DNA, 22 bp, Homo sapiens
taagagattctaaagctactgg

SEQ ID NO: 7056475 - DNA, 22 bp, Homo sapiens
taagagcactgaagtcttctta

SEQ ID NO: 7056476 - DNA, 22 bp, Homo sapiens
taagagaatgttgtggctaggt

SEQ ID NO: 7056477 - DNA, 22 bp, Homo sapiens
taagacatcctggatgttcaaa

SEQ ID NO: 7056478 - DNA, 22 bp, Homo sapiens
taagacatgagactcagccagt

SEQ ID NO: 7056479 - DNA, 22 bp, Homo sapiens
taagacaattcttcagtcacaa

SEQ ID NO: 7056480 - DNA, 22 bp, Homo sapiens
taacatctttagcagctcgaac

SEQ ID NO: 7056481 - DNA, 22 bp, Homo sapiens
taacagtaaagtaagttagctt

SEQ ID NO: 7056482 - DNA, 20 bp, Homo sapiens
taacagtaagtgatgttaca

SEQ ID NO: 7056483 - DNA, 22 bp, Homo sapiens
taacagtatagcctaacatttc

SEQ ID NO: 7056484 - DNA, 22 bp, Homo sapiens
taacagtattgaagataaacta

SEQ ID NO: 7056485 - DNA, 22 bp, Homo sapiens
taacagtgtggacttgagatct

SEQ ID NO: 7056486 - DNA, 22 bp, Homo sapiens
taacagctctgtgtggctgtaa

SEQ ID NO: 7056487 - DNA, 22 bp, Homo sapiens
taacagctggcgttataggaat

SEQ ID NO: 7056488 - DNA, 22 bp, Homo sapiens
taaatgctcagaccttattcca

SEQ ID NO: 7056489 - DNA, 22 bp, Homo sapiens
taaatgctccatacatacacca

SEQ ID NO: 7056490 - DNA, 22 bp, Homo sapiens
taaatgctatcgcataaaacct

SEQ ID NO: 7056491 - DNA, 22 bp, Homo sapiens
taaatgtgttagtcatggtttt

SEQ ID NO: 7056492 - DNA, 22 bp, Homo sapiens
taaatgcagcagtttctgttct

SEQ ID NO: 7056493 - DNA, 22 bp, Homo sapiens
taaatgcagttagtacttgcca

SEQ ID NO: 7056494 - DNA, 22 bp, Homo sapiens
taaatgcagttagtacttgcca

SEQ ID NO: 7056495 - DNA, 18 bp, Homo sapiens
taaatgcatgttaataac

SEQ ID NO: 7056496 - DNA, 22 bp, Homo sapiens
taaatgatttatgtatgtgaaa

SEQ ID NO: 7056497 - DNA, 22 bp, Homo sapiens
taaagcacatatcttacaataa

SEQ ID NO: 7056498 - DNA, 21 bp, Homo sapiens
gttttaagggagaaaacctag

SEQ ID NO: 7056499 - DNA, 21 bp, Homo sapiens
gttttaagggagaaaacctag

SEQ ID NO: 7056500 - DNA, 22 bp, Homo sapiens
taaaagacatataactgtagga

SEQ ID NO: 7056501 - DNA, 22 bp, Homo sapiens
taaaagagaatggataacagag

SEQ ID NO: 7056502 - DNA, 21 bp, Homo sapiens
taaaagatgacaagacagctc

SEQ ID NO: 7056503 - DNA, 22 bp, Homo sapiens
taaaagtaggaatgaaacgcat

SEQ ID NO: 7056504 - DNA, 22 bp, Homo sapiens
gtttgtttatacaaaagatcct

SEQ ID NO: 7056505 - DNA, 22 bp, Homo sapiens
gtttgtttgtagggaagccgtg

SEQ ID NO: 7056506 - DNA, 22 bp, Homo sapiens
gtttgttttaagataggatgga

SEQ ID NO: 7056507 - DNA, 20 bp, Homo sapiens
gttttaaggcacaggccttt

SEQ ID NO: 7056508 - DNA, 20 bp, Homo sapiens
gttttaaggcacaggccttt

SEQ ID NO: 7056509 - DNA, 21 bp, Homo sapiens
gttttaagggagaaaacctag

SEQ ID NO: 7056510 - DNA, 22 bp, Homo sapiens
gtttgtcaggaggttgaagtca

SEQ ID NO: 7056511 - DNA, 17 bp, Homo sapiens
gtttgcatggtgttaac

SEQ ID NO: 7056512 - DNA, 22 bp, Homo sapiens
gtttgaaagtggcaagtccttg

SEQ ID NO: 7056513 - DNA, 22 bp, Homo sapiens
gtttgcataaagtggatgcagg

SEQ ID NO: 7056514 - DNA, 22 bp, Homo sapiens
gtttgcatatttgcacaggaat

SEQ ID NO: 7056515 - DNA, 22 bp, Homo sapiens
gtttcttatttcaactggaaca

SEQ ID NO: 7056516 - DNA, 22 bp, Homo sapiens
gtttcttatttgcaggttgctt

SEQ ID NO: 7056517 - DNA, 22 bp, Homo sapiens
gtttcttagacatatgccatga

SEQ ID NO: 7056518 - DNA, 22 bp, Homo sapiens
gtttcttaggtaaattctttga

SEQ ID NO: 7056519 - DNA, 22 bp, Homo sapiens
gtttcttagacagacattatct

SEQ ID NO: 7056520 - DNA, 22 bp, Homo sapiens
gtttcacagatggggagacacg

SEQ ID NO: 7056521 - DNA, 22 bp, Homo sapiens
gtttcacagatggtgttcatat

SEQ ID NO: 7056522 - DNA, 22 bp, Homo sapiens
gtttatgaattgcattcccttt

SEQ ID NO: 7056523 - DNA, 22 bp, Homo sapiens
gtttatgaggaaaagttatgat

SEQ ID NO: 7056524 - DNA, 22 bp, Homo sapiens
gtttatgagttacgtaggggtt

SEQ ID NO: 7056525 - DNA, 22 bp, Homo sapiens
gtttatgaatgttactatagag

SEQ ID NO: 7056526 - DNA, 22 bp, Homo sapiens
gtttatgaatgtgtcagacata

SEQ ID NO: 7056527 - DNA, 21 bp, Homo sapiens
gtttatgaatcttgtcctgct

SEQ ID NO: 7056528 - DNA, 22 bp, Homo sapiens
gtttatattcaacggagtatct

SEQ ID NO: 7056529 - DNA, 22 bp, Homo sapiens
gtttatgaaatttcaggcattt

SEQ ID NO: 7056530 - DNA, 22 bp, Homo sapiens
gttgaaagatgtcttggttccc

SEQ ID NO: 7056531 - DNA, 22 bp, Homo sapiens
gttgaaagtagatgctatttgg

SEQ ID NO: 7056532 - DNA, 22 bp, Homo sapiens
gttctttaagtggagaaggaaa

SEQ ID NO: 7056533 - DNA, 22 bp, Homo sapiens
gttatttcagccacagagtgca

SEQ ID NO: 7056534 - DNA, 22 bp, Homo sapiens
gttatattggcagaagagaaga

SEQ ID NO: 7056535 - DNA, 22 bp, Homo sapiens
gttatattgccaagtatattgt

SEQ ID NO: 7056536 - DNA, 22 bp, Homo sapiens
gttatcttccctttgatgattt

SEQ ID NO: 7056537 - DNA, 22 bp, Homo sapiens
gttatcttctatttctcatact

SEQ ID NO: 7056538 - DNA, 22 bp, Homo sapiens
gttatgaaataaatatagatca

SEQ ID NO: 7056539 - DNA, 22 bp, Homo sapiens
gttatgaagtcattcacaaata

SEQ ID NO: 7056540 - DNA, 22 bp, Homo sapiens
gttataaatgactgcaaaagtt

SEQ ID NO: 7056541 - DNA, 22 bp, Homo sapiens
gttataaatgactgcaaaagtt

SEQ ID NO: 7056542 - DNA, 22 bp, Homo sapiens
gttatataagacaaatcagagt

SEQ ID NO: 7056543 - DNA, 22 bp, Homo sapiens
gttatataattcctgtggtagt

SEQ ID NO: 7056544 - DNA, 22 bp, Homo sapiens
gttatatatagtatttctctga

SEQ ID NO: 7056545 - DNA, 22 bp, Homo sapiens
gttatattcaaaatgaggctgt

SEQ ID NO: 7056546 - DNA, 22 bp, Homo sapiens
gttaaataacctcatgtccgtt

SEQ ID NO: 7056547 - DNA, 22 bp, Homo sapiens
gtgtttaataggtagctgaatc

SEQ ID NO: 7056548 - DNA, 22 bp, Homo sapiens
gtgtttaatgcagatgtgggtg

SEQ ID NO: 7056549 - DNA, 22 bp, Homo sapiens
gttaaataacctcatgtccgtt

SEQ ID NO: 7056550 - DNA, 22 bp, Homo sapiens
gttaaatgcactattgaaagct

SEQ ID NO: 7056551 - DNA, 22 bp, Homo sapiens
gttaaatgcagattctgactca

SEQ ID NO: 7056552 - DNA, 22 bp, Homo sapiens
gttaaatgcattttccaagcac

SEQ ID NO: 7056553 - DNA, 22 bp, Homo sapiens
gttaacacaggactctctgcct

SEQ ID NO: 7056554 - DNA, 22 bp, Homo sapiens
gttaacattcaattaaacagtc

SEQ ID NO: 7056555 - DNA, 22 bp, Homo sapiens
gttataaatacctaataggatt

SEQ ID NO: 7056556 - DNA, 22 bp, Homo sapiens
gtgttgatgacattttagaaac

SEQ ID NO: 7056557 - DNA, 22 bp, Homo sapiens
gtgttgatgacattttagaaac

SEQ ID NO: 7056558 - DNA, 22 bp, Homo sapiens
gtgtttaacatctggtttatac

SEQ ID NO: 7056559 - DNA, 22 bp, Homo sapiens
gtgctgggattacaggtgtgag

SEQ ID NO: 7056560 - DNA, 22 bp, Homo sapiens
tacacacttactggagatgaag

SEQ ID NO: 7056561 - DNA, 22 bp, Homo sapiens
tacacagaacctggtgtacagt

SEQ ID NO: 7056562 - DNA, 22 bp, Homo sapiens
tacacaattagttgcaaagtga

SEQ ID NO: 7056563 - DNA, 22 bp, Homo sapiens
tacacacagaggccatgggatt

SEQ ID NO: 7056564 - DNA, 22 bp, Homo sapiens
tacacacatgcatttgccttat

SEQ ID NO: 7056565 - DNA, 22 bp, Homo sapiens
tacacacatgcatttgccttat

SEQ ID NO: 7056566 - DNA, 22 bp, Homo sapiens
tacacactgtgataatgaagca

SEQ ID NO: 7056567 - DNA, 22 bp, Homo sapiens
tacagaatgttatgaagcatag

SEQ ID NO: 7056568 - DNA, 22 bp, Homo sapiens
tacagacaaagagcatgcggta

SEQ ID NO: 7056569 - DNA, 22 bp, Homo sapiens
tacaacataacgggcattcagt

SEQ ID NO: 7056570 - DNA, 22 bp, Homo sapiens
tacaacatgtggtcctttatga

SEQ ID NO: 7056571 - DNA, 22 bp, Homo sapiens
tacaaccatagacatatactag

SEQ ID NO: 7056572 - DNA, 22 bp, Homo sapiens
tacaacttccagctttcagccc

SEQ ID NO: 7056573 - DNA, 22 bp, Homo sapiens
tacaacttacttgaatggcttt

SEQ ID NO: 7056574 - DNA, 22 bp, Homo sapiens
tacaagaaactacatgaatgca

SEQ ID NO: 7056575 - DNA, 22 bp, Homo sapiens
tacaagaaatttctgcatatat

SEQ ID NO: 7056576 - DNA, 22 bp, Homo sapiens
tacaagaaatttctgcatatat

SEQ ID NO: 7056577 - DNA, 21 bp, Homo sapiens
tacaagaccggattcgggccc

SEQ ID NO: 7056578 - DNA, 22 bp, Homo sapiens
tacaagacgagggaagttcttt

SEQ ID NO: 7056579 - DNA, 22 bp, Homo sapiens
tacaagaggtatatagaaacag

SEQ ID NO: 7056580 - DNA, 21 bp, Homo sapiens
tacaagatagaggtaatatat

SEQ ID NO: 7056581 - DNA, 22 bp, Homo sapiens
tacaagctcacaaatttttaag

SEQ ID NO: 7056582 - DNA, 22 bp, Homo sapiens
tacacaatgacttaagatgtca

SEQ ID NO: 7056583 - DNA, 22 bp, Homo sapiens
taatttacttgcaaataacaat

SEQ ID NO: 7056584 - DNA, 22 bp, Homo sapiens
taatatatttctgctaagctca

SEQ ID NO: 7056585 - DNA, 22 bp, Homo sapiens
taatatatttctgctaagctca

SEQ ID NO: 7056586 - DNA, 22 bp, Homo sapiens
taatatatttctgctaagctca

SEQ ID NO: 7056587 - DNA, 22 bp, Homo sapiens
taatatatttctgctaagctca

SEQ ID NO: 7056588 - DNA, 22 bp, Homo sapiens
taatatctacttcatagagttt

SEQ ID NO: 7056589 - DNA, 22 bp, Homo sapiens
taatccagggtattctagtttc

SEQ ID NO: 7056590 - DNA, 22 bp, Homo sapiens
taatctctttatgagaagaagg

SEQ ID NO: 7056591 - DNA, 22 bp, Homo sapiens
taattattatgacaacaattgc

SEQ ID NO: 7056592 - DNA, 22 bp, Homo sapiens
taattattatgacaacaattgc

SEQ ID NO: 7056593 - DNA, 22 bp, Homo sapiens
taatatatacctttgttaggaa

SEQ ID NO: 7056594 - DNA, 22 bp, Homo sapiens
taatatatacctttgttaggaa

SEQ ID NO: 7056595 - DNA, 22 bp, Homo sapiens
taatatatacctttgttaggaa

SEQ ID NO: 7056596 - DNA, 22 bp, Homo sapiens
taatatatacctttgttaggaa

SEQ ID NO: 7056597 - DNA, 21 bp, Homo sapiens
taatataggttcacaactagt

SEQ ID NO: 7056598 - DNA, 22 bp, Homo sapiens
taatatatacctttgttaggaa

SEQ ID NO: 7056599 - DNA, 22 bp, Homo sapiens
taatatacttcccatagtttga

SEQ ID NO: 7056600 - DNA, 22 bp, Homo sapiens
taatagttgtgactttgtaaag

SEQ ID NO: 7056601 - DNA, 22 bp, Homo sapiens
taatagtttcataatgtgcttc

SEQ ID NO: 7056602 - DNA, 22 bp, Homo sapiens
taatataccaaactgtaatttt

SEQ ID NO: 7056603 - DNA, 22 bp, Homo sapiens
taatagttatggttggttctca

SEQ ID NO: 7056604 - DNA, 22 bp, Homo sapiens
taagccactagtctgttatgaa

SEQ ID NO: 7056605 - DNA, 21 bp, Homo sapiens
taagccaccatgtgaaaccag

SEQ ID NO: 7056606 - DNA, 22 bp, Homo sapiens
taagctattcctgaagaaggtt

SEQ ID NO: 7056607 - DNA, 22 bp, Homo sapiens
taagctcactgtaagaactgat

SEQ ID NO: 7056608 - DNA, 22 bp, Homo sapiens
taagctgtgggagattggcata

SEQ ID NO: 7056609 - DNA, 22 bp, Homo sapiens
taaggaaggggaaagacatgtc

SEQ ID NO: 7056610 - DNA, 22 bp, Homo sapiens
taaggaaggggaaagacatgtc

SEQ ID NO: 7056611 - DNA, 22 bp, Homo sapiens
tacagaggggacatggaagaca

SEQ ID NO: 7056612 - DNA, 22 bp, Homo sapiens
tacagaggagaccaaggctcag

SEQ ID NO: 7056613 - DNA, 22 bp, Homo sapiens
tacagtggggagctcaggagag

SEQ ID NO: 7056614 - DNA, 22 bp, Homo sapiens
tacatgtatgtgtacgtgcatg

SEQ ID NO: 7056615 - DNA, 22 bp, Homo sapiens
tacatgtatgtgttaatatctg

SEQ ID NO: 7056616 - DNA, 22 bp, Homo sapiens
tacatgtacatgcataggtaga

SEQ ID NO: 7056617 - DNA, 23 bp, Homo sapiens
tacatgctataatttcaccctca

SEQ ID NO: 7056618 - DNA, 22 bp, Homo sapiens
tacatgtaagacatgagactct

SEQ ID NO: 7056619 - DNA, 22 bp, Homo sapiens
tacatgtaattttcatagtaag

SEQ ID NO: 7056620 - DNA, 22 bp, Homo sapiens
tactagtttctaccttacagaa

SEQ ID NO: 7056621 - DNA, 22 bp, Homo sapiens
tactataaagtcttaatgagtc

SEQ ID NO: 7056622 - DNA, 23 bp, Homo sapiens
tactataacgctgtgtcagctcc

SEQ ID NO: 7056623 - DNA, 22 bp, Homo sapiens
tactatactctccattttatag

SEQ ID NO: 7056624 - DNA, 22 bp, Homo sapiens
taccatttcattctttcctcat

SEQ ID NO: 7056625 - DNA, 23 bp, Homo sapiens
tactacagggtcttgctatgaat

SEQ ID NO: 7056626 - DNA, 22 bp, Homo sapiens
tactacagtatgtgtgttatac

SEQ ID NO: 7056627 - DNA, 21 bp, Homo sapiens
tactacagtctctttatcagt

SEQ ID NO: 7056628 - DNA, 22 bp, Homo sapiens
taccaggaattattttacattt

SEQ ID NO: 7056629 - DNA, 22 bp, Homo sapiens
taccaggcagctgcacagaggc

SEQ ID NO: 7056630 - DNA, 22 bp, Homo sapiens
taccatgatcaggctcatcctt

SEQ ID NO: 7056631 - DNA, 22 bp, Homo sapiens
taccatgatgtttgagttacta

SEQ ID NO: 7056632 - DNA, 22 bp, Homo sapiens
taccattgtaccaaggtaattt

SEQ ID NO: 7056633 - DNA, 22 bp, Homo sapiens
tactgaaactcttgtaaatatc

SEQ ID NO: 7056634 - DNA, 22 bp, Homo sapiens
tactgaaagaatacataatttc

SEQ ID NO: 7056635 - DNA, 22 bp, Homo sapiens
tactgttttctataatggctgt

SEQ ID NO: 7056636 - DNA, 22 bp, Homo sapiens
tactgttttttagactcatggt

SEQ ID NO: 7056637 - DNA, 22 bp, Homo sapiens
tacttaaaactgatagaatctc

SEQ ID NO: 7056638 - DNA, 22 bp, Homo sapiens
tacttacacagctgtagaaggt

SEQ ID NO: 7056639 - DNA, 22 bp, Homo sapiens
tacttacagaaggaagcaattg

SEQ ID NO: 7056640 - DNA, 21 bp, Homo sapiens
tcaaatcaggtatcactattg

SEQ ID NO: 7056641 - DNA, 17 bp, Homo sapiens
tcaaatcctctgtctgg

SEQ ID NO: 7056642 - DNA, 22 bp, Homo sapiens
tcaaatatgtgatagaagctaa

SEQ ID NO: 7056643 - DNA, 22 bp, Homo sapiens
tcaaagggtaatgtaatagtct

SEQ ID NO: 7056644 - DNA, 22 bp, Homo sapiens
tcaaagggtagcccagggaaga

SEQ ID NO: 7056645 - DNA, 22 bp, Homo sapiens
tcaaagggtccttaacatgaga

SEQ ID NO: 7056646 - DNA, 22 bp, Homo sapiens
tcaaagtaaaagtatagagttt

SEQ ID NO: 7056647 - DNA, 22 bp, Homo sapiens
tcaaagtaggggtaagccaggc

SEQ ID NO: 7056648 - DNA, 22 bp, Homo sapiens
tatttttgcctctcagataaaa

SEQ ID NO: 7056649 - DNA, 22 bp, Homo sapiens
tattttgctttagctgactgtt

SEQ ID NO: 7056650 - DNA, 20 bp, Homo sapiens
tattttgcaattatggttca

SEQ ID NO: 7056651 - DNA, 22 bp, Homo sapiens
tattttgcaaacctgagtttga

SEQ ID NO: 7056652 - DNA, 22 bp, Homo sapiens
tattttgaggtatttttgagct

SEQ ID NO: 7056653 - DNA, 22 bp, Homo sapiens
tattttgacgattttatgcaaa

SEQ ID NO: 7056654 - DNA, 22 bp, Homo sapiens
tattttctgtggaggaccagat

SEQ ID NO: 7056655 - DNA, 22 bp, Homo sapiens
tattttctgtggaggaccagat

SEQ ID NO: 7056656 - DNA, 22 bp, Homo sapiens
tattttctggacagtcttgctt

SEQ ID NO: 7056657 - DNA, 22 bp, Homo sapiens
tattttctggacagtcttgctt

SEQ ID NO: 7056658 - DNA, 22 bp, Homo sapiens
tattttctggggagagtgaacc

SEQ ID NO: 7056659 - DNA, 22 bp, Homo sapiens
tattttctggggagagtgaacc

SEQ ID NO: 7056660 - DNA, 23 bp, Homo sapiens
tattttccaaatgatgactacat

SEQ ID NO: 7056661 - DNA, 22 bp, Homo sapiens
tatttgatggttctaaaacagc

SEQ ID NO: 7056662 - DNA, 22 bp, Homo sapiens
tatttgcaacataaaactctga

SEQ ID NO: 7056663 - DNA, 22 bp, Homo sapiens
tatttgatagagataaatgata

SEQ ID NO: 7056664 - DNA, 22 bp, Homo sapiens
tatttgatgaaggtaaagtctt

SEQ ID NO: 7056665 - DNA, 22 bp, Homo sapiens
tatttgatgaaggtaaagtctt

SEQ ID NO: 7056666 - DNA, 22 bp, Homo sapiens
tatttgcaggacatagatatgg

SEQ ID NO: 7056667 - DNA, 22 bp, Homo sapiens
tatttcttgttattctcgttga

SEQ ID NO: 7056668 - DNA, 22 bp, Homo sapiens
tatttgagcgaagcagtgtttt

SEQ ID NO: 7056669 - DNA, 22 bp, Homo sapiens
tatttaaaatagtgctccagca

SEQ ID NO: 7056670 - DNA, 22 bp, Homo sapiens
tatttaaaataagccccagtgg

SEQ ID NO: 7056671 - DNA, 22 bp, Homo sapiens
tatttaataaaactatggcatg

SEQ ID NO: 7056672 - DNA, 22 bp, Homo sapiens
tatttaaaaagaggccagctgg

SEQ ID NO: 7056673 - DNA, 22 bp, Homo sapiens
tatttaaaaagaggccagctgg

SEQ ID NO: 7056674 - DNA, 22 bp, Homo sapiens
tattgtgagtataactgcattt

SEQ ID NO: 7056675 - DNA, 20 bp, Homo sapiens
tattgtgataggtgttaatc

SEQ ID NO: 7056676 - DNA, 22 bp, Homo sapiens
tattgtattaaggattcaagta

SEQ ID NO: 7056677 - DNA, 22 bp, Homo sapiens
tattgtcaagaagtttatagtg

SEQ ID NO: 7056678 - DNA, 22 bp, Homo sapiens
tattgtcacgtcttaattctag

SEQ ID NO: 7056679 - DNA, 22 bp, Homo sapiens
tattgtatcttctgtttagaag

SEQ ID NO: 7056680 - DNA, 22 bp, Homo sapiens
tattgtatcttctgtttagaag

SEQ ID NO: 7056681 - DNA, 23 bp, Homo sapiens
tattacaattggtcttattaaga

SEQ ID NO: 7056682 - DNA, 22 bp, Homo sapiens
tattaatttaatctccatggta

SEQ ID NO: 7056683 - DNA, 21 bp, Homo sapiens
tattaatttttcttcccacta

SEQ ID NO: 7056684 - DNA, 22 bp, Homo sapiens
tatgaaaaggtggccaatgtag

SEQ ID NO: 7056685 - DNA, 22 bp, Homo sapiens
tatgaaaatttagctgaagcat

SEQ ID NO: 7056686 - DNA, 22 bp, Homo sapiens
tatgaaaaggtggccaatgtag

SEQ ID NO: 7056687 - DNA, 18 bp, Homo sapiens
tatcttttccagtggtat

SEQ ID NO: 7056688 - DNA, 22 bp, Homo sapiens
tatcattttactgtgacatttt

SEQ ID NO: 7056689 - DNA, 22 bp, Homo sapiens
tatcattttactgtgacatttt

SEQ ID NO: 7056690 - DNA, 22 bp, Homo sapiens
tatcattttactgtgacatttt

SEQ ID NO: 7056691 - DNA, 22 bp, Homo sapiens
tatcatttagagtatttcttca

SEQ ID NO: 7056692 - DNA, 22 bp, Homo sapiens
tatcatttagagtatttcttca

SEQ ID NO: 7056693 - DNA, 23 bp, Homo sapiens
tatcatttcagctctctgcctgg

SEQ ID NO: 7056694 - DNA, 22 bp, Homo sapiens
tatcatttgttattattagtgg

SEQ ID NO: 7056695 - DNA, 22 bp, Homo sapiens
tatcatttgttattattagtgg

SEQ ID NO: 7056696 - DNA, 22 bp, Homo sapiens
tatgaaatgatggggaaaatag

SEQ ID NO: 7056697 - DNA, 22 bp, Homo sapiens
tatgaaattgccatttttatgg

SEQ ID NO: 7056698 - DNA, 20 bp, Homo sapiens
tatgaagtgttcttctggta

SEQ ID NO: 7056699 - DNA, 22 bp, Homo sapiens
tatgaatataccacaatttagg

SEQ ID NO: 7056700 - DNA, 22 bp, Homo sapiens
tataaagtttcgaaagatgtat

SEQ ID NO: 7056701 - DNA, 22 bp, Homo sapiens
tataaagtttcgaaagatgtat

SEQ ID NO: 7056702 - DNA, 22 bp, Homo sapiens
tataaagagtctcaaagaagtt

SEQ ID NO: 7056703 - DNA, 19 bp, Homo sapiens
tatcactgggcactgagga

SEQ ID NO: 7056704 - DNA, 22 bp, Homo sapiens
tatcacttgcgttttggcagag

SEQ ID NO: 7056705 - DNA, 22 bp, Homo sapiens
tatcagaaggcacatggagtct

SEQ ID NO: 7056706 - DNA, 22 bp, Homo sapiens
tattaacatgaactgacttttc

SEQ ID NO: 7056707 - DNA, 22 bp, Homo sapiens
tattaaattatggatttaggag

SEQ ID NO: 7056708 - DNA, 22 bp, Homo sapiens
tattaaattatggatttaggag

SEQ ID NO: 7056709 - DNA, 22 bp, Homo sapiens
tatgtcacattgtaacagtgtg

SEQ ID NO: 7056710 - DNA, 22 bp, Homo sapiens
tatgtattctgagtacaagttc

SEQ ID NO: 7056711 - DNA, 22 bp, Homo sapiens
tatgtattctcagatttactaa

SEQ ID NO: 7056712 - DNA, 22 bp, Homo sapiens
tatgtagagataaaatccaaat

SEQ ID NO: 7056713 - DNA, 22 bp, Homo sapiens
tatgtagatttctctgtttttc

SEQ ID NO: 7056714 - DNA, 22 bp, Homo sapiens
tatgtagtacttagtgcataca

SEQ ID NO: 7056715 - DNA, 17 bp, Homo sapiens
tatgtagtacttataaa

SEQ ID NO: 7056716 - DNA, 22 bp, Homo sapiens
tatgtagtgttgagaatgcttg

SEQ ID NO: 7056717 - DNA, 22 bp, Homo sapiens
tatgtatagagtcttttaaatt

SEQ ID NO: 7056718 - DNA, 22 bp, Homo sapiens
tatggaaactaattcatttttc

SEQ ID NO: 7056719 - DNA, 22 bp, Homo sapiens
tatggaaagctctttttgattg

SEQ ID NO: 7056720 - DNA, 22 bp, Homo sapiens
tatgctttaaccctcttatatt

SEQ ID NO: 7056721 - DNA, 22 bp, Homo sapiens
tatgtagacaggctgcttttcc

SEQ ID NO: 7056722 - DNA, 22 bp, Homo sapiens
tatgtaaaaattcatcaggctg

SEQ ID NO: 7056723 - DNA, 22 bp, Homo sapiens
tagatataaggtccttagaaca

SEQ ID NO: 7056724 - DNA, 22 bp, Homo sapiens
tagatataaggtccttagaaca

SEQ ID NO: 7056725 - DNA, 22 bp, Homo sapiens
tagatataaggtccttagaaca

SEQ ID NO: 7056726 - DNA, 22 bp, Homo sapiens
tagatcatatttgtggagaaaa

SEQ ID NO: 7056727 - DNA, 22 bp, Homo sapiens
tagatcatggagtaaaatggaa

SEQ ID NO: 7056728 - DNA, 22 bp, Homo sapiens
tagatcatgggtactgcatatg

SEQ ID NO: 7056729 - DNA, 21 bp, Homo sapiens
tagatcatggtattctttggc

SEQ ID NO: 7056730 - DNA, 22 bp, Homo sapiens
tagatcctgagccctatctact

SEQ ID NO: 7056731 - DNA, 22 bp, Homo sapiens
tagatacatttttctttcctgt

SEQ ID NO: 7056732 - DNA, 22 bp, Homo sapiens
tagagtctagtgtatacaaagt

SEQ ID NO: 7056733 - DNA, 22 bp, Homo sapiens
tagagaggtttgaattggctgc

SEQ ID NO: 7056734 - DNA, 22 bp, Homo sapiens
tagagagccagttgtcatagtt

SEQ ID NO: 7056735 - DNA, 22 bp, Homo sapiens
tagagacaccagtaccattctg

SEQ ID NO: 7056736 - DNA, 22 bp, Homo sapiens
tagagaatggccttgaagtagt

SEQ ID NO: 7056737 - DNA, 21 bp, Homo sapiens
tagagaaaagaagctgttcct

SEQ ID NO: 7056738 - DNA, 22 bp, Homo sapiens
tagagaaaagcagggatcagga

SEQ ID NO: 7056739 - DNA, 22 bp, Homo sapiens
tagagaaataagctttgccttg

SEQ ID NO: 7056740 - DNA, 22 bp, Homo sapiens
tagacaggagtcaggctagaat

SEQ ID NO: 7056741 - DNA, 22 bp, Homo sapiens
tagacaggaaacattaggatgg

SEQ ID NO: 7056742 - DNA, 22 bp, Homo sapiens
tagaccattttacaatagtgtg

SEQ ID NO: 7056743 - DNA, 22 bp, Homo sapiens
tagactatagctcacagtgctt

SEQ ID NO: 7056744 - DNA, 22 bp, Homo sapiens
tagaagaacatgtcaaactata

SEQ ID NO: 7056745 - DNA, 22 bp, Homo sapiens
tagaacttagcactagacttgt

SEQ ID NO: 7056746 - DNA, 20 bp, Homo sapiens
tagatcctggggatttattg

SEQ ID NO: 7056747 - DNA, 22 bp, Homo sapiens
tagctgctgcagcacagggagg

SEQ ID NO: 7056748 - DNA, 22 bp, Homo sapiens
tagctgccagaccattcttact

SEQ ID NO: 7056749 - DNA, 19 bp, Homo sapiens
tagctgcctgttacctcca

SEQ ID NO: 7056750 - DNA, 22 bp, Homo sapiens
tagctgcctttgggctcctgct

SEQ ID NO: 7056751 - DNA, 22 bp, Homo sapiens
tagcaggggtagatagagtgtg

SEQ ID NO: 7056752 - DNA, 22 bp, Homo sapiens
tagcagggtccaatgtgaggca

SEQ ID NO: 7056753 - DNA, 22 bp, Homo sapiens
tagcagggtctcaggagtcagg

SEQ ID NO: 7056754 - DNA, 22 bp, Homo sapiens
tagcagggttttgaagagggtt

SEQ ID NO: 7056755 - DNA, 22 bp, Homo sapiens
tagctgagagctcacttgagga

SEQ ID NO: 7056756 - DNA, 22 bp, Homo sapiens
tagctgagaggccaattgaact

SEQ ID NO: 7056757 - DNA, 22 bp, Homo sapiens
tagctgccaaaagggtgggcta

SEQ ID NO: 7056758 - DNA, 22 bp, Homo sapiens
tagcagctgcatcattttacag

SEQ ID NO: 7056759 - DNA, 21 bp, Homo sapiens
tagcaggagcgaattttgatg

SEQ ID NO: 7056760 - DNA, 21 bp, Homo sapiens
tagcaggaggcccctgcttgc

SEQ ID NO: 7056761 - DNA, 21 bp, Homo sapiens
tagcaggatttggtttatttt

SEQ ID NO: 7056762 - DNA, 22 bp, Homo sapiens
tagcagggatacaaggtcgcct

SEQ ID NO: 7056763 - DNA, 22 bp, Homo sapiens
tagcagggccaggctgggaacc

SEQ ID NO: 7056764 - DNA, 22 bp, Homo sapiens
tagtttttaagtgtacaatttc

SEQ ID NO: 7056765 - DNA, 22 bp, Homo sapiens
tagttttatgaattggtataat

SEQ ID NO: 7056766 - DNA, 22 bp, Homo sapiens
tagttttatgaattggtataat

SEQ ID NO: 7056767 - DNA, 22 bp, Homo sapiens
tagttttataatgttaacatct

SEQ ID NO: 7056768 - DNA, 22 bp, Homo sapiens
tagttttataatgttaacatct

SEQ ID NO: 7056769 - DNA, 22 bp, Homo sapiens
tagtttagcttagccttctggt

SEQ ID NO: 7056770 - DNA, 22 bp, Homo sapiens
tagtttaggaacaagtagtgga

SEQ ID NO: 7056771 - DNA, 22 bp, Homo sapiens
tagtttaggaattatgagggtg

SEQ ID NO: 7056772 - DNA, 22 bp, Homo sapiens
tagtttaggatccaatctaaga

SEQ ID NO: 7056773 - DNA, 22 bp, Homo sapiens
tagtttaggatcttttttgtgc

SEQ ID NO: 7056774 - DNA, 22 bp, Homo sapiens
tagtttaggtcgtacaagcaaa

SEQ ID NO: 7056775 - DNA, 22 bp, Homo sapiens
tagtttaggtggggtagacaga

SEQ ID NO: 7056776 - DNA, 22 bp, Homo sapiens
tagtttagtaagaggagagctg

SEQ ID NO: 7056777 - DNA, 22 bp, Homo sapiens
tagtttagtgaatggttaaaga

SEQ ID NO: 7056778 - DNA, 22 bp, Homo sapiens
tagtttatgctgctgcagtgag

SEQ ID NO: 7056779 - DNA, 22 bp, Homo sapiens
tagtttaatggtcaactaatga

SEQ ID NO: 7056780 - DNA, 22 bp, Homo sapiens
tagtttagaatgttgcaataca

SEQ ID NO: 7056781 - DNA, 22 bp, Homo sapiens
tagtttagacttcaaccctttg

SEQ ID NO: 7056782 - DNA, 22 bp, Homo sapiens
tagtttagagaattggggatga

SEQ ID NO: 7056783 - DNA, 22 bp, Homo sapiens
tagtttagcactaagaaaaaca

SEQ ID NO: 7056784 - DNA, 22 bp, Homo sapiens
tagtttagcatacatcttcagg

SEQ ID NO: 7056785 - DNA, 22 bp, Homo sapiens
tagtttagccatttaggaattg

SEQ ID NO: 7056786 - DNA, 22 bp, Homo sapiens
tagtttagccccacgtgtgctt

SEQ ID NO: 7056787 - DNA, 22 bp, Homo sapiens
tagtggagaggatgtggagaaa

SEQ ID NO: 7056788 - DNA, 22 bp, Homo sapiens
tagtggagagttgttttgtgca

SEQ ID NO: 7056789 - DNA, 22 bp, Homo sapiens
tagtggaggcctgttgtgtgca

SEQ ID NO: 7056790 - DNA, 22 bp, Homo sapiens
tagtggaggggatgcaaagctt

SEQ ID NO: 7056791 - DNA, 22 bp, Homo sapiens
tagtggagggtgtagctgctgg

SEQ ID NO: 7056792 - DNA, 22 bp, Homo sapiens
tagtggaggtggtctgtgaact

SEQ ID NO: 7056793 - DNA, 22 bp, Homo sapiens
tagtggaggtggtctgtgaact

SEQ ID NO: 7056794 - DNA, 22 bp, Homo sapiens
tagtggagtagaaaccaaagaa

SEQ ID NO: 7056795 - DNA, 19 bp, Homo sapiens
tagtggagtgacaagttct

SEQ ID NO: 7056796 - DNA, 22 bp, Homo sapiens
tagtgcttaaaagtggaagaga

SEQ ID NO: 7056797 - DNA, 22 bp, Homo sapiens
tagtgcttaacacaaagtgatt

SEQ ID NO: 7056798 - DNA, 22 bp, Homo sapiens
tagtgcttaataaatttcagaa

SEQ ID NO: 7056799 - DNA, 22 bp, Homo sapiens
tagtgcttaataaatttcagaa

SEQ ID NO: 7056800 - DNA, 22 bp, Homo sapiens
tagtgcttattactgtgctgtc

SEQ ID NO: 7056801 - DNA, 22 bp, Homo sapiens
tagtgcttctaccctaggcagg

SEQ ID NO: 7056802 - DNA, 22 bp, Homo sapiens
tagtgcttgagtctctccgtac

SEQ ID NO: 7056803 - DNA, 22 bp, Homo sapiens
tagtgcttgagtctctccgtac

SEQ ID NO: 7056804 - DNA, 22 bp, Homo sapiens
tagtgcttggccctaccagata

SEQ ID NO: 7056805 - DNA, 22 bp, Homo sapiens
tagtgcttggccctaccagata

SEQ ID NO: 7056806 - DNA, 22 bp, Homo sapiens
tagtgcttggtggagatggaga

SEQ ID NO: 7056807 - DNA, 22 bp, Homo sapiens
tagtgctttaagtttacagaga

SEQ ID NO: 7056808 - DNA, 22 bp, Homo sapiens
tagtgctttaggcctgagtgtc

SEQ ID NO: 7056809 - DNA, 22 bp, Homo sapiens
tagtgctttaggcctgagtgtc

SEQ ID NO: 7056810 - DNA, 22 bp, Homo sapiens
tagtgctttattgttcctgaaa

SEQ ID NO: 7056811 - DNA, 22 bp, Homo sapiens
tagtgctttggagctttctcct

SEQ ID NO: 7056812 - DNA, 22 bp, Homo sapiens
tagtggagaagtggagtctgtg

SEQ ID NO: 7056813 - DNA, 22 bp, Homo sapiens
tagtctctggagactctagggg

SEQ ID NO: 7056814 - DNA, 22 bp, Homo sapiens
tagtctctgctttgcccttggc

SEQ ID NO: 7056815 - DNA, 22 bp, Homo sapiens
tagtgcatacctaacatttttg

SEQ ID NO: 7056816 - DNA, 22 bp, Homo sapiens
taggggaggggatcatgtgctg

SEQ ID NO: 7056817 - DNA, 22 bp, Homo sapiens
taggggaactggcacagggcag

SEQ ID NO: 7056818 - DNA, 22 bp, Homo sapiens
tagggctgttagtaattctcag

SEQ ID NO: 7056819 - DNA, 22 bp, Homo sapiens
tagggctgtgtctccaggacca

SEQ ID NO: 7056820 - DNA, 22 bp, Homo sapiens
tagggctgtttaaaagtgaggt

SEQ ID NO: 7056821 - DNA, 22 bp, Homo sapiens
tagggctgtttaaaagtgaggt

SEQ ID NO: 7056822 - DNA, 22 bp, Homo sapiens
tagggctgtggtcagtcctcta

SEQ ID NO: 7056823 - DNA, 22 bp, Homo sapiens
tagggctgtgtctccaggacca

SEQ ID NO: 7056824 - DNA, 22 bp, Homo sapiens
tagggctgggtacactcttgcc

SEQ ID NO: 7056825 - DNA, 16 bp, Homo sapiens
tagggctgggaaggag

SEQ ID NO: 7056826 - DNA, 16 bp, Homo sapiens
tagggctgggaaggag

SEQ ID NO: 7056827 - DNA, 19 bp, Homo sapiens
tagggctggccgggcggtg

SEQ ID NO: 7056828 - DNA, 22 bp, Homo sapiens
tagggctggcgtgctcagggaa

SEQ ID NO: 7056829 - DNA, 22 bp, Homo sapiens
tagggctgctgcagatgacagg

SEQ ID NO: 7056830 - DNA, 22 bp, Homo sapiens
tagggctgctttgtattctgct

SEQ ID NO: 7056831 - DNA, 19 bp, Homo sapiens
tagggctggccgggcggtg

SEQ ID NO: 7056832 - DNA, 22 bp, Homo sapiens
tagggctgcctatggctagata

SEQ ID NO: 7056833 - DNA, 22 bp, Homo sapiens
tagggctgcctatggctagata

SEQ ID NO: 7056834 - DNA, 22 bp, Homo sapiens
tagggctgctgcagatgacagg

SEQ ID NO: 7056835 - DNA, 22 bp, Homo sapiens
tagggctgcagaacaatggcct

SEQ ID NO: 7056836 - DNA, 22 bp, Homo sapiens
tagggctgccatttgcttttct

SEQ ID NO: 7056837 - DNA, 22 bp, Homo sapiens
taggccattgatttttataagt

SEQ ID NO: 7056838 - DNA, 22 bp, Homo sapiens
tagggcagccacccaggctgct

SEQ ID NO: 7056839 - DNA, 22 bp, Homo sapiens
tagggcagccacccaggctgct

SEQ ID NO: 7056840 - DNA, 22 bp, Homo sapiens
tagggcagctgcatcaggcact

SEQ ID NO: 7056841 - DNA, 22 bp, Homo sapiens
tagggctgaggcaacaagggag

SEQ ID NO: 7056842 - DNA, 22 bp, Homo sapiens
tagctggtctttaagcatgtaa

SEQ ID NO: 7056843 - DNA, 22 bp, Homo sapiens
tagctggttctccaggagctag

SEQ ID NO: 7056844 - DNA, 22 bp, Homo sapiens
tagctgtgtaagcttggtaaga

SEQ ID NO: 7056845 - DNA, 17 bp, Homo sapiens
tagctgtgtttcagcta

SEQ ID NO: 7056846 - DNA, 22 bp, Homo sapiens
taggcagaaaggaaggcaagtt

SEQ ID NO: 7056847 - DNA, 20 bp, Homo sapiens
taggcagagctgtgcagcct

SEQ ID NO: 7056848 - DNA, 20 bp, Homo sapiens
taggcagagctgtgcagcct

SEQ ID NO: 7056849 - DNA, 21 bp, Homo sapiens
taggcagaggagcaggtatct

SEQ ID NO: 7056850 - DNA, 22 bp, Homo sapiens
taggcagaggtatggtaaggac

SEQ ID NO: 7056851 - DNA, 22 bp, Homo sapiens
taggcagatgttaacaggaaaa

SEQ ID NO: 7056852 - DNA, 22 bp, Homo sapiens
taggcagatgttaacaggaaaa

SEQ ID NO: 7056853 - DNA, 22 bp, Homo sapiens
taggcagggattagggttgatt

SEQ ID NO: 7056854 - DNA, 22 bp, Homo sapiens
gtgaggagggctggtcccaggc

SEQ ID NO: 7056855 - DNA, 22 bp, Homo sapiens
gtgaggagctgacactggggtg

SEQ ID NO: 7056856 - DNA, 22 bp, Homo sapiens
gtgaggagggctggtcccaggc

SEQ ID NO: 7056857 - DNA, 22 bp, Homo sapiens
gtgaggagctgacactggggtg

SEQ ID NO: 7056858 - DNA, 22 bp, Homo sapiens
gtgaggactagtgggtttgtgc

SEQ ID NO: 7056859 - DNA, 22 bp, Homo sapiens
gtgaggactggtaaggactgca

SEQ ID NO: 7056860 - DNA, 22 bp, Homo sapiens
gtgagctggaatagtggagaaa

SEQ ID NO: 7056861 - DNA, 22 bp, Homo sapiens
gtgagctggaatagtggagaaa

SEQ ID NO: 7056862 - DNA, 22 bp, Homo sapiens
gtgagctgggtgaatggtaggg

SEQ ID NO: 7056863 - DNA, 22 bp, Homo sapiens
gtgagctgttggagtggcagag

SEQ ID NO: 7056864 - DNA, 22 bp, Homo sapiens
gtctttttgtctggcagaggtc

SEQ ID NO: 7056865 - DNA, 22 bp, Homo sapiens
gtcttttttacaccttacatca

SEQ ID NO: 7056866 - DNA, 22 bp, Homo sapiens
gtctttttctacgatagcgcct

SEQ ID NO: 7056867 - DNA, 22 bp, Homo sapiens
gtctttttattatagagtggag

SEQ ID NO: 7056868 - DNA, 22 bp, Homo sapiens
gtgaaaaatcatcatgacttga

SEQ ID NO: 7056869 - DNA, 22 bp, Homo sapiens
gtgaaaaatgatttgttaactg

SEQ ID NO: 7056870 - DNA, 21 bp, Homo sapiens
gtctttttaattgcgatttcc

SEQ ID NO: 7056871 - DNA, 21 bp, Homo sapiens
gtcttttaagtgaagagaggc

SEQ ID NO: 7056872 - DNA, 22 bp, Homo sapiens
gtctttctatgatgaactgttg

SEQ ID NO: 7056873 - DNA, 19 bp, Homo sapiens
gtcttggctctcaaccatc

SEQ ID NO: 7056874 - DNA, 22 bp, Homo sapiens
gtcttgtcagtgttggcagctt

SEQ ID NO: 7056875 - DNA, 23 bp, Homo sapiens
gtctttatagtggggcactttgt

SEQ ID NO: 7056876 - DNA, 22 bp, Homo sapiens
gtctttatatttactaaagaat

SEQ ID NO: 7056877 - DNA, 22 bp, Homo sapiens
gtctttatggtatgaaaactga

SEQ ID NO: 7056878 - DNA, 20 bp, Homo sapiens
gtctttatgttttatgacct

SEQ ID NO: 7056879 - DNA, 22 bp, Homo sapiens
gtctataagcaggggaaaactt

SEQ ID NO: 7056880 - DNA, 22 bp, Homo sapiens
gtctatttgggatcatgatatg

SEQ ID NO: 7056881 - DNA, 22 bp, Homo sapiens
gtgccaggtgctaagctgtgct

SEQ ID NO: 7056882 - DNA, 22 bp, Homo sapiens
gtgccaggtgctaagctgtgct

SEQ ID NO: 7056883 - DNA, 22 bp, Homo sapiens
gtgccagggggcactgaacaga

SEQ ID NO: 7056884 - DNA, 22 bp, Homo sapiens
gtgccagggagtggaggagctt

SEQ ID NO: 7056885 - DNA, 22 bp, Homo sapiens
gtgccagggagtggaggagctt

SEQ ID NO: 7056886 - DNA, 20 bp, Homo sapiens
gtgccaggcaagacaggtgg

SEQ ID NO: 7056887 - DNA, 22 bp, Homo sapiens
gtgccaggcccagggagcgggg

SEQ ID NO: 7056888 - DNA, 22 bp, Homo sapiens
gtgccaggcccagggagcgggg

SEQ ID NO: 7056889 - DNA, 18 bp, Homo sapiens
gtgccaggaggcgcagcc

SEQ ID NO: 7056890 - DNA, 18 bp, Homo sapiens
gtgccaggaggcgcagcc

SEQ ID NO: 7056891 - DNA, 22 bp, Homo sapiens
gtgctgccggcatagcagtgaa

SEQ ID NO: 7056892 - DNA, 22 bp, Homo sapiens
gtgctgcctgccagcttctggg

SEQ ID NO: 7056893 - DNA, 22 bp, Homo sapiens
gtgcccaggcccaaggcaccac

SEQ ID NO: 7056894 - DNA, 22 bp, Homo sapiens
gtgcccaggggccagctgccgg

SEQ ID NO: 7056895 - DNA, 22 bp, Homo sapiens
gtgctgacaggagcctggcggt

SEQ ID NO: 7056896 - DNA, 22 bp, Homo sapiens
gtgctgagaacaaaagtggaca

SEQ ID NO: 7056897 - DNA, 22 bp, Homo sapiens
gtgctgagtgcagagtgcagag

SEQ ID NO: 7056898 - DNA, 22 bp, Homo sapiens
gtgcagggcagccgaatgggct

SEQ ID NO: 7056899 - DNA, 22 bp, Homo sapiens
gtgcagggtagcgacggcagga

SEQ ID NO: 7056900 - DNA, 19 bp, Homo sapiens
gtgaggatactgctcagag

SEQ ID NO: 7056901 - DNA, 22 bp, Homo sapiens
gtgaggatacttaagagaacac

SEQ ID NO: 7056902 - DNA, 22 bp, Homo sapiens
gtgaggatgcagatgagggcct

SEQ ID NO: 7056903 - DNA, 22 bp, Homo sapiens
gtgaggcagaagttccctttta

SEQ ID NO: 7056904 - DNA, 22 bp, Homo sapiens
gtgaggcaggcattctcctttc

SEQ ID NO: 7056905 - DNA, 22 bp, Homo sapiens
gtgaggcagggaaagaggataa

SEQ ID NO: 7056906 - DNA, 22 bp, Homo sapiens
gtgcagcaaagtttgagatata

SEQ ID NO: 7056907 - DNA, 22 bp, Homo sapiens
gtgcaggagtaggagagggctt

SEQ ID NO: 7056908 - DNA, 22 bp, Homo sapiens
gtgcaggatctcagaacaagtg

SEQ ID NO: 7056909 - DNA, 22 bp, Homo sapiens
gtgcagggagcccagaaggtcc

SEQ ID NO: 7056910 - DNA, 22 bp, Homo sapiens
gtcctctggtgaaagcattccc

SEQ ID NO: 7056911 - DNA, 22 bp, Homo sapiens
gtcctgggaactggacagctaa

SEQ ID NO: 7056912 - DNA, 22 bp, Homo sapiens
gtcctctgggcagctgccccac

SEQ ID NO: 7056913 - DNA, 22 bp, Homo sapiens
gtcctctggaagatgagttctt

SEQ ID NO: 7056914 - DNA, 20 bp, Homo sapiens
gtccaggacccagcaggagg

SEQ ID NO: 7056915 - DNA, 22 bp, Homo sapiens
gtccaggctcaaaaggttgtta

SEQ ID NO: 7056916 - DNA, 22 bp, Homo sapiens
gtccagagaagggaggggactc

SEQ ID NO: 7056917 - DNA, 22 bp, Homo sapiens
gtcagaggaggctgagtaggaa

SEQ ID NO: 7056918 - DNA, 22 bp, Homo sapiens
gtcagagctgtgcaaggctgag

SEQ ID NO: 7056919 - DNA, 22 bp, Homo sapiens
gtcactgtatccaggttccagc

SEQ ID NO: 7056920 - DNA, 18 bp, Homo sapiens
gtcactgtgtttctgagc

SEQ ID NO: 7056921 - DNA, 22 bp, Homo sapiens
gtcactgtttcctattatattt

SEQ ID NO: 7056922 - DNA, 22 bp, Homo sapiens
gtcagacacatttctttcagtg

SEQ ID NO: 7056923 - DNA, 22 bp, Homo sapiens
gtacaacaggattgatgtacca

SEQ ID NO: 7056924 - DNA, 22 bp, Homo sapiens
gtacaaattgatacagatttga

SEQ ID NO: 7056925 - DNA, 22 bp, Homo sapiens
gtacaaaagttattgcggtttt

SEQ ID NO: 7056926 - DNA, 22 bp, Homo sapiens
gtaggtcagacataagaggaca

SEQ ID NO: 7056927 - DNA, 18 bp, Homo sapiens
gtaggtcagtaccaagca

SEQ ID NO: 7056928 - DNA, 22 bp, Homo sapiens
gtagtgctttcatctggagtgt

SEQ ID NO: 7056929 - DNA, 22 bp, Homo sapiens
gtaggcagaataattcctcctt

SEQ ID NO: 7056930 - DNA, 22 bp, Homo sapiens
gtaggcagataggagtgcagcc

SEQ ID NO: 7056931 - DNA, 22 bp, Homo sapiens
gtaggggtgctgagatctggaa

SEQ ID NO: 7056932 - DNA, 22 bp, Homo sapiens
gtattttcatgatttcagacca

SEQ ID NO: 7056933 - DNA, 22 bp, Homo sapiens
gtattttatggcctggggccta

SEQ ID NO: 7056934 - DNA, 22 bp, Homo sapiens
gtattttcaagagcagtagtat

SEQ ID NO: 7056935 - DNA, 22 bp, Homo sapiens
gtattttcatgatttcagacca

SEQ ID NO: 7056936 - DNA, 22 bp, Homo sapiens
gtatttcccccagactccctgg

SEQ ID NO: 7056937 - DNA, 22 bp, Homo sapiens
gtatttccctgagttctgtgag

SEQ ID NO: 7056938 - DNA, 22 bp, Homo sapiens
gtatttcctatagtgagggcct

SEQ ID NO: 7056939 - DNA, 22 bp, Homo sapiens
gtatttcctcgcttgtgggatt

SEQ ID NO: 7056940 - DNA, 22 bp, Homo sapiens
gtattttatggcatgcagtggc

SEQ ID NO: 7056941 - DNA, 20 bp, Homo sapiens
gtataagatttcacacatta

SEQ ID NO: 7056942 - DNA, 22 bp, Homo sapiens
gtagttttctgaaaattacttt

SEQ ID NO: 7056943 - DNA, 22 bp, Homo sapiens
gtatttttcattccaagtgaga

SEQ ID NO: 7056944 - DNA, 16 bp, Homo sapiens
gggctgggggattctg

SEQ ID NO: 7056945 - DNA, 22 bp, Homo sapiens
gggctggtctggcttagtcagg

SEQ ID NO: 7056946 - DNA, 22 bp, Homo sapiens
gggcttcaaaattggcactctt

SEQ ID NO: 7056947 - DNA, 22 bp, Homo sapiens
gggcttcaatagcagaggcgtg

SEQ ID NO: 7056948 - DNA, 22 bp, Homo sapiens
gggcttcagatccagggacctc

SEQ ID NO: 7056949 - DNA, 22 bp, Homo sapiens
gggcttcaggagggtcagccca

SEQ ID NO: 7056950 - DNA, 22 bp, Homo sapiens
gggcttcattcaggcagaattt

SEQ ID NO: 7056951 - DNA, 23 bp, Homo sapiens
gggcttcattttaattcagctgc

SEQ ID NO: 7056952 - DNA, 22 bp, Homo sapiens
gggcttctccctaaggactctg

SEQ ID NO: 7056953 - DNA, 22 bp, Homo sapiens
gggcttctctcaggggcatgag

SEQ ID NO: 7056954 - DNA, 22 bp, Homo sapiens
gggcttctctttagtgagctga

SEQ ID NO: 7056955 - DNA, 22 bp, Homo sapiens
ggggaggaagctggaacacggg

SEQ ID NO: 7056956 - DNA, 22 bp, Homo sapiens
ggggaggaagctggaacacggg

SEQ ID NO: 7056957 - DNA, 22 bp, Homo sapiens
ggggaggcaagatgaagtgagg

SEQ ID NO: 7056958 - DNA, 19 bp, Homo sapiens
ggggaggtattgttttcat

SEQ ID NO: 7056959 - DNA, 22 bp, Homo sapiens
ggggatggaatgtagtagtgat

SEQ ID NO: 7056960 - DNA, 22 bp, Homo sapiens
ggggcagggaggttatcgccga

SEQ ID NO: 7056961 - DNA, 22 bp, Homo sapiens
ggggccagagaggacccaggtg

SEQ ID NO: 7056962 - DNA, 22 bp, Homo sapiens
ggggccagatatcactaaggtt

SEQ ID NO: 7056963 - DNA, 22 bp, Homo sapiens
ggggcccagggcagcagtgcag

SEQ ID NO: 7056964 - DNA, 22 bp, Homo sapiens
ggggcccctcggacacgtgcgg

SEQ ID NO: 7056965 - DNA, 22 bp, Homo sapiens
ggggtagggcgattgctgcttt

SEQ ID NO: 7056966 - DNA, 22 bp, Homo sapiens
ggggtagggtgattgtgaagta

SEQ ID NO: 7056967 - DNA, 22 bp, Homo sapiens
ggggtgggagtgccatccttga

SEQ ID NO: 7056968 - DNA, 22 bp, Homo sapiens
ggggtgggcgtgcagggacacc

SEQ ID NO: 7056969 - DNA, 22 bp, Homo sapiens
ggggtgggagtgccatccttga

SEQ ID NO: 7056970 - DNA, 19 bp, Homo sapiens
ggggtggctggggctccag

SEQ ID NO: 7056971 - DNA, 22 bp, Homo sapiens
ggggtggattcctacaggtcca

SEQ ID NO: 7056972 - DNA, 22 bp, Homo sapiens
ggggtggattcctacaggtcca

SEQ ID NO: 7056973 - DNA, 22 bp, Homo sapiens
ggggtggatttcaggcggtgtc

SEQ ID NO: 7056974 - DNA, 22 bp, Homo sapiens
ggggtggagatggtggcccttt

SEQ ID NO: 7056975 - DNA, 22 bp, Homo sapiens
ggggtggagatggtggcccttt

SEQ ID NO: 7056976 - DNA, 22 bp, Homo sapiens
ggggtggagctaaatgtctact

SEQ ID NO: 7056977 - DNA, 22 bp, Homo sapiens
ggggtggatcaggcaggcccag

SEQ ID NO: 7056978 - DNA, 22 bp, Homo sapiens
gggtggagaggctaagtccagt

SEQ ID NO: 7056979 - DNA, 22 bp, Homo sapiens
gggtggagccagttgactctgt

SEQ ID NO: 7056980 - DNA, 22 bp, Homo sapiens
gggtggtgagatgtagctgatg

SEQ ID NO: 7056981 - DNA, 20 bp, Homo sapiens
gggtgaggatggagaatttg

SEQ ID NO: 7056982 - DNA, 22 bp, Homo sapiens
gggtgaggcccatttgaggcca

SEQ ID NO: 7056983 - DNA, 22 bp, Homo sapiens
gggtgaggcccatttgaggcca

SEQ ID NO: 7056984 - DNA, 22 bp, Homo sapiens
gggtgagggatgagccttcttc

SEQ ID NO: 7056985 - DNA, 22 bp, Homo sapiens
gggtgcagcagagctcctctgt

SEQ ID NO: 7056986 - DNA, 18 bp, Homo sapiens
gggtgcaggcactgactg

SEQ ID NO: 7056987 - DNA, 21 bp, Homo sapiens
gggtgctgtggtcatgcagga

SEQ ID NO: 7056988 - DNA, 22 bp, Homo sapiens
ggttcacaggtcctgggagcag

SEQ ID NO: 7056989 - DNA, 22 bp, Homo sapiens
ggtggtggagccagctgggagt

SEQ ID NO: 7056990 - DNA, 22 bp, Homo sapiens
ggtggtggagccagctgggagt

SEQ ID NO: 7056991 - DNA, 22 bp, Homo sapiens
ggttggggcgagctggaggccc

SEQ ID NO: 7056992 - DNA, 21 bp, Homo sapiens
ggttggtgtgtccagtggcca

SEQ ID NO: 7056993 - DNA, 21 bp, Homo sapiens
ggttggtgtgtccagtggcca

SEQ ID NO: 7056994 - DNA, 22 bp, Homo sapiens
ggtgggtgagccctgggagctg

SEQ ID NO: 7056995 - DNA, 22 bp, Homo sapiens
ggtggggccctggcactggtat

SEQ ID NO: 7056996 - DNA, 19 bp, Homo sapiens
ggtggcagaacgtgggtcc

SEQ ID NO: 7056997 - DNA, 22 bp, Homo sapiens
ggtggcagaataattgaaggtc

SEQ ID NO: 7056998 - DNA, 22 bp, Homo sapiens
ggtggcagagacataggacata

SEQ ID NO: 7056999 - DNA, 22 bp, Homo sapiens
ggtggcagagacataggacata

SEQ ID NO: 7057000 - DNA, 22 bp, Homo sapiens
ggtggcagagacataggacata

SEQ ID NO: 7057001 - DNA, 22 bp, Homo sapiens
ggtggcagagaggaggtagttt

SEQ ID NO: 7057002 - DNA, 22 bp, Homo sapiens
ggtggagctggaccaggagagg

SEQ ID NO: 7057003 - DNA, 22 bp, Homo sapiens
ggtggagctggaccaggagagg

SEQ ID NO: 7057004 - DNA, 22 bp, Homo sapiens
ggtggagtaattcgcagaggtt

SEQ ID NO: 7057005 - DNA, 22 bp, Homo sapiens
ggtggatgctgactgttctgct

SEQ ID NO: 7057006 - DNA, 22 bp, Homo sapiens
ggtccccgtggaggctggagcg

SEQ ID NO: 7057007 - DNA, 22 bp, Homo sapiens
ggtccctgcccaaagcccttgg

SEQ ID NO: 7057008 - DNA, 20 bp, Homo sapiens
ggtccctgccctctgtcatc

SEQ ID NO: 7057009 - DNA, 22 bp, Homo sapiens
gggttgaggcggatgtcggcgg

SEQ ID NO: 7057010 - DNA, 22 bp, Homo sapiens
gggttggggcccagcagtctgc

SEQ ID NO: 7057011 - DNA, 22 bp, Homo sapiens
gggttttatggttcacttgcaa

SEQ ID NO: 7057012 - DNA, 22 bp, Homo sapiens
ggtaaaaatcacaaatacttta

SEQ ID NO: 7057013 - DNA, 21 bp, Homo sapiens
ggtgctcgctgatgaggagtg

SEQ ID NO: 7057014 - DNA, 22 bp, Homo sapiens
ggtggaaggcagcagtctcagg

SEQ ID NO: 7057015 - DNA, 22 bp, Homo sapiens
ggtggaaggcctggaaggaggc

SEQ ID NO: 7057016 - DNA, 17 bp, Homo sapiens
ggtggaagtttctagtt

SEQ ID NO: 7057017 - DNA, 22 bp, Homo sapiens
ggtggacaaatgaatgactgaa

SEQ ID NO: 7057018 - DNA, 22 bp, Homo sapiens
ggtggacagtgttagctctggg

SEQ ID NO: 7057019 - DNA, 22 bp, Homo sapiens
ggtggacagtgttagctctggg

SEQ ID NO: 7057020 - DNA, 22 bp, Homo sapiens
ggtggacagtgttagctctggg

SEQ ID NO: 7057021 - DNA, 18 bp, Homo sapiens
ggtgagggagctggaagc

SEQ ID NO: 7057022 - DNA, 18 bp, Homo sapiens
ggtgagggagctggaagc

SEQ ID NO: 7057023 - DNA, 18 bp, Homo sapiens
ggtgagggagctggaagc

SEQ ID NO: 7057024 - DNA, 22 bp, Homo sapiens
ggtgagaggcagtgctgtggaa

SEQ ID NO: 7057025 - DNA, 22 bp, Homo sapiens
ggtccctggaagtccctcttct

SEQ ID NO: 7057026 - DNA, 22 bp, Homo sapiens
ggtccctgctgaagccttggtg

SEQ ID NO: 7057027 - DNA, 22 bp, Homo sapiens
ggtccctggaaggccaagcttg

SEQ ID NO: 7057028 - DNA, 22 bp, Homo sapiens
ggtgaggaaagatggtgacagt

SEQ ID NO: 7057029 - DNA, 22 bp, Homo sapiens
ggtgaggaaagatggtgacagt

SEQ ID NO: 7057030 - DNA, 22 bp, Homo sapiens
ggtgaggaaagatggtgacagt

SEQ ID NO: 7057031 - DNA, 22 bp, Homo sapiens
ggtgaggaattggggactgacc

SEQ ID NO: 7057032 - DNA, 22 bp, Homo sapiens
ggtgaggaattggggactgacc

SEQ ID NO: 7057033 - DNA, 22 bp, Homo sapiens
ggtgaggaattggggactgacc

SEQ ID NO: 7057034 - DNA, 22 bp, Homo sapiens
ggctgcagtttgtcttttgctt

SEQ ID NO: 7057035 - DNA, 22 bp, Homo sapiens
ggctgcagttgtgtgaaggccg

SEQ ID NO: 7057036 - DNA, 22 bp, Homo sapiens
ggctgcagttgtgtgaaggccg

SEQ ID NO: 7057037 - DNA, 17 bp, Homo sapiens
ggctgcagtccaggagg

SEQ ID NO: 7057038 - DNA, 17 bp, Homo sapiens
ggctgcagtccaggagg

SEQ ID NO: 7057039 - DNA, 17 bp, Homo sapiens
ggctgcagtccaggagg

SEQ ID NO: 7057040 - DNA, 22 bp, Homo sapiens
ggctgcaggttggttggcagct

SEQ ID NO: 7057041 - DNA, 22 bp, Homo sapiens
ggctgcagggcagctggtgtgg

SEQ ID NO: 7057042 - DNA, 22 bp, Homo sapiens
ggctgcaggttggttggcagct

SEQ ID NO: 7057043 - DNA, 22 bp, Homo sapiens
ggctgcaggcttccctccagca

SEQ ID NO: 7057044 - DNA, 22 bp, Homo sapiens
ggctgcaggcagggtatccact

SEQ ID NO: 7057045 - DNA, 22 bp, Homo sapiens
ggctgcaggcttccctccagca

SEQ ID NO: 7057046 - DNA, 21 bp, Homo sapiens
ggctgcagggagccctggggt

SEQ ID NO: 7057047 - DNA, 21 bp, Homo sapiens
ggctgcagggagccctggggt

SEQ ID NO: 7057048 - DNA, 22 bp, Homo sapiens
ggctggcagtgtgagagaggga

SEQ ID NO: 7057049 - DNA, 22 bp, Homo sapiens
ggctggcagtgtgagagaggga

SEQ ID NO: 7057050 - DNA, 22 bp, Homo sapiens
ggctggcagaggggagtctgtg

SEQ ID NO: 7057051 - DNA, 22 bp, Homo sapiens
ggctggaggtagaagaacactt

SEQ ID NO: 7057052 - DNA, 19 bp, Homo sapiens
ggctggagtggccatctgt

SEQ ID NO: 7057053 - DNA, 19 bp, Homo sapiens
ggctggagtggccatctgt

SEQ ID NO: 7057054 - DNA, 22 bp, Homo sapiens
ggctggagtgggctccagagtt

SEQ ID NO: 7057055 - DNA, 22 bp, Homo sapiens
ggctggagacaacgtcctgccc

SEQ ID NO: 7057056 - DNA, 22 bp, Homo sapiens
ggctggagatatgtctggaaca

SEQ ID NO: 7057057 - DNA, 22 bp, Homo sapiens
ggctggaggagaatgggtgtga

SEQ ID NO: 7057058 - DNA, 22 bp, Homo sapiens
ggctgtgctgagggggaagccc

SEQ ID NO: 7057059 - DNA, 18 bp, Homo sapiens
ggctgtgcgtggaggctg

SEQ ID NO: 7057060 - DNA, 22 bp, Homo sapiens
ggctgtggcagctggaagtggt

SEQ ID NO: 7057061 - DNA, 22 bp, Homo sapiens
ggctgtggcagctggaagtggt

SEQ ID NO: 7057062 - DNA, 22 bp, Homo sapiens
ggctgtggccagcggggctgag

SEQ ID NO: 7057063 - DNA, 22 bp, Homo sapiens
ggctgtggcattaggtgaggcc

SEQ ID NO: 7057064 - DNA, 22 bp, Homo sapiens
ggctgtggcattaggtgaggcc

SEQ ID NO: 7057065 - DNA, 22 bp, Homo sapiens
ggctgtgggatgcataggagct

SEQ ID NO: 7057066 - DNA, 22 bp, Homo sapiens
ggctgtgggatgcataggagct

SEQ ID NO: 7057067 - DNA, 22 bp, Homo sapiens
ggctgtgggatgcataggagct

SEQ ID NO: 7057068 - DNA, 22 bp, Homo sapiens
ggctgtggccagcggggctgag

SEQ ID NO: 7057069 - DNA, 22 bp, Homo sapiens
ggctgtggggccgggtacagtg

SEQ ID NO: 7057070 - DNA, 22 bp, Homo sapiens
ggctgtggggccgggtacagtg

SEQ ID NO: 7057071 - DNA, 22 bp, Homo sapiens
gggaagagggagctggaatgat

SEQ ID NO: 7057072 - DNA, 22 bp, Homo sapiens
gggagccacagtttatagtgat

SEQ ID NO: 7057073 - DNA, 22 bp, Homo sapiens
gggagccacagtgaggtgcatg

SEQ ID NO: 7057074 - DNA, 22 bp, Homo sapiens
gggagccacagtgaggtgcatg

SEQ ID NO: 7057075 - DNA, 22 bp, Homo sapiens
gggaaggccggtccagtcaggt

SEQ ID NO: 7057076 - DNA, 22 bp, Homo sapiens
gggagatgactcagtgacctcg

SEQ ID NO: 7057077 - DNA, 22 bp, Homo sapiens
gggagatggctcagaggccgcg

SEQ ID NO: 7057078 - DNA, 22 bp, Homo sapiens
gggagccagcagggcatggagc

SEQ ID NO: 7057079 - DNA, 23 bp, Homo sapiens
gggagccaggacctcgcgcccca

SEQ ID NO: 7057080 - DNA, 22 bp, Homo sapiens
gggaagccatgctcagaggtac

SEQ ID NO: 7057081 - DNA, 18 bp, Homo sapiens
gggaagccgggaagccgg

SEQ ID NO: 7057082 - DNA, 22 bp, Homo sapiens
gggaagatagtgttgagggccc

SEQ ID NO: 7057083 - DNA, 22 bp, Homo sapiens
gggaagcagcattgtgctggct

SEQ ID NO: 7057084 - DNA, 22 bp, Homo sapiens
gggagctccactgcctctcatt

SEQ ID NO: 7057085 - DNA, 22 bp, Homo sapiens
gggagtggagagcaatggatga

SEQ ID NO: 7057086 - DNA, 22 bp, Homo sapiens
gggagctgaatggcaatggaga

SEQ ID NO: 7057087 - DNA, 22 bp, Homo sapiens
gggataggaaacttaggtacac

SEQ ID NO: 7057088 - DNA, 22 bp, Homo sapiens
gggagtggggcttaccttgaag

SEQ ID NO: 7057089 - DNA, 22 bp, Homo sapiens
gggagtggattatgtggaccca

SEQ ID NO: 7057090 - DNA, 22 bp, Homo sapiens
gggagtggattatgtggaccca

SEQ ID NO: 7057091 - DNA, 22 bp, Homo sapiens
gggagtgggtttggcctaggcc

SEQ ID NO: 7057092 - DNA, 22 bp, Homo sapiens
gggagtgggtttggcctaggcc

SEQ ID NO: 7057093 - DNA, 20 bp, Homo sapiens
gggagtggtggtagcctgtg

SEQ ID NO: 7057094 - DNA, 20 bp, Homo sapiens
gggagtggtggtagcctgtg

SEQ ID NO: 7057095 - DNA, 22 bp, Homo sapiens
gggagtggttgatggtgaaaat

SEQ ID NO: 7057096 - DNA, 22 bp, Homo sapiens
gggagtggttgatggtgaaaat

SEQ ID NO: 7057097 - DNA, 22 bp, Homo sapiens
gggcaggtgattttggctccat

SEQ ID NO: 7057098 - DNA, 22 bp, Homo sapiens
gggcaggtgccagctccctgtc

SEQ ID NO: 7057099 - DNA, 21 bp, Homo sapiens
gggcagaggggcctcctgggt

SEQ ID NO: 7057100 - DNA, 21 bp, Homo sapiens
gggcagaggggcctcctgggt

SEQ ID NO: 7057101 - DNA, 21 bp, Homo sapiens
gggcagaggggcctcctgggt

SEQ ID NO: 7057102 - DNA, 22 bp, Homo sapiens
gggcagaggctctggcccatcc

SEQ ID NO: 7057103 - DNA, 21 bp, Homo sapiens
gggcagaggggcctcctgggt

SEQ ID NO: 7057104 - DNA, 17 bp, Homo sapiens
gggcagggactcctggg

SEQ ID NO: 7057105 - DNA, 22 bp, Homo sapiens
gggcactggtgctgccatcttg

SEQ ID NO: 7057106 - DNA, 22 bp, Homo sapiens
gggcactgtacactgtgcatgg

SEQ ID NO: 7057107 - DNA, 22 bp, Homo sapiens
gggcactgtgctaggtgctgag

SEQ ID NO: 7057108 - DNA, 22 bp, Homo sapiens
gggcagagactcagaaacagaa

SEQ ID NO: 7057109 - DNA, 22 bp, Homo sapiens
gggcagagagctggaactcctt

SEQ ID NO: 7057110 - DNA, 22 bp, Homo sapiens
gggcagagagctggaactcctt

SEQ ID NO: 7057111 - DNA, 22 bp, Homo sapiens
gggcagagagctggaactcctt

SEQ ID NO: 7057112 - DNA, 20 bp, Homo sapiens
gggcagagccagccagtccc

SEQ ID NO: 7057113 - DNA, 20 bp, Homo sapiens
gggcagagccagccagtccc

SEQ ID NO: 7057114 - DNA, 20 bp, Homo sapiens
gggcagagccagccagtccc

SEQ ID NO: 7057115 - DNA, 22 bp, Homo sapiens
gggcagaggctctggcccatcc

SEQ ID NO: 7057116 - DNA, 22 bp, Homo sapiens
gggcagaggctctggcccatcc

SEQ ID NO: 7057117 - DNA, 22 bp, Homo sapiens
gggctctggaaatgggagctcc

SEQ ID NO: 7057118 - DNA, 22 bp, Homo sapiens
gggctctggagttctagaaaga

SEQ ID NO: 7057119 - DNA, 22 bp, Homo sapiens
gggctccaacggtgagcatgga

SEQ ID NO: 7057120 - DNA, 22 bp, Homo sapiens
gggctcaggagtttgaggctgc

SEQ ID NO: 7057121 - DNA, 22 bp, Homo sapiens
gggctcagctgggcgtgctggt

SEQ ID NO: 7057122 - DNA, 22 bp, Homo sapiens
gggctcagaggagtggcctggg

SEQ ID NO: 7057123 - DNA, 22 bp, Homo sapiens
gggcaggttattggagtaggga

SEQ ID NO: 7057124 - DNA, 22 bp, Homo sapiens
gggcaggtggcagggtctctgg

SEQ ID NO: 7057125 - DNA, 22 bp, Homo sapiens
gggcaggtggcctcttgtacta

SEQ ID NO: 7057126 - DNA, 22 bp, Homo sapiens
gggcaggtgtgcagagctgttg

SEQ ID NO: 7057127 - DNA, 22 bp, Homo sapiens
gggcaggtgtttccaaggtgag

SEQ ID NO: 7057128 - DNA, 22 bp, Homo sapiens
gggcccttcagcttcctctgca

SEQ ID NO: 7057129 - DNA, 22 bp, Homo sapiens
gggccctggggcctgatttgca

SEQ ID NO: 7057130 - DNA, 22 bp, Homo sapiens
ggcccagtgctgttcacccagt

SEQ ID NO: 7057131 - DNA, 22 bp, Homo sapiens
ggccagcagtcacagggtcaga

SEQ ID NO: 7057132 - DNA, 22 bp, Homo sapiens
ggccagcagtatatagctaatt

SEQ ID NO: 7057133 - DNA, 21 bp, Homo sapiens
ggccagcagcgtccactgtgg

SEQ ID NO: 7057134 - DNA, 22 bp, Homo sapiens
ggccagcagacctcagggactc

SEQ ID NO: 7057135 - DNA, 22 bp, Homo sapiens
ggccagcagacctcagggactc

SEQ ID NO: 7057136 - DNA, 19 bp, Homo sapiens
ggccacctctcttcccagg

SEQ ID NO: 7057137 - DNA, 22 bp, Homo sapiens
ggccacctctgccctactgagt

SEQ ID NO: 7057138 - DNA, 22 bp, Homo sapiens
ggccagagttgatggcatcttg

SEQ ID NO: 7057139 - DNA, 22 bp, Homo sapiens
ggccacagtgggaaatcctggg

SEQ ID NO: 7057140 - DNA, 22 bp, Homo sapiens
ggcagtgggaaataagtgagaa

SEQ ID NO: 7057141 - DNA, 22 bp, Homo sapiens
ggcagtggctgtagtctcttgg

SEQ ID NO: 7057142 - DNA, 22 bp, Homo sapiens
ggcagtggctcctctctactcc

SEQ ID NO: 7057143 - DNA, 22 bp, Homo sapiens
ggcagtggcatgtgggtagtgg

SEQ ID NO: 7057144 - DNA, 22 bp, Homo sapiens
ggcagtgggtggatctcaggga

SEQ ID NO: 7057145 - DNA, 22 bp, Homo sapiens
ggccacagcaatgctgtgatgt

SEQ ID NO: 7057146 - DNA, 20 bp, Homo sapiens
ggccacagggtgctggtgga

SEQ ID NO: 7057147 - DNA, 22 bp, Homo sapiens
ggctcactgcaacttccgcctc

SEQ ID NO: 7057148 - DNA, 22 bp, Homo sapiens
ggctcactttggggtcagctgg

SEQ ID NO: 7057149 - DNA, 22 bp, Homo sapiens
ggctctctggaggagctcaccc

SEQ ID NO: 7057150 - DNA, 22 bp, Homo sapiens
ggctctgaacatggggaggagt

SEQ ID NO: 7057151 - DNA, 19 bp, Homo sapiens
ggcctctgcaggccgcccc

SEQ ID NO: 7057152 - DNA, 22 bp, Homo sapiens
ggcctctgccccagccacacct

SEQ ID NO: 7057153 - DNA, 21 bp, Homo sapiens
ggcctctgccttgccccactc

SEQ ID NO: 7057154 - DNA, 20 bp, Homo sapiens
ggcctctgaggacaaggaga

SEQ ID NO: 7057155 - DNA, 22 bp, Homo sapiens
ggcctctgcttatgctgatgac

SEQ ID NO: 7057156 - DNA, 18 bp, Homo sapiens
ggcctctggactggcagc

SEQ ID NO: 7057157 - DNA, 22 bp, Homo sapiens
ggcctctggcaggcaggccctc

SEQ ID NO: 7057158 - DNA, 22 bp, Homo sapiens
ggcctctggggtcctgagccca

SEQ ID NO: 7057159 - DNA, 22 bp, Homo sapiens
ggcctctggtcaagacaagcat

SEQ ID NO: 7057160 - DNA, 22 bp, Homo sapiens
ggctaggctcacctggagagtt

SEQ ID NO: 7057161 - DNA, 22 bp, Homo sapiens
ggctcactgcaacttccgcctc

SEQ ID NO: 7057162 - DNA, 22 bp, Homo sapiens
ggctcactgcaacttccgcctc

SEQ ID NO: 7057163 - DNA, 22 bp, Homo sapiens
ggctcacgcaattatcccggcc

SEQ ID NO: 7057164 - DNA, 22 bp, Homo sapiens
ggctagggaaaatgattggata

SEQ ID NO: 7057165 - DNA, 22 bp, Homo sapiens
ggctagggaaatcctgatccaa

SEQ ID NO: 7057166 - DNA, 22 bp, Homo sapiens
ggctcaccatggcctccctgct

SEQ ID NO: 7057167 - DNA, 22 bp, Homo sapiens
ggctcaccattttcactctctg

SEQ ID NO: 7057168 - DNA, 17 bp, Homo sapiens
ggcagtggaggaagaga

SEQ ID NO: 7057169 - DNA, 22 bp, Homo sapiens
ggcagtgcaaggctggcacagt

SEQ ID NO: 7057170 - DNA, 22 bp, Homo sapiens
ggcagtgactgttcagacgtcc

SEQ ID NO: 7057171 - DNA, 22 bp, Homo sapiens
ggcagtgagaggtctcctggtc

SEQ ID NO: 7057172 - DNA, 22 bp, Homo sapiens
ggcagtgagctggagggaagga

SEQ ID NO: 7057173 - DNA, 22 bp, Homo sapiens
ggcagtgagctggagggaagga

SEQ ID NO: 7057174 - DNA, 22 bp, Homo sapiens
ggcagtgagctggagggaagga

SEQ ID NO: 7057175 - DNA, 22 bp, Homo sapiens
ggcagtgagctggagggaagga

SEQ ID NO: 7057176 - DNA, 22 bp, Homo sapiens
ggcagtgagtcccggagaggcc

SEQ ID NO: 7057177 - DNA, 22 bp, Homo sapiens
ggcagtgagtcccggagaggcc

SEQ ID NO: 7057178 - DNA, 22 bp, Homo sapiens
ggcagtgagtcccggagaggcc

SEQ ID NO: 7057179 - DNA, 22 bp, Homo sapiens
ggcagtgatgtcaaacagtgaa

SEQ ID NO: 7057180 - DNA, 21 bp, Homo sapiens
ggcagtgatgtgaagtgcatc

SEQ ID NO: 7057181 - DNA, 22 bp, Homo sapiens
ggcagggccctgattcctgggg

SEQ ID NO: 7057182 - DNA, 20 bp, Homo sapiens
ggcagggcatcaacagctct

SEQ ID NO: 7057183 - DNA, 22 bp, Homo sapiens
ggcaggggtcctggtgttgact

SEQ ID NO: 7057184 - DNA, 22 bp, Homo sapiens
ggcaggggtcctggtgttgact

SEQ ID NO: 7057185 - DNA, 22 bp, Homo sapiens
ggcagggaaacagctgatccca

SEQ ID NO: 7057186 - DNA, 22 bp, Homo sapiens
ggcagggaaacagctgatccca

SEQ ID NO: 7057187 - DNA, 22 bp, Homo sapiens
ggcagggaaacagctgatccca

SEQ ID NO: 7057188 - DNA, 22 bp, Homo sapiens
ggcagggaagctggcatcacgg

SEQ ID NO: 7057189 - DNA, 22 bp, Homo sapiens
ggcagccatgtcccagggcttc

SEQ ID NO: 7057190 - DNA, 22 bp, Homo sapiens
ggcagccatgtcccagggcttc

SEQ ID NO: 7057191 - DNA, 22 bp, Homo sapiens
ggcagccatgtgggcagcgagt

SEQ ID NO: 7057192 - DNA, 22 bp, Homo sapiens
ggcagccatgtgggcagcgagt

SEQ ID NO: 7057193 - DNA, 22 bp, Homo sapiens
ggcagcccaccagcccacgtct

SEQ ID NO: 7057194 - DNA, 18 bp, Homo sapiens
ggcagcctacccacttgt

SEQ ID NO: 7057195 - DNA, 17 bp, Homo sapiens
ggcagcctcaggcgttt

SEQ ID NO: 7057196 - DNA, 17 bp, Homo sapiens
ggcagcctcaggcgttt

SEQ ID NO: 7057197 - DNA, 22 bp, Homo sapiens
ggcagcctccagggcactggtg

SEQ ID NO: 7057198 - DNA, 22 bp, Homo sapiens
ggcagcctccagggcactggtg

SEQ ID NO: 7057199 - DNA, 19 bp, Homo sapiens
ggcagcctgcacgggctgc

SEQ ID NO: 7057200 - DNA, 18 bp, Homo sapiens
ggcagcctggacatgctc

SEQ ID NO: 7057201 - DNA, 18 bp, Homo sapiens
ggcagcctggacatgctc

SEQ ID NO: 7057202 - DNA, 22 bp, Homo sapiens
ggcagccttctctcataggtga

SEQ ID NO: 7057203 - DNA, 22 bp, Homo sapiens
ggcagccttgactagtgactta

SEQ ID NO: 7057204 - DNA, 22 bp, Homo sapiens
ggcagccttgagggaggcctgg

SEQ ID NO: 7057205 - DNA, 22 bp, Homo sapiens
ggcagcaagtggtgggagactt

SEQ ID NO: 7057206 - DNA, 22 bp, Homo sapiens
ggcagcaactcggagagaagag

SEQ ID NO: 7057207 - DNA, 18 bp, Homo sapiens
ggcagcaagaagggaggg

SEQ ID NO: 7057208 - DNA, 22 bp, Homo sapiens
ggcagcaaatattgtcagctgt

SEQ ID NO: 7057209 - DNA, 22 bp, Homo sapiens
ggcagcacgacaggagtggaag

SEQ ID NO: 7057210 - DNA, 21 bp, Homo sapiens
ggcagcactacctgaagcata

SEQ ID NO: 7057211 - DNA, 22 bp, Homo sapiens
ggcagcactgcagcttgttggg

SEQ ID NO: 7057212 - DNA, 22 bp, Homo sapiens
ggcagcactgcagcttgttggg

SEQ ID NO: 7057213 - DNA, 21 bp, Homo sapiens
ggcactaggcccggaggaagc

SEQ ID NO: 7057214 - DNA, 22 bp, Homo sapiens
ggcactcaataaatgttgccaa

SEQ ID NO: 7057215 - DNA, 22 bp, Homo sapiens
ggcactgactgtgcagcgcacc

SEQ ID NO: 7057216 - DNA, 22 bp, Homo sapiens
ggcagaggtgaagttcacaagg

SEQ ID NO: 7057217 - DNA, 22 bp, Homo sapiens
ggcagaggtgacagtgtctttt

SEQ ID NO: 7057218 - DNA, 22 bp, Homo sapiens
ggcagatgttatatgatctgag

SEQ ID NO: 7057219 - DNA, 22 bp, Homo sapiens
ggaggatgagctacgaggagct

SEQ ID NO: 7057220 - DNA, 22 bp, Homo sapiens
ggaggagtgtggggcactctgc

SEQ ID NO: 7057221 - DNA, 22 bp, Homo sapiens
ggaggagtcagttgggctgctt

SEQ ID NO: 7057222 - DNA, 22 bp, Homo sapiens
ggaggaggggtttacattggaa

SEQ ID NO: 7057223 - DNA, 22 bp, Homo sapiens
ggaggaggggtttacattggaa

SEQ ID NO: 7057224 - DNA, 22 bp, Homo sapiens
ggaggaggggtgactgaatgct

SEQ ID NO: 7057225 - DNA, 22 bp, Homo sapiens
ggaggaggggtgactgaatgct

SEQ ID NO: 7057226 - DNA, 22 bp, Homo sapiens
ggaggatgccaagctgtgcaca

SEQ ID NO: 7057227 - DNA, 16 bp, Homo sapiens
ggcaccagtgaacaca

SEQ ID NO: 7057228 - DNA, 22 bp, Homo sapiens
ggaggcacttcccgtctcagcc

SEQ ID NO: 7057229 - DNA, 22 bp, Homo sapiens
gctctctgtcgttatgcttcat

SEQ ID NO: 7057230 - DNA, 22 bp, Homo sapiens
gctctctgttattaagatcttt

SEQ ID NO: 7057231 - DNA, 22 bp, Homo sapiens
gctctctgttattaagatcttt

SEQ ID NO: 7057232 - DNA, 22 bp, Homo sapiens
gctctgtaaagaagagaaatgc

SEQ ID NO: 7057233 - DNA, 22 bp, Homo sapiens
gctctctgccatatgaggatac

SEQ ID NO: 7057234 - DNA, 22 bp, Homo sapiens
gctctctgcctttctcaatgac

SEQ ID NO: 7057235 - DNA, 22 bp, Homo sapiens
gctctctggaggccatggacag

SEQ ID NO: 7057236 - DNA, 22 bp, Homo sapiens
gctctctggctagtccatcggg

SEQ ID NO: 7057237 - DNA, 22 bp, Homo sapiens
gctctctgggtggtgggcaaca

SEQ ID NO: 7057238 - DNA, 22 bp, Homo sapiens
gctctctgggtgtgtctagata

SEQ ID NO: 7057239 - DNA, 22 bp, Homo sapiens
gctctctgggtgtgtctagata

SEQ ID NO: 7057240 - DNA, 22 bp, Homo sapiens
gctctctggttccagtcaggaa

SEQ ID NO: 7057241 - DNA, 22 bp, Homo sapiens
gctctgtgaagggtgttgctca

SEQ ID NO: 7057242 - DNA, 22 bp, Homo sapiens
gctctgtgaccttaggcaagtt

SEQ ID NO: 7057243 - DNA, 22 bp, Homo sapiens
gctctgtgagccacttgatgta

SEQ ID NO: 7057244 - DNA, 22 bp, Homo sapiens
gctctgtgccacatgcagtgtt

SEQ ID NO: 7057245 - DNA, 22 bp, Homo sapiens
gctctgtgccagggctgggcca

SEQ ID NO: 7057246 - DNA, 22 bp, Homo sapiens
gctctgtggcaggaggtcttgt

SEQ ID NO: 7057247 - DNA, 22 bp, Homo sapiens
gctcccagcattgctgctgaat

SEQ ID NO: 7057248 - DNA, 22 bp, Homo sapiens
gctcccagcattgctgctgaat

SEQ ID NO: 7057249 - DNA, 22 bp, Homo sapiens
gctcccagctggagcctcaaca

SEQ ID NO: 7057250 - DNA, 22 bp, Homo sapiens
gctcccaggaagagaagggcca

SEQ ID NO: 7057251 - DNA, 22 bp, Homo sapiens
gctcccaggatgaggagccagg

SEQ ID NO: 7057252 - DNA, 21 bp, Homo sapiens
gctctccagggccagcccagg

SEQ ID NO: 7057253 - DNA, 22 bp, Homo sapiens
gctctccaggggctcccaggat

SEQ ID NO: 7057254 - DNA, 22 bp, Homo sapiens
gctctccaggtctcatgcactg

SEQ ID NO: 7057255 - DNA, 22 bp, Homo sapiens
gctctctccctaggcaagtgag

SEQ ID NO: 7057256 - DNA, 22 bp, Homo sapiens
gctctctcgtgaacaggtggtt

SEQ ID NO: 7057257 - DNA, 22 bp, Homo sapiens
gctctctcttggggattcagca

SEQ ID NO: 7057258 - DNA, 22 bp, Homo sapiens
gctctctgaggtgctggcagag

SEQ ID NO: 7057259 - DNA, 22 bp, Homo sapiens
gctctctgaggtgctggcagag

SEQ ID NO: 7057260 - DNA, 22 bp, Homo sapiens
gctctctgcaagtcagcagcct

SEQ ID NO: 7057261 - DNA, 22 bp, Homo sapiens
gctctctgcaagtcagcagcct

SEQ ID NO: 7057262 - DNA, 22 bp, Homo sapiens
gctctctgcagcctccttggag

SEQ ID NO: 7057263 - DNA, 21 bp, Homo sapiens
gctctctgcatggtggctcag

SEQ ID NO: 7057264 - DNA, 22 bp, Homo sapiens
gctcccagatttcagccttgtg

SEQ ID NO: 7057265 - DNA, 22 bp, Homo sapiens
gctcccagatttcagccttgtg

SEQ ID NO: 7057266 - DNA, 22 bp, Homo sapiens
gctcccagcaattgaggcagcc

SEQ ID NO: 7057267 - DNA, 22 bp, Homo sapiens
gctcccagcaattgaggcagcc

SEQ ID NO: 7057268 - DNA, 22 bp, Homo sapiens
gctcccagcaattgaggcagcc

SEQ ID NO: 7057269 - DNA, 22 bp, Homo sapiens
gctcagttatccgtgtgtgact

SEQ ID NO: 7057270 - DNA, 22 bp, Homo sapiens
gctcagggcgcgagggacgtgg

SEQ ID NO: 7057271 - DNA, 22 bp, Homo sapiens
gctcagggccatggaccagcag

SEQ ID NO: 7057272 - DNA, 22 bp, Homo sapiens
gctcagggcctggctgcggact

SEQ ID NO: 7057273 - DNA, 22 bp, Homo sapiens
gctcagggcctggctgcggact

SEQ ID NO: 7057274 - DNA, 20 bp, Homo sapiens
gctcagggcctgggtctgga

SEQ ID NO: 7057275 - DNA, 20 bp, Homo sapiens
gctcagggcctgggtctgga

SEQ ID NO: 7057276 - DNA, 22 bp, Homo sapiens
gctcagggagagagggcagccg

SEQ ID NO: 7057277 - DNA, 22 bp, Homo sapiens
gctcagggagtttcacagtgta

SEQ ID NO: 7057278 - DNA, 22 bp, Homo sapiens
gctaggtgcagcagacagctta

SEQ ID NO: 7057279 - DNA, 23 bp, Homo sapiens
gctaggtgcttccacacgtgctg

SEQ ID NO: 7057280 - DNA, 22 bp, Homo sapiens
gctatacaagtgtagaatagag

SEQ ID NO: 7057281 - DNA, 22 bp, Homo sapiens
gctatacacatttcttggtagt

SEQ ID NO: 7057282 - DNA, 21 bp, Homo sapiens
gctatacagaatggccagagg

SEQ ID NO: 7057283 - DNA, 22 bp, Homo sapiens
gctcagggaaggccacgtgaga

SEQ ID NO: 7057284 - DNA, 22 bp, Homo sapiens
gctcagggaatgagaagatgtt

SEQ ID NO: 7057285 - DNA, 22 bp, Homo sapiens
gctaggtctgtgcgcagccgct

SEQ ID NO: 7057286 - DNA, 16 bp, Homo sapiens
gctaggcaacaggctg

SEQ ID NO: 7057287 - DNA, 22 bp, Homo sapiens
gctaggctcggaagcagcaggg

SEQ ID NO: 7057288 - DNA, 22 bp, Homo sapiens
gctagagaccagaggccttgaa

SEQ ID NO: 7057289 - DNA, 22 bp, Homo sapiens
gctagctttataatgctgggcg

SEQ ID NO: 7057290 - DNA, 20 bp, Homo sapiens
gcctggcacccggggctggc

SEQ ID NO: 7057291 - DNA, 22 bp, Homo sapiens
gctgatagactgaatgttggga

SEQ ID NO: 7057292 - DNA, 22 bp, Homo sapiens
gctgagtgaggtccagagcttg

SEQ ID NO: 7057293 - DNA, 22 bp, Homo sapiens
gctgagtgattcatacgctgct

SEQ ID NO: 7057294 - DNA, 17 bp, Homo sapiens
gctgagtgcagggagtc

SEQ ID NO: 7057295 - DNA, 17 bp, Homo sapiens
gctgagtgcagggagtc

SEQ ID NO: 7057296 - DNA, 22 bp, Homo sapiens
gctgagtgtaatgatggcagag

SEQ ID NO: 7057297 - DNA, 22 bp, Homo sapiens
gctgagtgtaatgatggcagag

SEQ ID NO: 7057298 - DNA, 22 bp, Homo sapiens
gctgagttgaaagcagaggata

SEQ ID NO: 7057299 - DNA, 22 bp, Homo sapiens
gctgagttgaaagcagaggata

SEQ ID NO: 7057300 - DNA, 22 bp, Homo sapiens
gctgagggggaaggaaagctga

SEQ ID NO: 7057301 - DNA, 20 bp, Homo sapiens
gctgaggggtctatggcata

SEQ ID NO: 7057302 - DNA, 22 bp, Homo sapiens
gctctgtggcattcatgggcag

SEQ ID NO: 7057303 - DNA, 22 bp, Homo sapiens
gctctgtggtggggcagagttt

SEQ ID NO: 7057304 - DNA, 20 bp, Homo sapiens
gctctgtggtttgagtctcc

SEQ ID NO: 7057305 - DNA, 22 bp, Homo sapiens
gctgaggtggctgccttagtaa

SEQ ID NO: 7057306 - DNA, 22 bp, Homo sapiens
gctgaggtggctgccttagtaa

SEQ ID NO: 7057307 - DNA, 22 bp, Homo sapiens
gctgaggtggtgatggttcatc

SEQ ID NO: 7057308 - DNA, 22 bp, Homo sapiens
gctgaggtggtgatggttcatc

SEQ ID NO: 7057309 - DNA, 18 bp, Homo sapiens
gctgaggtggtgtcagag

SEQ ID NO: 7057310 - DNA, 22 bp, Homo sapiens
gctgaggtgtcaccttgctggg

SEQ ID NO: 7057311 - DNA, 22 bp, Homo sapiens
gctgaggtgtcaccttgctggg

SEQ ID NO: 7057312 - DNA, 22 bp, Homo sapiens
gctgaggtttcaggagtggcag

SEQ ID NO: 7057313 - DNA, 22 bp, Homo sapiens
gctgaggtttcaggagtggcag

SEQ ID NO: 7057314 - DNA, 22 bp, Homo sapiens
gctgaggtttcaggagtggcag

SEQ ID NO: 7057315 - DNA, 20 bp, Homo sapiens
gctgaggtttcttcctatat

SEQ ID NO: 7057316 - DNA, 20 bp, Homo sapiens
gctgaggtttcttcctatat

SEQ ID NO: 7057317 - DNA, 22 bp, Homo sapiens
gctgaggttttctgcctgctca

SEQ ID NO: 7057318 - DNA, 22 bp, Homo sapiens
gctgaggttttctgcctgctca

SEQ ID NO: 7057319 - DNA, 22 bp, Homo sapiens
gctgagtcagattgcagtcttg

SEQ ID NO: 7057320 - DNA, 22 bp, Homo sapiens
gctgagtcagattgcagtcttg

SEQ ID NO: 7057321 - DNA, 22 bp, Homo sapiens
gctgcaggctgtggcaggggag

SEQ ID NO: 7057322 - DNA, 22 bp, Homo sapiens
gctgcaggctgtggcaggggag

SEQ ID NO: 7057323 - DNA, 22 bp, Homo sapiens
gctgcaggctctgcaggaattg

SEQ ID NO: 7057324 - DNA, 21 bp, Homo sapiens
gctgcagggcccagggcaccc

SEQ ID NO: 7057325 - DNA, 21 bp, Homo sapiens
gctgcagggcccagggcaccc

SEQ ID NO: 7057326 - DNA, 22 bp, Homo sapiens
gctgcagggagctggaaggctc

SEQ ID NO: 7057327 - DNA, 22 bp, Homo sapiens
gctgcctccactggctcccagt

SEQ ID NO: 7057328 - DNA, 22 bp, Homo sapiens
gctgcctcccagagccctgcag

SEQ ID NO: 7057329 - DNA, 22 bp, Homo sapiens
gctgcctcccccatggctggaa

SEQ ID NO: 7057330 - DNA, 22 bp, Homo sapiens
gctgcctccgccggctccacag

SEQ ID NO: 7057331 - DNA, 23 bp, Homo sapiens
gctgcctcctacaaaagcccagc

SEQ ID NO: 7057332 - DNA, 22 bp, Homo sapiens
gctgcctcctgaaagcgctctg

SEQ ID NO: 7057333 - DNA, 22 bp, Homo sapiens
gctgcctcctgaaagcgctctg

SEQ ID NO: 7057334 - DNA, 22 bp, Homo sapiens
gctgcctcctgagatttgggca

SEQ ID NO: 7057335 - DNA, 22 bp, Homo sapiens
gctgcctctcctgagttgacag

SEQ ID NO: 7057336 - DNA, 22 bp, Homo sapiens
gctgcctctgcacagctcactc

SEQ ID NO: 7057337 - DNA, 22 bp, Homo sapiens
gctgcctctgcacagctcactc

SEQ ID NO: 7057338 - DNA, 22 bp, Homo sapiens
gctgcctctgcgactctgggcg

SEQ ID NO: 7057339 - DNA, 22 bp, Homo sapiens
gctgcctctgcgactctgggcg

SEQ ID NO: 7057340 - DNA, 22 bp, Homo sapiens
gctggcaggtccaagatagagc

SEQ ID NO: 7057341 - DNA, 22 bp, Homo sapiens
gctggaggtagggaggtcctgt

SEQ ID NO: 7057342 - DNA, 22 bp, Homo sapiens
gctggaggtttcacctgagttt

SEQ ID NO: 7057343 - DNA, 22 bp, Homo sapiens
gctgctggggccttccctcggg

SEQ ID NO: 7057344 - DNA, 22 bp, Homo sapiens
gctgcctctgtagctttggacc

SEQ ID NO: 7057345 - DNA, 23 bp, Homo sapiens
gctgcctctgttggtcttcagtt

SEQ ID NO: 7057346 - DNA, 22 bp, Homo sapiens
gctgcctgaagtgtctacactg

SEQ ID NO: 7057347 - DNA, 22 bp, Homo sapiens
gctgctgtcacggtgctaaggg

SEQ ID NO: 7057348 - DNA, 22 bp, Homo sapiens
gctgctgtcagtggtggcagtt

SEQ ID NO: 7057349 - DNA, 22 bp, Homo sapiens
gctgctgtccttcaagtctgcg

SEQ ID NO: 7057350 - DNA, 22 bp, Homo sapiens
gctggagctgcagcctgggcct

SEQ ID NO: 7057351 - DNA, 22 bp, Homo sapiens
gctggaggggtaataggatggg

SEQ ID NO: 7057352 - DNA, 22 bp, Homo sapiens
gctggaggggtaataggatggg

SEQ ID NO: 7057353 - DNA, 22 bp, Homo sapiens
gctgtttccagacaatgtcttt

SEQ ID NO: 7057354 - DNA, 22 bp, Homo sapiens
gctgtttccccttcacagtggc

SEQ ID NO: 7057355 - DNA, 22 bp, Homo sapiens
gctgtttctgagtagctaggct

SEQ ID NO: 7057356 - DNA, 22 bp, Homo sapiens
gctgtttctttggcaaactgat

SEQ ID NO: 7057357 - DNA, 22 bp, Homo sapiens
gctgtgtgttcaataatgtgat

SEQ ID NO: 7057358 - DNA, 22 bp, Homo sapiens
gctgtgttggtgaagctgtagc

SEQ ID NO: 7057359 - DNA, 22 bp, Homo sapiens
gctgtgtttgacagtagcagac

SEQ ID NO: 7057360 - DNA, 22 bp, Homo sapiens
gctgtgttttatgttaggttaa

SEQ ID NO: 7057361 - DNA, 22 bp, Homo sapiens
gcttggttactgatggaaagga

SEQ ID NO: 7057362 - DNA, 21 bp, Homo sapiens
gcttggttttggttacttgcc

SEQ ID NO: 7057363 - DNA, 22 bp, Homo sapiens
gcttaaatcccaatgctagacc

SEQ ID NO: 7057364 - DNA, 22 bp, Homo sapiens
gcttaaattgtttgtggatagt

SEQ ID NO: 7057365 - DNA, 22 bp, Homo sapiens
gcttgtttctatttatcaagta

SEQ ID NO: 7057366 - DNA, 22 bp, Homo sapiens
gctttttcaaatgaaagctggt

SEQ ID NO: 7057367 - DNA, 20 bp, Homo sapiens
gctttttctaatagcagtcc

SEQ ID NO: 7057368 - DNA, 21 bp, Homo sapiens
gctttttgtatggcccaggaa

SEQ ID NO: 7057369 - DNA, 19 bp, Homo sapiens
gctttttgttgtcaaaggt

SEQ ID NO: 7057370 - DNA, 22 bp, Homo sapiens
gctttatccgcttgacccttac

SEQ ID NO: 7057371 - DNA, 22 bp, Homo sapiens
gctttggatgtgtgcctgaggt

SEQ ID NO: 7057372 - DNA, 22 bp, Homo sapiens
gctttactgagatgacacaggg

SEQ ID NO: 7057373 - DNA, 22 bp, Homo sapiens
gctttactgtctggaaagtttg

SEQ ID NO: 7057374 - DNA, 22 bp, Homo sapiens
gctttatagccctattacatga

SEQ ID NO: 7057375 - DNA, 22 bp, Homo sapiens
gctgtagatggactggcatcca

SEQ ID NO: 7057376 - DNA, 22 bp, Homo sapiens
gctgtaggtaaggatggcaaag

SEQ ID NO: 7057377 - DNA, 17 bp, Homo sapiens
gctgtagtttgataaga

SEQ ID NO: 7057378 - DNA, 22 bp, Homo sapiens
gctgtatgtgaggccacagtga

SEQ ID NO: 7057379 - DNA, 22 bp, Homo sapiens
gctgtattcctgcactgtatag

SEQ ID NO: 7057380 - DNA, 22 bp, Homo sapiens
gctgtattcctgcactgtatag

SEQ ID NO: 7057381 - DNA, 22 bp, Homo sapiens
gctgtattggaacacatccatg

SEQ ID NO: 7057382 - DNA, 22 bp, Homo sapiens
gctgtatttaacaactggctca

SEQ ID NO: 7057383 - DNA, 22 bp, Homo sapiens
gctgtatttatatgaaggcatg

SEQ ID NO: 7057384 - DNA, 22 bp, Homo sapiens
gctgtatttattttctagggtt

SEQ ID NO: 7057385 - DNA, 22 bp, Homo sapiens
gctgtcagcgcccaaggagctc

SEQ ID NO: 7057386 - DNA, 22 bp, Homo sapiens
gctgtcagtgaggtgagacatg

SEQ ID NO: 7057387 - DNA, 22 bp, Homo sapiens
gctgtctgctgtgcactgagca

SEQ ID NO: 7057388 - DNA, 22 bp, Homo sapiens
gctgtctgctgtgcactgagca

SEQ ID NO: 7057389 - DNA, 22 bp, Homo sapiens
gctgtctggcatggcgtggctg

SEQ ID NO: 7057390 - DNA, 22 bp, Homo sapiens
gctgtctgtggtgtcagctgac

SEQ ID NO: 7057391 - DNA, 22 bp, Homo sapiens
ggaaaaatagagtatactttaa

SEQ ID NO: 7057392 - DNA, 22 bp, Homo sapiens
ggaaaaatgacacatatctcaa

SEQ ID NO: 7057393 - DNA, 20 bp, Homo sapiens
ggaaaaatgcatgctcaaga

SEQ ID NO: 7057394 - DNA, 19 bp, Homo sapiens
ggaaggagagaaatgcatg

SEQ ID NO: 7057395 - DNA, 22 bp, Homo sapiens
ggaaggagcatttgccagttta

SEQ ID NO: 7057396 - DNA, 22 bp, Homo sapiens
ggaaggaggatgctctggcctt

SEQ ID NO: 7057397 - DNA, 22 bp, Homo sapiens
ggaaggaggggcaaagcagttc

SEQ ID NO: 7057398 - DNA, 22 bp, Homo sapiens
ggaaggaggggcaaagcagttc

SEQ ID NO: 7057399 - DNA, 18 bp, Homo sapiens
ggaaggagtggaccccag

SEQ ID NO: 7057400 - DNA, 22 bp, Homo sapiens
ggacaggatgctgaagatgaag

SEQ ID NO: 7057401 - DNA, 22 bp, Homo sapiens
ggacaggatgctgaagatgaag

SEQ ID NO: 7057402 - DNA, 22 bp, Homo sapiens
ggacagagggttgacagagtat

SEQ ID NO: 7057403 - DNA, 18 bp, Homo sapiens
ggacaggagacatgggtg

SEQ ID NO: 7057404 - DNA, 22 bp, Homo sapiens
ggacaggagtgaggcgggttcc

SEQ ID NO: 7057405 - DNA, 22 bp, Homo sapiens
ggacaggataagagacactgcc

SEQ ID NO: 7057406 - DNA, 22 bp, Homo sapiens
ggaagggaaaattcattcggct

SEQ ID NO: 7057407 - DNA, 22 bp, Homo sapiens
ggacagagggttgacagagtat

SEQ ID NO: 7057408 - DNA, 19 bp, Homo sapiens
ggaaggcagaggggctgtg

SEQ ID NO: 7057409 - DNA, 22 bp, Homo sapiens
ggaaggcagtgaaggggctgat

SEQ ID NO: 7057410 - DNA, 22 bp, Homo sapiens
ggagaaagctgtagtggaatgt

SEQ ID NO: 7057411 - DNA, 22 bp, Homo sapiens
ggactgggaatcagggagatgc

SEQ ID NO: 7057412 - DNA, 22 bp, Homo sapiens
ggactgggaatcagggagatgc

SEQ ID NO: 7057413 - DNA, 22 bp, Homo sapiens
ggactgggtcactaagatagta

SEQ ID NO: 7057414 - DNA, 22 bp, Homo sapiens
ggacaggggcgtggggattgtt

SEQ ID NO: 7057415 - DNA, 19 bp, Homo sapiens
ggacagggggagcttttat

SEQ ID NO: 7057416 - DNA, 22 bp, Homo sapiens
ggacagggctcttggcactcct

SEQ ID NO: 7057417 - DNA, 23 bp, Homo sapiens
ggacagggccctgccctatggcc

SEQ ID NO: 7057418 - DNA, 22 bp, Homo sapiens
ggacagggatcattatctgagc

SEQ ID NO: 7057419 - DNA, 22 bp, Homo sapiens
ggacaggccctctggtcagctt

SEQ ID NO: 7057420 - DNA, 22 bp, Homo sapiens
ggacaggccgcctcggtggggg

SEQ ID NO: 7057421 - DNA, 22 bp, Homo sapiens
ggacaggcctggcacagtactg

SEQ ID NO: 7057422 - DNA, 22 bp, Homo sapiens
ggacaggctgcatctgagcatg

SEQ ID NO: 7057423 - DNA, 22 bp, Homo sapiens
ggagccagtatttagtggtctt

SEQ ID NO: 7057424 - DNA, 22 bp, Homo sapiens
ggagaagcagcttcttgatgaa

SEQ ID NO: 7057425 - DNA, 22 bp, Homo sapiens
ggagaagcagcttcttgatgaa

SEQ ID NO: 7057426 - DNA, 22 bp, Homo sapiens
ggagaagcaggtgctttgggtc

SEQ ID NO: 7057427 - DNA, 17 bp, Homo sapiens
ggagccaggagcccacc

SEQ ID NO: 7057428 - DNA, 22 bp, Homo sapiens
ggagcccaagtctgcactcggc

SEQ ID NO: 7057429 - DNA, 18 bp, Homo sapiens
ggagcccagaggacagga

SEQ ID NO: 7057430 - DNA, 18 bp, Homo sapiens
ggagcccagaggacagga

SEQ ID NO: 7057431 - DNA, 18 bp, Homo sapiens
ggagcccagaggtgagtt

SEQ ID NO: 7057432 - DNA, 18 bp, Homo sapiens
ggagcccagaggtgagtt

SEQ ID NO: 7057433 - DNA, 22 bp, Homo sapiens
ggagctggctacagagaactcc

SEQ ID NO: 7057434 - DNA, 20 bp, Homo sapiens
ggagctgccctgggctggag

SEQ ID NO: 7057435 - DNA, 22 bp, Homo sapiens
ggagctgcatttagggagcctt

SEQ ID NO: 7057436 - DNA, 22 bp, Homo sapiens
ggagctgtgcagtgactacaga

SEQ ID NO: 7057437 - DNA, 22 bp, Homo sapiens
ggagctgttcaggactgcttca

SEQ ID NO: 7057438 - DNA, 22 bp, Homo sapiens
ggagctgttggcagctatcttg

SEQ ID NO: 7057439 - DNA, 19 bp, Homo sapiens
ggagcttggtggctgtggc

SEQ ID NO: 7057440 - DNA, 22 bp, Homo sapiens
ggaggaggggtgactgaatgct

SEQ ID NO: 7057441 - DNA, 22 bp, Homo sapiens
ggaggaggggtgactgaatgct

SEQ ID NO: 7057442 - DNA, 22 bp, Homo sapiens
gagtagaactggttatctaata

SEQ ID NO: 7057443 - DNA, 22 bp, Homo sapiens
gagtagacattaaattacactg

SEQ ID NO: 7057444 - DNA, 22 bp, Homo sapiens
gagtagggatgctggtgactcc

SEQ ID NO: 7057445 - DNA, 22 bp, Homo sapiens
gagtagggtttccaggttagag

SEQ ID NO: 7057446 - DNA, 17 bp, Homo sapiens
gagtagttacaacagac

SEQ ID NO: 7057447 - DNA, 22 bp, Homo sapiens
gagtcaacaagtcagatctcac

SEQ ID NO: 7057448 - DNA, 22 bp, Homo sapiens
gagtcacaaaagatgcccaggg

SEQ ID NO: 7057449 - DNA, 22 bp, Homo sapiens
gcaaggaagcagagttgctatc

SEQ ID NO: 7057450 - DNA, 17 bp, Homo sapiens
gcaaggaagttctttgc

SEQ ID NO: 7057451 - DNA, 21 bp, Homo sapiens
gcaaggcaatgccatgatttc

SEQ ID NO: 7057452 - DNA, 20 bp, Homo sapiens
gcaaggcacagtgaggaggg

SEQ ID NO: 7057453 - DNA, 20 bp, Homo sapiens
gcaaggcacagtgaggaggg

SEQ ID NO: 7057454 - DNA, 22 bp, Homo sapiens
gcaaggcagcatccttttgagg

SEQ ID NO: 7057455 - DNA, 22 bp, Homo sapiens
gcaaggcagcgcggagtagcta

SEQ ID NO: 7057456 - DNA, 22 bp, Homo sapiens
gcaaggcctgaggtgggtgctc

SEQ ID NO: 7057457 - DNA, 18 bp, Homo sapiens
gcaaggctcaggccaggc

SEQ ID NO: 7057458 - DNA, 22 bp, Homo sapiens
gcaataaataacatggaagaca

SEQ ID NO: 7057459 - DNA, 22 bp, Homo sapiens
gcaatacagtaggtttattggt

SEQ ID NO: 7057460 - DNA, 22 bp, Homo sapiens
gcaatactaagtgacttttggg

SEQ ID NO: 7057461 - DNA, 22 bp, Homo sapiens
gcaatactcaacacttttgctt

SEQ ID NO: 7057462 - DNA, 22 bp, Homo sapiens
gcaatactgagattattgtact

SEQ ID NO: 7057463 - DNA, 22 bp, Homo sapiens
gcacagagagcagtgggggaca

SEQ ID NO: 7057464 - DNA, 22 bp, Homo sapiens
gcacagagagcagtgggggaca

SEQ ID NO: 7057465 - DNA, 22 bp, Homo sapiens
gcacagagagtcccgggtgccc

SEQ ID NO: 7057466 - DNA, 22 bp, Homo sapiens
gcacagaggtggaggacaaata

SEQ ID NO: 7057467 - DNA, 22 bp, Homo sapiens
gcacagcacagcaacatgtttt

SEQ ID NO: 7057468 - DNA, 22 bp, Homo sapiens
gcacatggacaatggaggtgca

SEQ ID NO: 7057469 - DNA, 22 bp, Homo sapiens
gcacatggtaggcatttgatgt

SEQ ID NO: 7057470 - DNA, 22 bp, Homo sapiens
gcacatgtcttattcactgtta

SEQ ID NO: 7057471 - DNA, 22 bp, Homo sapiens
gcacatgtgagagtagaggcct

SEQ ID NO: 7057472 - DNA, 22 bp, Homo sapiens
gcagcaagaataatttgggtag

SEQ ID NO: 7057473 - DNA, 22 bp, Homo sapiens
gcagagtgagatatgaacccag

SEQ ID NO: 7057474 - DNA, 22 bp, Homo sapiens
gcagagtgagatatgaacccag

SEQ ID NO: 7057475 - DNA, 22 bp, Homo sapiens
gcagagtgagccgaggctgctc

SEQ ID NO: 7057476 - DNA, 22 bp, Homo sapiens
gcagagtgaggaagagcttcca

SEQ ID NO: 7057477 - DNA, 22 bp, Homo sapiens
gcagagtgccgagatggaagcg

SEQ ID NO: 7057478 - DNA, 18 bp, Homo sapiens
gcagagtgcgtctctgtg

SEQ ID NO: 7057479 - DNA, 22 bp, Homo sapiens
gcagagtgctgtcgtacgcccc

SEQ ID NO: 7057480 - DNA, 22 bp, Homo sapiens
gcagaggtgagtttctcagctg

SEQ ID NO: 7057481 - DNA, 22 bp, Homo sapiens
gcagacagggctacagaggtac

SEQ ID NO: 7057482 - DNA, 22 bp, Homo sapiens
gcagacagggctacagaggtac

SEQ ID NO: 7057483 - DNA, 22 bp, Homo sapiens
gcagaggtgctcagtggcagaa

SEQ ID NO: 7057484 - DNA, 22 bp, Homo sapiens
gcagaggtggatgcaattgggg

SEQ ID NO: 7057485 - DNA, 22 bp, Homo sapiens
gcagaggtggcatctgggctct

SEQ ID NO: 7057486 - DNA, 22 bp, Homo sapiens
gcagaggtggcatctgggctct

SEQ ID NO: 7057487 - DNA, 22 bp, Homo sapiens
gcagaggtgtcaccttccagga

SEQ ID NO: 7057488 - DNA, 22 bp, Homo sapiens
gcagaggtgtagccccctccat

SEQ ID NO: 7057489 - DNA, 22 bp, Homo sapiens
gcagaggtgtcaccttccagga

SEQ ID NO: 7057490 - DNA, 22 bp, Homo sapiens
gcagaggtgtgggaggggccac

SEQ ID NO: 7057491 - DNA, 23 bp, Homo sapiens
gcagaggttatgttttttaggct

SEQ ID NO: 7057492 - DNA, 22 bp, Homo sapiens
gcagaggttggattggtgactt

SEQ ID NO: 7057493 - DNA, 23 bp, Homo sapiens
gcagaggtttttcagtatggttt

SEQ ID NO: 7057494 - DNA, 23 bp, Homo sapiens
gcagaggtttttcagtatggttt

SEQ ID NO: 7057495 - DNA, 22 bp, Homo sapiens
gcagagtgaagcagtatggaaa

SEQ ID NO: 7057496 - DNA, 22 bp, Homo sapiens
gcaccagcctgagcctcttgca

SEQ ID NO: 7057497 - DNA, 22 bp, Homo sapiens
gcaccaggaggcccttctcatc

SEQ ID NO: 7057498 - DNA, 22 bp, Homo sapiens
gcacccagaggtcagcagtgct

SEQ ID NO: 7057499 - DNA, 22 bp, Homo sapiens
gcagaaggatccgcaggtgcaa

SEQ ID NO: 7057500 - DNA, 22 bp, Homo sapiens
gcagaagggaataaggagcttt

SEQ ID NO: 7057501 - DNA, 23 bp, Homo sapiens
gcagacagagcagactaagacaa

SEQ ID NO: 7057502 - DNA, 22 bp, Homo sapiens
gcagacagatgagggtgctggg

SEQ ID NO: 7057503 - DNA, 22 bp, Homo sapiens
gcagacagatgagggtgctggg

SEQ ID NO: 7057504 - DNA, 22 bp, Homo sapiens
gcagacagcatgttgggctatt

SEQ ID NO: 7057505 - DNA, 22 bp, Homo sapiens
gcagacagccagactgcactgg

SEQ ID NO: 7057506 - DNA, 22 bp, Homo sapiens
gcagacaggcccagtggaggga

SEQ ID NO: 7057507 - DNA, 22 bp, Homo sapiens
gcagacaggcccagtggaggga

SEQ ID NO: 7057508 - DNA, 17 bp, Homo sapiens
gcagccagtgcagcagg

SEQ ID NO: 7057509 - DNA, 22 bp, Homo sapiens
gcagccaggaagcccaggacac

SEQ ID NO: 7057510 - DNA, 17 bp, Homo sapiens
gcagccagtgcagcagg

SEQ ID NO: 7057511 - DNA, 22 bp, Homo sapiens
gcagctggctcagagaggtggg

SEQ ID NO: 7057512 - DNA, 22 bp, Homo sapiens
gcagctgggccccagcctctcc

SEQ ID NO: 7057513 - DNA, 22 bp, Homo sapiens
gcagctggtctggcctagagta

SEQ ID NO: 7057514 - DNA, 23 bp, Homo sapiens
gcagctggttagaagggaaggag

SEQ ID NO: 7057515 - DNA, 23 bp, Homo sapiens
gcagctggttagaagggaaggag

SEQ ID NO: 7057516 - DNA, 22 bp, Homo sapiens
gcagcaagaggtttctgttgac

SEQ ID NO: 7057517 - DNA, 22 bp, Homo sapiens
gcagcaagtctagtttgtaggc

SEQ ID NO: 7057518 - DNA, 22 bp, Homo sapiens
gcagcaatcttcacagtgtcat

SEQ ID NO: 7057519 - DNA, 22 bp, Homo sapiens
gcagcacaaagtccccagggac

SEQ ID NO: 7057520 - DNA, 22 bp, Homo sapiens
gcagcacacggtggtgccctgg

SEQ ID NO: 7057521 - DNA, 22 bp, Homo sapiens
gcagcacatataaacaaagaga

SEQ ID NO: 7057522 - DNA, 22 bp, Homo sapiens
gcagcagaaggccaaggggagc

SEQ ID NO: 7057523 - DNA, 22 bp, Homo sapiens
gcagcagaaggccaaggggagc

SEQ ID NO: 7057524 - DNA, 22 bp, Homo sapiens
gcagcagaagtagaagtacagg

SEQ ID NO: 7057525 - DNA, 22 bp, Homo sapiens
gcagccaccctcaaggctgaat

SEQ ID NO: 7057526 - DNA, 22 bp, Homo sapiens
gcagccaccctcaaggctgaat

SEQ ID NO: 7057527 - DNA, 22 bp, Homo sapiens
gcagccagcccctctgacctct

SEQ ID NO: 7057528 - DNA, 22 bp, Homo sapiens
gcagccaggaaagctggaccct

SEQ ID NO: 7057529 - DNA, 19 bp, Homo sapiens
gcaggccaggaggcggagg

SEQ ID NO: 7057530 - DNA, 18 bp, Homo sapiens
gcaggccctgtttctggg

SEQ ID NO: 7057531 - DNA, 22 bp, Homo sapiens
gcaggcccttagccttggtggg

SEQ ID NO: 7057532 - DNA, 22 bp, Homo sapiens
gcagggcagctcactgtggttc

SEQ ID NO: 7057533 - DNA, 22 bp, Homo sapiens
gcagggcagctgaagctaggtg

SEQ ID NO: 7057534 - DNA, 22 bp, Homo sapiens
gcagggcagcttagtccctgtc

SEQ ID NO: 7057535 - DNA, 19 bp, Homo sapiens
gcagggtgttgactgtccc

SEQ ID NO: 7057536 - DNA, 22 bp, Homo sapiens
gcagggccagtgcagagaggaa

SEQ ID NO: 7057537 - DNA, 22 bp, Homo sapiens
gcagggcagtaagagctagagt

SEQ ID NO: 7057538 - DNA, 19 bp, Homo sapiens
gcaggtgagccgtggctcc

SEQ ID NO: 7057539 - DNA, 22 bp, Homo sapiens
gcaggtgatgtgatgtgagcat

SEQ ID NO: 7057540 - DNA, 22 bp, Homo sapiens
gcaggtgaatgatggactagga

SEQ ID NO: 7057541 - DNA, 22 bp, Homo sapiens
gcaggtgaatgatggactagga

SEQ ID NO: 7057542 - DNA, 22 bp, Homo sapiens
gcaggtgaatgatggactagga

SEQ ID NO: 7057543 - DNA, 22 bp, Homo sapiens
gcaggtagtgatcgagggtgac

SEQ ID NO: 7057544 - DNA, 19 bp, Homo sapiens
gcaggtcattaggctaggt

SEQ ID NO: 7057545 - DNA, 19 bp, Homo sapiens
gcaggtcattaggctaggt

SEQ ID NO: 7057546 - DNA, 22 bp, Homo sapiens
gcccaagccgccttccagagac

SEQ ID NO: 7057547 - DNA, 22 bp, Homo sapiens
gcccaagggcatcaagttctac

SEQ ID NO: 7057548 - DNA, 22 bp, Homo sapiens
gcccaaggtatatcagagacag

SEQ ID NO: 7057549 - DNA, 20 bp, Homo sapiens
gcccaaggtccagaaggggg

SEQ ID NO: 7057550 - DNA, 20 bp, Homo sapiens
gcccaaggtccagaaggggg

SEQ ID NO: 7057551 - DNA, 22 bp, Homo sapiens
gccaggctctcagtgactgccc

SEQ ID NO: 7057552 - DNA, 21 bp, Homo sapiens
gccatttcacacagacatttg

SEQ ID NO: 7057553 - DNA, 22 bp, Homo sapiens
gccattttctgtcttgtttatt

SEQ ID NO: 7057554 - DNA, 22 bp, Homo sapiens
gccaggcatgtcctctgcagaa

SEQ ID NO: 7057555 - DNA, 22 bp, Homo sapiens
gccaggcattattccgatccct

SEQ ID NO: 7057556 - DNA, 22 bp, Homo sapiens
gccaggctaagaaaggtgtgat

SEQ ID NO: 7057557 - DNA, 22 bp, Homo sapiens
gccaggctaagaaaggtgtgat

SEQ ID NO: 7057558 - DNA, 22 bp, Homo sapiens
gccaggctcagcagtcaacctg

SEQ ID NO: 7057559 - DNA, 22 bp, Homo sapiens
gccaggctcagtagcgattcct

SEQ ID NO: 7057560 - DNA, 22 bp, Homo sapiens
gccaggctccaggccctcctga

SEQ ID NO: 7057561 - DNA, 22 bp, Homo sapiens
gccaggctccaggccctcctga

SEQ ID NO: 7057562 - DNA, 22 bp, Homo sapiens
gccaggctccaggccctcctga

SEQ ID NO: 7057563 - DNA, 19 bp, Homo sapiens
gccaggctccatagccggc

SEQ ID NO: 7057564 - DNA, 19 bp, Homo sapiens
gccaggctccatagccggc

SEQ ID NO: 7057565 - DNA, 22 bp, Homo sapiens
gccaggctccccggatccctgg

SEQ ID NO: 7057566 - DNA, 22 bp, Homo sapiens
gccaggctccccggatccctgg

SEQ ID NO: 7057567 - DNA, 22 bp, Homo sapiens
gccaggctccccggatccctgg

SEQ ID NO: 7057568 - DNA, 23 bp, Homo sapiens
gccaggctccggtctgtggccac

SEQ ID NO: 7057569 - DNA, 23 bp, Homo sapiens
gccaggctccggtctgtggccac

SEQ ID NO: 7057570 - DNA, 22 bp, Homo sapiens
gccagctgtgcttttcctaaaa

SEQ ID NO: 7057571 - DNA, 22 bp, Homo sapiens
gccaggaaattcatgccagatc

SEQ ID NO: 7057572 - DNA, 22 bp, Homo sapiens
gccagaaggggtggatccaggc

SEQ ID NO: 7057573 - DNA, 22 bp, Homo sapiens
gccagaagactggagtcagctg

SEQ ID NO: 7057574 - DNA, 22 bp, Homo sapiens
gccagctggtaggcacctagcc

SEQ ID NO: 7057575 - DNA, 22 bp, Homo sapiens
gcatttagctttaaaatatttc

SEQ ID NO: 7057576 - DNA, 22 bp, Homo sapiens
gccacctctctcttgactcgag

SEQ ID NO: 7057577 - DNA, 22 bp, Homo sapiens
gccacctggacagctgtgccct

SEQ ID NO: 7057578 - DNA, 22 bp, Homo sapiens
gccacctggactcagagccagg

SEQ ID NO: 7057579 - DNA, 22 bp, Homo sapiens
gccacctgtttcgcttgcccag

SEQ ID NO: 7057580 - DNA, 22 bp, Homo sapiens
gccaccttccaaaataatcaca

SEQ ID NO: 7057581 - DNA, 20 bp, Homo sapiens
gccactgtgcttacactgct

SEQ ID NO: 7057582 - DNA, 22 bp, Homo sapiens
gccactgttgctcctcaggaaa

SEQ ID NO: 7057583 - DNA, 22 bp, Homo sapiens
gcagttttattatgatggaaat

SEQ ID NO: 7057584 - DNA, 22 bp, Homo sapiens
gcagttttagagctttaagatg

SEQ ID NO: 7057585 - DNA, 22 bp, Homo sapiens
gcaggtggaagcagcagactca

SEQ ID NO: 7057586 - DNA, 22 bp, Homo sapiens
gcaggtgattcaccctgggcct

SEQ ID NO: 7057587 - DNA, 18 bp, Homo sapiens
gcaggtgccactgctgtt

SEQ ID NO: 7057588 - DNA, 17 bp, Homo sapiens
gcagttaaattaagatg

SEQ ID NO: 7057589 - DNA, 22 bp, Homo sapiens
gcagtttactgtcaataactct

SEQ ID NO: 7057590 - DNA, 22 bp, Homo sapiens
gcctggagagcactgtgcgctt

SEQ ID NO: 7057591 - DNA, 22 bp, Homo sapiens
gcctggagtagcatggcaagcc

SEQ ID NO: 7057592 - DNA, 22 bp, Homo sapiens
gcctgcagtgagtgcagaaggt

SEQ ID NO: 7057593 - DNA, 23 bp, Homo sapiens
gcctggagaaaagctgcagttca

SEQ ID NO: 7057594 - DNA, 19 bp, Homo sapiens
gcctgcagaaaaggcaggg

SEQ ID NO: 7057595 - DNA, 22 bp, Homo sapiens
gcctgcagaactgtgaggcaat

SEQ ID NO: 7057596 - DNA, 20 bp, Homo sapiens
gcctgcagagaaggtcagag

SEQ ID NO: 7057597 - DNA, 22 bp, Homo sapiens
gcctgcagcctcagagaatttt

SEQ ID NO: 7057598 - DNA, 22 bp, Homo sapiens
gcctccctgtttcctgctccaa

SEQ ID NO: 7057599 - DNA, 22 bp, Homo sapiens
gcctgaggaatgctcctgactt

SEQ ID NO: 7057600 - DNA, 22 bp, Homo sapiens
gcctgagggctcctagcaggct

SEQ ID NO: 7057601 - DNA, 22 bp, Homo sapiens
gccctgctctggtctctgcccg

SEQ ID NO: 7057602 - DNA, 22 bp, Homo sapiens
gccctgctcctccgtcccacga

SEQ ID NO: 7057603 - DNA, 17 bp, Homo sapiens
gccctgcctgctgccct

SEQ ID NO: 7057604 - DNA, 22 bp, Homo sapiens
gccctgctctgttggtcacctg

SEQ ID NO: 7057605 - DNA, 22 bp, Homo sapiens
gccctgctcttttgcccaccca

SEQ ID NO: 7057606 - DNA, 23 bp, Homo sapiens
gccctgctgggacctcctgctac

SEQ ID NO: 7057607 - DNA, 23 bp, Homo sapiens
gccctgctgggacctcctgctac

SEQ ID NO: 7057608 - DNA, 22 bp, Homo sapiens
gccctgctgtcttcagagtata

SEQ ID NO: 7057609 - DNA, 22 bp, Homo sapiens
gcctcagtctcccgagtagctg

SEQ ID NO: 7057610 - DNA, 22 bp, Homo sapiens
gcctcagtgatatgtgggacaa

SEQ ID NO: 7057611 - DNA, 22 bp, Homo sapiens
gcctcagttgatctgtgtgagc

SEQ ID NO: 7057612 - DNA, 22 bp, Homo sapiens
gcccctgcctttgaacctggag

SEQ ID NO: 7057613 - DNA, 22 bp, Homo sapiens
gccccaggtggtaaacctaaga

SEQ ID NO: 7057614 - DNA, 22 bp, Homo sapiens
gccccaggtggtaaacctaaga

SEQ ID NO: 7057615 - DNA, 22 bp, Homo sapiens
gcccaaggtcccatggcagcac

SEQ ID NO: 7057616 - DNA, 22 bp, Homo sapiens
gccccaggggaggtgccctgca

SEQ ID NO: 7057617 - DNA, 22 bp, Homo sapiens
gccccaggggaggtgccctgca

SEQ ID NO: 7057618 - DNA, 22 bp, Homo sapiens
gcccctgttgtggctttgtcta

SEQ ID NO: 7057619 - DNA, 22 bp, Homo sapiens
gccccttcttctggagattcaa

SEQ ID NO: 7057620 - DNA, 22 bp, Homo sapiens
gcccgcagagatctttaacaaa

SEQ ID NO: 7057621 - DNA, 22 bp, Homo sapiens
gccctcagaggacagctgactt

SEQ ID NO: 7057622 - DNA, 19 bp, Homo sapiens
gccctgagtaagctaggag

SEQ ID NO: 7057623 - DNA, 22 bp, Homo sapiens
gccctgagtgcctgtgtaagaa

SEQ ID NO: 7057624 - DNA, 22 bp, Homo sapiens
gccctgagtggtacctgtgggt

SEQ ID NO: 7057625 - DNA, 22 bp, Homo sapiens
gaatttttctggaagcaattat

SEQ ID NO: 7057626 - DNA, 22 bp, Homo sapiens
gaattttgcttttatgtcaagt

SEQ ID NO: 7057627 - DNA, 22 bp, Homo sapiens
gacaaaacacattagtttaaaa

SEQ ID NO: 7057628 - DNA, 22 bp, Homo sapiens
gacaaaactgagatcacactgt

SEQ ID NO: 7057629 - DNA, 18 bp, Homo sapiens
gacaaaagtacagacaga

SEQ ID NO: 7057630 - DNA, 22 bp, Homo sapiens
gacagcaggagatcatgataga

SEQ ID NO: 7057631 - DNA, 22 bp, Homo sapiens
gacagcaggatgtgaggggatg

SEQ ID NO: 7057632 - DNA, 22 bp, Homo sapiens
gacagcagggaaagtccagacc

SEQ ID NO: 7057633 - DNA, 22 bp, Homo sapiens
gacagcagggacatgtaggaag

SEQ ID NO: 7057634 - DNA, 22 bp, Homo sapiens
gaagaaggtgccagaggcttac

SEQ ID NO: 7057635 - DNA, 22 bp, Homo sapiens
gaagaaggtgctacacagggca

SEQ ID NO: 7057636 - DNA, 22 bp, Homo sapiens
gaagaaggtggcccaggggtag

SEQ ID NO: 7057637 - DNA, 22 bp, Homo sapiens
gaagaagtatttttgtcctgtt

SEQ ID NO: 7057638 - DNA, 22 bp, Homo sapiens
gaagaatctgaggacagtcatt

SEQ ID NO: 7057639 - DNA, 22 bp, Homo sapiens
gaatgcaaagctctctatgtta

SEQ ID NO: 7057640 - DNA, 19 bp, Homo sapiens
gaatgcagaagagagtgga

SEQ ID NO: 7057641 - DNA, 22 bp, Homo sapiens
gaatgcagatggctggtgtatg

SEQ ID NO: 7057642 - DNA, 22 bp, Homo sapiens
gaatgcatgtgaagcaaagaat

SEQ ID NO: 7057643 - DNA, 22 bp, Homo sapiens
gaatgctaagcatgtgggagtt

SEQ ID NO: 7057644 - DNA, 22 bp, Homo sapiens
gaatgctggcttacaggcagtt

SEQ ID NO: 7057645 - DNA, 22 bp, Homo sapiens
gaatgtaaaattgcctacaaga

SEQ ID NO: 7057646 - DNA, 22 bp, Homo sapiens
gaattacaaagtgagacaagct

SEQ ID NO: 7057647 - DNA, 22 bp, Homo sapiens
gaattacagccagaagaatgaa

SEQ ID NO: 7057648 - DNA, 22 bp, Homo sapiens
gacagcagggacatgtaggaag

SEQ ID NO: 7057649 - DNA, 22 bp, Homo sapiens
gacagcaggtaattagttaaca

SEQ ID NO: 7057650 - DNA, 22 bp, Homo sapiens
gacagcagtcctggagttccca

SEQ ID NO: 7057651 - DNA, 22 bp, Homo sapiens
gacagctgcatcctcagacaca

SEQ ID NO: 7057652 - DNA, 22 bp, Homo sapiens
gacagctgctcccgtttctgct

SEQ ID NO: 7057653 - DNA, 22 bp, Homo sapiens
gacagctggcagtggaaaggtg

SEQ ID NO: 7057654 - DNA, 17 bp, Homo sapiens
gacagctggttcctggc

SEQ ID NO: 7057655 - DNA, 17 bp, Homo sapiens
gacagctggttcctggc

SEQ ID NO: 7057656 - DNA, 22 bp, Homo sapiens
gacagctgtacactcctggtta

SEQ ID NO: 7057657 - DNA, 22 bp, Homo sapiens
gacagctgtacactcctggtta

SEQ ID NO: 7057658 - DNA, 18 bp, Homo sapiens
gacagctgtcctgagccc

SEQ ID NO: 7057659 - DNA, 22 bp, Homo sapiens
gacagtctgggcacacatgaaa

SEQ ID NO: 7057660 - DNA, 19 bp, Homo sapiens
gacagtgcagttgtagtac

SEQ ID NO: 7057661 - DNA, 22 bp, Homo sapiens
gacagtgcatttcctggcatgg

SEQ ID NO: 7057662 - DNA, 22 bp, Homo sapiens
gacatgcaatgcagtggtaagt

SEQ ID NO: 7057663 - DNA, 22 bp, Homo sapiens
gacatgcatgaatgcaggtctc

SEQ ID NO: 7057664 - DNA, 20 bp, Homo sapiens
gacatgtctttctcacacaa

SEQ ID NO: 7057665 - DNA, 22 bp, Homo sapiens
gacctggactgagttagatggc

SEQ ID NO: 7057666 - DNA, 22 bp, Homo sapiens
gaccttcttgctgtgtcctaac

SEQ ID NO: 7057667 - DNA, 22 bp, Homo sapiens
gaccttcttgctgtgtcctaac

SEQ ID NO: 7057668 - DNA, 22 bp, Homo sapiens
gactacaggtgtgtgccaccat

SEQ ID NO: 7057669 - DNA, 22 bp, Homo sapiens
gactatttatttacagaaagct

SEQ ID NO: 7057670 - DNA, 22 bp, Homo sapiens
gagagaagggggatatgagcct

SEQ ID NO: 7057671 - DNA, 22 bp, Homo sapiens
gagagaagggggatatgagcct

SEQ ID NO: 7057672 - DNA, 22 bp, Homo sapiens
gagagaagaatgttccgaggcc

SEQ ID NO: 7057673 - DNA, 22 bp, Homo sapiens
gagaaggactacacatctggcc

SEQ ID NO: 7057674 - DNA, 22 bp, Homo sapiens
gagaagcaatcagcagccaccc

SEQ ID NO: 7057675 - DNA, 22 bp, Homo sapiens
gagaagcaatcagtggccaccc

SEQ ID NO: 7057676 - DNA, 22 bp, Homo sapiens
gagaagcaatcgtgacatctcc

SEQ ID NO: 7057677 - DNA, 22 bp, Homo sapiens
gagaagcaatcgtgacatctcc

SEQ ID NO: 7057678 - DNA, 22 bp, Homo sapiens
gagaagcaatttccaactgtgc

SEQ ID NO: 7057679 - DNA, 22 bp, Homo sapiens
gagaagcaggtttagcagacaa

SEQ ID NO: 7057680 - DNA, 22 bp, Homo sapiens
gagaagcaggtttagcagacaa

SEQ ID NO: 7057681 - DNA, 22 bp, Homo sapiens
gagaagccgagtcagctgagcc

SEQ ID NO: 7057682 - DNA, 19 bp, Homo sapiens
gactcacaccttccgctgt

SEQ ID NO: 7057683 - DNA, 22 bp, Homo sapiens
gactcagagatccctggaggtc

SEQ ID NO: 7057684 - DNA, 22 bp, Homo sapiens
gactcagatttagagggtaaga

SEQ ID NO: 7057685 - DNA, 22 bp, Homo sapiens
gagaaagggataatttgaagag

SEQ ID NO: 7057686 - DNA, 22 bp, Homo sapiens
gagaacaggctctggagtcaga

SEQ ID NO: 7057687 - DNA, 22 bp, Homo sapiens
gagaacctctccacaagtctgg

SEQ ID NO: 7057688 - DNA, 22 bp, Homo sapiens
gagaactcagacgcaggtcatg

SEQ ID NO: 7057689 - DNA, 16 bp, Homo sapiens
gagaagagcccggcag

SEQ ID NO: 7057690 - DNA, 18 bp, Homo sapiens
gagagcccagcaggtggt

SEQ ID NO: 7057691 - DNA, 18 bp, Homo sapiens
gagagcccagcaggtggt

SEQ ID NO: 7057692 - DNA, 22 bp, Homo sapiens
gagagacagcagaacgtgcagc

SEQ ID NO: 7057693 - DNA, 22 bp, Homo sapiens
gagagaatgtacatgctagggg

SEQ ID NO: 7057694 - DNA, 22 bp, Homo sapiens
gagagacagcacacagtgtggg

SEQ ID NO: 7057695 - DNA, 18 bp, Homo sapiens
gagaggagccagaatttt

SEQ ID NO: 7057696 - DNA, 22 bp, Homo sapiens
gagaggagacttatccagattg

SEQ ID NO: 7057697 - DNA, 22 bp, Homo sapiens
gagagccctcactccttccctg

SEQ ID NO: 7057698 - DNA, 22 bp, Homo sapiens
gagagctgtccggctgagcagc

SEQ ID NO: 7057699 - DNA, 22 bp, Homo sapiens
gagaggagaagcctgcgcttca

SEQ ID NO: 7057700 - DNA, 22 bp, Homo sapiens
gagaggagtagacactttggtt

SEQ ID NO: 7057701 - DNA, 22 bp, Homo sapiens
gagaggaggtggctatgacagc

SEQ ID NO: 7057702 - DNA, 22 bp, Homo sapiens
gagaggaggtggctatgacagc

SEQ ID NO: 7057703 - DNA, 22 bp, Homo sapiens
gagaggagtaggctgatggtgc

SEQ ID NO: 7057704 - DNA, 22 bp, Homo sapiens
gagaggagtaggctgatggtgc

SEQ ID NO: 7057705 - DNA, 17 bp, Homo sapiens
gagattttcgtcctgaa

SEQ ID NO: 7057706 - DNA, 22 bp, Homo sapiens
gagattttcagcttgactggga

SEQ ID NO: 7057707 - DNA, 22 bp, Homo sapiens
gagattttcagcttgactggga

SEQ ID NO: 7057708 - DNA, 22 bp, Homo sapiens
gagaggatccacaaaccaggaa

SEQ ID NO: 7057709 - DNA, 22 bp, Homo sapiens
gagaggcagaggcctgaaaccg

SEQ ID NO: 7057710 - DNA, 22 bp, Homo sapiens
gagcaaaataaattctgacaaa

SEQ ID NO: 7057711 - DNA, 22 bp, Homo sapiens
gagcaacagtttatggtttttc

SEQ ID NO: 7057712 - DNA, 22 bp, Homo sapiens
gagcacagaactaaatgctggt

SEQ ID NO: 7057713 - DNA, 22 bp, Homo sapiens
gagcacagatcctggagccaca

SEQ ID NO: 7057714 - DNA, 22 bp, Homo sapiens
gagcaaggtagctctctggggc

SEQ ID NO: 7057715 - DNA, 22 bp, Homo sapiens
gagcaggacgtgggaatgggaa

SEQ ID NO: 7057716 - DNA, 22 bp, Homo sapiens
gagcagagaatccagctaagtg

SEQ ID NO: 7057717 - DNA, 22 bp, Homo sapiens
gagcagagacagtacaactggc

SEQ ID NO: 7057718 - DNA, 23 bp, Homo sapiens
gagcagagcgggcgggggtcctg

SEQ ID NO: 7057719 - DNA, 18 bp, Homo sapiens
gagcagaggagggttttt

SEQ ID NO: 7057720 - DNA, 18 bp, Homo sapiens
gagcagaggctcaactgg

SEQ ID NO: 7057721 - DNA, 22 bp, Homo sapiens
gagcacctcaatttgctatttg

SEQ ID NO: 7057722 - DNA, 22 bp, Homo sapiens
gaggcgggcagatcacctgagg

SEQ ID NO: 7057723 - DNA, 22 bp, Homo sapiens
gaggctggtaggaaaggaaaca

SEQ ID NO: 7057724 - DNA, 22 bp, Homo sapiens
gaggctggggtctgcctttctg

SEQ ID NO: 7057725 - DNA, 22 bp, Homo sapiens
gaggctggtaggaaaggaaaca

SEQ ID NO: 7057726 - DNA, 22 bp, Homo sapiens
gaggctggtaggaaaggaaaca

SEQ ID NO: 7057727 - DNA, 22 bp, Homo sapiens
gaggctggtcagccctaagatc

SEQ ID NO: 7057728 - DNA, 22 bp, Homo sapiens
gaggctggtcagccctaagatc

SEQ ID NO: 7057729 - DNA, 22 bp, Homo sapiens
gaggctggtggttagttccatt

SEQ ID NO: 7057730 - DNA, 22 bp, Homo sapiens
gaggctggtggttagttccatt

SEQ ID NO: 7057731 - DNA, 22 bp, Homo sapiens
gaggctggtggttagttccatt

SEQ ID NO: 7057732 - DNA, 22 bp, Homo sapiens
gaggctggttcccttgatcttt

SEQ ID NO: 7057733 - DNA, 22 bp, Homo sapiens
gaggctggttcccttgatcttt

SEQ ID NO: 7057734 - DNA, 22 bp, Homo sapiens
gaggctggttcccttgatcttt

SEQ ID NO: 7057735 - DNA, 22 bp, Homo sapiens
gaggctggttctgaagtactgt

SEQ ID NO: 7057736 - DNA, 22 bp, Homo sapiens
gaggctggttctgaagtactgt

SEQ ID NO: 7057737 - DNA, 22 bp, Homo sapiens
gaggctggttctgaagtactgt

SEQ ID NO: 7057738 - DNA, 22 bp, Homo sapiens
gaggctggtttgccttttggca

SEQ ID NO: 7057739 - DNA, 22 bp, Homo sapiens
gaggcctggtctatgagatgtt

SEQ ID NO: 7057740 - DNA, 22 bp, Homo sapiens
gaggcctggtttgcatgagaat

SEQ ID NO: 7057741 - DNA, 22 bp, Homo sapiens
gaggcctgtcgctaggcctctg

SEQ ID NO: 7057742 - DNA, 22 bp, Homo sapiens
gaggccttgggatgtgccacgg

SEQ ID NO: 7057743 - DNA, 19 bp, Homo sapiens
gaggcgaggcgtgcaggag

SEQ ID NO: 7057744 - DNA, 22 bp, Homo sapiens
gagggaatggtgtgcaagaggt

SEQ ID NO: 7057745 - DNA, 22 bp, Homo sapiens
gagggagaaggactatcaggct

SEQ ID NO: 7057746 - DNA, 22 bp, Homo sapiens
gagggccacgttcagggctctc

SEQ ID NO: 7057747 - DNA, 22 bp, Homo sapiens
gagggagaattgcagccagcgt

SEQ ID NO: 7057748 - DNA, 22 bp, Homo sapiens
gaggctggtttgccttttggca

SEQ ID NO: 7057749 - DNA, 22 bp, Homo sapiens
gaggctgtaagtgtggagccta

SEQ ID NO: 7057750 - DNA, 21 bp, Homo sapiens
gaggctgtctgctgctggcct

SEQ ID NO: 7057751 - DNA, 22 bp, Homo sapiens
gaggctgtctgttagcctggga

SEQ ID NO: 7057752 - DNA, 22 bp, Homo sapiens
gagggctgataacaggaataca

SEQ ID NO: 7057753 - DNA, 22 bp, Homo sapiens
gagggctgataacaggaataca

SEQ ID NO: 7057754 - DNA, 22 bp, Homo sapiens
gagggctgataaatgcgcatgg

SEQ ID NO: 7057755 - DNA, 22 bp, Homo sapiens
gagggctgataaatgcgcatgg

SEQ ID NO: 7057756 - DNA, 22 bp, Homo sapiens
gagggccagatcccaggaggaa

SEQ ID NO: 7057757 - DNA, 22 bp, Homo sapiens
gagggccagatcccaggaggaa

SEQ ID NO: 7057758 - DNA, 22 bp, Homo sapiens
gagggccaggcggagacaggcg

SEQ ID NO: 7057759 - DNA, 22 bp, Homo sapiens
gagggctgatgcttacttattt

SEQ ID NO: 7057760 - DNA, 22 bp, Homo sapiens
gagggctgatgttgccacctca

SEQ ID NO: 7057761 - DNA, 22 bp, Homo sapiens
gagggtcttacctaagcagggt

SEQ ID NO: 7057762 - DNA, 22 bp, Homo sapiens
gagggtgcaggaggatggtagt

SEQ ID NO: 7057763 - DNA, 22 bp, Homo sapiens
gagggtggctcctccctgggcc

SEQ ID NO: 7057764 - DNA, 22 bp, Homo sapiens
gagggtggcctttagagcccat

SEQ ID NO: 7057765 - DNA, 22 bp, Homo sapiens
gagggtggatcagcctgattgg

SEQ ID NO: 7057766 - DNA, 22 bp, Homo sapiens
gagggtggaagagctgctgaga

SEQ ID NO: 7057767 - DNA, 22 bp, Homo sapiens
gagggtggggaatagactgcta

SEQ ID NO: 7057768 - DNA, 22 bp, Homo sapiens
gagggtgggctttgttcctcca

SEQ ID NO: 7057769 - DNA, 22 bp, Homo sapiens
gagggtggtggcttaaggtgct

SEQ ID NO: 7057770 - DNA, 22 bp, Homo sapiens
gaggtcctgtctgagaatggag

SEQ ID NO: 7057771 - DNA, 22 bp, Homo sapiens
gaggtctgccttcaggagagtt

SEQ ID NO: 7057772 - DNA, 22 bp, Homo sapiens
gaggtgggagggcagtccctaa

SEQ ID NO: 7057773 - DNA, 22 bp, Homo sapiens
gaggtggcttagtctctggaca

SEQ ID NO: 7057774 - DNA, 22 bp, Homo sapiens
gaggtttcactgtgttgtccag

SEQ ID NO: 7057775 - DNA, 22 bp, Homo sapiens
gaggtttcttatcaagaaagct

SEQ ID NO: 7057776 - DNA, 22 bp, Homo sapiens
gaggttttaagttgaaggggga

SEQ ID NO: 7057777 - DNA, 22 bp, Homo sapiens
gaggttttaggctgccattatt

SEQ ID NO: 7057778 - DNA, 22 bp, Homo sapiens
gagtaatttatccagtgaagta

SEQ ID NO: 7057779 - DNA, 19 bp, Homo sapiens
gagtacaggtgcagaaatg

SEQ ID NO: 7057780 - DNA, 22 bp, Homo sapiens
gaggtgcttcctttgggctctg

SEQ ID NO: 7057781 - DNA, 22 bp, Homo sapiens
gaggtgagtggatcacgaggtc

SEQ ID NO: 7057782 - DNA, 22 bp, Homo sapiens
gaggtgaaagttattcatttat

SEQ ID NO: 7057783 - DNA, 22 bp, Homo sapiens
gaggtggctccttcagggaata

SEQ ID NO: 7057784 - DNA, 22 bp, Homo sapiens
gaggtggctggctcagagccag

SEQ ID NO: 7057785 - DNA, 22 bp, Homo sapiens
gaggtggctgggagtagggaat

SEQ ID NO: 7057786 - DNA, 18 bp, Homo sapiens
gaggtggctgggccatct

SEQ ID NO: 7057787 - DNA, 22 bp, Homo sapiens
gaggtggctgtcagcttcactt

SEQ ID NO: 7057788 - DNA, 22 bp, Homo sapiens
gaggacgggcttcatggggcct

SEQ ID NO: 7057789 - DNA, 22 bp, Homo sapiens
gaggaccacagatgagcctgca

SEQ ID NO: 7057790 - DNA, 22 bp, Homo sapiens
gaggacagtgtgatctgccagc

SEQ ID NO: 7057791 - DNA, 22 bp, Homo sapiens
gaggacagtgtgatctgccagc

SEQ ID NO: 7057792 - DNA, 22 bp, Homo sapiens
gaggagagaacattcctccata

SEQ ID NO: 7057793 - DNA, 22 bp, Homo sapiens
gaggagacggggtgcctggagc

SEQ ID NO: 7057794 - DNA, 22 bp, Homo sapiens
gaggagactgacagcagattct

SEQ ID NO: 7057795 - DNA, 22 bp, Homo sapiens
gaggagactgacagcagattct

SEQ ID NO: 7057796 - DNA, 22 bp, Homo sapiens
gaggactgaaacttacaggaaa

SEQ ID NO: 7057797 - DNA, 22 bp, Homo sapiens
gaggactgaaacttacaggaaa

SEQ ID NO: 7057798 - DNA, 21 bp, Homo sapiens
gaggactgcacactctgattg

SEQ ID NO: 7057799 - DNA, 22 bp, Homo sapiens
gaggactgcagatgggtgcatc

SEQ ID NO: 7057800 - DNA, 22 bp, Homo sapiens
gaggagaaagcagtgatttgtg

SEQ ID NO: 7057801 - DNA, 22 bp, Homo sapiens
gaggagaaattatccttggtgt

SEQ ID NO: 7057802 - DNA, 22 bp, Homo sapiens
gaggagacatatttttgaagca

SEQ ID NO: 7057803 - DNA, 22 bp, Homo sapiens
gaggagacggggtgcctggagc

SEQ ID NO: 7057804 - DNA, 22 bp, Homo sapiens
gaggagtgccagccgtggagtc

SEQ ID NO: 7057805 - DNA, 22 bp, Homo sapiens
gaggagtgccagccgtggagtc

SEQ ID NO: 7057806 - DNA, 22 bp, Homo sapiens
gaggagagagggactgtctgca

SEQ ID NO: 7057807 - DNA, 22 bp, Homo sapiens
gaggaggtggagtcatgcagag

SEQ ID NO: 7057808 - DNA, 22 bp, Homo sapiens
gaggaggtggagtcatgcagag

SEQ ID NO: 7057809 - DNA, 22 bp, Homo sapiens
gaggaggtggagtcatgcagag

SEQ ID NO: 7057810 - DNA, 22 bp, Homo sapiens
gaggaggttccgggtggagaag

SEQ ID NO: 7057811 - DNA, 22 bp, Homo sapiens
gaggaggttccgggtggagaag

SEQ ID NO: 7057812 - DNA, 22 bp, Homo sapiens
gaggaggttccgggtggagaag

SEQ ID NO: 7057813 - DNA, 18 bp, Homo sapiens
gaggatggaaggagatgc

SEQ ID NO: 7057814 - DNA, 18 bp, Homo sapiens
gaggatggaaggagatgc

SEQ ID NO: 7057815 - DNA, 22 bp, Homo sapiens
gaggagtggagttgctgggttg

SEQ ID NO: 7057816 - DNA, 22 bp, Homo sapiens
gaggagtggagttgctgggttg

SEQ ID NO: 7057817 - DNA, 22 bp, Homo sapiens
gaggatgctgcagtgcaggaca

SEQ ID NO: 7057818 - DNA, 22 bp, Homo sapiens
gaggcctggagccgcctaggcg

SEQ ID NO: 7057819 - DNA, 22 bp, Homo sapiens
gaggccagaatgagtctctggg

SEQ ID NO: 7057820 - DNA, 22 bp, Homo sapiens
gaggccacttcctactggagga

SEQ ID NO: 7057821 - DNA, 22 bp, Homo sapiens
gaggccagaagtctgagatcag

SEQ ID NO: 7057822 - DNA, 22 bp, Homo sapiens
gaggccagaagtctgagatcag

SEQ ID NO: 7057823 - DNA, 22 bp, Homo sapiens
gaggccagaagtgcctcgggct

SEQ ID NO: 7057824 - DNA, 22 bp, Homo sapiens
gaggccagaatgagctgaatgc

SEQ ID NO: 7057825 - DNA, 22 bp, Homo sapiens
gaggccagaatgagtctctggg

SEQ ID NO: 7057826 - DNA, 22 bp, Homo sapiens
gaggatggaggtgtgagctatg

SEQ ID NO: 7057827 - DNA, 22 bp, Homo sapiens
gaggatggaggtgtgagctatg

SEQ ID NO: 7057828 - DNA, 22 bp, Homo sapiens
gaggatggaggtgtgagctatg

SEQ ID NO: 7057829 - DNA, 22 bp, Homo sapiens
gaggatggtatgaggcaagcaa

SEQ ID NO: 7057830 - DNA, 22 bp, Homo sapiens
gaggatggtgagcaggacccag

SEQ ID NO: 7057831 - DNA, 22 bp, Homo sapiens
gaggatggtgagcaggacccag

SEQ ID NO: 7057832 - DNA, 22 bp, Homo sapiens
gaggcatggcctgaggctagga

SEQ ID NO: 7057833 - DNA, 22 bp, Homo sapiens
gaggcatggcctgaggctagga

SEQ ID NO: 7057834 - DNA, 22 bp, Homo sapiens
gaggccacggttttccttgggg

SEQ ID NO: 7057835 - DNA, 21 bp, Homo sapiens
gaggccactaataggggcaga

SEQ ID NO: 7057836 - DNA, 22 bp, Homo sapiens
gaggccactgtccctgccttcc

SEQ ID NO: 7057837 - DNA, 22 bp, Homo sapiens
gagctcagaggcgtctttgtcc

SEQ ID NO: 7057838 - DNA, 22 bp, Homo sapiens
gagcaggatgggagctggggcc

SEQ ID NO: 7057839 - DNA, 22 bp, Homo sapiens
gagcaggcattctagtggctga

SEQ ID NO: 7057840 - DNA, 22 bp, Homo sapiens
gagctcaggagcatcagaagaa

SEQ ID NO: 7057841 - DNA, 22 bp, Homo sapiens
gagctcaggagcatcagaagaa

SEQ ID NO: 7057842 - DNA, 22 bp, Homo sapiens
gagctcagcaaaggtctgtgtg

SEQ ID NO: 7057843 - DNA, 22 bp, Homo sapiens
gagctcagcaaaggtctgtgtg

SEQ ID NO: 7057844 - DNA, 22 bp, Homo sapiens
gagctcagattctggtgtcaga

SEQ ID NO: 7057845 - DNA, 22 bp, Homo sapiens
gagctcagtgtagtcatggctt

SEQ ID NO: 7057846 - DNA, 22 bp, Homo sapiens
gagctcagtgtagtcatggctt

SEQ ID NO: 7057847 - DNA, 22 bp, Homo sapiens
gagctgggatttgaacctggga

SEQ ID NO: 7057848 - DNA, 22 bp, Homo sapiens
gagctgggatttgaacctggga

SEQ ID NO: 7057849 - DNA, 22 bp, Homo sapiens
gagctccagggaacagcagcta

SEQ ID NO: 7057850 - DNA, 22 bp, Homo sapiens
gagctggtcagtttcaggagag

SEQ ID NO: 7057851 - DNA, 22 bp, Homo sapiens
gagctggtcagtttcagggcca

SEQ ID NO: 7057852 - DNA, 22 bp, Homo sapiens
gagctggtccacaatctgcagg

SEQ ID NO: 7057853 - DNA, 22 bp, Homo sapiens
gagctggtcgaaatgggctgac

SEQ ID NO: 7057854 - DNA, 22 bp, Homo sapiens
gagctggtcgaaatgggctgac

SEQ ID NO: 7057855 - DNA, 22 bp, Homo sapiens
gagctggtgatcagctggagga

SEQ ID NO: 7057856 - DNA, 22 bp, Homo sapiens
gagctggtgctcttgtcaagac

SEQ ID NO: 7057857 - DNA, 22 bp, Homo sapiens
gagctggtggtgagaaagctct

SEQ ID NO: 7057858 - DNA, 22 bp, Homo sapiens
gagctggttctgtccagggaat

SEQ ID NO: 7057859 - DNA, 22 bp, Homo sapiens
gagctgtccaagatggtcgtaa

SEQ ID NO: 7057860 - DNA, 22 bp, Homo sapiens
gagctgtccgcccctgggccga

SEQ ID NO: 7057861 - DNA, 20 bp, Homo sapiens
gagctgtgctctcaggagcc

SEQ ID NO: 7057862 - DNA, 22 bp, Homo sapiens
gagctgtgtgcctggatggtct

SEQ ID NO: 7057863 - DNA, 22 bp, Homo sapiens
gaggacaggagactcactgttt

SEQ ID NO: 7057864 - DNA, 17 bp, Homo sapiens
gaggacagggaagtagg

SEQ ID NO: 7057865 - DNA, 22 bp, Homo sapiens
ctttctcttcactgtcatgatc

SEQ ID NO: 7057866 - DNA, 22 bp, Homo sapiens
ctttctctgtgtttcacatgct

SEQ ID NO: 7057867 - DNA, 22 bp, Homo sapiens
ctttctcagtgttaattacttt

SEQ ID NO: 7057868 - DNA, 22 bp, Homo sapiens
ctttcctggctggcagttgtgg

SEQ ID NO: 7057869 - DNA, 22 bp, Homo sapiens
ctttcctccactccctaggctt

SEQ ID NO: 7057870 - DNA, 22 bp, Homo sapiens
ctttcctctggcactgtctggt

SEQ ID NO: 7057871 - DNA, 22 bp, Homo sapiens
ctttcctctggcactgtctggt

SEQ ID NO: 7057872 - DNA, 22 bp, Homo sapiens
ctttcctgaaatctcttctgca

SEQ ID NO: 7057873 - DNA, 22 bp, Homo sapiens
ctttcctgagaaaggagaagga

SEQ ID NO: 7057874 - DNA, 22 bp, Homo sapiens
ctttcctgaggagtatggctgt

SEQ ID NO: 7057875 - DNA, 22 bp, Homo sapiens
ctttcctggctggcagttgtgg

SEQ ID NO: 7057876 - DNA, 22 bp, Homo sapiens
cttggaggaaaggcagggagac

SEQ ID NO: 7057877 - DNA, 22 bp, Homo sapiens
cttggaggatgtgcggctgccc

SEQ ID NO: 7057878 - DNA, 22 bp, Homo sapiens
ctttcctagttggtcccagcac

SEQ ID NO: 7057879 - DNA, 22 bp, Homo sapiens
cttgctgtcttgcatttagagc

SEQ ID NO: 7057880 - DNA, 22 bp, Homo sapiens
cttgctgtgtggtgttctcaga

SEQ ID NO: 7057881 - DNA, 22 bp, Homo sapiens
cttgctttcagtctcggcctca

SEQ ID NO: 7057882 - DNA, 22 bp, Homo sapiens
cttcttcccagcttccctcacc

SEQ ID NO: 7057883 - DNA, 22 bp, Homo sapiens
cttcttcctgctgcagcctcca

SEQ ID NO: 7057884 - DNA, 22 bp, Homo sapiens
cttgcctccctcagctcacagc

SEQ ID NO: 7057885 - DNA, 22 bp, Homo sapiens
cttgcctccctcagctcacagc

SEQ ID NO: 7057886 - DNA, 22 bp, Homo sapiens
cttgcctccctcagctcacagc

SEQ ID NO: 7057887 - DNA, 22 bp, Homo sapiens
cttgcctctgctaatggtttct

SEQ ID NO: 7057888 - DNA, 22 bp, Homo sapiens
cttgcctgaggaacagagggta

SEQ ID NO: 7057889 - DNA, 22 bp, Homo sapiens
cttgcctgccactacagctgaa

SEQ ID NO: 7057890 - DNA, 22 bp, Homo sapiens
cttgctggggtaagtctgtgct

SEQ ID NO: 7057891 - DNA, 19 bp, Homo sapiens
cttgctgggtggtttctgc

SEQ ID NO: 7057892 - DNA, 22 bp, Homo sapiens
cttgctggtggtgttttctatg

SEQ ID NO: 7057893 - DNA, 22 bp, Homo sapiens
cttgctgtcccttggtatgaac

SEQ ID NO: 7057894 - DNA, 22 bp, Homo sapiens
cttgctgtcttgcatttagagc

SEQ ID NO: 7057895 - DNA, 23 bp, Homo sapiens
cttcacaggttcaggggattaag

SEQ ID NO: 7057896 - DNA, 22 bp, Homo sapiens
cttcacagtaaatccagaagaa

SEQ ID NO: 7057897 - DNA, 22 bp, Homo sapiens
cttcacagtaaatccagaagaa

SEQ ID NO: 7057898 - DNA, 16 bp, Homo sapiens
cttcacagaggagagt

SEQ ID NO: 7057899 - DNA, 22 bp, Homo sapiens
ctgttaaaatgtggtcttaaaa

SEQ ID NO: 7057900 - DNA, 22 bp, Homo sapiens
ctgttaaagatagttaagcttc

SEQ ID NO: 7057901 - DNA, 20 bp, Homo sapiens
ctgttaaaaggtatgaattc

SEQ ID NO: 7057902 - DNA, 22 bp, Homo sapiens
cttcacttcacagatgccaaga

SEQ ID NO: 7057903 - DNA, 22 bp, Homo sapiens
cttcactttaagccaatcatga

SEQ ID NO: 7057904 - DNA, 22 bp, Homo sapiens
cttcagaaccagccagaagagg

SEQ ID NO: 7057905 - DNA, 22 bp, Homo sapiens
cttcactggaatctgtaatagt

SEQ ID NO: 7057906 - DNA, 22 bp, Homo sapiens
cttcactgagtagtctagactc

SEQ ID NO: 7057907 - DNA, 22 bp, Homo sapiens
cttcccttctgcagatctttgg

SEQ ID NO: 7057908 - DNA, 22 bp, Homo sapiens
cttcccttctgtgcagggcaga

SEQ ID NO: 7057909 - DNA, 22 bp, Homo sapiens
cttcccttggtgaacagagcat

SEQ ID NO: 7057910 - DNA, 22 bp, Homo sapiens
cttccctttagcatatagtagt

SEQ ID NO: 7057911 - DNA, 22 bp, Homo sapiens
cttccctttctggtgacttctc

SEQ ID NO: 7057912 - DNA, 22 bp, Homo sapiens
cttcttcagaggccagcctctg

SEQ ID NO: 7057913 - DNA, 22 bp, Homo sapiens
cttcccagttctgcttgagggg

SEQ ID NO: 7057914 - DNA, 22 bp, Homo sapiens
cttccccaaccccgactgtgtg

SEQ ID NO: 7057915 - DNA, 22 bp, Homo sapiens
cttccccaaccccgactgtgtg

SEQ ID NO: 7057916 - DNA, 22 bp, Homo sapiens
cttccccaagtagagaggggag

SEQ ID NO: 7057917 - DNA, 21 bp, Homo sapiens
cttccccaggctggtctgtat

SEQ ID NO: 7057918 - DNA, 19 bp, Homo sapiens
cttcccctgttacctcact

SEQ ID NO: 7057919 - DNA, 22 bp, Homo sapiens
cttccctgagctttctcaggct

SEQ ID NO: 7057920 - DNA, 22 bp, Homo sapiens
cttccctgataagagcctcaga

SEQ ID NO: 7057921 - DNA, 22 bp, Homo sapiens
cttccctgataagagcctcaga

SEQ ID NO: 7057922 - DNA, 22 bp, Homo sapiens
cttccctgataagagcctcaga

SEQ ID NO: 7057923 - DNA, 22 bp, Homo sapiens
cttccctggtgttagcccaatg

SEQ ID NO: 7057924 - DNA, 22 bp, Homo sapiens
cttcccttcccctcacggagac

SEQ ID NO: 7057925 - DNA, 22 bp, Homo sapiens
cttcccttcctggggcaattta

SEQ ID NO: 7057926 - DNA, 22 bp, Homo sapiens
ctttttctgatgttccatgatt

SEQ ID NO: 7057927 - DNA, 22 bp, Homo sapiens
ctttttctaatcataattgtct

SEQ ID NO: 7057928 - DNA, 22 bp, Homo sapiens
ctttggcaatgtcattttcaat

SEQ ID NO: 7057929 - DNA, 22 bp, Homo sapiens
ctttggcacagtctcatttgat

SEQ ID NO: 7057930 - DNA, 22 bp, Homo sapiens
cttttgttaggagaaaacatca

SEQ ID NO: 7057931 - DNA, 22 bp, Homo sapiens
ctttggcaacacatgtgggaca

SEQ ID NO: 7057932 - DNA, 22 bp, Homo sapiens
ctttggcaagggttttaattgt

SEQ ID NO: 7057933 - DNA, 22 bp, Homo sapiens
ctttggaatattttattgagaa

SEQ ID NO: 7057934 - DNA, 22 bp, Homo sapiens
ctttttgttgtataagcccttt

SEQ ID NO: 7057935 - DNA, 22 bp, Homo sapiens
gaaaaaggataaatacagtgtt

SEQ ID NO: 7057936 - DNA, 22 bp, Homo sapiens
gaaaaatgagctgatgtcaggg

SEQ ID NO: 7057937 - DNA, 22 bp, Homo sapiens
gaaaaatgagctgatgtcaggg

SEQ ID NO: 7057938 - DNA, 22 bp, Homo sapiens
gaaaaatgctccaaatctgtgg

SEQ ID NO: 7057939 - DNA, 22 bp, Homo sapiens
gaaaaatgctccaaatctgtgg

SEQ ID NO: 7057940 - DNA, 22 bp, Homo sapiens
gaaaacactttgatctgaaagt

SEQ ID NO: 7057941 - DNA, 22 bp, Homo sapiens
gaaacagcccctgtgtgaagca

SEQ ID NO: 7057942 - DNA, 22 bp, Homo sapiens
gaaacagctagaaagccattgg

SEQ ID NO: 7057943 - DNA, 22 bp, Homo sapiens
gaaacagctttaagtgatactg

SEQ ID NO: 7057944 - DNA, 22 bp, Homo sapiens
gaaactgtgaggatcttaactt

SEQ ID NO: 7057945 - DNA, 22 bp, Homo sapiens
gaaactgtatgtagtttttggg

SEQ ID NO: 7057946 - DNA, 22 bp, Homo sapiens
gaaacctcttagcctctctttg

SEQ ID NO: 7057947 - DNA, 22 bp, Homo sapiens
gaaactgtgatcgtgttctggg

SEQ ID NO: 7057948 - DNA, 22 bp, Homo sapiens
gaaactgtttctggctttggtg

SEQ ID NO: 7057949 - DNA, 22 bp, Homo sapiens
gaaacttcttgtctcacagttc

SEQ ID NO: 7057950 - DNA, 22 bp, Homo sapiens
gaaagaatgctatagtgacttc

SEQ ID NO: 7057951 - DNA, 22 bp, Homo sapiens
gaagaagcaggagtgtgtagca

SEQ ID NO: 7057952 - DNA, 19 bp, Homo sapiens
gaagaagcttgagaagtag

SEQ ID NO: 7057953 - DNA, 22 bp, Homo sapiens
gaagaagggagtgacaaatgca

SEQ ID NO: 7057954 - DNA, 22 bp, Homo sapiens
gaaattcactgtatttcttggg

SEQ ID NO: 7057955 - DNA, 22 bp, Homo sapiens
gaaatgtagaattgcttaactg

SEQ ID NO: 7057956 - DNA, 22 bp, Homo sapiens
gaaatgtagagtatctgaggat

SEQ ID NO: 7057957 - DNA, 22 bp, Homo sapiens
gaaatgtaggcataattatttt

SEQ ID NO: 7057958 - DNA, 22 bp, Homo sapiens
gaaatattgtactggagatgtt

SEQ ID NO: 7057959 - DNA, 22 bp, Homo sapiens
gaaatattgtactggagatgtt

SEQ ID NO: 7057960 - DNA, 22 bp, Homo sapiens
gaaatattgggactcagagctt

SEQ ID NO: 7057961 - DNA, 22 bp, Homo sapiens
gaaatattgtactggagatgtt

SEQ ID NO: 7057962 - DNA, 22 bp, Homo sapiens
gaaatattgtactggagatgtt

SEQ ID NO: 7057963 - DNA, 22 bp, Homo sapiens
gaaatattgggactcagagctt

SEQ ID NO: 7057964 - DNA, 22 bp, Homo sapiens
gaaatattgggactcagagctt

SEQ ID NO: 7057965 - DNA, 22 bp, Homo sapiens
gaaatattgggactcagagctt

SEQ ID NO: 7057966 - DNA, 22 bp, Homo sapiens
gaaatgtataagctggtctttt

SEQ ID NO: 7057967 - DNA, 20 bp, Homo sapiens
gaaatgtatctcttgattct

SEQ ID NO: 7057968 - DNA, 22 bp, Homo sapiens
gaaatgtatgtcttcccccatt

SEQ ID NO: 7057969 - DNA, 22 bp, Homo sapiens
gaaatgtatttgacagtccttg

SEQ ID NO: 7057970 - DNA, 20 bp, Homo sapiens
gaaatgtgacctcttctgtg

SEQ ID NO: 7057971 - DNA, 22 bp, Homo sapiens
gaaatattacagtggaggggat

SEQ ID NO: 7057972 - DNA, 22 bp, Homo sapiens
gaaatattcttgtcttgttttc

SEQ ID NO: 7057973 - DNA, 22 bp, Homo sapiens
gaaatattcttgtcttgttttc

SEQ ID NO: 7057974 - DNA, 22 bp, Homo sapiens
gaaatattcttgtcttgttttc

SEQ ID NO: 7057975 - DNA, 22 bp, Homo sapiens
gaaatattcttgtcttgttttc

SEQ ID NO: 7057976 - DNA, 22 bp, Homo sapiens
gaaatatacattgcaggaagag

SEQ ID NO: 7057977 - DNA, 22 bp, Homo sapiens
gaaatatacattgcaggaagag

SEQ ID NO: 7057978 - DNA, 22 bp, Homo sapiens
gaaatattacagtggaggggat

SEQ ID NO: 7057979 - DNA, 22 bp, Homo sapiens
gaaatattacagtggaggggat

SEQ ID NO: 7057980 - DNA, 22 bp, Homo sapiens
gaaatattacagtggaggggat

SEQ ID NO: 7057981 - DNA, 22 bp, Homo sapiens
gaaatatacattgcaggaagag

SEQ ID NO: 7057982 - DNA, 22 bp, Homo sapiens
ctgtggcaggaagggactagca

SEQ ID NO: 7057983 - DNA, 22 bp, Homo sapiens
ctgtggcattgtgaggactgca

SEQ ID NO: 7057984 - DNA, 22 bp, Homo sapiens
ctgtggcattgccgaggctggc

SEQ ID NO: 7057985 - DNA, 22 bp, Homo sapiens
ctgtggcattgccgaggctggc

SEQ ID NO: 7057986 - DNA, 22 bp, Homo sapiens
ctgtggcaggtgtctggggcag

SEQ ID NO: 7057987 - DNA, 20 bp, Homo sapiens
ctgtggcatctgtcatggtg

SEQ ID NO: 7057988 - DNA, 22 bp, Homo sapiens
ctgtgggatgggacctcagctg

SEQ ID NO: 7057989 - DNA, 22 bp, Homo sapiens
ctgtggcttcagcattcagagc

SEQ ID NO: 7057990 - DNA, 22 bp, Homo sapiens
ctgtggggaaagggtcctgctc

SEQ ID NO: 7057991 - DNA, 22 bp, Homo sapiens
ctgtggggccaaattctcctct

SEQ ID NO: 7057992 - DNA, 22 bp, Homo sapiens
ctgtggtcaccaggctggggcc

SEQ ID NO: 7057993 - DNA, 22 bp, Homo sapiens
ctgtggtcaccaggctggggcc

SEQ ID NO: 7057994 - DNA, 20 bp, Homo sapiens
ctgtggtgagcaggagagta

SEQ ID NO: 7057995 - DNA, 22 bp, Homo sapiens
ctgtggtggcacagcgggctgg

SEQ ID NO: 7057996 - DNA, 22 bp, Homo sapiens
ctgtgtgtgaacacagcccagc

SEQ ID NO: 7057997 - DNA, 22 bp, Homo sapiens
ctgtgtgtgagaagcaggttga

SEQ ID NO: 7057998 - DNA, 23 bp, Homo sapiens
ctgtgtgtgccgagggtggccac

SEQ ID NO: 7057999 - DNA, 22 bp, Homo sapiens
ctgtgtgtgctacaggcttcca

SEQ ID NO: 7058000 - DNA, 22 bp, Homo sapiens
ctgtgtgtgtctgcagcatact

SEQ ID NO: 7058001 - DNA, 22 bp, Homo sapiens
ctgtgtgtttatatcatttcct

SEQ ID NO: 7058002 - DNA, 22 bp, Homo sapiens
ctgtgttggcttttctcttgta

SEQ ID NO: 7058003 - DNA, 22 bp, Homo sapiens
ctgtgtttgatgagaagccacc

SEQ ID NO: 7058004 - DNA, 22 bp, Homo sapiens
ctgtgagggcagggaccagagg

SEQ ID NO: 7058005 - DNA, 22 bp, Homo sapiens
ctgtgaggcggaaaggactctc

SEQ ID NO: 7058006 - DNA, 22 bp, Homo sapiens
ctgtgaggcctttggccagata

SEQ ID NO: 7058007 - DNA, 22 bp, Homo sapiens
ctgtgaggcctttggccagata

SEQ ID NO: 7058008 - DNA, 22 bp, Homo sapiens
ctgtgagggcagggaccagagg

SEQ ID NO: 7058009 - DNA, 22 bp, Homo sapiens
ctgtgagggcagggaccagagg

SEQ ID NO: 7058010 - DNA, 22 bp, Homo sapiens
ctgtgagggccagagtcagggc

SEQ ID NO: 7058011 - DNA, 21 bp, Homo sapiens
ctgtgactccctgggcaatcc

SEQ ID NO: 7058012 - DNA, 22 bp, Homo sapiens
ctgtgactgcagcaccaagtaa

SEQ ID NO: 7058013 - DNA, 22 bp, Homo sapiens
ctgtgacttccactactgatca

SEQ ID NO: 7058014 - DNA, 22 bp, Homo sapiens
ctgtgagatatgcatatgctct

SEQ ID NO: 7058015 - DNA, 22 bp, Homo sapiens
ctgtgaattaagtattgttatc

SEQ ID NO: 7058016 - DNA, 22 bp, Homo sapiens
ctgtccctctcacacctcacca

SEQ ID NO: 7058017 - DNA, 22 bp, Homo sapiens
ctgtccctgagcaactcctgtt

SEQ ID NO: 7058018 - DNA, 22 bp, Homo sapiens
ctgtgaaatcaaccttgagccc

SEQ ID NO: 7058019 - DNA, 22 bp, Homo sapiens
ctgtcccctgtgctttcacttg

SEQ ID NO: 7058020 - DNA, 22 bp, Homo sapiens
ctgtccccgcgagtccagagct

SEQ ID NO: 7058021 - DNA, 22 bp, Homo sapiens
ctgtcccctgtgctttcacttg

SEQ ID NO: 7058022 - DNA, 22 bp, Homo sapiens
ctgtccccgcgagtccagagct

SEQ ID NO: 7058023 - DNA, 18 bp, Homo sapiens
ctgtcccatcctcaggtt

SEQ ID NO: 7058024 - DNA, 22 bp, Homo sapiens
ctgtccccacccaaatctcatc

SEQ ID NO: 7058025 - DNA, 22 bp, Homo sapiens
ctgtcccagatgttctcagcac

SEQ ID NO: 7058026 - DNA, 22 bp, Homo sapiens
ctggttggtgccacatggtggc

SEQ ID NO: 7058027 - DNA, 22 bp, Homo sapiens
ctggttttatgttatagatgga

SEQ ID NO: 7058028 - DNA, 22 bp, Homo sapiens
ctgtcattgagcctgtcagggc

SEQ ID NO: 7058029 - DNA, 22 bp, Homo sapiens
ctgggtgtcaggagacatgatg

SEQ ID NO: 7058030 - DNA, 22 bp, Homo sapiens
ctgggtgttcacccgaggcgct

SEQ ID NO: 7058031 - DNA, 22 bp, Homo sapiens
ctgggtgttcaggagctgggct

SEQ ID NO: 7058032 - DNA, 22 bp, Homo sapiens
ctgggttccatgtagccaagag

SEQ ID NO: 7058033 - DNA, 22 bp, Homo sapiens
ctgggttcttggcacagcagga

SEQ ID NO: 7058034 - DNA, 22 bp, Homo sapiens
ctgggttgcaaagcgctggctg

SEQ ID NO: 7058035 - DNA, 22 bp, Homo sapiens
ctgggtttagggtctccccttg

SEQ ID NO: 7058036 - DNA, 22 bp, Homo sapiens
ctgggtttagggtctccccttg

SEQ ID NO: 7058037 - DNA, 22 bp, Homo sapiens
ctgggttttattacagtgagct

SEQ ID NO: 7058038 - DNA, 22 bp, Homo sapiens
ctgggttttattacagtgagct

SEQ ID NO: 7058039 - DNA, 22 bp, Homo sapiens
ctggtacaaaatgctgatatca

SEQ ID NO: 7058040 - DNA, 22 bp, Homo sapiens
ctggtggttcaggagaatggct

SEQ ID NO: 7058041 - DNA, 22 bp, Homo sapiens
ctggtgtggactccgcgcggag

SEQ ID NO: 7058042 - DNA, 22 bp, Homo sapiens
ctggggctggtgaggcaggctc

SEQ ID NO: 7058043 - DNA, 22 bp, Homo sapiens
ctgggggcagcaagaagccatg

SEQ ID NO: 7058044 - DNA, 22 bp, Homo sapiens
ctgggctcctaaccatccaggt

SEQ ID NO: 7058045 - DNA, 22 bp, Homo sapiens
ctgggctcctaaccatccaggt

SEQ ID NO: 7058046 - DNA, 22 bp, Homo sapiens
ctggggtctcaattctagcggg

SEQ ID NO: 7058047 - DNA, 22 bp, Homo sapiens
ctggggtgagcagaaacagggg

SEQ ID NO: 7058048 - DNA, 22 bp, Homo sapiens
ctggggtcagggatcagagagc

SEQ ID NO: 7058049 - DNA, 22 bp, Homo sapiens
ctgggggtcgcgcctctgggca

SEQ ID NO: 7058050 - DNA, 22 bp, Homo sapiens
ctggggtgagcagaaacagggg

SEQ ID NO: 7058051 - DNA, 22 bp, Homo sapiens
ctggggtggagattggcaatct

SEQ ID NO: 7058052 - DNA, 22 bp, Homo sapiens
ctggggtggaggagctcccctg

SEQ ID NO: 7058053 - DNA, 22 bp, Homo sapiens
ctggggtggaggagctcccctg

SEQ ID NO: 7058054 - DNA, 22 bp, Homo sapiens
ctggggtggatgggtccaagtt

SEQ ID NO: 7058055 - DNA, 22 bp, Homo sapiens
ctggggtggatgggtccaagtt

SEQ ID NO: 7058056 - DNA, 22 bp, Homo sapiens
ctggggtggtgcaggcctcatg

SEQ ID NO: 7058057 - DNA, 22 bp, Homo sapiens
ctggggtggtgcaggcctcatg

SEQ ID NO: 7058058 - DNA, 22 bp, Homo sapiens
ctggggtggtgcaggcctcatg

SEQ ID NO: 7058059 - DNA, 22 bp, Homo sapiens
ctggggtgtgctcagagcaggg

SEQ ID NO: 7058060 - DNA, 22 bp, Homo sapiens
ctgggtggaaagtgctgagaat

SEQ ID NO: 7058061 - DNA, 22 bp, Homo sapiens
ctggagctaataatccatctga

SEQ ID NO: 7058062 - DNA, 22 bp, Homo sapiens
ctggagccttcaccaggggaaa

SEQ ID NO: 7058063 - DNA, 22 bp, Homo sapiens
ctggagctaggaagtccaagat

SEQ ID NO: 7058064 - DNA, 22 bp, Homo sapiens
ctggagctcagcccaggttcca

SEQ ID NO: 7058065 - DNA, 22 bp, Homo sapiens
ctggagctccagggtctcctct

SEQ ID NO: 7058066 - DNA, 22 bp, Homo sapiens
ctgggaggcggaggttgcagtg

SEQ ID NO: 7058067 - DNA, 22 bp, Homo sapiens
ctgggaggcggaggttgcagtg

SEQ ID NO: 7058068 - DNA, 22 bp, Homo sapiens
ctgggagtgaaaggagggctgc

SEQ ID NO: 7058069 - DNA, 22 bp, Homo sapiens
ctgggatgatagtgctagtatt

SEQ ID NO: 7058070 - DNA, 22 bp, Homo sapiens
ctgggcccacgagggctctggg

SEQ ID NO: 7058071 - DNA, 22 bp, Homo sapiens
ctgggatgtgaggagcgcctct

SEQ ID NO: 7058072 - DNA, 22 bp, Homo sapiens
ctgggccagcaactgcaatgga

SEQ ID NO: 7058073 - DNA, 22 bp, Homo sapiens
ctgggcctcatcctcagagttt

SEQ ID NO: 7058074 - DNA, 22 bp, Homo sapiens
ctgggcctcatccccagagttt

SEQ ID NO: 7058075 - DNA, 22 bp, Homo sapiens
ctgggcctcaatctcagagttt

SEQ ID NO: 7058076 - DNA, 23 bp, Homo sapiens
ctgggcctatggtctgaatccaa

SEQ ID NO: 7058077 - DNA, 22 bp, Homo sapiens
ctgggcctagcaacagaggagt

SEQ ID NO: 7058078 - DNA, 22 bp, Homo sapiens
ctgggcctccacgggccatcac

SEQ ID NO: 7058079 - DNA, 22 bp, Homo sapiens
ctgggctccactcccacagtgt

SEQ ID NO: 7058080 - DNA, 21 bp, Homo sapiens
ctgggctcatggtgttacaga

SEQ ID NO: 7058081 - DNA, 22 bp, Homo sapiens
ctgggctcagtggctcatggct

SEQ ID NO: 7058082 - DNA, 22 bp, Homo sapiens
ctgggctcagtggctcatggct

SEQ ID NO: 7058083 - DNA, 22 bp, Homo sapiens
ctgggctcagtgtctcactcct

SEQ ID NO: 7058084 - DNA, 22 bp, Homo sapiens
ctggagccggaccagggacggt

SEQ ID NO: 7058085 - DNA, 22 bp, Homo sapiens
ctggagcctgcagttttcactt

SEQ ID NO: 7058086 - DNA, 22 bp, Homo sapiens
ctggagccccaggctgtgcaga

SEQ ID NO: 7058087 - DNA, 22 bp, Homo sapiens
ctggagcaggtttaggagtccc

SEQ ID NO: 7058088 - DNA, 22 bp, Homo sapiens
ctggagcagcaggtggccaggg

SEQ ID NO: 7058089 - DNA, 22 bp, Homo sapiens
ctggagagggagccctggcagt

SEQ ID NO: 7058090 - DNA, 22 bp, Homo sapiens
ctggagagggagctgttggaag

SEQ ID NO: 7058091 - DNA, 22 bp, Homo sapiens
ctggagagttggaagatggact

SEQ ID NO: 7058092 - DNA, 23 bp, Homo sapiens
ctgctgtgaaacatggttttggt

SEQ ID NO: 7058093 - DNA, 22 bp, Homo sapiens
ctgctgtgacagctgccgtgtt

SEQ ID NO: 7058094 - DNA, 22 bp, Homo sapiens
ctgctgtgagcactccagcctg

SEQ ID NO: 7058095 - DNA, 22 bp, Homo sapiens
ctgctgtgagtggttcttgcct

SEQ ID NO: 7058096 - DNA, 22 bp, Homo sapiens
ctgctgtgagtttggaggtcta

SEQ ID NO: 7058097 - DNA, 22 bp, Homo sapiens
ctggaaagtgcatgtaatgagg

SEQ ID NO: 7058098 - DNA, 22 bp, Homo sapiens
ctggaaagtgcttttctgagag

SEQ ID NO: 7058099 - DNA, 22 bp, Homo sapiens
ctggaaggagaaggaggctgtg

SEQ ID NO: 7058100 - DNA, 19 bp, Homo sapiens
ctggaaggagggactgttc

SEQ ID NO: 7058101 - DNA, 22 bp, Homo sapiens
ctggaagggaaatctcttggca

SEQ ID NO: 7058102 - DNA, 22 bp, Homo sapiens
ctggaagggtcagagtgatgag

SEQ ID NO: 7058103 - DNA, 22 bp, Homo sapiens
ctggaagggtctacttagcaga

SEQ ID NO: 7058104 - DNA, 22 bp, Homo sapiens
ctggaaggtaacaaggccatta

SEQ ID NO: 7058105 - DNA, 22 bp, Homo sapiens
ctgctctgaccctttcaccttc

SEQ ID NO: 7058106 - DNA, 22 bp, Homo sapiens
ctgctctgttcccccatcatct

SEQ ID NO: 7058107 - DNA, 22 bp, Homo sapiens
ctgctctgttcccccatcatct

SEQ ID NO: 7058108 - DNA, 22 bp, Homo sapiens
ctgctctgttcccccatcatct

SEQ ID NO: 7058109 - DNA, 22 bp, Homo sapiens
ctgctctgtttcttagctgggt

SEQ ID NO: 7058110 - DNA, 22 bp, Homo sapiens
ctgcctttgtgatcagttcttt

SEQ ID NO: 7058111 - DNA, 22 bp, Homo sapiens
ctgccttttaaagccagtgtta

SEQ ID NO: 7058112 - DNA, 22 bp, Homo sapiens
ctgccttttcatctgagctgga

SEQ ID NO: 7058113 - DNA, 22 bp, Homo sapiens
ctgcctttggggagttagaggg

SEQ ID NO: 7058114 - DNA, 21 bp, Homo sapiens
ctgctctgacagtgaggccag

SEQ ID NO: 7058115 - DNA, 22 bp, Homo sapiens
ctgcctttgcccttgacactgt

SEQ ID NO: 7058116 - DNA, 22 bp, Homo sapiens
ctgccttcatctctgagctggg

SEQ ID NO: 7058117 - DNA, 22 bp, Homo sapiens
ctgcctgtttcctcttgctccc

SEQ ID NO: 7058118 - DNA, 22 bp, Homo sapiens
ctgccttccaaccccagactcc

SEQ ID NO: 7058119 - DNA, 22 bp, Homo sapiens
ctgccttccaaccccagactcc

SEQ ID NO: 7058120 - DNA, 22 bp, Homo sapiens
ctgccttctttcaagggtaagc

SEQ ID NO: 7058121 - DNA, 22 bp, Homo sapiens
ctgcctggggaatgtgaggatt

SEQ ID NO: 7058122 - DNA, 22 bp, Homo sapiens
ctgctgggaaggtctgctcagt

SEQ ID NO: 7058123 - DNA, 22 bp, Homo sapiens
ctgctgggatagaagtatctca

SEQ ID NO: 7058124 - DNA, 22 bp, Homo sapiens
ctgctgggcagaggctgcatga

SEQ ID NO: 7058125 - DNA, 20 bp, Homo sapiens
ctgctgagagcctggcttgc

SEQ ID NO: 7058126 - DNA, 22 bp, Homo sapiens
ctgctgacttacactgtttatt

SEQ ID NO: 7058127 - DNA, 22 bp, Homo sapiens
ctgctcttcccactcactccca

SEQ ID NO: 7058128 - DNA, 22 bp, Homo sapiens
ctgctgaaaacaataatgatga

SEQ ID NO: 7058129 - DNA, 22 bp, Homo sapiens
ctgctgacaaaataaaatgctc

SEQ ID NO: 7058130 - DNA, 22 bp, Homo sapiens
ctgctgacagccctgcttcagg

SEQ ID NO: 7058131 - DNA, 22 bp, Homo sapiens
ctgctgactcattttcaacact

SEQ ID NO: 7058132 - DNA, 22 bp, Homo sapiens
ctgctgactcttcctggagtga

SEQ ID NO: 7058133 - DNA, 22 bp, Homo sapiens
ctgctgggcagaggctgcatga

SEQ ID NO: 7058134 - DNA, 22 bp, Homo sapiens
ctgctgggtccccctgctgatt

SEQ ID NO: 7058135 - DNA, 22 bp, Homo sapiens
ctgctgggtctatgcaagtgga

SEQ ID NO: 7058136 - DNA, 22 bp, Homo sapiens
ctgctgtcaaaaatcactccat

SEQ ID NO: 7058137 - DNA, 22 bp, Homo sapiens
ctgctgtcaaaggaaatatttg

SEQ ID NO: 7058138 - DNA, 22 bp, Homo sapiens
ctgctgtccaggagtgccctgt

SEQ ID NO: 7058139 - DNA, 22 bp, Homo sapiens
ctgaggcctgtgttggggcagt

SEQ ID NO: 7058140 - DNA, 22 bp, Homo sapiens
ctgaggcctgggggcgtggacg

SEQ ID NO: 7058141 - DNA, 22 bp, Homo sapiens
ctgaggctaacctcgagagaca

SEQ ID NO: 7058142 - DNA, 22 bp, Homo sapiens
ctgaggctaacctcgagagaca

SEQ ID NO: 7058143 - DNA, 22 bp, Homo sapiens
ctgaggctagtataaagagcat

SEQ ID NO: 7058144 - DNA, 22 bp, Homo sapiens
ctgaggctcaagggcaggtggg

SEQ ID NO: 7058145 - DNA, 22 bp, Homo sapiens
ctgaggctagtataaagagcat

SEQ ID NO: 7058146 - DNA, 22 bp, Homo sapiens
ctgaggctcaagggcaggtggg

SEQ ID NO: 7058147 - DNA, 22 bp, Homo sapiens
ctgaggctcaagggcaggtggg

SEQ ID NO: 7058148 - DNA, 22 bp, Homo sapiens
ctgagccaaaaagcagagcttg

SEQ ID NO: 7058149 - DNA, 22 bp, Homo sapiens
ctgaggccgtctgggtctgcag

SEQ ID NO: 7058150 - DNA, 22 bp, Homo sapiens
ctgaggccgtctgggtctgcag

SEQ ID NO: 7058151 - DNA, 22 bp, Homo sapiens
ctgaggccgttggtgggcctta

SEQ ID NO: 7058152 - DNA, 22 bp, Homo sapiens
ctgaggccgttggtgggcctta

SEQ ID NO: 7058153 - DNA, 22 bp, Homo sapiens
ctgaggctcagcgtgaggaaag

SEQ ID NO: 7058154 - DNA, 22 bp, Homo sapiens
ctgaggctcagcgtgaggaaag

SEQ ID NO: 7058155 - DNA, 22 bp, Homo sapiens
ctgaggctccctcgggtctgct

SEQ ID NO: 7058156 - DNA, 22 bp, Homo sapiens
ctgaggctctgagaaagccaaa

SEQ ID NO: 7058157 - DNA, 22 bp, Homo sapiens
ctgaggctctgagaaagccaaa

SEQ ID NO: 7058158 - DNA, 22 bp, Homo sapiens
ctgaggctctgggtgtcactgt

SEQ ID NO: 7058159 - DNA, 22 bp, Homo sapiens
ctgaggctgaagagggcctacg

SEQ ID NO: 7058160 - DNA, 22 bp, Homo sapiens
ctgaggctgagacaggtgaaat

SEQ ID NO: 7058161 - DNA, 22 bp, Homo sapiens
ctgaggctgagacaggtgaaat

SEQ ID NO: 7058162 - DNA, 22 bp, Homo sapiens
ctgaggctgcccagggccaggt

SEQ ID NO: 7058163 - DNA, 22 bp, Homo sapiens
ctgaggctgcccagggccaggt

SEQ ID NO: 7058164 - DNA, 22 bp, Homo sapiens
ctgaggctggagtgcagtggtg

SEQ ID NO: 7058165 - DNA, 22 bp, Homo sapiens
ctgaggctggagtgcagtggtg

SEQ ID NO: 7058166 - DNA, 22 bp, Homo sapiens
ctgaggctggagtgcagtggtg

SEQ ID NO: 7058167 - DNA, 22 bp, Homo sapiens
ctgaggctggagtgcagtggtg

SEQ ID NO: 7058168 - DNA, 22 bp, Homo sapiens
ctgaggggaaaagtcaggatga

SEQ ID NO: 7058169 - DNA, 17 bp, Homo sapiens
ctgaggggagtgctgtg

SEQ ID NO: 7058170 - DNA, 22 bp, Homo sapiens
ctgaggtcaggagttcaagctg

SEQ ID NO: 7058171 - DNA, 22 bp, Homo sapiens
ctgaggtcctcagagggaaagg

SEQ ID NO: 7058172 - DNA, 22 bp, Homo sapiens
ctgaggtccttgactgcttgcc

SEQ ID NO: 7058173 - DNA, 22 bp, Homo sapiens
ctgaggtctagacaccccaggg

SEQ ID NO: 7058174 - DNA, 22 bp, Homo sapiens
ctgaggtctattttgaaactgc

SEQ ID NO: 7058175 - DNA, 22 bp, Homo sapiens
ctcttcctacagtctgctatgc

SEQ ID NO: 7058176 - DNA, 22 bp, Homo sapiens
ttttgcttttgtaacacagtgt

SEQ ID NO: 7058177 - DNA, 22 bp, Homo sapiens
ttttgctttaagatggagagga

SEQ ID NO: 7058178 - DNA, 22 bp, Homo sapiens
ttttgcttatctgagtgcagcc

SEQ ID NO: 7058179 - DNA, 22 bp, Homo sapiens
ttttgcttgagtgcacaaaatg

SEQ ID NO: 7058180 - DNA, 22 bp, Homo sapiens
ctcttcttatggccgtggctga

SEQ ID NO: 7058181 - DNA, 22 bp, Homo sapiens
ctgagcactgggcacatagctg

SEQ ID NO: 7058182 - DNA, 22 bp, Homo sapiens
ctcttctctgcagcctttgaag

SEQ ID NO: 7058183 - DNA, 22 bp, Homo sapiens
ctcttctgtacctcggcctcca

SEQ ID NO: 7058184 - DNA, 22 bp, Homo sapiens
ctgagcaggatattcacagcag

SEQ ID NO: 7058185 - DNA, 19 bp, Homo sapiens
ctgagcagcggcagcactt

SEQ ID NO: 7058186 - DNA, 22 bp, Homo sapiens
ctgagcagtctgactcaagcta

SEQ ID NO: 7058187 - DNA, 22 bp, Homo sapiens
ctgcaggagtgaaagcaggcct

SEQ ID NO: 7058188 - DNA, 22 bp, Homo sapiens
ctgcaggaggatcctgagagtg

SEQ ID NO: 7058189 - DNA, 22 bp, Homo sapiens
ctgcccagattttaccacctgc

SEQ ID NO: 7058190 - DNA, 20 bp, Homo sapiens
ctgcccagccactgagggat

SEQ ID NO: 7058191 - DNA, 20 bp, Homo sapiens
ctgcccagccactgagggat

SEQ ID NO: 7058192 - DNA, 20 bp, Homo sapiens
ctgcccagccactgagggat

SEQ ID NO: 7058193 - DNA, 22 bp, Homo sapiens
ctgcccacagttctctgccatg

SEQ ID NO: 7058194 - DNA, 22 bp, Homo sapiens
ctgcccagattttaccacctgc

SEQ ID NO: 7058195 - DNA, 22 bp, Homo sapiens
ctgcccaggctgaaggaacatc

SEQ ID NO: 7058196 - DNA, 22 bp, Homo sapiens
ctgcccagtttgggagcctttc

SEQ ID NO: 7058197 - DNA, 22 bp, Homo sapiens
ctgccccaggcctccttttctt

SEQ ID NO: 7058198 - DNA, 22 bp, Homo sapiens
ctgccccatggtccctggtggg

SEQ ID NO: 7058199 - DNA, 22 bp, Homo sapiens
ctgcaggactgaaagatgaggt

SEQ ID NO: 7058200 - DNA, 22 bp, Homo sapiens
ctgcaggactgaaagatgaggt

SEQ ID NO: 7058201 - DNA, 22 bp, Homo sapiens
ctgcagctttggaaacctgttt

SEQ ID NO: 7058202 - DNA, 22 bp, Homo sapiens
ctgcaggaatctgtgctaggtg

SEQ ID NO: 7058203 - DNA, 22 bp, Homo sapiens
ctgcagcctcaacctcctgagc

SEQ ID NO: 7058204 - DNA, 22 bp, Homo sapiens
ctgcagcctcaacctcctgagc

SEQ ID NO: 7058205 - DNA, 22 bp, Homo sapiens
ctgcagctgtctctactgggca

SEQ ID NO: 7058206 - DNA, 22 bp, Homo sapiens
ctgaggtctattttgaaactgc

SEQ ID NO: 7058207 - DNA, 22 bp, Homo sapiens
ctgaggtctctttccatagtga

SEQ ID NO: 7058208 - DNA, 23 bp, Homo sapiens
ctgaggtctgcaattctagtagt

SEQ ID NO: 7058209 - DNA, 23 bp, Homo sapiens
ctgaggtctgcaattctagtagt

SEQ ID NO: 7058210 - DNA, 22 bp, Homo sapiens
ctgaggtgagaggaggccatgt

SEQ ID NO: 7058211 - DNA, 22 bp, Homo sapiens
ctgaggtgagaggaggccatgt

SEQ ID NO: 7058212 - DNA, 19 bp, Homo sapiens
ctgaggtgaggggcatcat

SEQ ID NO: 7058213 - DNA, 19 bp, Homo sapiens
ctgaggtgaggggcatcat

SEQ ID NO: 7058214 - DNA, 22 bp, Homo sapiens
ctgaggtgatgtcaaatgggtt

SEQ ID NO: 7058215 - DNA, 22 bp, Homo sapiens
ctgaggtgctagggtccctgct

SEQ ID NO: 7058216 - DNA, 22 bp, Homo sapiens
ctgaggtgctatggaggatacg

SEQ ID NO: 7058217 - DNA, 22 bp, Homo sapiens
ctgaggtggaacagaggtgaag

SEQ ID NO: 7058218 - DNA, 22 bp, Homo sapiens
ctgaggtggaacagaggtgaag

SEQ ID NO: 7058219 - DNA, 22 bp, Homo sapiens
ctgaggtggcatcctagctcta

SEQ ID NO: 7058220 - DNA, 22 bp, Homo sapiens
ctgaggtggcatcctagctcta

SEQ ID NO: 7058221 - DNA, 22 bp, Homo sapiens
ctgaggtggcctctgccgggga

SEQ ID NO: 7058222 - DNA, 22 bp, Homo sapiens
ctgaggtggcgcctctctttaa

SEQ ID NO: 7058223 - DNA, 22 bp, Homo sapiens
ctgaggtggggcctgggcatca

SEQ ID NO: 7058224 - DNA, 22 bp, Homo sapiens
ctgaggtgtgaaatggtggcaa

SEQ ID NO: 7058225 - DNA, 22 bp, Homo sapiens
ctgaggtgtgaaatggtggcaa

SEQ ID NO: 7058226 - DNA, 22 bp, Homo sapiens
ctgaggtgtggtctgggagtat

SEQ ID NO: 7058227 - DNA, 22 bp, Homo sapiens
ctgaggtgtttagtaggggcgg

SEQ ID NO: 7058228 - DNA, 22 bp, Homo sapiens
ttttgcttaatctagattttgc

SEQ ID NO: 7058229 - DNA, 22 bp, Homo sapiens
ttttgcctgagagtgaaaataa

SEQ ID NO: 7058230 - DNA, 22 bp, Homo sapiens
ctctgtggttagactatggctg

SEQ ID NO: 7058231 - DNA, 22 bp, Homo sapiens
ctctgtggttagactatggctg

SEQ ID NO: 7058232 - DNA, 22 bp, Homo sapiens
ctctgtgggggagaggcagctg

SEQ ID NO: 7058233 - DNA, 22 bp, Homo sapiens
ctctgtgcctcagttttcttct

SEQ ID NO: 7058234 - DNA, 22 bp, Homo sapiens
ctctgtgcttatgctccatggg

SEQ ID NO: 7058235 - DNA, 22 bp, Homo sapiens
tttgttcattagtacagttgta

SEQ ID NO: 7058236 - DNA, 21 bp, Homo sapiens
tttgttcaggggcaaagttaa

SEQ ID NO: 7058237 - DNA, 22 bp, Homo sapiens
ctctgggtgtgacagcacctgg

SEQ ID NO: 7058238 - DNA, 22 bp, Homo sapiens
ctctggctccatttccctatgt

SEQ ID NO: 7058239 - DNA, 22 bp, Homo sapiens
tttggaatattaaaatgtctca

SEQ ID NO: 7058240 - DNA, 22 bp, Homo sapiens
tttggaatggtaccttcagttg

SEQ ID NO: 7058241 - DNA, 22 bp, Homo sapiens
tttggaatgtagtttaatcatc

SEQ ID NO: 7058242 - DNA, 22 bp, Homo sapiens
tttggaattggaaagtgctgtg

SEQ ID NO: 7058243 - DNA, 22 bp, Homo sapiens
tttgcaaacacttaagaagaga

SEQ ID NO: 7058244 - DNA, 22 bp, Homo sapiens
tttgcaaaccggagctctgcaa

SEQ ID NO: 7058245 - DNA, 22 bp, Homo sapiens
tttgagaagataggggaatact

SEQ ID NO: 7058246 - DNA, 22 bp, Homo sapiens
tttgcaaaatgaggtgaagagt

SEQ ID NO: 7058247 - DNA, 22 bp, Homo sapiens
tttgcaaaattattcccagcat

SEQ ID NO: 7058248 - DNA, 22 bp, Homo sapiens
tttgcaaactttcctctggacc

SEQ ID NO: 7058249 - DNA, 18 bp, Homo sapiens
tttgcaaaggaagtatgg

SEQ ID NO: 7058250 - DNA, 22 bp, Homo sapiens
tttgcaaagtccattgaagtta

SEQ ID NO: 7058251 - DNA, 22 bp, Homo sapiens
tttgcaaagtgactattatatg

SEQ ID NO: 7058252 - DNA, 22 bp, Homo sapiens
tttgcaaagtgactattatatg

SEQ ID NO: 7058253 - DNA, 20 bp, Homo sapiens
ctctggcaaaggatgcctat

SEQ ID NO: 7058254 - DNA, 22 bp, Homo sapiens
tttgaaagaaaccagtgagtga

SEQ ID NO: 7058255 - DNA, 22 bp, Homo sapiens
tttgaaagaatttatgtacttt

SEQ ID NO: 7058256 - DNA, 22 bp, Homo sapiens
tttgaaagacagaatatttttg

SEQ ID NO: 7058257 - DNA, 19 bp, Homo sapiens
tttgaaagagttttattgg

SEQ ID NO: 7058258 - DNA, 22 bp, Homo sapiens
tttgaaagcaccatttgagtag

SEQ ID NO: 7058259 - DNA, 22 bp, Homo sapiens
ctctgatttccttattctgtca

SEQ ID NO: 7058260 - DNA, 21 bp, Homo sapiens
tttgaatagaaatagtgctta

SEQ ID NO: 7058261 - DNA, 22 bp, Homo sapiens
tttgaatagaggcccctcagaa

SEQ ID NO: 7058262 - DNA, 22 bp, Homo sapiens
tttgaatagcataggattacat

SEQ ID NO: 7058263 - DNA, 22 bp, Homo sapiens
ctctgaaagagtttagtattat

SEQ ID NO: 7058264 - DNA, 18 bp, Homo sapiens
ctctctttccactctttg

SEQ ID NO: 7058265 - DNA, 22 bp, Homo sapiens
ctctctttcattggtcgccttg

SEQ ID NO: 7058266 - DNA, 22 bp, Homo sapiens
ctctcttcccgtgagtgttgca

SEQ ID NO: 7058267 - DNA, 22 bp, Homo sapiens
ctctctgttatgctttcatgaa

SEQ ID NO: 7058268 - DNA, 22 bp, Homo sapiens
ctctctgttatgctttcatgaa

SEQ ID NO: 7058269 - DNA, 22 bp, Homo sapiens
ctctctggtttcagcgaagggg

SEQ ID NO: 7058270 - DNA, 22 bp, Homo sapiens
ctctctgtggtggctgtcccat

SEQ ID NO: 7058271 - DNA, 22 bp, Homo sapiens
ctctctgtggtggctgtcccat

SEQ ID NO: 7058272 - DNA, 22 bp, Homo sapiens
ctctctgtggtggctgtcccat

SEQ ID NO: 7058273 - DNA, 22 bp, Homo sapiens
tttctcaagttcagatatttga

SEQ ID NO: 7058274 - DNA, 22 bp, Homo sapiens
tttctcaagttcagatatttga

SEQ ID NO: 7058275 - DNA, 22 bp, Homo sapiens
tttctcaagttcagatatttga

SEQ ID NO: 7058276 - DNA, 22 bp, Homo sapiens
tttctcaagttcagatatttga

SEQ ID NO: 7058277 - DNA, 19 bp, Homo sapiens
ctctctggcggtgtctgcg

SEQ ID NO: 7058278 - DNA, 22 bp, Homo sapiens
tttctcaactgtattatgcaga

SEQ ID NO: 7058279 - DNA, 22 bp, Homo sapiens
tttctcaaggtgtcatgtattt

SEQ ID NO: 7058280 - DNA, 22 bp, Homo sapiens
tttctcaaggtgtcatgtattt

SEQ ID NO: 7058281 - DNA, 22 bp, Homo sapiens
tttctcaagtactgcacatgaa

SEQ ID NO: 7058282 - DNA, 22 bp, Homo sapiens
tttctattttaaaggcatatgg

SEQ ID NO: 7058283 - DNA, 22 bp, Homo sapiens
tttctacatgtcaatccaaacc

SEQ ID NO: 7058284 - DNA, 22 bp, Homo sapiens
tttctcaaatactgttccagga

SEQ ID NO: 7058285 - DNA, 22 bp, Homo sapiens
tttctcaacctcaacactattt

SEQ ID NO: 7058286 - DNA, 22 bp, Homo sapiens
tttccaagctgtcttggcccac

SEQ ID NO: 7058287 - DNA, 22 bp, Homo sapiens
tttcattacgtgtttgacttgt

SEQ ID NO: 7058288 - DNA, 22 bp, Homo sapiens
tttctacaacacttctgaatct

SEQ ID NO: 7058289 - DNA, 22 bp, Homo sapiens
tttctacacttcgtggtgtttt

SEQ ID NO: 7058290 - DNA, 22 bp, Homo sapiens
tttctacagctggtgcaacttt

SEQ ID NO: 7058291 - DNA, 22 bp, Homo sapiens
tttcagaaattatattagatgc

SEQ ID NO: 7058292 - DNA, 22 bp, Homo sapiens
tttcagaaccgctaaaataaat

SEQ ID NO: 7058293 - DNA, 22 bp, Homo sapiens
tttcagaaggggagaaaggtca

SEQ ID NO: 7058294 - DNA, 22 bp, Homo sapiens
tttattcatcatctgttcatat

SEQ ID NO: 7058295 - DNA, 22 bp, Homo sapiens
ctccttcctgcagatctgagat

SEQ ID NO: 7058296 - DNA, 19 bp, Homo sapiens
ctccttccctggtttctgt

SEQ ID NO: 7058297 - DNA, 23 bp, Homo sapiens
tttcagaagtggtcctaggaagc

SEQ ID NO: 7058298 - DNA, 22 bp, Homo sapiens
tttatgtaagtggaatgatgcc

SEQ ID NO: 7058299 - DNA, 22 bp, Homo sapiens
tttattcactggggtctgcccg

SEQ ID NO: 7058300 - DNA, 22 bp, Homo sapiens
tttattcacttcagtgccaaag

SEQ ID NO: 7058301 - DNA, 22 bp, Homo sapiens
tttatgcagcctcagtatcaga

SEQ ID NO: 7058302 - DNA, 23 bp, Homo sapiens
tttatgcagcatgtagaacatgg

SEQ ID NO: 7058303 - DNA, 21 bp, Homo sapiens
tttatgcagataatgctattt

SEQ ID NO: 7058304 - DNA, 22 bp, Homo sapiens
tttatgattattttaaagcagc

SEQ ID NO: 7058305 - DNA, 23 bp, Homo sapiens
tttatattcctaatgtcttgagc

SEQ ID NO: 7058306 - DNA, 22 bp, Homo sapiens
ctccaggccagggaagtggaca

SEQ ID NO: 7058307 - DNA, 22 bp, Homo sapiens
ctccaggactgaggacagagct

SEQ ID NO: 7058308 - DNA, 22 bp, Homo sapiens
ttctggaagctggaaaaggcaa

SEQ ID NO: 7058309 - DNA, 22 bp, Homo sapiens
ttctggaagctgggcagcaccc

SEQ ID NO: 7058310 - DNA, 22 bp, Homo sapiens
ttctggaaggcagggagaaccc

SEQ ID NO: 7058311 - DNA, 22 bp, Homo sapiens
ttctggaagggtggagtagctt

SEQ ID NO: 7058312 - DNA, 22 bp, Homo sapiens
ttctggaagctgcaggtggccg

SEQ ID NO: 7058313 - DNA, 22 bp, Homo sapiens
ttctggaagccatgggaacagg

SEQ ID NO: 7058314 - DNA, 22 bp, Homo sapiens
ttctggaagccccagagtcaga

SEQ ID NO: 7058315 - DNA, 23 bp, Homo sapiens
ttctgcatgtttcagagctggga

SEQ ID NO: 7058316 - DNA, 22 bp, Homo sapiens
ttctggaaccaacatgccagtt

SEQ ID NO: 7058317 - DNA, 22 bp, Homo sapiens
ttctggaaccagcctgcctggg

SEQ ID NO: 7058318 - DNA, 22 bp, Homo sapiens
ttctgcatggagaaactgagtc

SEQ ID NO: 7058319 - DNA, 22 bp, Homo sapiens
ttctatttccagtccttcagag

SEQ ID NO: 7058320 - DNA, 22 bp, Homo sapiens
ttctattgcacacaaataatta

SEQ ID NO: 7058321 - DNA, 22 bp, Homo sapiens
ttctatgtcagtgtgctctgtg

SEQ ID NO: 7058322 - DNA, 22 bp, Homo sapiens
ttctatgttagtatgggtctcc

SEQ ID NO: 7058323 - DNA, 22 bp, Homo sapiens
ttctatgtgttgacaagcctga

SEQ ID NO: 7058324 - DNA, 22 bp, Homo sapiens
ttctatttcttaatcttggctg

SEQ ID NO: 7058325 - DNA, 22 bp, Homo sapiens
ttctatttcttaatcttggctg

SEQ ID NO: 7058326 - DNA, 22 bp, Homo sapiens
ttctgcagcccaacagtagttt

SEQ ID NO: 7058327 - DNA, 22 bp, Homo sapiens
ttctgcaggagccctagtgtat

SEQ ID NO: 7058328 - DNA, 22 bp, Homo sapiens
ttctgcaggagccctagtgtat

SEQ ID NO: 7058329 - DNA, 22 bp, Homo sapiens
ttctgcaggatgctctggtggt

SEQ ID NO: 7058330 - DNA, 22 bp, Homo sapiens
ttctgcagtgtgcagggcctgt

SEQ ID NO: 7058331 - DNA, 22 bp, Homo sapiens
ttctgcatacactgaatgtagt

SEQ ID NO: 7058332 - DNA, 22 bp, Homo sapiens
ttctatgattcatttagaagtt

SEQ ID NO: 7058333 - DNA, 22 bp, Homo sapiens
ctaaaaatccacactaggtgaa

SEQ ID NO: 7058334 - DNA, 22 bp, Homo sapiens
cgttctctcatgatcttcccga

SEQ ID NO: 7058335 - DNA, 22 bp, Homo sapiens
cgtgtgtgtacctgcgcattta

SEQ ID NO: 7058336 - DNA, 22 bp, Homo sapiens
cgtgtctgggatagcagaagta

SEQ ID NO: 7058337 - DNA, 22 bp, Homo sapiens
cgtgtctgggctcccatggcag

SEQ ID NO: 7058338 - DNA, 22 bp, Homo sapiens
cgtgtctgtatgtcaatcagct

SEQ ID NO: 7058339 - DNA, 23 bp, Homo sapiens
cgtgtctgtgggcgatccggcct

SEQ ID NO: 7058340 - DNA, 22 bp, Homo sapiens
cgtgtctgtgtatgcaggccgt

SEQ ID NO: 7058341 - DNA, 22 bp, Homo sapiens
cgtgtggtcccggcaaggcaag

SEQ ID NO: 7058342 - DNA, 20 bp, Homo sapiens
cgtgtgtggctattttgggt

SEQ ID NO: 7058343 - DNA, 22 bp, Homo sapiens
ttctttctgtccataatgagac

SEQ ID NO: 7058344 - DNA, 22 bp, Homo sapiens
ctcagaaagggttgctgagggc

SEQ ID NO: 7058345 - DNA, 22 bp, Homo sapiens
ctcagaaaggtgccatttatgt

SEQ ID NO: 7058346 - DNA, 22 bp, Homo sapiens
ctcagaaagtgacaggggggtg

SEQ ID NO: 7058347 - DNA, 21 bp, Homo sapiens
ctcagagaaatgtctgggagc

SEQ ID NO: 7058348 - DNA, 22 bp, Homo sapiens
ctcagagaagatggatgaggta

SEQ ID NO: 7058349 - DNA, 22 bp, Homo sapiens
ctcagagaagtctttgctaaac

SEQ ID NO: 7058350 - DNA, 22 bp, Homo sapiens
ttctttctctactagcagagct

SEQ ID NO: 7058351 - DNA, 21 bp, Homo sapiens
ctcagagacaaatgccatccc

SEQ ID NO: 7058352 - DNA, 22 bp, Homo sapiens
ctcagagaggcagtggaagtca

SEQ ID NO: 7058353 - DNA, 22 bp, Homo sapiens
ctcagagagggcaccagggcca

SEQ ID NO: 7058354 - DNA, 19 bp, Homo sapiens
ctcagagaggggcagtgcc

SEQ ID NO: 7058355 - DNA, 17 bp, Homo sapiens
ctcagagagggtaagta

SEQ ID NO: 7058356 - DNA, 22 bp, Homo sapiens
ctcagagaggttgaacaacttg

SEQ ID NO: 7058357 - DNA, 22 bp, Homo sapiens
ctcagagagtgaattcctgcct

SEQ ID NO: 7058358 - DNA, 22 bp, Homo sapiens
ctcagagagttaagtgaattac

SEQ ID NO: 7058359 - DNA, 18 bp, Homo sapiens
ctcagagatgcccttatt

SEQ ID NO: 7058360 - DNA, 17 bp, Homo sapiens
ctcagagcaggacagaa

SEQ ID NO: 7058361 - DNA, 21 bp, Homo sapiens
ctcagagcagttcagagggat

SEQ ID NO: 7058362 - DNA, 22 bp, Homo sapiens
ctcagagccagttagcaggtgc

SEQ ID NO: 7058363 - DNA, 22 bp, Homo sapiens
ctcagagctgaggccagggaca

SEQ ID NO: 7058364 - DNA, 22 bp, Homo sapiens
ctcagaggaggcagggtgtgcc

SEQ ID NO: 7058365 - DNA, 22 bp, Homo sapiens
ctatacactttttgaaaataga

SEQ ID NO: 7058366 - DNA, 22 bp, Homo sapiens
ctataaatctacccagcattgg

SEQ ID NO: 7058367 - DNA, 22 bp, Homo sapiens
ctatacagtaaccacagtgatt

SEQ ID NO: 7058368 - DNA, 22 bp, Homo sapiens
ctatacagcagcttactagtta

SEQ ID NO: 7058369 - DNA, 18 bp, Homo sapiens
ctcaccattctgcccaat

SEQ ID NO: 7058370 - DNA, 22 bp, Homo sapiens
ctcacccatatctccatgactc

SEQ ID NO: 7058371 - DNA, 22 bp, Homo sapiens
ctcactcagacatccagtgcag

SEQ ID NO: 7058372 - DNA, 22 bp, Homo sapiens
ctcactgactgcaagtcaagtt

SEQ ID NO: 7058373 - DNA, 22 bp, Homo sapiens
ctcactgcaagctcagcctccc

SEQ ID NO: 7058374 - DNA, 20 bp, Homo sapiens
ttggctctgatcagtggagc

SEQ ID NO: 7058375 - DNA, 22 bp, Homo sapiens
ttggctgccttcacccctggcc

SEQ ID NO: 7058376 - DNA, 22 bp, Homo sapiens
ctccaggaccagggctcctgga

SEQ ID NO: 7058377 - DNA, 22 bp, Homo sapiens
ctccaggacccagtggctccag

SEQ ID NO: 7058378 - DNA, 22 bp, Homo sapiens
ctccaggactcaggcccctggg

SEQ ID NO: 7058379 - DNA, 19 bp, Homo sapiens
ctcagtctggctctgcctg

SEQ ID NO: 7058380 - DNA, 22 bp, Homo sapiens
ctcagtctgtcttgtctgtgtt

SEQ ID NO: 7058381 - DNA, 22 bp, Homo sapiens
ttggaagattctgtgtctggtg

SEQ ID NO: 7058382 - DNA, 19 bp, Homo sapiens
ttggaaggagccagagtgg

SEQ ID NO: 7058383 - DNA, 22 bp, Homo sapiens
ttggaaggatttagagatgtct

SEQ ID NO: 7058384 - DNA, 22 bp, Homo sapiens
ttggaaggccctgcctagcagg

SEQ ID NO: 7058385 - DNA, 20 bp, Homo sapiens
ttggaaggtggagaagagga

SEQ ID NO: 7058386 - DNA, 22 bp, Homo sapiens
ttggagggactgagcttcagtc

SEQ ID NO: 7058387 - DNA, 22 bp, Homo sapiens
ttggaggggccactgcagagct

SEQ ID NO: 7058388 - DNA, 22 bp, Homo sapiens
ttggagggtcttccacagccat

SEQ ID NO: 7058389 - DNA, 22 bp, Homo sapiens
ttggagtgacagatgaggaaac

SEQ ID NO: 7058390 - DNA, 22 bp, Homo sapiens
ttggatccatctcaggcatagg

SEQ ID NO: 7058391 - DNA, 22 bp, Homo sapiens
ctcaggtcacggatctgagctg

SEQ ID NO: 7058392 - DNA, 22 bp, Homo sapiens
ctcaggtcgctatttctcttac

SEQ ID NO: 7058393 - DNA, 22 bp, Homo sapiens
ctcagggaattatttctgtcct

SEQ ID NO: 7058394 - DNA, 22 bp, Homo sapiens
ctcagggaattgaatctccttg

SEQ ID NO: 7058395 - DNA, 23 bp, Homo sapiens
ctcagggatagaaaggaagacag

SEQ ID NO: 7058396 - DNA, 22 bp, Homo sapiens
ctcagggatgggcagatgttaa

SEQ ID NO: 7058397 - DNA, 22 bp, Homo sapiens
ctcagggatggtgaagcaccca

SEQ ID NO: 7058398 - DNA, 22 bp, Homo sapiens
ttgcatatatttctaaggaggt

SEQ ID NO: 7058399 - DNA, 22 bp, Homo sapiens
ttgcatatcctccaacacatgg

SEQ ID NO: 7058400 - DNA, 22 bp, Homo sapiens
ttgcatatcctccaacacatgg

SEQ ID NO: 7058401 - DNA, 22 bp, Homo sapiens
ttgcatatcctccaacacatgg

SEQ ID NO: 7058402 - DNA, 22 bp, Homo sapiens
ttgcatatgaagctgacttaaa

SEQ ID NO: 7058403 - DNA, 21 bp, Homo sapiens
ttgcccctgagtttttctgag

SEQ ID NO: 7058404 - DNA, 22 bp, Homo sapiens
ttgccctgaagaacgtcccaga

SEQ ID NO: 7058405 - DNA, 22 bp, Homo sapiens
ttgccctgcctccctgaggtga

SEQ ID NO: 7058406 - DNA, 22 bp, Homo sapiens
ttgccctgcgggtcctgcgcaa

SEQ ID NO: 7058407 - DNA, 22 bp, Homo sapiens
ttgccctgcgttaccatctctt

SEQ ID NO: 7058408 - DNA, 22 bp, Homo sapiens
ttgccctgtctcactatgttaa

SEQ ID NO: 7058409 - DNA, 22 bp, Homo sapiens
ttgcataaaagagtatatctta

SEQ ID NO: 7058410 - DNA, 22 bp, Homo sapiens
ttgcataaagattttattgcat

SEQ ID NO: 7058411 - DNA, 22 bp, Homo sapiens
ttgcataaatgcttaaaatttg

SEQ ID NO: 7058412 - DNA, 23 bp, Homo sapiens
ttgcatagacatcctcatagatt

SEQ ID NO: 7058413 - DNA, 22 bp, Homo sapiens
ctcaggagtagttcagcagctg

SEQ ID NO: 7058414 - DNA, 22 bp, Homo sapiens
ctcaggaggtggtagaggccct

SEQ ID NO: 7058415 - DNA, 22 bp, Homo sapiens
ctcaggaggtggtagaggccct

SEQ ID NO: 7058416 - DNA, 22 bp, Homo sapiens
ctcaggagatgacagaaggtat

SEQ ID NO: 7058417 - DNA, 22 bp, Homo sapiens
ctcaggagatgacagaaggtat

SEQ ID NO: 7058418 - DNA, 22 bp, Homo sapiens
ctcaggacccggtccaggtggg

SEQ ID NO: 7058419 - DNA, 22 bp, Homo sapiens
ctcagccccaatttgccctctt

SEQ ID NO: 7058420 - DNA, 22 bp, Homo sapiens
ctcagccccaatttgccctctt

SEQ ID NO: 7058421 - DNA, 22 bp, Homo sapiens
ctcagctggcaattctggctcc

SEQ ID NO: 7058422 - DNA, 19 bp, Homo sapiens
ctcagctgtagctcatgtg

SEQ ID NO: 7058423 - DNA, 22 bp, Homo sapiens
ctcagaggcaagcaaggagctg

SEQ ID NO: 7058424 - DNA, 23 bp, Homo sapiens
ctcagaggcctgtccagggtggt

SEQ ID NO: 7058425 - DNA, 23 bp, Homo sapiens
ctcagaggcctgtccagggtggt

SEQ ID NO: 7058426 - DNA, 22 bp, Homo sapiens
ctcaggaaaggccatgcaaggg

SEQ ID NO: 7058427 - DNA, 22 bp, Homo sapiens
ctcaggaaccgcggcagcagcc

SEQ ID NO: 7058428 - DNA, 22 bp, Homo sapiens
ttataacaacagtttactttaa

SEQ ID NO: 7058429 - DNA, 22 bp, Homo sapiens
ttataaagtgagaagtgctatg

SEQ ID NO: 7058430 - DNA, 23 bp, Homo sapiens
ttataaatattttcaggtgtgtt

SEQ ID NO: 7058431 - DNA, 22 bp, Homo sapiens
ttatatttctggtagccttcag

SEQ ID NO: 7058432 - DNA, 22 bp, Homo sapiens
ttatcacttatgagctttttgc

SEQ ID NO: 7058433 - DNA, 22 bp, Homo sapiens
ttatcattgtcgcagtctaatt

SEQ ID NO: 7058434 - DNA, 22 bp, Homo sapiens
ttatcattgtcgcagtctaatt

SEQ ID NO: 7058435 - DNA, 22 bp, Homo sapiens
ttatccaaactggtgaatcatt

SEQ ID NO: 7058436 - DNA, 22 bp, Homo sapiens
ttagttttctcatctatctcac

SEQ ID NO: 7058437 - DNA, 22 bp, Homo sapiens
ttataaagattgttatgtatct

SEQ ID NO: 7058438 - DNA, 22 bp, Homo sapiens
ccttgcctcattgtgcttctcc

SEQ ID NO: 7058439 - DNA, 22 bp, Homo sapiens
ccttgcatatattatatctttg

SEQ ID NO: 7058440 - DNA, 22 bp, Homo sapiens
ccttgagccagggagctggcag

SEQ ID NO: 7058441 - DNA, 22 bp, Homo sapiens
ttagcactggatttcatcagaa

SEQ ID NO: 7058442 - DNA, 21 bp, Homo sapiens
ttagcaaagcaaacacatgct

SEQ ID NO: 7058443 - DNA, 22 bp, Homo sapiens
ttagacatagaatattgtctag

SEQ ID NO: 7058444 - DNA, 22 bp, Homo sapiens
ttacatacaaaggctgggttat

SEQ ID NO: 7058445 - DNA, 22 bp, Homo sapiens
ttacatagttaaatagtacagc

SEQ ID NO: 7058446 - DNA, 22 bp, Homo sapiens
ccttcacacaggtagaagcaga

SEQ ID NO: 7058447 - DNA, 22 bp, Homo sapiens
ttacaaagcgttgagacaagta

SEQ ID NO: 7058448 - DNA, 22 bp, Homo sapiens
ttacaaagcgctttacctctga

SEQ ID NO: 7058449 - DNA, 22 bp, Homo sapiens
ttacaaagcaggtcagctgaaa

SEQ ID NO: 7058450 - DNA, 22 bp, Homo sapiens
ttacaaagcaggtcagctgaaa

SEQ ID NO: 7058451 - DNA, 22 bp, Homo sapiens
ttacaaagattatattcagtta

SEQ ID NO: 7058452 - DNA, 22 bp, Homo sapiens
ccttaaattctccatttgaaag

SEQ ID NO: 7058453 - DNA, 22 bp, Homo sapiens
ccttaaaagaactatctcttct

SEQ ID NO: 7058454 - DNA, 22 bp, Homo sapiens
ttaagattttcttcagtattat

SEQ ID NO: 7058455 - DNA, 22 bp, Homo sapiens
ttaagatttgtagagaaaaagc

SEQ ID NO: 7058456 - DNA, 22 bp, Homo sapiens
ttaagaggtggtcgtgtctgtg

SEQ ID NO: 7058457 - DNA, 22 bp, Homo sapiens
ttaagaggagatcatactggag

SEQ ID NO: 7058458 - DNA, 22 bp, Homo sapiens
ttaagaggagatcatactggag

SEQ ID NO: 7058459 - DNA, 22 bp, Homo sapiens
ttaagagggtgatgctagcatt

SEQ ID NO: 7058460 - DNA, 22 bp, Homo sapiens
ttaagagggtgatgctagcatt

SEQ ID NO: 7058461 - DNA, 22 bp, Homo sapiens
ttaagaggtgaggcctttaaga

SEQ ID NO: 7058462 - DNA, 22 bp, Homo sapiens
ttaagaggtgaggcctttaaga

SEQ ID NO: 7058463 - DNA, 22 bp, Homo sapiens
ttaagaggtggtcgtgtctgtg

SEQ ID NO: 7058464 - DNA, 22 bp, Homo sapiens
ttaaattccagcctcataatag

SEQ ID NO: 7058465 - DNA, 22 bp, Homo sapiens
ttaaattatttctagtgaggtg

SEQ ID NO: 7058466 - DNA, 22 bp, Homo sapiens
ttaaattattgagggattgtca

SEQ ID NO: 7058467 - DNA, 22 bp, Homo sapiens
ttaaattatttctagtgaggtg

SEQ ID NO: 7058468 - DNA, 22 bp, Homo sapiens
ttaaattccagcctcataatag

SEQ ID NO: 7058469 - DNA, 22 bp, Homo sapiens
ttaaattgtcatttgagcaatg

SEQ ID NO: 7058470 - DNA, 22 bp, Homo sapiens
ttaaatttctacgtgatccagg

SEQ ID NO: 7058471 - DNA, 22 bp, Homo sapiens
tgtcaatagttttgagttctct

SEQ ID NO: 7058472 - DNA, 22 bp, Homo sapiens
tgtcaatagttttgagttctct

SEQ ID NO: 7058473 - DNA, 21 bp, Homo sapiens
tgtcagagcttgtaggacatt

SEQ ID NO: 7058474 - DNA, 21 bp, Homo sapiens
tgtcagcaacaatactttctc

SEQ ID NO: 7058475 - DNA, 22 bp, Homo sapiens
tgtcagcacatctgtaatcaca

SEQ ID NO: 7058476 - DNA, 22 bp, Homo sapiens
tgtcagcagaaatctggtctgc

SEQ ID NO: 7058477 - DNA, 22 bp, Homo sapiens
tgtcagcagaagtggtgcactc

SEQ ID NO: 7058478 - DNA, 22 bp, Homo sapiens
tgtcagcagctggtttgctgtt

SEQ ID NO: 7058479 - DNA, 22 bp, Homo sapiens
tgtcagctcccagtcagagaga

SEQ ID NO: 7058480 - DNA, 22 bp, Homo sapiens
ttaaattagtcaagcttctctg

SEQ ID NO: 7058481 - DNA, 22 bp, Homo sapiens
ttaaattagtcaagcttctctg

SEQ ID NO: 7058482 - DNA, 21 bp, Homo sapiens
cctttttgcttatggacagac

SEQ ID NO: 7058483 - DNA, 22 bp, Homo sapiens
cgagagatgggttggcaggggc

SEQ ID NO: 7058484 - DNA, 22 bp, Homo sapiens
cgagagttagctaggagtcaca

SEQ ID NO: 7058485 - DNA, 22 bp, Homo sapiens
ccttttcttgccactgactcgg

SEQ ID NO: 7058486 - DNA, 22 bp, Homo sapiens
ccttttgaaggtgttgttaagt

SEQ ID NO: 7058487 - DNA, 22 bp, Homo sapiens
ccttttgctctcccatccagaa

SEQ ID NO: 7058488 - DNA, 22 bp, Homo sapiens
cctttttcaatatagaattgca

SEQ ID NO: 7058489 - DNA, 22 bp, Homo sapiens
cctttttccctggagggacagc

SEQ ID NO: 7058490 - DNA, 22 bp, Homo sapiens
cctttttccctggagggacagc

SEQ ID NO: 7058491 - DNA, 22 bp, Homo sapiens
ttatccaacatgacttatgtcc

SEQ ID NO: 7058492 - DNA, 22 bp, Homo sapiens
ttatttattcattctgtctgtc

SEQ ID NO: 7058493 - DNA, 22 bp, Homo sapiens
ttatttattgtgtacctactgt

SEQ ID NO: 7058494 - DNA, 22 bp, Homo sapiens
ttatttattgtgtacctactgt

SEQ ID NO: 7058495 - DNA, 22 bp, Homo sapiens
ttatttattgtgtacctactgt

SEQ ID NO: 7058496 - DNA, 22 bp, Homo sapiens
ttatttcatataatgttatcaa

SEQ ID NO: 7058497 - DNA, 22 bp, Homo sapiens
ttatttcatgtaaaatttatgt

SEQ ID NO: 7058498 - DNA, 22 bp, Homo sapiens
cgctctggagaatagtagcttt

SEQ ID NO: 7058499 - DNA, 19 bp, Homo sapiens
cgctctgggtttcgtgtca

SEQ ID NO: 7058500 - DNA, 22 bp, Homo sapiens
cgctggccatagcctcctgtgt

SEQ ID NO: 7058501 - DNA, 22 bp, Homo sapiens
cggggagggcagaggctccctc

SEQ ID NO: 7058502 - DNA, 22 bp, Homo sapiens
cgggcaaggcgagactaggccc

SEQ ID NO: 7058503 - DNA, 22 bp, Homo sapiens
cgggctggctgcagctgctgga

SEQ ID NO: 7058504 - DNA, 22 bp, Homo sapiens
cggggaggcttcggattaaagc

SEQ ID NO: 7058505 - DNA, 22 bp, Homo sapiens
cggggcctagctgcacaccctc

SEQ ID NO: 7058506 - DNA, 22 bp, Homo sapiens
cggggcctagtctacctcggca

SEQ ID NO: 7058507 - DNA, 22 bp, Homo sapiens
cggggccctggggctgaaggtc

SEQ ID NO: 7058508 - DNA, 22 bp, Homo sapiens
cgtgagcaaaatggacactccc

SEQ ID NO: 7058509 - DNA, 22 bp, Homo sapiens
cgtgggagtggtgggtgctcag

SEQ ID NO: 7058510 - DNA, 22 bp, Homo sapiens
cggcaggacctcatttccttct

SEQ ID NO: 7058511 - DNA, 22 bp, Homo sapiens
cggcagagcttcctgctcagcg

SEQ ID NO: 7058512 - DNA, 18 bp, Homo sapiens
cggcagagtgcttctagc

SEQ ID NO: 7058513 - DNA, 18 bp, Homo sapiens
cggcagagtgcttctagc

SEQ ID NO: 7058514 - DNA, 22 bp, Homo sapiens
cggcagagtgtgtgcgtgcatg

SEQ ID NO: 7058515 - DNA, 22 bp, Homo sapiens
cggcagagtgtgtgcgtgcatg

SEQ ID NO: 7058516 - DNA, 18 bp, Homo sapiens
cggatcatgcgctgaggc

SEQ ID NO: 7058517 - DNA, 22 bp, Homo sapiens
cggatcatgtgacctttgagtg

SEQ ID NO: 7058518 - DNA, 22 bp, Homo sapiens
cggcagagacggcgctttgaac

SEQ ID NO: 7058519 - DNA, 22 bp, Homo sapiens
cggcagagacggcgctttgaac

SEQ ID NO: 7058520 - DNA, 22 bp, Homo sapiens
cggcagagccctgagtcagcct

SEQ ID NO: 7058521 - DNA, 22 bp, Homo sapiens
cggcagagccctgagtcagcct

SEQ ID NO: 7058522 - DNA, 22 bp, Homo sapiens
cggcagagcggcgagcccctcc

SEQ ID NO: 7058523 - DNA, 22 bp, Homo sapiens
cggcagagcggcgagcccctcc

SEQ ID NO: 7058524 - DNA, 22 bp, Homo sapiens
cggcagagcttcctgctcagcg

SEQ ID NO: 7058525 - DNA, 22 bp, Homo sapiens
cggagtcttgctatgttgccca

SEQ ID NO: 7058526 - DNA, 22 bp, Homo sapiens
cggagtcttgctatgttgccca

SEQ ID NO: 7058527 - DNA, 22 bp, Homo sapiens
ttcaaatggttagactgttagc

SEQ ID NO: 7058528 - DNA, 21 bp, Homo sapiens
ttcaaagtttgcctaaagatt

SEQ ID NO: 7058529 - DNA, 22 bp, Homo sapiens
ttcaaatacattctttgccact

SEQ ID NO: 7058530 - DNA, 22 bp, Homo sapiens
tagcattatctgtcttatcatt

SEQ ID NO: 7058531 - DNA, 22 bp, Homo sapiens
tagcaaggacaacatatgagag

SEQ ID NO: 7058532 - DNA, 22 bp, Homo sapiens
tagcaaggtgaagtatgggtga

SEQ ID NO: 7058533 - DNA, 22 bp, Homo sapiens
cagggcaaagagagcacatgct

SEQ ID NO: 7058534 - DNA, 22 bp, Homo sapiens
cagggatggcgctggctgcccg

SEQ ID NO: 7058535 - DNA, 22 bp, Homo sapiens
tagataatttggcatcatattg

SEQ ID NO: 7058536 - DNA, 20 bp, Homo sapiens
cagggcacactgcagcctcg

SEQ ID NO: 7058537 - DNA, 22 bp, Homo sapiens
cagggcacttaaattgcctcgt

SEQ ID NO: 7058538 - DNA, 22 bp, Homo sapiens
tagataaattagaaagtttact

SEQ ID NO: 7058539 - DNA, 22 bp, Homo sapiens
tagaatatgtggtaggatctgg

SEQ ID NO: 7058540 - DNA, 22 bp, Homo sapiens
caggctgggcagcctccccggc

SEQ ID NO: 7058541 - DNA, 22 bp, Homo sapiens
caggctgggcagcctccccggc

SEQ ID NO: 7058542 - DNA, 22 bp, Homo sapiens
caggctgggctccggagataaa

SEQ ID NO: 7058543 - DNA, 22 bp, Homo sapiens
caggctgggctccggagataaa

SEQ ID NO: 7058544 - DNA, 22 bp, Homo sapiens
caggctgggctggtgttagagt

SEQ ID NO: 7058545 - DNA, 22 bp, Homo sapiens
caggctgggctggtgttagagt

SEQ ID NO: 7058546 - DNA, 22 bp, Homo sapiens
caggctggtcccagagcattgc

SEQ ID NO: 7058547 - DNA, 22 bp, Homo sapiens
caggctggtcccagagcattgc

SEQ ID NO: 7058548 - DNA, 22 bp, Homo sapiens
tagacattttctcaacatctct

SEQ ID NO: 7058549 - DNA, 22 bp, Homo sapiens
tagaatatgattaattttctta

SEQ ID NO: 7058550 - DNA, 22 bp, Homo sapiens
tagaatatacactacagcttaa

SEQ ID NO: 7058551 - DNA, 22 bp, Homo sapiens
caggctggagtgcagtggtgcc

SEQ ID NO: 7058552 - DNA, 22 bp, Homo sapiens
caggctggagtgcagtggtgcc

SEQ ID NO: 7058553 - DNA, 22 bp, Homo sapiens
tagaacataagtcattcatttg

SEQ ID NO: 7058554 - DNA, 22 bp, Homo sapiens
tagaacataagtcattcatttg

SEQ ID NO: 7058555 - DNA, 22 bp, Homo sapiens
caggctggagtgcagtggcgcc

SEQ ID NO: 7058556 - DNA, 22 bp, Homo sapiens
caggctggagtgcagtggcgcc

SEQ ID NO: 7058557 - DNA, 22 bp, Homo sapiens
caggctggagtgcagtggcgct

SEQ ID NO: 7058558 - DNA, 22 bp, Homo sapiens
caggctggagtgcagtggcgct

SEQ ID NO: 7058559 - DNA, 22 bp, Homo sapiens
caggctggagtgcagtggcgct

SEQ ID NO: 7058560 - DNA, 22 bp, Homo sapiens
caggctggagtgcagtggggcg

SEQ ID NO: 7058561 - DNA, 22 bp, Homo sapiens
caggctggagtgcagtggggcg

SEQ ID NO: 7058562 - DNA, 22 bp, Homo sapiens
caggctggagtgagtgtagtgg

SEQ ID NO: 7058563 - DNA, 22 bp, Homo sapiens
caggctggagtgagtgtagtgg

SEQ ID NO: 7058564 - DNA, 22 bp, Homo sapiens
caggctggagtacaattgtgtg

SEQ ID NO: 7058565 - DNA, 22 bp, Homo sapiens
caggctggagtgagtgtagtgg

SEQ ID NO: 7058566 - DNA, 22 bp, Homo sapiens
tactgtctgggttcccaagcaa

SEQ ID NO: 7058567 - DNA, 22 bp, Homo sapiens
tactgtgaatacaaaataaatt

SEQ ID NO: 7058568 - DNA, 22 bp, Homo sapiens
tactgtgacagagtacttaaac

SEQ ID NO: 7058569 - DNA, 22 bp, Homo sapiens
caggctggagtgcaatgacgcc

SEQ ID NO: 7058570 - DNA, 22 bp, Homo sapiens
caggctggagtgcaatgacgcc

SEQ ID NO: 7058571 - DNA, 22 bp, Homo sapiens
caggctggagtgcaatggcaca

SEQ ID NO: 7058572 - DNA, 22 bp, Homo sapiens
caggctggagtgcaatggcaca

SEQ ID NO: 7058573 - DNA, 22 bp, Homo sapiens
caggctggagtgcaatggtgct

SEQ ID NO: 7058574 - DNA, 22 bp, Homo sapiens
caggctggagtgcaatggtgct

SEQ ID NO: 7058575 - DNA, 22 bp, Homo sapiens
caggctggagtgcagtggcgcc

SEQ ID NO: 7058576 - DNA, 22 bp, Homo sapiens
tactgtctctgccctggccagg

SEQ ID NO: 7058577 - DNA, 22 bp, Homo sapiens
tactgtctggagttgccaaagg

SEQ ID NO: 7058578 - DNA, 22 bp, Homo sapiens
tactcagagtcattgcccttct

SEQ ID NO: 7058579 - DNA, 22 bp, Homo sapiens
tactatttggaattttaaattg

SEQ ID NO: 7058580 - DNA, 22 bp, Homo sapiens
tactatttttgcaacgtataca

SEQ ID NO: 7058581 - DNA, 22 bp, Homo sapiens
gtgaggggccaagagtagggca

SEQ ID NO: 7058582 - DNA, 22 bp, Homo sapiens
gtgaggggtggctgagcagttt

SEQ ID NO: 7058583 - DNA, 22 bp, Homo sapiens
tacctgaaccaagcccagctct

SEQ ID NO: 7058584 - DNA, 22 bp, Homo sapiens
gtgaggggagtaaagccatgtt

SEQ ID NO: 7058585 - DNA, 22 bp, Homo sapiens
cagccctgtctatgactgatga

SEQ ID NO: 7058586 - DNA, 20 bp, Homo sapiens
cagccctgtgacctggccct

SEQ ID NO: 7058587 - DNA, 22 bp, Homo sapiens
cagggctcagggactgcagaaa

SEQ ID NO: 7058588 - DNA, 22 bp, Homo sapiens
cagggctcagggactgcagaaa

SEQ ID NO: 7058589 - DNA, 22 bp, Homo sapiens
cagggctcactcggctggcgtc

SEQ ID NO: 7058590 - DNA, 22 bp, Homo sapiens
cagggccttatcctgccattga

SEQ ID NO: 7058591 - DNA, 19 bp, Homo sapiens
taggaccctggtggccccc

SEQ ID NO: 7058592 - DNA, 19 bp, Homo sapiens
taggaccctggtggccccc

SEQ ID NO: 7058593 - DNA, 22 bp, Homo sapiens
taggacttggtgactctcaatg

SEQ ID NO: 7058594 - DNA, 22 bp, Homo sapiens
taggactttggcgtcagaactg

SEQ ID NO: 7058595 - DNA, 22 bp, Homo sapiens
taggagacattgatcccaagaa

SEQ ID NO: 7058596 - DNA, 22 bp, Homo sapiens
cagggcctggagctgggcctgc

SEQ ID NO: 7058597 - DNA, 22 bp, Homo sapiens
cagggcctggagctgggcctgc

SEQ ID NO: 7058598 - DNA, 22 bp, Homo sapiens
tagctttaagatgagatgtgga

SEQ ID NO: 7058599 - DNA, 22 bp, Homo sapiens
tagctttaataagctgctgaat

SEQ ID NO: 7058600 - DNA, 21 bp, Homo sapiens
tagctttaatattcccacatt

SEQ ID NO: 7058601 - DNA, 22 bp, Homo sapiens
tagctaccattattgagcacct

SEQ ID NO: 7058602 - DNA, 22 bp, Homo sapiens
tagctattgttggtagttaccc

SEQ ID NO: 7058603 - DNA, 22 bp, Homo sapiens
tagctatttggaaaattccaat

SEQ ID NO: 7058604 - DNA, 22 bp, Homo sapiens
cagggcaggaatttgacattgc

SEQ ID NO: 7058605 - DNA, 22 bp, Homo sapiens
tatcataagttaattaaacagt

SEQ ID NO: 7058606 - DNA, 22 bp, Homo sapiens
tatcataagttaattaaacagt

SEQ ID NO: 7058607 - DNA, 22 bp, Homo sapiens
tatcatctgcaaagcacatcta

SEQ ID NO: 7058608 - DNA, 22 bp, Homo sapiens
tatcattcttctcacctttgaa

SEQ ID NO: 7058609 - DNA, 22 bp, Homo sapiens
tatcattgtgttatttcttcca

SEQ ID NO: 7058610 - DNA, 22 bp, Homo sapiens
tatcatttaacagaatcattgc

SEQ ID NO: 7058611 - DNA, 22 bp, Homo sapiens
tatcatttaacagaatcattgc

SEQ ID NO: 7058612 - DNA, 22 bp, Homo sapiens
tatattgttggtgggaatataa

SEQ ID NO: 7058613 - DNA, 22 bp, Homo sapiens
caggggagttttatgcaacaga

SEQ ID NO: 7058614 - DNA, 22 bp, Homo sapiens
tagtgaaacctgacagatcatg

SEQ ID NO: 7058615 - DNA, 22 bp, Homo sapiens
tagggtagtaccatgctgccag

SEQ ID NO: 7058616 - DNA, 22 bp, Homo sapiens
cagggctccatgcagggactcc

SEQ ID NO: 7058617 - DNA, 21 bp, Homo sapiens
tagggcaggcattggaagaga

SEQ ID NO: 7058618 - DNA, 22 bp, Homo sapiens
tagggacactgctcatgagttc

SEQ ID NO: 7058619 - DNA, 21 bp, Homo sapiens
tagggcaggcattggaagaga

SEQ ID NO: 7058620 - DNA, 22 bp, Homo sapiens
tagggcaggggaggaatctgaa

SEQ ID NO: 7058621 - DNA, 22 bp, Homo sapiens
tagggcaggtgaagaaaagcta

SEQ ID NO: 7058622 - DNA, 22 bp, Homo sapiens
caggggaagatgccaagggaga

SEQ ID NO: 7058623 - DNA, 22 bp, Homo sapiens
caggggaaggagccttgaaact

SEQ ID NO: 7058624 - DNA, 18 bp, Homo sapiens
cagggctgtggggtcact

SEQ ID NO: 7058625 - DNA, 18 bp, Homo sapiens
cagggctgtggggtcact

SEQ ID NO: 7058626 - DNA, 22 bp, Homo sapiens
cagggctttcctgagaagtgat

SEQ ID NO: 7058627 - DNA, 22 bp, Homo sapiens
cagggctttgtgtgcctgggga

SEQ ID NO: 7058628 - DNA, 22 bp, Homo sapiens
cagggctttttattagctgcct

SEQ ID NO: 7058629 - DNA, 22 bp, Homo sapiens
tagggtggttagaaggagtatg

SEQ ID NO: 7058630 - DNA, 22 bp, Homo sapiens
tcacagttatagtctgtagaat

SEQ ID NO: 7058631 - DNA, 22 bp, Homo sapiens
tcacaagacagaaaacatttag

SEQ ID NO: 7058632 - DNA, 22 bp, Homo sapiens
cagtgaagtttaaagtgtagat

SEQ ID NO: 7058633 - DNA, 22 bp, Homo sapiens
cagtgagataccacagagcaaa

SEQ ID NO: 7058634 - DNA, 22 bp, Homo sapiens
cagtgaggaagctgtctggacc

SEQ ID NO: 7058635 - DNA, 22 bp, Homo sapiens
tcacacttcaaagggttagatc

SEQ ID NO: 7058636 - DNA, 22 bp, Homo sapiens
tatttgaaagtgtacaaaaact

SEQ ID NO: 7058637 - DNA, 22 bp, Homo sapiens
tatttcttttcgtgacttattg

SEQ ID NO: 7058638 - DNA, 22 bp, Homo sapiens
tcaatgactggtccaaggtggc

SEQ ID NO: 7058639 - DNA, 22 bp, Homo sapiens
tatttcttttcgtgacttattg

SEQ ID NO: 7058640 - DNA, 21 bp, Homo sapiens
tatttctttgactctctccct

SEQ ID NO: 7058641 - DNA, 22 bp, Homo sapiens
tatttctttcaggtatgtgttg

SEQ ID NO: 7058642 - DNA, 22 bp, Homo sapiens
tatttctttcaggtatgtgttg

SEQ ID NO: 7058643 - DNA, 22 bp, Homo sapiens
cagtcccagacccagaaggtgg

SEQ ID NO: 7058644 - DNA, 22 bp, Homo sapiens
cagtcccagaagagcctgggag

SEQ ID NO: 7058645 - DNA, 22 bp, Homo sapiens
cagtcccagacatagtaaggga

SEQ ID NO: 7058646 - DNA, 22 bp, Homo sapiens
cagtatatgctctttcatcaaa

SEQ ID NO: 7058647 - DNA, 18 bp, Homo sapiens
cagtcccaaaccttagga

SEQ ID NO: 7058648 - DNA, 19 bp, Homo sapiens
cagtcccaaattcttgtca

SEQ ID NO: 7058649 - DNA, 22 bp, Homo sapiens
cagtcccaaggaggaagcagtc

SEQ ID NO: 7058650 - DNA, 20 bp, Homo sapiens
cagtcccaatccagggccag

SEQ ID NO: 7058651 - DNA, 22 bp, Homo sapiens
cagtcccacaagatctccacaa

SEQ ID NO: 7058652 - DNA, 22 bp, Homo sapiens
cagtcccaccaggatcgctctt

SEQ ID NO: 7058653 - DNA, 22 bp, Homo sapiens
cagtcccactagtgccaatacc

SEQ ID NO: 7058654 - DNA, 22 bp, Homo sapiens
tatttccaagctgaatccaatg

SEQ ID NO: 7058655 - DNA, 22 bp, Homo sapiens
cagtaggaaggatgcagaaaaa

SEQ ID NO: 7058656 - DNA, 22 bp, Homo sapiens
cagtagtctttttcctcctaga

SEQ ID NO: 7058657 - DNA, 22 bp, Homo sapiens
caggttccagttgcagggactt

SEQ ID NO: 7058658 - DNA, 22 bp, Homo sapiens
caggtggtcaggcagatgggct

SEQ ID NO: 7058659 - DNA, 22 bp, Homo sapiens
caggtttagttccacacagctc

SEQ ID NO: 7058660 - DNA, 22 bp, Homo sapiens
caggtttctagttctaagaata

SEQ ID NO: 7058661 - DNA, 22 bp, Homo sapiens
tatttcatctggaacaaggtaa

SEQ ID NO: 7058662 - DNA, 22 bp, Homo sapiens
tatttcatgtgcaccataattc

SEQ ID NO: 7058663 - DNA, 22 bp, Homo sapiens
tatttcattctttatcaggagc

SEQ ID NO: 7058664 - DNA, 22 bp, Homo sapiens
tatttccaaaaaggccatattc

SEQ ID NO: 7058665 - DNA, 21 bp, Homo sapiens
cagtgccagccacaggacgcc

SEQ ID NO: 7058666 - DNA, 22 bp, Homo sapiens
cagtgcccaagatgtgccatgc

SEQ ID NO: 7058667 - DNA, 22 bp, Homo sapiens
cagtggctggttagggacagga

SEQ ID NO: 7058668 - DNA, 22 bp, Homo sapiens
cagtggctgtgaccagggacct

SEQ ID NO: 7058669 - DNA, 22 bp, Homo sapiens
cagtggcttctcatgtcattca

SEQ ID NO: 7058670 - DNA, 22 bp, Homo sapiens
cagtgggaatgaagtggaggcc

SEQ ID NO: 7058671 - DNA, 22 bp, Homo sapiens
cagtgggatatgggggcagcat

SEQ ID NO: 7058672 - DNA, 22 bp, Homo sapiens
cagtgggacatgggcactgggc

SEQ ID NO: 7058673 - DNA, 22 bp, Homo sapiens
cagtgggatatgggggcagcat

SEQ ID NO: 7058674 - DNA, 22 bp, Homo sapiens
cagtgggggtgaggccgaggta

SEQ ID NO: 7058675 - DNA, 22 bp, Homo sapiens
cagtggggaggccaggatagaa

SEQ ID NO: 7058676 - DNA, 22 bp, Homo sapiens
cagtgggtagtggggattagca

SEQ ID NO: 7058677 - DNA, 22 bp, Homo sapiens
cagtgtgacttctgagctgcca

SEQ ID NO: 7058678 - DNA, 23 bp, Homo sapiens
cagtgtgacgaggtgaggcaggc

SEQ ID NO: 7058679 - DNA, 23 bp, Homo sapiens
cagtgtgacgaggtgaggcaggc

SEQ ID NO: 7058680 - DNA, 22 bp, Homo sapiens
cagtgtgaggaattagtgtcca

SEQ ID NO: 7058681 - DNA, 22 bp, Homo sapiens
tcagactgatcatctatcagat

SEQ ID NO: 7058682 - DNA, 22 bp, Homo sapiens
tcagagaaataattgctgagtt

SEQ ID NO: 7058683 - DNA, 22 bp, Homo sapiens
tcagagaaataattgctgagtt

SEQ ID NO: 7058684 - DNA, 22 bp, Homo sapiens
tcagagaaataattgctgagtt

SEQ ID NO: 7058685 - DNA, 22 bp, Homo sapiens
tcagagaaatgctgagctcatg

SEQ ID NO: 7058686 - DNA, 22 bp, Homo sapiens
tcagagaacacagaggtgatgt

SEQ ID NO: 7058687 - DNA, 21 bp, Homo sapiens
tcagagaacccggcaggcaag

SEQ ID NO: 7058688 - DNA, 22 bp, Homo sapiens
cagtgtctccagatgctccaat

SEQ ID NO: 7058689 - DNA, 22 bp, Homo sapiens
cagttaaacgggccatgtgagt

SEQ ID NO: 7058690 - DNA, 22 bp, Homo sapiens
tcagcagaatgtggcatgtcac

SEQ ID NO: 7058691 - DNA, 22 bp, Homo sapiens
tcagcagacagttagctatatt

SEQ ID NO: 7058692 - DNA, 22 bp, Homo sapiens
tcagctttgccaccagctgtaa

SEQ ID NO: 7058693 - DNA, 22 bp, Homo sapiens
tcagctttgccaccagctgtaa

SEQ ID NO: 7058694 - DNA, 22 bp, Homo sapiens
tcagctttgatctcaggcaatc

SEQ ID NO: 7058695 - DNA, 22 bp, Homo sapiens
cagtttatatataagcacattg

SEQ ID NO: 7058696 - DNA, 22 bp, Homo sapiens
cagtttagtgttgcatttggag

SEQ ID NO: 7058697 - DNA, 22 bp, Homo sapiens
cagtttagaagaatcatgaaca

SEQ ID NO: 7058698 - DNA, 22 bp, Homo sapiens
cagtttagcaaatttgtatcaa

SEQ ID NO: 7058699 - DNA, 22 bp, Homo sapiens
cagtttagcatttaccgtgatg

SEQ ID NO: 7058700 - DNA, 22 bp, Homo sapiens
cagtttaggagagacgcgttct

SEQ ID NO: 7058701 - DNA, 22 bp, Homo sapiens
cagtttaggtcatccttgcttt

SEQ ID NO: 7058702 - DNA, 22 bp, Homo sapiens
cagtttagtaggtgatatcaat

SEQ ID NO: 7058703 - DNA, 22 bp, Homo sapiens
cagtttagtcctgccaccatgg

SEQ ID NO: 7058704 - DNA, 22 bp, Homo sapiens
cataaagtagcagagcatgact

SEQ ID NO: 7058705 - DNA, 22 bp, Homo sapiens
cataaagtaggcaagcattcca

SEQ ID NO: 7058706 - DNA, 22 bp, Homo sapiens
tcaggaaactacagttgaacta

SEQ ID NO: 7058707 - DNA, 22 bp, Homo sapiens
tcaggaaagaagatgctcagtg

SEQ ID NO: 7058708 - DNA, 22 bp, Homo sapiens
tcaggaaagagtaatgtataca

SEQ ID NO: 7058709 - DNA, 22 bp, Homo sapiens
tcatttatttgactttggagtg

SEQ ID NO: 7058710 - DNA, 22 bp, Homo sapiens
tccacagttttgccactagctg

SEQ ID NO: 7058711 - DNA, 22 bp, Homo sapiens
tccacatccattgcttgacttt

SEQ ID NO: 7058712 - DNA, 22 bp, Homo sapiens
tccacatgaccattgtgctcct

SEQ ID NO: 7058713 - DNA, 22 bp, Homo sapiens
tcattctgcatcactcttgctc

SEQ ID NO: 7058714 - DNA, 22 bp, Homo sapiens
tcattccttatccgtatctttt

SEQ ID NO: 7058715 - DNA, 22 bp, Homo sapiens
tcatttatcgctgccttttaaa

SEQ ID NO: 7058716 - DNA, 22 bp, Homo sapiens
tcatttatgcaggaatggcata

SEQ ID NO: 7058717 - DNA, 22 bp, Homo sapiens
tcatttatgcaggaatggcata

SEQ ID NO: 7058718 - DNA, 22 bp, Homo sapiens
tcatttatgcaggaatggcata

SEQ ID NO: 7058719 - DNA, 21 bp, Homo sapiens
tcatttattgagaaatgactg

SEQ ID NO: 7058720 - DNA, 21 bp, Homo sapiens
tcatttattgagaaatgactg

SEQ ID NO: 7058721 - DNA, 22 bp, Homo sapiens
tcatgtgacaggcactgttctg

SEQ ID NO: 7058722 - DNA, 18 bp, Homo sapiens
tcattcattaaacttggc

SEQ ID NO: 7058723 - DNA, 22 bp, Homo sapiens
catctttggagaaacttccgtt

SEQ ID NO: 7058724 - DNA, 22 bp, Homo sapiens
catctttgttctgtaaactttt

SEQ ID NO: 7058725 - DNA, 22 bp, Homo sapiens
catctttgttttggatataatc

SEQ ID NO: 7058726 - DNA, 22 bp, Homo sapiens
tcatgagtctgcaaattatgga

SEQ ID NO: 7058727 - DNA, 22 bp, Homo sapiens
tcatgagtggattaatatggct

SEQ ID NO: 7058728 - DNA, 22 bp, Homo sapiens
tccagctcttgttgcccactgc

SEQ ID NO: 7058729 - DNA, 22 bp, Homo sapiens
tccagcctaggggaacagctgc

SEQ ID NO: 7058730 - DNA, 22 bp, Homo sapiens
tccagccctgtggcttccaccc

SEQ ID NO: 7058731 - DNA, 22 bp, Homo sapiens
tccaggcccgagatgggctgga

SEQ ID NO: 7058732 - DNA, 22 bp, Homo sapiens
tccagctggcctaacttcaggg

SEQ ID NO: 7058733 - DNA, 20 bp, Homo sapiens
tccagctgggaacagctgat

SEQ ID NO: 7058734 - DNA, 22 bp, Homo sapiens
tccaggcccatggagcagagct

SEQ ID NO: 7058735 - DNA, 22 bp, Homo sapiens
catgtgtgtctccaccagctgc

SEQ ID NO: 7058736 - DNA, 22 bp, Homo sapiens
tccaggctcccctgcgtgctcc

SEQ ID NO: 7058737 - DNA, 22 bp, Homo sapiens
tcccagagcccaagttggagag

SEQ ID NO: 7058738 - DNA, 22 bp, Homo sapiens
tcccagagcctctgccactctg

SEQ ID NO: 7058739 - DNA, 22 bp, Homo sapiens
tcccagagcctctgccactctg

SEQ ID NO: 7058740 - DNA, 22 bp, Homo sapiens
tcccagagctctgacaccagct

SEQ ID NO: 7058741 - DNA, 22 bp, Homo sapiens
tcccagagctctgacaccagct

SEQ ID NO: 7058742 - DNA, 22 bp, Homo sapiens
tcccagagctctggaggttgga

SEQ ID NO: 7058743 - DNA, 22 bp, Homo sapiens
tcccagagctctggaggttgga

SEQ ID NO: 7058744 - DNA, 22 bp, Homo sapiens
tcccagagctgataagccttta

SEQ ID NO: 7058745 - DNA, 22 bp, Homo sapiens
tcccagagctgataagccttta

SEQ ID NO: 7058746 - DNA, 22 bp, Homo sapiens
tcccagaggaaatggcagctga

SEQ ID NO: 7058747 - DNA, 22 bp, Homo sapiens
cattcagtcatgctggttttga

SEQ ID NO: 7058748 - DNA, 22 bp, Homo sapiens
cattcacatcttgttccatcac

SEQ ID NO: 7058749 - DNA, 22 bp, Homo sapiens
cattcacaaagctgattgatgg

SEQ ID NO: 7058750 - DNA, 22 bp, Homo sapiens
cattcacaaagctgattgatgg

SEQ ID NO: 7058751 - DNA, 22 bp, Homo sapiens
cattcacaatagttgaaaggtg

SEQ ID NO: 7058752 - DNA, 22 bp, Homo sapiens
cattcacagagggggaagcatc

SEQ ID NO: 7058753 - DNA, 22 bp, Homo sapiens
catgtttctgagaaaagtagga

SEQ ID NO: 7058754 - DNA, 22 bp, Homo sapiens
catgttggctgaggctgtattt

SEQ ID NO: 7058755 - DNA, 22 bp, Homo sapiens
catgttaagtgtttgataacca

SEQ ID NO: 7058756 - DNA, 22 bp, Homo sapiens
catgttaagtgtttgataacca

SEQ ID NO: 7058757 - DNA, 22 bp, Homo sapiens
catgttatttatccattaaaca

SEQ ID NO: 7058758 - DNA, 22 bp, Homo sapiens
tcccagggtcctcttctggaat

SEQ ID NO: 7058759 - DNA, 22 bp, Homo sapiens
tcctcagggaagatgagcctca

SEQ ID NO: 7058760 - DNA, 22 bp, Homo sapiens
catttgtacatgttgtcttctt

SEQ ID NO: 7058761 - DNA, 22 bp, Homo sapiens
catttgtagtatctgtttatat

SEQ ID NO: 7058762 - DNA, 22 bp, Homo sapiens
catttgtagttaaaaatgtctc

SEQ ID NO: 7058763 - DNA, 22 bp, Homo sapiens
catttgtatcatatgtatctta

SEQ ID NO: 7058764 - DNA, 22 bp, Homo sapiens
catttgtatcatatgtatctta

SEQ ID NO: 7058765 - DNA, 22 bp, Homo sapiens
tcctcccctcagggcaacggat

SEQ ID NO: 7058766 - DNA, 22 bp, Homo sapiens
tcctctccatattttctgattt

SEQ ID NO: 7058767 - DNA, 22 bp, Homo sapiens
tcctctccatattttctgattt

SEQ ID NO: 7058768 - DNA, 21 bp, Homo sapiens
tcctctccatgatctgtttgt

SEQ ID NO: 7058769 - DNA, 22 bp, Homo sapiens
tccctagtcgcatctgtggaga

SEQ ID NO: 7058770 - DNA, 22 bp, Homo sapiens
tccctaggtcctagtcacagta

SEQ ID NO: 7058771 - DNA, 22 bp, Homo sapiens
tcctagaagatggatcagagaa

SEQ ID NO: 7058772 - DNA, 22 bp, Homo sapiens
tcctcagcttttatttcacttg

SEQ ID NO: 7058773 - DNA, 22 bp, Homo sapiens
tctcttaaaagattttaatgac

SEQ ID NO: 7058774 - DNA, 22 bp, Homo sapiens
tctctgttcatggcactatgtc

SEQ ID NO: 7058775 - DNA, 22 bp, Homo sapiens
tctgaaatgacctttccccact

SEQ ID NO: 7058776 - DNA, 22 bp, Homo sapiens
tctctgtgtgttggctgtatat

SEQ ID NO: 7058777 - DNA, 22 bp, Homo sapiens
ccagcaggtgtagggctcatgg

SEQ ID NO: 7058778 - DNA, 22 bp, Homo sapiens
ccagcaggtgtagggctcatgg

SEQ ID NO: 7058779 - DNA, 22 bp, Homo sapiens
ccagcatcagcattgtcttagg

SEQ ID NO: 7058780 - DNA, 19 bp, Homo sapiens
tctgaagtccagggcatac

SEQ ID NO: 7058781 - DNA, 19 bp, Homo sapiens
tctgaagtccagggcatac

SEQ ID NO: 7058782 - DNA, 22 bp, Homo sapiens
tctgaagttcttaaattagttt

SEQ ID NO: 7058783 - DNA, 22 bp, Homo sapiens
tctgaagtgatcatcatttctc

SEQ ID NO: 7058784 - DNA, 22 bp, Homo sapiens
tctgaatatgtttatcatctct

SEQ ID NO: 7058785 - DNA, 22 bp, Homo sapiens
ccagccctgtcaccaactggag

SEQ ID NO: 7058786 - DNA, 22 bp, Homo sapiens
tctgatatcgcactaaactctg

SEQ ID NO: 7058787 - DNA, 22 bp, Homo sapiens
tctgcagaagccatggccttgc

SEQ ID NO: 7058788 - DNA, 22 bp, Homo sapiens
tctgcagaaggaatcagctgag

SEQ ID NO: 7058789 - DNA, 22 bp, Homo sapiens
tctgcagaagtggctgggccac

SEQ ID NO: 7058790 - DNA, 22 bp, Homo sapiens
tctgcagaattcgaggaagaaa

SEQ ID NO: 7058791 - DNA, 21 bp, Homo sapiens
tctctgggaggacttgtgaga

SEQ ID NO: 7058792 - DNA, 21 bp, Homo sapiens
tctctgggaggacttgtgaga

SEQ ID NO: 7058793 - DNA, 22 bp, Homo sapiens
tctctgggagcaattgtttgct

SEQ ID NO: 7058794 - DNA, 22 bp, Homo sapiens
tctctgggaattttttggacat

SEQ ID NO: 7058795 - DNA, 22 bp, Homo sapiens
tctctgggaattttttggacat

SEQ ID NO: 7058796 - DNA, 22 bp, Homo sapiens
tctctgcccatcctcagtccac

SEQ ID NO: 7058797 - DNA, 22 bp, Homo sapiens
tctctgcccatcctcagtccac

SEQ ID NO: 7058798 - DNA, 22 bp, Homo sapiens
tctctgcccatgagcaatctgc

SEQ ID NO: 7058799 - DNA, 22 bp, Homo sapiens
tctctgccacagcttctgcctt

SEQ ID NO: 7058800 - DNA, 22 bp, Homo sapiens
tctctgccacagcttctgcctt

SEQ ID NO: 7058801 - DNA, 22 bp, Homo sapiens
tctctgccaccatgagatgggc

SEQ ID NO: 7058802 - DNA, 22 bp, Homo sapiens
tctctgccaccatgagatgggc

SEQ ID NO: 7058803 - DNA, 22 bp, Homo sapiens
tctctgcccaagtttctcaagt

SEQ ID NO: 7058804 - DNA, 22 bp, Homo sapiens
tctctgcccaagtttctcaagt

SEQ ID NO: 7058805 - DNA, 22 bp, Homo sapiens
tctctgcccatcctcagtccac

SEQ ID NO: 7058806 - DNA, 22 bp, Homo sapiens
tctcctgggaggacaaggaagg

SEQ ID NO: 7058807 - DNA, 22 bp, Homo sapiens
tctctcttgtcaccccatctgc

SEQ ID NO: 7058808 - DNA, 23 bp, Homo sapiens
tctctgagttgtactttcccttg

SEQ ID NO: 7058809 - DNA, 17 bp, Homo sapiens
tctcctggctctatcag

SEQ ID NO: 7058810 - DNA, 22 bp, Homo sapiens
tctcctggcctttaggttaagg

SEQ ID NO: 7058811 - DNA, 22 bp, Homo sapiens
tctcctggctcaccaggctgga

SEQ ID NO: 7058812 - DNA, 22 bp, Homo sapiens
ccagcagaggggcggagtgcag

SEQ ID NO: 7058813 - DNA, 22 bp, Homo sapiens
ccagcagagtctaggaaggagg

SEQ ID NO: 7058814 - DNA, 22 bp, Homo sapiens
ccagcagctttattggctctcc

SEQ ID NO: 7058815 - DNA, 22 bp, Homo sapiens
ccagcagggcagtgccctggac

SEQ ID NO: 7058816 - DNA, 22 bp, Homo sapiens
ccagcagggcagtgccctggac

SEQ ID NO: 7058817 - DNA, 22 bp, Homo sapiens
ccacatgtgcactgctgtatgg

SEQ ID NO: 7058818 - DNA, 22 bp, Homo sapiens
tcctgactccaggtcctgtgtg

SEQ ID NO: 7058819 - DNA, 22 bp, Homo sapiens
tcctgactctggtgtcctctac

SEQ ID NO: 7058820 - DNA, 18 bp, Homo sapiens
tcctctctttccccaggg

SEQ ID NO: 7058821 - DNA, 22 bp, Homo sapiens
tcctctccatgtctcacgccac

SEQ ID NO: 7058822 - DNA, 22 bp, Homo sapiens
tcctctccatgtctcacgccac

SEQ ID NO: 7058823 - DNA, 22 bp, Homo sapiens
tcctctctgcactggccctgcc

SEQ ID NO: 7058824 - DNA, 18 bp, Homo sapiens
tcctctctttccccaggg

SEQ ID NO: 7058825 - DNA, 21 bp, Homo sapiens
tcctctgcagtgaggtggcct

SEQ ID NO: 7058826 - DNA, 22 bp, Homo sapiens
tcctgaagtatgggtatggagt

SEQ ID NO: 7058827 - DNA, 22 bp, Homo sapiens
tcctgaagtcacaggctctgag

SEQ ID NO: 7058828 - DNA, 22 bp, Homo sapiens
tcgctgaggctgcacggctgcc

SEQ ID NO: 7058829 - DNA, 22 bp, Homo sapiens
tcgctgaggctgcacggctgcc

SEQ ID NO: 7058830 - DNA, 22 bp, Homo sapiens
tcgctgaggctgcacggctgcc

SEQ ID NO: 7058831 - DNA, 22 bp, Homo sapiens
tcgcgggttgcacatggccatc

SEQ ID NO: 7058832 - DNA, 22 bp, Homo sapiens
ccaccaggacagccctgagggg

SEQ ID NO: 7058833 - DNA, 22 bp, Homo sapiens
ccaccaggacagccctgagggg

SEQ ID NO: 7058834 - DNA, 22 bp, Homo sapiens
tcctttccagcctcacctcagc

SEQ ID NO: 7058835 - DNA, 22 bp, Homo sapiens
ccaccacttctggcttctggtg

SEQ ID NO: 7058836 - DNA, 22 bp, Homo sapiens
ccaccagcttcagcagccgcgg

SEQ ID NO: 7058837 - DNA, 22 bp, Homo sapiens
tcgctgtggtttctgtacatgg

SEQ ID NO: 7058838 - DNA, 23 bp, Homo sapiens
tcggtgggcgtggaggccgaggc

SEQ ID NO: 7058839 - DNA, 22 bp, Homo sapiens
ccacccttgggttcggaggccg

SEQ ID NO: 7058840 - DNA, 20 bp, Homo sapiens
tctcagtttctagagtcagg

SEQ ID NO: 7058841 - DNA, 22 bp, Homo sapiens
tctcagtttcctcatatgtaaa

SEQ ID NO: 7058842 - DNA, 22 bp, Homo sapiens
tctccacaccagaaggagctga

SEQ ID NO: 7058843 - DNA, 22 bp, Homo sapiens
tctccacaccagaaggagctga

SEQ ID NO: 7058844 - DNA, 22 bp, Homo sapiens
tctccacactttctctcccagg

SEQ ID NO: 7058845 - DNA, 22 bp, Homo sapiens
tctcaagcttgttggtatgttt

SEQ ID NO: 7058846 - DNA, 22 bp, Homo sapiens
tctcaagcttgttggtatgttt

SEQ ID NO: 7058847 - DNA, 23 bp, Homo sapiens
tctcaagccagaccaggcctcgc

SEQ ID NO: 7058848 - DNA, 22 bp, Homo sapiens
tctcaagagggaggcaatcatg

SEQ ID NO: 7058849 - DNA, 22 bp, Homo sapiens
tctcaaatttatacagagttca

SEQ ID NO: 7058850 - DNA, 22 bp, Homo sapiens
tctcaaatttgttagataaaat

SEQ ID NO: 7058851 - DNA, 22 bp, Homo sapiens
tctcaacaccacttgctgaaga

SEQ ID NO: 7058852 - DNA, 22 bp, Homo sapiens
ccacctccacctattgccagcc

SEQ ID NO: 7058853 - DNA, 22 bp, Homo sapiens
ccacctgagataagagagctca

SEQ ID NO: 7058854 - DNA, 16 bp, Homo sapiens
ccacctgcagctctca

SEQ ID NO: 7058855 - DNA, 22 bp, Homo sapiens
tctatattccagatacagatta

SEQ ID NO: 7058856 - DNA, 19 bp, Homo sapiens
ccagagagctaggtacaga

SEQ ID NO: 7058857 - DNA, 22 bp, Homo sapiens
ccagagagagtactgggctctg

SEQ ID NO: 7058858 - DNA, 20 bp, Homo sapiens
tctccagatgcagatgacat

SEQ ID NO: 7058859 - DNA, 21 bp, Homo sapiens
ccagagagagggaagtgggtt

SEQ ID NO: 7058860 - DNA, 22 bp, Homo sapiens
tctcccacagtctcccatggct

SEQ ID NO: 7058861 - DNA, 22 bp, Homo sapiens
ccagagaggccaaggtcgtggt

SEQ ID NO: 7058862 - DNA, 22 bp, Homo sapiens
tctccctctgtaagatcagggg

SEQ ID NO: 7058863 - DNA, 22 bp, Homo sapiens
tctcccacggtacaggataaac

SEQ ID NO: 7058864 - DNA, 22 bp, Homo sapiens
tctcccacggtacaggataaac

SEQ ID NO: 7058865 - DNA, 22 bp, Homo sapiens
tctccctcattcctgcttccat

SEQ ID NO: 7058866 - DNA, 22 bp, Homo sapiens
tctccctctttgtctgctttgg

SEQ ID NO: 7058867 - DNA, 20 bp, Homo sapiens
tctccctgcccatctcagat

SEQ ID NO: 7058868 - DNA, 22 bp, Homo sapiens
tctccgatcacaggttttcaat

SEQ ID NO: 7058869 - DNA, 22 bp, Homo sapiens
cctggagcactctccctggctg

SEQ ID NO: 7058870 - DNA, 22 bp, Homo sapiens
tgtacatacatagatatacaca

SEQ ID NO: 7058871 - DNA, 22 bp, Homo sapiens
tgtaatgagaaagagagtgaat

SEQ ID NO: 7058872 - DNA, 22 bp, Homo sapiens
tgtaatgatgtacttagaagga

SEQ ID NO: 7058873 - DNA, 22 bp, Homo sapiens
tgtaatcattacagtacatgga

SEQ ID NO: 7058874 - DNA, 21 bp, Homo sapiens
tgtaagtttcatctgaattgg

SEQ ID NO: 7058875 - DNA, 22 bp, Homo sapiens
tgtaataccactgttggacatt

SEQ ID NO: 7058876 - DNA, 22 bp, Homo sapiens
cctggaaaacatgggaatcaca

SEQ ID NO: 7058877 - DNA, 22 bp, Homo sapiens
cctgcttcagggatgatggcac

SEQ ID NO: 7058878 - DNA, 22 bp, Homo sapiens
cctgctgttctgtttagtgaac

SEQ ID NO: 7058879 - DNA, 22 bp, Homo sapiens
tgtcaaatttttattgcagtat

SEQ ID NO: 7058880 - DNA, 22 bp, Homo sapiens
tgtcaaatttttattgcagtat

SEQ ID NO: 7058881 - DNA, 22 bp, Homo sapiens
tgtcaacagatactagagagct

SEQ ID NO: 7058882 - DNA, 22 bp, Homo sapiens
tgtcaaccaggtattttggtct

SEQ ID NO: 7058883 - DNA, 23 bp, Homo sapiens
tgtcaagtatagcaggccctccc

SEQ ID NO: 7058884 - DNA, 22 bp, Homo sapiens
tgtcaataacatttacttctat

SEQ ID NO: 7058885 - DNA, 22 bp, Homo sapiens
tgtcaataactggagtcattat

SEQ ID NO: 7058886 - DNA, 18 bp, Homo sapiens
cctggagctccacagcaa

SEQ ID NO: 7058887 - DNA, 22 bp, Homo sapiens
cctggagcttttccagttgaca

SEQ ID NO: 7058888 - DNA, 22 bp, Homo sapiens
cctggaggcggaggttgcagtg

SEQ ID NO: 7058889 - DNA, 22 bp, Homo sapiens
cctggaggctctgggagggcag

SEQ ID NO: 7058890 - DNA, 22 bp, Homo sapiens
cctggagggaccctggccctgt

SEQ ID NO: 7058891 - DNA, 22 bp, Homo sapiens
cctggagggaccctggccctgt

SEQ ID NO: 7058892 - DNA, 22 bp, Homo sapiens
cctgctggctggtagagttccg

SEQ ID NO: 7058893 - DNA, 22 bp, Homo sapiens
cctgctgtgaagccaggcctgt

SEQ ID NO: 7058894 - DNA, 22 bp, Homo sapiens
cctgctgtgaagccaggcctgt

SEQ ID NO: 7058895 - DNA, 22 bp, Homo sapiens
cctgctgtgaccggggagcagg

SEQ ID NO: 7058896 - DNA, 21 bp, Homo sapiens
cctgctgtgatcttagtgagt

SEQ ID NO: 7058897 - DNA, 22 bp, Homo sapiens
cctgctgtaatgtgtctttatt

SEQ ID NO: 7058898 - DNA, 22 bp, Homo sapiens
cctgctgtagggcccctggggc

SEQ ID NO: 7058899 - DNA, 22 bp, Homo sapiens
cctgctgtcagcatcctcgcga

SEQ ID NO: 7058900 - DNA, 22 bp, Homo sapiens
tggtctgatggtcccaccaccg

SEQ ID NO: 7058901 - DNA, 22 bp, Homo sapiens
cctgctctaaatctcatggaac

SEQ ID NO: 7058902 - DNA, 22 bp, Homo sapiens
cctgctgctatgaaggtgacag

SEQ ID NO: 7058903 - DNA, 22 bp, Homo sapiens
cctgctggacgtggaggagggg

SEQ ID NO: 7058904 - DNA, 22 bp, Homo sapiens
cctgccaggctttgggcttctg

SEQ ID NO: 7058905 - DNA, 18 bp, Homo sapiens
cctgccagtctggagcag

SEQ ID NO: 7058906 - DNA, 18 bp, Homo sapiens
cctgccagtctggagcag

SEQ ID NO: 7058907 - DNA, 22 bp, Homo sapiens
tgggtcagagctgtgctgccca

SEQ ID NO: 7058908 - DNA, 22 bp, Homo sapiens
tgggtcagattgagcccctggt

SEQ ID NO: 7058909 - DNA, 22 bp, Homo sapiens
tgggtcagattgagcccctggt

SEQ ID NO: 7058910 - DNA, 22 bp, Homo sapiens
cctgcctgggctcacttgccag

SEQ ID NO: 7058911 - DNA, 22 bp, Homo sapiens
cctgcctgggctcacttgccag

SEQ ID NO: 7058912 - DNA, 22 bp, Homo sapiens
cctgcctgtaagatgggtacaa

SEQ ID NO: 7058913 - DNA, 22 bp, Homo sapiens
cctgcctgtctttatcccctgt

SEQ ID NO: 7058914 - DNA, 20 bp, Homo sapiens
cctgcctgtgtttgtgatga

SEQ ID NO: 7058915 - DNA, 23 bp, Homo sapiens
cctgcctgttctaactccatttc

SEQ ID NO: 7058916 - DNA, 17 bp, Homo sapiens
tggggtccccgatggtg

SEQ ID NO: 7058917 - DNA, 22 bp, Homo sapiens
tgggggtgtgccagggacctcc

SEQ ID NO: 7058918 - DNA, 22 bp, Homo sapiens
tgggggagagaggcattctttc

SEQ ID NO: 7058919 - DNA, 22 bp, Homo sapiens
tgggggtggttcttgcctccag

SEQ ID NO: 7058920 - DNA, 21 bp, Homo sapiens
tgggggagaattggttgcttt

SEQ ID NO: 7058921 - DNA, 22 bp, Homo sapiens
tgggggtgtcctggtgcacaca

SEQ ID NO: 7058922 - DNA, 21 bp, Homo sapiens
cctgagggtggttgtgaagat

SEQ ID NO: 7058923 - DNA, 21 bp, Homo sapiens
cctgagggtggttgtgaagat

SEQ ID NO: 7058924 - DNA, 22 bp, Homo sapiens
cctgaggtcacaacttgcttat

SEQ ID NO: 7058925 - DNA, 22 bp, Homo sapiens
cctgaggtcacaacttgcttat

SEQ ID NO: 7058926 - DNA, 22 bp, Homo sapiens
cctgaggtcagccattcttgcc

SEQ ID NO: 7058927 - DNA, 22 bp, Homo sapiens
cctgaggtcagccattcttgcc

SEQ ID NO: 7058928 - DNA, 22 bp, Homo sapiens
cctgaggtcagcggttcccaca

SEQ ID NO: 7058929 - DNA, 22 bp, Homo sapiens
cctgaggtcatgcatttccaac

SEQ ID NO: 7058930 - DNA, 22 bp, Homo sapiens
tggggtcctctcacttggaggg

SEQ ID NO: 7058931 - DNA, 20 bp, Homo sapiens
tggggtcctggaggggatcc

SEQ ID NO: 7058932 - DNA, 22 bp, Homo sapiens
cctgatggctgtctgggcctga

SEQ ID NO: 7058933 - DNA, 22 bp, Homo sapiens
cctgatggtatattgttgggag

SEQ ID NO: 7058934 - DNA, 22 bp, Homo sapiens
cctgccagagcagcttgtcctc

SEQ ID NO: 7058935 - DNA, 22 bp, Homo sapiens
cctgccaggagctggtgctgca

SEQ ID NO: 7058936 - DNA, 22 bp, Homo sapiens
cctgccaggccagtgagcttcc

SEQ ID NO: 7058937 - DNA, 22 bp, Homo sapiens
cctgaggctggcccttccatcc

SEQ ID NO: 7058938 - DNA, 22 bp, Homo sapiens
cctgaggctccacctccagaga

SEQ ID NO: 7058939 - DNA, 22 bp, Homo sapiens
cctgaggctcgcgcgcccctgg

SEQ ID NO: 7058940 - DNA, 22 bp, Homo sapiens
cctgaggctccacctccagaga

SEQ ID NO: 7058941 - DNA, 22 bp, Homo sapiens
cctgaggccctggctgtgctga

SEQ ID NO: 7058942 - DNA, 22 bp, Homo sapiens
cctgagcttgatccttctgtct

SEQ ID NO: 7058943 - DNA, 22 bp, Homo sapiens
cctgaggcttaatctgtcccaa

SEQ ID NO: 7058944 - DNA, 22 bp, Homo sapiens
cctgagggcgccgagctcccag

SEQ ID NO: 7058945 - DNA, 22 bp, Homo sapiens
cctgagggctcagcccccagcc

SEQ ID NO: 7058946 - DNA, 22 bp, Homo sapiens
cctgacttaagtctcctgttgg

SEQ ID NO: 7058947 - DNA, 22 bp, Homo sapiens
cctgagaaacctggtgcaatta

SEQ ID NO: 7058948 - DNA, 22 bp, Homo sapiens
cctgagacatgaaccaggctcc

SEQ ID NO: 7058949 - DNA, 22 bp, Homo sapiens
cctctggcaacttcacagccca

SEQ ID NO: 7058950 - DNA, 22 bp, Homo sapiens
cctctggcaagtgatttatcat

SEQ ID NO: 7058951 - DNA, 22 bp, Homo sapiens
cctctggcagccagccagttgt

SEQ ID NO: 7058952 - DNA, 22 bp, Homo sapiens
cctctggcatagcaagtggcct

SEQ ID NO: 7058953 - DNA, 22 bp, Homo sapiens
tgggagcagttcaggtgtggct

SEQ ID NO: 7058954 - DNA, 22 bp, Homo sapiens
tgggagcaggtgtgctagggaa

SEQ ID NO: 7058955 - DNA, 22 bp, Homo sapiens
cctccctgcgctcctgcggcgg

SEQ ID NO: 7058956 - DNA, 22 bp, Homo sapiens
tggctctcagctcccagcagcc

SEQ ID NO: 7058957 - DNA, 23 bp, Homo sapiens
tggctctctcagtgctgcagagg

SEQ ID NO: 7058958 - DNA, 20 bp, Homo sapiens
tggctctctctagtaagtgg

SEQ ID NO: 7058959 - DNA, 22 bp, Homo sapiens
tggctctctgggaggtcctggc

SEQ ID NO: 7058960 - DNA, 22 bp, Homo sapiens
tggctctctgggaggtcctggc

SEQ ID NO: 7058961 - DNA, 21 bp, Homo sapiens
tggctctgaaagagtgctgca

SEQ ID NO: 7058962 - DNA, 22 bp, Homo sapiens
tgggcagggagctggaaccaca

SEQ ID NO: 7058963 - DNA, 22 bp, Homo sapiens
cctctggccacatgggacatag

SEQ ID NO: 7058964 - DNA, 22 bp, Homo sapiens
cctctggccagagaaaggccag

SEQ ID NO: 7058965 - DNA, 22 bp, Homo sapiens
cctctggccatcccccattaag

SEQ ID NO: 7058966 - DNA, 22 bp, Homo sapiens
tgggccagatccatggcaataa

SEQ ID NO: 7058967 - DNA, 21 bp, Homo sapiens
tgggccagatctgagtttcta

SEQ ID NO: 7058968 - DNA, 22 bp, Homo sapiens
cctcttctgagtgagactccct

SEQ ID NO: 7058969 - DNA, 22 bp, Homo sapiens
cctcttctgcttcaggagcact

SEQ ID NO: 7058970 - DNA, 22 bp, Homo sapiens
cctcttctgcttcaggagcact

SEQ ID NO: 7058971 - DNA, 22 bp, Homo sapiens
cctgaaaatatcctctcctttg

SEQ ID NO: 7058972 - DNA, 22 bp, Homo sapiens
cctgaaaatcaaggtagtttgg

SEQ ID NO: 7058973 - DNA, 22 bp, Homo sapiens
tgctttcaaaggctttctagat

SEQ ID NO: 7058974 - DNA, 22 bp, Homo sapiens
tgcctgctagatatccaggtga

SEQ ID NO: 7058975 - DNA, 19 bp, Homo sapiens
tgcctgctcctggcttcca

SEQ ID NO: 7058976 - DNA, 22 bp, Homo sapiens
tgctttattgcatcagtgtggg

SEQ ID NO: 7058977 - DNA, 22 bp, Homo sapiens
tgcctcataacactcctggagt

SEQ ID NO: 7058978 - DNA, 22 bp, Homo sapiens
tgcctgcctctggcagccctgc

SEQ ID NO: 7058979 - DNA, 22 bp, Homo sapiens
tgcctgccttgctgctggacag

SEQ ID NO: 7058980 - DNA, 22 bp, Homo sapiens
tgcctccatgtttcagcatcta

SEQ ID NO: 7058981 - DNA, 20 bp, Homo sapiens
tgcctgcccctgctttttcc

SEQ ID NO: 7058982 - DNA, 22 bp, Homo sapiens
tgcctgccctgaaaactgccca

SEQ ID NO: 7058983 - DNA, 22 bp, Homo sapiens
tgcctgcctaggaagctgtgaa

SEQ ID NO: 7058984 - DNA, 22 bp, Homo sapiens
tgcctgcctcaggccgagtgct

SEQ ID NO: 7058985 - DNA, 22 bp, Homo sapiens
cccgtgtggatgcgctggtgct

SEQ ID NO: 7058986 - DNA, 23 bp, Homo sapiens
ccctaactaattctagggcctaa

SEQ ID NO: 7058987 - DNA, 21 bp, Homo sapiens
ccctaactctaaaggatccat

SEQ ID NO: 7058988 - DNA, 22 bp, Homo sapiens
ccctagaacacgcagacactga

SEQ ID NO: 7058989 - DNA, 22 bp, Homo sapiens
ccctagaacacgcagacactga

SEQ ID NO: 7058990 - DNA, 22 bp, Homo sapiens
tggaaagacattcagccgctgg

SEQ ID NO: 7058991 - DNA, 22 bp, Homo sapiens
tggaagaaggcagagaggcatt

SEQ ID NO: 7058992 - DNA, 22 bp, Homo sapiens
tggaagaataggatagaagaac

SEQ ID NO: 7058993 - DNA, 20 bp, Homo sapiens
tggaagacactgaagggcca

SEQ ID NO: 7058994 - DNA, 22 bp, Homo sapiens
ccctgcctgtgggcatcaacat

SEQ ID NO: 7058995 - DNA, 22 bp, Homo sapiens
ccctgcctctgaagctgctcag

SEQ ID NO: 7058996 - DNA, 22 bp, Homo sapiens
ccctgcctgtgggcatcaacat

SEQ ID NO: 7058997 - DNA, 22 bp, Homo sapiens
ccctgccttcttggcctttaaa

SEQ ID NO: 7058998 - DNA, 19 bp, Homo sapiens
ccctgccctggtgactggg

SEQ ID NO: 7058999 - DNA, 19 bp, Homo sapiens
ccctgccctggtgactggg

SEQ ID NO: 7059000 - DNA, 22 bp, Homo sapiens
ccctgcctacagggttttcttt

SEQ ID NO: 7059001 - DNA, 22 bp, Homo sapiens
ccctgcctacagggttttcttt

SEQ ID NO: 7059002 - DNA, 22 bp, Homo sapiens
ccctgcctctgaagctgctcag

SEQ ID NO: 7059003 - DNA, 22 bp, Homo sapiens
ccctgcctctgaagctgctcag

SEQ ID NO: 7059004 - DNA, 22 bp, Homo sapiens
tggacaggttgagtaggaggag

SEQ ID NO: 7059005 - DNA, 22 bp, Homo sapiens
ccctgcagagggatgggggcag

SEQ ID NO: 7059006 - DNA, 22 bp, Homo sapiens
tggaagggaacaggtgggtgtt

SEQ ID NO: 7059007 - DNA, 22 bp, Homo sapiens
tggaagggaacaggtgggtgtt

SEQ ID NO: 7059008 - DNA, 22 bp, Homo sapiens
ccctgaggaccaggaaggaggg

SEQ ID NO: 7059009 - DNA, 22 bp, Homo sapiens
ccctgcagacgtcttgatgcct

SEQ ID NO: 7059010 - DNA, 22 bp, Homo sapiens
ccctgccttgttggagcctatg

SEQ ID NO: 7059011 - DNA, 22 bp, Homo sapiens
ccctgccttgtctgggctaggt

SEQ ID NO: 7059012 - DNA, 22 bp, Homo sapiens
ccctgccttgttggagcctatg

SEQ ID NO: 7059013 - DNA, 22 bp, Homo sapiens
ccctgccttgttggagcctatg

SEQ ID NO: 7059014 - DNA, 22 bp, Homo sapiens
ccctgctagaacctccaacatg

SEQ ID NO: 7059015 - DNA, 22 bp, Homo sapiens
ccctgccttcttggcctttaaa

SEQ ID NO: 7059016 - DNA, 22 bp, Homo sapiens
ccctgccttcttggcctttaaa

SEQ ID NO: 7059017 - DNA, 22 bp, Homo sapiens
ccctgccttggggtccacaccg

SEQ ID NO: 7059018 - DNA, 22 bp, Homo sapiens
ccctgccttggggtccacaccg

SEQ ID NO: 7059019 - DNA, 22 bp, Homo sapiens
ccctgccttggggtccacaccg

SEQ ID NO: 7059020 - DNA, 22 bp, Homo sapiens
ccctgccttggggtccacaccg

SEQ ID NO: 7059021 - DNA, 22 bp, Homo sapiens
ccctgccttggggtccacaccg

SEQ ID NO: 7059022 - DNA, 22 bp, Homo sapiens
ccctgccttgtctgggctaggt

SEQ ID NO: 7059023 - DNA, 23 bp, Homo sapiens
ccctgctcaggggtctgattctc

SEQ ID NO: 7059024 - DNA, 22 bp, Homo sapiens
ccctgctcttagtgcctgtgtg

SEQ ID NO: 7059025 - DNA, 22 bp, Homo sapiens
ccctgctcttctgactcaagct

SEQ ID NO: 7059026 - DNA, 19 bp, Homo sapiens
tggaggggtttgaatgtgg

SEQ ID NO: 7059027 - DNA, 22 bp, Homo sapiens
tggaggggcaatggagcgcgga

SEQ ID NO: 7059028 - DNA, 22 bp, Homo sapiens
tggaggggcaatggagcgcgga

SEQ ID NO: 7059029 - DNA, 22 bp, Homo sapiens
tggaggtctctgtctgggcagg

SEQ ID NO: 7059030 - DNA, 22 bp, Homo sapiens
tggaggtgacggggcctcgttg

SEQ ID NO: 7059031 - DNA, 22 bp, Homo sapiens
tggaggtgacggggcctcgttg

SEQ ID NO: 7059032 - DNA, 22 bp, Homo sapiens
tggaggtgagtgtggtacagca

SEQ ID NO: 7059033 - DNA, 22 bp, Homo sapiens
tggaggtggagttggaaactga

SEQ ID NO: 7059034 - DNA, 22 bp, Homo sapiens
ccctggagctagtctgagcaga

SEQ ID NO: 7059035 - DNA, 22 bp, Homo sapiens
tggaggtggagttggaaactga

SEQ ID NO: 7059036 - DNA, 23 bp, Homo sapiens
ccctggagctagtctgagcagag

SEQ ID NO: 7059037 - DNA, 21 bp, Homo sapiens
cctcaaagatgatggggtttc

SEQ ID NO: 7059038 - DNA, 22 bp, Homo sapiens
cctcacagagcccagatgtcta

SEQ ID NO: 7059039 - DNA, 22 bp, Homo sapiens
ccggctactcgggaggctgacg

SEQ ID NO: 7059040 - DNA, 22 bp, Homo sapiens
ccgggcctcgggacaccgggta

SEQ ID NO: 7059041 - DNA, 22 bp, Homo sapiens
ccgtattataagtttttccttc

SEQ ID NO: 7059042 - DNA, 22 bp, Homo sapiens
ccgtggagttgtgctgagtatg

SEQ ID NO: 7059043 - DNA, 22 bp, Homo sapiens
ccgtggtcacctgagctccttg

SEQ ID NO: 7059044 - DNA, 22 bp, Homo sapiens
ccctggtgtccactggaggaag

SEQ ID NO: 7059045 - DNA, 22 bp, Homo sapiens
ccctgtccttggctgtgaggct

SEQ ID NO: 7059046 - DNA, 22 bp, Homo sapiens
ccctgtctcattgatcacttgt

SEQ ID NO: 7059047 - DNA, 22 bp, Homo sapiens
ccctggaggaaaatctgaggct

SEQ ID NO: 7059048 - DNA, 22 bp, Homo sapiens
ccctgtgatgtagctagagtag

SEQ ID NO: 7059049 - DNA, 22 bp, Homo sapiens
ccggctactcgggaggctgacg

SEQ ID NO: 7059050 - DNA, 22 bp, Homo sapiens
ccggagtgtctggcctgctggg

SEQ ID NO: 7059051 - DNA, 19 bp, Homo sapiens
cctccccttggaccagcaa

SEQ ID NO: 7059052 - DNA, 22 bp, Homo sapiens
cctcccctgctcagaactctgg

SEQ ID NO: 7059053 - DNA, 22 bp, Homo sapiens
cctccctccattgccatcgtct

SEQ ID NO: 7059054 - DNA, 22 bp, Homo sapiens
cctcccagatgtgcccaatgga

SEQ ID NO: 7059055 - DNA, 22 bp, Homo sapiens
tggctaggctccaagagctgga

SEQ ID NO: 7059056 - DNA, 22 bp, Homo sapiens
tggctcagccattcgtgttgcc

SEQ ID NO: 7059057 - DNA, 22 bp, Homo sapiens
tggctcagcgcggcctggtctt

SEQ ID NO: 7059058 - DNA, 22 bp, Homo sapiens
tggcctcccctaacagcctctt

SEQ ID NO: 7059059 - DNA, 22 bp, Homo sapiens
tggcctcagattattgcacagt

SEQ ID NO: 7059060 - DNA, 22 bp, Homo sapiens
cctcagaagctcaaggacattg

SEQ ID NO: 7059061 - DNA, 22 bp, Homo sapiens
cctcagaagctcaaggacattg

SEQ ID NO: 7059062 - DNA, 22 bp, Homo sapiens
tggccctgcttatgtctctctt

SEQ ID NO: 7059063 - DNA, 22 bp, Homo sapiens
cctcactgaagaggtgacattt

SEQ ID NO: 7059064 - DNA, 22 bp, Homo sapiens
cctcactgctatgtgtttgctc

SEQ ID NO: 7059065 - DNA, 22 bp, Homo sapiens
cctcactgaagaggtgacattt

SEQ ID NO: 7059066 - DNA, 22 bp, Homo sapiens
cctcactgctatgtgtttgctc

SEQ ID NO: 7059067 - DNA, 22 bp, Homo sapiens
cctcactggccagccaggggtg

SEQ ID NO: 7059068 - DNA, 22 bp, Homo sapiens
cctcactgtcacttatagtggt

SEQ ID NO: 7059069 - DNA, 22 bp, Homo sapiens
cctcactgtcatcagtagttat

SEQ ID NO: 7059070 - DNA, 22 bp, Homo sapiens
cctcagaacggaaatggttttg

SEQ ID NO: 7059071 - DNA, 22 bp, Homo sapiens
cctcagaagaagtggaattgat

SEQ ID NO: 7059072 - DNA, 22 bp, Homo sapiens
cctcagaagactttagggaaga

SEQ ID NO: 7059073 - DNA, 22 bp, Homo sapiens
cctcagccttggccccaggcag

SEQ ID NO: 7059074 - DNA, 22 bp, Homo sapiens
cctcagctcccatgagatctgc

SEQ ID NO: 7059075 - DNA, 22 bp, Homo sapiens
tggcctgggtcacaccagggtc

SEQ ID NO: 7059076 - DNA, 22 bp, Homo sapiens
tgcctcagtctaaagtctctca

SEQ ID NO: 7059077 - DNA, 22 bp, Homo sapiens
tgcctcagtctaaagtctctca

SEQ ID NO: 7059078 - DNA, 23 bp, Homo sapiens
tgcctcagtggaatgtgagggtg

SEQ ID NO: 7059079 - DNA, 20 bp, Homo sapiens
cccaggagtgagcagcttta

SEQ ID NO: 7059080 - DNA, 22 bp, Homo sapiens
tgccctggttacactggagtcc

SEQ ID NO: 7059081 - DNA, 22 bp, Homo sapiens
tgccctggttacactggagtcc

SEQ ID NO: 7059082 - DNA, 21 bp, Homo sapiens
cccaggagtcctatttaaatg

SEQ ID NO: 7059083 - DNA, 22 bp, Homo sapiens
cccaggaggttggggctacagt

SEQ ID NO: 7059084 - DNA, 22 bp, Homo sapiens
cccaggaggttggggctacagt

SEQ ID NO: 7059085 - DNA, 22 bp, Homo sapiens
tgccctctttctgtacagctcc

SEQ ID NO: 7059086 - DNA, 22 bp, Homo sapiens
cccaggaggcggaggttgcagt

SEQ ID NO: 7059087 - DNA, 21 bp, Homo sapiens
cccaggaggctgagaagagca

SEQ ID NO: 7059088 - DNA, 22 bp, Homo sapiens
tgccctcagaattgctccctgc

SEQ ID NO: 7059089 - DNA, 22 bp, Homo sapiens
tgccctcagcagcagctcctgc

SEQ ID NO: 7059090 - DNA, 22 bp, Homo sapiens
tgccctcagccacctccaagtt

SEQ ID NO: 7059091 - DNA, 22 bp, Homo sapiens
tgccctccacagtggctccacc

SEQ ID NO: 7059092 - DNA, 22 bp, Homo sapiens
tgccctccacagtggctccacc

SEQ ID NO: 7059093 - DNA, 23 bp, Homo sapiens
tgccctcccaatgcttcggtcac

SEQ ID NO: 7059094 - DNA, 22 bp, Homo sapiens
tgccctcccacattatggctgt

SEQ ID NO: 7059095 - DNA, 22 bp, Homo sapiens
tgccctcctcctgagcccatgt

SEQ ID NO: 7059096 - DNA, 22 bp, Homo sapiens
tgccctctaggctacagttcca

SEQ ID NO: 7059097 - DNA, 22 bp, Homo sapiens
tgccctctgcctcctctgcaga

SEQ ID NO: 7059098 - DNA, 22 bp, Homo sapiens
tgccctctgcctcctctgcaga

SEQ ID NO: 7059099 - DNA, 22 bp, Homo sapiens
cccaggaggccaaggttgcagt

SEQ ID NO: 7059100 - DNA, 22 bp, Homo sapiens
cccaggaggcagatgttgcagt

SEQ ID NO: 7059101 - DNA, 22 bp, Homo sapiens
cccaggaggcagaggttgcagt

SEQ ID NO: 7059102 - DNA, 22 bp, Homo sapiens
cccaggaggcagagcttgcagt

SEQ ID NO: 7059103 - DNA, 22 bp, Homo sapiens
cccaggaggaggaaaaagctcg

SEQ ID NO: 7059104 - DNA, 22 bp, Homo sapiens
cccaggaggcagaagttgcagt

SEQ ID NO: 7059105 - DNA, 21 bp, Homo sapiens
cccaggaggagctccggctcc

SEQ ID NO: 7059106 - DNA, 22 bp, Homo sapiens
cccaggagatctggatctcgtc

SEQ ID NO: 7059107 - DNA, 22 bp, Homo sapiens
cccaggagataacgttcccaag

SEQ ID NO: 7059108 - DNA, 22 bp, Homo sapiens
tgcatattttctgattcagaag

SEQ ID NO: 7059109 - DNA, 21 bp, Homo sapiens
tgcatattcttctggtggctg

SEQ ID NO: 7059110 - DNA, 22 bp, Homo sapiens
tgcatattgtccttgatattat

SEQ ID NO: 7059111 - DNA, 22 bp, Homo sapiens
tgcatattgtccttgatattat

SEQ ID NO: 7059112 - DNA, 22 bp, Homo sapiens
tgcatattgtccttgatattat

SEQ ID NO: 7059113 - DNA, 22 bp, Homo sapiens
tgcatattgtgaaaatgtagat

SEQ ID NO: 7059114 - DNA, 22 bp, Homo sapiens
tgcatatttgattgagatacct

SEQ ID NO: 7059115 - DNA, 22 bp, Homo sapiens
tgcatatttgtatgatgtttag

SEQ ID NO: 7059116 - DNA, 22 bp, Homo sapiens
tgcatatttgtatgatgtttag

SEQ ID NO: 7059117 - DNA, 22 bp, Homo sapiens
tgcatattttataaagatggaa

SEQ ID NO: 7059118 - DNA, 21 bp, Homo sapiens
tgcatatataagtgcatacac

SEQ ID NO: 7059119 - DNA, 19 bp, Homo sapiens
tgcatatatctatgaaaga

SEQ ID NO: 7059120 - DNA, 22 bp, Homo sapiens
cccaggagacagaaacagaggt

SEQ ID NO: 7059121 - DNA, 22 bp, Homo sapiens
cccaggagacagaaacagaggt

SEQ ID NO: 7059122 - DNA, 22 bp, Homo sapiens
tgcatatatcttatttttctgt

SEQ ID NO: 7059123 - DNA, 22 bp, Homo sapiens
tgcatattataaagagaattag

SEQ ID NO: 7059124 - DNA, 22 bp, Homo sapiens
tgcatattatgtgtatctgtct

SEQ ID NO: 7059125 - DNA, 22 bp, Homo sapiens
tgcatattctcctttattttgt

SEQ ID NO: 7059126 - DNA, 22 bp, Homo sapiens
cccaggagaatataatgttctt

SEQ ID NO: 7059127 - DNA, 21 bp, Homo sapiens
cccaggagaagaaaagatgca

SEQ ID NO: 7059128 - DNA, 22 bp, Homo sapiens
cccaggactctgacacccccaa

SEQ ID NO: 7059129 - DNA, 22 bp, Homo sapiens
cccaggacccttcaatggctcc

SEQ ID NO: 7059130 - DNA, 18 bp, Homo sapiens
cccagctccacttccctc

SEQ ID NO: 7059131 - DNA, 22 bp, Homo sapiens
tgcagtggaatctggagagcag

SEQ ID NO: 7059132 - DNA, 22 bp, Homo sapiens
tgcagtggaggccgtgagacag

SEQ ID NO: 7059133 - DNA, 22 bp, Homo sapiens
tgcaggtggacacgggagacgg

SEQ ID NO: 7059134 - DNA, 22 bp, Homo sapiens
tgcagtcttccagctgcacaaa

SEQ ID NO: 7059135 - DNA, 22 bp, Homo sapiens
tgcagtggaagaggtggagatc

SEQ ID NO: 7059136 - DNA, 22 bp, Homo sapiens
cccagcaggtcggtgctgcctg

SEQ ID NO: 7059137 - DNA, 22 bp, Homo sapiens
cccagcaggtgccatcactctg

SEQ ID NO: 7059138 - DNA, 21 bp, Homo sapiens
tgcagagatatctgaagcaga

SEQ ID NO: 7059139 - DNA, 22 bp, Homo sapiens
tgcagaggtgttgctgagataa

SEQ ID NO: 7059140 - DNA, 22 bp, Homo sapiens
tgcagaggtttccaggcaagtt

SEQ ID NO: 7059141 - DNA, 22 bp, Homo sapiens
tgcagaggtttccaggcaagtt

SEQ ID NO: 7059142 - DNA, 23 bp, Homo sapiens
cccacatgtctgagtcagtgcca

SEQ ID NO: 7059143 - DNA, 22 bp, Homo sapiens
tgcagagatagaactactttct

SEQ ID NO: 7059144 - DNA, 22 bp, Homo sapiens
cccacaggcaggggcagagaca

SEQ ID NO: 7059145 - DNA, 22 bp, Homo sapiens
cccacaggccctgctgccttga

SEQ ID NO: 7059146 - DNA, 22 bp, Homo sapiens
cccacaggccctgctgccttga

SEQ ID NO: 7059147 - DNA, 22 bp, Homo sapiens
cccacagggctgctgatggcag

SEQ ID NO: 7059148 - DNA, 22 bp, Homo sapiens
cccacaggtccccatgaactcg

SEQ ID NO: 7059149 - DNA, 22 bp, Homo sapiens
cccagagatcttgtcctttcca

SEQ ID NO: 7059150 - DNA, 22 bp, Homo sapiens
cccagagaagtgaagtgacttg

SEQ ID NO: 7059151 - DNA, 22 bp, Homo sapiens
cccagagaatctttcagaaagg

SEQ ID NO: 7059152 - DNA, 22 bp, Homo sapiens
cccagagaattccacatagagg

SEQ ID NO: 7059153 - DNA, 22 bp, Homo sapiens
cccagcagaatctgatgagggc

SEQ ID NO: 7059154 - DNA, 23 bp, Homo sapiens
cccagcagagatgaggaggggtc

SEQ ID NO: 7059155 - DNA, 22 bp, Homo sapiens
cccagcagatggctatgtgcta

SEQ ID NO: 7059156 - DNA, 22 bp, Homo sapiens
tgatgagggagatttgagccca

SEQ ID NO: 7059157 - DNA, 22 bp, Homo sapiens
tgatgagggcagttcttgttgc

SEQ ID NO: 7059158 - DNA, 22 bp, Homo sapiens
tgatgaggggctcagaggtcag

SEQ ID NO: 7059159 - DNA, 22 bp, Homo sapiens
tgatgagggggaacagagattt

SEQ ID NO: 7059160 - DNA, 21 bp, Homo sapiens
tgatgaggtcatagcaccctc

SEQ ID NO: 7059161 - DNA, 22 bp, Homo sapiens
tgatgactatatatgactagtg

SEQ ID NO: 7059162 - DNA, 22 bp, Homo sapiens
tgatgaggacccatcacctggt

SEQ ID NO: 7059163 - DNA, 22 bp, Homo sapiens
tgatgaggacctggtctctgct

SEQ ID NO: 7059164 - DNA, 22 bp, Homo sapiens
tgatgaggacctggtctctgct

SEQ ID NO: 7059165 - DNA, 22 bp, Homo sapiens
tgatgaggagactgtggcttgg

SEQ ID NO: 7059166 - DNA, 22 bp, Homo sapiens
tgatgaggcatatgctacacat

SEQ ID NO: 7059167 - DNA, 22 bp, Homo sapiens
tgatgaggcttcttggtgaaca

SEQ ID NO: 7059168 - DNA, 22 bp, Homo sapiens
tgatgagggaactggttcatac

SEQ ID NO: 7059169 - DNA, 22 bp, Homo sapiens
tgatgaattagtaacaaatgag

SEQ ID NO: 7059170 - DNA, 22 bp, Homo sapiens
tgatgacaaactttcctgatgc

SEQ ID NO: 7059171 - DNA, 18 bp, Homo sapiens
tgaggcagtcagtgatgg

SEQ ID NO: 7059172 - DNA, 18 bp, Homo sapiens
tgaggcagtcagtgatgg

SEQ ID NO: 7059173 - DNA, 22 bp, Homo sapiens
tgaggcagtgctgggaagcctg

SEQ ID NO: 7059174 - DNA, 22 bp, Homo sapiens
tgaggcaggtggattacaaggt

SEQ ID NO: 7059175 - DNA, 22 bp, Homo sapiens
tgaggcagtattctccattcca

SEQ ID NO: 7059176 - DNA, 22 bp, Homo sapiens
tgaggcagtattttagtgactt

SEQ ID NO: 7059177 - DNA, 18 bp, Homo sapiens
tgaggcagtcagtgatgg

SEQ ID NO: 7059178 - DNA, 22 bp, Homo sapiens
ccagtgtgttccctgcctcact

SEQ ID NO: 7059179 - DNA, 23 bp, Homo sapiens
ccagtgtggtaggtccacaggtg

SEQ ID NO: 7059180 - DNA, 23 bp, Homo sapiens
ccagtgtggtaggtccacaggtg

SEQ ID NO: 7059181 - DNA, 22 bp, Homo sapiens
tgattacattggtaatgtttat

SEQ ID NO: 7059182 - DNA, 22 bp, Homo sapiens
tgattacagtatttgagatcca

SEQ ID NO: 7059183 - DNA, 23 bp, Homo sapiens
tgattacaggaagttcaagtgtt

SEQ ID NO: 7059184 - DNA, 22 bp, Homo sapiens
tgattacactatttgggaatag

SEQ ID NO: 7059185 - DNA, 22 bp, Homo sapiens
tgattacacagcagtaatttca

SEQ ID NO: 7059186 - DNA, 22 bp, Homo sapiens
cccaactactctcaggcagctt

SEQ ID NO: 7059187 - DNA, 22 bp, Homo sapiens
cccaagagatcgcatgtagttg

SEQ ID NO: 7059188 - DNA, 22 bp, Homo sapiens
cccaagcagggtgcagaggcat

SEQ ID NO: 7059189 - DNA, 22 bp, Homo sapiens
ccatggagcgggtgagtgagtg

SEQ ID NO: 7059190 - DNA, 22 bp, Homo sapiens
ccatggcctcgctctacgtggg

SEQ ID NO: 7059191 - DNA, 22 bp, Homo sapiens
ccattgtaaattctgtggaagt

SEQ ID NO: 7059192 - DNA, 21 bp, Homo sapiens
ccagggaagaaatgagggcag

SEQ ID NO: 7059193 - DNA, 21 bp, Homo sapiens
tgaaggagaggaccgagtgct

SEQ ID NO: 7059194 - DNA, 21 bp, Homo sapiens
tgaaggagaggaccgagtgct

SEQ ID NO: 7059195 - DNA, 22 bp, Homo sapiens
ccaggctttcccagcctctcca

SEQ ID NO: 7059196 - DNA, 22 bp, Homo sapiens
ccagggaaaatcaacttctact

SEQ ID NO: 7059197 - DNA, 19 bp, Homo sapiens
tgacagagagcagggtggt

SEQ ID NO: 7059198 - DNA, 23 bp, Homo sapiens
tgacagagcacagtgggggagat

SEQ ID NO: 7059199 - DNA, 22 bp, Homo sapiens
ccagggcatgggaagaactgaa

SEQ ID NO: 7059200 - DNA, 22 bp, Homo sapiens
ccagggcatgtccaagacttag

SEQ ID NO: 7059201 - DNA, 22 bp, Homo sapiens
tgaccctgagagctgaatggct

SEQ ID NO: 7059202 - DNA, 22 bp, Homo sapiens
tgactttggataagaaaatgag

SEQ ID NO: 7059203 - DNA, 22 bp, Homo sapiens
tgactttgtccctttcaaatcc

SEQ ID NO: 7059204 - DNA, 22 bp, Homo sapiens
tgactttggcttaagcagcagt

SEQ ID NO: 7059205 - DNA, 22 bp, Homo sapiens
ccagggccagtaagattggcat

SEQ ID NO: 7059206 - DNA, 22 bp, Homo sapiens
ccagggccagtaagattggcat

SEQ ID NO: 7059207 - DNA, 22 bp, Homo sapiens
tgaccaaaggtggtttatttgg

SEQ ID NO: 7059208 - DNA, 22 bp, Homo sapiens
ccagggtggggtccaggaacca

SEQ ID NO: 7059209 - DNA, 22 bp, Homo sapiens
ccagggtggggtccaggaacca

SEQ ID NO: 7059210 - DNA, 22 bp, Homo sapiens
ccagggtgtagggattccagat

SEQ ID NO: 7059211 - DNA, 22 bp, Homo sapiens
ccagggtgtgagaaggaagtag

SEQ ID NO: 7059212 - DNA, 22 bp, Homo sapiens
ccagggtgtgggcgtcggcacg

SEQ ID NO: 7059213 - DNA, 22 bp, Homo sapiens
ccagggtgggaggctgaaggcg

SEQ ID NO: 7059214 - DNA, 22 bp, Homo sapiens
ccagggttgcagggagccagca

SEQ ID NO: 7059215 - DNA, 22 bp, Homo sapiens
ccagggttgctgtatggcactt

SEQ ID NO: 7059216 - DNA, 22 bp, Homo sapiens
ccagggttggatgagtcactta

SEQ ID NO: 7059217 - DNA, 22 bp, Homo sapiens
ccagggttggcaagcaaggctt

SEQ ID NO: 7059218 - DNA, 22 bp, Homo sapiens
ccagggttggtattcacctgga

SEQ ID NO: 7059219 - DNA, 22 bp, Homo sapiens
ccagggtttaaattctgactat

SEQ ID NO: 7059220 - DNA, 22 bp, Homo sapiens
ccagggtttagcaagcctacaa

SEQ ID NO: 7059221 - DNA, 22 bp, Homo sapiens
tgagacttggcactgaggaact

SEQ ID NO: 7059222 - DNA, 22 bp, Homo sapiens
tgagagtgaaatgtcacatgtc

SEQ ID NO: 7059223 - DNA, 22 bp, Homo sapiens
tgagagtggttcagctcagaag

SEQ ID NO: 7059224 - DNA, 22 bp, Homo sapiens
tgagataacatggaagagtagc

SEQ ID NO: 7059225 - DNA, 22 bp, Homo sapiens
tgagataactctgatttatgtt

SEQ ID NO: 7059226 - DNA, 23 bp, Homo sapiens
tgagctgggcctgcaggggtctc

SEQ ID NO: 7059227 - DNA, 23 bp, Homo sapiens
tgagctggtattgtccatctcca

SEQ ID NO: 7059228 - DNA, 22 bp, Homo sapiens
tgaggaagttgtttctcttcta

SEQ ID NO: 7059229 - DNA, 22 bp, Homo sapiens
tgaggaatgctgagcagaggaa

SEQ ID NO: 7059230 - DNA, 22 bp, Homo sapiens
tgaggacatgagtgggacagag

SEQ ID NO: 7059231 - DNA, 22 bp, Homo sapiens
tgaggacatgagtgggacagag

SEQ ID NO: 7059232 - DNA, 22 bp, Homo sapiens
tgaggacatgagtgggacagag

SEQ ID NO: 7059233 - DNA, 22 bp, Homo sapiens
tgaggacattaggaagtgaagg

SEQ ID NO: 7059234 - DNA, 22 bp, Homo sapiens
tgaggacattaggaagtgaagg

SEQ ID NO: 7059235 - DNA, 22 bp, Homo sapiens
tgaggacattgagactggagac

SEQ ID NO: 7059236 - DNA, 22 bp, Homo sapiens
tgaggacattggtcaggacatg

SEQ ID NO: 7059237 - DNA, 23 bp, Homo sapiens
ccagtggcgtaaactagaggata

SEQ ID NO: 7059238 - DNA, 22 bp, Homo sapiens
ccagtggctacaggggggttga

SEQ ID NO: 7059239 - DNA, 22 bp, Homo sapiens
tgagctggcttgtcaaccaggg

SEQ ID NO: 7059240 - DNA, 22 bp, Homo sapiens
tgagctggcaggggctcaggga

SEQ ID NO: 7059241 - DNA, 22 bp, Homo sapiens
tgagcagaagccctcctggact

SEQ ID NO: 7059242 - DNA, 22 bp, Homo sapiens
ccaggctcaggtgcgagagaca

SEQ ID NO: 7059243 - DNA, 22 bp, Homo sapiens
ccaggctcaggcctgctcgttg

SEQ ID NO: 7059244 - DNA, 22 bp, Homo sapiens
ccaggctcactgactaccacat

SEQ ID NO: 7059245 - DNA, 22 bp, Homo sapiens
ccaggctcagcgcgcacgtctg

SEQ ID NO: 7059246 - DNA, 22 bp, Homo sapiens
ccaggctcagcgcgcacgtctg

SEQ ID NO: 7059247 - DNA, 18 bp, Homo sapiens
tctttaagttgtcagagt

SEQ ID NO: 7059248 - DNA, 21 bp, Homo sapiens
ccagcctcagatcagggagct

SEQ ID NO: 7059249 - DNA, 18 bp, Homo sapiens
tcttgcctgcaccctctc

SEQ ID NO: 7059250 - DNA, 22 bp, Homo sapiens
tcttgtatgtgtattttgctgt

SEQ ID NO: 7059251 - DNA, 22 bp, Homo sapiens
tcttgtatttgattccttccaa

SEQ ID NO: 7059252 - DNA, 21 bp, Homo sapiens
tcttgtccttgctctcccact

SEQ ID NO: 7059253 - DNA, 22 bp, Homo sapiens
tctgcagacactggggtctgga

SEQ ID NO: 7059254 - DNA, 22 bp, Homo sapiens
tctgcagacaggaagctgaggc

SEQ ID NO: 7059255 - DNA, 22 bp, Homo sapiens
tctgcagagattctgggctgag

SEQ ID NO: 7059256 - DNA, 22 bp, Homo sapiens
tgaaagcagatagctctgttgt

SEQ ID NO: 7059257 - DNA, 22 bp, Homo sapiens
tgaaagcagcaccaataccatt

SEQ ID NO: 7059258 - DNA, 22 bp, Homo sapiens
tgaaagctgaggacaggagggt

SEQ ID NO: 7059259 - DNA, 22 bp, Homo sapiens
tgaaagctgtccactaggctgt

SEQ ID NO: 7059260 - DNA, 22 bp, Homo sapiens
tgaaagggaacctgctggactg

SEQ ID NO: 7059261 - DNA, 22 bp, Homo sapiens
tgaaaggggttgagttacagct

SEQ ID NO: 7059262 - DNA, 22 bp, Homo sapiens
ccaggctgagcatgattggagc

SEQ ID NO: 7059263 - DNA, 22 bp, Homo sapiens
ccaggctgagcatgattggagc

SEQ ID NO: 7059264 - DNA, 22 bp, Homo sapiens
ccaggctgcagtcaaggggcat

SEQ ID NO: 7059265 - DNA, 22 bp, Homo sapiens
ccaggctgcagtcaaggggcat

SEQ ID NO: 7059266 - DNA, 22 bp, Homo sapiens
ccaggctgccgaggaaagaaag

SEQ ID NO: 7059267 - DNA, 22 bp, Homo sapiens
ccaggctgccgaggaaagaaag

SEQ ID NO: 7059268 - DNA, 22 bp, Homo sapiens
ccaggctgccgaggaaagaaag

SEQ ID NO: 7059269 - DNA, 22 bp, Homo sapiens
ccaggctgctcacaagctgccc

SEQ ID NO: 7059270 - DNA, 22 bp, Homo sapiens
ccaggctgctcacaagctgccc

SEQ ID NO: 7059271 - DNA, 22 bp, Homo sapiens
tgaaatgattatatggtgtttg

SEQ ID NO: 7059272 - DNA, 22 bp, Homo sapiens
tgaacacataaggctttcctgt

SEQ ID NO: 7059273 - DNA, 22 bp, Homo sapiens
tgaacagatcaatagaactgac

SEQ ID NO: 7059274 - DNA, 22 bp, Homo sapiens
tgaacagatggcccagcagagg

SEQ ID NO: 7059275 - DNA, 22 bp, Homo sapiens
tgaagagatagaagtacatgct

SEQ ID NO: 7059276 - DNA, 22 bp, Homo sapiens
tgaagagatagaagtacatgct

SEQ ID NO: 7059277 - DNA, 22 bp, Homo sapiens
tgaagagatagaagtacatgct

SEQ ID NO: 7059278 - DNA, 22 bp, Homo sapiens
tgaagaggccaaactatcattg

SEQ ID NO: 7059279 - DNA, 17 bp, Homo sapiens
tgaagatgcatggcagc

SEQ ID NO: 7059280 - DNA, 22 bp, Homo sapiens
tgaagatttccaccaaatcaca

SEQ ID NO: 7059281 - DNA, 22 bp, Homo sapiens
tgaaggaagaataggcagtgtt

SEQ ID NO: 7059282 - DNA, 22 bp, Homo sapiens
tgaaggaatgagggagtgggtc

SEQ ID NO: 7059283 - DNA, 22 bp, Homo sapiens
tgaaggaatgagtatactgttt

SEQ ID NO: 7059284 - DNA, 22 bp, Homo sapiens
tgaaggagaaatggaaagtggg

SEQ ID NO: 7059285 - DNA, 22 bp, Homo sapiens
tgaaggagaattaataggcatt

SEQ ID NO: 7059286 - DNA, 22 bp, Homo sapiens
tttttcagccatgaattacact

SEQ ID NO: 7059287 - DNA, 22 bp, Homo sapiens
tttttcaagacaacctgcatgt

SEQ ID NO: 7059288 - DNA, 22 bp, Homo sapiens
tttttatgcctacgctgaaaag

SEQ ID NO: 7059289 - DNA, 22 bp, Homo sapiens
tttttatatgaaggatagtgcg

SEQ ID NO: 7059290 - DNA, 22 bp, Homo sapiens
tttttataactcttttgtgaca

SEQ ID NO: 7059291 - DNA, 22 bp, Homo sapiens
tttttataactcttttgtgaca

SEQ ID NO: 7059292 - DNA, 22 bp, Homo sapiens
tttttagagtgttaccagtata

SEQ ID NO: 7059293 - DNA, 22 bp, Homo sapiens
tttttagattactcagccacca

SEQ ID NO: 7059294 - DNA, 22 bp, Homo sapiens
tttttagattactcagccacca

SEQ ID NO: 7059295 - DNA, 22 bp, Homo sapiens
tttttagtagaggtgggtttca

SEQ ID NO: 7059296 - DNA, 22 bp, Homo sapiens
ttttgttgtaatatacctatcc

SEQ ID NO: 7059297 - DNA, 22 bp, Homo sapiens
ttttgtttaaaatcctggatgg

SEQ ID NO: 7059298 - DNA, 22 bp, Homo sapiens
ttttgtttgtgtccactgcagt

SEQ ID NO: 7059299 - DNA, 22 bp, Homo sapiens
tttttacacttagcattgagcg

SEQ ID NO: 7059300 - DNA, 22 bp, Homo sapiens
tttttacacttagcattgagcg

SEQ ID NO: 7059301 - DNA, 22 bp, Homo sapiens
tttggtcttttatttaaagcag

SEQ ID NO: 7059302 - DNA, 22 bp, Homo sapiens
tttggttaaacgagagaacata

SEQ ID NO: 7059303 - DNA, 22 bp, Homo sapiens
tttggtttagggtcatttaaca

SEQ ID NO: 7059304 - DNA, 22 bp, Homo sapiens
tttggtttattaaattgtaggc

SEQ ID NO: 7059305 - DNA, 22 bp, Homo sapiens
tttggtttttaatacaaagtac

SEQ ID NO: 7059306 - DNA, 22 bp, Homo sapiens
tttgtaaaagcccaagctgtag

SEQ ID NO: 7059307 - DNA, 22 bp, Homo sapiens
tttgtaaaagcccaagctgtag

SEQ ID NO: 7059308 - DNA, 22 bp, Homo sapiens
tttgatttactggatattctca

SEQ ID NO: 7059309 - DNA, 19 bp, Homo sapiens
tttgatgagaatttaagca

SEQ ID NO: 7059310 - DNA, 22 bp, Homo sapiens
tttgatgaacctatataatttg

SEQ ID NO: 7059311 - DNA, 22 bp, Homo sapiens
tttgatgagtttaataacagcc

SEQ ID NO: 7059312 - DNA, 22 bp, Homo sapiens
tttgatgatgatgataaagttt

SEQ ID NO: 7059313 - DNA, 22 bp, Homo sapiens
tttgcttgttcaagatttctgt

SEQ ID NO: 7059314 - DNA, 22 bp, Homo sapiens
tttgatactttgtgcaatttct

SEQ ID NO: 7059315 - DNA, 19 bp, Homo sapiens
tttgatatctgaattatgc

SEQ ID NO: 7059316 - DNA, 22 bp, Homo sapiens
tttgatccgttgctggtgagga

SEQ ID NO: 7059317 - DNA, 22 bp, Homo sapiens
tttgatgaaagctactatttac

SEQ ID NO: 7059318 - DNA, 22 bp, Homo sapiens
tttgagtgcccatgtttcccag

SEQ ID NO: 7059319 - DNA, 22 bp, Homo sapiens
tttcttttgccctgtgggttag

SEQ ID NO: 7059320 - DNA, 22 bp, Homo sapiens
tttctttgttgttatcacatca

SEQ ID NO: 7059321 - DNA, 22 bp, Homo sapiens
tttctttgtagtagcataatca

SEQ ID NO: 7059322 - DNA, 22 bp, Homo sapiens
tttcttttccaatatccctact

SEQ ID NO: 7059323 - DNA, 18 bp, Homo sapiens
tttctttctgcctggggc

SEQ ID NO: 7059324 - DNA, 21 bp, Homo sapiens
tttccctcattgtgttggcac

SEQ ID NO: 7059325 - DNA, 22 bp, Homo sapiens
tttccctctgtgccagcttctc

SEQ ID NO: 7059326 - DNA, 22 bp, Homo sapiens
tttccctctgtgccagcttctc

SEQ ID NO: 7059327 - DNA, 19 bp, Homo sapiens
tttcctaaaaagctgtgct

SEQ ID NO: 7059328 - DNA, 22 bp, Homo sapiens
tttcctaacacaatgcatgaga

SEQ ID NO: 7059329 - DNA, 22 bp, Homo sapiens
tttcctcacttcatgagagttt

SEQ ID NO: 7059330 - DNA, 22 bp, Homo sapiens
tttcctcacttcatgagagttt

SEQ ID NO: 7059331 - DNA, 22 bp, Homo sapiens
tttcctaacacaatgcatgaga

SEQ ID NO: 7059332 - DNA, 22 bp, Homo sapiens
tttcctcagaagtgtctactat

SEQ ID NO: 7059333 - DNA, 22 bp, Homo sapiens
tttcctcagaagtgtctactat

SEQ ID NO: 7059334 - DNA, 22 bp, Homo sapiens
tttcctcatttatctgctggga

SEQ ID NO: 7059335 - DNA, 22 bp, Homo sapiens
tttcctcatttatctgctggga

SEQ ID NO: 7059336 - DNA, 22 bp, Homo sapiens
tttcctcctagcctccagccgc

SEQ ID NO: 7059337 - DNA, 22 bp, Homo sapiens
tttcctctaaacgcatttgctt

SEQ ID NO: 7059338 - DNA, 22 bp, Homo sapiens
tttcctctaaacgcatttgctt

SEQ ID NO: 7059339 - DNA, 22 bp, Homo sapiens
tttcctctccaccaggaggtct

SEQ ID NO: 7059340 - DNA, 22 bp, Homo sapiens
tttcctctccggggcctccagg

SEQ ID NO: 7059341 - DNA, 22 bp, Homo sapiens
tttcctctccggggcctccagg

SEQ ID NO: 7059342 - DNA, 22 bp, Homo sapiens
tttcctctgactgctcccctgc

SEQ ID NO: 7059343 - DNA, 22 bp, Homo sapiens
tttcctctgactgctcccctgc

SEQ ID NO: 7059344 - DNA, 22 bp, Homo sapiens
tttcctctgagtgagctgggag

SEQ ID NO: 7059345 - DNA, 22 bp, Homo sapiens
tttgacaattcatgacatttat

SEQ ID NO: 7059346 - DNA, 22 bp, Homo sapiens
tttgacaagagcaaatgttctt

SEQ ID NO: 7059347 - DNA, 22 bp, Homo sapiens
tttgaatgttttaggtacttaa

SEQ ID NO: 7059348 - DNA, 22 bp, Homo sapiens
tttgacaaatatttattggcac

SEQ ID NO: 7059349 - DNA, 22 bp, Homo sapiens
tttgacaacacgttatttgcct

SEQ ID NO: 7059350 - DNA, 22 bp, Homo sapiens
tttgaaagcctggcttttctct

SEQ ID NO: 7059351 - DNA, 21 bp, Homo sapiens
tttgaaagccctatgttttca

SEQ ID NO: 7059352 - DNA, 21 bp, Homo sapiens
tttgaaagctacatctatagc

SEQ ID NO: 7059353 - DNA, 22 bp, Homo sapiens
tttgaaaggaattaggatgaca

SEQ ID NO: 7059354 - DNA, 22 bp, Homo sapiens
tttgaaaggagctttatccaga

SEQ ID NO: 7059355 - DNA, 19 bp, Homo sapiens
tttgaaaggattgttattt

SEQ ID NO: 7059356 - DNA, 22 bp, Homo sapiens
tttgaaagggttatgagactga

SEQ ID NO: 7059357 - DNA, 22 bp, Homo sapiens
tttgaaaggtgtcgagatgtgt

SEQ ID NO: 7059358 - DNA, 22 bp, Homo sapiens
tttgaagataaatatggagaaa

SEQ ID NO: 7059359 - DNA, 22 bp, Homo sapiens
tttgaatagcataggattacat

SEQ ID NO: 7059360 - DNA, 22 bp, Homo sapiens
tttgaatatacttcaaacaaag

SEQ ID NO: 7059361 - DNA, 22 bp, Homo sapiens
tttgaatatcacaaactttcaa

SEQ ID NO: 7059362 - DNA, 22 bp, Homo sapiens
tttgttcaaggaatagtaaatg

SEQ ID NO: 7059363 - DNA, 22 bp, Homo sapiens
tttgttataacaataaaaagtc

SEQ ID NO: 7059364 - DNA, 22 bp, Homo sapiens
tttgttaaggagtattgcttct

SEQ ID NO: 7059365 - DNA, 22 bp, Homo sapiens
tttgttaattcttatgttagag

SEQ ID NO: 7059366 - DNA, 22 bp, Homo sapiens
tttgttaaaatgcagattctgt

SEQ ID NO: 7059367 - DNA, 22 bp, Homo sapiens
tttgttaaatatttattgagtg

SEQ ID NO: 7059368 - DNA, 22 bp, Homo sapiens
tttgttaaatatttattgagtg

SEQ ID NO: 7059369 - DNA, 22 bp, Homo sapiens
tttgtgttttcccatactattg

SEQ ID NO: 7059370 - DNA, 22 bp, Homo sapiens
tttgtgttggaagaaatgctac

SEQ ID NO: 7059371 - DNA, 22 bp, Homo sapiens
tttgtaaaaggaggaagcatgg

SEQ ID NO: 7059372 - DNA, 22 bp, Homo sapiens
ttttaacttaaaatacatagat

SEQ ID NO: 7059373 - DNA, 22 bp, Homo sapiens
ttttaagaaatgtatgactgtc

SEQ ID NO: 7059374 - DNA, 22 bp, Homo sapiens
ttttaaatctccagttgacccc

SEQ ID NO: 7059375 - DNA, 22 bp, Homo sapiens
ttttaaatctccagttgacccc

SEQ ID NO: 7059376 - DNA, 22 bp, Homo sapiens
ttttaaactgcagaatttagaa

SEQ ID NO: 7059377 - DNA, 22 bp, Homo sapiens
ttttaattcaaagtgaatagtg

SEQ ID NO: 7059378 - DNA, 22 bp, Homo sapiens
ttttaatgtgctctgcaatgat

SEQ ID NO: 7059379 - DNA, 22 bp, Homo sapiens
ttttaatgggcgactattatgg

SEQ ID NO: 7059380 - DNA, 22 bp, Homo sapiens
ttttatgtgctggactggcagt

SEQ ID NO: 7059381 - DNA, 22 bp, Homo sapiens
ttttatgtaatccttactgtcg

SEQ ID NO: 7059382 - DNA, 21 bp, Homo sapiens
ttttatgcataggaaatatat

SEQ ID NO: 7059383 - DNA, 22 bp, Homo sapiens
ttttatgcaagttatgattaaa

SEQ ID NO: 7059384 - DNA, 22 bp, Homo sapiens
ttttatgagtgtccctctgtgg

SEQ ID NO: 7059385 - DNA, 22 bp, Homo sapiens
ttttatgattgagctggctaca

SEQ ID NO: 7059386 - DNA, 22 bp, Homo sapiens
ttttcttatgtgcagctatatg

SEQ ID NO: 7059387 - DNA, 22 bp, Homo sapiens
ttttcttatggtgaagcacaaa

SEQ ID NO: 7059388 - DNA, 22 bp, Homo sapiens
ttttcttatggtgaagcacaaa

SEQ ID NO: 7059389 - DNA, 22 bp, Homo sapiens
ttttcttatagagcttaaagtt

SEQ ID NO: 7059390 - DNA, 22 bp, Homo sapiens
ttttcttaggtgctccaagtag

SEQ ID NO: 7059391 - DNA, 22 bp, Homo sapiens
ttttcttactgtctgtgatcct

SEQ ID NO: 7059392 - DNA, 22 bp, Homo sapiens
ttttcttactgtctgtgatcct

SEQ ID NO: 7059393 - DNA, 22 bp, Homo sapiens
ttttctgttacaaagtacagcg

SEQ ID NO: 7059394 - DNA, 22 bp, Homo sapiens
ttttcatttacattagggaaga

SEQ ID NO: 7059395 - DNA, 22 bp, Homo sapiens
ttttcatttttgtagatgcaag

SEQ ID NO: 7059396 - DNA, 22 bp, Homo sapiens
ttttctcaagatccaatgcact

SEQ ID NO: 7059397 - DNA, 22 bp, Homo sapiens
ttttctcagctgcactgtatta

SEQ ID NO: 7059398 - DNA, 22 bp, Homo sapiens
ttttctcagctgcactgtatta

SEQ ID NO: 7059399 - DNA, 19 bp, Homo sapiens
ttttctcagcttctagcgg

SEQ ID NO: 7059400 - DNA, 22 bp, Homo sapiens
ttttctcttccctctggacctg

SEQ ID NO: 7059401 - DNA, 22 bp, Homo sapiens
ttttctcttgttaatgtactga

SEQ ID NO: 7059402 - DNA, 22 bp, Homo sapiens
ttttctgaagtttaagacattt

SEQ ID NO: 7059403 - DNA, 22 bp, Homo sapiens
ttttctgaagtttaagacattt

SEQ ID NO: 7059404 - DNA, 22 bp, Homo sapiens
ttttctgaagtttaagacattt

SEQ ID NO: 7059405 - DNA, 22 bp, Homo sapiens
ttttatgttcctctttatgcga

SEQ ID NO: 7059406 - DNA, 22 bp, Homo sapiens
ttttatgttcctgaagctatct

SEQ ID NO: 7059407 - DNA, 22 bp, Homo sapiens
ttttatgttgctataataggta

SEQ ID NO: 7059408 - DNA, 22 bp, Homo sapiens
ttttattagtggctagatgggg

SEQ ID NO: 7059409 - DNA, 22 bp, Homo sapiens
ttttcattgttactatgagcta

SEQ ID NO: 7059410 - DNA, 22 bp, Homo sapiens
ttttcattgttcctcgagcatt

SEQ ID NO: 7059411 - DNA, 22 bp, Homo sapiens
ttttcattgttcctcgagcatt

SEQ ID NO: 7059412 - DNA, 22 bp, Homo sapiens
ttttcattgtaaatcaggaaac

SEQ ID NO: 7059413 - DNA, 22 bp, Homo sapiens
ttttcattgttactatgagcta

SEQ ID NO: 7059414 - DNA, 22 bp, Homo sapiens
ttttcattgttactatgagcta

SEQ ID NO: 7059415 - DNA, 22 bp, Homo sapiens
ttttcattgtaaatcaggaaac

SEQ ID NO: 7059416 - DNA, 22 bp, Homo sapiens
ttttcattgagcacctgagtaa

SEQ ID NO: 7059417 - DNA, 22 bp, Homo sapiens
ttttcattagaatgactgagaa

SEQ ID NO: 7059418 - DNA, 22 bp, Homo sapiens
ttttcatctctgctttgtacct

SEQ ID NO: 7059419 - DNA, 22 bp, Homo sapiens
ttttcatgtcatgtccttgagg

SEQ ID NO: 7059420 - DNA, 22 bp, Homo sapiens
ttttattggagtgataccaagc

SEQ ID NO: 7059421 - DNA, 22 bp, Homo sapiens
ttttcacacaaggtgataagtt

SEQ ID NO: 7059422 - DNA, 22 bp, Homo sapiens
ttttcacacaaggtgataagtt

SEQ ID NO: 7059423 - DNA, 19 bp, Homo sapiens
ttttcacatactggatcct

SEQ ID NO: 7059424 - DNA, 22 bp, Homo sapiens
ttggaaattgcaagtgatttgc

SEQ ID NO: 7059425 - DNA, 22 bp, Homo sapiens
ttggaaatggctgtagttatga

SEQ ID NO: 7059426 - DNA, 22 bp, Homo sapiens
ttggaaatacagcagttacttt

SEQ ID NO: 7059427 - DNA, 22 bp, Homo sapiens
ttggaaaggagattctattgtg

SEQ ID NO: 7059428 - DNA, 22 bp, Homo sapiens
ttggaaacttggatggaaaacc

SEQ ID NO: 7059429 - DNA, 22 bp, Homo sapiens
ttggaaagaagggctgagcaag

SEQ ID NO: 7059430 - DNA, 22 bp, Homo sapiens
ttggaaagaccgaattcctgtt

SEQ ID NO: 7059431 - DNA, 22 bp, Homo sapiens
ttggaaagattattattatgaa

SEQ ID NO: 7059432 - DNA, 22 bp, Homo sapiens
ttggaaaatgtatttctagaag

SEQ ID NO: 7059433 - DNA, 22 bp, Homo sapiens
ttgctttccgtcatgtgctaat

SEQ ID NO: 7059434 - DNA, 22 bp, Homo sapiens
ttgctttccgtcatgtgctaat

SEQ ID NO: 7059435 - DNA, 22 bp, Homo sapiens
ttgctttattgggtttactgcc

SEQ ID NO: 7059436 - DNA, 23 bp, Homo sapiens
ttgctttcatcatgagatgctcc

SEQ ID NO: 7059437 - DNA, 22 bp, Homo sapiens
ttgcatgtgtataaaagttgga

SEQ ID NO: 7059438 - DNA, 22 bp, Homo sapiens
ttgcatttaagtagatgttaca

SEQ ID NO: 7059439 - DNA, 22 bp, Homo sapiens
ttgctctgaacccagggcacca

SEQ ID NO: 7059440 - DNA, 22 bp, Homo sapiens
ttgctctgattaggtggaaaca

SEQ ID NO: 7059441 - DNA, 22 bp, Homo sapiens
ttgctctgtcagggcctcagtc

SEQ ID NO: 7059442 - DNA, 22 bp, Homo sapiens
ttgctctgtccagccagcaggt

SEQ ID NO: 7059443 - DNA, 22 bp, Homo sapiens
ttgctgaaaacagtgggtattg

SEQ ID NO: 7059444 - DNA, 22 bp, Homo sapiens
ttgctgaaatctatgacatcct

SEQ ID NO: 7059445 - DNA, 22 bp, Homo sapiens
ttgctgaagtgaaggtatgttt

SEQ ID NO: 7059446 - DNA, 22 bp, Homo sapiens
ttgctgaagttaatgcttgcaa

SEQ ID NO: 7059447 - DNA, 22 bp, Homo sapiens
ttgctgaattgaatcctttggt

SEQ ID NO: 7059448 - DNA, 22 bp, Homo sapiens
ttgctgagagcgtgtcaacaag

SEQ ID NO: 7059449 - DNA, 22 bp, Homo sapiens
ttgctgtgaaaccatgggaagt

SEQ ID NO: 7059450 - DNA, 22 bp, Homo sapiens
ttgctgtgtaactcctggcctg

SEQ ID NO: 7059451 - DNA, 22 bp, Homo sapiens
ttgctgtgtcatttgtttaatc

SEQ ID NO: 7059452 - DNA, 22 bp, Homo sapiens
ttgctgtgtctgatggctgaga

SEQ ID NO: 7059453 - DNA, 22 bp, Homo sapiens
ttgctgttttacatctggtggg

SEQ ID NO: 7059454 - DNA, 21 bp, Homo sapiens
ttgctgttttcccaatgcagt

SEQ ID NO: 7059455 - DNA, 22 bp, Homo sapiens
ttgcttatttgattaaatgtct

SEQ ID NO: 7059456 - DNA, 22 bp, Homo sapiens
ttgcagtaggtggagtgaattt

SEQ ID NO: 7059457 - DNA, 18 bp, Homo sapiens
ttgcaggtacctctatct

SEQ ID NO: 7059458 - DNA, 22 bp, Homo sapiens
ttgcaggtgagggaaatgactg

SEQ ID NO: 7059459 - DNA, 22 bp, Homo sapiens
ttgcaggggaaggagcagagct

SEQ ID NO: 7059460 - DNA, 22 bp, Homo sapiens
ttgcaggattttagagatgaca

SEQ ID NO: 7059461 - DNA, 22 bp, Homo sapiens
ttgacaatgtcctttgaatttc

SEQ ID NO: 7059462 - DNA, 22 bp, Homo sapiens
ttgacacaatgtatattttcaa

SEQ ID NO: 7059463 - DNA, 22 bp, Homo sapiens
ttgcagagaggttaggaactca

SEQ ID NO: 7059464 - DNA, 22 bp, Homo sapiens
ttgcagagatcagcaggtttga

SEQ ID NO: 7059465 - DNA, 22 bp, Homo sapiens
ttgcagagcagtaggaatatag

SEQ ID NO: 7059466 - DNA, 22 bp, Homo sapiens
ttgcagagccatgaggctggct

SEQ ID NO: 7059467 - DNA, 22 bp, Homo sapiens
ttgcagaggcaaaaatgaactc

SEQ ID NO: 7059468 - DNA, 22 bp, Homo sapiens
ttgcagagtggttgtgaggatt

SEQ ID NO: 7059469 - DNA, 22 bp, Homo sapiens
ttgtcattggggttatttgtta

SEQ ID NO: 7059470 - DNA, 22 bp, Homo sapiens
ttgtccaaggtcccacagttag

SEQ ID NO: 7059471 - DNA, 22 bp, Homo sapiens
ttgtcaagaaaaatggatgaag

SEQ ID NO: 7059472 - DNA, 22 bp, Homo sapiens
ttgtcaagattgagagatgact

SEQ ID NO: 7059473 - DNA, 22 bp, Homo sapiens
ttgtcaaggcttttaatattct

SEQ ID NO: 7059474 - DNA, 22 bp, Homo sapiens
ttgtcaagtaaggctgacattt

SEQ ID NO: 7059475 - DNA, 22 bp, Homo sapiens
ttgtcactagtgaagaatcagg

SEQ ID NO: 7059476 - DNA, 22 bp, Homo sapiens
ttgtcctgcaacctcacatggc

SEQ ID NO: 7059477 - DNA, 23 bp, Homo sapiens
ttgtcctgccgatctctgagaat

SEQ ID NO: 7059478 - DNA, 22 bp, Homo sapiens
ttgtcctggaggttaatagagt

SEQ ID NO: 7059479 - DNA, 22 bp, Homo sapiens
ttgtcctgtcaggctgggggct

SEQ ID NO: 7059480 - DNA, 22 bp, Homo sapiens
ttgtcctgtgatttcagggcct

SEQ ID NO: 7059481 - DNA, 22 bp, Homo sapiens
ttgtcctgtgtctgtttggatt

SEQ ID NO: 7059482 - DNA, 22 bp, Homo sapiens
ttgtcctgttacttgtttggat

SEQ ID NO: 7059483 - DNA, 22 bp, Homo sapiens
ttgtggctcgtgagatgttagg

SEQ ID NO: 7059484 - DNA, 22 bp, Homo sapiens
ttgtacaagtattatgtgaaca

SEQ ID NO: 7059485 - DNA, 22 bp, Homo sapiens
ttgtaagagagaattgcaaatt

SEQ ID NO: 7059486 - DNA, 22 bp, Homo sapiens
ttgtacagaaaaaattcttggt

SEQ ID NO: 7059487 - DNA, 22 bp, Homo sapiens
ttgtattttttcctggcggtgg

SEQ ID NO: 7059488 - DNA, 22 bp, Homo sapiens
ttgtaacaggtactaaataact

SEQ ID NO: 7059489 - DNA, 22 bp, Homo sapiens
ttgtaacagctgtttatatagt

SEQ ID NO: 7059490 - DNA, 22 bp, Homo sapiens
ttgtaaatagtagtaagatgcc

SEQ ID NO: 7059491 - DNA, 22 bp, Homo sapiens
ttggagatatcacaccttcaca

SEQ ID NO: 7059492 - DNA, 22 bp, Homo sapiens
ttggaggaggcattggaggatt

SEQ ID NO: 7059493 - DNA, 22 bp, Homo sapiens
ttggcaggaatattgcagaggt

SEQ ID NO: 7059494 - DNA, 22 bp, Homo sapiens
ttggcagggcatcagacacgtg

SEQ ID NO: 7059495 - DNA, 22 bp, Homo sapiens
ttggcagtaaaagaaaatgctt

SEQ ID NO: 7059496 - DNA, 22 bp, Homo sapiens
ttggcagtgatgcagcttgttc

SEQ ID NO: 7059497 - DNA, 22 bp, Homo sapiens
ttggcagtgtctgcaaaatgga

SEQ ID NO: 7059498 - DNA, 22 bp, Homo sapiens
ttgggcagtctggctgcagagt

SEQ ID NO: 7059499 - DNA, 22 bp, Homo sapiens
ttgggcaggtgtggctctcctt

SEQ ID NO: 7059500 - DNA, 22 bp, Homo sapiens
ttgggacagaaaaggagaagat

SEQ ID NO: 7059501 - DNA, 22 bp, Homo sapiens
tttacagtctctatagtcaaaa

SEQ ID NO: 7059502 - DNA, 22 bp, Homo sapiens
tttacagtctgtctagcaatgt

SEQ ID NO: 7059503 - DNA, 19 bp, Homo sapiens
tttacagggaatggagacc

SEQ ID NO: 7059504 - DNA, 22 bp, Homo sapiens
tttaatgtagcgtgaaatgatt

SEQ ID NO: 7059505 - DNA, 22 bp, Homo sapiens
tttaatgatagtcttacgaaaa

SEQ ID NO: 7059506 - DNA, 22 bp, Homo sapiens
tttaatgaataattcaaatctg

SEQ ID NO: 7059507 - DNA, 22 bp, Homo sapiens
tttaaggatgtaaaggaagaag

SEQ ID NO: 7059508 - DNA, 22 bp, Homo sapiens
tttaaggcagtgaaactattct

SEQ ID NO: 7059509 - DNA, 22 bp, Homo sapiens
tttaaggaaaaaatgtacttag

SEQ ID NO: 7059510 - DNA, 22 bp, Homo sapiens
tttaaggagctactcaccgtca

SEQ ID NO: 7059511 - DNA, 22 bp, Homo sapiens
tttaaggaggggctcacgtggg

SEQ ID NO: 7059512 - DNA, 22 bp, Homo sapiens
tttaaggatgatgtgatatata

SEQ ID NO: 7059513 - DNA, 22 bp, Homo sapiens
tttaagattcagtaaggcaaac

SEQ ID NO: 7059514 - DNA, 22 bp, Homo sapiens
tttaaatgtttaaaactcgtga

SEQ ID NO: 7059515 - DNA, 22 bp, Homo sapiens
tttaaatgtttatagagagtac

SEQ ID NO: 7059516 - DNA, 22 bp, Homo sapiens
tttaagatggtattttataaag

SEQ ID NO: 7059517 - DNA, 22 bp, Homo sapiens
tttaagatggtattttataaag

SEQ ID NO: 7059518 - DNA, 22 bp, Homo sapiens
tttaaatggcattttcccagat

SEQ ID NO: 7059519 - DNA, 22 bp, Homo sapiens
tttaaatggcattttcccagat

SEQ ID NO: 7059520 - DNA, 22 bp, Homo sapiens
tttaaatgtgttcttagtagct

SEQ ID NO: 7059521 - DNA, 22 bp, Homo sapiens
tttaaatgtgttcttagtagct

SEQ ID NO: 7059522 - DNA, 22 bp, Homo sapiens
tttaaatgttcatgatactgaa

SEQ ID NO: 7059523 - DNA, 22 bp, Homo sapiens
tttaaataggactcctgggggt

SEQ ID NO: 7059524 - DNA, 22 bp, Homo sapiens
tttaaataggactcctgggggt

SEQ ID NO: 7059525 - DNA, 22 bp, Homo sapiens
tttaaataggactcctgggggt

SEQ ID NO: 7059526 - DNA, 22 bp, Homo sapiens
tttaaatgcagacgttgattca

SEQ ID NO: 7059527 - DNA, 22 bp, Homo sapiens
tttaaatgctttaagcaagggt

SEQ ID NO: 7059528 - DNA, 22 bp, Homo sapiens
tttaaagtgctgctcctatcct

SEQ ID NO: 7059529 - DNA, 22 bp, Homo sapiens
tttaaagtggtccatttcagaa

SEQ ID NO: 7059530 - DNA, 22 bp, Homo sapiens
tttaaagtttttgcacattctg

SEQ ID NO: 7059531 - DNA, 22 bp, Homo sapiens
ttgtgtgtactggttatgggca

SEQ ID NO: 7059532 - DNA, 22 bp, Homo sapiens
ttgtgtgtagactcagccattg

SEQ ID NO: 7059533 - DNA, 17 bp, Homo sapiens
ttgtgtgtagttctgat

SEQ ID NO: 7059534 - DNA, 22 bp, Homo sapiens
tttaaactaacagtacacgttg

SEQ ID NO: 7059535 - DNA, 17 bp, Homo sapiens
tttaaactactacaagg

SEQ ID NO: 7059536 - DNA, 22 bp, Homo sapiens
tttaaagaaattcctcatcttt

SEQ ID NO: 7059537 - DNA, 19 bp, Homo sapiens
tttaaagtgactggtattt

SEQ ID NO: 7059538 - DNA, 22 bp, Homo sapiens
tttagattgtgacctcccccca

SEQ ID NO: 7059539 - DNA, 22 bp, Homo sapiens
tttagataatgctcaagcaatt

SEQ ID NO: 7059540 - DNA, 17 bp, Homo sapiens
tttagaatacaatgttt

SEQ ID NO: 7059541 - DNA, 20 bp, Homo sapiens
tttacattttgaaacagtga

SEQ ID NO: 7059542 - DNA, 22 bp, Homo sapiens
tttaccaaatagattatgtcag

SEQ ID NO: 7059543 - DNA, 22 bp, Homo sapiens
tttacagtctgtctagcaatgt

SEQ ID NO: 7059544 - DNA, 22 bp, Homo sapiens
tttacatttccctctgtcagtt

SEQ ID NO: 7059545 - DNA, 22 bp, Homo sapiens
tttaccaagagttgtcactgtt

SEQ ID NO: 7059546 - DNA, 22 bp, Homo sapiens
tttaccaagctttaattacata

SEQ ID NO: 7059547 - DNA, 22 bp, Homo sapiens
tttatctgaggaaagcagacaa

SEQ ID NO: 7059548 - DNA, 22 bp, Homo sapiens
tttattcaagatgaggttcatg

SEQ ID NO: 7059549 - DNA, 22 bp, Homo sapiens
tttatccattcaccagttgaac

SEQ ID NO: 7059550 - DNA, 22 bp, Homo sapiens
tttatccatatcattaaaatct

SEQ ID NO: 7059551 - DNA, 22 bp, Homo sapiens
tttatcaaacaaattatccagc

SEQ ID NO: 7059552 - DNA, 22 bp, Homo sapiens
tttatcacagaataagaagtca

SEQ ID NO: 7059553 - DNA, 22 bp, Homo sapiens
tttatcatcttgtttttaaagc

SEQ ID NO: 7059554 - DNA, 22 bp, Homo sapiens
tttatccagaatcaggattttt

SEQ ID NO: 7059555 - DNA, 22 bp, Homo sapiens
tttagcaagtatttactgacta

SEQ ID NO: 7059556 - DNA, 22 bp, Homo sapiens
tttatatagagatttgtgcatg

SEQ ID NO: 7059557 - DNA, 22 bp, Homo sapiens
tttatatatggctggtctggat

SEQ ID NO: 7059558 - DNA, 22 bp, Homo sapiens
tttatatttcccaggattggcc

SEQ ID NO: 7059559 - DNA, 22 bp, Homo sapiens
tttatattgtaaaaatggttct

SEQ ID NO: 7059560 - DNA, 22 bp, Homo sapiens
tttatattgtaaaaatggttct

SEQ ID NO: 7059561 - DNA, 22 bp, Homo sapiens
tttatattgggagtcgttttga

SEQ ID NO: 7059562 - DNA, 22 bp, Homo sapiens
tttcaagcataactgggaagag

SEQ ID NO: 7059563 - DNA, 20 bp, Homo sapiens
tttcacaatgaacatgtctc

SEQ ID NO: 7059564 - DNA, 20 bp, Homo sapiens
tttcacaatgaacatgtctc

SEQ ID NO: 7059565 - DNA, 23 bp, Homo sapiens
tttcacaatgagcattacagaat

SEQ ID NO: 7059566 - DNA, 23 bp, Homo sapiens
tttcacaatgagcattacagaat

SEQ ID NO: 7059567 - DNA, 22 bp, Homo sapiens
tttcacaattttaaggagcaaa

SEQ ID NO: 7059568 - DNA, 22 bp, Homo sapiens
tttcacactagtcagaatacca

SEQ ID NO: 7059569 - DNA, 22 bp, Homo sapiens
tttcacactgcagcatcagaga

SEQ ID NO: 7059570 - DNA, 22 bp, Homo sapiens
tttcaagactcattgagtattg

SEQ ID NO: 7059571 - DNA, 23 bp, Homo sapiens
tttcaacaatgcttagagaaaac

SEQ ID NO: 7059572 - DNA, 22 bp, Homo sapiens
tttcaacaccagagaccatgcg

SEQ ID NO: 7059573 - DNA, 21 bp, Homo sapiens
tttattctcagatacagggag

SEQ ID NO: 7059574 - DNA, 19 bp, Homo sapiens
tttattcacctttaccttg

SEQ ID NO: 7059575 - DNA, 22 bp, Homo sapiens
tttattctagctcagaatagtt

SEQ ID NO: 7059576 - DNA, 22 bp, Homo sapiens
tttcagaaagctgaacatatga

SEQ ID NO: 7059577 - DNA, 22 bp, Homo sapiens
tttcagaaacgattatgaacac

SEQ ID NO: 7059578 - DNA, 22 bp, Homo sapiens
tttcagaaagcatcatcaaagt

SEQ ID NO: 7059579 - DNA, 22 bp, Homo sapiens
tttcagaaatggcactgaaatc

SEQ ID NO: 7059580 - DNA, 22 bp, Homo sapiens
tttcagaaatggcactgaaatc

SEQ ID NO: 7059581 - DNA, 22 bp, Homo sapiens
tttcacctcagtctttttatat

SEQ ID NO: 7059582 - DNA, 22 bp, Homo sapiens
tttcagaaaacttatcatcagt

SEQ ID NO: 7059583 - DNA, 23 bp, Homo sapiens
tttcacagcttttattctgcatc

SEQ ID NO: 7059584 - DNA, 22 bp, Homo sapiens
tttcacagcatataggtgtact

SEQ ID NO: 7059585 - DNA, 22 bp, Homo sapiens
tttcacagctgggtggcagagt

SEQ ID NO: 7059586 - DNA, 22 bp, Homo sapiens
tttcattcattatacagtagag

SEQ ID NO: 7059587 - DNA, 22 bp, Homo sapiens
tttcattgatgggtgatagaaa

SEQ ID NO: 7059588 - DNA, 19 bp, Homo sapiens
tttcccagcccttgctgtg

SEQ ID NO: 7059589 - DNA, 22 bp, Homo sapiens
tttcatgaggggcaaaatctca

SEQ ID NO: 7059590 - DNA, 22 bp, Homo sapiens
tttcatcttccttggcataggt

SEQ ID NO: 7059591 - DNA, 22 bp, Homo sapiens
tttcatgatccatttacaaaat

SEQ ID NO: 7059592 - DNA, 22 bp, Homo sapiens
tttcatgattaacttagtgaat

SEQ ID NO: 7059593 - DNA, 22 bp, Homo sapiens
tttcatgattaacttagtgaat

SEQ ID NO: 7059594 - DNA, 22 bp, Homo sapiens
ttcaaactcttgctctgctagt

SEQ ID NO: 7059595 - DNA, 22 bp, Homo sapiens
ttattgttaggcttttggaatt

SEQ ID NO: 7059596 - DNA, 22 bp, Homo sapiens
ttcaaacagatgactctgctct

SEQ ID NO: 7059597 - DNA, 22 bp, Homo sapiens
ttcaaacagatgactctgctct

SEQ ID NO: 7059598 - DNA, 22 bp, Homo sapiens
ttattcttttctccagaatccc

SEQ ID NO: 7059599 - DNA, 22 bp, Homo sapiens
ttattgaaggaactgaaataaa

SEQ ID NO: 7059600 - DNA, 22 bp, Homo sapiens
ttattgtaggcctattgtagaa

SEQ ID NO: 7059601 - DNA, 22 bp, Homo sapiens
ttattgtaggcctattgtagaa

SEQ ID NO: 7059602 - DNA, 22 bp, Homo sapiens
ttattgtcaaaaacaggacact

SEQ ID NO: 7059603 - DNA, 22 bp, Homo sapiens
ttattctttaaacatatatgtt

SEQ ID NO: 7059604 - DNA, 22 bp, Homo sapiens
ttattctttaaacatatatgtt

SEQ ID NO: 7059605 - DNA, 22 bp, Homo sapiens
ttattatgtgctagagaatgta

SEQ ID NO: 7059606 - DNA, 22 bp, Homo sapiens
ttattatgtggatgaaagatgt

SEQ ID NO: 7059607 - DNA, 22 bp, Homo sapiens
ttattatgtggatgaaagatgt

SEQ ID NO: 7059608 - DNA, 22 bp, Homo sapiens
ttattataatgagggataaaaa

SEQ ID NO: 7059609 - DNA, 22 bp, Homo sapiens
ttattatgccattacctccctg

SEQ ID NO: 7059610 - DNA, 22 bp, Homo sapiens
ttattatggcagttttctaggt

SEQ ID NO: 7059611 - DNA, 22 bp, Homo sapiens
ttattatggtatttctttgcag

SEQ ID NO: 7059612 - DNA, 22 bp, Homo sapiens
ttattataatgagggataaaaa

SEQ ID NO: 7059613 - DNA, 22 bp, Homo sapiens
ttattagatctgttagggatcc

SEQ ID NO: 7059614 - DNA, 22 bp, Homo sapiens
ttattagagtgctttgagaaag

SEQ ID NO: 7059615 - DNA, 22 bp, Homo sapiens
ttattaatacatgcacctgcat

SEQ ID NO: 7059616 - DNA, 22 bp, Homo sapiens
ttattaataaagtggcatagcc

SEQ ID NO: 7059617 - DNA, 22 bp, Homo sapiens
ttattaatcttatctttggaaa

SEQ ID NO: 7059618 - DNA, 22 bp, Homo sapiens
ttattaatgagtacaagttatt

SEQ ID NO: 7059619 - DNA, 22 bp, Homo sapiens
ttattacaatgcagaaaataga

SEQ ID NO: 7059620 - DNA, 22 bp, Homo sapiens
ttatatgagtatcatatcactt

SEQ ID NO: 7059621 - DNA, 22 bp, Homo sapiens
ttatatctttttacatctctcc

SEQ ID NO: 7059622 - DNA, 22 bp, Homo sapiens
ttattaaaatgcggatttggct

SEQ ID NO: 7059623 - DNA, 22 bp, Homo sapiens
ttatatatatgtagaggtcacg

SEQ ID NO: 7059624 - DNA, 22 bp, Homo sapiens
ttatatatcttgatttgttcca

SEQ ID NO: 7059625 - DNA, 22 bp, Homo sapiens
ttatagatgccttgagtaaatg

SEQ ID NO: 7059626 - DNA, 22 bp, Homo sapiens
ttataggaaaagttctagaaaa

SEQ ID NO: 7059627 - DNA, 22 bp, Homo sapiens
ttatataaagataacttttctt

SEQ ID NO: 7059628 - DNA, 22 bp, Homo sapiens
ttatataactcaggtgggctca

SEQ ID NO: 7059629 - DNA, 22 bp, Homo sapiens
ttatatactgtggtagtactgt

SEQ ID NO: 7059630 - DNA, 22 bp, Homo sapiens
ttagctttcatgaacctggtcg

SEQ ID NO: 7059631 - DNA, 22 bp, Homo sapiens
ttagctttctttggcagacgtg

SEQ ID NO: 7059632 - DNA, 22 bp, Homo sapiens
ttagctttggattgcatttagt

SEQ ID NO: 7059633 - DNA, 22 bp, Homo sapiens
ttagcttttaagtgtgctacat

SEQ ID NO: 7059634 - DNA, 22 bp, Homo sapiens
ttagcttttcacttgcattatc

SEQ ID NO: 7059635 - DNA, 22 bp, Homo sapiens
ttagcttttgagaatgatttct

SEQ ID NO: 7059636 - DNA, 22 bp, Homo sapiens
ttatacagtttatacttagaat

SEQ ID NO: 7059637 - DNA, 21 bp, Homo sapiens
ttatacatatgttctctgcct

SEQ ID NO: 7059638 - DNA, 22 bp, Homo sapiens
tcctgcctgcaatcccagcact

SEQ ID NO: 7059639 - DNA, 18 bp, Homo sapiens
tcctgcctgcgggctccc

SEQ ID NO: 7059640 - DNA, 18 bp, Homo sapiens
tcctgcctgcgggctccc

SEQ ID NO: 7059641 - DNA, 18 bp, Homo sapiens
tcctgcctgcgggctccc

SEQ ID NO: 7059642 - DNA, 19 bp, Homo sapiens
tcctgcctggggccgcctg

SEQ ID NO: 7059643 - DNA, 19 bp, Homo sapiens
tcctgcctggggccgcctg

SEQ ID NO: 7059644 - DNA, 18 bp, Homo sapiens
tcctgcctgtgccccagg

SEQ ID NO: 7059645 - DNA, 18 bp, Homo sapiens
tcctgcctgtgccccagg

SEQ ID NO: 7059646 - DNA, 18 bp, Homo sapiens
tcctgcctgtgccccagg

SEQ ID NO: 7059647 - DNA, 22 bp, Homo sapiens
tcctgcctgtttacctgtactt

SEQ ID NO: 7059648 - DNA, 22 bp, Homo sapiens
tcctgcctgtttacctgtactt

SEQ ID NO: 7059649 - DNA, 22 bp, Homo sapiens
tcctgcctgtttacctgtactt

SEQ ID NO: 7059650 - DNA, 22 bp, Homo sapiens
tcctgccttagagcaaggaaaa

SEQ ID NO: 7059651 - DNA, 22 bp, Homo sapiens
tcctgccttagagcaaggaaaa

SEQ ID NO: 7059652 - DNA, 21 bp, Homo sapiens
tcctgctgctcctgtcgtgtt

SEQ ID NO: 7059653 - DNA, 22 bp, Homo sapiens
tcctgctggaagtagggaatga

SEQ ID NO: 7059654 - DNA, 22 bp, Homo sapiens
tcctgctggactctgagtacaa

SEQ ID NO: 7059655 - DNA, 22 bp, Homo sapiens
ttagccatatagaaaaagagct

SEQ ID NO: 7059656 - DNA, 22 bp, Homo sapiens
ttagccatatagaaaaagagct

SEQ ID NO: 7059657 - DNA, 19 bp, Homo sapiens
ttagccatccacagtgaaa

SEQ ID NO: 7059658 - DNA, 22 bp, Homo sapiens
ttagccatgccctagaagagga

SEQ ID NO: 7059659 - DNA, 22 bp, Homo sapiens
ttagccatgccctagaagagga

SEQ ID NO: 7059660 - DNA, 22 bp, Homo sapiens
ttagccatggactgaattgact

SEQ ID NO: 7059661 - DNA, 22 bp, Homo sapiens
ttagccatgtgggaaaaacagc

SEQ ID NO: 7059662 - DNA, 22 bp, Homo sapiens
ttagccatgttgaagatttaga

SEQ ID NO: 7059663 - DNA, 22 bp, Homo sapiens
ttagccattaaattacaaggtg

SEQ ID NO: 7059664 - DNA, 22 bp, Homo sapiens
ttagccattaatgtcctgtgca

SEQ ID NO: 7059665 - DNA, 22 bp, Homo sapiens
ttagccattgtcagcacatggc

SEQ ID NO: 7059666 - DNA, 22 bp, Homo sapiens
ttagccattttatacaagtgta

SEQ ID NO: 7059667 - DNA, 22 bp, Homo sapiens
ttagctcagaaaatttaaactt

SEQ ID NO: 7059668 - DNA, 22 bp, Homo sapiens
ttagctttcagcctttctcacc

SEQ ID NO: 7059669 - DNA, 22 bp, Homo sapiens
ttcacagatgagaaaattgagg

SEQ ID NO: 7059670 - DNA, 22 bp, Homo sapiens
ttcacagatgagaaaattgagg

SEQ ID NO: 7059671 - DNA, 21 bp, Homo sapiens
ttcacagatgggaaaactgag

SEQ ID NO: 7059672 - DNA, 20 bp, Homo sapiens
ttcacagaggactcaggtca

SEQ ID NO: 7059673 - DNA, 22 bp, Homo sapiens
ttcacagatgtattggaactcc

SEQ ID NO: 7059674 - DNA, 23 bp, Homo sapiens
ttcaaagatcttctgaaatctgt

SEQ ID NO: 7059675 - DNA, 22 bp, Homo sapiens
ttcacaatggcaaaccattaaa

SEQ ID NO: 7059676 - DNA, 21 bp, Homo sapiens
ttcagcaagcactctggacac

SEQ ID NO: 7059677 - DNA, 22 bp, Homo sapiens
ttcagcaagtgtctctactgtc

SEQ ID NO: 7059678 - DNA, 22 bp, Homo sapiens
ttcagagctggtgtctacagct

SEQ ID NO: 7059679 - DNA, 22 bp, Homo sapiens
ttcacagggcagcagctgagcc

SEQ ID NO: 7059680 - DNA, 22 bp, Homo sapiens
ttcacaggcttggaggtggggg

SEQ ID NO: 7059681 - DNA, 22 bp, Homo sapiens
ttcagagaacttcatggaagag

SEQ ID NO: 7059682 - DNA, 22 bp, Homo sapiens
ttcagagacatgttctagatca

SEQ ID NO: 7059683 - DNA, 22 bp, Homo sapiens
ttcagagagaaaccagtgggaa

SEQ ID NO: 7059684 - DNA, 22 bp, Homo sapiens
ttcagagagtttgtgagtcctt

SEQ ID NO: 7059685 - DNA, 22 bp, Homo sapiens
ttcagagcatctctaaagccag

SEQ ID NO: 7059686 - DNA, 22 bp, Homo sapiens
ttcagagccacttcaagtctaa

SEQ ID NO: 7059687 - DNA, 22 bp, Homo sapiens
ttcattgtactttaagagatgc

SEQ ID NO: 7059688 - DNA, 22 bp, Homo sapiens
ttcattgtagcttgactaatta

SEQ ID NO: 7059689 - DNA, 22 bp, Homo sapiens
ttcattgtctctgtttgccttc

SEQ ID NO: 7059690 - DNA, 22 bp, Homo sapiens
ttcattgtgaacacattctgcc

SEQ ID NO: 7059691 - DNA, 22 bp, Homo sapiens
ttcattgtgattcttggctagc

SEQ ID NO: 7059692 - DNA, 22 bp, Homo sapiens
ttcatacaatgggatattatga

SEQ ID NO: 7059693 - DNA, 23 bp, Homo sapiens
ttcatttaggagttcataagagc

SEQ ID NO: 7059694 - DNA, 22 bp, Homo sapiens
ttcatttgcactggattactgg

SEQ ID NO: 7059695 - DNA, 21 bp, Homo sapiens
ttcataaaccattctcatgca

SEQ ID NO: 7059696 - DNA, 22 bp, Homo sapiens
ttcagttttattgtactgctat

SEQ ID NO: 7059697 - DNA, 22 bp, Homo sapiens
ttcagttccttgtgcgaattcc

SEQ ID NO: 7059698 - DNA, 22 bp, Homo sapiens
ttccagtgaaacatgaggtgtg

SEQ ID NO: 7059699 - DNA, 22 bp, Homo sapiens
ttcattttataaaccctgctga

SEQ ID NO: 7059700 - DNA, 22 bp, Homo sapiens
ttcattttctttcacgctgctg

SEQ ID NO: 7059701 - DNA, 22 bp, Homo sapiens
ttcatttttaccgcgtgtcaaa

SEQ ID NO: 7059702 - DNA, 22 bp, Homo sapiens
ttcatttggcctctgcttaaaa

SEQ ID NO: 7059703 - DNA, 22 bp, Homo sapiens
ttcatttgtaactctgttaggg

SEQ ID NO: 7059704 - DNA, 23 bp, Homo sapiens
ttcatttgtctacttcacttgtt

SEQ ID NO: 7059705 - DNA, 22 bp, Homo sapiens
ttcatttgtctgctatagatcc

SEQ ID NO: 7059706 - DNA, 22 bp, Homo sapiens
ttgaaatggcagcagctgacct

SEQ ID NO: 7059707 - DNA, 19 bp, Homo sapiens
ttgaaattgtttgatatgg

SEQ ID NO: 7059708 - DNA, 22 bp, Homo sapiens
ttgaacagtcctaagagaccct

SEQ ID NO: 7059709 - DNA, 22 bp, Homo sapiens
ttcttttgggaattacgtatgc

SEQ ID NO: 7059710 - DNA, 22 bp, Homo sapiens
ttctttttaaagtgtgtatgca

SEQ ID NO: 7059711 - DNA, 22 bp, Homo sapiens
ttgaaaggaatacagaggccta

SEQ ID NO: 7059712 - DNA, 22 bp, Homo sapiens
ttgaaaggcacaggcacctggg

SEQ ID NO: 7059713 - DNA, 22 bp, Homo sapiens
ttgaaaggcctgtttatccagc

SEQ ID NO: 7059714 - DNA, 22 bp, Homo sapiens
ttcttttctttaggcattgtgt

SEQ ID NO: 7059715 - DNA, 22 bp, Homo sapiens
ttgaaagggatatatctttctg

SEQ ID NO: 7059716 - DNA, 22 bp, Homo sapiens
ttgaaagggttaaagtggtaaa

SEQ ID NO: 7059717 - DNA, 22 bp, Homo sapiens
ttgaaatatggattgaccttga

SEQ ID NO: 7059718 - DNA, 22 bp, Homo sapiens
ttgaaatgctctttggaatcta

SEQ ID NO: 7059719 - DNA, 22 bp, Homo sapiens
ttgaaatggaagtgaaaattct

SEQ ID NO: 7059720 - DNA, 22 bp, Homo sapiens
ttcttttaatgttctgaagttt

SEQ ID NO: 7059721 - DNA, 22 bp, Homo sapiens
ttcttttctgcagctggtattt

SEQ ID NO: 7059722 - DNA, 22 bp, Homo sapiens
ttcttttctgcagctggtattt

SEQ ID NO: 7059723 - DNA, 22 bp, Homo sapiens
ttcttttcttggcaggagtaga

SEQ ID NO: 7059724 - DNA, 22 bp, Homo sapiens
ttcttcaattattggaaagaaa

SEQ ID NO: 7059725 - DNA, 22 bp, Homo sapiens
ttcttcaaaatccagcatgatt

SEQ ID NO: 7059726 - DNA, 22 bp, Homo sapiens
ttcttattttcctgaggaagaa

SEQ ID NO: 7059727 - DNA, 22 bp, Homo sapiens
ttcttatgttcacataattcca

SEQ ID NO: 7059728 - DNA, 22 bp, Homo sapiens
ttcttactagtatgtttcagca

SEQ ID NO: 7059729 - DNA, 20 bp, Homo sapiens
ttcttagtagagcatgtatt

SEQ ID NO: 7059730 - DNA, 19 bp, Homo sapiens
ttcttagtctcatgcatga

SEQ ID NO: 7059731 - DNA, 22 bp, Homo sapiens
ttcttagtggtagtcatctttg

SEQ ID NO: 7059732 - DNA, 19 bp, Homo sapiens
ttctgtgttaattccttta

SEQ ID NO: 7059733 - DNA, 22 bp, Homo sapiens
ttcttacattactttacatgtg

SEQ ID NO: 7059734 - DNA, 22 bp, Homo sapiens
ttcttacattactttacatgtg

SEQ ID NO: 7059735 - DNA, 22 bp, Homo sapiens
ttctgtctgtaaacttctcaat

SEQ ID NO: 7059736 - DNA, 22 bp, Homo sapiens
ttctgtctgtaaacttctcaat

SEQ ID NO: 7059737 - DNA, 22 bp, Homo sapiens
ttctgtctgtaaacttctcaat

SEQ ID NO: 7059738 - DNA, 22 bp, Homo sapiens
ttctgtctctgtgtttacatta

SEQ ID NO: 7059739 - DNA, 22 bp, Homo sapiens
ttctgtgaatcttttttcccac

SEQ ID NO: 7059740 - DNA, 22 bp, Homo sapiens
ttctggagccgggcctgggcag

SEQ ID NO: 7059741 - DNA, 22 bp, Homo sapiens
ttctggaattcttgcagccact

SEQ ID NO: 7059742 - DNA, 22 bp, Homo sapiens
ttctggagaatcaccaccaggc

SEQ ID NO: 7059743 - DNA, 22 bp, Homo sapiens
ttctggaagttggaaatagcag

SEQ ID NO: 7059744 - DNA, 22 bp, Homo sapiens
ttctggaagtgttagaatctgg

SEQ ID NO: 7059745 - DNA, 22 bp, Homo sapiens
ttctggaatactaagttccttt

SEQ ID NO: 7059746 - DNA, 22 bp, Homo sapiens
ttctggaatatttgacacaatt

SEQ ID NO: 7059747 - DNA, 18 bp, Homo sapiens
ttctctggtggatgttat

SEQ ID NO: 7059748 - DNA, 22 bp, Homo sapiens
ttctggaaatgggtatagagca

SEQ ID NO: 7059749 - DNA, 22 bp, Homo sapiens
ttctggaaatgttgctgaggcc

SEQ ID NO: 7059750 - DNA, 22 bp, Homo sapiens
ttctggaacatagcaagaagtt

SEQ ID NO: 7059751 - DNA, 19 bp, Homo sapiens
ttctctggactagatgctg

SEQ ID NO: 7059752 - DNA, 22 bp, Homo sapiens
ttctctgggatctggcaaaagg

SEQ ID NO: 7059753 - DNA, 22 bp, Homo sapiens
ttctctggggacttggttggag

SEQ ID NO: 7059754 - DNA, 16 bp, Homo sapiens
ttctctggggttgtgc

SEQ ID NO: 7059755 - DNA, 22 bp, Homo sapiens
ttctctgggttaggggaactat

SEQ ID NO: 7059756 - DNA, 22 bp, Homo sapiens
ttctcagatccatcagaagtcc

SEQ ID NO: 7059757 - DNA, 21 bp, Homo sapiens
ttctcagatcgagtagtgaga

SEQ ID NO: 7059758 - DNA, 21 bp, Homo sapiens
ttctcagatcgagtagtgaga

SEQ ID NO: 7059759 - DNA, 22 bp, Homo sapiens
ttctcagatgattcagataaac

SEQ ID NO: 7059760 - DNA, 22 bp, Homo sapiens
ttctcagatgattcagataaac

SEQ ID NO: 7059761 - DNA, 22 bp, Homo sapiens
ttctcagattccccttttaata

SEQ ID NO: 7059762 - DNA, 22 bp, Homo sapiens
ttctcaggactcctgcctgctt

SEQ ID NO: 7059763 - DNA, 22 bp, Homo sapiens
ttctcaggtagtgctgatgctg

SEQ ID NO: 7059764 - DNA, 22 bp, Homo sapiens
ttctcaggtagtgctgatgctg

SEQ ID NO: 7059765 - DNA, 22 bp, Homo sapiens
ttctccaagatgaagctgtgta

SEQ ID NO: 7059766 - DNA, 22 bp, Homo sapiens
ttctccaaggatacagtcctgt

SEQ ID NO: 7059767 - DNA, 22 bp, Homo sapiens
ttctccagaccactgcctctgt

SEQ ID NO: 7059768 - DNA, 22 bp, Homo sapiens
ttctccagaccctcctgcagac

SEQ ID NO: 7059769 - DNA, 22 bp, Homo sapiens
ttctccagaccttgtgactatg

SEQ ID NO: 7059770 - DNA, 22 bp, Homo sapiens
ttctccagagggctctgcagga

SEQ ID NO: 7059771 - DNA, 22 bp, Homo sapiens
ttctcctctgttggccttccct

SEQ ID NO: 7059772 - DNA, 22 bp, Homo sapiens
ttctcctctgttggccttccct

SEQ ID NO: 7059773 - DNA, 23 bp, Homo sapiens
ttctcctgaggaagcagggactg

SEQ ID NO: 7059774 - DNA, 22 bp, Homo sapiens
ttctcctgcccttggacttcca

SEQ ID NO: 7059775 - DNA, 20 bp, Homo sapiens
ttctctagccttcccctggg

SEQ ID NO: 7059776 - DNA, 22 bp, Homo sapiens
ttctctaggagttctgggatca

SEQ ID NO: 7059777 - DNA, 22 bp, Homo sapiens
ttctctaggttttagatgaaga

SEQ ID NO: 7059778 - DNA, 22 bp, Homo sapiens
ttctctaatggtgatgattaga

SEQ ID NO: 7059779 - DNA, 22 bp, Homo sapiens
ttctctccagactgcagtgggt

SEQ ID NO: 7059780 - DNA, 22 bp, Homo sapiens
ttctctccagtcctggattctg

SEQ ID NO: 7059781 - DNA, 21 bp, Homo sapiens
ttctctccatatgcccagccc

SEQ ID NO: 7059782 - DNA, 21 bp, Homo sapiens
ttctctccatatgcccagccc

SEQ ID NO: 7059783 - DNA, 22 bp, Homo sapiens
ttctctcccatgaagcttctat

SEQ ID NO: 7059784 - DNA, 22 bp, Homo sapiens
ttctctcccatgaagcttctat

SEQ ID NO: 7059785 - DNA, 22 bp, Homo sapiens
ttctctcctacccagtatccat

SEQ ID NO: 7059786 - DNA, 22 bp, Homo sapiens
ttctctcctacccagtatccat

SEQ ID NO: 7059787 - DNA, 22 bp, Homo sapiens
ttctctcctacccagtatccat

SEQ ID NO: 7059788 - DNA, 22 bp, Homo sapiens
ttctctcctcctagaggctttt

SEQ ID NO: 7059789 - DNA, 22 bp, Homo sapiens
ttctctctgagagcatctggaa

SEQ ID NO: 7059790 - DNA, 22 bp, Homo sapiens
ttctctgatcttgctagactga

SEQ ID NO: 7059791 - DNA, 22 bp, Homo sapiens
ttctctgcagctcctggctggg

SEQ ID NO: 7059792 - DNA, 22 bp, Homo sapiens
ttctctgcagcttaggcccagt

SEQ ID NO: 7059793 - DNA, 22 bp, Homo sapiens
ttctctgcattgtaaagagcca

SEQ ID NO: 7059794 - DNA, 22 bp, Homo sapiens
ttctctgagatagactaagtgg

SEQ ID NO: 7059795 - DNA, 17 bp, Homo sapiens
ttctctgagctgtattg

SEQ ID NO: 7059796 - DNA, 22 bp, Homo sapiens
ttctctgagtacgtttcagtgt

SEQ ID NO: 7059797 - DNA, 22 bp, Homo sapiens
ttctctgcctcacaggtctaag

SEQ ID NO: 7059798 - DNA, 22 bp, Homo sapiens
ttctctgctctcacatacagaa

SEQ ID NO: 7059799 - DNA, 22 bp, Homo sapiens
ttctctggaactgaaacaagat

SEQ ID NO: 7059800 - DNA, 22 bp, Homo sapiens
ttctctcttactgccatgctgt

SEQ ID NO: 7059801 - DNA, 22 bp, Homo sapiens
ttctctcttactgccatgctgt

SEQ ID NO: 7059802 - DNA, 22 bp, Homo sapiens
ttctctcttccagttcccactt

SEQ ID NO: 7059803 - DNA, 22 bp, Homo sapiens
ttctctcttccagttcccactt

SEQ ID NO: 7059804 - DNA, 22 bp, Homo sapiens
ttctctgaaggccatgctcact

SEQ ID NO: 7059805 - DNA, 22 bp, Homo sapiens
ttccttgaatgagtcatggaaa

SEQ ID NO: 7059806 - DNA, 22 bp, Homo sapiens
ttccttgagatgactgtcttgt

SEQ ID NO: 7059807 - DNA, 22 bp, Homo sapiens
ttccttgaggtattcagtttta

SEQ ID NO: 7059808 - DNA, 22 bp, Homo sapiens
ttccttctggaggctccagggg

SEQ ID NO: 7059809 - DNA, 22 bp, Homo sapiens
ttccttcttccaaacccatcat

SEQ ID NO: 7059810 - DNA, 22 bp, Homo sapiens
ttccttcttccagaggctgccc

SEQ ID NO: 7059811 - DNA, 22 bp, Homo sapiens
ttcctggggcttagcaatggag

SEQ ID NO: 7059812 - DNA, 22 bp, Homo sapiens
ttcctgggggcagcagtcttga

SEQ ID NO: 7059813 - DNA, 22 bp, Homo sapiens
ttcctgggtggtcctggtagag

SEQ ID NO: 7059814 - DNA, 17 bp, Homo sapiens
ttccagtttagtattgt

SEQ ID NO: 7059815 - DNA, 22 bp, Homo sapiens
ttcctgagaaatttgtacctgg

SEQ ID NO: 7059816 - DNA, 22 bp, Homo sapiens
ttcctgagaacatggcagctta

SEQ ID NO: 7059817 - DNA, 22 bp, Homo sapiens
ttcctgagaccctcacagtgat

SEQ ID NO: 7059818 - DNA, 22 bp, Homo sapiens
ttcctgagcaccagacactgca

SEQ ID NO: 7059819 - DNA, 22 bp, Homo sapiens
ttcctgaggctcatcggagtcg

SEQ ID NO: 7059820 - DNA, 22 bp, Homo sapiens
ttcctgagggacttttgagatt

SEQ ID NO: 7059821 - DNA, 22 bp, Homo sapiens
ttcctgagggccccagaggagg

SEQ ID NO: 7059822 - DNA, 22 bp, Homo sapiens
ttcctgaggtgattctaatgtg

SEQ ID NO: 7059823 - DNA, 22 bp, Homo sapiens
ttcctgagtcgccgagtctatg

SEQ ID NO: 7059824 - DNA, 22 bp, Homo sapiens
ttcctgcccctgagagctccca

SEQ ID NO: 7059825 - DNA, 22 bp, Homo sapiens
ttcctgctccatttgctgagct

SEQ ID NO: 7059826 - DNA, 22 bp, Homo sapiens
ttcctgctccatttgctgagct

SEQ ID NO: 7059827 - DNA, 22 bp, Homo sapiens
ttcctggcaaagtgagcatcac

SEQ ID NO: 7059828 - DNA, 22 bp, Homo sapiens
ttcctggcacatagttagtgct

SEQ ID NO: 7059829 - DNA, 22 bp, Homo sapiens
ttcctggccaagcagagtggaa

SEQ ID NO: 7059830 - DNA, 22 bp, Homo sapiens
ttcctggccccacccctggaga

SEQ ID NO: 7059831 - DNA, 22 bp, Homo sapiens
ttcctggcctctctctgagcag

SEQ ID NO: 7059832 - DNA, 21 bp, Homo sapiens
ttcctggggacttccgtggga

SEQ ID NO: 7059833 - DNA, 22 bp, Homo sapiens
ttcctggggcgactgtatctga

SEQ ID NO: 7059834 - DNA, 22 bp, Homo sapiens
gggctcaggagtttgaggctgc

SEQ ID NO: 7059835 - DNA, 22 bp, Homo sapiens
gggctcaggcctggcctctcac

SEQ ID NO: 7059836 - DNA, 22 bp, Homo sapiens
cagagctgtcatttgccagtga

SEQ ID NO: 7059837 - DNA, 22 bp, Homo sapiens
cagagcttgaatgtccatggtt

SEQ ID NO: 7059838 - DNA, 22 bp, Homo sapiens
cagaggaaagtatttctggaag

SEQ ID NO: 7059839 - DNA, 22 bp, Homo sapiens
cagaggaaagtatttctggaag

SEQ ID NO: 7059840 - DNA, 22 bp, Homo sapiens
cagaggaaatgggaaggagata

SEQ ID NO: 7059841 - DNA, 22 bp, Homo sapiens
cagaggaaatgggaaggagata

SEQ ID NO: 7059842 - DNA, 22 bp, Homo sapiens
cagaggaacgtttggattgatt

SEQ ID NO: 7059843 - DNA, 22 bp, Homo sapiens
cagaggaacgtttggattgatt

SEQ ID NO: 7059844 - DNA, 22 bp, Homo sapiens
cagaggaagagatacaagccct

SEQ ID NO: 7059845 - DNA, 22 bp, Homo sapiens
cagaggaagagatacaagccct

SEQ ID NO: 7059846 - DNA, 22 bp, Homo sapiens
gggggaggtgaatgcaataagg

SEQ ID NO: 7059847 - DNA, 22 bp, Homo sapiens
gggggaggtgaatgcaataagg

SEQ ID NO: 7059848 - DNA, 22 bp, Homo sapiens
cagaggaagcagacacatcttg

SEQ ID NO: 7059849 - DNA, 22 bp, Homo sapiens
cagaggaagctgggtgtggagt

SEQ ID NO: 7059850 - DNA, 22 bp, Homo sapiens
cagaggaagctgggtgtggagt

SEQ ID NO: 7059851 - DNA, 22 bp, Homo sapiens
cagaggaaggctctgggaatgt

SEQ ID NO: 7059852 - DNA, 22 bp, Homo sapiens
cagaggaaggctctgggaatgt

SEQ ID NO: 7059853 - DNA, 22 bp, Homo sapiens
cagaggaagggtgctgcgaaag

SEQ ID NO: 7059854 - DNA, 22 bp, Homo sapiens
cagaggaagggtgctgcgaaag

SEQ ID NO: 7059855 - DNA, 22 bp, Homo sapiens
cagaggaagttccttgatgaga

SEQ ID NO: 7059856 - DNA, 22 bp, Homo sapiens
cagaggaagttccttgatgaga

SEQ ID NO: 7059857 - DNA, 22 bp, Homo sapiens
cagaggacaatagaatggaaag

SEQ ID NO: 7059858 - DNA, 22 bp, Homo sapiens
cagaggcagaatggagatttgg

SEQ ID NO: 7059859 - DNA, 22 bp, Homo sapiens
cagaggcagaatggagatttgg

SEQ ID NO: 7059860 - DNA, 22 bp, Homo sapiens
cagaggcagaggtcatctctgg

SEQ ID NO: 7059861 - DNA, 22 bp, Homo sapiens
cagaggcagaggtcatctctgg

SEQ ID NO: 7059862 - DNA, 22 bp, Homo sapiens
cagaagcaaatgccttgctgag

SEQ ID NO: 7059863 - DNA, 22 bp, Homo sapiens
cagaagcaaatgccttgctgag

SEQ ID NO: 7059864 - DNA, 22 bp, Homo sapiens
cagaagcacatgtttacatgta

SEQ ID NO: 7059865 - DNA, 23 bp, Homo sapiens
cagaagcacctgttgactgctgc

SEQ ID NO: 7059866 - DNA, 22 bp, Homo sapiens
cagagacagtttcacagggtct

SEQ ID NO: 7059867 - DNA, 22 bp, Homo sapiens
cagagagaatcttggcagctga

SEQ ID NO: 7059868 - DNA, 22 bp, Homo sapiens
cagagagaatcttggcagctga

SEQ ID NO: 7059869 - DNA, 19 bp, Homo sapiens
cagagagaccaaggcgcca

SEQ ID NO: 7059870 - DNA, 22 bp, Homo sapiens
cagagagagcaggaaacctccg

SEQ ID NO: 7059871 - DNA, 22 bp, Homo sapiens
cagagagagtcaaatctttgct

SEQ ID NO: 7059872 - DNA, 22 bp, Homo sapiens
cagagagagtggggtgtggatt

SEQ ID NO: 7059873 - DNA, 22 bp, Homo sapiens
cagagagagtggggtgtggatt

SEQ ID NO: 7059874 - DNA, 22 bp, Homo sapiens
cagagagcttagtgtgctgcat

SEQ ID NO: 7059875 - DNA, 22 bp, Homo sapiens
gggccctgcgtccggaagtctg

SEQ ID NO: 7059876 - DNA, 22 bp, Homo sapiens
cagagcagagtgattgttctgg

SEQ ID NO: 7059877 - DNA, 22 bp, Homo sapiens
cagagcagcctccagggggagc

SEQ ID NO: 7059878 - DNA, 21 bp, Homo sapiens
cagagcagcgttctgctgtgg

SEQ ID NO: 7059879 - DNA, 22 bp, Homo sapiens
cagagcaggaatagggtgttga

SEQ ID NO: 7059880 - DNA, 22 bp, Homo sapiens
ggtgcagagtccacagaaagct

SEQ ID NO: 7059881 - DNA, 22 bp, Homo sapiens
ggtgcaggaaaattacctggag

SEQ ID NO: 7059882 - DNA, 22 bp, Homo sapiens
cagatacaggtttttgttagat

SEQ ID NO: 7059883 - DNA, 22 bp, Homo sapiens
cagataaatagatagataaact

SEQ ID NO: 7059884 - DNA, 22 bp, Homo sapiens
cagataaatagatagataaact

SEQ ID NO: 7059885 - DNA, 22 bp, Homo sapiens
cagataaaggcttactagtagt

SEQ ID NO: 7059886 - DNA, 22 bp, Homo sapiens
cagagtgggctgtcagccacca

SEQ ID NO: 7059887 - DNA, 22 bp, Homo sapiens
cagagtggtgcaagggcagtgt

SEQ ID NO: 7059888 - DNA, 22 bp, Homo sapiens
cagagttcaaagcctgctggga

SEQ ID NO: 7059889 - DNA, 22 bp, Homo sapiens
cagagttttatgtatgcatgta

SEQ ID NO: 7059890 - DNA, 22 bp, Homo sapiens
cagagttttgtgaacaacttgg

SEQ ID NO: 7059891 - DNA, 22 bp, Homo sapiens
ggggtgagctgggcctgtgcct

SEQ ID NO: 7059892 - DNA, 22 bp, Homo sapiens
ggggtgagatcaaggaagccct

SEQ ID NO: 7059893 - DNA, 21 bp, Homo sapiens
ggggtcaagtgaatggtgttg

SEQ ID NO: 7059894 - DNA, 21 bp, Homo sapiens
ggggtcaagtgaatggtgttg

SEQ ID NO: 7059895 - DNA, 22 bp, Homo sapiens
cagaggctgctctgggtggcat

SEQ ID NO: 7059896 - DNA, 22 bp, Homo sapiens
cagaggctgccagccatgtgca

SEQ ID NO: 7059897 - DNA, 22 bp, Homo sapiens
cagaggctgccagccatgtgca

SEQ ID NO: 7059898 - DNA, 22 bp, Homo sapiens
cagaggctgccagccatgtgca

SEQ ID NO: 7059899 - DNA, 22 bp, Homo sapiens
cagaggctgccagccatgtgca

SEQ ID NO: 7059900 - DNA, 22 bp, Homo sapiens
cagaggctgatgtgggatgggc

SEQ ID NO: 7059901 - DNA, 22 bp, Homo sapiens
cagaggctgatgtgggatgggc

SEQ ID NO: 7059902 - DNA, 22 bp, Homo sapiens
cagaggctgctctgggtggcat

SEQ ID NO: 7059903 - DNA, 22 bp, Homo sapiens
ggggtagggtgattgtgaagta

SEQ ID NO: 7059904 - DNA, 22 bp, Homo sapiens
ggggtcaagctcagaatcctag

SEQ ID NO: 7059905 - DNA, 22 bp, Homo sapiens
cagaggctgatggctgtagcca

SEQ ID NO: 7059906 - DNA, 22 bp, Homo sapiens
cagaggctgatgtgggatgggc

SEQ ID NO: 7059907 - DNA, 22 bp, Homo sapiens
cagaggctgatgtgggatgggc

SEQ ID NO: 7059908 - DNA, 21 bp, Homo sapiens
cagaggctgagagggcaatct

SEQ ID NO: 7059909 - DNA, 21 bp, Homo sapiens
cagaggctgagagggcaatct

SEQ ID NO: 7059910 - DNA, 22 bp, Homo sapiens
cagaggctgagcagtcagtttg

SEQ ID NO: 7059911 - DNA, 22 bp, Homo sapiens
cagaggctgatggctgtagcca

SEQ ID NO: 7059912 - DNA, 22 bp, Homo sapiens
cagaggcaggataagaactgcg

SEQ ID NO: 7059913 - DNA, 22 bp, Homo sapiens
cagaggcaggataagaactgcg

SEQ ID NO: 7059914 - DNA, 22 bp, Homo sapiens
cagaggctgaccctgctgttgt

SEQ ID NO: 7059915 - DNA, 22 bp, Homo sapiens
cagaggctgaccctgctgttgt

SEQ ID NO: 7059916 - DNA, 21 bp, Homo sapiens
cagaggctgagagggcaatct

SEQ ID NO: 7059917 - DNA, 22 bp, Homo sapiens
gtaagaggagtgggaagcctca

SEQ ID NO: 7059918 - DNA, 22 bp, Homo sapiens
gtaagaggagtgggaagcctca

SEQ ID NO: 7059919 - DNA, 22 bp, Homo sapiens
gtaagaggatcaaggcggtgca

SEQ ID NO: 7059920 - DNA, 22 bp, Homo sapiens
gtaagcaaacagcaaatgattt

SEQ ID NO: 7059921 - DNA, 20 bp, Homo sapiens
cagcagagacccatggggag

SEQ ID NO: 7059922 - DNA, 19 bp, Homo sapiens
ggtgtgccaaatgggaatg

SEQ ID NO: 7059923 - DNA, 22 bp, Homo sapiens
gtaaacatcagccactctattt

SEQ ID NO: 7059924 - DNA, 22 bp, Homo sapiens
gtaaacatcgacccaacagggg

SEQ ID NO: 7059925 - DNA, 22 bp, Homo sapiens
gtaacatttacagttcctagag

SEQ ID NO: 7059926 - DNA, 22 bp, Homo sapiens
cagcagactggagtaggcagtg

SEQ ID NO: 7059927 - DNA, 22 bp, Homo sapiens
cagcagagaaattaaacttctg

SEQ ID NO: 7059928 - DNA, 22 bp, Homo sapiens
cagcagagaaattaaacttctg

SEQ ID NO: 7059929 - DNA, 22 bp, Homo sapiens
cagcagagaaattacatatttg

SEQ ID NO: 7059930 - DNA, 22 bp, Homo sapiens
cagcagagaaattacatatttg

SEQ ID NO: 7059931 - DNA, 18 bp, Homo sapiens
cagcagagacattcaaaa

SEQ ID NO: 7059932 - DNA, 18 bp, Homo sapiens
cagcagagacattcaaaa

SEQ ID NO: 7059933 - DNA, 22 bp, Homo sapiens
cagcagagaccaagtgatttga

SEQ ID NO: 7059934 - DNA, 22 bp, Homo sapiens
ggtgtctgatggtggcttctca

SEQ ID NO: 7059935 - DNA, 22 bp, Homo sapiens
ggtgtctgattccaaggccaca

SEQ ID NO: 7059936 - DNA, 15 bp, Homo sapiens
ggtgtctgcagtgtg

SEQ ID NO: 7059937 - DNA, 22 bp, Homo sapiens
ggtgtctgcttccctccagctg

SEQ ID NO: 7059938 - DNA, 22 bp, Homo sapiens
ggtgtctggacagtgagccagg

SEQ ID NO: 7059939 - DNA, 22 bp, Homo sapiens
ggtgtctgttgcctcctggtta

SEQ ID NO: 7059940 - DNA, 22 bp, Homo sapiens
ggtgtctgtgatggcatataac

SEQ ID NO: 7059941 - DNA, 22 bp, Homo sapiens
ggtgtctgttgcctcctggtta

SEQ ID NO: 7059942 - DNA, 19 bp, Homo sapiens
ggtgtgaagtgaggagtta

SEQ ID NO: 7059943 - DNA, 22 bp, Homo sapiens
ggtggcagtggtctctgacaga

SEQ ID NO: 7059944 - DNA, 22 bp, Homo sapiens
ggtgggaaggccactgaaggtt

SEQ ID NO: 7059945 - DNA, 22 bp, Homo sapiens
ggtgggacaggtaggagtggct

SEQ ID NO: 7059946 - DNA, 22 bp, Homo sapiens
ggtggcagtagcactgggcctg

SEQ ID NO: 7059947 - DNA, 18 bp, Homo sapiens
ggtggcaggtcagatgcc

SEQ ID NO: 7059948 - DNA, 22 bp, Homo sapiens
cagatggaacacagaaaggaga

SEQ ID NO: 7059949 - DNA, 22 bp, Homo sapiens
cagatggagtcccgtggagttc

SEQ ID NO: 7059950 - DNA, 22 bp, Homo sapiens
cagatggagtcccgtggagttc

SEQ ID NO: 7059951 - DNA, 22 bp, Homo sapiens
ggtggcagggagtgtccctggg

SEQ ID NO: 7059952 - DNA, 22 bp, Homo sapiens
cagcagtggctgcaggcagctg

SEQ ID NO: 7059953 - DNA, 22 bp, Homo sapiens
cagcagtggctgcaggcagctg

SEQ ID NO: 7059954 - DNA, 22 bp, Homo sapiens
cagcagtgcttcagtgtgagat

SEQ ID NO: 7059955 - DNA, 22 bp, Homo sapiens
cagcaggtgtctagcaagggtc

SEQ ID NO: 7059956 - DNA, 22 bp, Homo sapiens
cagcaggttaacagaggctggt

SEQ ID NO: 7059957 - DNA, 22 bp, Homo sapiens
cagcagtaattagtgctgcatg

SEQ ID NO: 7059958 - DNA, 22 bp, Homo sapiens
cagcagtacttctcagaggtat

SEQ ID NO: 7059959 - DNA, 22 bp, Homo sapiens
cagcagagacggtaagcagaac

SEQ ID NO: 7059960 - DNA, 22 bp, Homo sapiens
cagcagagacggtaagcagaac

SEQ ID NO: 7059961 - DNA, 22 bp, Homo sapiens
cagcagagacggtaagcagaac

SEQ ID NO: 7059962 - DNA, 23 bp, Homo sapiens
cagcagagagcagacctttgtgt

SEQ ID NO: 7059963 - DNA, 22 bp, Homo sapiens
cagcagagatgagattcctata

SEQ ID NO: 7059964 - DNA, 22 bp, Homo sapiens
cagcagagatgagattcctata

SEQ ID NO: 7059965 - DNA, 22 bp, Homo sapiens
cagcagagcatttggtaggagg

SEQ ID NO: 7059966 - DNA, 22 bp, Homo sapiens
cagcagagctgggaataaaatt

SEQ ID NO: 7059967 - DNA, 22 bp, Homo sapiens
cagcagagctgggaataaaatt

SEQ ID NO: 7059968 - DNA, 22 bp, Homo sapiens
cagcagagctgggctttgaatt

SEQ ID NO: 7059969 - DNA, 22 bp, Homo sapiens
cagcagagctgggctttgaatt

SEQ ID NO: 7059970 - DNA, 22 bp, Homo sapiens
cagcaggtcccactgagggccc

SEQ ID NO: 7059971 - DNA, 22 bp, Homo sapiens
cagcagtggctgcaggcagctg

SEQ ID NO: 7059972 - DNA, 22 bp, Homo sapiens
cagcagtggctgcaggcagctg

SEQ ID NO: 7059973 - DNA, 22 bp, Homo sapiens
gtcctctgtgtaggctgcagac

SEQ ID NO: 7059974 - DNA, 22 bp, Homo sapiens
gtcctctgttagaaatgtgctt

SEQ ID NO: 7059975 - DNA, 22 bp, Homo sapiens
gtcctctgtttccatctgactt

SEQ ID NO: 7059976 - DNA, 22 bp, Homo sapiens
gtcctgacggctgattggcctg

SEQ ID NO: 7059977 - DNA, 22 bp, Homo sapiens
gtcctgacggctgattggcctg

SEQ ID NO: 7059978 - DNA, 22 bp, Homo sapiens
gtcctgagagaggctccttgcc

SEQ ID NO: 7059979 - DNA, 22 bp, Homo sapiens
gtcctgagatgtcacaaggttt

SEQ ID NO: 7059980 - DNA, 22 bp, Homo sapiens
gtcctgagccctcagcacagca

SEQ ID NO: 7059981 - DNA, 18 bp, Homo sapiens
gtcctgagctctgctgta

SEQ ID NO: 7059982 - DNA, 22 bp, Homo sapiens
gtcctgaggatgcagagataaa

SEQ ID NO: 7059983 - DNA, 22 bp, Homo sapiens
cagcatcttcatgtgcatctcc

SEQ ID NO: 7059984 - DNA, 20 bp, Homo sapiens
gtctcaagtatctcacagtc

SEQ ID NO: 7059985 - DNA, 22 bp, Homo sapiens
gtctccacagcccagctgccac

SEQ ID NO: 7059986 - DNA, 22 bp, Homo sapiens
gtctcattggttctgccagagt

SEQ ID NO: 7059987 - DNA, 19 bp, Homo sapiens
gtctctggatttcaggtcc

SEQ ID NO: 7059988 - DNA, 22 bp, Homo sapiens
gtctctggctttatgctggttt

SEQ ID NO: 7059989 - DNA, 22 bp, Homo sapiens
gtctctgggttaagcagtgcat

SEQ ID NO: 7059990 - DNA, 22 bp, Homo sapiens
gtctctgttatttccagggtca

SEQ ID NO: 7059991 - DNA, 22 bp, Homo sapiens
gtcttaaaatcagaggatatag

SEQ ID NO: 7059992 - DNA, 22 bp, Homo sapiens
gtctttgctgtctttgctctca

SEQ ID NO: 7059993 - DNA, 22 bp, Homo sapiens
gtgaagtcaagaatgcaatttg

SEQ ID NO: 7059994 - DNA, 22 bp, Homo sapiens
gtgaagttcaagcttgccatct

SEQ ID NO: 7059995 - DNA, 22 bp, Homo sapiens
gtgaataactttctatgttaat

SEQ ID NO: 7059996 - DNA, 22 bp, Homo sapiens
gtgaataatattgtttataaaa

SEQ ID NO: 7059997 - DNA, 22 bp, Homo sapiens
gtgaataatcacccttctggat

SEQ ID NO: 7059998 - DNA, 22 bp, Homo sapiens
gtgaataattttttagtataag

SEQ ID NO: 7059999 - DNA, 17 bp, Homo sapiens
gtgaatggcatagtcgg

SEQ ID NO: 7060000 - DNA, 22 bp, Homo sapiens
gtgaatggggcaggaaggatgg

SEQ ID NO: 7060001 - DNA, 22 bp, Homo sapiens
gtgaggtcaaagccttgggtat

SEQ ID NO: 7060002 - DNA, 22 bp, Homo sapiens
gtgaggtcaccggccgttgcca

SEQ ID NO: 7060003 - DNA, 16 bp, Homo sapiens
gtgcaaaagtgaggag

SEQ ID NO: 7060004 - DNA, 22 bp, Homo sapiens
gtgcaggagccaggggtaggaa

SEQ ID NO: 7060005 - DNA, 22 bp, Homo sapiens
cagctcagcttcctgggtgtgt

SEQ ID NO: 7060006 - DNA, 20 bp, Homo sapiens
gtgctgagggctgggcaatg

SEQ ID NO: 7060007 - DNA, 22 bp, Homo sapiens
gtgctgaggtgggtgggcagcc

SEQ ID NO: 7060008 - DNA, 21 bp, Homo sapiens
cagctccactaaagcagctgt

SEQ ID NO: 7060009 - DNA, 22 bp, Homo sapiens
cagctccagcccaggcagctcc

SEQ ID NO: 7060010 - DNA, 23 bp, Homo sapiens
cagctccagtgcactcaggtagc

SEQ ID NO: 7060011 - DNA, 22 bp, Homo sapiens
cagctcccagtggcagctcctt

SEQ ID NO: 7060012 - DNA, 22 bp, Homo sapiens
gtgcctggggttgagctatgaa

SEQ ID NO: 7060013 - DNA, 22 bp, Homo sapiens
gtgctgagattacaggtgtgag

SEQ ID NO: 7060014 - DNA, 22 bp, Homo sapiens
gtgctgagcacaccttggagca

SEQ ID NO: 7060015 - DNA, 22 bp, Homo sapiens
gtgctgagcacagctgcccagg

SEQ ID NO: 7060016 - DNA, 22 bp, Homo sapiens
gtgctgagcatcatgaggcact

SEQ ID NO: 7060017 - DNA, 22 bp, Homo sapiens
gtgctgagctgcagatgcgctc

SEQ ID NO: 7060018 - DNA, 22 bp, Homo sapiens
gtgctgaggatacagctgtgaa

SEQ ID NO: 7060019 - DNA, 22 bp, Homo sapiens
gtgcctgggacttgctccggat

SEQ ID NO: 7060020 - DNA, 19 bp, Homo sapiens
cagcctcaatccctcgggc

SEQ ID NO: 7060021 - DNA, 20 bp, Homo sapiens
cagcctccactcactcagct

SEQ ID NO: 7060022 - DNA, 20 bp, Homo sapiens
cagccctttatcctcctatg

SEQ ID NO: 7060023 - DNA, 23 bp, Homo sapiens
cagcccttcctgcatgtttttgt

SEQ ID NO: 7060024 - DNA, 22 bp, Homo sapiens
gtgcaggaggtaacatagcaaa

SEQ ID NO: 7060025 - DNA, 22 bp, Homo sapiens
gtgcaggaggtaacatagcaaa

SEQ ID NO: 7060026 - DNA, 22 bp, Homo sapiens
gtgcatattttgcacacagatg

SEQ ID NO: 7060027 - DNA, 22 bp, Homo sapiens
gtgcaggagctcccgcagtggt

SEQ ID NO: 7060028 - DNA, 22 bp, Homo sapiens
gtgcaggagcttctggcctgac

SEQ ID NO: 7060029 - DNA, 22 bp, Homo sapiens
gtgcaggaggatgacaactgca

SEQ ID NO: 7060030 - DNA, 22 bp, Homo sapiens
gtgcatgaagactcagaaagtc

SEQ ID NO: 7060031 - DNA, 17 bp, Homo sapiens
cagctctgcagacttcc

SEQ ID NO: 7060032 - DNA, 22 bp, Homo sapiens
ggcagtcaagagggagtctgaa

SEQ ID NO: 7060033 - DNA, 22 bp, Homo sapiens
ggcagtcacaggggagactggg

SEQ ID NO: 7060034 - DNA, 19 bp, Homo sapiens
ggcagtcacggtcaggagc

SEQ ID NO: 7060035 - DNA, 22 bp, Homo sapiens
ggcagtcaagagggagtctgaa

SEQ ID NO: 7060036 - DNA, 22 bp, Homo sapiens
ggcaggtgtgagctgtaaagga

SEQ ID NO: 7060037 - DNA, 22 bp, Homo sapiens
ggcaggtgtgagctgtaaagga

SEQ ID NO: 7060038 - DNA, 22 bp, Homo sapiens
ggcaggtgtggtgaccagagat

SEQ ID NO: 7060039 - DNA, 22 bp, Homo sapiens
ggcaggacattgactacagtga

SEQ ID NO: 7060040 - DNA, 20 bp, Homo sapiens
ggcaggacccggtagggagc

SEQ ID NO: 7060041 - DNA, 22 bp, Homo sapiens
ggcaggagaaaggtctcttctt

SEQ ID NO: 7060042 - DNA, 22 bp, Homo sapiens
cacatgcatacctatgtgtata

SEQ ID NO: 7060043 - DNA, 22 bp, Homo sapiens
cacatgcatctgtcatgtttgg

SEQ ID NO: 7060044 - DNA, 22 bp, Homo sapiens
cacatgcattggcaaaagtgta

SEQ ID NO: 7060045 - DNA, 21 bp, Homo sapiens
ggagtttttctggaagggact

SEQ ID NO: 7060046 - DNA, 22 bp, Homo sapiens
ggataaagtctttaggtggaca

SEQ ID NO: 7060047 - DNA, 22 bp, Homo sapiens
ggagtgactcacagctgggaca

SEQ ID NO: 7060048 - DNA, 22 bp, Homo sapiens
ggagtgactctcggggccacta

SEQ ID NO: 7060049 - DNA, 22 bp, Homo sapiens
ggagtgaagtggcgcgatctcg

SEQ ID NO: 7060050 - DNA, 22 bp, Homo sapiens
ggaggtggaggttgcagtgagc

SEQ ID NO: 7060051 - DNA, 22 bp, Homo sapiens
ggataagaaaattgtaataact

SEQ ID NO: 7060052 - DNA, 18 bp, Homo sapiens
ggataggaccttaggcag

SEQ ID NO: 7060053 - DNA, 22 bp, Homo sapiens
ggcaggaaaacaatgagccagg

SEQ ID NO: 7060054 - DNA, 22 bp, Homo sapiens
ggcaggaaaacaatgagccagg

SEQ ID NO: 7060055 - DNA, 22 bp, Homo sapiens
ggcaggaagcattaaaacgatt

SEQ ID NO: 7060056 - DNA, 22 bp, Homo sapiens
ggcaggaagctcatgtggactg

SEQ ID NO: 7060057 - DNA, 22 bp, Homo sapiens
ggcaggaagtagcagtctgagc

SEQ ID NO: 7060058 - DNA, 22 bp, Homo sapiens
ggcaggaataaattatggactt

SEQ ID NO: 7060059 - DNA, 22 bp, Homo sapiens
cacccagcttttgcatcctccg

SEQ ID NO: 7060060 - DNA, 22 bp, Homo sapiens
ggccagggcctggggactgtcc

SEQ ID NO: 7060061 - DNA, 22 bp, Homo sapiens
cacccaggctagagtgcagtgg

SEQ ID NO: 7060062 - DNA, 22 bp, Homo sapiens
cacccaggacaggccagatgtg

SEQ ID NO: 7060063 - DNA, 22 bp, Homo sapiens
cacatttgaaggaattagcatt

SEQ ID NO: 7060064 - DNA, 18 bp, Homo sapiens
ggccagccccaggccagc

SEQ ID NO: 7060065 - DNA, 18 bp, Homo sapiens
ggccagccccaggccagc

SEQ ID NO: 7060066 - DNA, 22 bp, Homo sapiens
ggccagcggcacagcctggccc

SEQ ID NO: 7060067 - DNA, 22 bp, Homo sapiens
ggcgagggagcagtgcggtggg

SEQ ID NO: 7060068 - DNA, 22 bp, Homo sapiens
ggcgagggagcagtgcggtggg

SEQ ID NO: 7060069 - DNA, 22 bp, Homo sapiens
ggcgagggagcagtgcggtggg

SEQ ID NO: 7060070 - DNA, 22 bp, Homo sapiens
ggcgcaggccttggatcctggt

SEQ ID NO: 7060071 - DNA, 22 bp, Homo sapiens
ggctgcggatctaaggctggga

SEQ ID NO: 7060072 - DNA, 22 bp, Homo sapiens
cactgtctgcttcgactcttca

SEQ ID NO: 7060073 - DNA, 22 bp, Homo sapiens
cactgtcttgattactatgggt

SEQ ID NO: 7060074 - DNA, 22 bp, Homo sapiens
cactgtcttttgtgaagacaat

SEQ ID NO: 7060075 - DNA, 22 bp, Homo sapiens
cactgtgctcctaactagctgt

SEQ ID NO: 7060076 - DNA, 22 bp, Homo sapiens
cactgtgctccttccttagcac

SEQ ID NO: 7060077 - DNA, 22 bp, Homo sapiens
ggctgcagattgtagtctgtta

SEQ ID NO: 7060078 - DNA, 22 bp, Homo sapiens
ggctgcagatagccagccacca

SEQ ID NO: 7060079 - DNA, 22 bp, Homo sapiens
cactgcctgctggctgtcactt

SEQ ID NO: 7060080 - DNA, 22 bp, Homo sapiens
ggctgaggctcatgccatcttg

SEQ ID NO: 7060081 - DNA, 22 bp, Homo sapiens
ggctgcagaggcgatctgaggt

SEQ ID NO: 7060082 - DNA, 22 bp, Homo sapiens
ggctgcagccctcgcctagcca

SEQ ID NO: 7060083 - DNA, 22 bp, Homo sapiens
ggctgcagccctcgcctagcca

SEQ ID NO: 7060084 - DNA, 22 bp, Homo sapiens
ggctcctgtcccctcagctgct

SEQ ID NO: 7060085 - DNA, 22 bp, Homo sapiens
cactgcccagcgtcttaggcac

SEQ ID NO: 7060086 - DNA, 22 bp, Homo sapiens
cactgcccaggacctgccaccc

SEQ ID NO: 7060087 - DNA, 22 bp, Homo sapiens
cactgccctcactgtggttctc

SEQ ID NO: 7060088 - DNA, 20 bp, Homo sapiens
cactgccctccagcctgagc

SEQ ID NO: 7060089 - DNA, 21 bp, Homo sapiens
cactgaggtcaggggtagggt

SEQ ID NO: 7060090 - DNA, 22 bp, Homo sapiens
cactgattaagtctgctagagg

SEQ ID NO: 7060091 - DNA, 22 bp, Homo sapiens
cactgcaacctccacctcctgg

SEQ ID NO: 7060092 - DNA, 22 bp, Homo sapiens
cactgcaacctccacctcctgg

SEQ ID NO: 7060093 - DNA, 22 bp, Homo sapiens
cactgcaacctccacctcctgg

SEQ ID NO: 7060094 - DNA, 22 bp, Homo sapiens
cactgcaacctccacctcctgg

SEQ ID NO: 7060095 - DNA, 22 bp, Homo sapiens
cactgaggcttccttaggcaat

SEQ ID NO: 7060096 - DNA, 22 bp, Homo sapiens
ggcgctcagtgttgccccagag

SEQ ID NO: 7060097 - DNA, 22 bp, Homo sapiens
ggcgctggccacggtggctctg

SEQ ID NO: 7060098 - DNA, 22 bp, Homo sapiens
ggctgggaggatgacttgctac

SEQ ID NO: 7060099 - DNA, 17 bp, Homo sapiens
ggcttcagggagctggg

SEQ ID NO: 7060100 - DNA, 23 bp, Homo sapiens
ggcttcttgcctgtcttggtgct

SEQ ID NO: 7060101 - DNA, 22 bp, Homo sapiens
ggcttctttttagtaaatgtca

SEQ ID NO: 7060102 - DNA, 22 bp, Homo sapiens
ggcttgagacccgggagccaga

SEQ ID NO: 7060103 - DNA, 23 bp, Homo sapiens
ggcttgagctggaacagcttggt

SEQ ID NO: 7060104 - DNA, 22 bp, Homo sapiens
cagaagaggactgggtagctca

SEQ ID NO: 7060105 - DNA, 22 bp, Homo sapiens
cagaagagtagctgaacaagtt

SEQ ID NO: 7060106 - DNA, 23 bp, Homo sapiens
ggctgggagctccgggtgcacgt

SEQ ID NO: 7060107 - DNA, 22 bp, Homo sapiens
ggctgggagccccacagagtca

SEQ ID NO: 7060108 - DNA, 23 bp, Homo sapiens
ggctgggagctccgggtgcacgt

SEQ ID NO: 7060109 - DNA, 23 bp, Homo sapiens
ggctgggagctccgggtgcacgt

SEQ ID NO: 7060110 - DNA, 22 bp, Homo sapiens
ggctgggagccccacagagtca

SEQ ID NO: 7060111 - DNA, 22 bp, Homo sapiens
ggctgggagccccacagagtca

SEQ ID NO: 7060112 - DNA, 22 bp, Homo sapiens
ggctgggacgatgaggattagt

SEQ ID NO: 7060113 - DNA, 22 bp, Homo sapiens
ggctgggacgatgaggattagt

SEQ ID NO: 7060114 - DNA, 22 bp, Homo sapiens
ggctgctggtaggggtaggaag

SEQ ID NO: 7060115 - DNA, 22 bp, Homo sapiens
ggctgctggtggaatggtaggc

SEQ ID NO: 7060116 - DNA, 19 bp, Homo sapiens
ggctgctggttacagaggc

SEQ ID NO: 7060117 - DNA, 22 bp, Homo sapiens
ggctgctgtactgatgtcagtt

SEQ ID NO: 7060118 - DNA, 21 bp, Homo sapiens
ggctgctgtcaccgctgtcac

SEQ ID NO: 7060119 - DNA, 19 bp, Homo sapiens
cagaaatagcgaagtgtaa

SEQ ID NO: 7060120 - DNA, 22 bp, Homo sapiens
cagaaatggagcccaggaatct

SEQ ID NO: 7060121 - DNA, 22 bp, Homo sapiens
cagaaatgtactgacatgcagt

SEQ ID NO: 7060122 - DNA, 22 bp, Homo sapiens
cacagagacagatctattttgc

SEQ ID NO: 7060123 - DNA, 22 bp, Homo sapiens
cacagagacatgatgtcattgc

SEQ ID NO: 7060124 - DNA, 22 bp, Homo sapiens
ggagatagtccaggtgaaggga

SEQ ID NO: 7060125 - DNA, 22 bp, Homo sapiens
ggacagcatatcagcagggcag

SEQ ID NO: 7060126 - DNA, 22 bp, Homo sapiens
ggacagcattctactgtaggca

SEQ ID NO: 7060127 - DNA, 22 bp, Homo sapiens
ggacagcccatacacatgtctg

SEQ ID NO: 7060128 - DNA, 22 bp, Homo sapiens
ggacagcgtggctggtggaggg

SEQ ID NO: 7060129 - DNA, 22 bp, Homo sapiens
ggacagctcctgcacttgagta

SEQ ID NO: 7060130 - DNA, 22 bp, Homo sapiens
ggacagctctgccaggagctca

SEQ ID NO: 7060131 - DNA, 22 bp, Homo sapiens
ggacagctgctttcaggccaca

SEQ ID NO: 7060132 - DNA, 22 bp, Homo sapiens
ggacagctgctttcaggccaca

SEQ ID NO: 7060133 - DNA, 22 bp, Homo sapiens
ggagagctgacatcatgatgtt

SEQ ID NO: 7060134 - DNA, 22 bp, Homo sapiens
ggagagtctgccgagccagccc

SEQ ID NO: 7060135 - DNA, 22 bp, Homo sapiens
ggagagtctgctggccacagtg

SEQ ID NO: 7060136 - DNA, 17 bp, Homo sapiens
ggagagtgggaatggcc

SEQ ID NO: 7060137 - DNA, 22 bp, Homo sapiens
ggacagcacagctcttgacaac

SEQ ID NO: 7060138 - DNA, 22 bp, Homo sapiens
ggacacagataatcacacagat

SEQ ID NO: 7060139 - DNA, 22 bp, Homo sapiens
ggacaagcctgtgagtgggttt

SEQ ID NO: 7060140 - DNA, 22 bp, Homo sapiens
ggacaagcctgtgagtgggttt

SEQ ID NO: 7060141 - DNA, 22 bp, Homo sapiens
ggacaagcctgtgagtgggttt

SEQ ID NO: 7060142 - DNA, 22 bp, Homo sapiens
ggaacagggatttggcctggtt

SEQ ID NO: 7060143 - DNA, 22 bp, Homo sapiens
ggaagactgcatggcatagtga

SEQ ID NO: 7060144 - DNA, 22 bp, Homo sapiens
ggaagagagatcccatagatgt

SEQ ID NO: 7060145 - DNA, 22 bp, Homo sapiens
ggaagagagggctgggcctcaa

SEQ ID NO: 7060146 - DNA, 22 bp, Homo sapiens
ggaagagcctggggtgtcaggc

SEQ ID NO: 7060147 - DNA, 22 bp, Homo sapiens
cacaggagattgatctattggt

SEQ ID NO: 7060148 - DNA, 22 bp, Homo sapiens
cacaggagattgatctattggt

SEQ ID NO: 7060149 - DNA, 18 bp, Homo sapiens
cacaggagatgacctgac

SEQ ID NO: 7060150 - DNA, 22 bp, Homo sapiens
cacaggagaggttaatgggggc

SEQ ID NO: 7060151 - DNA, 22 bp, Homo sapiens
cacaggagaacccacagattct

SEQ ID NO: 7060152 - DNA, 22 bp, Homo sapiens
ggaggggccggctgcctgccac

SEQ ID NO: 7060153 - DNA, 22 bp, Homo sapiens
ggaggggatttagtagatgcta

SEQ ID NO: 7060154 - DNA, 22 bp, Homo sapiens
cacagctgaagtagccatgtgg

SEQ ID NO: 7060155 - DNA, 22 bp, Homo sapiens
ggaggggatttagtagatgcta

SEQ ID NO: 7060156 - DNA, 22 bp, Homo sapiens
ggaggggatggtttgaccctgg

SEQ ID NO: 7060157 - DNA, 22 bp, Homo sapiens
cacagccttactgagatccact

SEQ ID NO: 7060158 - DNA, 22 bp, Homo sapiens
ggagcagcttgcatgctcaggg

SEQ ID NO: 7060159 - DNA, 22 bp, Homo sapiens
ggaggagacggagtgattagtg

SEQ ID NO: 7060160 - DNA, 22 bp, Homo sapiens
ggaggagacggagtgattagtg

SEQ ID NO: 7060161 - DNA, 22 bp, Homo sapiens
ggaggagacggagtgattagtg

SEQ ID NO: 7060162 - DNA, 22 bp, Homo sapiens
ggaggagattcccctctcactt

SEQ ID NO: 7060163 - DNA, 22 bp, Homo sapiens
ggaggagcacttctgagctcag

SEQ ID NO: 7060164 - DNA, 22 bp, Homo sapiens
ggaggagcacttctgagctcag

SEQ ID NO: 7060165 - DNA, 22 bp, Homo sapiens
ggaggagcacttctgagctcag

SEQ ID NO: 7060166 - DNA, 22 bp, Homo sapiens
ggaggagcacttgacggggtct

SEQ ID NO: 7060167 - DNA, 22 bp, Homo sapiens
ggaggagcatgagagggtagtg

SEQ ID NO: 7060168 - DNA, 22 bp, Homo sapiens
cacagcccccttgacactctgg

SEQ ID NO: 7060169 - DNA, 22 bp, Homo sapiens
ggagcagccacgtctcagggca

SEQ ID NO: 7060170 - DNA, 22 bp, Homo sapiens
ggagcagccgcgtctcagggca

SEQ ID NO: 7060171 - DNA, 17 bp, Homo sapiens
ggaacaaatactatgca

SEQ ID NO: 7060172 - DNA, 19 bp, Homo sapiens
gcttccagcactgcaggag

SEQ ID NO: 7060173 - DNA, 20 bp, Homo sapiens
gcttccaggagggctgatat

SEQ ID NO: 7060174 - DNA, 22 bp, Homo sapiens
gcttccaggggctgtgggctga

SEQ ID NO: 7060175 - DNA, 22 bp, Homo sapiens
ggaaatgacttggtgcttcgtt

SEQ ID NO: 7060176 - DNA, 21 bp, Homo sapiens
caatggcgagatcttggctca

SEQ ID NO: 7060177 - DNA, 21 bp, Homo sapiens
caagtgtggatgtggaaggta

SEQ ID NO: 7060178 - DNA, 22 bp, Homo sapiens
gctggtgattgcctcaggaggc

SEQ ID NO: 7060179 - DNA, 22 bp, Homo sapiens
gctggtgcattagctgcagttc

SEQ ID NO: 7060180 - DNA, 22 bp, Homo sapiens
gctggtttccttatctataaag

SEQ ID NO: 7060181 - DNA, 20 bp, Homo sapiens
gctgaggtccctgtggtttt

SEQ ID NO: 7060182 - DNA, 20 bp, Homo sapiens
gctgaggtccctgtggtttt

SEQ ID NO: 7060183 - DNA, 20 bp, Homo sapiens
gctgaggtcattatgcctca

SEQ ID NO: 7060184 - DNA, 20 bp, Homo sapiens
gctgaggtcattatgcctca

SEQ ID NO: 7060185 - DNA, 22 bp, Homo sapiens
gctgaggtccagcattcgccta

SEQ ID NO: 7060186 - DNA, 23 bp, Homo sapiens
gctgaggtcctgctgagtggtgg

SEQ ID NO: 7060187 - DNA, 23 bp, Homo sapiens
gctgaggtcctgctgagtggtgg

SEQ ID NO: 7060188 - DNA, 23 bp, Homo sapiens
gctgaggtcctgctgagtggtgg

SEQ ID NO: 7060189 - DNA, 22 bp, Homo sapiens
gctgaggtgaggctggaaagga

SEQ ID NO: 7060190 - DNA, 22 bp, Homo sapiens
gctgaggtggagattgcagtga

SEQ ID NO: 7060191 - DNA, 22 bp, Homo sapiens
caaatttaggtaacagtctgta

SEQ ID NO: 7060192 - DNA, 23 bp, Homo sapiens
gctgaggtacatttacaggaaga

SEQ ID NO: 7060193 - DNA, 22 bp, Homo sapiens
gctgaggtaggaggttgcagtg

SEQ ID NO: 7060194 - DNA, 22 bp, Homo sapiens
gctgaggtcaggagctgtgggg

SEQ ID NO: 7060195 - DNA, 22 bp, Homo sapiens
gctgaggtcaggagctgtgggg

SEQ ID NO: 7060196 - DNA, 22 bp, Homo sapiens
gctgaggtcaggagctgtgggg

SEQ ID NO: 7060197 - DNA, 22 bp, Homo sapiens
gctggcagccaagtgaagaggg

SEQ ID NO: 7060198 - DNA, 19 bp, Homo sapiens
gctggcagatgtggccgtg

SEQ ID NO: 7060199 - DNA, 22 bp, Homo sapiens
gctggcagagagctggtgagga

SEQ ID NO: 7060200 - DNA, 22 bp, Homo sapiens
gctgaggtggagattgcagtga

SEQ ID NO: 7060201 - DNA, 19 bp, Homo sapiens
gctgaggtggaggaaggag

SEQ ID NO: 7060202 - DNA, 19 bp, Homo sapiens
gctgaggtggaggaaggag

SEQ ID NO: 7060203 - DNA, 16 bp, Homo sapiens
gctggagggaggggtt

SEQ ID NO: 7060204 - DNA, 20 bp, Homo sapiens
gctgggctaccactggccct

SEQ ID NO: 7060205 - DNA, 19 bp, Homo sapiens
gctgggagcagaccctccc

SEQ ID NO: 7060206 - DNA, 22 bp, Homo sapiens
gctgggagcaagtactcatctt

SEQ ID NO: 7060207 - DNA, 22 bp, Homo sapiens
gctggctgtgattttgccaaca

SEQ ID NO: 7060208 - DNA, 22 bp, Homo sapiens
gctgggagcaaagccatgcata

SEQ ID NO: 7060209 - DNA, 22 bp, Homo sapiens
gctgggagccctggtctgctcc

SEQ ID NO: 7060210 - DNA, 22 bp, Homo sapiens
gctgggagccctggtctgctcc

SEQ ID NO: 7060211 - DNA, 19 bp, Homo sapiens
gctgggagcagaccctccc

SEQ ID NO: 7060212 - DNA, 22 bp, Homo sapiens
gctgggagccccgagccagcgc

SEQ ID NO: 7060213 - DNA, 18 bp, Homo sapiens
gcaggagatgggtggggt

SEQ ID NO: 7060214 - DNA, 22 bp, Homo sapiens
gcaggagagtctgtgccaggtt

SEQ ID NO: 7060215 - DNA, 22 bp, Homo sapiens
gcagccaggtttgaggaccact

SEQ ID NO: 7060216 - DNA, 22 bp, Homo sapiens
gcagccagggagagaaccaggg

SEQ ID NO: 7060217 - DNA, 22 bp, Homo sapiens
gcagccaggctacagcgggctt

SEQ ID NO: 7060218 - DNA, 22 bp, Homo sapiens
gcagcaggtctgtcaatgtcat

SEQ ID NO: 7060219 - DNA, 22 bp, Homo sapiens
gcagaggctctttaatgcttag

SEQ ID NO: 7060220 - DNA, 22 bp, Homo sapiens
gcagaggggaagctgaggaatt

SEQ ID NO: 7060221 - DNA, 16 bp, Homo sapiens
gcagaggaaaggggag

SEQ ID NO: 7060222 - DNA, 22 bp, Homo sapiens
gcaaaagtacagccggatttct

SEQ ID NO: 7060223 - DNA, 20 bp, Homo sapiens
gcaaaataggctctgttggt

SEQ ID NO: 7060224 - DNA, 22 bp, Homo sapiens
atgtttctagttgtatgtcact

SEQ ID NO: 7060225 - DNA, 22 bp, Homo sapiens
gcaaatggagtgaagagctgga

SEQ ID NO: 7060226 - DNA, 22 bp, Homo sapiens
gcacagggagcaggtctctggt

SEQ ID NO: 7060227 - DNA, 21 bp, Homo sapiens
gcacagggacagatcatcaca

SEQ ID NO: 7060228 - DNA, 22 bp, Homo sapiens
gcacagaggatgaggcagctct

SEQ ID NO: 7060229 - DNA, 22 bp, Homo sapiens
gcacaggctctcttggggacac

SEQ ID NO: 7060230 - DNA, 22 bp, Homo sapiens
gcacaggctgttggccttcaga

SEQ ID NO: 7060231 - DNA, 23 bp, Homo sapiens
gcacagagcagttaggggaagat

SEQ ID NO: 7060232 - DNA, 22 bp, Homo sapiens
gcacagagctggccctccaggc

SEQ ID NO: 7060233 - DNA, 22 bp, Homo sapiens
gcacagggcaacaggtctgtta

SEQ ID NO: 7060234 - DNA, 22 bp, Homo sapiens
gcactcagtaccaggtcactgc

SEQ ID NO: 7060235 - DNA, 22 bp, Homo sapiens
gcactgtgacccagagcaggtg

SEQ ID NO: 7060236 - DNA, 22 bp, Homo sapiens
gcattcctgagaatgcagagtg

SEQ ID NO: 7060237 - DNA, 22 bp, Homo sapiens
gccactattttcccacctttct

SEQ ID NO: 7060238 - DNA, 22 bp, Homo sapiens
gccactcatgggaggtgtgcaa

SEQ ID NO: 7060239 - DNA, 19 bp, Homo sapiens
gccactcctgatgctgccc

SEQ ID NO: 7060240 - DNA, 21 bp, Homo sapiens
gccactgcactccagcctggg

SEQ ID NO: 7060241 - DNA, 22 bp, Homo sapiens
gccactggcgctgtgcagagtg

SEQ ID NO: 7060242 - DNA, 20 bp, Homo sapiens
gccactgggcaccagcaggg

SEQ ID NO: 7060243 - DNA, 22 bp, Homo sapiens
gccactgtcataccctggcaat

SEQ ID NO: 7060244 - DNA, 22 bp, Homo sapiens
gccactgtcctgtgcctgtgct

SEQ ID NO: 7060245 - DNA, 22 bp, Homo sapiens
attgtttccccggaattattca

SEQ ID NO: 7060246 - DNA, 22 bp, Homo sapiens
atttaaatgcttaagagggttt

SEQ ID NO: 7060247 - DNA, 22 bp, Homo sapiens
atttaaatgcttaagagggttt

SEQ ID NO: 7060248 - DNA, 22 bp, Homo sapiens
atttaaatgcttaagagggttt

SEQ ID NO: 7060249 - DNA, 22 bp, Homo sapiens
atttaaatgcttaagagggttt

SEQ ID NO: 7060250 - DNA, 22 bp, Homo sapiens
attgtaagtagaaatgttatgg

SEQ ID NO: 7060251 - DNA, 22 bp, Homo sapiens
attgtacaatgcctggaacatt

SEQ ID NO: 7060252 - DNA, 22 bp, Homo sapiens
attgtacaatgcctggaacatt

SEQ ID NO: 7060253 - DNA, 22 bp, Homo sapiens
attgttatgaaaataagatgtt

SEQ ID NO: 7060254 - DNA, 22 bp, Homo sapiens
attgttcaaagtgctttgcatg

SEQ ID NO: 7060255 - DNA, 22 bp, Homo sapiens
attgttctggatatttacattg

SEQ ID NO: 7060256 - DNA, 18 bp, Homo sapiens
attgttctgtgacatgtc

SEQ ID NO: 7060257 - DNA, 22 bp, Homo sapiens
gcagggagggcctttcatgaca

SEQ ID NO: 7060258 - DNA, 22 bp, Homo sapiens
gcaggctgtggtatgttgggca

SEQ ID NO: 7060259 - DNA, 22 bp, Homo sapiens
gcaggctggtctgaccatccct

SEQ ID NO: 7060260 - DNA, 22 bp, Homo sapiens
gcaggctgtagacaccaaacta

SEQ ID NO: 7060261 - DNA, 22 bp, Homo sapiens
gcaggctgtctaaagttagagt

SEQ ID NO: 7060262 - DNA, 22 bp, Homo sapiens
gcaggctgtctaaagttagagt

SEQ ID NO: 7060263 - DNA, 22 bp, Homo sapiens
gcaggctgtctaaagttagagt

SEQ ID NO: 7060264 - DNA, 22 bp, Homo sapiens
gcaggctgtgaggctcagatgg

SEQ ID NO: 7060265 - DNA, 22 bp, Homo sapiens
gcaggctgtgaggctcagatgg

SEQ ID NO: 7060266 - DNA, 22 bp, Homo sapiens
gcaggctgtgaggctcagatgg

SEQ ID NO: 7060267 - DNA, 22 bp, Homo sapiens
gcaggctgtgaggctcagatgg

SEQ ID NO: 7060268 - DNA, 22 bp, Homo sapiens
gcaggctgtgaggctcagatgg

SEQ ID NO: 7060269 - DNA, 22 bp, Homo sapiens
gcaggatgccagggcagcagcg

SEQ ID NO: 7060270 - DNA, 22 bp, Homo sapiens
gcaggatgaaggcagaggctga

SEQ ID NO: 7060271 - DNA, 22 bp, Homo sapiens
gcaggattgggcagagggtgaa

SEQ ID NO: 7060272 - DNA, 22 bp, Homo sapiens
gcaggattgggctgaaggagtg

SEQ ID NO: 7060273 - DNA, 22 bp, Homo sapiens
gcaggagccacttcagggatgc

SEQ ID NO: 7060274 - DNA, 22 bp, Homo sapiens
gcaggatgaactaacacctgca

SEQ ID NO: 7060275 - DNA, 22 bp, Homo sapiens
gcaggatgaactaacacctgca

SEQ ID NO: 7060276 - DNA, 22 bp, Homo sapiens
attgtaaagtactgtgtacaat

SEQ ID NO: 7060277 - DNA, 22 bp, Homo sapiens
attgtaaatagtgccacaataa

SEQ ID NO: 7060278 - DNA, 22 bp, Homo sapiens
attggcagttagtgacgaggct

SEQ ID NO: 7060279 - DNA, 22 bp, Homo sapiens
gcaggtggatattgctacttga

SEQ ID NO: 7060280 - DNA, 22 bp, Homo sapiens
gcaggtggatcaccacgtcagg

SEQ ID NO: 7060281 - DNA, 22 bp, Homo sapiens
gcaggtggatcacctgaggtca

SEQ ID NO: 7060282 - DNA, 16 bp, Homo sapiens
gcaggggtgggtggag

SEQ ID NO: 7060283 - DNA, 22 bp, Homo sapiens
gcaggggtggaggctgtcctgt

SEQ ID NO: 7060284 - DNA, 22 bp, Homo sapiens
gcagggctggggctgctcctga

SEQ ID NO: 7060285 - DNA, 22 bp, Homo sapiens
gcagggaggtttgctgacctgg

SEQ ID NO: 7060286 - DNA, 22 bp, Homo sapiens
attttactaagtggatatctgt

SEQ ID NO: 7060287 - DNA, 22 bp, Homo sapiens
attttacataaggaaggtttaa

SEQ ID NO: 7060288 - DNA, 22 bp, Homo sapiens
attttacataaggaaggtttaa

SEQ ID NO: 7060289 - DNA, 23 bp, Homo sapiens
attttacaggtcagttccttgaa

SEQ ID NO: 7060290 - DNA, 23 bp, Homo sapiens
attttacaggtcagttccttgaa

SEQ ID NO: 7060291 - DNA, 22 bp, Homo sapiens
attttactactccaattaatga

SEQ ID NO: 7060292 - DNA, 22 bp, Homo sapiens
gcctgcccacggggctggcata

SEQ ID NO: 7060293 - DNA, 21 bp, Homo sapiens
gcctgccccatgtttctgttg

SEQ ID NO: 7060294 - DNA, 22 bp, Homo sapiens
gcctgccccttcctgggcaggg

SEQ ID NO: 7060295 - DNA, 21 bp, Homo sapiens
gcctgccctctgtgatggcca

SEQ ID NO: 7060296 - DNA, 22 bp, Homo sapiens
gcctgccctgaaagaggtgaag

SEQ ID NO: 7060297 - DNA, 22 bp, Homo sapiens
gcctgcctagaattgcagcttt

SEQ ID NO: 7060298 - DNA, 22 bp, Homo sapiens
gcctgcctagaattgcagcttt

SEQ ID NO: 7060299 - DNA, 22 bp, Homo sapiens
gcctgcctagaattgcagcttt

SEQ ID NO: 7060300 - DNA, 22 bp, Homo sapiens
gcctgcctagaattgcagcttt

SEQ ID NO: 7060301 - DNA, 18 bp, Homo sapiens
gcctgcctagagcttgcc

SEQ ID NO: 7060302 - DNA, 22 bp, Homo sapiens
attttctagatagatgatgcat

SEQ ID NO: 7060303 - DNA, 22 bp, Homo sapiens
attttctgtgtgcagataaata

SEQ ID NO: 7060304 - DNA, 22 bp, Homo sapiens
attttcttctctccctggctgc

SEQ ID NO: 7060305 - DNA, 22 bp, Homo sapiens
attttcttctctccctggctgc

SEQ ID NO: 7060306 - DNA, 22 bp, Homo sapiens
attttgaaaagcatttgagtaa

SEQ ID NO: 7060307 - DNA, 22 bp, Homo sapiens
attttgaaaccaagttatttcc

SEQ ID NO: 7060308 - DNA, 22 bp, Homo sapiens
attttgaaatacttgaaggaaa

SEQ ID NO: 7060309 - DNA, 22 bp, Homo sapiens
attttgaaatacttgaaggaaa

SEQ ID NO: 7060310 - DNA, 18 bp, Homo sapiens
attttgaactgggaatat

SEQ ID NO: 7060311 - DNA, 18 bp, Homo sapiens
attttgaactgggaatat

SEQ ID NO: 7060312 - DNA, 22 bp, Homo sapiens
attttgaagggaattgaagttc

SEQ ID NO: 7060313 - DNA, 22 bp, Homo sapiens
gcctggctcacagagcagcctt

SEQ ID NO: 7060314 - DNA, 22 bp, Homo sapiens
gcctggctccctctgcagctcc

SEQ ID NO: 7060315 - DNA, 22 bp, Homo sapiens
gcctggctccctctgcagctcc

SEQ ID NO: 7060316 - DNA, 22 bp, Homo sapiens
attttaataagattcccaagta

SEQ ID NO: 7060317 - DNA, 22 bp, Homo sapiens
attttaataagattcccaagta

SEQ ID NO: 7060318 - DNA, 22 bp, Homo sapiens
attttaataagatccatttggt

SEQ ID NO: 7060319 - DNA, 22 bp, Homo sapiens
attttaaggcttatttaaaggc

SEQ ID NO: 7060320 - DNA, 22 bp, Homo sapiens
atttgccttttaaactcacaat

SEQ ID NO: 7060321 - DNA, 23 bp, Homo sapiens
attttaaccttgactaacatgca

SEQ ID NO: 7060322 - DNA, 22 bp, Homo sapiens
attttaaggcttatttaaaggc

SEQ ID NO: 7060323 - DNA, 22 bp, Homo sapiens
atttgcctttcgaatcaacagg

SEQ ID NO: 7060324 - DNA, 22 bp, Homo sapiens
atttgcctgtaagacaaggcct

SEQ ID NO: 7060325 - DNA, 22 bp, Homo sapiens
atttgacaacttctggtggcat

SEQ ID NO: 7060326 - DNA, 22 bp, Homo sapiens
atttgacattattctctcagtc

SEQ ID NO: 7060327 - DNA, 22 bp, Homo sapiens
atttgacagtgagttgtggatg

SEQ ID NO: 7060328 - DNA, 22 bp, Homo sapiens
atttgacattgacacacctatg

SEQ ID NO: 7060329 - DNA, 22 bp, Homo sapiens
atttgacattgacacacctatg

SEQ ID NO: 7060330 - DNA, 23 bp, Homo sapiens
atttgagaaagtatttttaagac

SEQ ID NO: 7060331 - DNA, 22 bp, Homo sapiens
atttgattagctgtgtaatttt

SEQ ID NO: 7060332 - DNA, 22 bp, Homo sapiens
atttgcaaaggttaacagcagt

SEQ ID NO: 7060333 - DNA, 22 bp, Homo sapiens
atttgcagaagggagggggacc

SEQ ID NO: 7060334 - DNA, 18 bp, Homo sapiens
atttgcaggcatgcaggc

SEQ ID NO: 7060335 - DNA, 22 bp, Homo sapiens
atttgcataatagtgatttgta

SEQ ID NO: 7060336 - DNA, 21 bp, Homo sapiens
gccccctggactcctcatcca

SEQ ID NO: 7060337 - DNA, 22 bp, Homo sapiens
gccctccaccagagcccttctc

SEQ ID NO: 7060338 - DNA, 22 bp, Homo sapiens
gccctccatggtgatccaggcc

SEQ ID NO: 7060339 - DNA, 22 bp, Homo sapiens
gccctcccctctgggtggtgag

SEQ ID NO: 7060340 - DNA, 22 bp, Homo sapiens
gccctccctacagcctatttct

SEQ ID NO: 7060341 - DNA, 23 bp, Homo sapiens
gccctccctcccaggtgggtgtt

SEQ ID NO: 7060342 - DNA, 22 bp, Homo sapiens
gccctgcagtgcggaggtggca

SEQ ID NO: 7060343 - DNA, 22 bp, Homo sapiens
gccctgccctctcggcactcgc

SEQ ID NO: 7060344 - DNA, 22 bp, Homo sapiens
gccctgccctgagccgtagacc

SEQ ID NO: 7060345 - DNA, 22 bp, Homo sapiens
gccctgccctgttgaaactaga

SEQ ID NO: 7060346 - DNA, 23 bp, Homo sapiens
gccctgcccttagcacactcaca

SEQ ID NO: 7060347 - DNA, 22 bp, Homo sapiens
gccctgcctgccggtgtgggtc

SEQ ID NO: 7060348 - DNA, 22 bp, Homo sapiens
gcccactccagcttctcccaca

SEQ ID NO: 7060349 - DNA, 20 bp, Homo sapiens
gcccactctaatccactgtc

SEQ ID NO: 7060350 - DNA, 20 bp, Homo sapiens
gcccactctaatccactgtc

SEQ ID NO: 7060351 - DNA, 22 bp, Homo sapiens
gccagaggtatcaaagatagta

SEQ ID NO: 7060352 - DNA, 22 bp, Homo sapiens
gccagaggggctcgaaggcgcg

SEQ ID NO: 7060353 - DNA, 18 bp, Homo sapiens
gccagagggcccaaggtc

SEQ ID NO: 7060354 - DNA, 18 bp, Homo sapiens
gccagagggaagcaggtg

SEQ ID NO: 7060355 - DNA, 22 bp, Homo sapiens
atttacataatagactttaggt

SEQ ID NO: 7060356 - DNA, 22 bp, Homo sapiens
atttacattccatggtggttac

SEQ ID NO: 7060357 - DNA, 22 bp, Homo sapiens
gctgaggaggtgtggttaggtg

SEQ ID NO: 7060358 - DNA, 22 bp, Homo sapiens
caaatgaagggagctgaagtct

SEQ ID NO: 7060359 - DNA, 22 bp, Homo sapiens
gctctggtaccagctactccta

SEQ ID NO: 7060360 - DNA, 22 bp, Homo sapiens
gctgagctgaggcagggctggg

SEQ ID NO: 7060361 - DNA, 22 bp, Homo sapiens
gctgagctgggacagtcctggg

SEQ ID NO: 7060362 - DNA, 22 bp, Homo sapiens
gctgagctgggacagtcctggg

SEQ ID NO: 7060363 - DNA, 22 bp, Homo sapiens
gctgaggaaaccaatgctcaga

SEQ ID NO: 7060364 - DNA, 22 bp, Homo sapiens
gctgaggaaaggctggaaggga

SEQ ID NO: 7060365 - DNA, 22 bp, Homo sapiens
gctgaggaagtcaggtggccca

SEQ ID NO: 7060366 - DNA, 22 bp, Homo sapiens
gctgaggacatacacattgtgc

SEQ ID NO: 7060367 - DNA, 22 bp, Homo sapiens
gctgaggacatcatggaaggaa

SEQ ID NO: 7060368 - DNA, 22 bp, Homo sapiens
gctctgggtgaacttggagcaa

SEQ ID NO: 7060369 - DNA, 22 bp, Homo sapiens
caaatcatggaataactagaga

SEQ ID NO: 7060370 - DNA, 22 bp, Homo sapiens
gctctgagaggatgctgagcag

SEQ ID NO: 7060371 - DNA, 22 bp, Homo sapiens
caaatagacttaagcatctgta

SEQ ID NO: 7060372 - DNA, 22 bp, Homo sapiens
caaatattccaggtacatccct

SEQ ID NO: 7060373 - DNA, 22 bp, Homo sapiens
caaatattccaggtacatccct

SEQ ID NO: 7060374 - DNA, 22 bp, Homo sapiens
gctattgtgacagcttttcgcc

SEQ ID NO: 7060375 - DNA, 22 bp, Homo sapiens
gctatgcaggagcctaatgaca

SEQ ID NO: 7060376 - DNA, 22 bp, Homo sapiens
gctacagactgagcatggctct

SEQ ID NO: 7060377 - DNA, 22 bp, Homo sapiens
gctatttccaaagctgctgttc

SEQ ID NO: 7060378 - DNA, 22 bp, Homo sapiens
gctatttttgagccatttataa

SEQ ID NO: 7060379 - DNA, 22 bp, Homo sapiens
gctcaaagaatattcagaatga

SEQ ID NO: 7060380 - DNA, 22 bp, Homo sapiens
gctcaaagaccagacagaggag

SEQ ID NO: 7060381 - DNA, 22 bp, Homo sapiens
gctcaaaggccaggtagcagca

SEQ ID NO: 7060382 - DNA, 21 bp, Homo sapiens
gctcaaagggcttgccatgct

SEQ ID NO: 7060383 - DNA, 21 bp, Homo sapiens
gcctggctctcactggcctgg

SEQ ID NO: 7060384 - DNA, 22 bp, Homo sapiens
gcgtggggtaggtagacatgga

SEQ ID NO: 7060385 - DNA, 22 bp, Homo sapiens
gctcggtggccagcctgaggcc

SEQ ID NO: 7060386 - DNA, 22 bp, Homo sapiens
gctccttctggctcccttttgg

SEQ ID NO: 7060387 - DNA, 22 bp, Homo sapiens
gctcgaccgccagaaacttcct

SEQ ID NO: 7060388 - DNA, 20 bp, Homo sapiens
gctctaaagccacagattga

SEQ ID NO: 7060389 - DNA, 22 bp, Homo sapiens
gctctaactattaagaggtcat

SEQ ID NO: 7060390 - DNA, 22 bp, Homo sapiens
gctcaggggaatgggctgccgt

SEQ ID NO: 7060391 - DNA, 22 bp, Homo sapiens
gctcagggctaaggctgagggg

SEQ ID NO: 7060392 - DNA, 22 bp, Homo sapiens
gctcagggctaaggctgagggg

SEQ ID NO: 7060393 - DNA, 22 bp, Homo sapiens
gctcaggggaatgggctgccgt

SEQ ID NO: 7060394 - DNA, 22 bp, Homo sapiens
gctcaggggaatgggctgccgt

SEQ ID NO: 7060395 - DNA, 22 bp, Homo sapiens
gctcagggtcccttggtgctgg

SEQ ID NO: 7060396 - DNA, 22 bp, Homo sapiens
gctcagggtcccttggtgctgg

SEQ ID NO: 7060397 - DNA, 22 bp, Homo sapiens
gctcagggtcccttggtgctgg

SEQ ID NO: 7060398 - DNA, 18 bp, Homo sapiens
gctcaggtatagacaggg

SEQ ID NO: 7060399 - DNA, 23 bp, Homo sapiens
gctcaggtggctcagggactgat

SEQ ID NO: 7060400 - DNA, 22 bp, Homo sapiens
gaacataactattgtgaatagt

SEQ ID NO: 7060401 - DNA, 22 bp, Homo sapiens
gaacatcagtcataatttaacg

SEQ ID NO: 7060402 - DNA, 22 bp, Homo sapiens
atgaggcattccactcaaactc

SEQ ID NO: 7060403 - DNA, 22 bp, Homo sapiens
atgaggcattccactcaaactc

SEQ ID NO: 7060404 - DNA, 22 bp, Homo sapiens
atgaggcatgtgaggagaaggg

SEQ ID NO: 7060405 - DNA, 22 bp, Homo sapiens
atgaggcatgtgaggagaaggg

SEQ ID NO: 7060406 - DNA, 22 bp, Homo sapiens
atgaggcattcacagaaggcac

SEQ ID NO: 7060407 - DNA, 22 bp, Homo sapiens
atgaggcatagcagggatcgga

SEQ ID NO: 7060408 - DNA, 22 bp, Homo sapiens
atgaggcatagcagggatcgga

SEQ ID NO: 7060409 - DNA, 16 bp, Homo sapiens
atgaggcataggctgc

SEQ ID NO: 7060410 - DNA, 22 bp, Homo sapiens
gaaatgatgtctgtgctgccac

SEQ ID NO: 7060411 - DNA, 22 bp, Homo sapiens
gaaatgattttagtttatcatg

SEQ ID NO: 7060412 - DNA, 22 bp, Homo sapiens
atgaggcatctaacattgcaaa

SEQ ID NO: 7060413 - DNA, 22 bp, Homo sapiens
atgaggcatctgcagtcactag

SEQ ID NO: 7060414 - DNA, 22 bp, Homo sapiens
atgaggcatgtgaggagaaggg

SEQ ID NO: 7060415 - DNA, 22 bp, Homo sapiens
gaaaatgtgtcatccctactgt

SEQ ID NO: 7060416 - DNA, 22 bp, Homo sapiens
gaaaatgagcctcagctacatt

SEQ ID NO: 7060417 - DNA, 22 bp, Homo sapiens
gaaaatgtgcctttgggtattg

SEQ ID NO: 7060418 - DNA, 22 bp, Homo sapiens
gaaatatacatgaagtcggctg

SEQ ID NO: 7060419 - DNA, 22 bp, Homo sapiens
gaactttaccatttaggtaact

SEQ ID NO: 7060420 - DNA, 20 bp, Homo sapiens
gaacatggcaggtggagggg

SEQ ID NO: 7060421 - DNA, 22 bp, Homo sapiens
atgcaagagcaatatggtatgc

SEQ ID NO: 7060422 - DNA, 22 bp, Homo sapiens
atgaatgattttatgtaaatga

SEQ ID NO: 7060423 - DNA, 22 bp, Homo sapiens
atgaatgagaaacaggtgagat

SEQ ID NO: 7060424 - DNA, 22 bp, Homo sapiens
atgaatgagaaagctgaaatct

SEQ ID NO: 7060425 - DNA, 19 bp, Homo sapiens
atgaatgagctgtgaggtt

SEQ ID NO: 7060426 - DNA, 19 bp, Homo sapiens
atgaatgagctgtgaggtt

SEQ ID NO: 7060427 - DNA, 22 bp, Homo sapiens
atgaatgattaaagagtacagt

SEQ ID NO: 7060428 - DNA, 22 bp, Homo sapiens
atgaatggatggggtcaagata

SEQ ID NO: 7060429 - DNA, 22 bp, Homo sapiens
atgaattgaggaaaacagtcgt

SEQ ID NO: 7060430 - DNA, 22 bp, Homo sapiens
ctttttccagcttcagggtggg

SEQ ID NO: 7060431 - DNA, 22 bp, Homo sapiens
gaaaactaacggaaaagttagg

SEQ ID NO: 7060432 - DNA, 22 bp, Homo sapiens
gaaaactaacggaaaagttagg

SEQ ID NO: 7060433 - DNA, 22 bp, Homo sapiens
gaaaactattggcctagaacaa

SEQ ID NO: 7060434 - DNA, 22 bp, Homo sapiens
gaaaactattggcctagaacaa

SEQ ID NO: 7060435 - DNA, 22 bp, Homo sapiens
gaaaagaactgcatgggattaa

SEQ ID NO: 7060436 - DNA, 22 bp, Homo sapiens
gaaaatgagcctcagctacatt

SEQ ID NO: 7060437 - DNA, 22 bp, Homo sapiens
atcttcaaagcacatcgtttgt

SEQ ID NO: 7060438 - DNA, 22 bp, Homo sapiens
atcttcaacttgatcatttgaa

SEQ ID NO: 7060439 - DNA, 22 bp, Homo sapiens
atcttcaactttggggctgcct

SEQ ID NO: 7060440 - DNA, 22 bp, Homo sapiens
atcttcagttttcagtgagcca

SEQ ID NO: 7060441 - DNA, 22 bp, Homo sapiens
atcttcatcaagttcacagtgg

SEQ ID NO: 7060442 - DNA, 22 bp, Homo sapiens
atcttcccaggctggggagagg

SEQ ID NO: 7060443 - DNA, 22 bp, Homo sapiens
atcttcccaggctggggagagg

SEQ ID NO: 7060444 - DNA, 22 bp, Homo sapiens
cttgaggttttgactcagcttt

SEQ ID NO: 7060445 - DNA, 22 bp, Homo sapiens
cttgaggttttgactcagcttt

SEQ ID NO: 7060446 - DNA, 22 bp, Homo sapiens
atgaagttctcaataatcatgt

SEQ ID NO: 7060447 - DNA, 22 bp, Homo sapiens
atgaataaaacattttaatcag

SEQ ID NO: 7060448 - DNA, 22 bp, Homo sapiens
atgaataaaacattttaatcag

SEQ ID NO: 7060449 - DNA, 22 bp, Homo sapiens
atgaatatgagactgagagcct

SEQ ID NO: 7060450 - DNA, 22 bp, Homo sapiens
atgaatcaaactgtacactgag

SEQ ID NO: 7060451 - DNA, 22 bp, Homo sapiens
atgaatgaagaacatctgtgcc

SEQ ID NO: 7060452 - DNA, 23 bp, Homo sapiens
atgaatgaataaggcaggaaagc

SEQ ID NO: 7060453 - DNA, 22 bp, Homo sapiens
atgaatgactgtctactttggg

SEQ ID NO: 7060454 - DNA, 22 bp, Homo sapiens
atgccctgagcaggccttcaag

SEQ ID NO: 7060455 - DNA, 22 bp, Homo sapiens
atgccctgctctcgggaaggga

SEQ ID NO: 7060456 - DNA, 20 bp, Homo sapiens
atgcatatatgtggtgtctg

SEQ ID NO: 7060457 - DNA, 20 bp, Homo sapiens
atgcatatatgtggtgtctg

SEQ ID NO: 7060458 - DNA, 22 bp, Homo sapiens
atgcatatcacagtctccatgt

SEQ ID NO: 7060459 - DNA, 22 bp, Homo sapiens
atgcatatcagtgattgtttgc

SEQ ID NO: 7060460 - DNA, 22 bp, Homo sapiens
atgcatatcagtgattgtttgc

SEQ ID NO: 7060461 - DNA, 22 bp, Homo sapiens
atgcatatctcctatctcctca

SEQ ID NO: 7060462 - DNA, 22 bp, Homo sapiens
atgcatatctcctatctcctca

SEQ ID NO: 7060463 - DNA, 22 bp, Homo sapiens
atgcatatgcaatgcacaattt

SEQ ID NO: 7060464 - DNA, 22 bp, Homo sapiens
atgcatatgcatctgtgtacat

SEQ ID NO: 7060465 - DNA, 22 bp, Homo sapiens
atgcatatgcatctgtgtacat

SEQ ID NO: 7060466 - DNA, 22 bp, Homo sapiens
atgccctgtgactctcctggac

SEQ ID NO: 7060467 - DNA, 22 bp, Homo sapiens
atgcctcctcaaatctgccaca

SEQ ID NO: 7060468 - DNA, 22 bp, Homo sapiens
atgcctgccatttagaagtctt

SEQ ID NO: 7060469 - DNA, 22 bp, Homo sapiens
atgcctgcttactccaggtgct

SEQ ID NO: 7060470 - DNA, 22 bp, Homo sapiens
atgcctggactgacatgcactg

SEQ ID NO: 7060471 - DNA, 22 bp, Homo sapiens
atgcctggactgacatgcactg

SEQ ID NO: 7060472 - DNA, 22 bp, Homo sapiens
gacaggaacataaatgtaggag

SEQ ID NO: 7060473 - DNA, 22 bp, Homo sapiens
gacagggactccctggttagaa

SEQ ID NO: 7060474 - DNA, 22 bp, Homo sapiens
gaagcagagcctaaggcagaca

SEQ ID NO: 7060475 - DNA, 22 bp, Homo sapiens
gaatgtaatagtcagtagaaca

SEQ ID NO: 7060476 - DNA, 22 bp, Homo sapiens
atgcataatgtatgtattgact

SEQ ID NO: 7060477 - DNA, 22 bp, Homo sapiens
atgcatataaggcacatgtatt

SEQ ID NO: 7060478 - DNA, 22 bp, Homo sapiens
atgcatataaggcacatgtatt

SEQ ID NO: 7060479 - DNA, 22 bp, Homo sapiens
atgcatataatggccagaacaa

SEQ ID NO: 7060480 - DNA, 22 bp, Homo sapiens
atgcatataatggccagaacaa

SEQ ID NO: 7060481 - DNA, 22 bp, Homo sapiens
atgcatatagaacatttgacat

SEQ ID NO: 7060482 - DNA, 22 bp, Homo sapiens
atgcatatagaacatttgacat

SEQ ID NO: 7060483 - DNA, 22 bp, Homo sapiens
atgcatatatacatacacagtc

SEQ ID NO: 7060484 - DNA, 22 bp, Homo sapiens
atgctttattgttaggtcatgt

SEQ ID NO: 7060485 - DNA, 20 bp, Homo sapiens
atgctttcttgtgtgctgct

SEQ ID NO: 7060486 - DNA, 22 bp, Homo sapiens
atgctttggccaatgagaagtg

SEQ ID NO: 7060487 - DNA, 22 bp, Homo sapiens
atgcttttaactcctttatccc

SEQ ID NO: 7060488 - DNA, 22 bp, Homo sapiens
atgcttttccaggagaaatata

SEQ ID NO: 7060489 - DNA, 22 bp, Homo sapiens
gactttgaacagtgtatcagta

SEQ ID NO: 7060490 - DNA, 22 bp, Homo sapiens
gactttgacgaaagagtcatta

SEQ ID NO: 7060491 - DNA, 22 bp, Homo sapiens
gactttgagggatacaaacatt

SEQ ID NO: 7060492 - DNA, 22 bp, Homo sapiens
gactttgattaaatcaagcaaa

SEQ ID NO: 7060493 - DNA, 22 bp, Homo sapiens
gacccgtggcaggctgcctgct

SEQ ID NO: 7060494 - DNA, 22 bp, Homo sapiens
gaccctcctactaccctggaaa

SEQ ID NO: 7060495 - DNA, 22 bp, Homo sapiens
atgctttatgttctggcatttt

SEQ ID NO: 7060496 - DNA, 21 bp, Homo sapiens
gaccccagaccagcagacaca

SEQ ID NO: 7060497 - DNA, 22 bp, Homo sapiens
gaccctctagatggaagcactg

SEQ ID NO: 7060498 - DNA, 22 bp, Homo sapiens
gaccctctagatggaagcactg

SEQ ID NO: 7060499 - DNA, 22 bp, Homo sapiens
gaccctggagccgtctgaggca

SEQ ID NO: 7060500 - DNA, 22 bp, Homo sapiens
gactttccaggtcctgggctat

SEQ ID NO: 7060501 - DNA, 22 bp, Homo sapiens
gacagtggttccaaggcagctt

SEQ ID NO: 7060502 - DNA, 22 bp, Homo sapiens
gacagtttaggttcaaatctca

SEQ ID NO: 7060503 - DNA, 22 bp, Homo sapiens
gacagggcgagactcagtctca

SEQ ID NO: 7060504 - DNA, 22 bp, Homo sapiens
gacagggaggagcagagcttct

SEQ ID NO: 7060505 - DNA, 22 bp, Homo sapiens
gacagggaggagcagagcttct

SEQ ID NO: 7060506 - DNA, 22 bp, Homo sapiens
gacagggaggaaagagactgct

SEQ ID NO: 7060507 - DNA, 22 bp, Homo sapiens
atgctttacgacaaaaaactca

SEQ ID NO: 7060508 - DNA, 22 bp, Homo sapiens
atgctttatacaaaacacttaa

SEQ ID NO: 7060509 - DNA, 19 bp, Homo sapiens
atgctttatgttatttctt

SEQ ID NO: 7060510 - DNA, 22 bp, Homo sapiens
atgctttaaaacgtatgtgtaa

SEQ ID NO: 7060511 - DNA, 22 bp, Homo sapiens
atgctttaaactataaatccac

SEQ ID NO: 7060512 - DNA, 22 bp, Homo sapiens
atgctttacagttttccaaaca

SEQ ID NO: 7060513 - DNA, 22 bp, Homo sapiens
gacataaaatggaattctgttg

SEQ ID NO: 7060514 - DNA, 22 bp, Homo sapiens
gacataaaattcaataatttgt

SEQ ID NO: 7060515 - DNA, 22 bp, Homo sapiens
gacataaaccttgagatattaa

SEQ ID NO: 7060516 - DNA, 22 bp, Homo sapiens
gacataaagttcttgcttgaat

SEQ ID NO: 7060517 - DNA, 22 bp, Homo sapiens
atgtttccgtgagcatccttga

SEQ ID NO: 7060518 - DNA, 22 bp, Homo sapiens
atgtttccattttcttgtatca

SEQ ID NO: 7060519 - DNA, 22 bp, Homo sapiens
atgtttccaggttcttcctatg

SEQ ID NO: 7060520 - DNA, 18 bp, Homo sapiens
gatctctgcagtgcctac

SEQ ID NO: 7060521 - DNA, 22 bp, Homo sapiens
gatctctgtggactcttagcac

SEQ ID NO: 7060522 - DNA, 22 bp, Homo sapiens
gagttatagatggactattatt

SEQ ID NO: 7060523 - DNA, 22 bp, Homo sapiens
gagttatatcctgagtcatatt

SEQ ID NO: 7060524 - DNA, 22 bp, Homo sapiens
gagttatatttgcgatattgga

SEQ ID NO: 7060525 - DNA, 22 bp, Homo sapiens
gatatttaactctcacaggtcc

SEQ ID NO: 7060526 - DNA, 22 bp, Homo sapiens
gatatttacaaatttgccaata

SEQ ID NO: 7060527 - DNA, 22 bp, Homo sapiens
gatcgagttgtttgttctgggg

SEQ ID NO: 7060528 - DNA, 22 bp, Homo sapiens
gatcgggtgggttctgccatca

SEQ ID NO: 7060529 - DNA, 22 bp, Homo sapiens
atgtttcatgactgagcaaaat

SEQ ID NO: 7060530 - DNA, 22 bp, Homo sapiens
atgtttcaccagttttataaga

SEQ ID NO: 7060531 - DNA, 22 bp, Homo sapiens
atgtttcagatacagatcaaat

SEQ ID NO: 7060532 - DNA, 22 bp, Homo sapiens
atgtttcaatgcactttagcct

SEQ ID NO: 7060533 - DNA, 21 bp, Homo sapiens
gagtgcaggtctgatgccatc

SEQ ID NO: 7060534 - DNA, 21 bp, Homo sapiens
gagtgcaggtctgatgccatc

SEQ ID NO: 7060535 - DNA, 22 bp, Homo sapiens
atgtttaattatctgggttttg

SEQ ID NO: 7060536 - DNA, 22 bp, Homo sapiens
gagtccagtgatgttcctggtc

SEQ ID NO: 7060537 - DNA, 22 bp, Homo sapiens
gagtccagttagtgaggctggg

SEQ ID NO: 7060538 - DNA, 23 bp, Homo sapiens
gagtgcagaatagacatgcagtg

SEQ ID NO: 7060539 - DNA, 23 bp, Homo sapiens
gagtgcagaatagacatgcagtg

SEQ ID NO: 7060540 - DNA, 22 bp, Homo sapiens
gagtgcagatgaacagaagatt

SEQ ID NO: 7060541 - DNA, 22 bp, Homo sapiens
gaggtagggcagaggctgaatg

SEQ ID NO: 7060542 - DNA, 22 bp, Homo sapiens
gaggttggggctgcagtgagct

SEQ ID NO: 7060543 - DNA, 22 bp, Homo sapiens
gagtccagctcattgtctggga

SEQ ID NO: 7060544 - DNA, 22 bp, Homo sapiens
gaggtacatgaggatacacagg

SEQ ID NO: 7060545 - DNA, 18 bp, Homo sapiens
gaggtagataagattttc

SEQ ID NO: 7060546 - DNA, 22 bp, Homo sapiens
gaggtacagagtgttccaatgt

SEQ ID NO: 7060547 - DNA, 23 bp, Homo sapiens
gaggtacagcaccagtgaatagg

SEQ ID NO: 7060548 - DNA, 17 bp, Homo sapiens
gaggtaggaagtgagtc

SEQ ID NO: 7060549 - DNA, 19 bp, Homo sapiens
gaggggaggaattgacaag

SEQ ID NO: 7060550 - DNA, 19 bp, Homo sapiens
gaggggaggaattgacaag

SEQ ID NO: 7060551 - DNA, 22 bp, Homo sapiens
gagggggcgtgcaaggctccgc

SEQ ID NO: 7060552 - DNA, 22 bp, Homo sapiens
gagggggctctgccaacctgtc

SEQ ID NO: 7060553 - DNA, 22 bp, Homo sapiens
gagggaaacagatgggttgtgg

SEQ ID NO: 7060554 - DNA, 22 bp, Homo sapiens
gaggctgttagggcctgaggta

SEQ ID NO: 7060555 - DNA, 22 bp, Homo sapiens
gaggctgttcagtgtccagctt

SEQ ID NO: 7060556 - DNA, 22 bp, Homo sapiens
gaggctgttggctgatctgagt

SEQ ID NO: 7060557 - DNA, 22 bp, Homo sapiens
gagggatgtgcctgaaggcagg

SEQ ID NO: 7060558 - DNA, 22 bp, Homo sapiens
gagggatggtgtgagaggctca

SEQ ID NO: 7060559 - DNA, 22 bp, Homo sapiens
gagggatgtcaggggaccttgg

SEQ ID NO: 7060560 - DNA, 22 bp, Homo sapiens
gagggaagaaagaattgatgcg

SEQ ID NO: 7060561 - DNA, 22 bp, Homo sapiens
gagggatggtgtgagaggctca

SEQ ID NO: 7060562 - DNA, 22 bp, Homo sapiens
atgtcacatctgggatggccct

SEQ ID NO: 7060563 - DNA, 22 bp, Homo sapiens
atgtcacatgagagcgcagcac

SEQ ID NO: 7060564 - DNA, 22 bp, Homo sapiens
atgtcacatggttctggggcct

SEQ ID NO: 7060565 - DNA, 22 bp, Homo sapiens
atgtcacattggagctgctgga

SEQ ID NO: 7060566 - DNA, 22 bp, Homo sapiens
gaggccaaggtgggcagatcac

SEQ ID NO: 7060567 - DNA, 22 bp, Homo sapiens
gaggccacagtcctgaggcatc

SEQ ID NO: 7060568 - DNA, 22 bp, Homo sapiens
gaggccacagtcctgaggcatc

SEQ ID NO: 7060569 - DNA, 23 bp, Homo sapiens
gaggccacattcccctgcttgag

SEQ ID NO: 7060570 - DNA, 22 bp, Homo sapiens
gaggctggaatattagaaatgt

SEQ ID NO: 7060571 - DNA, 22 bp, Homo sapiens
gaggctgtgtgtccctctggac

SEQ ID NO: 7060572 - DNA, 22 bp, Homo sapiens
gaggctgtgtttcagtgaggcc

SEQ ID NO: 7060573 - DNA, 22 bp, Homo sapiens
atgtaacaaatggtatacatgt

SEQ ID NO: 7060574 - DNA, 22 bp, Homo sapiens
atgtaagtattcaaaatatttc

SEQ ID NO: 7060575 - DNA, 22 bp, Homo sapiens
atgtatttctatgtagtgaaga

SEQ ID NO: 7060576 - DNA, 22 bp, Homo sapiens
atgtcacagcaggagtattctt

SEQ ID NO: 7060577 - DNA, 22 bp, Homo sapiens
atgtcacagctcccattcctcc

SEQ ID NO: 7060578 - DNA, 22 bp, Homo sapiens
atgtacaacctgcatgacagtc

SEQ ID NO: 7060579 - DNA, 22 bp, Homo sapiens
gagcttggtgcacagtggttaa

SEQ ID NO: 7060580 - DNA, 22 bp, Homo sapiens
gagctttaccttaggttctgtt

SEQ ID NO: 7060581 - DNA, 22 bp, Homo sapiens
gagctctgcttgggttcttagg

SEQ ID NO: 7060582 - DNA, 22 bp, Homo sapiens
gagctttgctggaagcctgggg

SEQ ID NO: 7060583 - DNA, 22 bp, Homo sapiens
gaggaagcagggcttggctgag

SEQ ID NO: 7060584 - DNA, 22 bp, Homo sapiens
gaggaagcagggcttggctgag

SEQ ID NO: 7060585 - DNA, 22 bp, Homo sapiens
gaggaagctgcgtggcatttca

SEQ ID NO: 7060586 - DNA, 22 bp, Homo sapiens
gaggaaggctaaggggcttaga

SEQ ID NO: 7060587 - DNA, 22 bp, Homo sapiens
gagaggtggaggttgcagtgag

SEQ ID NO: 7060588 - DNA, 22 bp, Homo sapiens
gagaggtggaggttgcagtgag

SEQ ID NO: 7060589 - DNA, 22 bp, Homo sapiens
gagaggtggtgaggacttgtct

SEQ ID NO: 7060590 - DNA, 22 bp, Homo sapiens
gagaggtgtgtttcagataaga

SEQ ID NO: 7060591 - DNA, 22 bp, Homo sapiens
gagaggtgaaaggatagtttga

SEQ ID NO: 7060592 - DNA, 22 bp, Homo sapiens
gagaggtgaaatagttgtccgg

SEQ ID NO: 7060593 - DNA, 22 bp, Homo sapiens
gagaggtgaaggctgccctggg

SEQ ID NO: 7060594 - DNA, 22 bp, Homo sapiens
gagaggtgaatgtggatgccac

SEQ ID NO: 7060595 - DNA, 22 bp, Homo sapiens
gagcacagggaatagacagata

SEQ ID NO: 7060596 - DNA, 22 bp, Homo sapiens
gagcagctcgagaaggaagcag

SEQ ID NO: 7060597 - DNA, 22 bp, Homo sapiens
gagaggctgggttggagatcga

SEQ ID NO: 7060598 - DNA, 22 bp, Homo sapiens
gagaggtagcagtaagaacagg

SEQ ID NO: 7060599 - DNA, 22 bp, Homo sapiens
gagaggctgcatatgcacactg

SEQ ID NO: 7060600 - DNA, 22 bp, Homo sapiens
gagaggctggcagtgccaggtt

SEQ ID NO: 7060601 - DNA, 22 bp, Homo sapiens
gagaggctggcagtgccaggtt

SEQ ID NO: 7060602 - DNA, 22 bp, Homo sapiens
gagaggctgatcctgcagagaa

SEQ ID NO: 7060603 - DNA, 22 bp, Homo sapiens
gagaggctgaaatcacaggagc

SEQ ID NO: 7060604 - DNA, 22 bp, Homo sapiens
gagaggctgactggctgtcctg

SEQ ID NO: 7060605 - DNA, 22 bp, Homo sapiens
gagaggctccgccactgctcag

SEQ ID NO: 7060606 - DNA, 22 bp, Homo sapiens
gagaggctccgccactgctcag

SEQ ID NO: 7060607 - DNA, 22 bp, Homo sapiens
gagaggctctgaggactggggt

SEQ ID NO: 7060608 - DNA, 22 bp, Homo sapiens
gagaggctctgaggactggggt

SEQ ID NO: 7060609 - DNA, 22 bp, Homo sapiens
atgcttttcctaaaatgatgcc

SEQ ID NO: 7060610 - DNA, 22 bp, Homo sapiens
atgctttttaaacttaattgga

SEQ ID NO: 7060611 - DNA, 21 bp, Homo sapiens
atggaaaaacaggtagagcat

SEQ ID NO: 7060612 - DNA, 22 bp, Homo sapiens
gagcgcgccacaaggagcggcg

SEQ ID NO: 7060613 - DNA, 22 bp, Homo sapiens
gagcctggcctcctgcctcagc

SEQ ID NO: 7060614 - DNA, 20 bp, Homo sapiens
gagcctgggaagtctaaggt

SEQ ID NO: 7060615 - DNA, 22 bp, Homo sapiens
gagcctggggaccctcctgagt

SEQ ID NO: 7060616 - DNA, 22 bp, Homo sapiens
gagcctgggtccttccctggga

SEQ ID NO: 7060617 - DNA, 22 bp, Homo sapiens
gagcagggagacaactctggtg

SEQ ID NO: 7060618 - DNA, 22 bp, Homo sapiens
gagcagctgagctggaatgaga

SEQ ID NO: 7060619 - DNA, 17 bp, Homo sapiens
gagcagggatgcggttc

SEQ ID NO: 7060620 - DNA, 17 bp, Homo sapiens
gagcagggatgcggttc

SEQ ID NO: 7060621 - DNA, 22 bp, Homo sapiens
gagcagtgaagacagaagtaca

SEQ ID NO: 7060622 - DNA, 22 bp, Homo sapiens
gagcagtgactggagcatgaga

SEQ ID NO: 7060623 - DNA, 22 bp, Homo sapiens
ataaagcaagcataccattaag

SEQ ID NO: 7060624 - DNA, 22 bp, Homo sapiens
ataaagctaagacttacatgaa

SEQ ID NO: 7060625 - DNA, 22 bp, Homo sapiens
ctgcagggaccacaagcaggtt

SEQ ID NO: 7060626 - DNA, 22 bp, Homo sapiens
ctgcagggagaggggacagcct

SEQ ID NO: 7060627 - DNA, 22 bp, Homo sapiens
ataaacatctgtttctcttctg

SEQ ID NO: 7060628 - DNA, 22 bp, Homo sapiens
ataaaccagaagtaaaagctac

SEQ ID NO: 7060629 - DNA, 22 bp, Homo sapiens
agttcttattgaatagaaatca

SEQ ID NO: 7060630 - DNA, 22 bp, Homo sapiens
ataaaaggaaagcctgttgtga

SEQ ID NO: 7060631 - DNA, 22 bp, Homo sapiens
agttctagaagacttttccatt

SEQ ID NO: 7060632 - DNA, 22 bp, Homo sapiens
agttctcagcttagtatgctgt

SEQ ID NO: 7060633 - DNA, 22 bp, Homo sapiens
agttctgaatgaggaatctggg

SEQ ID NO: 7060634 - DNA, 22 bp, Homo sapiens
agttctggttgcccatgacatc

SEQ ID NO: 7060635 - DNA, 22 bp, Homo sapiens
ctgcctgggttcaagtcctgtt

SEQ ID NO: 7060636 - DNA, 22 bp, Homo sapiens
ctgcctggaaggagcaagggga

SEQ ID NO: 7060637 - DNA, 22 bp, Homo sapiens
ctgcctgtgatttttctctagt

SEQ ID NO: 7060638 - DNA, 22 bp, Homo sapiens
ctgcctgtgccaatgctccttt

SEQ ID NO: 7060639 - DNA, 22 bp, Homo sapiens
ctgctaaacctctctgagagct

SEQ ID NO: 7060640 - DNA, 22 bp, Homo sapiens
ctgctacaccggaatagtgaca

SEQ ID NO: 7060641 - DNA, 22 bp, Homo sapiens
ctgctcacgccaccgttcatca

SEQ ID NO: 7060642 - DNA, 19 bp, Homo sapiens
ctgctcagagcagctccag

SEQ ID NO: 7060643 - DNA, 19 bp, Homo sapiens
ctgctcagagcagctccag

SEQ ID NO: 7060644 - DNA, 22 bp, Homo sapiens
ctgctcagaggaaggaatgtct

SEQ ID NO: 7060645 - DNA, 22 bp, Homo sapiens
ctgctcagcggaaggaagagcg

SEQ ID NO: 7060646 - DNA, 22 bp, Homo sapiens
ctgctcagcggaaggaagagcg

SEQ ID NO: 7060647 - DNA, 19 bp, Homo sapiens
ctgctcaggtcagtctgtc

SEQ ID NO: 7060648 - DNA, 22 bp, Homo sapiens
ctgctgggcctggtctctgagg

SEQ ID NO: 7060649 - DNA, 22 bp, Homo sapiens
ctgctgggctcctcatgtgact

SEQ ID NO: 7060650 - DNA, 22 bp, Homo sapiens
ctgctggggaggcgcctcgacg

SEQ ID NO: 7060651 - DNA, 22 bp, Homo sapiens
ctgctgggggacacaggtccgg

SEQ ID NO: 7060652 - DNA, 22 bp, Homo sapiens
atacacatctatttaagagaca

SEQ ID NO: 7060653 - DNA, 20 bp, Homo sapiens
atacacatattcttgcaact

SEQ ID NO: 7060654 - DNA, 15 bp, Homo sapiens
atacacatgagggag

SEQ ID NO: 7060655 - DNA, 22 bp, Homo sapiens
atacacatgcacacatgtgtgt

SEQ ID NO: 7060656 - DNA, 22 bp, Homo sapiens
atacacatatcaggtgtataca

SEQ ID NO: 7060657 - DNA, 22 bp, Homo sapiens
atacacatatgtgtgtatatgt

SEQ ID NO: 7060658 - DNA, 22 bp, Homo sapiens
atacacatatgtgtgtatatgt

SEQ ID NO: 7060659 - DNA, 20 bp, Homo sapiens
atacacatattcttgcaact

SEQ ID NO: 7060660 - DNA, 22 bp, Homo sapiens
atacacaggtgctaggtcaata

SEQ ID NO: 7060661 - DNA, 21 bp, Homo sapiens
atacacatacacataaatgtg

SEQ ID NO: 7060662 - DNA, 19 bp, Homo sapiens
atacacatacgtaaactga

SEQ ID NO: 7060663 - DNA, 19 bp, Homo sapiens
atacacatacgtaaactga

SEQ ID NO: 7060664 - DNA, 22 bp, Homo sapiens
atacacatatatacacgtttaa

SEQ ID NO: 7060665 - DNA, 22 bp, Homo sapiens
ctgctgtgtcagagtccagggg

SEQ ID NO: 7060666 - DNA, 22 bp, Homo sapiens
ctgctgtggtgtcaagcatctc

SEQ ID NO: 7060667 - DNA, 22 bp, Homo sapiens
ctgctgtgtatcattttagatg

SEQ ID NO: 7060668 - DNA, 22 bp, Homo sapiens
ctgctgtgtcagagtccagggg

SEQ ID NO: 7060669 - DNA, 18 bp, Homo sapiens
ctgctgtgtcgtctgggc

SEQ ID NO: 7060670 - DNA, 22 bp, Homo sapiens
ctgctgtggatgcaggacctca

SEQ ID NO: 7060671 - DNA, 22 bp, Homo sapiens
ctgctgtggccagccaggtcaa

SEQ ID NO: 7060672 - DNA, 21 bp, Homo sapiens
ctgctgtggcccccgacatgc

SEQ ID NO: 7060673 - DNA, 22 bp, Homo sapiens
ctgctgtgggcagggtagctgg

SEQ ID NO: 7060674 - DNA, 22 bp, Homo sapiens
ctgctgtgggttaagacactgt

SEQ ID NO: 7060675 - DNA, 20 bp, Homo sapiens
ctgctgtggtcctttatttt

SEQ ID NO: 7060676 - DNA, 22 bp, Homo sapiens
ctgctggggtcagagcactggg

SEQ ID NO: 7060677 - DNA, 22 bp, Homo sapiens
ctgctgtgcagacagactctct

SEQ ID NO: 7060678 - DNA, 22 bp, Homo sapiens
ctgctgtgcaggtgcctatgat

SEQ ID NO: 7060679 - DNA, 22 bp, Homo sapiens
ctgctgtgcatatttatctagg

SEQ ID NO: 7060680 - DNA, 22 bp, Homo sapiens
ctgctgtgcctcttttcacgtg

SEQ ID NO: 7060681 - DNA, 22 bp, Homo sapiens
ctgctgtgccttaaaatgcaag

SEQ ID NO: 7060682 - DNA, 22 bp, Homo sapiens
ctgctgtgcttgtggccacccg

SEQ ID NO: 7060683 - DNA, 22 bp, Homo sapiens
atatacttggagactatcattg

SEQ ID NO: 7060684 - DNA, 22 bp, Homo sapiens
atatacttggagactatcattg

SEQ ID NO: 7060685 - DNA, 22 bp, Homo sapiens
atatacttccccattatggggg

SEQ ID NO: 7060686 - DNA, 22 bp, Homo sapiens
atatacctcattctttgagtgc

SEQ ID NO: 7060687 - DNA, 20 bp, Homo sapiens
atataccatcccacaacagg

SEQ ID NO: 7060688 - DNA, 22 bp, Homo sapiens
atatacagggagaaacagctta

SEQ ID NO: 7060689 - DNA, 22 bp, Homo sapiens
atatacaggtggtatgtgtaaa

SEQ ID NO: 7060690 - DNA, 22 bp, Homo sapiens
atatacaggtggtatgtgtaaa

SEQ ID NO: 7060691 - DNA, 22 bp, Homo sapiens
atatacaggtggtatgtgtaaa

SEQ ID NO: 7060692 - DNA, 19 bp, Homo sapiens
ctggctgcaatgccagggt

SEQ ID NO: 7060693 - DNA, 22 bp, Homo sapiens
atataatacaacctgctaagtg

SEQ ID NO: 7060694 - DNA, 22 bp, Homo sapiens
atataatagtttcataaaggct

SEQ ID NO: 7060695 - DNA, 22 bp, Homo sapiens
ctggctgaggcagagcctgggg

SEQ ID NO: 7060696 - DNA, 22 bp, Homo sapiens
ctggctgaggtcaccagtagct

SEQ ID NO: 7060697 - DNA, 22 bp, Homo sapiens
ctggctgagttactccactgag

SEQ ID NO: 7060698 - DNA, 22 bp, Homo sapiens
ctggcctcggcagcaggaacag

SEQ ID NO: 7060699 - DNA, 19 bp, Homo sapiens
ctggcctgtgtcctgtgct

SEQ ID NO: 7060700 - DNA, 22 bp, Homo sapiens
ctggcctttagccccagtgtct

SEQ ID NO: 7060701 - DNA, 23 bp, Homo sapiens
atataaacaccagatagattgta

SEQ ID NO: 7060702 - DNA, 22 bp, Homo sapiens
atataaagaagtggaaaatgag

SEQ ID NO: 7060703 - DNA, 22 bp, Homo sapiens
atataaagaagtggaaaatgag

SEQ ID NO: 7060704 - DNA, 22 bp, Homo sapiens
atataaagagcttagtatagtg

SEQ ID NO: 7060705 - DNA, 22 bp, Homo sapiens
atataaagtgtttagaaagctg

SEQ ID NO: 7060706 - DNA, 22 bp, Homo sapiens
atataaagtgtttagaaagctg

SEQ ID NO: 7060707 - DNA, 22 bp, Homo sapiens
atataaagtgtttagaaagctg

SEQ ID NO: 7060708 - DNA, 22 bp, Homo sapiens
ctggctcttgcgactcagcttg

SEQ ID NO: 7060709 - DNA, 22 bp, Homo sapiens
ctggctctttcagccgctggag

SEQ ID NO: 7060710 - DNA, 22 bp, Homo sapiens
ctggctctttcctagctaggct

SEQ ID NO: 7060711 - DNA, 22 bp, Homo sapiens
ctggctctttcctagctaggct

SEQ ID NO: 7060712 - DNA, 22 bp, Homo sapiens
ctggctgaatcctagtctcata

SEQ ID NO: 7060713 - DNA, 22 bp, Homo sapiens
ctggctgacaccttgatagcag

SEQ ID NO: 7060714 - DNA, 22 bp, Homo sapiens
ctggcagtattaagagaagtga

SEQ ID NO: 7060715 - DNA, 22 bp, Homo sapiens
ctggccactggaggtggcaccc

SEQ ID NO: 7060716 - DNA, 22 bp, Homo sapiens
ctggcaggtggaggttgcagtg

SEQ ID NO: 7060717 - DNA, 22 bp, Homo sapiens
ctggcctaaaattgcttctgca

SEQ ID NO: 7060718 - DNA, 22 bp, Homo sapiens
ctggcctcatagccaagctgtg

SEQ ID NO: 7060719 - DNA, 20 bp, Homo sapiens
atacacatgcagacagatgc

SEQ ID NO: 7060720 - DNA, 22 bp, Homo sapiens
atacacatgtgtatgtgcatgc

SEQ ID NO: 7060721 - DNA, 22 bp, Homo sapiens
atacacatgtgtatgtgcatgc

SEQ ID NO: 7060722 - DNA, 22 bp, Homo sapiens
atacacatgttattgtggaagc

SEQ ID NO: 7060723 - DNA, 22 bp, Homo sapiens
atacacattactttctgtctga

SEQ ID NO: 7060724 - DNA, 22 bp, Homo sapiens
atacatgtaactgcattgtaat

SEQ ID NO: 7060725 - DNA, 22 bp, Homo sapiens
atacatgtcatcatatgtttgt

SEQ ID NO: 7060726 - DNA, 22 bp, Homo sapiens
atacatgtgggtctaaacatat

SEQ ID NO: 7060727 - DNA, 22 bp, Homo sapiens
atacatgtgtccctgatttatt

SEQ ID NO: 7060728 - DNA, 22 bp, Homo sapiens
atacatgtgtgagcgaagatgt

SEQ ID NO: 7060729 - DNA, 22 bp, Homo sapiens
atacatgtgtgtgcatacatgt

SEQ ID NO: 7060730 - DNA, 22 bp, Homo sapiens
ctggcagcttattagaaatgca

SEQ ID NO: 7060731 - DNA, 22 bp, Homo sapiens
cttagatgaagtcacagaaccc

SEQ ID NO: 7060732 - DNA, 22 bp, Homo sapiens
cttaatctcacctgcaaagtcc

SEQ ID NO: 7060733 - DNA, 21 bp, Homo sapiens
atccatccatcttggcctaac

SEQ ID NO: 7060734 - DNA, 22 bp, Homo sapiens
ctgtttctcccaacgccctagt

SEQ ID NO: 7060735 - DNA, 22 bp, Homo sapiens
ctgtttctcccatgtccaagtg

SEQ ID NO: 7060736 - DNA, 22 bp, Homo sapiens
cttaacagagagaagtgttgct

SEQ ID NO: 7060737 - DNA, 22 bp, Homo sapiens
cttaagagtctttctgtgttta

SEQ ID NO: 7060738 - DNA, 22 bp, Homo sapiens
cttaagatgaggtcatgctata

SEQ ID NO: 7060739 - DNA, 22 bp, Homo sapiens
cttaagatttgagatacctaat

SEQ ID NO: 7060740 - DNA, 22 bp, Homo sapiens
cttaagatttgcgatacctaat

SEQ ID NO: 7060741 - DNA, 22 bp, Homo sapiens
cttaaggaaaagtctcttttaa

SEQ ID NO: 7060742 - DNA, 22 bp, Homo sapiens
cttattataaaatcctgtttga

SEQ ID NO: 7060743 - DNA, 22 bp, Homo sapiens
cttatgtataatgttccacata

SEQ ID NO: 7060744 - DNA, 22 bp, Homo sapiens
cttcctctatgttcaggtagaa

SEQ ID NO: 7060745 - DNA, 22 bp, Homo sapiens
cttcctctcaataagatgagaa

SEQ ID NO: 7060746 - DNA, 22 bp, Homo sapiens
cttcctctcttgcccataagag

SEQ ID NO: 7060747 - DNA, 22 bp, Homo sapiens
cttcaagagaatgcagggatgt

SEQ ID NO: 7060748 - DNA, 22 bp, Homo sapiens
cttcaagatatttctagaatca

SEQ ID NO: 7060749 - DNA, 22 bp, Homo sapiens
cttcttaatgacagattaaaat

SEQ ID NO: 7060750 - DNA, 22 bp, Homo sapiens
atctggttcttcttaggcatca

SEQ ID NO: 7060751 - DNA, 22 bp, Homo sapiens
cttctgttactgttagctgaag

SEQ ID NO: 7060752 - DNA, 22 bp, Homo sapiens
cttcttaaagattacacaatga

SEQ ID NO: 7060753 - DNA, 22 bp, Homo sapiens
atctgtaacatcagtagcagaa

SEQ ID NO: 7060754 - DNA, 22 bp, Homo sapiens
atctgtctatgatatagtctgt

SEQ ID NO: 7060755 - DNA, 22 bp, Homo sapiens
atctgtcttccaccacacatcc

SEQ ID NO: 7060756 - DNA, 22 bp, Homo sapiens
atctgtcttgccttgcatattt

SEQ ID NO: 7060757 - DNA, 22 bp, Homo sapiens
atctgtcttgccttgcatattt

SEQ ID NO: 7060758 - DNA, 22 bp, Homo sapiens
atctgttatttacccatctctg

SEQ ID NO: 7060759 - DNA, 23 bp, Homo sapiens
atctgttcatctgacacagattc

SEQ ID NO: 7060760 - DNA, 22 bp, Homo sapiens
atctgttcccctatgctctcta

SEQ ID NO: 7060761 - DNA, 22 bp, Homo sapiens
cttctgcccctgtagcctgagt

SEQ ID NO: 7060762 - DNA, 22 bp, Homo sapiens
cttctgtgatttggttaggata

SEQ ID NO: 7060763 - DNA, 22 bp, Homo sapiens
cttctgagatgttgttttacag

SEQ ID NO: 7060764 - DNA, 22 bp, Homo sapiens
cttctgagatgttgttttacag

SEQ ID NO: 7060765 - DNA, 22 bp, Homo sapiens
cttctgagatgttgttttacag

SEQ ID NO: 7060766 - DNA, 22 bp, Homo sapiens
cttctgagggcctttgcttcca

SEQ ID NO: 7060767 - DNA, 22 bp, Homo sapiens
cttctgagggcctttgcttcca

SEQ ID NO: 7060768 - DNA, 22 bp, Homo sapiens
cttctgattagcaagtttgtat

SEQ ID NO: 7060769 - DNA, 22 bp, Homo sapiens
cttctgcaataagttttggtcc

SEQ ID NO: 7060770 - DNA, 22 bp, Homo sapiens
cttctgcaataagttttggtcc

SEQ ID NO: 7060771 - DNA, 22 bp, Homo sapiens
cttctgcactgaccttttgtcc

SEQ ID NO: 7060772 - DNA, 22 bp, Homo sapiens
cttctgcaggccctgtctgacc

SEQ ID NO: 7060773 - DNA, 19 bp, Homo sapiens
cttctgcagggtgacagtg

SEQ ID NO: 7060774 - DNA, 22 bp, Homo sapiens
atctctccttatgaagcattat

SEQ ID NO: 7060775 - DNA, 22 bp, Homo sapiens
atctctccttcagctgaggccc

SEQ ID NO: 7060776 - DNA, 23 bp, Homo sapiens
atctctctggtggtcacagtcag

SEQ ID NO: 7060777 - DNA, 22 bp, Homo sapiens
atctctgatttacagcatctct

SEQ ID NO: 7060778 - DNA, 22 bp, Homo sapiens
cttctgagatgttgttttacag

SEQ ID NO: 7060779 - DNA, 22 bp, Homo sapiens
cttctgagatgttgttttacag

SEQ ID NO: 7060780 - DNA, 22 bp, Homo sapiens
atctccttggtctcgttccagg

SEQ ID NO: 7060781 - DNA, 20 bp, Homo sapiens
ctgggtggcaagcaaggggg

SEQ ID NO: 7060782 - DNA, 22 bp, Homo sapiens
ctgggtggatcgcagccccagg

SEQ ID NO: 7060783 - DNA, 20 bp, Homo sapiens
ctgggtggcaagcaaggggg

SEQ ID NO: 7060784 - DNA, 22 bp, Homo sapiens
ctgggtggcagagcctgcagtg

SEQ ID NO: 7060785 - DNA, 22 bp, Homo sapiens
ctgggtggcgtctggggccagt

SEQ ID NO: 7060786 - DNA, 22 bp, Homo sapiens
atattcacagtaagtgtagcag

SEQ ID NO: 7060787 - DNA, 23 bp, Homo sapiens
atattcacgccgccagaggtccc

SEQ ID NO: 7060788 - DNA, 22 bp, Homo sapiens
atattcactcctggtgagacta

SEQ ID NO: 7060789 - DNA, 22 bp, Homo sapiens
atattcactgagcataaagcca

SEQ ID NO: 7060790 - DNA, 22 bp, Homo sapiens
atattcactgagcataaagcca

SEQ ID NO: 7060791 - DNA, 18 bp, Homo sapiens
atattcaagaagacagag

SEQ ID NO: 7060792 - DNA, 22 bp, Homo sapiens
atattattttccctggagttgt

SEQ ID NO: 7060793 - DNA, 22 bp, Homo sapiens
ctgggtggctgtccagccagcc

SEQ ID NO: 7060794 - DNA, 22 bp, Homo sapiens
ctggtcatgccaggtttgctgc

SEQ ID NO: 7060795 - DNA, 17 bp, Homo sapiens
ctggtcccaccaagccc

SEQ ID NO: 7060796 - DNA, 22 bp, Homo sapiens
ctgggggcaatggtcagagtgt

SEQ ID NO: 7060797 - DNA, 22 bp, Homo sapiens
atattattctagctcttgtgtg

SEQ ID NO: 7060798 - DNA, 22 bp, Homo sapiens
atattattctagtaacagtgat

SEQ ID NO: 7060799 - DNA, 23 bp, Homo sapiens
ctggggctttcaaatctgggcag

SEQ ID NO: 7060800 - DNA, 22 bp, Homo sapiens
ctggggctgtgggagacaaggc

SEQ ID NO: 7060801 - DNA, 19 bp, Homo sapiens
ctgggaggtgttcagagaa

SEQ ID NO: 7060802 - DNA, 22 bp, Homo sapiens
ctgggagcttttagaaatgcag

SEQ ID NO: 7060803 - DNA, 22 bp, Homo sapiens
ctgggaggacaacttggagctc

SEQ ID NO: 7060804 - DNA, 22 bp, Homo sapiens
ctgggaggacaacttggagctc

SEQ ID NO: 7060805 - DNA, 22 bp, Homo sapiens
ctgggaggcggaggttgcagtg

SEQ ID NO: 7060806 - DNA, 22 bp, Homo sapiens
ctgggaggatacacaagatcag

SEQ ID NO: 7060807 - DNA, 22 bp, Homo sapiens
ctgggaggattcattgaggtga

SEQ ID NO: 7060808 - DNA, 19 bp, Homo sapiens
ctgggaggtgttcagagaa

SEQ ID NO: 7060809 - DNA, 22 bp, Homo sapiens
ctgggaggtggaggttgcattg

SEQ ID NO: 7060810 - DNA, 22 bp, Homo sapiens
ctgggaggtggaggttgcattg

SEQ ID NO: 7060811 - DNA, 22 bp, Homo sapiens
ctgggaggtgaacagaaaaact

SEQ ID NO: 7060812 - DNA, 22 bp, Homo sapiens
ctgggaggtgaacagaaaaact

SEQ ID NO: 7060813 - DNA, 22 bp, Homo sapiens
ctgggaggtgcagcaaaaatca

SEQ ID NO: 7060814 - DNA, 22 bp, Homo sapiens
ctgggaggcggaggttgtagtg

SEQ ID NO: 7060815 - DNA, 22 bp, Homo sapiens
ctgggaggcggaggttgtagtg

SEQ ID NO: 7060816 - DNA, 22 bp, Homo sapiens
ctgggaggggtagccaatccta

SEQ ID NO: 7060817 - DNA, 20 bp, Homo sapiens
ctgggaggtcttccaaatca

SEQ ID NO: 7060818 - DNA, 22 bp, Homo sapiens
ctgtaagatgggataagacttt

SEQ ID NO: 7060819 - DNA, 22 bp, Homo sapiens
ctgtaatcccagctacctggga

SEQ ID NO: 7060820 - DNA, 22 bp, Homo sapiens
ctgtaatcccagctactcggga

SEQ ID NO: 7060821 - DNA, 22 bp, Homo sapiens
atcagcaggtgctggtggagac

SEQ ID NO: 7060822 - DNA, 22 bp, Homo sapiens
atcagctgaaaaacaggcagca

SEQ ID NO: 7060823 - DNA, 22 bp, Homo sapiens
atcagctgaaaaacaggcagca

SEQ ID NO: 7060824 - DNA, 22 bp, Homo sapiens
ctgtaaatggaactatgtagta

SEQ ID NO: 7060825 - DNA, 20 bp, Homo sapiens
ctgtaaactgcgtctgtaat

SEQ ID NO: 7060826 - DNA, 22 bp, Homo sapiens
atcacaaaggtctcagagcaca

SEQ ID NO: 7060827 - DNA, 22 bp, Homo sapiens
atcataaaccactttgtaatct

SEQ ID NO: 7060828 - DNA, 22 bp, Homo sapiens
atcataaagtgctatctgattg

SEQ ID NO: 7060829 - DNA, 22 bp, Homo sapiens
atcaggtgatgctctggttccc

SEQ ID NO: 7060830 - DNA, 22 bp, Homo sapiens
ctgtctctgataagctcgaggg

SEQ ID NO: 7060831 - DNA, 22 bp, Homo sapiens
ctgtctcagcaggaagtcatca

SEQ ID NO: 7060832 - DNA, 22 bp, Homo sapiens
ctgtcgcctggtcctctctgga

SEQ ID NO: 7060833 - DNA, 19 bp, Homo sapiens
agtctttcccactcgtctt

SEQ ID NO: 7060834 - DNA, 22 bp, Homo sapiens
agtctttcctgcttgactgttc

SEQ ID NO: 7060835 - DNA, 18 bp, Homo sapiens
agtcttctgatccatttt

SEQ ID NO: 7060836 - DNA, 22 bp, Homo sapiens
ctcacagttttctgtagtccaa

SEQ ID NO: 7060837 - DNA, 22 bp, Homo sapiens
ctcacattcacaggacagaagg

SEQ ID NO: 7060838 - DNA, 22 bp, Homo sapiens
ctcacattccacttgtgccaac

SEQ ID NO: 7060839 - DNA, 22 bp, Homo sapiens
ctcaccacagagcctgtccagc

SEQ ID NO: 7060840 - DNA, 22 bp, Homo sapiens
ctcaccacagagcctgtccagc

SEQ ID NO: 7060841 - DNA, 22 bp, Homo sapiens
agtctcagaaaagaagcatgga

SEQ ID NO: 7060842 - DNA, 22 bp, Homo sapiens
agtctatttcagtcttactagt

SEQ ID NO: 7060843 - DNA, 22 bp, Homo sapiens
agtgaaatagcatttatgaagc

SEQ ID NO: 7060844 - DNA, 22 bp, Homo sapiens
agtgaaatactgtcgtttttag

SEQ ID NO: 7060845 - DNA, 22 bp, Homo sapiens
agtgaaatagcatttatgaagc

SEQ ID NO: 7060846 - DNA, 22 bp, Homo sapiens
agtgaaatcaggttttgactgc

SEQ ID NO: 7060847 - DNA, 22 bp, Homo sapiens
agtgaaaacactagttcttgcc

SEQ ID NO: 7060848 - DNA, 22 bp, Homo sapiens
agtgagggactagtgctgggga

SEQ ID NO: 7060849 - DNA, 21 bp, Homo sapiens
agtgaaattgcatcagaggga

SEQ ID NO: 7060850 - DNA, 22 bp, Homo sapiens
agtgaaattgctgtaagaggaa

SEQ ID NO: 7060851 - DNA, 22 bp, Homo sapiens
agtgacttctcctaatgtcata

SEQ ID NO: 7060852 - DNA, 22 bp, Homo sapiens
agtgaaatcctggtcaacaggt

SEQ ID NO: 7060853 - DNA, 22 bp, Homo sapiens
agtgaaatgatagtgtaaatac

SEQ ID NO: 7060854 - DNA, 22 bp, Homo sapiens
agtgaaatgattctgagcaaga

SEQ ID NO: 7060855 - DNA, 22 bp, Homo sapiens
agtgaaattcctggtctttgtt

SEQ ID NO: 7060856 - DNA, 22 bp, Homo sapiens
agtgaggggattcaggcaaggt

SEQ ID NO: 7060857 - DNA, 22 bp, Homo sapiens
agtggaaggtcaggggacagtg

SEQ ID NO: 7060858 - DNA, 22 bp, Homo sapiens
agtgctgtcagttttatagata

SEQ ID NO: 7060859 - DNA, 22 bp, Homo sapiens
agtgctttgtgctctcactgca

SEQ ID NO: 7060860 - DNA, 22 bp, Homo sapiens
agtggaccagaagactgaagct

SEQ ID NO: 7060861 - DNA, 22 bp, Homo sapiens
agtggacccggaacagaggccc

SEQ ID NO: 7060862 - DNA, 22 bp, Homo sapiens
agtggactcttcccagtgcttg

SEQ ID NO: 7060863 - DNA, 22 bp, Homo sapiens
agtggagaagaggatggtctcc

SEQ ID NO: 7060864 - DNA, 22 bp, Homo sapiens
agtggagaatatgcagaaagcc

SEQ ID NO: 7060865 - DNA, 22 bp, Homo sapiens
agtggagacaggacagtcgata

SEQ ID NO: 7060866 - DNA, 22 bp, Homo sapiens
agtggaggcactaattggattt

SEQ ID NO: 7060867 - DNA, 22 bp, Homo sapiens
agtggaggttacagctgtacat

SEQ ID NO: 7060868 - DNA, 22 bp, Homo sapiens
agtggcagaagccaagtctgca

SEQ ID NO: 7060869 - DNA, 22 bp, Homo sapiens
agtggcagggctggctgctgca

SEQ ID NO: 7060870 - DNA, 22 bp, Homo sapiens
agtggcagtggggcagggccct

SEQ ID NO: 7060871 - DNA, 22 bp, Homo sapiens
agtggcagtggggcagggccct

SEQ ID NO: 7060872 - DNA, 22 bp, Homo sapiens
agtggcagtttgggagctacag

SEQ ID NO: 7060873 - DNA, 22 bp, Homo sapiens
agtggccaatatgtcatgctct

SEQ ID NO: 7060874 - DNA, 22 bp, Homo sapiens
agtgccctggcccagctggacc

SEQ ID NO: 7060875 - DNA, 22 bp, Homo sapiens
agtgccaggagcaaggagctcc

SEQ ID NO: 7060876 - DNA, 22 bp, Homo sapiens
agtgcctggaccccatgacata

SEQ ID NO: 7060877 - DNA, 22 bp, Homo sapiens
agtgccttgtgtgtgggcagcc

SEQ ID NO: 7060878 - DNA, 22 bp, Homo sapiens
agtgctgtaacaacttatttgg

SEQ ID NO: 7060879 - DNA, 22 bp, Homo sapiens
agtgctgtcagttttatagata

SEQ ID NO: 7060880 - DNA, 22 bp, Homo sapiens
agtgatgttgactagctataag

SEQ ID NO: 7060881 - DNA, 22 bp, Homo sapiens
agtgatttactaccatattggg

SEQ ID NO: 7060882 - DNA, 22 bp, Homo sapiens
agtgcagggggaaagggtgtct

SEQ ID NO: 7060883 - DNA, 22 bp, Homo sapiens
agtgcagggggaaagggtgtct

SEQ ID NO: 7060884 - DNA, 22 bp, Homo sapiens
ctctggagttagtgatctgggc

SEQ ID NO: 7060885 - DNA, 22 bp, Homo sapiens
ctctggagtgtctggccagggt

SEQ ID NO: 7060886 - DNA, 22 bp, Homo sapiens
ctctggagttcttcaagctact

SEQ ID NO: 7060887 - DNA, 22 bp, Homo sapiens
agtgggtggcgcagaggaggaa

SEQ ID NO: 7060888 - DNA, 19 bp, Homo sapiens
agtggtagatgagcaggag

SEQ ID NO: 7060889 - DNA, 22 bp, Homo sapiens
agtggtcaaagactagatttca

SEQ ID NO: 7060890 - DNA, 22 bp, Homo sapiens
agtgggtgataagaccaaggag

SEQ ID NO: 7060891 - DNA, 22 bp, Homo sapiens
agtggctctccaagaagtcaca

SEQ ID NO: 7060892 - DNA, 22 bp, Homo sapiens
agtggccagtgctgctctgggg

SEQ ID NO: 7060893 - DNA, 22 bp, Homo sapiens
agtggctagatcatgagtgagc

SEQ ID NO: 7060894 - DNA, 22 bp, Homo sapiens
agtggctatgcatgactggaat

SEQ ID NO: 7060895 - DNA, 22 bp, Homo sapiens
agtgtacaaaatgatagataaa

SEQ ID NO: 7060896 - DNA, 22 bp, Homo sapiens
agtgtcagcctgggcaaggaac

SEQ ID NO: 7060897 - DNA, 22 bp, Homo sapiens
agtgtctgggctcccttggagc

SEQ ID NO: 7060898 - DNA, 22 bp, Homo sapiens
agtgtcctcctctgggagccag

SEQ ID NO: 7060899 - DNA, 20 bp, Homo sapiens
agtgtctgggcctcaggccc

SEQ ID NO: 7060900 - DNA, 21 bp, Homo sapiens
agtgtcatttgatcattgtta

SEQ ID NO: 7060901 - DNA, 23 bp, Homo sapiens
agtgtgacttttttgactgtcac

SEQ ID NO: 7060902 - DNA, 22 bp, Homo sapiens
agtgtgagcctacaggccaaag

SEQ ID NO: 7060903 - DNA, 22 bp, Homo sapiens
agtgtgagtaattcagggaggg

SEQ ID NO: 7060904 - DNA, 20 bp, Homo sapiens
agtgtgcatttagagtctgc

SEQ ID NO: 7060905 - DNA, 22 bp, Homo sapiens
agtgtggagccactgagtggct

SEQ ID NO: 7060906 - DNA, 22 bp, Homo sapiens
agtgtggattggctggagctat

SEQ ID NO: 7060907 - DNA, 22 bp, Homo sapiens
agtgtttgagacacatttcact

SEQ ID NO: 7060908 - DNA, 22 bp, Homo sapiens
agtgttttattagaacacagcc

SEQ ID NO: 7060909 - DNA, 22 bp, Homo sapiens
ctgagccagcgggctcactttt

SEQ ID NO: 7060910 - DNA, 22 bp, Homo sapiens
ctgagccagctggcatgtgcta

SEQ ID NO: 7060911 - DNA, 22 bp, Homo sapiens
ctgagccagctggcatgtgcta

SEQ ID NO: 7060912 - DNA, 22 bp, Homo sapiens
ctgagccagggccacacatgga

SEQ ID NO: 7060913 - DNA, 22 bp, Homo sapiens
ctgagctctaatgtcagccttg

SEQ ID NO: 7060914 - DNA, 22 bp, Homo sapiens
ctgagccagcgggctcactttt

SEQ ID NO: 7060915 - DNA, 22 bp, Homo sapiens
agttcccaggtgatgctgatgt

SEQ ID NO: 7060916 - DNA, 22 bp, Homo sapiens
agttcatggaagattcaatgga

SEQ ID NO: 7060917 - DNA, 22 bp, Homo sapiens
agttcatgtggtttaacttaat

SEQ ID NO: 7060918 - DNA, 22 bp, Homo sapiens
ctgagctgcagtcctggctctg

SEQ ID NO: 7060919 - DNA, 22 bp, Homo sapiens
ctattctagattacagtataaa

SEQ ID NO: 7060920 - DNA, 22 bp, Homo sapiens
ctatgagaagaaaacaagatta

SEQ ID NO: 7060921 - DNA, 22 bp, Homo sapiens
ctatctcttgttttcctgaagc

SEQ ID NO: 7060922 - DNA, 18 bp, Homo sapiens
ctatccctggagcttggg

SEQ ID NO: 7060923 - DNA, 22 bp, Homo sapiens
ctattgaaagtgtacaattcaa

SEQ ID NO: 7060924 - DNA, 22 bp, Homo sapiens
ctattgaatagcccaaatcatt

SEQ ID NO: 7060925 - DNA, 22 bp, Homo sapiens
ctattgaattaactattaaagt

SEQ ID NO: 7060926 - DNA, 22 bp, Homo sapiens
ctattgaattaactattaaagt

SEQ ID NO: 7060927 - DNA, 22 bp, Homo sapiens
ctatttatctatttctgaatga

SEQ ID NO: 7060928 - DNA, 22 bp, Homo sapiens
ctatatttggtgagggatgtct

SEQ ID NO: 7060929 - DNA, 22 bp, Homo sapiens
ctatcattttacatggttggtg

SEQ ID NO: 7060930 - DNA, 22 bp, Homo sapiens
ctatatttcttggctttaaaca

SEQ ID NO: 7060931 - DNA, 22 bp, Homo sapiens
agtcaggatttaaactcagaca

SEQ ID NO: 7060932 - DNA, 22 bp, Homo sapiens
ctagtgaacgtggtactatgga

SEQ ID NO: 7060933 - DNA, 22 bp, Homo sapiens
ctatatttcttggctttaaaca

SEQ ID NO: 7060934 - DNA, 22 bp, Homo sapiens
agtcagcagcctggccaggaga

SEQ ID NO: 7060935 - DNA, 22 bp, Homo sapiens
agtcagcagcctggccaggaga

SEQ ID NO: 7060936 - DNA, 22 bp, Homo sapiens
agtcagcagcctggccaggaga

SEQ ID NO: 7060937 - DNA, 22 bp, Homo sapiens
agtcagcagtgaaagcacagcc

SEQ ID NO: 7060938 - DNA, 22 bp, Homo sapiens
agtcaggagctgctgcattgta

SEQ ID NO: 7060939 - DNA, 22 bp, Homo sapiens
agtcaggatatgccttgtgggc

SEQ ID NO: 7060940 - DNA, 22 bp, Homo sapiens
agtcaattatctctaggtcatc

SEQ ID NO: 7060941 - DNA, 22 bp, Homo sapiens
agtcaattcttttcaactcaag

SEQ ID NO: 7060942 - DNA, 22 bp, Homo sapiens
agtcacagaaacccaggtgtgg

SEQ ID NO: 7060943 - DNA, 22 bp, Homo sapiens
agtcacatagaagtgggtttaa

SEQ ID NO: 7060944 - DNA, 22 bp, Homo sapiens
agtcacatagctctggtttctt

SEQ ID NO: 7060945 - DNA, 22 bp, Homo sapiens
agtcacatagtgttttggaatc

SEQ ID NO: 7060946 - DNA, 22 bp, Homo sapiens
agtcacatcgattataaaattt

SEQ ID NO: 7060947 - DNA, 23 bp, Homo sapiens
agtcacatcttagcagccaggtc

SEQ ID NO: 7060948 - DNA, 22 bp, Homo sapiens
agtcacatgagcactaattagg

SEQ ID NO: 7060949 - DNA, 22 bp, Homo sapiens
agtcacatgaggaaggggaagg

SEQ ID NO: 7060950 - DNA, 22 bp, Homo sapiens
agtcacatgagtttctctttat

SEQ ID NO: 7060951 - DNA, 22 bp, Homo sapiens
agtcacatgatccctgggcctg

SEQ ID NO: 7060952 - DNA, 20 bp, Homo sapiens
agtcacatgcatacacaagt

SEQ ID NO: 7060953 - DNA, 22 bp, Homo sapiens
agtcacatgcattttcttcaat

SEQ ID NO: 7060954 - DNA, 22 bp, Homo sapiens
agtcacatggactcaggatgac

SEQ ID NO: 7060955 - DNA, 22 bp, Homo sapiens
agtcacatggcagagagaagtt

SEQ ID NO: 7060956 - DNA, 22 bp, Homo sapiens
agtcacatgggattagaaccca

SEQ ID NO: 7060957 - DNA, 22 bp, Homo sapiens
agtcacattctggggtactggg

SEQ ID NO: 7060958 - DNA, 20 bp, Homo sapiens
agtcacattgagcttttgga

SEQ ID NO: 7060959 - DNA, 21 bp, Homo sapiens
agtcacattgggggtttaggg

SEQ ID NO: 7060960 - DNA, 22 bp, Homo sapiens
agtcacatttgggggtgtcaaa

SEQ ID NO: 7060961 - DNA, 22 bp, Homo sapiens
ctagaattgcattctatgaata

SEQ ID NO: 7060962 - DNA, 22 bp, Homo sapiens
ctagagaaaatgatagcaggaa

SEQ ID NO: 7060963 - DNA, 22 bp, Homo sapiens
ctagcttcaagtcctggctgtg

SEQ ID NO: 7060964 - DNA, 22 bp, Homo sapiens
ctagctttttatgacaatcttg

SEQ ID NO: 7060965 - DNA, 22 bp, Homo sapiens
ctaggaaagacacagagagttt

SEQ ID NO: 7060966 - DNA, 22 bp, Homo sapiens
ctaggaggcgggggctgcagta

SEQ ID NO: 7060967 - DNA, 22 bp, Homo sapiens
ctaggcactcacgtggctttag

SEQ ID NO: 7060968 - DNA, 22 bp, Homo sapiens
ctaggcacttgtaaggccgctc

SEQ ID NO: 7060969 - DNA, 22 bp, Homo sapiens
agtaggaggcgggagcatgaag

SEQ ID NO: 7060970 - DNA, 20 bp, Homo sapiens
agtagcagtgtgacattgac

SEQ ID NO: 7060971 - DNA, 22 bp, Homo sapiens
agtagaatagatggatactatt

SEQ ID NO: 7060972 - DNA, 22 bp, Homo sapiens
agtagaatcagcctcttgatgg

SEQ ID NO: 7060973 - DNA, 19 bp, Homo sapiens
agtagcagaaagtgcagtg

SEQ ID NO: 7060974 - DNA, 22 bp, Homo sapiens
agtacatacttcaaatgtactt

SEQ ID NO: 7060975 - DNA, 22 bp, Homo sapiens
agtaacagaaggcctgacttaa

SEQ ID NO: 7060976 - DNA, 22 bp, Homo sapiens
ccttctcccctctgcagggtgt

SEQ ID NO: 7060977 - DNA, 20 bp, Homo sapiens
ccttctccagcttgttcttg

SEQ ID NO: 7060978 - DNA, 22 bp, Homo sapiens
agtaaacagtttcttagaagaa

SEQ ID NO: 7060979 - DNA, 22 bp, Homo sapiens
ccttctctctgaagaccccaaa

SEQ ID NO: 7060980 - DNA, 22 bp, Homo sapiens
ccttctcctgccttgggttcat

SEQ ID NO: 7060981 - DNA, 22 bp, Homo sapiens
agtaaagcagagttgcagtaca

SEQ ID NO: 7060982 - DNA, 22 bp, Homo sapiens
agtaaagcagagttgcagtaca

SEQ ID NO: 7060983 - DNA, 22 bp, Homo sapiens
agtaaagcattgtcttcagagt

SEQ ID NO: 7060984 - DNA, 22 bp, Homo sapiens
agtaaacataatttacctgtag

SEQ ID NO: 7060985 - DNA, 22 bp, Homo sapiens
agtaaagtaccaaagtgtgagt

SEQ ID NO: 7060986 - DNA, 22 bp, Homo sapiens
agtaaagcggtgtcacagaatg

SEQ ID NO: 7060987 - DNA, 22 bp, Homo sapiens
agtaaataacagagaaaatggg

SEQ ID NO: 7060988 - DNA, 22 bp, Homo sapiens
agtaaataacagagaaaatggg

SEQ ID NO: 7060989 - DNA, 22 bp, Homo sapiens
agtaaataacagagaaaatggg

SEQ ID NO: 7060990 - DNA, 22 bp, Homo sapiens
agtaaataacagagaaaatggg

SEQ ID NO: 7060991 - DNA, 22 bp, Homo sapiens
aggtcagaaaaggagagcattg

SEQ ID NO: 7060992 - DNA, 22 bp, Homo sapiens
aggtcagaagtgccagggaatt

SEQ ID NO: 7060993 - DNA, 22 bp, Homo sapiens
aggtcagacagggtgtctttct

SEQ ID NO: 7060994 - DNA, 22 bp, Homo sapiens
aggtcacccgtttgactatcca

SEQ ID NO: 7060995 - DNA, 22 bp, Homo sapiens
aggtcagatgggagatgggatg

SEQ ID NO: 7060996 - DNA, 22 bp, Homo sapiens
aggtcagcatgagtagaaggta

SEQ ID NO: 7060997 - DNA, 22 bp, Homo sapiens
aggtcagctgctgataggcagc

SEQ ID NO: 7060998 - DNA, 22 bp, Homo sapiens
aggtcagctgtgtgtgcatgag

SEQ ID NO: 7060999 - DNA, 22 bp, Homo sapiens
aggtcaggtatcagcaggtatt

SEQ ID NO: 7061000 - DNA, 22 bp, Homo sapiens
cctgggaggctgtgggtctgct

SEQ ID NO: 7061001 - DNA, 22 bp, Homo sapiens
cctgggaggctgtttccagcct

SEQ ID NO: 7061002 - DNA, 22 bp, Homo sapiens
aggtatttatgagagcacatat

SEQ ID NO: 7061003 - DNA, 22 bp, Homo sapiens
aggtaaagacagtgaaagaggg

SEQ ID NO: 7061004 - DNA, 22 bp, Homo sapiens
aggtaactagcattagcttctg

SEQ ID NO: 7061005 - DNA, 22 bp, Homo sapiens
aggtaaggctgtaagctaagcc

SEQ ID NO: 7061006 - DNA, 22 bp, Homo sapiens
aggtaaaatagatagtatttct

SEQ ID NO: 7061007 - DNA, 22 bp, Homo sapiens
agggttctgccagtgtcttgag

SEQ ID NO: 7061008 - DNA, 22 bp, Homo sapiens
agggttgcctctgagtgctccg

SEQ ID NO: 7061009 - DNA, 22 bp, Homo sapiens
agggtgggctagactcttcccc

SEQ ID NO: 7061010 - DNA, 22 bp, Homo sapiens
cctgagtagctggaattaaagg

SEQ ID NO: 7061011 - DNA, 21 bp, Homo sapiens
cctgaggtttctggcctctgt

SEQ ID NO: 7061012 - DNA, 22 bp, Homo sapiens
cctgaggtttttggatagttgt

SEQ ID NO: 7061013 - DNA, 22 bp, Homo sapiens
cctgagtaacatggtgagaacc

SEQ ID NO: 7061014 - DNA, 22 bp, Homo sapiens
cctgagtagctggaattaaagg

SEQ ID NO: 7061015 - DNA, 22 bp, Homo sapiens
cctgaggtggctgcagcactgc

SEQ ID NO: 7061016 - DNA, 18 bp, Homo sapiens
cctgaggtgggaggaagg

SEQ ID NO: 7061017 - DNA, 19 bp, Homo sapiens
cctgaggtggggtggaagg

SEQ ID NO: 7061018 - DNA, 19 bp, Homo sapiens
cctgaggtggggtggaagg

SEQ ID NO: 7061019 - DNA, 19 bp, Homo sapiens
cctgaggtggggtggaagg

SEQ ID NO: 7061020 - DNA, 22 bp, Homo sapiens
cctgaggttatccatctacctg

SEQ ID NO: 7061021 - DNA, 22 bp, Homo sapiens
cctgaggttgaagtataaattg

SEQ ID NO: 7061022 - DNA, 22 bp, Homo sapiens
aggtggcagatgggggtgctcg

SEQ ID NO: 7061023 - DNA, 22 bp, Homo sapiens
aggtggcagagtgacaggctga

SEQ ID NO: 7061024 - DNA, 22 bp, Homo sapiens
aggtggcagatgggggtgctcg

SEQ ID NO: 7061025 - DNA, 22 bp, Homo sapiens
aggtggcagcagaatcagggag

SEQ ID NO: 7061026 - DNA, 22 bp, Homo sapiens
aggtggcagttgtggaaccatc

SEQ ID NO: 7061027 - DNA, 22 bp, Homo sapiens
cctgtttggtacaatctgccaa

SEQ ID NO: 7061028 - DNA, 22 bp, Homo sapiens
ccttcattgcatctttaagaga

SEQ ID NO: 7061029 - DNA, 22 bp, Homo sapiens
ccttccagccccatctcatcgt

SEQ ID NO: 7061030 - DNA, 22 bp, Homo sapiens
ccttccaggagtctctgcaggt

SEQ ID NO: 7061031 - DNA, 22 bp, Homo sapiens
ccttccagaggcgtgacaccct

SEQ ID NO: 7061032 - DNA, 22 bp, Homo sapiens
ccttccagagttcagtctgccc

SEQ ID NO: 7061033 - DNA, 22 bp, Homo sapiens
cctgtgggaggttctgtgagtc

SEQ ID NO: 7061034 - DNA, 22 bp, Homo sapiens
cctgtgggtcacatgggtgact

SEQ ID NO: 7061035 - DNA, 22 bp, Homo sapiens
cctgtgggcttgagtgtagggt

SEQ ID NO: 7061036 - DNA, 22 bp, Homo sapiens
aggtggcagagctggcccagcg

SEQ ID NO: 7061037 - DNA, 22 bp, Homo sapiens
aggtggcagaggactcctcctg

SEQ ID NO: 7061038 - DNA, 22 bp, Homo sapiens
aggtggcagagtgacaggctga

SEQ ID NO: 7061039 - DNA, 22 bp, Homo sapiens
aggtggcagactaacagaagga

SEQ ID NO: 7061040 - DNA, 22 bp, Homo sapiens
aggtgcaggagctgtgcaggga

SEQ ID NO: 7061041 - DNA, 22 bp, Homo sapiens
cctgtgggagcccaggcagata

SEQ ID NO: 7061042 - DNA, 22 bp, Homo sapiens
aggtgcagcatgagtccaacgg

SEQ ID NO: 7061043 - DNA, 22 bp, Homo sapiens
aggtgcagctgacaccatgtgg

SEQ ID NO: 7061044 - DNA, 22 bp, Homo sapiens
aggtgcagctggtggagtctgg

SEQ ID NO: 7061045 - DNA, 22 bp, Homo sapiens
cctgggtagactttgaagcatt

SEQ ID NO: 7061046 - DNA, 22 bp, Homo sapiens
cctgggtccaccctgtgaagta

SEQ ID NO: 7061047 - DNA, 17 bp, Homo sapiens
aggtgcagaggcagagc

SEQ ID NO: 7061048 - DNA, 17 bp, Homo sapiens
aggtgcagaggcagagc

SEQ ID NO: 7061049 - DNA, 22 bp, Homo sapiens
aggtcctggtgaccatggagtt

SEQ ID NO: 7061050 - DNA, 22 bp, Homo sapiens
cctgggctttgagggcaggatg

SEQ ID NO: 7061051 - DNA, 20 bp, Homo sapiens
cctggggtacactggcatgt

SEQ ID NO: 7061052 - DNA, 22 bp, Homo sapiens
agctcttttgctctccaagttt

SEQ ID NO: 7061053 - DNA, 22 bp, Homo sapiens
agctgaagaaatgggaagcatt

SEQ ID NO: 7061054 - DNA, 22 bp, Homo sapiens
caggaagaaagaggtgaggtgt

SEQ ID NO: 7061055 - DNA, 22 bp, Homo sapiens
caggaagaagggtggtgagtcc

SEQ ID NO: 7061056 - DNA, 22 bp, Homo sapiens
caggaagaagggtggtgagtcc

SEQ ID NO: 7061057 - DNA, 22 bp, Homo sapiens
caggaagaccagggctgtggct

SEQ ID NO: 7061058 - DNA, 22 bp, Homo sapiens
agctgcccctcattttcaccac

SEQ ID NO: 7061059 - DNA, 20 bp, Homo sapiens
agctgcccctgggcactgcc

SEQ ID NO: 7061060 - DNA, 18 bp, Homo sapiens
agctgccctgggctggag

SEQ ID NO: 7061061 - DNA, 22 bp, Homo sapiens
agctgccctgggctggagatgg

SEQ ID NO: 7061062 - DNA, 21 bp, Homo sapiens
agctgcctccacttctgaggc

SEQ ID NO: 7061063 - DNA, 22 bp, Homo sapiens
agctgccctgtggggagggttg

SEQ ID NO: 7061064 - DNA, 22 bp, Homo sapiens
agctgcccttaataggcattca

SEQ ID NO: 7061065 - DNA, 22 bp, Homo sapiens
agctgccctttatgatgctgaa

SEQ ID NO: 7061066 - DNA, 20 bp, Homo sapiens
agctgcccttttcacatgtt

SEQ ID NO: 7061067 - DNA, 22 bp, Homo sapiens
agctgctttgccaatgcgttcc

SEQ ID NO: 7061068 - DNA, 18 bp, Homo sapiens
agctgcttttggcttaaa

SEQ ID NO: 7061069 - DNA, 22 bp, Homo sapiens
agctggaagctgatgagcacag

SEQ ID NO: 7061070 - DNA, 22 bp, Homo sapiens
agctgggcctgatttgcagggg

SEQ ID NO: 7061071 - DNA, 22 bp, Homo sapiens
agctgggcgcagtggctggtga

SEQ ID NO: 7061072 - DNA, 21 bp, Homo sapiens
agctgggcctcagcctgcagt

SEQ ID NO: 7061073 - DNA, 22 bp, Homo sapiens
agctgggcagactgcagtggtt

SEQ ID NO: 7061074 - DNA, 22 bp, Homo sapiens
agctggagccagtgtgaggctt

SEQ ID NO: 7061075 - DNA, 22 bp, Homo sapiens
agctggagcttcaagcaggtaa

SEQ ID NO: 7061076 - DNA, 19 bp, Homo sapiens
agctggagattggagggca

SEQ ID NO: 7061077 - DNA, 22 bp, Homo sapiens
agctggagaaacctgggagggt

SEQ ID NO: 7061078 - DNA, 20 bp, Homo sapiens
agctggagaagggcccttcc

SEQ ID NO: 7061079 - DNA, 22 bp, Homo sapiens
agctggagatcatgctgatact

SEQ ID NO: 7061080 - DNA, 22 bp, Homo sapiens
agctggagatgcccagcaccgg

SEQ ID NO: 7061081 - DNA, 22 bp, Homo sapiens
agctggtgctcaggggcatgga

SEQ ID NO: 7061082 - DNA, 22 bp, Homo sapiens
agctggtgagggttgaggggta

SEQ ID NO: 7061083 - DNA, 22 bp, Homo sapiens
agctggtgatgtggtccctcac

SEQ ID NO: 7061084 - DNA, 22 bp, Homo sapiens
agctggtctgctgcatggagtg

SEQ ID NO: 7061085 - DNA, 18 bp, Homo sapiens
agctggtgaaatccagta

SEQ ID NO: 7061086 - DNA, 22 bp, Homo sapiens
agctggtgaacctgaggcacag

SEQ ID NO: 7061087 - DNA, 22 bp, Homo sapiens
agctggtatgaacaggatagga

SEQ ID NO: 7061088 - DNA, 22 bp, Homo sapiens
agctggtatttgttagggagtt

SEQ ID NO: 7061089 - DNA, 22 bp, Homo sapiens
agctggtcagagtggggataga

SEQ ID NO: 7061090 - DNA, 20 bp, Homo sapiens
agctggtccccaagcctctc

SEQ ID NO: 7061091 - DNA, 22 bp, Homo sapiens
agctgggtggtgctgagccttg

SEQ ID NO: 7061092 - DNA, 22 bp, Homo sapiens
caggcagagtgagaagcccttg

SEQ ID NO: 7061093 - DNA, 19 bp, Homo sapiens
agctggggcggtgtgtgtt

SEQ ID NO: 7061094 - DNA, 20 bp, Homo sapiens
caggcagaggatgctgacca

SEQ ID NO: 7061095 - DNA, 20 bp, Homo sapiens
caggcagaggatgctgacca

SEQ ID NO: 7061096 - DNA, 20 bp, Homo sapiens
caggcagaggatgctgacca

SEQ ID NO: 7061097 - DNA, 22 bp, Homo sapiens
caggcagaggcttttcatggct

SEQ ID NO: 7061098 - DNA, 22 bp, Homo sapiens
caggcagagtcagattagactt

SEQ ID NO: 7061099 - DNA, 22 bp, Homo sapiens
caggcagagtcagattagactt

SEQ ID NO: 7061100 - DNA, 22 bp, Homo sapiens
aggaaacaacttggcatgagcc

SEQ ID NO: 7061101 - DNA, 22 bp, Homo sapiens
aggaaacagagtgaagcttggg

SEQ ID NO: 7061102 - DNA, 22 bp, Homo sapiens
aggaaaatcgagtctggaggca

SEQ ID NO: 7061103 - DNA, 20 bp, Homo sapiens
aggaaaagggtggtggtaga

SEQ ID NO: 7061104 - DNA, 22 bp, Homo sapiens
cagggagaaatctccaggaggt

SEQ ID NO: 7061105 - DNA, 22 bp, Homo sapiens
agctttgggggtaggtatagag

SEQ ID NO: 7061106 - DNA, 22 bp, Homo sapiens
cagggacccgcacaggtagcat

SEQ ID NO: 7061107 - DNA, 22 bp, Homo sapiens
agctttctcttctttagaaagt

SEQ ID NO: 7061108 - DNA, 22 bp, Homo sapiens
cagggacagggatcatttgctt

SEQ ID NO: 7061109 - DNA, 22 bp, Homo sapiens
cagggacaggggagaaaagatg

SEQ ID NO: 7061110 - DNA, 22 bp, Homo sapiens
cagggacataagaggaacatgg

SEQ ID NO: 7061111 - DNA, 22 bp, Homo sapiens
agcttctgttcatcttccaggc

SEQ ID NO: 7061112 - DNA, 20 bp, Homo sapiens
agcttctgctgcctttcggc

SEQ ID NO: 7061113 - DNA, 22 bp, Homo sapiens
agcttctggaaggcaaggcttg

SEQ ID NO: 7061114 - DNA, 22 bp, Homo sapiens
agcttctccctttcctattggt

SEQ ID NO: 7061115 - DNA, 22 bp, Homo sapiens
agcttctgcatcttttcttccc

SEQ ID NO: 7061116 - DNA, 22 bp, Homo sapiens
agcttctgcccgtgtttgctct

SEQ ID NO: 7061117 - DNA, 17 bp, Homo sapiens
agcttctgccctttctt

SEQ ID NO: 7061118 - DNA, 22 bp, Homo sapiens
agctttatatttaatgaattct

SEQ ID NO: 7061119 - DNA, 22 bp, Homo sapiens
caggctgtgaaactgagatgcg

SEQ ID NO: 7061120 - DNA, 22 bp, Homo sapiens
caggctggagttcagtggtgtg

SEQ ID NO: 7061121 - DNA, 22 bp, Homo sapiens
caggctggagttcagtggtgtg

SEQ ID NO: 7061122 - DNA, 22 bp, Homo sapiens
caggctggagttacctttaggg

SEQ ID NO: 7061123 - DNA, 22 bp, Homo sapiens
agctggtgctcggggagctggc

SEQ ID NO: 7061124 - DNA, 22 bp, Homo sapiens
agctggtgctcggggagctggc

SEQ ID NO: 7061125 - DNA, 22 bp, Homo sapiens
agctggtgctgaagctcttgag

SEQ ID NO: 7061126 - DNA, 22 bp, Homo sapiens
caggcttcagggaacgcagtct

SEQ ID NO: 7061127 - DNA, 22 bp, Homo sapiens
caggcttcatgaattatgcacc

SEQ ID NO: 7061128 - DNA, 22 bp, Homo sapiens
caggcttgagggcaggcccagt

SEQ ID NO: 7061129 - DNA, 22 bp, Homo sapiens
caggcttgctgctagagcactt

SEQ ID NO: 7061130 - DNA, 22 bp, Homo sapiens
cagggtgcttccgtggagctgt

SEQ ID NO: 7061131 - DNA, 22 bp, Homo sapiens
cagggtggtaccagcatctagt

SEQ ID NO: 7061132 - DNA, 22 bp, Homo sapiens
aggaaacattgatattgggaaa

SEQ ID NO: 7061133 - DNA, 17 bp, Homo sapiens
aggaaacattttctttc

SEQ ID NO: 7061134 - DNA, 22 bp, Homo sapiens
cagggttggggtagataagaaa

SEQ ID NO: 7061135 - DNA, 22 bp, Homo sapiens
cagggtttcaccatgttagcag

SEQ ID NO: 7061136 - DNA, 22 bp, Homo sapiens
aggaagaggtagctgtcaaggg

SEQ ID NO: 7061137 - DNA, 22 bp, Homo sapiens
aggaagagtgttacctatgggt

SEQ ID NO: 7061138 - DNA, 22 bp, Homo sapiens
aggaagcaaaaggcagggtcta

SEQ ID NO: 7061139 - DNA, 22 bp, Homo sapiens
aggaagggtgtcatgagccctt

SEQ ID NO: 7061140 - DNA, 22 bp, Homo sapiens
aggaagggttctttgtgaaaga

SEQ ID NO: 7061141 - DNA, 22 bp, Homo sapiens
aggaagggttctttgtgaaaga

SEQ ID NO: 7061142 - DNA, 22 bp, Homo sapiens
aggaagggttctttgtgaaaga

SEQ ID NO: 7061143 - DNA, 22 bp, Homo sapiens
aggaagtgaaagggaaggagtt

SEQ ID NO: 7061144 - DNA, 22 bp, Homo sapiens
aggaatgacagatgtccgcacc

SEQ ID NO: 7061145 - DNA, 22 bp, Homo sapiens
aggagccacctaggagctgttt

SEQ ID NO: 7061146 - DNA, 22 bp, Homo sapiens
cagtgcttttttaccttccaac

SEQ ID NO: 7061147 - DNA, 22 bp, Homo sapiens
cagtggaaactatgctgctgga

SEQ ID NO: 7061148 - DNA, 22 bp, Homo sapiens
cagtggaaactatgctgctgga

SEQ ID NO: 7061149 - DNA, 22 bp, Homo sapiens
cagtggaaatcagagtgagagt

SEQ ID NO: 7061150 - DNA, 22 bp, Homo sapiens
aggagccaaattactagctctg

SEQ ID NO: 7061151 - DNA, 22 bp, Homo sapiens
aggagcagcttctgaaccatgt

SEQ ID NO: 7061152 - DNA, 22 bp, Homo sapiens
aggagatggagctcagtgggca

SEQ ID NO: 7061153 - DNA, 22 bp, Homo sapiens
aggagcagcccactcctgtcct

SEQ ID NO: 7061154 - DNA, 22 bp, Homo sapiens
cagtggaagactcagctctccc

SEQ ID NO: 7061155 - DNA, 22 bp, Homo sapiens
cagtggaagctggctgtgaaga

SEQ ID NO: 7061156 - DNA, 22 bp, Homo sapiens
cagtggaatatataggggattt

SEQ ID NO: 7061157 - DNA, 23 bp, Homo sapiens
cagtggagactcatgcttcctta

SEQ ID NO: 7061158 - DNA, 22 bp, Homo sapiens
cagtggagagacttttactctt

SEQ ID NO: 7061159 - DNA, 22 bp, Homo sapiens
aggagctggcctagaaaggaga

SEQ ID NO: 7061160 - DNA, 22 bp, Homo sapiens
aggagctgggagaaggactaaa

SEQ ID NO: 7061161 - DNA, 22 bp, Homo sapiens
aggagctgggcccaaggatgct

SEQ ID NO: 7061162 - DNA, 22 bp, Homo sapiens
aggagctgggctgctgctggga

SEQ ID NO: 7061163 - DNA, 22 bp, Homo sapiens
aggagctgggctgctgctggga

SEQ ID NO: 7061164 - DNA, 22 bp, Homo sapiens
aggaattactcatctgtggtat

SEQ ID NO: 7061165 - DNA, 22 bp, Homo sapiens
aggaattgagatcctaggtttt

SEQ ID NO: 7061166 - DNA, 22 bp, Homo sapiens
aggacaagacaaggaccagaga

SEQ ID NO: 7061167 - DNA, 22 bp, Homo sapiens
cagtctgaacactgggctactc

SEQ ID NO: 7061168 - DNA, 22 bp, Homo sapiens
cagtgaggagtccagggcagag

SEQ ID NO: 7061169 - DNA, 22 bp, Homo sapiens
cagtgaggctctgctgagcggt

SEQ ID NO: 7061170 - DNA, 22 bp, Homo sapiens
cagtgaggctctgctgagcggt

SEQ ID NO: 7061171 - DNA, 22 bp, Homo sapiens
cagtgagggcattcagtgctgg

SEQ ID NO: 7061172 - DNA, 22 bp, Homo sapiens
cagtgagggcattcagtgctgg

SEQ ID NO: 7061173 - DNA, 22 bp, Homo sapiens
cagtgcagccaaggacaggcac

SEQ ID NO: 7061174 - DNA, 22 bp, Homo sapiens
cagtgcaggctgggggccctgc

SEQ ID NO: 7061175 - DNA, 23 bp, Homo sapiens
cagtgcagggcaactcagactcc

SEQ ID NO: 7061176 - DNA, 22 bp, Homo sapiens
aggaggctggttcaggccatat

SEQ ID NO: 7061177 - DNA, 22 bp, Homo sapiens
aggaggctgggcacagtggcct

SEQ ID NO: 7061178 - DNA, 22 bp, Homo sapiens
catcagaggtacttaatgaatg

SEQ ID NO: 7061179 - DNA, 23 bp, Homo sapiens
catcagaggttgccactccctgg

SEQ ID NO: 7061180 - DNA, 22 bp, Homo sapiens
catcagagtcagagctctttct

SEQ ID NO: 7061181 - DNA, 22 bp, Homo sapiens
aggaggctgcaaccctgaggcc

SEQ ID NO: 7061182 - DNA, 22 bp, Homo sapiens
catattttagttgctgaacagc

SEQ ID NO: 7061183 - DNA, 22 bp, Homo sapiens
cagttctctttccactggaggc

SEQ ID NO: 7061184 - DNA, 22 bp, Homo sapiens
catcacccggaactgtgtctgc

SEQ ID NO: 7061185 - DNA, 22 bp, Homo sapiens
cagttccctaatgtgtagaaga

SEQ ID NO: 7061186 - DNA, 22 bp, Homo sapiens
cagttctctgtgcctcgctggg

SEQ ID NO: 7061187 - DNA, 22 bp, Homo sapiens
cagttataggagccattgtata

SEQ ID NO: 7061188 - DNA, 22 bp, Homo sapiens
catcatttgtttgcatgcagga

SEQ ID NO: 7061189 - DNA, 20 bp, Homo sapiens
catcattttaaaatctctcc

SEQ ID NO: 7061190 - DNA, 22 bp, Homo sapiens
catcatttcacttagatgaagt

SEQ ID NO: 7061191 - DNA, 22 bp, Homo sapiens
catcatttgttcacttgattcc

SEQ ID NO: 7061192 - DNA, 22 bp, Homo sapiens
catcatttaattataggggctg

SEQ ID NO: 7061193 - DNA, 22 bp, Homo sapiens
catcatttcacttagatgaagt

SEQ ID NO: 7061194 - DNA, 22 bp, Homo sapiens
aggagtgtgaagagcctagatc

SEQ ID NO: 7061195 - DNA, 22 bp, Homo sapiens
catcattttattaaccaagaaa

SEQ ID NO: 7061196 - DNA, 22 bp, Homo sapiens
catcattttattaaccaagaaa

SEQ ID NO: 7061197 - DNA, 22 bp, Homo sapiens
catcattttgtatccaagggga

SEQ ID NO: 7061198 - DNA, 22 bp, Homo sapiens
catcatttttgtaagctggtag

SEQ ID NO: 7061199 - DNA, 22 bp, Homo sapiens
aggaggtgttgatagaaggttt

SEQ ID NO: 7061200 - DNA, 22 bp, Homo sapiens
aggagtgggggcgagaagttaa

SEQ ID NO: 7061201 - DNA, 22 bp, Homo sapiens
aggaggctggttcaggccatat

SEQ ID NO: 7061202 - DNA, 22 bp, Homo sapiens
aggaggggcatagaaatgtaat

SEQ ID NO: 7061203 - DNA, 22 bp, Homo sapiens
aggagggtggggtctgcctgtc

SEQ ID NO: 7061204 - DNA, 22 bp, Homo sapiens
aggagggtggggtctgcctgtc

SEQ ID NO: 7061205 - DNA, 22 bp, Homo sapiens
aggagggtggggtctgcctgtc

SEQ ID NO: 7061206 - DNA, 22 bp, Homo sapiens
aggagggtttcaatgggatgag

SEQ ID NO: 7061207 - DNA, 22 bp, Homo sapiens
aggaggtgacagcctgcatctg

SEQ ID NO: 7061208 - DNA, 22 bp, Homo sapiens
aggaggtgacagcctgcatctg

SEQ ID NO: 7061209 - DNA, 22 bp, Homo sapiens
aggaggtgacagcctgcatctg

SEQ ID NO: 7061210 - DNA, 22 bp, Homo sapiens
aggaggtgagcggtcatgtggt

SEQ ID NO: 7061211 - DNA, 22 bp, Homo sapiens
aggaggtgagcggtcatgtggt

SEQ ID NO: 7061212 - DNA, 22 bp, Homo sapiens
aggaggtgagcggtcatgtggt

SEQ ID NO: 7061213 - DNA, 22 bp, Homo sapiens
aggaggtgagcggtcatgtggt

SEQ ID NO: 7061214 - DNA, 22 bp, Homo sapiens
aggcagagagcagtggccgtct

SEQ ID NO: 7061215 - DNA, 22 bp, Homo sapiens
aggcagagagcagtggccgtct

SEQ ID NO: 7061216 - DNA, 16 bp, Homo sapiens
aggcagagatttaccc

SEQ ID NO: 7061217 - DNA, 22 bp, Homo sapiens
aggcactgattctgttttccat

SEQ ID NO: 7061218 - DNA, 22 bp, Homo sapiens
aggcactgcagattacaggcgc

SEQ ID NO: 7061219 - DNA, 22 bp, Homo sapiens
aggcagagagcagtggccgtct

SEQ ID NO: 7061220 - DNA, 22 bp, Homo sapiens
aggcactgactcaagggagcca

SEQ ID NO: 7061221 - DNA, 22 bp, Homo sapiens
aggcactgagaggctgtgttgc

SEQ ID NO: 7061222 - DNA, 22 bp, Homo sapiens
aggcactgattctcagagttac

SEQ ID NO: 7061223 - DNA, 22 bp, Homo sapiens
aggcactgacaattctggactg

SEQ ID NO: 7061224 - DNA, 22 bp, Homo sapiens
aggcactgacagattctgtgtc

SEQ ID NO: 7061225 - DNA, 22 bp, Homo sapiens
aggcactgacctgcttccttga

SEQ ID NO: 7061226 - DNA, 19 bp, Homo sapiens
aggcacaggttgtctggac

SEQ ID NO: 7061227 - DNA, 22 bp, Homo sapiens
aggcactgaaaggtggccagag

SEQ ID NO: 7061228 - DNA, 22 bp, Homo sapiens
aggcactgaagaactctttttg

SEQ ID NO: 7061229 - DNA, 22 bp, Homo sapiens
aggcactgaaggaagcttgcgc

SEQ ID NO: 7061230 - DNA, 22 bp, Homo sapiens
aggcactgaagtggtaaatgta

SEQ ID NO: 7061231 - DNA, 22 bp, Homo sapiens
aggcactgaatatccagtaaaa

SEQ ID NO: 7061232 - DNA, 23 bp, Homo sapiens
aggcactgaatgtgtcagtgagt

SEQ ID NO: 7061233 - DNA, 22 bp, Homo sapiens
aggagttatggcagaatcaaat

SEQ ID NO: 7061234 - DNA, 22 bp, Homo sapiens
aggagtttatccgagggcataa

SEQ ID NO: 7061235 - DNA, 22 bp, Homo sapiens
aggataaaggtcattattccca

SEQ ID NO: 7061236 - DNA, 22 bp, Homo sapiens
aggataaattctccaaagtgtg

SEQ ID NO: 7061237 - DNA, 22 bp, Homo sapiens
aggatcatataagctccagcta

SEQ ID NO: 7061238 - DNA, 22 bp, Homo sapiens
aggatcatgtggtcattcctga

SEQ ID NO: 7061239 - DNA, 22 bp, Homo sapiens
aggatcctccttagaaaagacc

SEQ ID NO: 7061240 - DNA, 22 bp, Homo sapiens
aggatgactggaacccaagtga

SEQ ID NO: 7061241 - DNA, 22 bp, Homo sapiens
aggatgagaagattggaatctt

SEQ ID NO: 7061242 - DNA, 22 bp, Homo sapiens
aggcacaggtggacttcacagt

SEQ ID NO: 7061243 - DNA, 21 bp, Homo sapiens
aggcaggattcaaacacagag

SEQ ID NO: 7061244 - DNA, 21 bp, Homo sapiens
aggcaggattcaaacacagag

SEQ ID NO: 7061245 - DNA, 23 bp, Homo sapiens
aggcaggcagttcagctgttgtt

SEQ ID NO: 7061246 - DNA, 22 bp, Homo sapiens
ccaaaatgtttgaatgcatgtg

SEQ ID NO: 7061247 - DNA, 22 bp, Homo sapiens
aggcaggctgctatggagtaga

SEQ ID NO: 7061248 - DNA, 22 bp, Homo sapiens
aggcaggctgctatggagtaga

SEQ ID NO: 7061249 - DNA, 22 bp, Homo sapiens
aggcaggctctgggtatgtgca

SEQ ID NO: 7061250 - DNA, 22 bp, Homo sapiens
aggcaggctagtcgcttgagcc

SEQ ID NO: 7061251 - DNA, 18 bp, Homo sapiens
aggcaggcggatcacaag

SEQ ID NO: 7061252 - DNA, 19 bp, Homo sapiens
aggcagaggcttggctagc

SEQ ID NO: 7061253 - DNA, 22 bp, Homo sapiens
aggcagcgtagcaaggctagta

SEQ ID NO: 7061254 - DNA, 22 bp, Homo sapiens
aggcagcgtagcaaggctagta

SEQ ID NO: 7061255 - DNA, 21 bp, Homo sapiens
aggcagcgtgagggccactca

SEQ ID NO: 7061256 - DNA, 22 bp, Homo sapiens
aggcagctggcagcacccaggg

SEQ ID NO: 7061257 - DNA, 20 bp, Homo sapiens
aggcagctggccaggcaggt

SEQ ID NO: 7061258 - DNA, 23 bp, Homo sapiens
aggcagagccaaggtcaaaaccc

SEQ ID NO: 7061259 - DNA, 20 bp, Homo sapiens
aggcagagcgcacttttaga

SEQ ID NO: 7061260 - DNA, 20 bp, Homo sapiens
aggcagagcgcacttttaga

SEQ ID NO: 7061261 - DNA, 22 bp, Homo sapiens
aggcagagctaggaagaattgt

SEQ ID NO: 7061262 - DNA, 22 bp, Homo sapiens
aggcagagctaggaagaattgt

SEQ ID NO: 7061263 - DNA, 22 bp, Homo sapiens
aggcagagctaggaagaattgt

SEQ ID NO: 7061264 - DNA, 22 bp, Homo sapiens
aggcagagctgatgttctgtga

SEQ ID NO: 7061265 - DNA, 22 bp, Homo sapiens
aggcagagctgatgttctgtga

SEQ ID NO: 7061266 - DNA, 22 bp, Homo sapiens
aggcagagctgggttttgaaat

SEQ ID NO: 7061267 - DNA, 22 bp, Homo sapiens
aggcagagctgggttttgaaat

SEQ ID NO: 7061268 - DNA, 22 bp, Homo sapiens
aggcagaggaagggtggatttg

SEQ ID NO: 7061269 - DNA, 22 bp, Homo sapiens
aggcagaggaagggtggatttg

SEQ ID NO: 7061270 - DNA, 22 bp, Homo sapiens
aggcagaggagaatgatcttcc

SEQ ID NO: 7061271 - DNA, 22 bp, Homo sapiens
aggcagaggagaatgatcttcc

SEQ ID NO: 7061272 - DNA, 19 bp, Homo sapiens
aggcagaggcttggctagc

SEQ ID NO: 7061273 - DNA, 22 bp, Homo sapiens
ccagagctaaacacacaggctg

SEQ ID NO: 7061274 - DNA, 22 bp, Homo sapiens
ccagagctccagggctacagaa

SEQ ID NO: 7061275 - DNA, 22 bp, Homo sapiens
ccagagctccagggctacagaa

SEQ ID NO: 7061276 - DNA, 22 bp, Homo sapiens
ccagagctgaggagatgggctt

SEQ ID NO: 7061277 - DNA, 22 bp, Homo sapiens
aggccaggtggtcatgcttgct

SEQ ID NO: 7061278 - DNA, 22 bp, Homo sapiens
aggccaggttcctcaatcttga

SEQ ID NO: 7061279 - DNA, 22 bp, Homo sapiens
aggccaggttcctcaatcttga

SEQ ID NO: 7061280 - DNA, 22 bp, Homo sapiens
ccactgggggctgctcccaggt

SEQ ID NO: 7061281 - DNA, 18 bp, Homo sapiens
aggcaggctggagtgact

SEQ ID NO: 7061282 - DNA, 22 bp, Homo sapiens
aggcaggctgctatggagtaga

SEQ ID NO: 7061283 - DNA, 22 bp, Homo sapiens
ccagaaagactttttaggtacg

SEQ ID NO: 7061284 - DNA, 22 bp, Homo sapiens
ccagaaagataggaaatcaagt

SEQ ID NO: 7061285 - DNA, 22 bp, Homo sapiens
ccagaaagttcagctgtgaatg

SEQ ID NO: 7061286 - DNA, 22 bp, Homo sapiens
ccagactggggctccttgaggg

SEQ ID NO: 7061287 - DNA, 22 bp, Homo sapiens
aggccacagtactttgcagacc

SEQ ID NO: 7061288 - DNA, 22 bp, Homo sapiens
aggcctctgggtctcctctgac

SEQ ID NO: 7061289 - DNA, 22 bp, Homo sapiens
ccagctgacgatgcctggtctc

SEQ ID NO: 7061290 - DNA, 22 bp, Homo sapiens
ccagctgagaagtgtaaagtga

SEQ ID NO: 7061291 - DNA, 22 bp, Homo sapiens
ccagctggagctcgcagatagg

SEQ ID NO: 7061292 - DNA, 21 bp, Homo sapiens
ccagctctgcctccagttggt

SEQ ID NO: 7061293 - DNA, 22 bp, Homo sapiens
ccagcaggagatgcctgtgtct

SEQ ID NO: 7061294 - DNA, 22 bp, Homo sapiens
ccagctctggcttcttgctggg

SEQ ID NO: 7061295 - DNA, 22 bp, Homo sapiens
ccagctctgcttgcccagtcag

SEQ ID NO: 7061296 - DNA, 18 bp, Homo sapiens
aggcctgggaagctgagg

SEQ ID NO: 7061297 - DNA, 18 bp, Homo sapiens
aggcctgggaagctgagg

SEQ ID NO: 7061298 - DNA, 22 bp, Homo sapiens
aggcctggcctgggcggcattg

SEQ ID NO: 7061299 - DNA, 22 bp, Homo sapiens
aggcctggcctttatgttcaag

SEQ ID NO: 7061300 - DNA, 22 bp, Homo sapiens
aggcctgtcccagctgaggacg

SEQ ID NO: 7061301 - DNA, 22 bp, Homo sapiens
aggcgctgcatgtgaaggagtt

SEQ ID NO: 7061302 - DNA, 22 bp, Homo sapiens
aggcgctgcgctggggccagaa

SEQ ID NO: 7061303 - DNA, 22 bp, Homo sapiens
aggcgctgcgctggggccagaa

SEQ ID NO: 7061304 - DNA, 22 bp, Homo sapiens
aggcgctgtgcttggggctgga

SEQ ID NO: 7061305 - DNA, 22 bp, Homo sapiens
aggcggcttctgaggaggctgc

SEQ ID NO: 7061306 - DNA, 22 bp, Homo sapiens
aggcggtgctgtggacagtgac

SEQ ID NO: 7061307 - DNA, 22 bp, Homo sapiens
aggcggtggccaaggagcggga

SEQ ID NO: 7061308 - DNA, 22 bp, Homo sapiens
aggcgtgggaggatctgaggcc

SEQ ID NO: 7061309 - DNA, 22 bp, Homo sapiens
aggcgtgggaggatctgaggcc

SEQ ID NO: 7061310 - DNA, 22 bp, Homo sapiens
aggctgaggatcgtactttcca

SEQ ID NO: 7061311 - DNA, 22 bp, Homo sapiens
aggctgaggatccctgtgttct

SEQ ID NO: 7061312 - DNA, 22 bp, Homo sapiens
aggctgaggatcgtactttcca

SEQ ID NO: 7061313 - DNA, 22 bp, Homo sapiens
aggctgaggatcgtactttcca

SEQ ID NO: 7061314 - DNA, 22 bp, Homo sapiens
aggctgagctgacctggtttgg

SEQ ID NO: 7061315 - DNA, 22 bp, Homo sapiens
ccagggctggtgggagatgctg

SEQ ID NO: 7061316 - DNA, 22 bp, Homo sapiens
aggctgagctgacctggtttgg

SEQ ID NO: 7061317 - DNA, 22 bp, Homo sapiens
ccagggctggtgggagatgctg

SEQ ID NO: 7061318 - DNA, 22 bp, Homo sapiens
ccagggctggtgggagatgctg

SEQ ID NO: 7061319 - DNA, 22 bp, Homo sapiens
ccagggctggtggctgcagagg

SEQ ID NO: 7061320 - DNA, 22 bp, Homo sapiens
ccagggctggtggctgcagagg

SEQ ID NO: 7061321 - DNA, 22 bp, Homo sapiens
ccagggctggtggctgcagagg

SEQ ID NO: 7061322 - DNA, 22 bp, Homo sapiens
ccagggctggtggctgcagagg

SEQ ID NO: 7061323 - DNA, 22 bp, Homo sapiens
ccagggctgggtttgtcggtgt

SEQ ID NO: 7061324 - DNA, 22 bp, Homo sapiens
aggctgaggatcgtactttcca

SEQ ID NO: 7061325 - DNA, 22 bp, Homo sapiens
aggctgaggcaagaggatcact

SEQ ID NO: 7061326 - DNA, 22 bp, Homo sapiens
aggctgaggcaagaggatcact

SEQ ID NO: 7061327 - DNA, 22 bp, Homo sapiens
aggctgaggcaagaggatcact

SEQ ID NO: 7061328 - DNA, 22 bp, Homo sapiens
aggctgaggcaagaggatcact

SEQ ID NO: 7061329 - DNA, 22 bp, Homo sapiens
aggctgaggcaagaggatcact

SEQ ID NO: 7061330 - DNA, 22 bp, Homo sapiens
aggctgaggcaggtggatcacc

SEQ ID NO: 7061331 - DNA, 22 bp, Homo sapiens
aggctgaggcaggtggatcacc

SEQ ID NO: 7061332 - DNA, 22 bp, Homo sapiens
aggctgaggcaggtggatcacc

SEQ ID NO: 7061333 - DNA, 20 bp, Homo sapiens
ccagggctggctcctgggat

SEQ ID NO: 7061334 - DNA, 20 bp, Homo sapiens
ccagggctggctcctgggat

SEQ ID NO: 7061335 - DNA, 22 bp, Homo sapiens
ccagggctcaggctcccagtgg

SEQ ID NO: 7061336 - DNA, 22 bp, Homo sapiens
ccagggctcaggctcccagtgg

SEQ ID NO: 7061337 - DNA, 19 bp, Homo sapiens
ccagggctccaagctgagt

SEQ ID NO: 7061338 - DNA, 22 bp, Homo sapiens
ccagggctccattgctcatcct

SEQ ID NO: 7061339 - DNA, 22 bp, Homo sapiens
ccagggctccattgctcatcct

SEQ ID NO: 7061340 - DNA, 22 bp, Homo sapiens
ccagggcaggagaaagactcac

SEQ ID NO: 7061341 - DNA, 22 bp, Homo sapiens
ccagggcctcgtgttctgagtg

SEQ ID NO: 7061342 - DNA, 22 bp, Homo sapiens
ccagggcctgccacttagcaag

SEQ ID NO: 7061343 - DNA, 22 bp, Homo sapiens
ccagggcctgccacttagcaag

SEQ ID NO: 7061344 - DNA, 23 bp, Homo sapiens
ccagggctacgggcaccgtcctg

SEQ ID NO: 7061345 - DNA, 23 bp, Homo sapiens
ccagggctacgggcaccgtcctg

SEQ ID NO: 7061346 - DNA, 22 bp, Homo sapiens
aggcgtggttgaggcgagcata

SEQ ID NO: 7061347 - DNA, 22 bp, Homo sapiens
aggctaaaagagaatcatttag

SEQ ID NO: 7061348 - DNA, 22 bp, Homo sapiens
aggctaagatgtggtctgagca

SEQ ID NO: 7061349 - DNA, 22 bp, Homo sapiens
aggctaaggagtgtgatgctca

SEQ ID NO: 7061350 - DNA, 22 bp, Homo sapiens
aggctaagggatgactggagtg

SEQ ID NO: 7061351 - DNA, 22 bp, Homo sapiens
aggctagactttggcgaagcac

SEQ ID NO: 7061352 - DNA, 22 bp, Homo sapiens
ccaggctgctgttggtgtccgc

SEQ ID NO: 7061353 - DNA, 22 bp, Homo sapiens
ccaggctgctgttggtgtccgc

SEQ ID NO: 7061354 - DNA, 22 bp, Homo sapiens
ccaggctgcttagccttatctt

SEQ ID NO: 7061355 - DNA, 22 bp, Homo sapiens
ccaggctgcttagccttatctt

SEQ ID NO: 7061356 - DNA, 22 bp, Homo sapiens
ccaggctgctttattactctgt

SEQ ID NO: 7061357 - DNA, 22 bp, Homo sapiens
ccaggctggaatcaatattctg

SEQ ID NO: 7061358 - DNA, 22 bp, Homo sapiens
ccaggctggagtatagtggcgc

SEQ ID NO: 7061359 - DNA, 21 bp, Homo sapiens
ccaggctgggagggcagttcc

SEQ ID NO: 7061360 - DNA, 21 bp, Homo sapiens
ccaggctgggagggcagttcc

SEQ ID NO: 7061361 - DNA, 22 bp, Homo sapiens
ccaggctgggcggggaacctgg

SEQ ID NO: 7061362 - DNA, 22 bp, Homo sapiens
ccaggctgggcggggaacctgg

SEQ ID NO: 7061363 - DNA, 22 bp, Homo sapiens
ccaggctgggctacaagttgag

SEQ ID NO: 7061364 - DNA, 22 bp, Homo sapiens
ccaggctgggctacaagttgag

SEQ ID NO: 7061365 - DNA, 22 bp, Homo sapiens
ccaggctgggctacaagttgag

SEQ ID NO: 7061366 - DNA, 22 bp, Homo sapiens
ccaggctgggctacaagttgag

SEQ ID NO: 7061367 - DNA, 15 bp, Homo sapiens
ccaggctgggtgagc

SEQ ID NO: 7061368 - DNA, 22 bp, Homo sapiens
ccaggctggtctgaatttctag

SEQ ID NO: 7061369 - DNA, 22 bp, Homo sapiens
aggctggggaattgaatttgct

SEQ ID NO: 7061370 - DNA, 20 bp, Homo sapiens
aggctggggtgttttgccca

SEQ ID NO: 7061371 - DNA, 22 bp, Homo sapiens
aggctgggtacctgtcatatgc

SEQ ID NO: 7061372 - DNA, 22 bp, Homo sapiens
aggctgggtacctgtcatatgc

SEQ ID NO: 7061373 - DNA, 22 bp, Homo sapiens
aggctgggcaccgttttgatcc

SEQ ID NO: 7061374 - DNA, 22 bp, Homo sapiens
aggctgggctccgcccaactcc

SEQ ID NO: 7061375 - DNA, 22 bp, Homo sapiens
ccatttgtggtttatttgctct

SEQ ID NO: 7061376 - DNA, 22 bp, Homo sapiens
ccatttgttttcgctaccatgg

SEQ ID NO: 7061377 - DNA, 22 bp, Homo sapiens
ccattttattagtgacatttag

SEQ ID NO: 7061378 - DNA, 22 bp, Homo sapiens
aggctggctggcaggggacaca

SEQ ID NO: 7061379 - DNA, 22 bp, Homo sapiens
aggctggctggggatgcgtctt

SEQ ID NO: 7061380 - DNA, 22 bp, Homo sapiens
aggctgggaaggtaaagttgta

SEQ ID NO: 7061381 - DNA, 22 bp, Homo sapiens
aggctggccctactggctgcct

SEQ ID NO: 7061382 - DNA, 22 bp, Homo sapiens
aggctggccctactggctgcct

SEQ ID NO: 7061383 - DNA, 22 bp, Homo sapiens
aggctggcgacatctggcgggc

SEQ ID NO: 7061384 - DNA, 22 bp, Homo sapiens
aggctggcgacatctggcgggc

SEQ ID NO: 7061385 - DNA, 22 bp, Homo sapiens
aggctggcggtgactgctctga

SEQ ID NO: 7061386 - DNA, 22 bp, Homo sapiens
aggctggagtgctggagtgctg

SEQ ID NO: 7061387 - DNA, 22 bp, Homo sapiens
aggctggagtgtagcagtgcag

SEQ ID NO: 7061388 - DNA, 22 bp, Homo sapiens
aggctggagtgcaatggcgtga

SEQ ID NO: 7061389 - DNA, 22 bp, Homo sapiens
aggctggagtacagtggctatt

SEQ ID NO: 7061390 - DNA, 22 bp, Homo sapiens
aggctggagtgtagcagtgcag

SEQ ID NO: 7061391 - DNA, 22 bp, Homo sapiens
aggctggagtgtgcagtggcgc

SEQ ID NO: 7061392 - DNA, 22 bp, Homo sapiens
aggctggagcaagggggcatat

SEQ ID NO: 7061393 - DNA, 22 bp, Homo sapiens
aggctggagcaagggggcatat

SEQ ID NO: 7061394 - DNA, 22 bp, Homo sapiens
aggctggagcaagggggcatat

SEQ ID NO: 7061395 - DNA, 22 bp, Homo sapiens
aggctggagacccgccaagaaa

SEQ ID NO: 7061396 - DNA, 22 bp, Homo sapiens
aggctggagacccgccaagaaa

SEQ ID NO: 7061397 - DNA, 22 bp, Homo sapiens
aggctggagagtgcagtggcgt

SEQ ID NO: 7061398 - DNA, 22 bp, Homo sapiens
aggctggagagtgcagtggcgt

SEQ ID NO: 7061399 - DNA, 22 bp, Homo sapiens
aggctggagagtgcagtggcgt

SEQ ID NO: 7061400 - DNA, 22 bp, Homo sapiens
ccaggtctggaaccaccagggc

SEQ ID NO: 7061401 - DNA, 22 bp, Homo sapiens
ccaggtctggcactggccagtc

SEQ ID NO: 7061402 - DNA, 19 bp, Homo sapiens
ccaggtctggggccagatt

SEQ ID NO: 7061403 - DNA, 22 bp, Homo sapiens
aggctgctcagtagatggagct

SEQ ID NO: 7061404 - DNA, 19 bp, Homo sapiens
aggctggagacaccaggcc

SEQ ID NO: 7061405 - DNA, 19 bp, Homo sapiens
aggctggagacaccaggcc

SEQ ID NO: 7061406 - DNA, 22 bp, Homo sapiens
agggctaggaatggaactggag

SEQ ID NO: 7061407 - DNA, 22 bp, Homo sapiens
agggctgctttgctaaatatgg

SEQ ID NO: 7061408 - DNA, 22 bp, Homo sapiens
agggctggagccacagctggga

SEQ ID NO: 7061409 - DNA, 22 bp, Homo sapiens
agggctggagccacagctggga

SEQ ID NO: 7061410 - DNA, 22 bp, Homo sapiens
agggctggagccacagctggga

SEQ ID NO: 7061411 - DNA, 22 bp, Homo sapiens
agggctggagggtactagttta

SEQ ID NO: 7061412 - DNA, 22 bp, Homo sapiens
agggctggcaagggattgaaat

SEQ ID NO: 7061413 - DNA, 22 bp, Homo sapiens
agggctggcaagggattgaaat

SEQ ID NO: 7061414 - DNA, 22 bp, Homo sapiens
agggctggcaagggattgaaat

SEQ ID NO: 7061415 - DNA, 22 bp, Homo sapiens
agggctggcatctctaatgctg

SEQ ID NO: 7061416 - DNA, 22 bp, Homo sapiens
cctcaggatacaggagccacag

SEQ ID NO: 7061417 - DNA, 22 bp, Homo sapiens
cctcaggatacaggagccacag

SEQ ID NO: 7061418 - DNA, 22 bp, Homo sapiens
cctcaggccctgtccctgcgcc

SEQ ID NO: 7061419 - DNA, 22 bp, Homo sapiens
agggcgaggagacggaggcaca

SEQ ID NO: 7061420 - DNA, 22 bp, Homo sapiens
agggcgtggtggtgctggagca

SEQ ID NO: 7061421 - DNA, 22 bp, Homo sapiens
agggcctgagctggctgacctc

SEQ ID NO: 7061422 - DNA, 22 bp, Homo sapiens
ccctgctttcaaccttctagct

SEQ ID NO: 7061423 - DNA, 22 bp, Homo sapiens
ccctgctttgcacccaggctgg

SEQ ID NO: 7061424 - DNA, 22 bp, Homo sapiens
agggcctgaggctgacggggag

SEQ ID NO: 7061425 - DNA, 19 bp, Homo sapiens
agggcctgcagctcaagct

SEQ ID NO: 7061426 - DNA, 19 bp, Homo sapiens
agggcctgcagctcaagct

SEQ ID NO: 7061427 - DNA, 22 bp, Homo sapiens
agggcctgcatcaggagcttgg

SEQ ID NO: 7061428 - DNA, 22 bp, Homo sapiens
agggcctggcgcgtggccgccg

SEQ ID NO: 7061429 - DNA, 20 bp, Homo sapiens
agggcctggagtacagcagg

SEQ ID NO: 7061430 - DNA, 23 bp, Homo sapiens
agggcctggcgtggagtgtgtgc

SEQ ID NO: 7061431 - DNA, 22 bp, Homo sapiens
agggcctggcttcactttctca

SEQ ID NO: 7061432 - DNA, 22 bp, Homo sapiens
cctcagcttgatttctgcagag

SEQ ID NO: 7061433 - DNA, 22 bp, Homo sapiens
cctcaggaaatgaataaatggc

SEQ ID NO: 7061434 - DNA, 22 bp, Homo sapiens
cctcaggaaccacattgctgct

SEQ ID NO: 7061435 - DNA, 22 bp, Homo sapiens
agggcctggaactggagaccac

SEQ ID NO: 7061436 - DNA, 22 bp, Homo sapiens
agggcctgctctatcactctca

SEQ ID NO: 7061437 - DNA, 20 bp, Homo sapiens
agggcctgctctgtggtgtc

SEQ ID NO: 7061438 - DNA, 22 bp, Homo sapiens
agggcctggaactgtgggcagg

SEQ ID NO: 7061439 - DNA, 22 bp, Homo sapiens
agggtatgttttaggctgagtt

SEQ ID NO: 7061440 - DNA, 22 bp, Homo sapiens
agggtcaacactttaaacatat

SEQ ID NO: 7061441 - DNA, 22 bp, Homo sapiens
agggtcaacattctaaaatctg

SEQ ID NO: 7061442 - DNA, 22 bp, Homo sapiens
cctgaggtctagagtcagggtg

SEQ ID NO: 7061443 - DNA, 22 bp, Homo sapiens
cctgaggtggctgcagcactgc

SEQ ID NO: 7061444 - DNA, 22 bp, Homo sapiens
aggggtgacacatatcagtgca

SEQ ID NO: 7061445 - DNA, 22 bp, Homo sapiens
agggtaggaactgagtggaagg

SEQ ID NO: 7061446 - DNA, 22 bp, Homo sapiens
aggggtgaaggcccgataggag

SEQ ID NO: 7061447 - DNA, 22 bp, Homo sapiens
aggggtgaaggcccgataggag

SEQ ID NO: 7061448 - DNA, 22 bp, Homo sapiens
agggtagggcccggagacagac

SEQ ID NO: 7061449 - DNA, 22 bp, Homo sapiens
agggtaggaactgagtggaagg

SEQ ID NO: 7061450 - DNA, 22 bp, Homo sapiens
agggtagggccgtagggccatg

SEQ ID NO: 7061451 - DNA, 22 bp, Homo sapiens
agggtagggccgtagggccatg

SEQ ID NO: 7061452 - DNA, 22 bp, Homo sapiens
cctgaagatgctgtggcctggt

SEQ ID NO: 7061453 - DNA, 22 bp, Homo sapiens
cctgaagagcactctagagttg

SEQ ID NO: 7061454 - DNA, 22 bp, Homo sapiens
cctgagaggccctctcactgtc

SEQ ID NO: 7061455 - DNA, 22 bp, Homo sapiens
aggggaggcagcgataaacctg

SEQ ID NO: 7061456 - DNA, 22 bp, Homo sapiens
aggggaggagcttttcttgcct

SEQ ID NO: 7061457 - DNA, 22 bp, Homo sapiens
aggggaggagcttttcttgcct

SEQ ID NO: 7061458 - DNA, 22 bp, Homo sapiens
aggggaggcagcgataaacctg

SEQ ID NO: 7061459 - DNA, 22 bp, Homo sapiens
aggggaggtgtccccaaatctc

SEQ ID NO: 7061460 - DNA, 22 bp, Homo sapiens
aggggatgatcctcccgcagcg

SEQ ID NO: 7061461 - DNA, 22 bp, Homo sapiens
agggctggccacatgatttggt

SEQ ID NO: 7061462 - DNA, 22 bp, Homo sapiens
agggctggctaggtgcgttccc

SEQ ID NO: 7061463 - DNA, 22 bp, Homo sapiens
agggctggctccgttaccttga

SEQ ID NO: 7061464 - DNA, 22 bp, Homo sapiens
aggggagcaacatagtcactct

SEQ ID NO: 7061465 - DNA, 20 bp, Homo sapiens
aggggcacctgcgacggggc

SEQ ID NO: 7061466 - DNA, 22 bp, Homo sapiens
aggggatggagctggaaggcag

SEQ ID NO: 7061467 - DNA, 22 bp, Homo sapiens
aggggatgcctgaggatctgta

SEQ ID NO: 7061468 - DNA, 22 bp, Homo sapiens
aggggatggagctggaaggcag

SEQ ID NO: 7061469 - DNA, 22 bp, Homo sapiens
aggggcagcctcacaatcctct

SEQ ID NO: 7061470 - DNA, 22 bp, Homo sapiens
cccatcacagacactgggttat

SEQ ID NO: 7061471 - DNA, 22 bp, Homo sapiens
cccatctcagtcgtgctaaggg

SEQ ID NO: 7061472 - DNA, 22 bp, Homo sapiens
cccaggcttttaagttagacag

SEQ ID NO: 7061473 - DNA, 22 bp, Homo sapiens
cccaggcttttaagttagacag

SEQ ID NO: 7061474 - DNA, 22 bp, Homo sapiens
cccaggcttttctcttgcccca

SEQ ID NO: 7061475 - DNA, 22 bp, Homo sapiens
cccagtacctctgttccctgct

SEQ ID NO: 7061476 - DNA, 22 bp, Homo sapiens
cccaggctgcgtatccacaata

SEQ ID NO: 7061477 - DNA, 18 bp, Homo sapiens
cccaggctttgtgggtct

SEQ ID NO: 7061478 - DNA, 18 bp, Homo sapiens
cccaggctttgtgggtct

SEQ ID NO: 7061479 - DNA, 22 bp, Homo sapiens
cccaggaggtcgaagctgcagt

SEQ ID NO: 7061480 - DNA, 22 bp, Homo sapiens
cccaggaggtcgaagctgcagt

SEQ ID NO: 7061481 - DNA, 22 bp, Homo sapiens
cccaggaggtcgaagctgcagt

SEQ ID NO: 7061482 - DNA, 22 bp, Homo sapiens
cccaggctgatgggatgggcca

SEQ ID NO: 7061483 - DNA, 22 bp, Homo sapiens
cccaggctgatgttcagcgggt

SEQ ID NO: 7061484 - DNA, 22 bp, Homo sapiens
cccaggaggtcaaggctgcagt

SEQ ID NO: 7061485 - DNA, 22 bp, Homo sapiens
cccaggaggtagaggttgcagt

SEQ ID NO: 7061486 - DNA, 22 bp, Homo sapiens
cccaggagggtggcctctgccc

SEQ ID NO: 7061487 - DNA, 22 bp, Homo sapiens
cccaggagcttctctctgcctc

SEQ ID NO: 7061488 - DNA, 20 bp, Homo sapiens
cccaggagctgtgccccatc

SEQ ID NO: 7061489 - DNA, 20 bp, Homo sapiens
cccaggagctgtgccccatc

SEQ ID NO: 7061490 - DNA, 23 bp, Homo sapiens
cccaggagcctgagtcctctctg

SEQ ID NO: 7061491 - DNA, 22 bp, Homo sapiens
cccaggagatggtgcgtggtct

SEQ ID NO: 7061492 - DNA, 22 bp, Homo sapiens
cccaggagatggaggttgcagt

SEQ ID NO: 7061493 - DNA, 22 bp, Homo sapiens
cccaggagatgcactccattgg

SEQ ID NO: 7061494 - DNA, 22 bp, Homo sapiens
aggctggtcccagggagggaat

SEQ ID NO: 7061495 - DNA, 22 bp, Homo sapiens
aggctggtctatacggagacga

SEQ ID NO: 7061496 - DNA, 22 bp, Homo sapiens
aggctggtctatacggagacga

SEQ ID NO: 7061497 - DNA, 22 bp, Homo sapiens
aggctggtctgttggcattttt

SEQ ID NO: 7061498 - DNA, 22 bp, Homo sapiens
aggctggtgattagaagcagcc

SEQ ID NO: 7061499 - DNA, 22 bp, Homo sapiens
aggctggtgcttcctagggcag

SEQ ID NO: 7061500 - DNA, 22 bp, Homo sapiens
aggctggtgcttcctagggcag

SEQ ID NO: 7061501 - DNA, 22 bp, Homo sapiens
aggctggtgtgtcctgaagcct

SEQ ID NO: 7061502 - DNA, 22 bp, Homo sapiens
aggctgtagtgcatgtgctatg

SEQ ID NO: 7061503 - DNA, 20 bp, Homo sapiens
aggctgtcatttctggcagg

SEQ ID NO: 7061504 - DNA, 22 bp, Homo sapiens
aggctgtcctctcttgctcagt

SEQ ID NO: 7061505 - DNA, 21 bp, Homo sapiens
aggctgtcctttgccagccct

SEQ ID NO: 7061506 - DNA, 22 bp, Homo sapiens
aggctgtctcacctcaggaggg

SEQ ID NO: 7061507 - DNA, 22 bp, Homo sapiens
aggctgtctcagcctgcttgca

SEQ ID NO: 7061508 - DNA, 22 bp, Homo sapiens
aggctgtgaactctatgctgaa

SEQ ID NO: 7061509 - DNA, 22 bp, Homo sapiens
ccccttccacagtgcttcctaa

SEQ ID NO: 7061510 - DNA, 22 bp, Homo sapiens
cccatgagtgctgctcagaggc

SEQ ID NO: 7061511 - DNA, 22 bp, Homo sapiens
cccatgagattctgaatttggc

SEQ ID NO: 7061512 - DNA, 22 bp, Homo sapiens
ccctgccctggagacacttaaa

SEQ ID NO: 7061513 - DNA, 22 bp, Homo sapiens
ccctgccctgggcagaagtggg

SEQ ID NO: 7061514 - DNA, 22 bp, Homo sapiens
ccctgctgtcaggtgctgggag

SEQ ID NO: 7061515 - DNA, 22 bp, Homo sapiens
ccctgctgtccctcagtcctgc

SEQ ID NO: 7061516 - DNA, 22 bp, Homo sapiens
ccctgcccatcggggcggcctg

SEQ ID NO: 7061517 - DNA, 22 bp, Homo sapiens
ccctgcccaccacatgctggga

SEQ ID NO: 7061518 - DNA, 22 bp, Homo sapiens
ccctgcccaccacatgctggga

SEQ ID NO: 7061519 - DNA, 22 bp, Homo sapiens
ccctgccctggagacacttaaa

SEQ ID NO: 7061520 - DNA, 23 bp, Homo sapiens
ccctgcccattgagcaggacgtc

SEQ ID NO: 7061521 - DNA, 22 bp, Homo sapiens
ccctcagctccaccctcagcag

SEQ ID NO: 7061522 - DNA, 22 bp, Homo sapiens
ccctcccaagcactctgacata

SEQ ID NO: 7061523 - DNA, 22 bp, Homo sapiens
ccctcccaagcactctgacata

SEQ ID NO: 7061524 - DNA, 22 bp, Homo sapiens
ccctcccaagcactctgacata

SEQ ID NO: 7061525 - DNA, 22 bp, Homo sapiens
ccctcccaagcactctgacata

SEQ ID NO: 7061526 - DNA, 20 bp, Homo sapiens
ccctcccagatgcttcccaa

SEQ ID NO: 7061527 - DNA, 20 bp, Homo sapiens
ccctcccagatgcttcccaa

SEQ ID NO: 7061528 - DNA, 20 bp, Homo sapiens
ccctcccagatgcttcccaa

SEQ ID NO: 7061529 - DNA, 22 bp, Homo sapiens
ccctcccagatgggcttgaggt

SEQ ID NO: 7061530 - DNA, 22 bp, Homo sapiens
ccctcccagatgggcttgaggt

SEQ ID NO: 7061531 - DNA, 22 bp, Homo sapiens
ccctcccaggagtggccagaga

SEQ ID NO: 7061532 - DNA, 22 bp, Homo sapiens
ccctcccaggagtggccagaga

SEQ ID NO: 7061533 - DNA, 22 bp, Homo sapiens
ccctgatggcacagtggcaggc

SEQ ID NO: 7061534 - DNA, 22 bp, Homo sapiens
ccctgatgttttctctgccttt

SEQ ID NO: 7061535 - DNA, 22 bp, Homo sapiens
ccctgatgttttctctgccttt

SEQ ID NO: 7061536 - DNA, 23 bp, Homo sapiens
ccctgcatctgtccctcaccagt

SEQ ID NO: 7061537 - DNA, 22 bp, Homo sapiens
ccctgccaatcccgtctctctg

SEQ ID NO: 7061538 - DNA, 20 bp, Homo sapiens
agcagagtgcccatcccgga

SEQ ID NO: 7061539 - DNA, 22 bp, Homo sapiens
caataatatcctgtgctgtttg

SEQ ID NO: 7061540 - DNA, 21 bp, Homo sapiens
agcagaggggacatgtttgat

SEQ ID NO: 7061541 - DNA, 22 bp, Homo sapiens
agcagaggtgtttattatggga

SEQ ID NO: 7061542 - DNA, 22 bp, Homo sapiens
agcagaggtttgttggaaacct

SEQ ID NO: 7061543 - DNA, 22 bp, Homo sapiens
agcagaggtttgttggaaacct

SEQ ID NO: 7061544 - DNA, 20 bp, Homo sapiens
agcagagtgcccatcccgga

SEQ ID NO: 7061545 - DNA, 21 bp, Homo sapiens
agcagaggctgcctggtgact

SEQ ID NO: 7061546 - DNA, 21 bp, Homo sapiens
agcagaggcagaatgtatgca

SEQ ID NO: 7061547 - DNA, 22 bp, Homo sapiens
agcagaggaggatttagttagg

SEQ ID NO: 7061548 - DNA, 22 bp, Homo sapiens
agcagaggacagttcttaggaa

SEQ ID NO: 7061549 - DNA, 22 bp, Homo sapiens
agcagagctttttggactcaga

SEQ ID NO: 7061550 - DNA, 22 bp, Homo sapiens
agcagagctgggatcctgggtc

SEQ ID NO: 7061551 - DNA, 22 bp, Homo sapiens
agcagagaccatatagcccaga

SEQ ID NO: 7061552 - DNA, 22 bp, Homo sapiens
agcagagacctggttttgttga

SEQ ID NO: 7061553 - DNA, 22 bp, Homo sapiens
agcagagctgcagtggcctgct

SEQ ID NO: 7061554 - DNA, 22 bp, Homo sapiens
caaaggcttcatctcagagcag

SEQ ID NO: 7061555 - DNA, 22 bp, Homo sapiens
caaagggaaaagccatgtgggc

SEQ ID NO: 7061556 - DNA, 22 bp, Homo sapiens
caaagggaaacgcagtgtcaag

SEQ ID NO: 7061557 - DNA, 22 bp, Homo sapiens
caaagggcatggcctgagcact

SEQ ID NO: 7061558 - DNA, 22 bp, Homo sapiens
caaaggctgccactgtggctgt

SEQ ID NO: 7061559 - DNA, 22 bp, Homo sapiens
caaagggcattttagtgaactg

SEQ ID NO: 7061560 - DNA, 22 bp, Homo sapiens
caaagggcggctgtcggagggt

SEQ ID NO: 7061561 - DNA, 20 bp, Homo sapiens
agcaccagtgggggcagccc

SEQ ID NO: 7061562 - DNA, 22 bp, Homo sapiens
agcacctgtcacaagcagaagg

SEQ ID NO: 7061563 - DNA, 22 bp, Homo sapiens
agcacctgtcacaagcagaagg

SEQ ID NO: 7061564 - DNA, 17 bp, Homo sapiens
agcacctgtccagtccc

SEQ ID NO: 7061565 - DNA, 22 bp, Homo sapiens
agcactgatttaaactggattt

SEQ ID NO: 7061566 - DNA, 22 bp, Homo sapiens
agcactgattttgttgcactta

SEQ ID NO: 7061567 - DNA, 22 bp, Homo sapiens
agcactagctttaagcattctg

SEQ ID NO: 7061568 - DNA, 22 bp, Homo sapiens
agcactgctttagagcctctgc

SEQ ID NO: 7061569 - DNA, 22 bp, Homo sapiens
agcacctgttgcacttcataat

SEQ ID NO: 7061570 - DNA, 21 bp, Homo sapiens
agcaccttacagctataatgg

SEQ ID NO: 7061571 - DNA, 22 bp, Homo sapiens
agcaccttgctcttggccttcc

SEQ ID NO: 7061572 - DNA, 22 bp, Homo sapiens
caatacactaaacttctctgaa

SEQ ID NO: 7061573 - DNA, 22 bp, Homo sapiens
agcagcagatcaaacaggcttg

SEQ ID NO: 7061574 - DNA, 22 bp, Homo sapiens
agcagcctggacttggatgtgg

SEQ ID NO: 7061575 - DNA, 22 bp, Homo sapiens
agcagcctggtctctcgccaat

SEQ ID NO: 7061576 - DNA, 22 bp, Homo sapiens
agcagccttgcaggggtcgcac

SEQ ID NO: 7061577 - DNA, 22 bp, Homo sapiens
agcagccttgtgactccggggt

SEQ ID NO: 7061578 - DNA, 22 bp, Homo sapiens
agcagcctttgatcatctggga

SEQ ID NO: 7061579 - DNA, 22 bp, Homo sapiens
agcagcctttgatcatctggga

SEQ ID NO: 7061580 - DNA, 22 bp, Homo sapiens
cacagagatcggaacagaagta

SEQ ID NO: 7061581 - DNA, 22 bp, Homo sapiens
cacagagatggtctggcaggtg

SEQ ID NO: 7061582 - DNA, 22 bp, Homo sapiens
cacagagattagaattagacta

SEQ ID NO: 7061583 - DNA, 22 bp, Homo sapiens
agcaggaatctgttctgtataa

SEQ ID NO: 7061584 - DNA, 20 bp, Homo sapiens
agcaggaatgatgctttcat

SEQ ID NO: 7061585 - DNA, 22 bp, Homo sapiens
agcaggaactcagggagttctc

SEQ ID NO: 7061586 - DNA, 22 bp, Homo sapiens
agcaggaaggctttgggggttc

SEQ ID NO: 7061587 - DNA, 22 bp, Homo sapiens
agcaggaaggggatgatgggca

SEQ ID NO: 7061588 - DNA, 22 bp, Homo sapiens
agcaggaaggtctgtgtgagtc

SEQ ID NO: 7061589 - DNA, 22 bp, Homo sapiens
agcaggaaggtctgtgtgagtc

SEQ ID NO: 7061590 - DNA, 22 bp, Homo sapiens
agcaggaagtagtctgtaagca

SEQ ID NO: 7061591 - DNA, 22 bp, Homo sapiens
cacagcagaacttaatttcaaa

SEQ ID NO: 7061592 - DNA, 22 bp, Homo sapiens
cacagcagagggagccattgaa

SEQ ID NO: 7061593 - DNA, 22 bp, Homo sapiens
cacagcagagggagccattgaa

SEQ ID NO: 7061594 - DNA, 22 bp, Homo sapiens
agcagggagaccatctcttcct

SEQ ID NO: 7061595 - DNA, 22 bp, Homo sapiens
agcagggaggcggtgtgctggc

SEQ ID NO: 7061596 - DNA, 17 bp, Homo sapiens
agcagggagtcaaggga

SEQ ID NO: 7061597 - DNA, 22 bp, Homo sapiens
agcagggctctgccatgggccc

SEQ ID NO: 7061598 - DNA, 22 bp, Homo sapiens
caccagctaattaaaacagcag

SEQ ID NO: 7061599 - DNA, 22 bp, Homo sapiens
agcagggctctgtggagggtgg

SEQ ID NO: 7061600 - DNA, 23 bp, Homo sapiens
caccactttctccttctccttgg

SEQ ID NO: 7061601 - DNA, 22 bp, Homo sapiens
caccagaacaagacaggagaat

SEQ ID NO: 7061602 - DNA, 22 bp, Homo sapiens
caccagagttgtccaaatgatt

SEQ ID NO: 7061603 - DNA, 22 bp, Homo sapiens
agcagggcagcttttttcagaa

SEQ ID NO: 7061604 - DNA, 22 bp, Homo sapiens
agcagggcaggtaaggatcaga

SEQ ID NO: 7061605 - DNA, 22 bp, Homo sapiens
cacatttaatcctttataagta

SEQ ID NO: 7061606 - DNA, 22 bp, Homo sapiens
caccactgtatccctagcactt

SEQ ID NO: 7061607 - DNA, 22 bp, Homo sapiens
agcagggcaaagtcaggctaac

SEQ ID NO: 7061608 - DNA, 22 bp, Homo sapiens
agcagggcactggaaggcactg

SEQ ID NO: 7061609 - DNA, 22 bp, Homo sapiens
agcagggcagctgatgcgcacg

SEQ ID NO: 7061610 - DNA, 18 bp, Homo sapiens
agcatgagagaggctgtg

SEQ ID NO: 7061611 - DNA, 22 bp, Homo sapiens
agcatgaaaggcgtgccaactt

SEQ ID NO: 7061612 - DNA, 22 bp, Homo sapiens
agcatgaaagcataggacagtc

SEQ ID NO: 7061613 - DNA, 22 bp, Homo sapiens
agcatgaagacttcagagctag

SEQ ID NO: 7061614 - DNA, 22 bp, Homo sapiens
agcagtggcctggggctctgtg

SEQ ID NO: 7061615 - DNA, 22 bp, Homo sapiens
agcagtggacctcagtgctatt

SEQ ID NO: 7061616 - DNA, 22 bp, Homo sapiens
agcagtgagtgggaggaccatg

SEQ ID NO: 7061617 - DNA, 22 bp, Homo sapiens
agcagtgatgaaatgagcatcc

SEQ ID NO: 7061618 - DNA, 22 bp, Homo sapiens
agcagggctggggcacgagcca

SEQ ID NO: 7061619 - DNA, 19 bp, Homo sapiens
agcaggtgggtaagaaaat

SEQ ID NO: 7061620 - DNA, 22 bp, Homo sapiens
agcaggtgtcggcgagggtctt

SEQ ID NO: 7061621 - DNA, 22 bp, Homo sapiens
agcaggtgtcggcgagggtctt

SEQ ID NO: 7061622 - DNA, 18 bp, Homo sapiens
agcaggtgtgcagaatgt

SEQ ID NO: 7061623 - DNA, 22 bp, Homo sapiens
agcaggtgttagggatccaatg

SEQ ID NO: 7061624 - DNA, 22 bp, Homo sapiens
agcaggtgtttgtatcataagg

SEQ ID NO: 7061625 - DNA, 20 bp, Homo sapiens
agcagtaggacctctgggcc

SEQ ID NO: 7061626 - DNA, 22 bp, Homo sapiens
cactgttttattccaacatagg

SEQ ID NO: 7061627 - DNA, 22 bp, Homo sapiens
cacttaaagtcttagcttacag

SEQ ID NO: 7061628 - DNA, 22 bp, Homo sapiens
cactttactatctataaaataa

SEQ ID NO: 7061629 - DNA, 22 bp, Homo sapiens
cactgttcatcaaaactgctct

SEQ ID NO: 7061630 - DNA, 22 bp, Homo sapiens
cactgttctttttgtagtccaa

SEQ ID NO: 7061631 - DNA, 23 bp, Homo sapiens
agcatggaataggaaagaggcag

SEQ ID NO: 7061632 - DNA, 22 bp, Homo sapiens
agcatggggcaatgcatgtgct

SEQ ID NO: 7061633 - DNA, 22 bp, Homo sapiens
agcatggggcaatgcatgtgct

SEQ ID NO: 7061634 - DNA, 22 bp, Homo sapiens
agccctgggctgtagataagca

SEQ ID NO: 7061635 - DNA, 22 bp, Homo sapiens
agccctgggcagccaaggaagc

SEQ ID NO: 7061636 - DNA, 22 bp, Homo sapiens
agccctgggcgttactgggatg

SEQ ID NO: 7061637 - DNA, 22 bp, Homo sapiens
agccctggctcccagcagcgct

SEQ ID NO: 7061638 - DNA, 22 bp, Homo sapiens
agccctggctcccagcagcgct

SEQ ID NO: 7061639 - DNA, 22 bp, Homo sapiens
agccctggcagagccaggtagt

SEQ ID NO: 7061640 - DNA, 22 bp, Homo sapiens
agccctgcgtgccaggggactg

SEQ ID NO: 7061641 - DNA, 22 bp, Homo sapiens
agccctgctcatctggatcccg

SEQ ID NO: 7061642 - DNA, 23 bp, Homo sapiens
agccctgctgagacccagctccc

SEQ ID NO: 7061643 - DNA, 22 bp, Homo sapiens
cagagctctatgttcatggagg

SEQ ID NO: 7061644 - DNA, 22 bp, Homo sapiens
agccagtggaattcccaggggt

SEQ ID NO: 7061645 - DNA, 22 bp, Homo sapiens
agccagtgggattagagcctct

SEQ ID NO: 7061646 - DNA, 22 bp, Homo sapiens
agccagtgttaagtgactggtt

SEQ ID NO: 7061647 - DNA, 22 bp, Homo sapiens
agccagtgtcgtgtgacatgag

SEQ ID NO: 7061648 - DNA, 22 bp, Homo sapiens
agccagtgttaagtgactggtt

SEQ ID NO: 7061649 - DNA, 22 bp, Homo sapiens
agccagtttccagatattaact

SEQ ID NO: 7061650 - DNA, 22 bp, Homo sapiens
agcccaggttgaggctgcagtg

SEQ ID NO: 7061651 - DNA, 22 bp, Homo sapiens
agcccaggttgaggctgcagtg

SEQ ID NO: 7061652 - DNA, 22 bp, Homo sapiens
agcccaggttgaggctgcagtg

SEQ ID NO: 7061653 - DNA, 20 bp, Homo sapiens
agcccatctcccacagctac

SEQ ID NO: 7061654 - DNA, 22 bp, Homo sapiens
agcccatggtgtactctgtggc

SEQ ID NO: 7061655 - DNA, 22 bp, Homo sapiens
agccccacactctctctgagaa

SEQ ID NO: 7061656 - DNA, 20 bp, Homo sapiens
agccccacccttgtcctggc

SEQ ID NO: 7061657 - DNA, 22 bp, Homo sapiens
agccccagcccctctctcacaa

SEQ ID NO: 7061658 - DNA, 22 bp, Homo sapiens
agccccaggatgggccgcagga

SEQ ID NO: 7061659 - DNA, 22 bp, Homo sapiens
agccagcatgaagacagaggcc

SEQ ID NO: 7061660 - DNA, 22 bp, Homo sapiens
agccagcatcttgcttcttgag

SEQ ID NO: 7061661 - DNA, 22 bp, Homo sapiens
agccagcagggcttagaggaca

SEQ ID NO: 7061662 - DNA, 22 bp, Homo sapiens
agccagcaggtgagtgcagcct

SEQ ID NO: 7061663 - DNA, 22 bp, Homo sapiens
agccagcaggaacgtctaggtt

SEQ ID NO: 7061664 - DNA, 22 bp, Homo sapiens
agccagcacggcgccatggagt

SEQ ID NO: 7061665 - DNA, 22 bp, Homo sapiens
agccagagagtgttggagatgt

SEQ ID NO: 7061666 - DNA, 22 bp, Homo sapiens
agccagagttgaatgtgagtct

SEQ ID NO: 7061667 - DNA, 22 bp, Homo sapiens
cagagacatgtggcctgcacgt

SEQ ID NO: 7061668 - DNA, 22 bp, Homo sapiens
cagagacatgtggcctgcacgt

SEQ ID NO: 7061669 - DNA, 22 bp, Homo sapiens
cagagacattaagtgccatgat

SEQ ID NO: 7061670 - DNA, 22 bp, Homo sapiens
cagagacattctccccattgga

SEQ ID NO: 7061671 - DNA, 22 bp, Homo sapiens
cagagacattctccccattgga

SEQ ID NO: 7061672 - DNA, 17 bp, Homo sapiens
agccaggcatatgaagt

SEQ ID NO: 7061673 - DNA, 22 bp, Homo sapiens
agccaggccagactcacaccct

SEQ ID NO: 7061674 - DNA, 22 bp, Homo sapiens
agccaggccagctgtcttgagt

SEQ ID NO: 7061675 - DNA, 20 bp, Homo sapiens
agccaggcctcaagttaagt

SEQ ID NO: 7061676 - DNA, 22 bp, Homo sapiens
agccaggccttagggagaggca

SEQ ID NO: 7061677 - DNA, 22 bp, Homo sapiens
agccaggccttagggagaggca

SEQ ID NO: 7061678 - DNA, 22 bp, Homo sapiens
agccaggccttttctcaaggtt

SEQ ID NO: 7061679 - DNA, 22 bp, Homo sapiens
cagagcccagggcctacgtccc

SEQ ID NO: 7061680 - DNA, 22 bp, Homo sapiens
cagagccttcctagcagactct

SEQ ID NO: 7061681 - DNA, 22 bp, Homo sapiens
cagagccttcctagcagactct

SEQ ID NO: 7061682 - DNA, 22 bp, Homo sapiens
cagagctcagagcagggcactc

SEQ ID NO: 7061683 - DNA, 22 bp, Homo sapiens
cagagctcagagctgccaggca

SEQ ID NO: 7061684 - DNA, 20 bp, Homo sapiens
cagcaactttggactgagtt

SEQ ID NO: 7061685 - DNA, 22 bp, Homo sapiens
cagcaactctcctgtgctcaaa

SEQ ID NO: 7061686 - DNA, 22 bp, Homo sapiens
cagcaacatatatgaaactgtg

SEQ ID NO: 7061687 - DNA, 20 bp, Homo sapiens
cagatgggacgtggaggagt

SEQ ID NO: 7061688 - DNA, 22 bp, Homo sapiens
cagatgtacatgaagggcaatg

SEQ ID NO: 7061689 - DNA, 22 bp, Homo sapiens
cagatgtgcatgatgggaaggg

SEQ ID NO: 7061690 - DNA, 19 bp, Homo sapiens
agcctggctttgctctgct

SEQ ID NO: 7061691 - DNA, 17 bp, Homo sapiens
agcctgggaaggagtga

SEQ ID NO: 7061692 - DNA, 17 bp, Homo sapiens
agcctgggaaggagtga

SEQ ID NO: 7061693 - DNA, 22 bp, Homo sapiens
agctacctgatccttcttctga

SEQ ID NO: 7061694 - DNA, 22 bp, Homo sapiens
agctacctggcttatcactgtc

SEQ ID NO: 7061695 - DNA, 22 bp, Homo sapiens
agctacagtggacaagtgaact

SEQ ID NO: 7061696 - DNA, 22 bp, Homo sapiens
agctagagaatgacagagtctg

SEQ ID NO: 7061697 - DNA, 22 bp, Homo sapiens
agctagagctgagaagcacttg

SEQ ID NO: 7061698 - DNA, 23 bp, Homo sapiens
agctaaggaagctgaggcacagt

SEQ ID NO: 7061699 - DNA, 22 bp, Homo sapiens
agcctgggcatgggacgggagg

SEQ ID NO: 7061700 - DNA, 22 bp, Homo sapiens
agcctgggtgggggttcggaga

SEQ ID NO: 7061701 - DNA, 22 bp, Homo sapiens
agcctggtgatatcagtggttt

SEQ ID NO: 7061702 - DNA, 20 bp, Homo sapiens
agcggcagcttcctgcttcg

SEQ ID NO: 7061703 - DNA, 22 bp, Homo sapiens
agctaagacttagtgacttagt

SEQ ID NO: 7061704 - DNA, 22 bp, Homo sapiens
agctcctgtggcagctcttctg

SEQ ID NO: 7061705 - DNA, 22 bp, Homo sapiens
agctcttcctgcacctgtggct

SEQ ID NO: 7061706 - DNA, 22 bp, Homo sapiens
agctctttagagtctcccttct

SEQ ID NO: 7061707 - DNA, 22 bp, Homo sapiens
agctcctggtctttgtccagag

SEQ ID NO: 7061708 - DNA, 22 bp, Homo sapiens
agctcctgggggttccaagcag

SEQ ID NO: 7061709 - DNA, 22 bp, Homo sapiens
agctcctgggggttccaagcag

SEQ ID NO: 7061710 - DNA, 18 bp, Homo sapiens
agctcctggtctcaggga

SEQ ID NO: 7061711 - DNA, 22 bp, Homo sapiens
agctcctggctttcctctcacc

SEQ ID NO: 7061712 - DNA, 22 bp, Homo sapiens
agctcctgggccaagcccatgc

SEQ ID NO: 7061713 - DNA, 22 bp, Homo sapiens
agctcctgggccatcacaacca

SEQ ID NO: 7061714 - DNA, 22 bp, Homo sapiens
agctaggaaattgaggctgaga

SEQ ID NO: 7061715 - DNA, 20 bp, Homo sapiens
agctaggagaaagcatggag

SEQ ID NO: 7061716 - DNA, 22 bp, Homo sapiens
agctccagccgctgatgggttt

SEQ ID NO: 7061717 - DNA, 22 bp, Homo sapiens
agctccagcctcttctggaggt

SEQ ID NO: 7061718 - DNA, 23 bp, Homo sapiens
agctccagctgacgtgggcagcc

SEQ ID NO: 7061719 - DNA, 23 bp, Homo sapiens
agctccagctgacgtgggcagcc

SEQ ID NO: 7061720 - DNA, 22 bp, Homo sapiens
agctccaggataagacaggtgc

SEQ ID NO: 7061721 - DNA, 22 bp, Homo sapiens
agatgcaacctctgcttaacaa

SEQ ID NO: 7061722 - DNA, 22 bp, Homo sapiens
agatgcagaaaaactaagtgat

SEQ ID NO: 7061723 - DNA, 22 bp, Homo sapiens
agatggagttagtaccagagtc

SEQ ID NO: 7061724 - DNA, 22 bp, Homo sapiens
agatggagttgtagcagtgact

SEQ ID NO: 7061725 - DNA, 22 bp, Homo sapiens
agatggatttcttccagtgaga

SEQ ID NO: 7061726 - DNA, 17 bp, Homo sapiens
agatggcaggaggcaga

SEQ ID NO: 7061727 - DNA, 22 bp, Homo sapiens
agatggctctttgaaggggaat

SEQ ID NO: 7061728 - DNA, 22 bp, Homo sapiens
attttaaccctcttatatatac

SEQ ID NO: 7061729 - DNA, 22 bp, Homo sapiens
agatattctagaacctagtaga

SEQ ID NO: 7061730 - DNA, 22 bp, Homo sapiens
agatattctgcctaacaggttt

SEQ ID NO: 7061731 - DNA, 22 bp, Homo sapiens
agatattaccagcagtctatgc

SEQ ID NO: 7061732 - DNA, 22 bp, Homo sapiens
agatatttaaatcagacaaaga

SEQ ID NO: 7061733 - DNA, 22 bp, Homo sapiens
agatatttgtatcttgctattg

SEQ ID NO: 7061734 - DNA, 22 bp, Homo sapiens
agatatttgtatcttgctattg

SEQ ID NO: 7061735 - DNA, 22 bp, Homo sapiens
agatattttgtgtgatgtttca

SEQ ID NO: 7061736 - DNA, 22 bp, Homo sapiens
agatcaaagccatgagagattt

SEQ ID NO: 7061737 - DNA, 22 bp, Homo sapiens
agatcacagagccaagattcca

SEQ ID NO: 7061738 - DNA, 22 bp, Homo sapiens
agatcacagcccccagatgcca

SEQ ID NO: 7061739 - DNA, 22 bp, Homo sapiens
agatcacagtcaattgcaagtt

SEQ ID NO: 7061740 - DNA, 22 bp, Homo sapiens
agatcacagtggcaactccctt

SEQ ID NO: 7061741 - DNA, 22 bp, Homo sapiens
agatcacagtggcaactccctt

SEQ ID NO: 7061742 - DNA, 22 bp, Homo sapiens
agatcacagtggcaactccctt

SEQ ID NO: 7061743 - DNA, 22 bp, Homo sapiens
agatcacagttctctattcgta

SEQ ID NO: 7061744 - DNA, 23 bp, Homo sapiens
agatcacatagttatcagatgac

SEQ ID NO: 7061745 - DNA, 22 bp, Homo sapiens
agagtggagagaaacaactctg

SEQ ID NO: 7061746 - DNA, 20 bp, Homo sapiens
agcaagagtaaggacagcga

SEQ ID NO: 7061747 - DNA, 20 bp, Homo sapiens
agcaagagtaaggacagcga

SEQ ID NO: 7061748 - DNA, 22 bp, Homo sapiens
agcaacatttttcaattaacat

SEQ ID NO: 7061749 - DNA, 19 bp, Homo sapiens
agcaacctgtcagagatgc

SEQ ID NO: 7061750 - DNA, 19 bp, Homo sapiens
agcaacaccgtttatttcc

SEQ ID NO: 7061751 - DNA, 19 bp, Homo sapiens
agcaacaccgtttatttcc

SEQ ID NO: 7061752 - DNA, 22 bp, Homo sapiens
agatgtgtttctagttcctgca

SEQ ID NO: 7061753 - DNA, 22 bp, Homo sapiens
agatgtggttattctcttcctt

SEQ ID NO: 7061754 - DNA, 22 bp, Homo sapiens
agatgtgtttctagttcctgca

SEQ ID NO: 7061755 - DNA, 22 bp, Homo sapiens
attttaaccctcttatatatac

SEQ ID NO: 7061756 - DNA, 22 bp, Homo sapiens
attttaaccctcttatatatac

SEQ ID NO: 7061757 - DNA, 22 bp, Homo sapiens
attttatccccactggattaca

SEQ ID NO: 7061758 - DNA, 22 bp, Homo sapiens
attttatctgcttactttcagg

SEQ ID NO: 7061759 - DNA, 22 bp, Homo sapiens
attttatctgcttactttcagg

SEQ ID NO: 7061760 - DNA, 22 bp, Homo sapiens
attttatgacacgattcttcca

SEQ ID NO: 7061761 - DNA, 22 bp, Homo sapiens
attttatgacacgattcttcca

SEQ ID NO: 7061762 - DNA, 22 bp, Homo sapiens
attttcaaaacatctgctgtgt

SEQ ID NO: 7061763 - DNA, 22 bp, Homo sapiens
attttcaaaacatctgctgtgt

SEQ ID NO: 7061764 - DNA, 22 bp, Homo sapiens
attttcagaacattcattcact

SEQ ID NO: 7061765 - DNA, 22 bp, Homo sapiens
attttcagaacattcattcact

SEQ ID NO: 7061766 - DNA, 22 bp, Homo sapiens
attttcaccctgaatatattga

SEQ ID NO: 7061767 - DNA, 22 bp, Homo sapiens
attttcaccctgaatatattga

SEQ ID NO: 7061768 - DNA, 22 bp, Homo sapiens
agatgtggcctttgggagatta

SEQ ID NO: 7061769 - DNA, 22 bp, Homo sapiens
agaggtggagctcttggcatca

SEQ ID NO: 7061770 - DNA, 22 bp, Homo sapiens
agagtcagaaagcagacagggg

SEQ ID NO: 7061771 - DNA, 22 bp, Homo sapiens
agagtcagaaagcagacagggg

SEQ ID NO: 7061772 - DNA, 22 bp, Homo sapiens
agagtcagaaccaagatgaggc

SEQ ID NO: 7061773 - DNA, 22 bp, Homo sapiens
agagtcagcttatgacacagtc

SEQ ID NO: 7061774 - DNA, 22 bp, Homo sapiens
agagtcagttagcgaatactta

SEQ ID NO: 7061775 - DNA, 19 bp, Homo sapiens
agagtcggggggacatagg

SEQ ID NO: 7061776 - DNA, 21 bp, Homo sapiens
agagtctgagtgtgcaagggc

SEQ ID NO: 7061777 - DNA, 20 bp, Homo sapiens
agagtgagactccatctcag

SEQ ID NO: 7061778 - DNA, 22 bp, Homo sapiens
agagtgagggggcactgagacg

SEQ ID NO: 7061779 - DNA, 22 bp, Homo sapiens
agagtgcaaccgaaacaagcag

SEQ ID NO: 7061780 - DNA, 22 bp, Homo sapiens
agaggctgtctcatattttgta

SEQ ID NO: 7061781 - DNA, 22 bp, Homo sapiens
agaggggaaggatgtgatgtga

SEQ ID NO: 7061782 - DNA, 22 bp, Homo sapiens
agaggggaaggatgtgatgtga

SEQ ID NO: 7061783 - DNA, 22 bp, Homo sapiens
agaggctgggtacgggccacct

SEQ ID NO: 7061784 - DNA, 22 bp, Homo sapiens
agaggctgggaagggtccccgg

SEQ ID NO: 7061785 - DNA, 22 bp, Homo sapiens
agaggctgggcaggacccacag

SEQ ID NO: 7061786 - DNA, 22 bp, Homo sapiens
agaggctgggcaggacccacag

SEQ ID NO: 7061787 - DNA, 22 bp, Homo sapiens
agaggctgggtacgggccacct

SEQ ID NO: 7061788 - DNA, 16 bp, Homo sapiens
agaggctgtaatggaa

SEQ ID NO: 7061789 - DNA, 19 bp, Homo sapiens
agaggctgtcacctgtagc

SEQ ID NO: 7061790 - DNA, 16 bp, Homo sapiens
agaggctgtaatggaa

SEQ ID NO: 7061791 - DNA, 22 bp, Homo sapiens
agaggctgtcccttgctattcc

SEQ ID NO: 7061792 - DNA, 22 bp, Homo sapiens
agaggctgtcccttgctattcc

SEQ ID NO: 7061793 - DNA, 23 bp, Homo sapiens
agaggggagcatctgctggctga

SEQ ID NO: 7061794 - DNA, 23 bp, Homo sapiens
agaggggagcatctgctggctga

SEQ ID NO: 7061795 - DNA, 22 bp, Homo sapiens
agaggggaggcgaaccagagtc

SEQ ID NO: 7061796 - DNA, 22 bp, Homo sapiens
agaggggaggcgaaccagagtc

SEQ ID NO: 7061797 - DNA, 22 bp, Homo sapiens
agaggggaggcgaaccagagtc

SEQ ID NO: 7061798 - DNA, 22 bp, Homo sapiens
agaggggagtcctaatctgatt

SEQ ID NO: 7061799 - DNA, 22 bp, Homo sapiens
agaggggagtcctaatctgatt

SEQ ID NO: 7061800 - DNA, 22 bp, Homo sapiens
agaggtgacataggagaggctc

SEQ ID NO: 7061801 - DNA, 22 bp, Homo sapiens
agaggctgatggagtagtgtct

SEQ ID NO: 7061802 - DNA, 22 bp, Homo sapiens
agaggctgcacttgctcatgat

SEQ ID NO: 7061803 - DNA, 22 bp, Homo sapiens
agaggctgcacttgctcatgat

SEQ ID NO: 7061804 - DNA, 22 bp, Homo sapiens
agaggctgcacttgctcatgat

SEQ ID NO: 7061805 - DNA, 23 bp, Homo sapiens
agaggccagcctttggagacacc

SEQ ID NO: 7061806 - DNA, 22 bp, Homo sapiens
agaggccaggcagcccaaggtg

SEQ ID NO: 7061807 - DNA, 22 bp, Homo sapiens
agaggctgcaggctggaaatca

SEQ ID NO: 7061808 - DNA, 23 bp, Homo sapiens
agaggctgcagggtattgagaat

SEQ ID NO: 7061809 - DNA, 18 bp, Homo sapiens
agaggctggacaggggat

SEQ ID NO: 7061810 - DNA, 23 bp, Homo sapiens
agaggctgcagggtattgagaat

SEQ ID NO: 7061811 - DNA, 18 bp, Homo sapiens
agaggctggacaggggat

SEQ ID NO: 7061812 - DNA, 22 bp, Homo sapiens
agaggctggattgagcatagac

SEQ ID NO: 7061813 - DNA, 22 bp, Homo sapiens
agaggctggattgagcatagac

SEQ ID NO: 7061814 - DNA, 22 bp, Homo sapiens
agaggctggattgagcatagac

SEQ ID NO: 7061815 - DNA, 22 bp, Homo sapiens
agaggctgggaagggtccccgg

SEQ ID NO: 7061816 - DNA, 22 bp, Homo sapiens
attacacaggctggctctttga

SEQ ID NO: 7061817 - DNA, 20 bp, Homo sapiens
agagctgggaagctccctat

SEQ ID NO: 7061818 - DNA, 22 bp, Homo sapiens
agagctggctgtgggtgacttt

SEQ ID NO: 7061819 - DNA, 22 bp, Homo sapiens
agagctggctgtgggtgacttt

SEQ ID NO: 7061820 - DNA, 22 bp, Homo sapiens
agagctgggaccgtctggaagt

SEQ ID NO: 7061821 - DNA, 22 bp, Homo sapiens
agaggaggtccttttctgatgt

SEQ ID NO: 7061822 - DNA, 22 bp, Homo sapiens
agaggcaagattatcagggcat

SEQ ID NO: 7061823 - DNA, 22 bp, Homo sapiens
agaggcaaggcaggattcttct

SEQ ID NO: 7061824 - DNA, 19 bp, Homo sapiens
agaggcaagggctcatgac

SEQ ID NO: 7061825 - DNA, 19 bp, Homo sapiens
agaggcaagggtggaagta

SEQ ID NO: 7061826 - DNA, 22 bp, Homo sapiens
agaggcaatgaaagcagtctct

SEQ ID NO: 7061827 - DNA, 22 bp, Homo sapiens
agagccaggcggctgggcacct

SEQ ID NO: 7061828 - DNA, 22 bp, Homo sapiens
agagccaggccaggccggggca

SEQ ID NO: 7061829 - DNA, 22 bp, Homo sapiens
agagcccatcagtggcagtgga

SEQ ID NO: 7061830 - DNA, 22 bp, Homo sapiens
agagcccctcggtggaggggtc

SEQ ID NO: 7061831 - DNA, 22 bp, Homo sapiens
agagcccctggtggagtgagaa

SEQ ID NO: 7061832 - DNA, 22 bp, Homo sapiens
agagcagatggagctggaagag

SEQ ID NO: 7061833 - DNA, 22 bp, Homo sapiens
agagagttctttctagttgaag

SEQ ID NO: 7061834 - DNA, 22 bp, Homo sapiens
agagagttctttctagttgaag

SEQ ID NO: 7061835 - DNA, 22 bp, Homo sapiens
agagcacatggttcctgtgtcc

SEQ ID NO: 7061836 - DNA, 22 bp, Homo sapiens
agagcagagggctctgggacaa

SEQ ID NO: 7061837 - DNA, 22 bp, Homo sapiens
agagctggcagcagcttctcct

SEQ ID NO: 7061838 - DNA, 22 bp, Homo sapiens
agagctggatggtcaagatggc

SEQ ID NO: 7061839 - DNA, 22 bp, Homo sapiens
agagctggatggtcaagatggc

SEQ ID NO: 7061840 - DNA, 22 bp, Homo sapiens
agagctggatggtcaagatggc

SEQ ID NO: 7061841 - DNA, 22 bp, Homo sapiens
agagctggagatgcaggtttcg

SEQ ID NO: 7061842 - DNA, 22 bp, Homo sapiens
agagctggacgtctgagcccta

SEQ ID NO: 7061843 - DNA, 22 bp, Homo sapiens
agagctggaatcagacctcagg

SEQ ID NO: 7061844 - DNA, 21 bp, Homo sapiens
agagctggcctgccaggccct

SEQ ID NO: 7061845 - DNA, 22 bp, Homo sapiens
agagctggctggtagccctgat

SEQ ID NO: 7061846 - DNA, 22 bp, Homo sapiens
agagctggctgctgcggtgctt

SEQ ID NO: 7061847 - DNA, 22 bp, Homo sapiens
agagctggctgtgggtgacttt

SEQ ID NO: 7061848 - DNA, 22 bp, Homo sapiens
agagctggctggtagccctgat

SEQ ID NO: 7061849 - DNA, 22 bp, Homo sapiens
agagccctctcattggcttatt

SEQ ID NO: 7061850 - DNA, 22 bp, Homo sapiens
agagccctgacggggacagatg

SEQ ID NO: 7061851 - DNA, 22 bp, Homo sapiens
agagccctggagggcagtcccg

SEQ ID NO: 7061852 - DNA, 21 bp, Homo sapiens
agagcctgagatcttccagca

SEQ ID NO: 7061853 - DNA, 22 bp, Homo sapiens
agagcctgagcctgaaagccct

SEQ ID NO: 7061854 - DNA, 22 bp, Homo sapiens
agagcctgaggccctgagaggg

SEQ ID NO: 7061855 - DNA, 22 bp, Homo sapiens
agagcctgaggccctgagaggg

SEQ ID NO: 7061856 - DNA, 22 bp, Homo sapiens
agagagggaatatttggggtat

SEQ ID NO: 7061857 - DNA, 21 bp, Homo sapiens
agagagggagatgaaacatcc

SEQ ID NO: 7061858 - DNA, 22 bp, Homo sapiens
agagagggcatagaaaaaggga

SEQ ID NO: 7061859 - DNA, 22 bp, Homo sapiens
agagagcccgggccagggcaca

SEQ ID NO: 7061860 - DNA, 22 bp, Homo sapiens
agagagcccgggccagggcaca

SEQ ID NO: 7061861 - DNA, 22 bp, Homo sapiens
agagagctgactttggagtcag

SEQ ID NO: 7061862 - DNA, 22 bp, Homo sapiens
agagaattaacattccatggct

SEQ ID NO: 7061863 - DNA, 22 bp, Homo sapiens
agagaattctggtgctaacaag

SEQ ID NO: 7061864 - DNA, 22 bp, Homo sapiens
agagacaaacactgcaacttct

SEQ ID NO: 7061865 - DNA, 22 bp, Homo sapiens
agagacaccgcgcatcatggct

SEQ ID NO: 7061866 - DNA, 22 bp, Homo sapiens
agagacagacacatcgggctgc

SEQ ID NO: 7061867 - DNA, 21 bp, Homo sapiens
agagacagagaaagtaacatt

SEQ ID NO: 7061868 - DNA, 21 bp, Homo sapiens
agagacagagaaagtaacatt

SEQ ID NO: 7061869 - DNA, 21 bp, Homo sapiens
agagacagagaaagtaacatt

SEQ ID NO: 7061870 - DNA, 21 bp, Homo sapiens
agagagaaggccatatggtcc

SEQ ID NO: 7061871 - DNA, 18 bp, Homo sapiens
agactttgagttagaggg

SEQ ID NO: 7061872 - DNA, 22 bp, Homo sapiens
agagaaaactcattgaggtgtc

SEQ ID NO: 7061873 - DNA, 22 bp, Homo sapiens
agagaaaagagttcaggctttg

SEQ ID NO: 7061874 - DNA, 22 bp, Homo sapiens
agagaaaagagttcaggctttg

SEQ ID NO: 7061875 - DNA, 19 bp, Homo sapiens
agagaaggatcctatggtt

SEQ ID NO: 7061876 - DNA, 22 bp, Homo sapiens
agagaagggtgtagcctgggcc

SEQ ID NO: 7061877 - DNA, 22 bp, Homo sapiens
agagaaggtcactaaggaccca

SEQ ID NO: 7061878 - DNA, 22 bp, Homo sapiens
agagaagtgagcttgttcactc

SEQ ID NO: 7061879 - DNA, 22 bp, Homo sapiens
agagaatacaaagaagatatgt

SEQ ID NO: 7061880 - DNA, 22 bp, Homo sapiens
agagaatacaaagaagatatgt

SEQ ID NO: 7061881 - DNA, 22 bp, Homo sapiens
agagaatgcagggcttcggaca

SEQ ID NO: 7061882 - DNA, 22 bp, Homo sapiens
agacaactagaaaactagacag

SEQ ID NO: 7061883 - DNA, 22 bp, Homo sapiens
agacaagactaggcagttgttg

SEQ ID NO: 7061884 - DNA, 22 bp, Homo sapiens
agacaaggcaaggcggccagat

SEQ ID NO: 7061885 - DNA, 22 bp, Homo sapiens
agacaatacatttattcccttt

SEQ ID NO: 7061886 - DNA, 23 bp, Homo sapiens
agacactgtaaagaattgcagtt

SEQ ID NO: 7061887 - DNA, 22 bp, Homo sapiens
agacactgttctcacatgcttg

SEQ ID NO: 7061888 - DNA, 21 bp, Homo sapiens
agacagaacaactgctctcca

SEQ ID NO: 7061889 - DNA, 22 bp, Homo sapiens
atgagggaggcaaggagatgct

SEQ ID NO: 7061890 - DNA, 22 bp, Homo sapiens
atgaggctatgaatggggagat

SEQ ID NO: 7061891 - DNA, 22 bp, Homo sapiens
atgaggcagagggctgtgccag

SEQ ID NO: 7061892 - DNA, 22 bp, Homo sapiens
atgaggccagggtgccatgaaa

SEQ ID NO: 7061893 - DNA, 22 bp, Homo sapiens
agaatatagttaccaaattctg

SEQ ID NO: 7061894 - DNA, 22 bp, Homo sapiens
atgaagttccagtatatgcagt

SEQ ID NO: 7061895 - DNA, 22 bp, Homo sapiens
atgaagttctagtgagaaatgc

SEQ ID NO: 7061896 - DNA, 22 bp, Homo sapiens
atgaaggacaacaggggagcag

SEQ ID NO: 7061897 - DNA, 22 bp, Homo sapiens
atgaaggatagggcaaaatttt

SEQ ID NO: 7061898 - DNA, 22 bp, Homo sapiens
atgaaggatggctggctgccct

SEQ ID NO: 7061899 - DNA, 22 bp, Homo sapiens
atgaagtctagcaagcattgaa

SEQ ID NO: 7061900 - DNA, 22 bp, Homo sapiens
atgaagtctctttttcatgaga

SEQ ID NO: 7061901 - DNA, 22 bp, Homo sapiens
atctgcctccaagtccatgtgt

SEQ ID NO: 7061902 - DNA, 22 bp, Homo sapiens
atctgcctccaagtccatgtgt

SEQ ID NO: 7061903 - DNA, 22 bp, Homo sapiens
atctgcctccaagtccatgtgt

SEQ ID NO: 7061904 - DNA, 22 bp, Homo sapiens
atctgcctcttcttcattgcga

SEQ ID NO: 7061905 - DNA, 22 bp, Homo sapiens
atctgcctcttcttcattgcga

SEQ ID NO: 7061906 - DNA, 22 bp, Homo sapiens
atctgcctgagtctaggttttc

SEQ ID NO: 7061907 - DNA, 22 bp, Homo sapiens
atctgcctgagtctaggttttc

SEQ ID NO: 7061908 - DNA, 22 bp, Homo sapiens
atctgcctgcagtggaggtggg

SEQ ID NO: 7061909 - DNA, 22 bp, Homo sapiens
atctgcctgcagtggaggtggg

SEQ ID NO: 7061910 - DNA, 22 bp, Homo sapiens
atctgcctgcagtggaggtggg

SEQ ID NO: 7061911 - DNA, 22 bp, Homo sapiens
atctgcctgcttatgatgcctg

SEQ ID NO: 7061912 - DNA, 22 bp, Homo sapiens
atctgcctggctccaggtgagc

SEQ ID NO: 7061913 - DNA, 22 bp, Homo sapiens
atctgcctggctccaggtgagc

SEQ ID NO: 7061914 - DNA, 22 bp, Homo sapiens
atctgcctggctccaggtgagc

SEQ ID NO: 7061915 - DNA, 22 bp, Homo sapiens
atctgcctggtctttgatgcag

SEQ ID NO: 7061916 - DNA, 22 bp, Homo sapiens
atctgcctgtatttaccatcat

SEQ ID NO: 7061917 - DNA, 22 bp, Homo sapiens
atctgcctgtatttaccatcat

SEQ ID NO: 7061918 - DNA, 19 bp, Homo sapiens
atctgcctgttatcacata

SEQ ID NO: 7061919 - DNA, 19 bp, Homo sapiens
atctgcctgttatcacata

SEQ ID NO: 7061920 - DNA, 19 bp, Homo sapiens
atctgccttagtgctgctg

SEQ ID NO: 7061921 - DNA, 19 bp, Homo sapiens
atctgccttagtgctgctg

SEQ ID NO: 7061922 - DNA, 22 bp, Homo sapiens
atctgcttcctgggctccatga

SEQ ID NO: 7061923 - DNA, 22 bp, Homo sapiens
atctgcttcctgggctccatga

SEQ ID NO: 7061924 - DNA, 22 bp, Homo sapiens
atctgcttgaaacttcttatac

SEQ ID NO: 7061925 - DNA, 22 bp, Homo sapiens
atctgcttgagtttgaagtcag

SEQ ID NO: 7061926 - DNA, 22 bp, Homo sapiens
atgaacaatgactacatattga

SEQ ID NO: 7061927 - DNA, 22 bp, Homo sapiens
atgcaggtccaaacgctagtgt

SEQ ID NO: 7061928 - DNA, 22 bp, Homo sapiens
atgcaggttgggcaagtgtggg

SEQ ID NO: 7061929 - DNA, 22 bp, Homo sapiens
atgcatatggcttgagggaata

SEQ ID NO: 7061930 - DNA, 22 bp, Homo sapiens
atgcatatgtacccatgttctg

SEQ ID NO: 7061931 - DNA, 22 bp, Homo sapiens
atgatatacttcctagaacagt

SEQ ID NO: 7061932 - DNA, 22 bp, Homo sapiens
atgatatacttcctagaacagt

SEQ ID NO: 7061933 - DNA, 22 bp, Homo sapiens
atgatacattgcaaaattttaa

SEQ ID NO: 7061934 - DNA, 22 bp, Homo sapiens
atgatacattgcaaaattttaa

SEQ ID NO: 7061935 - DNA, 22 bp, Homo sapiens
atgatacatcttcatgtcagtg

SEQ ID NO: 7061936 - DNA, 22 bp, Homo sapiens
atgcatttttgagtatgaatga

SEQ ID NO: 7061937 - DNA, 22 bp, Homo sapiens
atgcatttttgagtatgaatga

SEQ ID NO: 7061938 - DNA, 22 bp, Homo sapiens
atgcatttgtaaaatataatcg

SEQ ID NO: 7061939 - DNA, 22 bp, Homo sapiens
atgcatattttctactatatcg

SEQ ID NO: 7061940 - DNA, 22 bp, Homo sapiens
atgcatattttctgttggtgac

SEQ ID NO: 7061941 - DNA, 22 bp, Homo sapiens
atgcatttgtaaaatataatcg

SEQ ID NO: 7061942 - DNA, 22 bp, Homo sapiens
atgcatatgtacccatgttctg

SEQ ID NO: 7061943 - DNA, 22 bp, Homo sapiens
atgcatatgtacccatgttctg

SEQ ID NO: 7061944 - DNA, 22 bp, Homo sapiens
atgcatatgtacttgcatatgt

SEQ ID NO: 7061945 - DNA, 22 bp, Homo sapiens
atgcatatgtgtgcacacgtgt

SEQ ID NO: 7061946 - DNA, 22 bp, Homo sapiens
atgcatattcttagcccctcct

SEQ ID NO: 7061947 - DNA, 22 bp, Homo sapiens
atgcatattgattatagattca

SEQ ID NO: 7061948 - DNA, 22 bp, Homo sapiens
atgcatattggattagcagcca

SEQ ID NO: 7061949 - DNA, 22 bp, Homo sapiens
atgcatattgtcatttagtcct

SEQ ID NO: 7061950 - DNA, 22 bp, Homo sapiens
atgcatattgtcatttagtcct

SEQ ID NO: 7061951 - DNA, 22 bp, Homo sapiens
atgcatatttcatgaatctttg

SEQ ID NO: 7061952 - DNA, 22 bp, Homo sapiens
atgcatatttcttggagcacct

SEQ ID NO: 7061953 - DNA, 22 bp, Homo sapiens
atgcatatttcttgggcttacc

SEQ ID NO: 7061954 - DNA, 18 bp, Homo sapiens
atgcatattttaagttgt

SEQ ID NO: 7061955 - DNA, 21 bp, Homo sapiens
atgcatattttaagttgtgtc

SEQ ID NO: 7061956 - DNA, 21 bp, Homo sapiens
atgcatattttaagttgtgtc

SEQ ID NO: 7061957 - DNA, 22 bp, Homo sapiens
atgcatattttctactatatcg

SEQ ID NO: 7061958 - DNA, 22 bp, Homo sapiens
atgcatattttctactatatcg

SEQ ID NO: 7061959 - DNA, 22 bp, Homo sapiens
atgcgagtgatgcagagtggct

SEQ ID NO: 7061960 - DNA, 22 bp, Homo sapiens
atgcctttgccacagattagga

SEQ ID NO: 7061961 - DNA, 22 bp, Homo sapiens
agactgggtttgagacttagca

SEQ ID NO: 7061962 - DNA, 22 bp, Homo sapiens
agacctggaagttcaagagaaa

SEQ ID NO: 7061963 - DNA, 22 bp, Homo sapiens
agacctggatgtgagggaagta

SEQ ID NO: 7061964 - DNA, 22 bp, Homo sapiens
agacctgggtgccctgtgcttt

SEQ ID NO: 7061965 - DNA, 22 bp, Homo sapiens
agacctgggttcgagtcctaac

SEQ ID NO: 7061966 - DNA, 22 bp, Homo sapiens
agacctggtgatagctgtccta

SEQ ID NO: 7061967 - DNA, 22 bp, Homo sapiens
agacctggtttatcaccagcat

SEQ ID NO: 7061968 - DNA, 22 bp, Homo sapiens
agacctgtgatcacatggaatg

SEQ ID NO: 7061969 - DNA, 22 bp, Homo sapiens
agacctgttgggttcattggct

SEQ ID NO: 7061970 - DNA, 22 bp, Homo sapiens
actctccttttgatcttcagaa

SEQ ID NO: 7061971 - DNA, 22 bp, Homo sapiens
actctctcacacacgcctatat

SEQ ID NO: 7061972 - DNA, 22 bp, Homo sapiens
actctctcacagcttggctgat

SEQ ID NO: 7061973 - DNA, 22 bp, Homo sapiens
actctctctgatggaactttag

SEQ ID NO: 7061974 - DNA, 22 bp, Homo sapiens
actctctgagctaccaggtgag

SEQ ID NO: 7061975 - DNA, 22 bp, Homo sapiens
actctctgggcatgccccacca

SEQ ID NO: 7061976 - DNA, 22 bp, Homo sapiens
actctctggtattggcaagttt

SEQ ID NO: 7061977 - DNA, 22 bp, Homo sapiens
actctctggtgtagaaagacct

SEQ ID NO: 7061978 - DNA, 22 bp, Homo sapiens
actctctgtctaaatgcagttt

SEQ ID NO: 7061979 - DNA, 22 bp, Homo sapiens
actctctgtgatggaggccagc

SEQ ID NO: 7061980 - DNA, 22 bp, Homo sapiens
actctctgtgatggaggccagc

SEQ ID NO: 7061981 - DNA, 22 bp, Homo sapiens
actctcttgggggagagcagag

SEQ ID NO: 7061982 - DNA, 22 bp, Homo sapiens
agtcactgctttgtccctgtgt

SEQ ID NO: 7061983 - DNA, 22 bp, Homo sapiens
agtcactgaataccttaatgtt

SEQ ID NO: 7061984 - DNA, 22 bp, Homo sapiens
agtcactgagatggtgaggcta

SEQ ID NO: 7061985 - DNA, 22 bp, Homo sapiens
agtcactgtcaaagccacacac

SEQ ID NO: 7061986 - DNA, 22 bp, Homo sapiens
agtcactgtcttgcaaaggtca

SEQ ID NO: 7061987 - DNA, 22 bp, Homo sapiens
agtcactgttctgtcatgtcaa

SEQ ID NO: 7061988 - DNA, 21 bp, Homo sapiens
actccctgcataagtgattta

SEQ ID NO: 7061989 - DNA, 22 bp, Homo sapiens
actcctcagccagcatcaggga

SEQ ID NO: 7061990 - DNA, 22 bp, Homo sapiens
agtcaccatctgtggcagcctg

SEQ ID NO: 7061991 - DNA, 22 bp, Homo sapiens
agtatacagtaatgacatatct

SEQ ID NO: 7061992 - DNA, 22 bp, Homo sapiens
agtatacaaataaatgtgtaat

SEQ ID NO: 7061993 - DNA, 22 bp, Homo sapiens
agtataattagatatcaaaagt

SEQ ID NO: 7061994 - DNA, 22 bp, Homo sapiens
agtaataatttatattagggag

SEQ ID NO: 7061995 - DNA, 22 bp, Homo sapiens
agtaccattatccagtaaagga

SEQ ID NO: 7061996 - DNA, 22 bp, Homo sapiens
aggtggggaaaccagcgatccc

SEQ ID NO: 7061997 - DNA, 22 bp, Homo sapiens
aggtgggcggattcatgaggtc

SEQ ID NO: 7061998 - DNA, 22 bp, Homo sapiens
aggtgggcttggtgccaacatg

SEQ ID NO: 7061999 - DNA, 22 bp, Homo sapiens
aggtgggcggattcatgaggtc

SEQ ID NO: 7062000 - DNA, 22 bp, Homo sapiens
aggtgggcactccgctcgaggt

SEQ ID NO: 7062001 - DNA, 21 bp, Homo sapiens
aggtgggcaggtggagtggcc

SEQ ID NO: 7062002 - DNA, 22 bp, Homo sapiens
actagaaagtttccagagttat

SEQ ID NO: 7062003 - DNA, 22 bp, Homo sapiens
actagaaattactcagaataaa

SEQ ID NO: 7062004 - DNA, 22 bp, Homo sapiens
actacagtgtgataagaggggc

SEQ ID NO: 7062005 - DNA, 22 bp, Homo sapiens
actacatcttgcatatctataa

SEQ ID NO: 7062006 - DNA, 22 bp, Homo sapiens
aggtgagaaaacgagggttgca

SEQ ID NO: 7062007 - DNA, 22 bp, Homo sapiens
actaaatatttgagaggtgtag

SEQ ID NO: 7062008 - DNA, 22 bp, Homo sapiens
aggtgactggtttatctggcag

SEQ ID NO: 7062009 - DNA, 22 bp, Homo sapiens
aggtgacaggacaggagctggt

SEQ ID NO: 7062010 - DNA, 22 bp, Homo sapiens
aggtgacaggacaggagctggt

SEQ ID NO: 7062011 - DNA, 22 bp, Homo sapiens
aggtgacatcccggcagcagag

SEQ ID NO: 7062012 - DNA, 22 bp, Homo sapiens
accttttttcagaactctaaag

SEQ ID NO: 7062013 - DNA, 22 bp, Homo sapiens
acctttggataatctttgtgtt

SEQ ID NO: 7062014 - DNA, 22 bp, Homo sapiens
acctttggataatttgagtttg

SEQ ID NO: 7062015 - DNA, 21 bp, Homo sapiens
acctttgggtgtttataatag

SEQ ID NO: 7062016 - DNA, 22 bp, Homo sapiens
acctttggtaagtttccaaaac

SEQ ID NO: 7062017 - DNA, 22 bp, Homo sapiens
acctttggtcatttacttttca

SEQ ID NO: 7062018 - DNA, 22 bp, Homo sapiens
acctttttgttctgttctcagc

SEQ ID NO: 7062019 - DNA, 22 bp, Homo sapiens
accttcctctaagacatttagc

SEQ ID NO: 7062020 - DNA, 22 bp, Homo sapiens
accttctgaccagttatcttga

SEQ ID NO: 7062021 - DNA, 22 bp, Homo sapiens
acctttcaaagtggctatcact

SEQ ID NO: 7062022 - DNA, 20 bp, Homo sapiens
acctttcaaatgattcagca

SEQ ID NO: 7062023 - DNA, 22 bp, Homo sapiens
acctttcacggtatcagacatc

SEQ ID NO: 7062024 - DNA, 22 bp, Homo sapiens
acctttcattaaagtctgtagt

SEQ ID NO: 7062025 - DNA, 21 bp, Homo sapiens
acctttggaaagaccctggga

SEQ ID NO: 7062026 - DNA, 22 bp, Homo sapiens
acctttggaaataaacactctg

SEQ ID NO: 7062027 - DNA, 22 bp, Homo sapiens
acctttggagcatgcattttct

SEQ ID NO: 7062028 - DNA, 22 bp, Homo sapiens
acctttggaggactagggtcat

SEQ ID NO: 7062029 - DNA, 20 bp, Homo sapiens
aggtccactgaggctgcctc

SEQ ID NO: 7062030 - DNA, 22 bp, Homo sapiens
aggtattttatagataagtaaa

SEQ ID NO: 7062031 - DNA, 22 bp, Homo sapiens
aggtccacagttcagctgccca

SEQ ID NO: 7062032 - DNA, 22 bp, Homo sapiens
agtgctcactctccacagtgcc

SEQ ID NO: 7062033 - DNA, 22 bp, Homo sapiens
agtgctcataaaaatgtgaaac

SEQ ID NO: 7062034 - DNA, 22 bp, Homo sapiens
agtgctctaacagtcaaaaaag

SEQ ID NO: 7062035 - DNA, 22 bp, Homo sapiens
agtgaatacatgtcactcagca

SEQ ID NO: 7062036 - DNA, 20 bp, Homo sapiens
agtgaatagagacattgccc

SEQ ID NO: 7062037 - DNA, 22 bp, Homo sapiens
actctgaaccagagatcatacc

SEQ ID NO: 7062038 - DNA, 21 bp, Homo sapiens
actctgccagtctcctgcact

SEQ ID NO: 7062039 - DNA, 22 bp, Homo sapiens
actctgccatcccaggtgctgt

SEQ ID NO: 7062040 - DNA, 22 bp, Homo sapiens
actctgccccgagttctgggaa

SEQ ID NO: 7062041 - DNA, 22 bp, Homo sapiens
actctgcctgaacctcctgcaa

SEQ ID NO: 7062042 - DNA, 22 bp, Homo sapiens
actctgcctttcagcagatgaa

SEQ ID NO: 7062043 - DNA, 22 bp, Homo sapiens
agtgaaatttgtttagataggt

SEQ ID NO: 7062044 - DNA, 22 bp, Homo sapiens
agtgaagaggaagtggggcaca

SEQ ID NO: 7062045 - DNA, 22 bp, Homo sapiens
actgggcctgtacagagaaaac

SEQ ID NO: 7062046 - DNA, 22 bp, Homo sapiens
actgggccagatcagagcaact

SEQ ID NO: 7062047 - DNA, 22 bp, Homo sapiens
actgggcatgatgagtcaccta

SEQ ID NO: 7062048 - DNA, 22 bp, Homo sapiens
actgggcattttgaacgttctt

SEQ ID NO: 7062049 - DNA, 22 bp, Homo sapiens
actgggcagggaaggagaccga

SEQ ID NO: 7062050 - DNA, 22 bp, Homo sapiens
actgggcagcagctcgagccgc

SEQ ID NO: 7062051 - DNA, 20 bp, Homo sapiens
actgggcatacctgtcctgt

SEQ ID NO: 7062052 - DNA, 22 bp, Homo sapiens
actggctgtggccacggctgct

SEQ ID NO: 7062053 - DNA, 22 bp, Homo sapiens
actggcttggcaggaggaagat

SEQ ID NO: 7062054 - DNA, 22 bp, Homo sapiens
actgcccagtgattggtggtta

SEQ ID NO: 7062055 - DNA, 22 bp, Homo sapiens
actgccctcccatctattgcaa

SEQ ID NO: 7062056 - DNA, 22 bp, Homo sapiens
actgccctgtaactgccaggta

SEQ ID NO: 7062057 - DNA, 22 bp, Homo sapiens
actgcccttgtcctggcacacc

SEQ ID NO: 7062058 - DNA, 22 bp, Homo sapiens
actgcctcttggtgctgagaga

SEQ ID NO: 7062059 - DNA, 22 bp, Homo sapiens
actgcctcttggtgctgagaga

SEQ ID NO: 7062060 - DNA, 22 bp, Homo sapiens
actgcctgagctattggaaaag

SEQ ID NO: 7062061 - DNA, 22 bp, Homo sapiens
actgccattggtcaaatgagtg

SEQ ID NO: 7062062 - DNA, 22 bp, Homo sapiens
actgcctgatgtggttctaaat

SEQ ID NO: 7062063 - DNA, 19 bp, Homo sapiens
actgcctgcaggtgttggg

SEQ ID NO: 7062064 - DNA, 22 bp, Homo sapiens
actgcctgcatccttagggtag

SEQ ID NO: 7062065 - DNA, 22 bp, Homo sapiens
actgcctgcctctgattctgca

SEQ ID NO: 7062066 - DNA, 22 bp, Homo sapiens
actgcctgctcataacattgct

SEQ ID NO: 7062067 - DNA, 22 bp, Homo sapiens
actgcctggcagaggtttgcaa

SEQ ID NO: 7062068 - DNA, 22 bp, Homo sapiens
actggctgcgttcctgtgagac

SEQ ID NO: 7062069 - DNA, 22 bp, Homo sapiens
agaacctgcctttactctcctt

SEQ ID NO: 7062070 - DNA, 22 bp, Homo sapiens
atctcagggctggagccctgga

SEQ ID NO: 7062071 - DNA, 22 bp, Homo sapiens
atctctggcaatgcagcatcgt

SEQ ID NO: 7062072 - DNA, 22 bp, Homo sapiens
atctctggcccctggggtccga

SEQ ID NO: 7062073 - DNA, 22 bp, Homo sapiens
atccagctttgtctggtcttcg

SEQ ID NO: 7062074 - DNA, 22 bp, Homo sapiens
atccaggcattctgacttcaag

SEQ ID NO: 7062075 - DNA, 19 bp, Homo sapiens
atcccaaggagctgggact

SEQ ID NO: 7062076 - DNA, 22 bp, Homo sapiens
atcccagatagtgaccctcagg

SEQ ID NO: 7062077 - DNA, 22 bp, Homo sapiens
atctctggccttccttttccaa

SEQ ID NO: 7062078 - DNA, 22 bp, Homo sapiens
atctctgggctttgagtttgtt

SEQ ID NO: 7062079 - DNA, 22 bp, Homo sapiens
atctctgggtccatagaagaga

SEQ ID NO: 7062080 - DNA, 22 bp, Homo sapiens
atctctggtccaaatgttacct

SEQ ID NO: 7062081 - DNA, 22 bp, Homo sapiens
atctctggttgttttgctccca

SEQ ID NO: 7062082 - DNA, 21 bp, Homo sapiens
atctcttcaaggctgatttac

SEQ ID NO: 7062083 - DNA, 22 bp, Homo sapiens
agaagccaacagggcaggagag

SEQ ID NO: 7062084 - DNA, 20 bp, Homo sapiens
agaagccaagtgacatgttt

SEQ ID NO: 7062085 - DNA, 22 bp, Homo sapiens
agaagccaatcagctctctgct

SEQ ID NO: 7062086 - DNA, 22 bp, Homo sapiens
agaagccaatccttgtctctct

SEQ ID NO: 7062087 - DNA, 22 bp, Homo sapiens
agaagccaattctgtgtgagtc

SEQ ID NO: 7062088 - DNA, 22 bp, Homo sapiens
agaagccaattctgtgtgagtc

SEQ ID NO: 7062089 - DNA, 22 bp, Homo sapiens
agaagccacaggcctcgtctgg

SEQ ID NO: 7062090 - DNA, 22 bp, Homo sapiens
agaagccaccagctgaggaaga

SEQ ID NO: 7062091 - DNA, 22 bp, Homo sapiens
agaaggcactcacactggcacg

SEQ ID NO: 7062092 - DNA, 22 bp, Homo sapiens
agaaggcagatgggacggagca

SEQ ID NO: 7062093 - DNA, 22 bp, Homo sapiens
atctgccaatgccatgagaaga

SEQ ID NO: 7062094 - DNA, 22 bp, Homo sapiens
atcaaaaccttgacttttaatg

SEQ ID NO: 7062095 - DNA, 22 bp, Homo sapiens
atcaaaaccttgacttttaatg

SEQ ID NO: 7062096 - DNA, 22 bp, Homo sapiens
atattttgtaacttggaatagg

SEQ ID NO: 7062097 - DNA, 21 bp, Homo sapiens
agaaaaaccagcatgttttca

SEQ ID NO: 7062098 - DNA, 22 bp, Homo sapiens
agaaaaagtcaaggaattggac

SEQ ID NO: 7062099 - DNA, 22 bp, Homo sapiens
atatttctccaaatgttttcaa

SEQ ID NO: 7062100 - DNA, 22 bp, Homo sapiens
atatttctccaaatgttttcaa

SEQ ID NO: 7062101 - DNA, 22 bp, Homo sapiens
actttttgctggtctcttccat

SEQ ID NO: 7062102 - DNA, 22 bp, Homo sapiens
actttttacagggtgtatacca

SEQ ID NO: 7062103 - DNA, 22 bp, Homo sapiens
actttttgcatagtaagtgtct

SEQ ID NO: 7062104 - DNA, 22 bp, Homo sapiens
acttttggttctgtaactgtga

SEQ ID NO: 7062105 - DNA, 22 bp, Homo sapiens
actttttacagggtgtatacca

SEQ ID NO: 7062106 - DNA, 23 bp, Homo sapiens
acttttcaattagctatgcttaa

SEQ ID NO: 7062107 - DNA, 20 bp, Homo sapiens
atcaaaatcctattgaggtt

SEQ ID NO: 7062108 - DNA, 22 bp, Homo sapiens
agaaagcactctgtcttttacc

SEQ ID NO: 7062109 - DNA, 22 bp, Homo sapiens
agaaagcactctgtcttttacc

SEQ ID NO: 7062110 - DNA, 22 bp, Homo sapiens
agaaagcagcatttatgatctc

SEQ ID NO: 7062111 - DNA, 22 bp, Homo sapiens
atcagttatttttaagctataa

SEQ ID NO: 7062112 - DNA, 22 bp, Homo sapiens
atcagttatttttaagctataa

SEQ ID NO: 7062113 - DNA, 22 bp, Homo sapiens
agaaatcatgtcttatttctat

SEQ ID NO: 7062114 - DNA, 22 bp, Homo sapiens
actgttgtcaggctgctttgga

SEQ ID NO: 7062115 - DNA, 22 bp, Homo sapiens
ataaaaactgacccatcctttg

SEQ ID NO: 7062116 - DNA, 21 bp, Homo sapiens
agtttttactcttaactgtgg

SEQ ID NO: 7062117 - DNA, 18 bp, Homo sapiens
agtttttaggaagaaatg

SEQ ID NO: 7062118 - DNA, 23 bp, Homo sapiens
agtttttaatggtcatagctgag

SEQ ID NO: 7062119 - DNA, 23 bp, Homo sapiens
agtttttaatggtcatagctgag

SEQ ID NO: 7062120 - DNA, 22 bp, Homo sapiens
agttttatgtagacaattcatt

SEQ ID NO: 7062121 - DNA, 22 bp, Homo sapiens
agttttatggctcaacctaata

SEQ ID NO: 7062122 - DNA, 22 bp, Homo sapiens
agttttatgtagacaattcatt

SEQ ID NO: 7062123 - DNA, 22 bp, Homo sapiens
agttttatgttcacagaaggat

SEQ ID NO: 7062124 - DNA, 22 bp, Homo sapiens
agttttatgcagtgttctgata

SEQ ID NO: 7062125 - DNA, 22 bp, Homo sapiens
agttttatggctcaacctaata

SEQ ID NO: 7062126 - DNA, 22 bp, Homo sapiens
agttttatggctcaacctaata

SEQ ID NO: 7062127 - DNA, 22 bp, Homo sapiens
agttttatgcagtgttctgata

SEQ ID NO: 7062128 - DNA, 22 bp, Homo sapiens
agttttatgcagtgttctgata

SEQ ID NO: 7062129 - DNA, 22 bp, Homo sapiens
agttttatctgtaagctgttca

SEQ ID NO: 7062130 - DNA, 22 bp, Homo sapiens
agttttatgcagtgttctgata

SEQ ID NO: 7062131 - DNA, 21 bp, Homo sapiens
agttttatattataagctaaa

SEQ ID NO: 7062132 - DNA, 21 bp, Homo sapiens
agttttatattataagctaaa

SEQ ID NO: 7062133 - DNA, 22 bp, Homo sapiens
agttttatctgtaagctgttca

SEQ ID NO: 7062134 - DNA, 21 bp, Homo sapiens
agttttatattataagctaaa

SEQ ID NO: 7062135 - DNA, 22 bp, Homo sapiens
agttttatatcttccattggtt

SEQ ID NO: 7062136 - DNA, 22 bp, Homo sapiens
agttttataaaggcacctcagt

SEQ ID NO: 7062137 - DNA, 22 bp, Homo sapiens
agttttataaaggcacctcagt

SEQ ID NO: 7062138 - DNA, 22 bp, Homo sapiens
agttttatatcttccattggtt

SEQ ID NO: 7062139 - DNA, 22 bp, Homo sapiens
agtttctagcaaggattgttga

SEQ ID NO: 7062140 - DNA, 22 bp, Homo sapiens
agttttaaatgatggtggtggt

SEQ ID NO: 7062141 - DNA, 22 bp, Homo sapiens
acttaaaggttagctattctac

SEQ ID NO: 7062142 - DNA, 22 bp, Homo sapiens
ataaagtcaaggcattttatga

SEQ ID NO: 7062143 - DNA, 22 bp, Homo sapiens
ataaagtcaaggcattttatga

SEQ ID NO: 7062144 - DNA, 22 bp, Homo sapiens
ataaagtcatggcagctagaat

SEQ ID NO: 7062145 - DNA, 22 bp, Homo sapiens
ataaagtcatggcagctagaat

SEQ ID NO: 7062146 - DNA, 22 bp, Homo sapiens
acttccttgtcaggtgcatcat

SEQ ID NO: 7062147 - DNA, 22 bp, Homo sapiens
acttccttttcaaccatacagc

SEQ ID NO: 7062148 - DNA, 22 bp, Homo sapiens
acttctaatcagaaggtctggt

SEQ ID NO: 7062149 - DNA, 22 bp, Homo sapiens
acttcctgggcatgcagagtcc

SEQ ID NO: 7062150 - DNA, 22 bp, Homo sapiens
acttcctgtgttggtcttgctg

SEQ ID NO: 7062151 - DNA, 22 bp, Homo sapiens
ataaagttctgctggcatatat

SEQ ID NO: 7062152 - DNA, 19 bp, Homo sapiens
ataaataaaaagtgggaga

SEQ ID NO: 7062153 - DNA, 19 bp, Homo sapiens
ataaataaaaagtgggaga

SEQ ID NO: 7062154 - DNA, 22 bp, Homo sapiens
actttgttcctttcacaaagaa

SEQ ID NO: 7062155 - DNA, 22 bp, Homo sapiens
atagatcatgttaaaagctcca

SEQ ID NO: 7062156 - DNA, 22 bp, Homo sapiens
actttgtgcccaacagaaagaa

SEQ ID NO: 7062157 - DNA, 22 bp, Homo sapiens
atagatattagcaaaattttat

SEQ ID NO: 7062158 - DNA, 20 bp, Homo sapiens
atagatatcatctttagaag

SEQ ID NO: 7062159 - DNA, 22 bp, Homo sapiens
actttgcaaataaactctctaa

SEQ ID NO: 7062160 - DNA, 22 bp, Homo sapiens
actttgcaatacttaatacaaa

SEQ ID NO: 7062161 - DNA, 22 bp, Homo sapiens
actttgcacttcaatataactt

SEQ ID NO: 7062162 - DNA, 22 bp, Homo sapiens
atacatcatgctccatatattt

SEQ ID NO: 7062163 - DNA, 22 bp, Homo sapiens
atacaaaatatatactggagac

SEQ ID NO: 7062164 - DNA, 22 bp, Homo sapiens
atacaaaatatatactggagac

SEQ ID NO: 7062165 - DNA, 22 bp, Homo sapiens
acttggttggtctcaccctgtt

SEQ ID NO: 7062166 - DNA, 22 bp, Homo sapiens
atacaaaaattagccgggagta

SEQ ID NO: 7062167 - DNA, 22 bp, Homo sapiens
acttctcttcataggtggcaat

SEQ ID NO: 7062168 - DNA, 21 bp, Homo sapiens
actttacaatttacatagtga

SEQ ID NO: 7062169 - DNA, 22 bp, Homo sapiens
actttacaagcttatagcctag

SEQ ID NO: 7062170 - DNA, 21 bp, Homo sapiens
actttacaatttacatagtga

SEQ ID NO: 7062171 - DNA, 22 bp, Homo sapiens
agctgcaggagtcgcctaggat

SEQ ID NO: 7062172 - DNA, 22 bp, Homo sapiens
agctgcaggcccatgctcagtc

SEQ ID NO: 7062173 - DNA, 22 bp, Homo sapiens
agctgctgggatacagtagtga

SEQ ID NO: 7062174 - DNA, 23 bp, Homo sapiens
acagccagttcacctctccttgg

SEQ ID NO: 7062175 - DNA, 22 bp, Homo sapiens
acagccagtcatctcagcaggg

SEQ ID NO: 7062176 - DNA, 22 bp, Homo sapiens
agctggcagctctcaggggtac

SEQ ID NO: 7062177 - DNA, 22 bp, Homo sapiens
acagcctgacttttgttgtcac

SEQ ID NO: 7062178 - DNA, 22 bp, Homo sapiens
agctggccttagtgagcacctg

SEQ ID NO: 7062179 - DNA, 22 bp, Homo sapiens
agctggccttcggtgtcactgg

SEQ ID NO: 7062180 - DNA, 22 bp, Homo sapiens
agctggctatgccctgtgaacc

SEQ ID NO: 7062181 - DNA, 22 bp, Homo sapiens
agctggctatgccctgtgaacc

SEQ ID NO: 7062182 - DNA, 21 bp, Homo sapiens
agctggctctctctggagaga

SEQ ID NO: 7062183 - DNA, 22 bp, Homo sapiens
agctgctgtttggtgagtcttg

SEQ ID NO: 7062184 - DNA, 22 bp, Homo sapiens
agctgcttagagtcctcaggat

SEQ ID NO: 7062185 - DNA, 22 bp, Homo sapiens
agctgcttataagatttgggag

SEQ ID NO: 7062186 - DNA, 22 bp, Homo sapiens
agctgcttcaaaatgggctcct

SEQ ID NO: 7062187 - DNA, 22 bp, Homo sapiens
agctgcttcctctttgatgtca

SEQ ID NO: 7062188 - DNA, 21 bp, Homo sapiens
agctgctttcagctcctagag

SEQ ID NO: 7062189 - DNA, 22 bp, Homo sapiens
acagccccagcgcggcggggtc

SEQ ID NO: 7062190 - DNA, 23 bp, Homo sapiens
acagccccatgcaggtgtgtttg

SEQ ID NO: 7062191 - DNA, 22 bp, Homo sapiens
acagccccccgctcagtttcca

SEQ ID NO: 7062192 - DNA, 22 bp, Homo sapiens
aggaaacttcagagttttggtc

SEQ ID NO: 7062193 - DNA, 22 bp, Homo sapiens
aggaaactcccctacatctcaa

SEQ ID NO: 7062194 - DNA, 18 bp, Homo sapiens
aggaaagaaaggcaggtg

SEQ ID NO: 7062195 - DNA, 18 bp, Homo sapiens
aggaaagaaaggcaggtg

SEQ ID NO: 7062196 - DNA, 18 bp, Homo sapiens
aggaagcaggaggaaggc

SEQ ID NO: 7062197 - DNA, 22 bp, Homo sapiens
aggaagccatggtggacgtcta

SEQ ID NO: 7062198 - DNA, 22 bp, Homo sapiens
aggaaaaaagtctgtgattata

SEQ ID NO: 7062199 - DNA, 22 bp, Homo sapiens
aggaaaaagagttgctgccttc

SEQ ID NO: 7062200 - DNA, 22 bp, Homo sapiens
agcttttacataatgatcttga

SEQ ID NO: 7062201 - DNA, 22 bp, Homo sapiens
agctttggttgaggggagtgtg

SEQ ID NO: 7062202 - DNA, 22 bp, Homo sapiens
agctgtgggatttgggtgtgcc

SEQ ID NO: 7062203 - DNA, 22 bp, Homo sapiens
agctgtgggcctgggagagctg

SEQ ID NO: 7062204 - DNA, 22 bp, Homo sapiens
agctgtgggagaatctctgggt

SEQ ID NO: 7062205 - DNA, 22 bp, Homo sapiens
agctgggatgaggagcatcctt

SEQ ID NO: 7062206 - DNA, 22 bp, Homo sapiens
agctgggatgataacctcagtc

SEQ ID NO: 7062207 - DNA, 22 bp, Homo sapiens
agctgggcaaaatgtgaggttg

SEQ ID NO: 7062208 - DNA, 21 bp, Homo sapiens
agctggctctctctggagaga

SEQ ID NO: 7062209 - DNA, 22 bp, Homo sapiens
agctgggagctgaaggctgatt

SEQ ID NO: 7062210 - DNA, 22 bp, Homo sapiens
agctgggaggctcctctgtgac

SEQ ID NO: 7062211 - DNA, 23 bp, Homo sapiens
acatacataagcaccacattttg

SEQ ID NO: 7062212 - DNA, 22 bp, Homo sapiens
acataacaatcataggacatag

SEQ ID NO: 7062213 - DNA, 22 bp, Homo sapiens
acatacacatgaatatattttt

SEQ ID NO: 7062214 - DNA, 22 bp, Homo sapiens
acatacacatgaatatattttt

SEQ ID NO: 7062215 - DNA, 22 bp, Homo sapiens
acatacatcaagtatcacaaga

SEQ ID NO: 7062216 - DNA, 22 bp, Homo sapiens
aggcaacaagggtagtcagtga

SEQ ID NO: 7062217 - DNA, 22 bp, Homo sapiens
aggcaacatgggccaggcagaa

SEQ ID NO: 7062218 - DNA, 19 bp, Homo sapiens
aggcaaccaatgaggcaaa

SEQ ID NO: 7062219 - DNA, 22 bp, Homo sapiens
aggcacagaatggcattcagtg

SEQ ID NO: 7062220 - DNA, 22 bp, Homo sapiens
aggcacagagaagtaaagtatc

SEQ ID NO: 7062221 - DNA, 22 bp, Homo sapiens
aggcacagagaatgccctccat

SEQ ID NO: 7062222 - DNA, 22 bp, Homo sapiens
aggcacagagaggttaaatgca

SEQ ID NO: 7062223 - DNA, 18 bp, Homo sapiens
aggcacagagcatacata

SEQ ID NO: 7062224 - DNA, 22 bp, Homo sapiens
aggcacagatttggggaaagca

SEQ ID NO: 7062225 - DNA, 22 bp, Homo sapiens
aggagggaataagaaagagtca

SEQ ID NO: 7062226 - DNA, 20 bp, Homo sapiens
aggagggacctggattggcg

SEQ ID NO: 7062227 - DNA, 22 bp, Homo sapiens
aggagggagatgcccatcctgg

SEQ ID NO: 7062228 - DNA, 21 bp, Homo sapiens
aggaggggtctttcccactga

SEQ ID NO: 7062229 - DNA, 22 bp, Homo sapiens
aggaggggttctcgggtgctga

SEQ ID NO: 7062230 - DNA, 22 bp, Homo sapiens
aggaggggttctcgggtgctga

SEQ ID NO: 7062231 - DNA, 22 bp, Homo sapiens
aggagggtacaatgggtggaaa

SEQ ID NO: 7062232 - DNA, 22 bp, Homo sapiens
aggagggtcatgttgaagtgta

SEQ ID NO: 7062233 - DNA, 23 bp, Homo sapiens
aggagacagggaagtgcctggct

SEQ ID NO: 7062234 - DNA, 22 bp, Homo sapiens
aggagacataactatgatgaga

SEQ ID NO: 7062235 - DNA, 23 bp, Homo sapiens
aggagacagggaagtgcctggct

SEQ ID NO: 7062236 - DNA, 23 bp, Homo sapiens
aggagacagggaagtgcctggct

SEQ ID NO: 7062237 - DNA, 17 bp, Homo sapiens
aggaagggcaagtttct

SEQ ID NO: 7062238 - DNA, 22 bp, Homo sapiens
aggaagggctgtttctccaaga

SEQ ID NO: 7062239 - DNA, 22 bp, Homo sapiens
aggagacccagaatgttgctgt

SEQ ID NO: 7062240 - DNA, 22 bp, Homo sapiens
aggagacccaatgccagaaaga

SEQ ID NO: 7062241 - DNA, 21 bp, Homo sapiens
aggagaccggcttgtttgtgc

SEQ ID NO: 7062242 - DNA, 21 bp, Homo sapiens
aggagaccggcttgtttgtgc

SEQ ID NO: 7062243 - DNA, 22 bp, Homo sapiens
aggagaccttcaccacttccac

SEQ ID NO: 7062244 - DNA, 22 bp, Homo sapiens
aggagaccttttgagtgtgaga

SEQ ID NO: 7062245 - DNA, 22 bp, Homo sapiens
aggagaccttttgagtgtgaga

SEQ ID NO: 7062246 - DNA, 22 bp, Homo sapiens
aggagacataactatgatgaga

SEQ ID NO: 7062247 - DNA, 22 bp, Homo sapiens
aggagacatactataggaatat

SEQ ID NO: 7062248 - DNA, 22 bp, Homo sapiens
aggagacatactataggaatat

SEQ ID NO: 7062249 - DNA, 22 bp, Homo sapiens
aggagacatggaatagtgaggc

SEQ ID NO: 7062250 - DNA, 20 bp, Homo sapiens
aggagaccaagccaagtgga

SEQ ID NO: 7062251 - DNA, 22 bp, Homo sapiens
aggaagcctggcattaaaaagc

SEQ ID NO: 7062252 - DNA, 22 bp, Homo sapiens
aggaagcccaagtctcatcttc

SEQ ID NO: 7062253 - DNA, 17 bp, Homo sapiens
aggaagcgagctggcct

SEQ ID NO: 7062254 - DNA, 17 bp, Homo sapiens
aggaagcgagctggcct

SEQ ID NO: 7062255 - DNA, 22 bp, Homo sapiens
aggaagcgtgggtctggctgga

SEQ ID NO: 7062256 - DNA, 23 bp, Homo sapiens
aggaagctaccaattttgtaggc

SEQ ID NO: 7062257 - DNA, 22 bp, Homo sapiens
aggaagctcaaagccatgatgt

SEQ ID NO: 7062258 - DNA, 22 bp, Homo sapiens
aggaaggagggcagatattaag

SEQ ID NO: 7062259 - DNA, 20 bp, Homo sapiens
aggagccattgactgcagca

SEQ ID NO: 7062260 - DNA, 22 bp, Homo sapiens
aggagcagaccgtagtcctgca

SEQ ID NO: 7062261 - DNA, 22 bp, Homo sapiens
acagggtggggatggtgagctt

SEQ ID NO: 7062262 - DNA, 22 bp, Homo sapiens
acagggtgactttgtgacagat

SEQ ID NO: 7062263 - DNA, 22 bp, Homo sapiens
acagggtgactttgtgacagat

SEQ ID NO: 7062264 - DNA, 22 bp, Homo sapiens
acaggggtgcatggtgcatggt

SEQ ID NO: 7062265 - DNA, 22 bp, Homo sapiens
acagggtgaatgtgacattatc

SEQ ID NO: 7062266 - DNA, 22 bp, Homo sapiens
aggagctggagtccaggcaagt

SEQ ID NO: 7062267 - DNA, 22 bp, Homo sapiens
aggagctgctttggtgcggttt

SEQ ID NO: 7062268 - DNA, 22 bp, Homo sapiens
aggagctgcagattctgccttg

SEQ ID NO: 7062269 - DNA, 22 bp, Homo sapiens
aggctgtgcaattagggtaaga

SEQ ID NO: 7062270 - DNA, 22 bp, Homo sapiens
aggctccagcccaaggctgcag

SEQ ID NO: 7062271 - DNA, 22 bp, Homo sapiens
aggcttcagaggaagtgcggcc

SEQ ID NO: 7062272 - DNA, 22 bp, Homo sapiens
aggcttcagcagccctctcttg

SEQ ID NO: 7062273 - DNA, 22 bp, Homo sapiens
aggcttcagcctagagctggag

SEQ ID NO: 7062274 - DNA, 22 bp, Homo sapiens
aggcttcaggaagtctcctggg

SEQ ID NO: 7062275 - DNA, 19 bp, Homo sapiens
aggcttcaggccacatgct

SEQ ID NO: 7062276 - DNA, 22 bp, Homo sapiens
aggcttcagtagggagcatgtc

SEQ ID NO: 7062277 - DNA, 22 bp, Homo sapiens
aggcttcagtattcaccgcatg

SEQ ID NO: 7062278 - DNA, 19 bp, Homo sapiens
aggcttcatcctgggcagc

SEQ ID NO: 7062279 - DNA, 22 bp, Homo sapiens
aggcttcatgtgtcctgggtga

SEQ ID NO: 7062280 - DNA, 22 bp, Homo sapiens
aggcttcattacagtggttcaa

SEQ ID NO: 7062281 - DNA, 22 bp, Homo sapiens
aggcttcattgtggcatcagga

SEQ ID NO: 7062282 - DNA, 22 bp, Homo sapiens
acattgagtgctccataaatca

SEQ ID NO: 7062283 - DNA, 23 bp, Homo sapiens
aggctccactccctgggatgtgg

SEQ ID NO: 7062284 - DNA, 22 bp, Homo sapiens
aggctccagcagccagaggaag

SEQ ID NO: 7062285 - DNA, 22 bp, Homo sapiens
acattctagatatgttatattt

SEQ ID NO: 7062286 - DNA, 22 bp, Homo sapiens
acattctagatatgttatattt

SEQ ID NO: 7062287 - DNA, 22 bp, Homo sapiens
acattctagatatgttatattt

SEQ ID NO: 7062288 - DNA, 22 bp, Homo sapiens
acattctatgaagataatttta

SEQ ID NO: 7062289 - DNA, 22 bp, Homo sapiens
acattcccttggcttgaagcag

SEQ ID NO: 7062290 - DNA, 22 bp, Homo sapiens
aggccctgcaggaagcaggatg

SEQ ID NO: 7062291 - DNA, 22 bp, Homo sapiens
aggccctgcaggagtggggaca

SEQ ID NO: 7062292 - DNA, 20 bp, Homo sapiens
aggccctgccagggacggag

SEQ ID NO: 7062293 - DNA, 21 bp, Homo sapiens
acattcacaggatattatcat

SEQ ID NO: 7062294 - DNA, 22 bp, Homo sapiens
acattcaggccacagtggagtc

SEQ ID NO: 7062295 - DNA, 22 bp, Homo sapiens
acattcatgtcccacttctagc

SEQ ID NO: 7062296 - DNA, 22 bp, Homo sapiens
acattcatgtcccacttctagc

SEQ ID NO: 7062297 - DNA, 22 bp, Homo sapiens
acattcattccaggtcagtcag

SEQ ID NO: 7062298 - DNA, 22 bp, Homo sapiens
aggccctgagaaaatccctgca

SEQ ID NO: 7062299 - DNA, 22 bp, Homo sapiens
aggccctgagcatccgagggca

SEQ ID NO: 7062300 - DNA, 22 bp, Homo sapiens
aggcccagggctgctctctgaa

SEQ ID NO: 7062301 - DNA, 22 bp, Homo sapiens
aggcccagggctgctctctgaa

SEQ ID NO: 7062302 - DNA, 22 bp, Homo sapiens
acatgaaacctgagtctaactc

SEQ ID NO: 7062303 - DNA, 22 bp, Homo sapiens
aggccagcagcatgacggcatc

SEQ ID NO: 7062304 - DNA, 22 bp, Homo sapiens
aggccagcattctctctccagg

SEQ ID NO: 7062305 - DNA, 20 bp, Homo sapiens
aggcagttagaaggagatga

SEQ ID NO: 7062306 - DNA, 22 bp, Homo sapiens
aggcagttctcgtgtgtgtccc

SEQ ID NO: 7062307 - DNA, 22 bp, Homo sapiens
aggcatggctttaggcaggcgt

SEQ ID NO: 7062308 - DNA, 22 bp, Homo sapiens
aggcatggctttaggcaggcgt

SEQ ID NO: 7062309 - DNA, 22 bp, Homo sapiens
aggcatggctttaggcaggcgt

SEQ ID NO: 7062310 - DNA, 19 bp, Homo sapiens
aggcatgggaagagaagtc

SEQ ID NO: 7062311 - DNA, 22 bp, Homo sapiens
aggcatggggctgcagtcaggt

SEQ ID NO: 7062312 - DNA, 22 bp, Homo sapiens
aggcatggggctgcagtcaggt

SEQ ID NO: 7062313 - DNA, 22 bp, Homo sapiens
aggcatgggtagaagagaagcc

SEQ ID NO: 7062314 - DNA, 17 bp, Homo sapiens
aggcatggtctggggtg

SEQ ID NO: 7062315 - DNA, 18 bp, Homo sapiens
aggcatggtggtgcgcac

SEQ ID NO: 7062316 - DNA, 22 bp, Homo sapiens
aggcatgtatatgtgcacatgt

SEQ ID NO: 7062317 - DNA, 22 bp, Homo sapiens
aggccacaagaactaccccatc

SEQ ID NO: 7062318 - DNA, 22 bp, Homo sapiens
aggccacagcctgggaggtgac

SEQ ID NO: 7062319 - DNA, 22 bp, Homo sapiens
aggccacaggcaccctgtgttc

SEQ ID NO: 7062320 - DNA, 22 bp, Homo sapiens
aggccagcacgacagccgcagg

SEQ ID NO: 7062321 - DNA, 22 bp, Homo sapiens
accagtgcttcctgctggagct

SEQ ID NO: 7062322 - DNA, 22 bp, Homo sapiens
accagtccgcggagctccgggg

SEQ ID NO: 7062323 - DNA, 22 bp, Homo sapiens
accaggtggccccagcgtggtt

SEQ ID NO: 7062324 - DNA, 20 bp, Homo sapiens
accaggtggctgatgacacc

SEQ ID NO: 7062325 - DNA, 22 bp, Homo sapiens
accaggctgtgaagtgagacta

SEQ ID NO: 7062326 - DNA, 22 bp, Homo sapiens
accaggagttgggggtgggacc

SEQ ID NO: 7062327 - DNA, 22 bp, Homo sapiens
accagggcacattccggccaga

SEQ ID NO: 7062328 - DNA, 22 bp, Homo sapiens
accagggcagccgaggtgtgtc

SEQ ID NO: 7062329 - DNA, 19 bp, Homo sapiens
accaggagtatcagagctg

SEQ ID NO: 7062330 - DNA, 22 bp, Homo sapiens
accaggagggaccctggtggcc

SEQ ID NO: 7062331 - DNA, 22 bp, Homo sapiens
accaggagtaacagtgagtggt

SEQ ID NO: 7062332 - DNA, 22 bp, Homo sapiens
accagggcagccgaggtgtgtc

SEQ ID NO: 7062333 - DNA, 22 bp, Homo sapiens
accagggcccgggagagctctc

SEQ ID NO: 7062334 - DNA, 22 bp, Homo sapiens
accagggcggcttgaggaggca

SEQ ID NO: 7062335 - DNA, 22 bp, Homo sapiens
accagggcggcttgaggaggca

SEQ ID NO: 7062336 - DNA, 22 bp, Homo sapiens
accagggcggcttgaggaggca

SEQ ID NO: 7062337 - DNA, 22 bp, Homo sapiens
accagggctgacaatctgatgg

SEQ ID NO: 7062338 - DNA, 22 bp, Homo sapiens
accagggctgggataggtcagg

SEQ ID NO: 7062339 - DNA, 22 bp, Homo sapiens
accagggcttacagcagtagct

SEQ ID NO: 7062340 - DNA, 22 bp, Homo sapiens
accaggagccatagagtcaggc

SEQ ID NO: 7062341 - DNA, 22 bp, Homo sapiens
accaggaggcctggagcacaaa

SEQ ID NO: 7062342 - DNA, 22 bp, Homo sapiens
accaggagccacaggaggagcc

SEQ ID NO: 7062343 - DNA, 20 bp, Homo sapiens
accaggagatggaggcaggg

SEQ ID NO: 7062344 - DNA, 22 bp, Homo sapiens
accaagcacaaagatgagtaaa

SEQ ID NO: 7062345 - DNA, 22 bp, Homo sapiens
acccagtgacatcctttacctg

SEQ ID NO: 7062346 - DNA, 22 bp, Homo sapiens
acccagggtttgagctctgcag

SEQ ID NO: 7062347 - DNA, 22 bp, Homo sapiens
acccaggtggctctgacggggg

SEQ ID NO: 7062348 - DNA, 22 bp, Homo sapiens
acccagggtcaccccgtagggt

SEQ ID NO: 7062349 - DNA, 22 bp, Homo sapiens
acccagggttcctgggtcccag

SEQ ID NO: 7062350 - DNA, 22 bp, Homo sapiens
acccagggttcctgggtcccag

SEQ ID NO: 7062351 - DNA, 19 bp, Homo sapiens
acccagggttgatgtccag

SEQ ID NO: 7062352 - DNA, 22 bp, Homo sapiens
acccagggtttgagctctgcag

SEQ ID NO: 7062353 - DNA, 22 bp, Homo sapiens
acccagagcacagatgcaacgt

SEQ ID NO: 7062354 - DNA, 22 bp, Homo sapiens
acccagggaccccgctgacgcc

SEQ ID NO: 7062355 - DNA, 22 bp, Homo sapiens
acccagggagtgctcctgttct

SEQ ID NO: 7062356 - DNA, 22 bp, Homo sapiens
acccagggtagagtgcagtggc

SEQ ID NO: 7062357 - DNA, 22 bp, Homo sapiens
acccagggtagagtgcagtggc

SEQ ID NO: 7062358 - DNA, 22 bp, Homo sapiens
acccagggtagagtgcagtggc

SEQ ID NO: 7062359 - DNA, 22 bp, Homo sapiens
acccagggtcaccccgtagggt

SEQ ID NO: 7062360 - DNA, 22 bp, Homo sapiens
agggcctgagaccgtggcttga

SEQ ID NO: 7062361 - DNA, 22 bp, Homo sapiens
agggcctgagctctcctccagt

SEQ ID NO: 7062362 - DNA, 22 bp, Homo sapiens
acccacagccgctgtgcgtccc

SEQ ID NO: 7062363 - DNA, 22 bp, Homo sapiens
acccacgaagatgagcggcatg

SEQ ID NO: 7062364 - DNA, 23 bp, Homo sapiens
acccatctctcctgtcatgcaga

SEQ ID NO: 7062365 - DNA, 22 bp, Homo sapiens
acccatgtgctcttttgtaccc

SEQ ID NO: 7062366 - DNA, 22 bp, Homo sapiens
accccagaggcggaggctgcag

SEQ ID NO: 7062367 - DNA, 22 bp, Homo sapiens
accctctgccttgagcagtgcc

SEQ ID NO: 7062368 - DNA, 18 bp, Homo sapiens
accctctggcttctgagc

SEQ ID NO: 7062369 - DNA, 22 bp, Homo sapiens
accctgcttggccccacttcta

SEQ ID NO: 7062370 - DNA, 21 bp, Homo sapiens
accctgctttatgccgtcctc

SEQ ID NO: 7062371 - DNA, 22 bp, Homo sapiens
accctgctttatgccgtcctct

SEQ ID NO: 7062372 - DNA, 22 bp, Homo sapiens
aatgtataaagtgttaataact

SEQ ID NO: 7062373 - DNA, 22 bp, Homo sapiens
aatgtataaagtgttaataact

SEQ ID NO: 7062374 - DNA, 22 bp, Homo sapiens
aatgtagatgagatattttttg

SEQ ID NO: 7062375 - DNA, 22 bp, Homo sapiens
aatgtataaagtgttaataact

SEQ ID NO: 7062376 - DNA, 22 bp, Homo sapiens
aatgtacagctgtctttcctcc

SEQ ID NO: 7062377 - DNA, 22 bp, Homo sapiens
aatgtacatctcagtgtagtac

SEQ ID NO: 7062378 - DNA, 22 bp, Homo sapiens
aatgtaaacagcaagagaaggg

SEQ ID NO: 7062379 - DNA, 22 bp, Homo sapiens
agaatctctactcaagtacttg

SEQ ID NO: 7062380 - DNA, 20 bp, Homo sapiens
agaatctgacccagagagac

SEQ ID NO: 7062381 - DNA, 22 bp, Homo sapiens
agaattggttggggaatgtgga

SEQ ID NO: 7062382 - DNA, 22 bp, Homo sapiens
agaattgtaagcaatttgatta

SEQ ID NO: 7062383 - DNA, 22 bp, Homo sapiens
agaataatactgaaatgctgaa

SEQ ID NO: 7062384 - DNA, 22 bp, Homo sapiens
agaataatcactgaagttcaaa

SEQ ID NO: 7062385 - DNA, 22 bp, Homo sapiens
agaataaaatagtctgaagatg

SEQ ID NO: 7062386 - DNA, 22 bp, Homo sapiens
agaataaaatagtctgaagatg

SEQ ID NO: 7062387 - DNA, 22 bp, Homo sapiens
agaataaaatagtctgaagatg

SEQ ID NO: 7062388 - DNA, 22 bp, Homo sapiens
agaataaaatagtctgaagatg

SEQ ID NO: 7062389 - DNA, 22 bp, Homo sapiens
agaataaatcaaatgtcctgag

SEQ ID NO: 7062390 - DNA, 22 bp, Homo sapiens
agaataaatgctacctatcaca

SEQ ID NO: 7062391 - DNA, 22 bp, Homo sapiens
aatgctttttgcgaaatgtgca

SEQ ID NO: 7062392 - DNA, 23 bp, Homo sapiens
aatgctggaaattcaggcatgat

SEQ ID NO: 7062393 - DNA, 22 bp, Homo sapiens
agagatatgagtagttgtgaca

SEQ ID NO: 7062394 - DNA, 23 bp, Homo sapiens
agagagagtttgtgtcaggtacc

SEQ ID NO: 7062395 - DNA, 22 bp, Homo sapiens
agagagaattggataaattggt

SEQ ID NO: 7062396 - DNA, 22 bp, Homo sapiens
agagacagggttttgccatgtt

SEQ ID NO: 7062397 - DNA, 22 bp, Homo sapiens
agagaaagtaaagattctacct

SEQ ID NO: 7062398 - DNA, 22 bp, Homo sapiens
agagaaacaggtcagctgggag

SEQ ID NO: 7062399 - DNA, 22 bp, Homo sapiens
agagaaacccttcagtgttttg

SEQ ID NO: 7062400 - DNA, 22 bp, Homo sapiens
agagaaactgatgtcctttgaa

SEQ ID NO: 7062401 - DNA, 18 bp, Homo sapiens
agagaaagaccaaagcat

SEQ ID NO: 7062402 - DNA, 18 bp, Homo sapiens
agagaaagaccaaagcat

SEQ ID NO: 7062403 - DNA, 21 bp, Homo sapiens
agactgccatctttgggccac

SEQ ID NO: 7062404 - DNA, 23 bp, Homo sapiens
agactgaggctgccagggtcaga

SEQ ID NO: 7062405 - DNA, 23 bp, Homo sapiens
agactgaggctgccagggtcaga

SEQ ID NO: 7062406 - DNA, 22 bp, Homo sapiens
agacactgatgttcagctcaat

SEQ ID NO: 7062407 - DNA, 17 bp, Homo sapiens
agacactgagccaagta

SEQ ID NO: 7062408 - DNA, 22 bp, Homo sapiens
aatgtataaccataggaaattt

SEQ ID NO: 7062409 - DNA, 22 bp, Homo sapiens
aatgtataaccataggaaattt

SEQ ID NO: 7062410 - DNA, 21 bp, Homo sapiens
agacctcttcccttcatgcac

SEQ ID NO: 7062411 - DNA, 22 bp, Homo sapiens
agagggctggacgcaggttgga

SEQ ID NO: 7062412 - DNA, 22 bp, Homo sapiens
aattttctggtgtgtaatgaag

SEQ ID NO: 7062413 - DNA, 21 bp, Homo sapiens
aattttgaaggaagattaagg

SEQ ID NO: 7062414 - DNA, 22 bp, Homo sapiens
aatttcaaagctcactggcata

SEQ ID NO: 7062415 - DNA, 22 bp, Homo sapiens
agaggcttggcctcagttctgt

SEQ ID NO: 7062416 - DNA, 22 bp, Homo sapiens
aatttattatatcctaggggaa

SEQ ID NO: 7062417 - DNA, 22 bp, Homo sapiens
aatttattcccgtctctgggct

SEQ ID NO: 7062418 - DNA, 22 bp, Homo sapiens
aatttatttcctgccagtacac

SEQ ID NO: 7062419 - DNA, 22 bp, Homo sapiens
agagcagctggggcagagacca

SEQ ID NO: 7062420 - DNA, 22 bp, Homo sapiens
agagcagctggggcagagacca

SEQ ID NO: 7062421 - DNA, 22 bp, Homo sapiens
agagcagctgtgacatggacag

SEQ ID NO: 7062422 - DNA, 22 bp, Homo sapiens
agaggcaacatggggaacagat

SEQ ID NO: 7062423 - DNA, 22 bp, Homo sapiens
agaggcaacatggggaacagat

SEQ ID NO: 7062424 - DNA, 21 bp, Homo sapiens
agaggcaggcattaagtacac

SEQ ID NO: 7062425 - DNA, 21 bp, Homo sapiens
agaggcaggcattaagtacac

SEQ ID NO: 7062426 - DNA, 22 bp, Homo sapiens
agaggccaagccagactgtgca

SEQ ID NO: 7062427 - DNA, 22 bp, Homo sapiens
agattatgctggctgctacaag

SEQ ID NO: 7062428 - DNA, 20 bp, Homo sapiens
agattattcctaagatttct

SEQ ID NO: 7062429 - DNA, 22 bp, Homo sapiens
agattacagcatgggaatggga

SEQ ID NO: 7062430 - DNA, 22 bp, Homo sapiens
agatggtaatcacatttatctg

SEQ ID NO: 7062431 - DNA, 22 bp, Homo sapiens
agatcctgccaatggaagcagg

SEQ ID NO: 7062432 - DNA, 22 bp, Homo sapiens
agatctgagtatgatttgcctg

SEQ ID NO: 7062433 - DNA, 22 bp, Homo sapiens
agatctgagtggctgcatgtaa

SEQ ID NO: 7062434 - DNA, 22 bp, Homo sapiens
agatatgactagaagctcattt

SEQ ID NO: 7062435 - DNA, 22 bp, Homo sapiens
agatatatttaaggtaataagt

SEQ ID NO: 7062436 - DNA, 22 bp, Homo sapiens
agatatacacccatatcacata

SEQ ID NO: 7062437 - DNA, 22 bp, Homo sapiens
agatataataatttacaagtgt

SEQ ID NO: 7062438 - DNA, 22 bp, Homo sapiens
agatataataatttacaagtgt

SEQ ID NO: 7062439 - DNA, 22 bp, Homo sapiens
agagtgaaaagctagagcagta

SEQ ID NO: 7062440 - DNA, 22 bp, Homo sapiens
agaggtggccatgggcgctgga

SEQ ID NO: 7062441 - DNA, 22 bp, Homo sapiens
agaggtgggagcctggtcacat

SEQ ID NO: 7062442 - DNA, 22 bp, Homo sapiens
agaggttgggtctgaggtgaga

SEQ ID NO: 7062443 - DNA, 20 bp, Homo sapiens
agagtaactggcacataggg

SEQ ID NO: 7062444 - DNA, 22 bp, Homo sapiens
aattttgtttaagtgatctgct

SEQ ID NO: 7062445 - DNA, 22 bp, Homo sapiens
agaggtggccatgggcgctgga

SEQ ID NO: 7062446 - DNA, 23 bp, Homo sapiens
acacagaagaagacccaaggaag

SEQ ID NO: 7062447 - DNA, 22 bp, Homo sapiens
acacagaacctcatagcctctc

SEQ ID NO: 7062448 - DNA, 22 bp, Homo sapiens
agcagccagagtctgaacatta

SEQ ID NO: 7062449 - DNA, 22 bp, Homo sapiens
agcagccaggaatctgcagagc

SEQ ID NO: 7062450 - DNA, 22 bp, Homo sapiens
acacactggcccccagtactga

SEQ ID NO: 7062451 - DNA, 22 bp, Homo sapiens
acacactgtaaggactatcact

SEQ ID NO: 7062452 - DNA, 22 bp, Homo sapiens
acacactgtaaggactatcact

SEQ ID NO: 7062453 - DNA, 22 bp, Homo sapiens
acacacttcagatgtaatttgt

SEQ ID NO: 7062454 - DNA, 22 bp, Homo sapiens
agcagcagctcagttctcagct

SEQ ID NO: 7062455 - DNA, 21 bp, Homo sapiens
agatttgtcccttcccattta

SEQ ID NO: 7062456 - DNA, 22 bp, Homo sapiens
agattttagtgtagaggacttg

SEQ ID NO: 7062457 - DNA, 22 bp, Homo sapiens
agattttagtttggggaggtgc

SEQ ID NO: 7062458 - DNA, 22 bp, Homo sapiens
agattttatagataatttccca

SEQ ID NO: 7062459 - DNA, 22 bp, Homo sapiens
acacacagaaggaagccccact

SEQ ID NO: 7062460 - DNA, 22 bp, Homo sapiens
acacacagaaggaagccccact

SEQ ID NO: 7062461 - DNA, 22 bp, Homo sapiens
acacacatggtattgttcagaa

SEQ ID NO: 7062462 - DNA, 22 bp, Homo sapiens
acacactcaattgcataagcac

SEQ ID NO: 7062463 - DNA, 22 bp, Homo sapiens
acacactgagtgccataggacc

SEQ ID NO: 7062464 - DNA, 21 bp, Homo sapiens
acacactgagttttccactgt

SEQ ID NO: 7062465 - DNA, 21 bp, Homo sapiens
acacactgagttttccactgt

SEQ ID NO: 7062466 - DNA, 22 bp, Homo sapiens
acacactggcaggagctataaa

SEQ ID NO: 7062467 - DNA, 22 bp, Homo sapiens
agcaggcaggctgccagtgaat

SEQ ID NO: 7062468 - DNA, 22 bp, Homo sapiens
agcaggagtgtcccctggctgt

SEQ ID NO: 7062469 - DNA, 22 bp, Homo sapiens
agcaggagtgtcccctggctgt

SEQ ID NO: 7062470 - DNA, 22 bp, Homo sapiens
agcaggagctgtgggaagatgg

SEQ ID NO: 7062471 - DNA, 22 bp, Homo sapiens
agcaggaggagagcctggcggt

SEQ ID NO: 7062472 - DNA, 22 bp, Homo sapiens
agcagctgagccccagctgtga

SEQ ID NO: 7062473 - DNA, 22 bp, Homo sapiens
agcaggaacgagttcatgggga

SEQ ID NO: 7062474 - DNA, 22 bp, Homo sapiens
agcaggaacgagttcatgggga

SEQ ID NO: 7062475 - DNA, 22 bp, Homo sapiens
agcagccatagatagcatgcaa

SEQ ID NO: 7062476 - DNA, 22 bp, Homo sapiens
agcagctcgggctacagagggg

SEQ ID NO: 7062477 - DNA, 23 bp, Homo sapiens
agcaggcatctgtggcacaaggc

SEQ ID NO: 7062478 - DNA, 19 bp, Homo sapiens
agcaggccacagggccagc

SEQ ID NO: 7062479 - DNA, 19 bp, Homo sapiens
agcaggcaggtggcccagg

SEQ ID NO: 7062480 - DNA, 22 bp, Homo sapiens
agcaggcagtgtagagccttca

SEQ ID NO: 7062481 - DNA, 22 bp, Homo sapiens
agcaggcatagagtagcactca

SEQ ID NO: 7062482 - DNA, 22 bp, Homo sapiens
agcagggctgtgtaggtaatga

SEQ ID NO: 7062483 - DNA, 22 bp, Homo sapiens
agcagggcttgccgcttgtcct

SEQ ID NO: 7062484 - DNA, 22 bp, Homo sapiens
agcagggctttgtctctgtgaa

SEQ ID NO: 7062485 - DNA, 21 bp, Homo sapiens
agcaggtgaacctccagtaca

SEQ ID NO: 7062486 - DNA, 22 bp, Homo sapiens
agcaggtgaattcctggatgtg

SEQ ID NO: 7062487 - DNA, 22 bp, Homo sapiens
agcaggtgacagggctgtggtg

SEQ ID NO: 7062488 - DNA, 22 bp, Homo sapiens
agcaggtgagcacagccaggct

SEQ ID NO: 7062489 - DNA, 22 bp, Homo sapiens
agcccaggtgactcatacaccc

SEQ ID NO: 7062490 - DNA, 22 bp, Homo sapiens
acagacatcatcaacatcttcc

SEQ ID NO: 7062491 - DNA, 22 bp, Homo sapiens
agcccagggctaataggaacca

SEQ ID NO: 7062492 - DNA, 22 bp, Homo sapiens
agcccaggtccagttcactgca

SEQ ID NO: 7062493 - DNA, 22 bp, Homo sapiens
acagaactgcaggaggaaaagc

SEQ ID NO: 7062494 - DNA, 22 bp, Homo sapiens
acagaactgcagacagtgccaa

SEQ ID NO: 7062495 - DNA, 22 bp, Homo sapiens
agccaggctcaaggcctgctcc

SEQ ID NO: 7062496 - DNA, 20 bp, Homo sapiens
agccaggctcaagctccccc

SEQ ID NO: 7062497 - DNA, 22 bp, Homo sapiens
agccaggcgggtctttgctcct

SEQ ID NO: 7062498 - DNA, 22 bp, Homo sapiens
agccaggctaaatgagccatga

SEQ ID NO: 7062499 - DNA, 22 bp, Homo sapiens
agccaggctactccttgctgac

SEQ ID NO: 7062500 - DNA, 22 bp, Homo sapiens
agccaggcggggcaggtttcct

SEQ ID NO: 7062501 - DNA, 22 bp, Homo sapiens
agcattccacactgaagtctgc

SEQ ID NO: 7062502 - DNA, 22 bp, Homo sapiens
agcatgaaagcataggacagtc

SEQ ID NO: 7062503 - DNA, 22 bp, Homo sapiens
agcattcattgctagaatgtaa

SEQ ID NO: 7062504 - DNA, 22 bp, Homo sapiens
agcatcctgcctctcctcccaa

SEQ ID NO: 7062505 - DNA, 22 bp, Homo sapiens
agctcaggctctgcagggacta

SEQ ID NO: 7062506 - DNA, 22 bp, Homo sapiens
agctcagggcaaagactcaaat

SEQ ID NO: 7062507 - DNA, 22 bp, Homo sapiens
agctcaggtcattccagggatg

SEQ ID NO: 7062508 - DNA, 22 bp, Homo sapiens
agcctgtggatccctgcactgg

SEQ ID NO: 7062509 - DNA, 21 bp, Homo sapiens
agcctgttggtttactgctca

SEQ ID NO: 7062510 - DNA, 20 bp, Homo sapiens
agccctgtaaatcccctgga

SEQ ID NO: 7062511 - DNA, 22 bp, Homo sapiens
agccctggggtgcagaaccatg

SEQ ID NO: 7062512 - DNA, 22 bp, Homo sapiens
agcctgctgggaagggaggctt

SEQ ID NO: 7062513 - DNA, 22 bp, Homo sapiens
agcctggccactcagggcctga

SEQ ID NO: 7062514 - DNA, 22 bp, Homo sapiens
agcctggcctgggcaggcacat

SEQ ID NO: 7062515 - DNA, 22 bp, Homo sapiens
agcccctgtaccctgagtgctt

SEQ ID NO: 7062516 - DNA, 22 bp, Homo sapiens
agcccctgtcctctctgatgac

SEQ ID NO: 7062517 - DNA, 22 bp, Homo sapiens
agccctgcaggaggtgggagag

SEQ ID NO: 7062518 - DNA, 22 bp, Homo sapiens
agccctgcaggatgagggaggt

SEQ ID NO: 7062519 - DNA, 22 bp, Homo sapiens
agccctggggctggtcttggaa

SEQ ID NO: 7062520 - DNA, 22 bp, Homo sapiens
aataaaatggtcagttttctca

SEQ ID NO: 7062521 - DNA, 22 bp, Homo sapiens
actgagaacttggggacagagg

SEQ ID NO: 7062522 - DNA, 22 bp, Homo sapiens
actgagaagattctcactctta

SEQ ID NO: 7062523 - DNA, 22 bp, Homo sapiens
aagttttattggctatagcact

SEQ ID NO: 7062524 - DNA, 22 bp, Homo sapiens
actgactcttgttaacttcagc

SEQ ID NO: 7062525 - DNA, 22 bp, Homo sapiens
aataaagaatggatgagatcgt

SEQ ID NO: 7062526 - DNA, 22 bp, Homo sapiens
aataaagacaaacaggggagcc

SEQ ID NO: 7062527 - DNA, 22 bp, Homo sapiens
aataaagacaaacaggggagcc

SEQ ID NO: 7062528 - DNA, 22 bp, Homo sapiens
aataaagcatgaggcatttatc

SEQ ID NO: 7062529 - DNA, 22 bp, Homo sapiens
aataaaggcaccataaggcaaa

SEQ ID NO: 7062530 - DNA, 22 bp, Homo sapiens
aataaatgttaagattgtctca

SEQ ID NO: 7062531 - DNA, 22 bp, Homo sapiens
aataaatgtttgttggatgttt

SEQ ID NO: 7062532 - DNA, 22 bp, Homo sapiens
aataacagaaacttgagcatca

SEQ ID NO: 7062533 - DNA, 22 bp, Homo sapiens
aataacagagtcttcaagatag

SEQ ID NO: 7062534 - DNA, 22 bp, Homo sapiens
aagttttaacaagtacttacta

SEQ ID NO: 7062535 - DNA, 22 bp, Homo sapiens
aagttttaacaagtacttacta

SEQ ID NO: 7062536 - DNA, 22 bp, Homo sapiens
aagtggctcatgtggcttctgc

SEQ ID NO: 7062537 - DNA, 22 bp, Homo sapiens
aagtggctttgagcttctgcca

SEQ ID NO: 7062538 - DNA, 22 bp, Homo sapiens
aagtttggtccttctaagaaga

SEQ ID NO: 7062539 - DNA, 23 bp, Homo sapiens
actcagagaccccgggaagtgac

SEQ ID NO: 7062540 - DNA, 22 bp, Homo sapiens
aagtggaggccgagttcacgca

SEQ ID NO: 7062541 - DNA, 22 bp, Homo sapiens
aagtggagtccctacaaccagc

SEQ ID NO: 7062542 - DNA, 22 bp, Homo sapiens
aagtctgagagaaactctctca

SEQ ID NO: 7062543 - DNA, 22 bp, Homo sapiens
aagtgaatttcattccaattct

SEQ ID NO: 7062544 - DNA, 22 bp, Homo sapiens
aagtgactatttgagtacatca

SEQ ID NO: 7062545 - DNA, 18 bp, Homo sapiens
aagtgactggcaggccaa

SEQ ID NO: 7062546 - DNA, 22 bp, Homo sapiens
aagtgatgctacgactttgaca

SEQ ID NO: 7062547 - DNA, 22 bp, Homo sapiens
aagtgatgctacgactttgaca

SEQ ID NO: 7062548 - DNA, 19 bp, Homo sapiens
accttctgggaaacattcc

SEQ ID NO: 7062549 - DNA, 22 bp, Homo sapiens
acctgggaacgctttgtggagg

SEQ ID NO: 7062550 - DNA, 22 bp, Homo sapiens
aagtaaatatctgtttatagca

SEQ ID NO: 7062551 - DNA, 21 bp, Homo sapiens
aagtaaatcagagaaataacc

SEQ ID NO: 7062552 - DNA, 21 bp, Homo sapiens
aagtaaatcagagaaataacc

SEQ ID NO: 7062553 - DNA, 21 bp, Homo sapiens
aagtaaatcagagaaataacc

SEQ ID NO: 7062554 - DNA, 22 bp, Homo sapiens
aagtaaatgttggagctcaaat

SEQ ID NO: 7062555 - DNA, 18 bp, Homo sapiens
acctgcctgttcttctct

SEQ ID NO: 7062556 - DNA, 22 bp, Homo sapiens
aatatcttctaaggatagaact

SEQ ID NO: 7062557 - DNA, 22 bp, Homo sapiens
aatatcttctaaggatagaact

SEQ ID NO: 7062558 - DNA, 22 bp, Homo sapiens
aatatgaattattgttacaagt

SEQ ID NO: 7062559 - DNA, 19 bp, Homo sapiens
acttcctgcccgctccttt

SEQ ID NO: 7062560 - DNA, 22 bp, Homo sapiens
aatatcttctaaggatagaact

SEQ ID NO: 7062561 - DNA, 17 bp, Homo sapiens
acttcccacccctccag

SEQ ID NO: 7062562 - DNA, 22 bp, Homo sapiens
acttccctgtgggcaggtagtg

SEQ ID NO: 7062563 - DNA, 22 bp, Homo sapiens
acttcctgaatggggctaatta

SEQ ID NO: 7062564 - DNA, 22 bp, Homo sapiens
acttcctgacttctgggttgga

SEQ ID NO: 7062565 - DNA, 22 bp, Homo sapiens
acttccaggaggtgtcactgaa

SEQ ID NO: 7062566 - DNA, 22 bp, Homo sapiens
acttatatttgctttatgcttc

SEQ ID NO: 7062567 - DNA, 22 bp, Homo sapiens
acttataagagtgctatgggga

SEQ ID NO: 7062568 - DNA, 22 bp, Homo sapiens
actgttggcttctggtagtgac

SEQ ID NO: 7062569 - DNA, 22 bp, Homo sapiens
aatactttcctatataaggtgc

SEQ ID NO: 7062570 - DNA, 22 bp, Homo sapiens
aatacttatgtgacctcatttt

SEQ ID NO: 7062571 - DNA, 22 bp, Homo sapiens
aataacaggctcatcagatgct

SEQ ID NO: 7062572 - DNA, 21 bp, Homo sapiens
aataaccactaatatagtggc

SEQ ID NO: 7062573 - DNA, 22 bp, Homo sapiens
actgtctgctggcccctggtta

SEQ ID NO: 7062574 - DNA, 19 bp, Homo sapiens
actgtgctcgggaaccact

SEQ ID NO: 7062575 - DNA, 22 bp, Homo sapiens
actgtggcgtcaggaagaaatt

SEQ ID NO: 7062576 - DNA, 22 bp, Homo sapiens
aatcttctttcttaacagtaca

SEQ ID NO: 7062577 - DNA, 22 bp, Homo sapiens
aatcttgagtgttactctcatt

SEQ ID NO: 7062578 - DNA, 22 bp, Homo sapiens
aatcttaggtttggcttcatct

SEQ ID NO: 7062579 - DNA, 22 bp, Homo sapiens
agaaacctgtgtgctgtgatga

SEQ ID NO: 7062580 - DNA, 22 bp, Homo sapiens
agaaactatcctgagtagcaaa

SEQ ID NO: 7062581 - DNA, 22 bp, Homo sapiens
aatctgttctactctattcaga

SEQ ID NO: 7062582 - DNA, 22 bp, Homo sapiens
aatctgttctactctattcaga

SEQ ID NO: 7062583 - DNA, 17 bp, Homo sapiens
aatctgtttacagtcag

SEQ ID NO: 7062584 - DNA, 22 bp, Homo sapiens
aatctgtttagttctgcgtatg

SEQ ID NO: 7062585 - DNA, 22 bp, Homo sapiens
aatctgtttccattagagtcat

SEQ ID NO: 7062586 - DNA, 22 bp, Homo sapiens
aatatgttcaaaatagatcact

SEQ ID NO: 7062587 - DNA, 22 bp, Homo sapiens
aatattaatagaaggggttcta

SEQ ID NO: 7062588 - DNA, 22 bp, Homo sapiens
aatattagtttctcaagagaga

SEQ ID NO: 7062589 - DNA, 22 bp, Homo sapiens
aatattagtttctcaagagaga

SEQ ID NO: 7062590 - DNA, 22 bp, Homo sapiens
aatattatcaaaagctttttca

SEQ ID NO: 7062591 - DNA, 22 bp, Homo sapiens
aatatgcattaactgtgtacat

SEQ ID NO: 7062592 - DNA, 22 bp, Homo sapiens
agaaaactgggaggagagcttc

SEQ ID NO: 7062593 - DNA, 22 bp, Homo sapiens
agaaaataatttcttggctggt

SEQ ID NO: 7062594 - DNA, 22 bp, Homo sapiens
aatattcatttgcagaagaagt

SEQ ID NO: 7062595 - DNA, 22 bp, Homo sapiens
agaaaactggagcctggggttg

SEQ ID NO: 7062596 - DNA, 22 bp, Homo sapiens
agaaaatattcattgagaggct

SEQ ID NO: 7062597 - DNA, 20 bp, Homo sapiens
agaaaatgttttcagctgga

SEQ ID NO: 7062598 - DNA, 22 bp, Homo sapiens
agaaaattactccagagacaag

SEQ ID NO: 7062599 - DNA, 22 bp, Homo sapiens
agaaacctccatttattcactc

SEQ ID NO: 7062600 - DNA, 22 bp, Homo sapiens
acagtgtccccagctctgtgag

SEQ ID NO: 7062601 - DNA, 22 bp, Homo sapiens
acagtgctggctacaaccctgg

SEQ ID NO: 7062602 - DNA, 20 bp, Homo sapiens
acagtgggtggggagcactg

SEQ ID NO: 7062603 - DNA, 22 bp, Homo sapiens
acagtgctaaacacttcttgaa

SEQ ID NO: 7062604 - DNA, 22 bp, Homo sapiens
acagtgctaaacacttcttgaa

SEQ ID NO: 7062605 - DNA, 23 bp, Homo sapiens
acagggcttatctgtcactcatc

SEQ ID NO: 7062606 - DNA, 21 bp, Homo sapiens
acaggctttagaaaatgactc

SEQ ID NO: 7062607 - DNA, 21 bp, Homo sapiens
acaggctttagaaaatgactc

SEQ ID NO: 7062608 - DNA, 22 bp, Homo sapiens
acaggcttttttagaatgacat

SEQ ID NO: 7062609 - DNA, 23 bp, Homo sapiens
acagggaaaagtcatcagtgtga

SEQ ID NO: 7062610 - DNA, 22 bp, Homo sapiens
acaggtcaacgagagcaggcaa

SEQ ID NO: 7062611 - DNA, 22 bp, Homo sapiens
acaggtcagataaaggctggtg

SEQ ID NO: 7062612 - DNA, 22 bp, Homo sapiens
acaggtcaacgagagcaggcaa

SEQ ID NO: 7062613 - DNA, 22 bp, Homo sapiens
acaggctgaaagttaagttctg

SEQ ID NO: 7062614 - DNA, 22 bp, Homo sapiens
acaggctgacttcctgccatgt

SEQ ID NO: 7062615 - DNA, 22 bp, Homo sapiens
acaggctgacttcctgccatgt

SEQ ID NO: 7062616 - DNA, 22 bp, Homo sapiens
acaggctgagcgtccatcttca

SEQ ID NO: 7062617 - DNA, 22 bp, Homo sapiens
acaggctgaggatgattgcatc

SEQ ID NO: 7062618 - DNA, 22 bp, Homo sapiens
acaggctgaggatgattgcatc

SEQ ID NO: 7062619 - DNA, 22 bp, Homo sapiens
acaggctgatagaccataaata

SEQ ID NO: 7062620 - DNA, 22 bp, Homo sapiens
acaggctgccacttgcatccaa

SEQ ID NO: 7062621 - DNA, 22 bp, Homo sapiens
acaggctgttggggtccagggt

SEQ ID NO: 7062622 - DNA, 22 bp, Homo sapiens
acaggcttacaggctgcaagta

SEQ ID NO: 7062623 - DNA, 22 bp, Homo sapiens
acaggcttcagatgtattaact

SEQ ID NO: 7062624 - DNA, 22 bp, Homo sapiens
acaggcttctcacagaaaaggg

SEQ ID NO: 7062625 - DNA, 20 bp, Homo sapiens
acaggagatctgaggaaagg

SEQ ID NO: 7062626 - DNA, 22 bp, Homo sapiens
acaggaggagcagctgtgtgcc

SEQ ID NO: 7062627 - DNA, 19 bp, Homo sapiens
acaggcagaattgggtgtg

SEQ ID NO: 7062628 - DNA, 22 bp, Homo sapiens
acaggcagagaactcagccaga

SEQ ID NO: 7062629 - DNA, 22 bp, Homo sapiens
acaggcagagaactcagccaga

SEQ ID NO: 7062630 - DNA, 22 bp, Homo sapiens
acaggcagagaactcagccaga

SEQ ID NO: 7062631 - DNA, 22 bp, Homo sapiens
acaggcagagagtggcggactc

SEQ ID NO: 7062632 - DNA, 22 bp, Homo sapiens
aagccctgagcactgcagagaa

SEQ ID NO: 7062633 - DNA, 22 bp, Homo sapiens
aagccctgagcactgcagagaa

SEQ ID NO: 7062634 - DNA, 22 bp, Homo sapiens
aagccctgcagtctctgccaca

SEQ ID NO: 7062635 - DNA, 22 bp, Homo sapiens
aagccctggaactttcctagcc

SEQ ID NO: 7062636 - DNA, 22 bp, Homo sapiens
aagccctggattaaagatgcca

SEQ ID NO: 7062637 - DNA, 22 bp, Homo sapiens
aagccctggcaatgtcagatga

SEQ ID NO: 7062638 - DNA, 22 bp, Homo sapiens
aagccctggcgggtggagggcc

SEQ ID NO: 7062639 - DNA, 22 bp, Homo sapiens
aagccctggctcagctcaccag

SEQ ID NO: 7062640 - DNA, 21 bp, Homo sapiens
acaggagaccgcctggcagtc

SEQ ID NO: 7062641 - DNA, 21 bp, Homo sapiens
acaggagaccgcctggcagtc

SEQ ID NO: 7062642 - DNA, 22 bp, Homo sapiens
acaggagaccctgctggttctg

SEQ ID NO: 7062643 - DNA, 22 bp, Homo sapiens
acaggaaatgaaatggtatcta

SEQ ID NO: 7062644 - DNA, 22 bp, Homo sapiens
acaggaaattggcatatcagtt

SEQ ID NO: 7062645 - DNA, 20 bp, Homo sapiens
acagatgaggaaaatgaagt

SEQ ID NO: 7062646 - DNA, 22 bp, Homo sapiens
acagctggagtgttggtgaggt

SEQ ID NO: 7062647 - DNA, 22 bp, Homo sapiens
acattctctccatgtcttcttt

SEQ ID NO: 7062648 - DNA, 22 bp, Homo sapiens
acattctcatttggtgatcatt

SEQ ID NO: 7062649 - DNA, 21 bp, Homo sapiens
acattataattcatattccac

SEQ ID NO: 7062650 - DNA, 22 bp, Homo sapiens
acatggtgtgctgagaatgaca

SEQ ID NO: 7062651 - DNA, 22 bp, Homo sapiens
aaggccagcttgtagggctggt

SEQ ID NO: 7062652 - DNA, 22 bp, Homo sapiens
aaggccaggcctagcacggagg

SEQ ID NO: 7062653 - DNA, 22 bp, Homo sapiens
acatactttttaaaagattgct

SEQ ID NO: 7062654 - DNA, 22 bp, Homo sapiens
acatacttatgtgtatatgtgt

SEQ ID NO: 7062655 - DNA, 22 bp, Homo sapiens
acatacttaacattaaagtcat

SEQ ID NO: 7062656 - DNA, 23 bp, Homo sapiens
acatgggagggacatggaggctg

SEQ ID NO: 7062657 - DNA, 22 bp, Homo sapiens
acatgggatcaatgaggcaggc

SEQ ID NO: 7062658 - DNA, 23 bp, Homo sapiens
acatgggagggacatggaggctg

SEQ ID NO: 7062659 - DNA, 22 bp, Homo sapiens
acattcttccagctggctgttg

SEQ ID NO: 7062660 - DNA, 22 bp, Homo sapiens
accacaggggaggaatgatgcc

SEQ ID NO: 7062661 - DNA, 22 bp, Homo sapiens
accacctcatcaagctggattg

SEQ ID NO: 7062662 - DNA, 22 bp, Homo sapiens
aagggcagctgacagatgctta

SEQ ID NO: 7062663 - DNA, 22 bp, Homo sapiens
aagggcaggaaaagatggatgt

SEQ ID NO: 7062664 - DNA, 22 bp, Homo sapiens
aagggcaggaaaagatggatgt

SEQ ID NO: 7062665 - DNA, 23 bp, Homo sapiens
accagctgccctgaactttgtgc

SEQ ID NO: 7062666 - DNA, 22 bp, Homo sapiens
accagctgccttttcttagtag

SEQ ID NO: 7062667 - DNA, 22 bp, Homo sapiens
accagctgttaggcttggtgct

SEQ ID NO: 7062668 - DNA, 22 bp, Homo sapiens
accagctggtcacctgggcact

SEQ ID NO: 7062669 - DNA, 22 bp, Homo sapiens
accagctggtcacctgggcact

SEQ ID NO: 7062670 - DNA, 22 bp, Homo sapiens
accagctgtgtcctggctgcag

SEQ ID NO: 7062671 - DNA, 22 bp, Homo sapiens
accaggccaaaatcatatttac

SEQ ID NO: 7062672 - DNA, 22 bp, Homo sapiens
aaggtttttttccagtatctct

SEQ ID NO: 7062673 - DNA, 22 bp, Homo sapiens
aactttctctggatggcttcct

SEQ ID NO: 7062674 - DNA, 22 bp, Homo sapiens
aactttctgaaaagcttgatca

SEQ ID NO: 7062675 - DNA, 22 bp, Homo sapiens
aatgttttttggtctgatgaat

SEQ ID NO: 7062676 - DNA, 22 bp, Homo sapiens
aactttcaggcaatgaatattt

SEQ ID NO: 7062677 - DNA, 22 bp, Homo sapiens
aactttatcggaacaggtactc

SEQ ID NO: 7062678 - DNA, 22 bp, Homo sapiens
aatgtgaaaccgcacagaataa

SEQ ID NO: 7062679 - DNA, 22 bp, Homo sapiens
aatgtgaaaccgcacagaataa

SEQ ID NO: 7062680 - DNA, 22 bp, Homo sapiens
aatgttacgatcaacaacacat

SEQ ID NO: 7062681 - DNA, 22 bp, Homo sapiens
aactcttgaattcccttgaaga

SEQ ID NO: 7062682 - DNA, 22 bp, Homo sapiens
aatgtacaccgtgggtttttta

SEQ ID NO: 7062683 - DNA, 22 bp, Homo sapiens
aactctatttaccctactaaac

SEQ ID NO: 7062684 - DNA, 22 bp, Homo sapiens
aactctatttaccctactaaac

SEQ ID NO: 7062685 - DNA, 22 bp, Homo sapiens
aatgtcaaaatggaatgagact

SEQ ID NO: 7062686 - DNA, 22 bp, Homo sapiens
aatgtcaacacaagagaaatgc

SEQ ID NO: 7062687 - DNA, 23 bp, Homo sapiens
aattcaaattcagtgtgactagg

SEQ ID NO: 7062688 - DNA, 22 bp, Homo sapiens
aattcaaattacaatagttgtt

SEQ ID NO: 7062689 - DNA, 22 bp, Homo sapiens
aattcaaattacaatagttgtt

SEQ ID NO: 7062690 - DNA, 22 bp, Homo sapiens
aattagcatttcccatataaat

SEQ ID NO: 7062691 - DNA, 22 bp, Homo sapiens
aattagaagctgttagcaaaat

SEQ ID NO: 7062692 - DNA, 22 bp, Homo sapiens
aattagaagggagttattgata

SEQ ID NO: 7062693 - DNA, 22 bp, Homo sapiens
aattagaatcttatttggggaa

SEQ ID NO: 7062694 - DNA, 22 bp, Homo sapiens
aagaattattgcaatactagat

SEQ ID NO: 7062695 - DNA, 22 bp, Homo sapiens
aagaattttccagcatgtcagt

SEQ ID NO: 7062696 - DNA, 22 bp, Homo sapiens
aagacaagcatcaaatcaggca

SEQ ID NO: 7062697 - DNA, 22 bp, Homo sapiens
aagacacaaagcttcccttttc

SEQ ID NO: 7062698 - DNA, 22 bp, Homo sapiens
acaactgtcagtaaagaatatt

SEQ ID NO: 7062699 - DNA, 22 bp, Homo sapiens
acaacttcaattgggattctcc

SEQ ID NO: 7062700 - DNA, 22 bp, Homo sapiens
acaacttctcacagataaattt

SEQ ID NO: 7062701 - DNA, 22 bp, Homo sapiens
acaactttaatgggtttcagct

SEQ ID NO: 7062702 - DNA, 22 bp, Homo sapiens
acaactttctgggttatctgat

SEQ ID NO: 7062703 - DNA, 22 bp, Homo sapiens
aagacattcatgaagaagggat

SEQ ID NO: 7062704 - DNA, 22 bp, Homo sapiens
aagacattccaaagtggctaat

SEQ ID NO: 7062705 - DNA, 22 bp, Homo sapiens
aagacattggcattgactgtaa

SEQ ID NO: 7062706 - DNA, 22 bp, Homo sapiens
aagacattgtggagatgttgct

SEQ ID NO: 7062707 - DNA, 22 bp, Homo sapiens
acactacagggccgggatggaa

SEQ ID NO: 7062708 - DNA, 22 bp, Homo sapiens
acacggcactttaggaaggggc

SEQ ID NO: 7062709 - DNA, 22 bp, Homo sapiens
acacggcactttaggaaggggc

SEQ ID NO: 7062710 - DNA, 22 bp, Homo sapiens
acacctttgtgaagtgatgatg

SEQ ID NO: 7062711 - DNA, 22 bp, Homo sapiens
aagagtttatgatataacatgt

SEQ ID NO: 7062712 - DNA, 22 bp, Homo sapiens
acacatttctcccagtctccat

SEQ ID NO: 7062713 - DNA, 22 bp, Homo sapiens
acacatttctctttttgtaagt

SEQ ID NO: 7062714 - DNA, 22 bp, Homo sapiens
aagaggttgtctgtgatgagtt

SEQ ID NO: 7062715 - DNA, 22 bp, Homo sapiens
aagaggtttaactgactcacag

SEQ ID NO: 7062716 - DNA, 22 bp, Homo sapiens
aagaggtttcatgattttctta

SEQ ID NO: 7062717 - DNA, 22 bp, Homo sapiens
aagagtatagctttaggattga

SEQ ID NO: 7062718 - DNA, 22 bp, Homo sapiens
aagagtctattggaactagaca

SEQ ID NO: 7062719 - DNA, 20 bp, Homo sapiens
aagagtctttactgagctaa

SEQ ID NO: 7062720 - DNA, 22 bp, Homo sapiens
aagagttagctcaataacttga

SEQ ID NO: 7062721 - DNA, 22 bp, Homo sapiens
aagagtttaccagtgctgcttc

SEQ ID NO: 7062722 - DNA, 22 bp, Homo sapiens
acacacatgcatgcttgccatt

SEQ ID NO: 7062723 - DNA, 22 bp, Homo sapiens
acacacatgcatgcttgccatt

SEQ ID NO: 7062724 - DNA, 22 bp, Homo sapiens
aagaggtgagaagctacactta

SEQ ID NO: 7062725 - DNA, 20 bp, Homo sapiens
aagaggtgataacaggtgag

SEQ ID NO: 7062726 - DNA, 22 bp, Homo sapiens
aagaggtgccaggggttttgta

SEQ ID NO: 7062727 - DNA, 22 bp, Homo sapiens
aagaggtggaacagcaattcgt

SEQ ID NO: 7062728 - DNA, 22 bp, Homo sapiens
aagaggtgggttggacagatac

SEQ ID NO: 7062729 - DNA, 22 bp, Homo sapiens
aagaggttattgttcccagctt

SEQ ID NO: 7062730 - DNA, 22 bp, Homo sapiens
aagaggttctaatttaactatc

SEQ ID NO: 7062731 - DNA, 20 bp, Homo sapiens
acacacagagacatgcgcat

SEQ ID NO: 7062732 - DNA, 22 bp, Homo sapiens
acacacaggtaaaggagcctgg

SEQ ID NO: 7062733 - DNA, 22 bp, Homo sapiens
acacacaggtaaaggagcctgg

SEQ ID NO: 7062734 - DNA, 22 bp, Homo sapiens
aagaggagtagatgtggttggt

SEQ ID NO: 7062735 - DNA, 22 bp, Homo sapiens
aagaggagtagatgtggttggt

SEQ ID NO: 7062736 - DNA, 19 bp, Homo sapiens
aagaggcaaccctcgagcc

SEQ ID NO: 7062737 - DNA, 22 bp, Homo sapiens
aagaggagggcagattcaaggc

SEQ ID NO: 7062738 - DNA, 22 bp, Homo sapiens
aagaggcagaaatatcgctgaa

SEQ ID NO: 7062739 - DNA, 23 bp, Homo sapiens
aagaggaggccctgctcccgtcc

SEQ ID NO: 7062740 - DNA, 22 bp, Homo sapiens
aagaggaggattgatgtgggag

SEQ ID NO: 7062741 - DNA, 22 bp, Homo sapiens
aagacattttagagatagggaa

SEQ ID NO: 7062742 - DNA, 18 bp, Homo sapiens
acagaggcagacatgtat

SEQ ID NO: 7062743 - DNA, 22 bp, Homo sapiens
acagaggaagcatatagcacaa

SEQ ID NO: 7062744 - DNA, 22 bp, Homo sapiens
acagaggaaggctgagctgccc

SEQ ID NO: 7062745 - DNA, 22 bp, Homo sapiens
acagaggaaggctgagctgccc

SEQ ID NO: 7062746 - DNA, 22 bp, Homo sapiens
acagaggaagcatatagcacaa

SEQ ID NO: 7062747 - DNA, 22 bp, Homo sapiens
aagcacatctcaaacttcatct

SEQ ID NO: 7062748 - DNA, 22 bp, Homo sapiens
aagcacatctcctgtgcagaac

SEQ ID NO: 7062749 - DNA, 22 bp, Homo sapiens
aagcacatctcctgtgcagaac

SEQ ID NO: 7062750 - DNA, 22 bp, Homo sapiens
aagcacattaaggaacattgaa

SEQ ID NO: 7062751 - DNA, 22 bp, Homo sapiens
aagcacattgcctggcacatag

SEQ ID NO: 7062752 - DNA, 22 bp, Homo sapiens
aagcacattgtacatttgtgct

SEQ ID NO: 7062753 - DNA, 22 bp, Homo sapiens
aagcacattgtacatttgtgct

SEQ ID NO: 7062754 - DNA, 20 bp, Homo sapiens
aagcacatttctacaataat

SEQ ID NO: 7062755 - DNA, 22 bp, Homo sapiens
aagcacatttggaaaacatgga

SEQ ID NO: 7062756 - DNA, 22 bp, Homo sapiens
acagatgaaacccagctagttg

SEQ ID NO: 7062757 - DNA, 22 bp, Homo sapiens
acagatgagaagctgcattcaa

SEQ ID NO: 7062758 - DNA, 22 bp, Homo sapiens
aagattttctcaactgtatttg

SEQ ID NO: 7062759 - DNA, 22 bp, Homo sapiens
aagatttttttccacagactca

SEQ ID NO: 7062760 - DNA, 22 bp, Homo sapiens
aagatttttttccacagactca

SEQ ID NO: 7062761 - DNA, 22 bp, Homo sapiens
aagattttctcaactgtatttg

SEQ ID NO: 7062762 - DNA, 22 bp, Homo sapiens
aagattttcagtgcctaaaaca

SEQ ID NO: 7062763 - DNA, 22 bp, Homo sapiens
aagattttcagctaatggtgca

SEQ ID NO: 7062764 - DNA, 22 bp, Homo sapiens
aagatatactattaagtaccat

SEQ ID NO: 7062765 - DNA, 20 bp, Homo sapiens
aactcctagcctcaagtgat

SEQ ID NO: 7062766 - DNA, 22 bp, Homo sapiens
aactatacatatttacatagac

SEQ ID NO: 7062767 - DNA, 22 bp, Homo sapiens
aactcagttacatattagaata

SEQ ID NO: 7062768 - DNA, 22 bp, Homo sapiens
aatcacatttacattgctaatt

SEQ ID NO: 7062769 - DNA, 22 bp, Homo sapiens
aaccagctgagaatgcttctgc

SEQ ID NO: 7062770 - DNA, 22 bp, Homo sapiens
aacagtttgggtaggtatgtag

SEQ ID NO: 7062771 - DNA, 22 bp, Homo sapiens
aacataaatttgaagtggcaaa

SEQ ID NO: 7062772 - DNA, 22 bp, Homo sapiens
aacataaatttgaagtggcaaa

SEQ ID NO: 7062773 - DNA, 22 bp, Homo sapiens
aacattaagatggcggaacagt

SEQ ID NO: 7062774 - DNA, 20 bp, Homo sapiens
aacattgaaagtctagaaga

SEQ ID NO: 7062775 - DNA, 22 bp, Homo sapiens
aacatttacaaatccttctgca

SEQ ID NO: 7062776 - DNA, 22 bp, Homo sapiens
aacatttatgattgaggtaaat

SEQ ID NO: 7062777 - DNA, 22 bp, Homo sapiens
aacatttattctaattctggga

SEQ ID NO: 7062778 - DNA, 22 bp, Homo sapiens
aacatttcagcacctgattcct

SEQ ID NO: 7062779 - DNA, 22 bp, Homo sapiens
aatcacatgtgctcaattttaa

SEQ ID NO: 7062780 - DNA, 22 bp, Homo sapiens
aacagtttgctttaagaggcac

SEQ ID NO: 7062781 - DNA, 22 bp, Homo sapiens
aacagtttgagctttgaatttc

SEQ ID NO: 7062782 - DNA, 18 bp, Homo sapiens
aacagtttccagattctc

SEQ ID NO: 7062783 - DNA, 22 bp, Homo sapiens
aataaacaaatctttcctgtgg

SEQ ID NO: 7062784 - DNA, 20 bp, Homo sapiens
aataaactactgagagatgt

SEQ ID NO: 7062785 - DNA, 20 bp, Homo sapiens
aataaactactgagagatgt

SEQ ID NO: 7062786 - DNA, 22 bp, Homo sapiens
aagtttggaatgatagagacct

SEQ ID NO: 7062787 - DNA, 20 bp, Homo sapiens
aagtttggagtcaggagacc

SEQ ID NO: 7062788 - DNA, 22 bp, Homo sapiens
aataaaatggtcagttttctca

SEQ ID NO: 7062789 - DNA, 20 bp, Homo sapiens
aagttgcagagagttgtctt

SEQ ID NO: 7062790 - DNA, 22 bp, Homo sapiens
aagtttctgatattgttaaagc

SEQ ID NO: 7062791 - DNA, 22 bp, Homo sapiens
aagtttctgtatgctcttctgt

SEQ ID NO: 7062792 - DNA, 22 bp, Homo sapiens
aagtttctgttcatatctctga

SEQ ID NO: 7062793 - DNA, 22 bp, Homo sapiens
aagtttctttattagcttgtcc

SEQ ID NO: 7062794 - DNA, 22 bp, Homo sapiens
aagtttgacagaagtttctaat

SEQ ID NO: 7062795 - DNA, 22 bp, Homo sapiens
aagttgatttaaactactagtc

SEQ ID NO: 7062796 - DNA, 19 bp, Homo sapiens
aagttgatcattttgacag

SEQ ID NO: 7062797 - DNA, 22 bp, Homo sapiens
aagttgattaatctttcgagaa

SEQ ID NO: 7062798 - DNA, 22 bp, Homo sapiens
aagttgaatcagtaacacagtt

SEQ ID NO: 7062799 - DNA, 22 bp, Homo sapiens
aagttacattttggtctaattg

SEQ ID NO: 7062800 - DNA, 22 bp, Homo sapiens
aacactgtaacagcatcatttt

SEQ ID NO: 7062801 - DNA, 22 bp, Homo sapiens
aagtattcataaggacatatgt

SEQ ID NO: 7062802 - DNA, 22 bp, Homo sapiens
aagtatttcgttctgaaaaagt

SEQ ID NO: 7062803 - DNA, 22 bp, Homo sapiens
aagtatttctggcctgtgaaag

SEQ ID NO: 7062804 - DNA, 22 bp, Homo sapiens
aacactgagtatcagagttggg

SEQ ID NO: 7062805 - DNA, 22 bp, Homo sapiens
aacactggaagggacatcaagt

SEQ ID NO: 7062806 - DNA, 22 bp, Homo sapiens
aacaatcaagtttctaaatgac

SEQ ID NO: 7062807 - DNA, 22 bp, Homo sapiens
aacaataattgcggttctctat

SEQ ID NO: 7062808 - DNA, 22 bp, Homo sapiens
aacaataggctatatgctaggc

SEQ ID NO: 7062809 - DNA, 22 bp, Homo sapiens
aagtacagaaatagcaggtgca

SEQ ID NO: 7062810 - DNA, 18 bp, Homo sapiens
aagtatgcctatgttatt

SEQ ID NO: 7062811 - DNA, 22 bp, Homo sapiens
aaggggctcttgtcaggcgcag

SEQ ID NO: 7062812 - DNA, 22 bp, Homo sapiens
aaggggatttaaggtaagaaga

SEQ ID NO: 7062813 - DNA, 22 bp, Homo sapiens
aaggggaagtagcaccagaggt

SEQ ID NO: 7062814 - DNA, 22 bp, Homo sapiens
aaggggaatagagtgggttgtg

SEQ ID NO: 7062815 - DNA, 22 bp, Homo sapiens
aagggagaggagggtcttgttg

SEQ ID NO: 7062816 - DNA, 21 bp, Homo sapiens
aagggagataggaatcaggcc

SEQ ID NO: 7062817 - DNA, 22 bp, Homo sapiens
aagggagcggggagaccctatg

SEQ ID NO: 7062818 - DNA, 22 bp, Homo sapiens
aagggctggagactgggtcttc

SEQ ID NO: 7062819 - DNA, 22 bp, Homo sapiens
aagggctggagactgggtcttc

SEQ ID NO: 7062820 - DNA, 22 bp, Homo sapiens
aaggggaagtagcaccagaggt

SEQ ID NO: 7062821 - DNA, 22 bp, Homo sapiens
aacaataactagacatgccatg

SEQ ID NO: 7062822 - DNA, 22 bp, Homo sapiens
aacaataactagacatgccatg

SEQ ID NO: 7062823 - DNA, 22 bp, Homo sapiens
aacaataactagacatgccatg

SEQ ID NO: 7062824 - DNA, 22 bp, Homo sapiens
aagggagacagttgtgtgagga

SEQ ID NO: 7062825 - DNA, 22 bp, Homo sapiens
aacaataattgcggttctctat

SEQ ID NO: 7062826 - DNA, 22 bp, Homo sapiens
aagggagacccaccgtcctgga

SEQ ID NO: 7062827 - DNA, 22 bp, Homo sapiens
aaatttcaagcaaagtagctat

SEQ ID NO: 7062828 - DNA, 22 bp, Homo sapiens
aaatttcaagcaaagtagctat

SEQ ID NO: 7062829 - DNA, 22 bp, Homo sapiens
aaatttcagttggaatgagctc

SEQ ID NO: 7062830 - DNA, 22 bp, Homo sapiens
aaatttcagttggaatgagctc

SEQ ID NO: 7062831 - DNA, 22 bp, Homo sapiens
aaatttctaagcagccacttcc

SEQ ID NO: 7062832 - DNA, 22 bp, Homo sapiens
aaatttctaagtcaagaagaac

SEQ ID NO: 7062833 - DNA, 22 bp, Homo sapiens
aaggccacacttgctggccagc

SEQ ID NO: 7062834 - DNA, 22 bp, Homo sapiens
aaattgcattttaaaggtagat

SEQ ID NO: 7062835 - DNA, 22 bp, Homo sapiens
aaattgttgatctacagtaagg

SEQ ID NO: 7062836 - DNA, 22 bp, Homo sapiens
aaatttaaaaagcagcattgca

SEQ ID NO: 7062837 - DNA, 21 bp, Homo sapiens
aaggacgaggttttgattaca

SEQ ID NO: 7062838 - DNA, 22 bp, Homo sapiens
aaggactgacaaatgtcttcct

SEQ ID NO: 7062839 - DNA, 22 bp, Homo sapiens
aaggagaaatggtagatgtgca

SEQ ID NO: 7062840 - DNA, 22 bp, Homo sapiens
aaggagaaatggtagatgtgca

SEQ ID NO: 7062841 - DNA, 22 bp, Homo sapiens
aaattattataggcagagctga

SEQ ID NO: 7062842 - DNA, 22 bp, Homo sapiens
aaattattacaagctagttggc

SEQ ID NO: 7062843 - DNA, 22 bp, Homo sapiens
aagctggggactcagaccccat

SEQ ID NO: 7062844 - DNA, 20 bp, Homo sapiens
aagctgggtaggagaggagc

SEQ ID NO: 7062845 - DNA, 22 bp, Homo sapiens
aagctgggagggagcccagagt

SEQ ID NO: 7062846 - DNA, 22 bp, Homo sapiens
aagctgggacttagcgcagata

SEQ ID NO: 7062847 - DNA, 22 bp, Homo sapiens
aagctgggacttagcgcagata

SEQ ID NO: 7062848 - DNA, 22 bp, Homo sapiens
aagctgtgaaatagattacaca

SEQ ID NO: 7062849 - DNA, 18 bp, Homo sapiens
aagctgggaaggagacag

SEQ ID NO: 7062850 - DNA, 18 bp, Homo sapiens
aagctgggaaggagacag

SEQ ID NO: 7062851 - DNA, 22 bp, Homo sapiens
aagctggcatgtcacctgagaa

SEQ ID NO: 7062852 - DNA, 22 bp, Homo sapiens
aagctgatgtcccagtttgaag

SEQ ID NO: 7062853 - DNA, 22 bp, Homo sapiens
aagctgattctaaaatttatta

SEQ ID NO: 7062854 - DNA, 22 bp, Homo sapiens
aagctggcaattatcaaaactg

SEQ ID NO: 7062855 - DNA, 21 bp, Homo sapiens
aagccagcccacagtggtttg

SEQ ID NO: 7062856 - DNA, 22 bp, Homo sapiens
aagccagtcctctactgggcac

SEQ ID NO: 7062857 - DNA, 22 bp, Homo sapiens
aagccagtgtccagaatgggca

SEQ ID NO: 7062858 - DNA, 22 bp, Homo sapiens
aagccagtgtttttgagagttg

SEQ ID NO: 7062859 - DNA, 22 bp, Homo sapiens
aacaaatttagctctgagtgct

SEQ ID NO: 7062860 - DNA, 22 bp, Homo sapiens
aaatgggcctggaaagaggatg

SEQ ID NO: 7062861 - DNA, 22 bp, Homo sapiens
aaatgggtttgattctcagcca

SEQ ID NO: 7062862 - DNA, 22 bp, Homo sapiens
aaagcaatgggtctaaggtaaa

SEQ ID NO: 7062863 - DNA, 22 bp, Homo sapiens
aacagcagctgaggagctgggc

SEQ ID NO: 7062864 - DNA, 22 bp, Homo sapiens
aacagcagcatgacagctgggt

SEQ ID NO: 7062865 - DNA, 22 bp, Homo sapiens
aacagcttgctgcaccttaata

SEQ ID NO: 7062866 - DNA, 22 bp, Homo sapiens
aacagctttagaggataatagt

SEQ ID NO: 7062867 - DNA, 22 bp, Homo sapiens
aacagctttgagcagttctgta

SEQ ID NO: 7062868 - DNA, 22 bp, Homo sapiens
aacagctttgcttctggagaca

SEQ ID NO: 7062869 - DNA, 22 bp, Homo sapiens
aacagctttgcttctggagaca

SEQ ID NO: 7062870 - DNA, 22 bp, Homo sapiens
aacagctttgtatacagtaact

SEQ ID NO: 7062871 - DNA, 22 bp, Homo sapiens
aacagctttgtgctcagatttg

SEQ ID NO: 7062872 - DNA, 22 bp, Homo sapiens
aacagcttttttggtcagcatt

SEQ ID NO: 7062873 - DNA, 22 bp, Homo sapiens
aacaagaagggaaggcatgatt

SEQ ID NO: 7062874 - DNA, 22 bp, Homo sapiens
aacattcaaaacccagttcagt

SEQ ID NO: 7062875 - DNA, 22 bp, Homo sapiens
aacattcaaaacccagttcagt

SEQ ID NO: 7062876 - DNA, 22 bp, Homo sapiens
aacattcaaaacccagttcagt

SEQ ID NO: 7062877 - DNA, 22 bp, Homo sapiens
aacattcaagttctggtttatg

SEQ ID NO: 7062878 - DNA, 22 bp, Homo sapiens
aactatgttaataagtttcatt

SEQ ID NO: 7062879 - DNA, 22 bp, Homo sapiens
aactcactttgtggcttctgaa

SEQ ID NO: 7062880 - DNA, 22 bp, Homo sapiens
aactaatacattaatacatgtg

SEQ ID NO: 7062881 - DNA, 22 bp, Homo sapiens
aacttgcagacacctgtctcaa

SEQ ID NO: 7062882 - DNA, 22 bp, Homo sapiens
aactcagtgtgtttcttagtat

SEQ ID NO: 7062883 - DNA, 22 bp, Homo sapiens
aagccactgagatttcactgca

SEQ ID NO: 7062884 - DNA, 22 bp, Homo sapiens
aagccactcacaataactgtcc

SEQ ID NO: 7062885 - DNA, 22 bp, Homo sapiens
aagccactgagatttcactgca

SEQ ID NO: 7062886 - DNA, 22 bp, Homo sapiens
aagccaatggattggttgcttt

SEQ ID NO: 7062887 - DNA, 22 bp, Homo sapiens
aagccaatgttgcctgggtttc

SEQ ID NO: 7062888 - DNA, 22 bp, Homo sapiens
aagccacagatcgttctgtcac

SEQ ID NO: 7062889 - DNA, 22 bp, Homo sapiens
aagccactatggtgattctcaa

SEQ ID NO: 7062890 - DNA, 22 bp, Homo sapiens
aagccactttcagctgtctcag

SEQ ID NO: 7062891 - DNA, 23 bp, Homo sapiens
aagcatggttcacagttagtact

SEQ ID NO: 7062892 - DNA, 22 bp, Homo sapiens
aagccaatgatacgggtgatct

SEQ ID NO: 7062893 - DNA, 22 bp, Homo sapiens
aagccaatgctagcccacatgc

SEQ ID NO: 7062894 - DNA, 22 bp, Homo sapiens
aagcactgagcacagtggctga

SEQ ID NO: 7062895 - DNA, 22 bp, Homo sapiens
aagcactgggtatagcaatgat

SEQ ID NO: 7062896 - DNA, 22 bp, Homo sapiens
aagcagagttagcttgtcacct

SEQ ID NO: 7062897 - DNA, 22 bp, Homo sapiens
aagcagatgggactccaaggca

SEQ ID NO: 7062898 - DNA, 22 bp, Homo sapiens
aaatatgaatgataagagttat

SEQ ID NO: 7062899 - DNA, 22 bp, Homo sapiens
aaatatgaatgataagagttat

SEQ ID NO: 7062900 - DNA, 22 bp, Homo sapiens
aaatatgaatgataagagttat

SEQ ID NO: 7062901 - DNA, 22 bp, Homo sapiens
aagcacagctggaacagcagga

SEQ ID NO: 7062902 - DNA, 22 bp, Homo sapiens
aagcacctgcagttgacaaaaa

SEQ ID NO: 7062903 - DNA, 22 bp, Homo sapiens
aagcacctgggttatatcttag

SEQ ID NO: 7062904 - DNA, 19 bp, Homo sapiens
aaatatcagagagatgata

SEQ ID NO: 7062905 - DNA, 22 bp, Homo sapiens
aagcaactccctcctcattttt

SEQ ID NO: 7062906 - DNA, 22 bp, Homo sapiens
aaatatcattctggtgcacaga

SEQ ID NO: 7062907 - DNA, 22 bp, Homo sapiens
aaatatcatttataacttttaa

SEQ ID NO: 7062908 - DNA, 18 bp, Homo sapiens
aagaggaggagcaggttg

SEQ ID NO: 7062909 - DNA, 18 bp, Homo sapiens
aagaggaggagcaggttg

SEQ ID NO: 7062910 - DNA, 22 bp, Homo sapiens
aagattctcagaaaaaggctat

SEQ ID NO: 7062911 - DNA, 22 bp, Homo sapiens
aagattctcagagtgaaagaat

SEQ ID NO: 7062912 - DNA, 22 bp, Homo sapiens
aagattctccctgagatattta

SEQ ID NO: 7062913 - DNA, 22 bp, Homo sapiens
aagattctgaaaggggtggggc

SEQ ID NO: 7062914 - DNA, 22 bp, Homo sapiens
aagaggaggacggttcccagaa

SEQ ID NO: 7062915 - DNA, 18 bp, Homo sapiens
aagaggaggaaacccagg

SEQ ID NO: 7062916 - DNA, 22 bp, Homo sapiens
aagaggagacttcagcaacttg

SEQ ID NO: 7062917 - DNA, 22 bp, Homo sapiens
aagcaaatgtgggtgcagaatt

SEQ ID NO: 7062918 - DNA, 22 bp, Homo sapiens
aagaggagaaaggctggctttg

SEQ ID NO: 7062919 - DNA, 22 bp, Homo sapiens
aagaggaagtctccatggagag

SEQ ID NO: 7062920 - DNA, 22 bp, Homo sapiens
aagagcatctatttcacagtgg

SEQ ID NO: 7062921 - DNA, 22 bp, Homo sapiens
aagagcatttccactggcactg

SEQ ID NO: 7062922 - DNA, 22 bp, Homo sapiens
aagagcatttggtgagatttga

SEQ ID NO: 7062923 - DNA, 22 bp, Homo sapiens
aagagccagctagtgaagaggc

SEQ ID NO: 7062924 - DNA, 22 bp, Homo sapiens
aagagccagctagtgaagaggc

SEQ ID NO: 7062925 - DNA, 22 bp, Homo sapiens
aagagccagtgggaaagtcttg

SEQ ID NO: 7062926 - DNA, 22 bp, Homo sapiens
aagaatgttagtttctgataca

SEQ ID NO: 7062927 - DNA, 22 bp, Homo sapiens
aactttctttgcatctaagttt

SEQ ID NO: 7062928 - DNA, 22 bp, Homo sapiens
aagaatgtgggtggatatgatg

SEQ ID NO: 7062929 - DNA, 22 bp, Homo sapiens
aagaatgtgggtggatatgatg

SEQ ID NO: 7062930 - DNA, 22 bp, Homo sapiens
aagaatgtggcatttatttata

SEQ ID NO: 7062931 - DNA, 22 bp, Homo sapiens
aagaatgtcgttggtattttaa

SEQ ID NO: 7062932 - DNA, 22 bp, Homo sapiens
aagaatgagctcaaagatctta

SEQ ID NO: 7062933 - DNA, 22 bp, Homo sapiens
aagaaagtgggtaatatgattt

SEQ ID NO: 7062934 - DNA, 22 bp, Homo sapiens
aagaaagtgtggagagcctagc

SEQ ID NO: 7062935 - DNA, 22 bp, Homo sapiens
aagaaagtgatgagctacagat

SEQ ID NO: 7062936 - DNA, 22 bp, Homo sapiens
aagaaagtgctttgtaaattat

SEQ ID NO: 7062937 - DNA, 18 bp, Homo sapiens
aaagaaggattggagagc

SEQ ID NO: 7062938 - DNA, 22 bp, Homo sapiens
aaagaagggacagactgcctct

SEQ ID NO: 7062939 - DNA, 23 bp, Homo sapiens
aaacttgctatggctgaaatcat

SEQ ID NO: 7062940 - DNA, 22 bp, Homo sapiens
aaacttgagtcacttctcttcc

SEQ ID NO: 7062941 - DNA, 22 bp, Homo sapiens
aaactgtaaacacagcagtaca

SEQ ID NO: 7062942 - DNA, 22 bp, Homo sapiens
aaacatgagcatctcttcaagc

SEQ ID NO: 7062943 - DNA, 22 bp, Homo sapiens
aaacatttgcaactcggtttgg

SEQ ID NO: 7062944 - DNA, 19 bp, Homo sapiens
aaacacagatttcttacca

SEQ ID NO: 7062945 - DNA, 22 bp, Homo sapiens
aaacacagatttctttgtccca

SEQ ID NO: 7062946 - DNA, 22 bp, Homo sapiens
aaacacagggatatatattcca

SEQ ID NO: 7062947 - DNA, 22 bp, Homo sapiens
aaacacaggtactgcagaagtg

SEQ ID NO: 7062948 - DNA, 22 bp, Homo sapiens
aaacatcttctcttgattcttt

SEQ ID NO: 7062949 - DNA, 22 bp, Homo sapiens
aaacatcttctcttgattcttt

SEQ ID NO: 7062950 - DNA, 22 bp, Homo sapiens
aaacatgagcacttgcttcata

SEQ ID NO: 7062951 - DNA, 22 bp, Homo sapiens
aaacatgagcatctcttcaagc

SEQ ID NO: 7062952 - DNA, 22 bp, Homo sapiens
aaaagtctgctctcatttcaga

SEQ ID NO: 7062953 - DNA, 22 bp, Homo sapiens
aaaagtctctctgagtaaaagt

SEQ ID NO: 7062954 - DNA, 22 bp, Homo sapiens
aaaagggaaagcagaatgactt

SEQ ID NO: 7062955 - DNA, 22 bp, Homo sapiens
aaaagtattttggatctcagat

SEQ ID NO: 7062956 - DNA, 22 bp, Homo sapiens
aaaaatgtcattatggaactga

SEQ ID NO: 7062957 - DNA, 22 bp, Homo sapiens
aaaaatgtgaccacagggtgtt

SEQ ID NO: 7062958 - DNA, 21 bp, Homo sapiens
aaaaatgaagttgttcaggaa

SEQ ID NO: 7062959 - DNA, 22 bp, Homo sapiens
aaaaatgaattcttcagtggca

SEQ ID NO: 7062960 - DNA, 22 bp, Homo sapiens
aaaaactgtaattacttttgca

SEQ ID NO: 7062961 - DNA, 22 bp, Homo sapiens
aaacaacatggtgggtgtgtag

SEQ ID NO: 7062962 - DNA, 22 bp, Homo sapiens
aaacaagagcttacatggctgc

SEQ ID NO: 7062963 - DNA, 22 bp, Homo sapiens
aaacaaatagtgcatgggaatt

SEQ ID NO: 7062964 - DNA, 22 bp, Homo sapiens
aaacaacaatccaatgggagct

SEQ ID NO: 7062965 - DNA, 22 bp, Homo sapiens
aaaatagattctaggatgtctt

SEQ ID NO: 7062966 - DNA, 22 bp, Homo sapiens
aaaagtcttggggaaggccagg

SEQ ID NO: 7062967 - DNA, 22 bp, Homo sapiens
aaaagtcttgtcaaggttccca

SEQ ID NO: 7062968 - DNA, 22 bp, Homo sapiens
aaaatagctatggaatgtcact

SEQ ID NO: 7062969 - DNA, 22 bp, Homo sapiens
aaacagttttctcatttagtgt

SEQ ID NO: 7062970 - DNA, 22 bp, Homo sapiens
aaacactgcagggtttacttga

SEQ ID NO: 7062971 - DNA, 22 bp, Homo sapiens
aaacactggcaatttcatgcac

SEQ ID NO: 7062972 - DNA, 22 bp, Homo sapiens
aaacactggtatgatgtatagt

SEQ ID NO: 7062973 - DNA, 22 bp, Homo sapiens
aaacactggtatgatgtatagt

SEQ ID NO: 7062974 - DNA, 22 bp, Homo sapiens
aaagtcatttagccttatctcc

SEQ ID NO: 7062975 - DNA, 22 bp, Homo sapiens
aaaggaggaatggagagatgct

SEQ ID NO: 7062976 - DNA, 22 bp, Homo sapiens
aaaggaggccacatggctagga

SEQ ID NO: 7062977 - DNA, 22 bp, Homo sapiens
aaaggcatggatagtgaattca

SEQ ID NO: 7062978 - DNA, 22 bp, Homo sapiens
aaacactgatggatatttttcc

SEQ ID NO: 7062979 - DNA, 22 bp, Homo sapiens
aaacactgatggatatttttcc

SEQ ID NO: 7062980 - DNA, 22 bp, Homo sapiens
aaagcaatcagattcagatgtc

SEQ ID NO: 7062981 - DNA, 22 bp, Homo sapiens
aaatactgttgaatgaagtaag

SEQ ID NO: 7062982 - DNA, 22 bp, Homo sapiens
aaactaaacctggcttagtaag

SEQ ID NO: 7062983 - DNA, 22 bp, Homo sapiens
aaatatgtgatcagtgaataaa

SEQ ID NO: 7062984 - DNA, 22 bp, Homo sapiens
aaatatgtaagattagcactag

SEQ ID NO: 7062985 - DNA, 22 bp, Homo sapiens
aaatatgtaaccaaggtgaagt

SEQ ID NO: 7062986 - DNA, 19 bp, Homo sapiens
aaactaaggggaaatgttt

SEQ ID NO: 7062987 - DNA, 19 bp, Homo sapiens
aaactaaggggaaatgttt

SEQ ID NO: 7062988 - DNA, 23 bp, Homo sapiens
aaactacaacgccaggcactgag

SEQ ID NO: 7062989 - DNA, 22 bp, Homo sapiens
aaactacactttgggaccagca

SEQ ID NO: 7062990 - DNA, 22 bp, Homo sapiens
aaactacatctcatggatgagg

SEQ ID NO: 7062991 - DNA, 23 bp, Homo sapiens
aaactacatttatagtttttctc

SEQ ID NO: 7062992 - DNA, 23 bp, Homo sapiens
aaactacatttatagtttttctc

SEQ ID NO: 7062993 - DNA, 18 bp, Homo sapiens
aaatgctaggctacatga

SEQ ID NO: 7062994 - DNA, 22 bp, Homo sapiens
aaatgctctccaaaatgaaagt

SEQ ID NO: 7062995 - DNA, 22 bp, Homo sapiens
aaatgctctctaatgtaataca

SEQ ID NO: 7062996 - DNA, 22 bp, Homo sapiens
aaatgcagctgggcatgagagg

SEQ ID NO: 7062997 - DNA, 22 bp, Homo sapiens
aaatcatggtggaagaaacaga

SEQ ID NO: 7062998 - DNA, 22 bp, Homo sapiens
aaatatgttttccagttgtcat

SEQ ID NO: 7062999 - DNA, 22 bp, Homo sapiens
aaatattagggagaacagggac

SEQ ID NO: 7063000 - DNA, 22 bp, Homo sapiens
aaatattattgcttaaggggag

SEQ ID NO: 7063001 - DNA, 22 bp, Homo sapiens
aaatattattgcttaaggggag

SEQ ID NO: 7063002 - DNA, 22 bp, Homo sapiens
tcacatctccctggaggacaca

SEQ ID NO: 7063003 - DNA, 22 bp, Homo sapiens
tcacatctctgttttctaaatc

SEQ ID NO: 7063004 - DNA, 20 bp, Homo sapiens
tcacatcctctcccaacatg

SEQ ID NO: 7063005 - DNA, 22 bp, Homo sapiens
tcacatctaattccatttctgc

SEQ ID NO: 7063006 - DNA, 22 bp, Homo sapiens
tcacatctatacccaataattt

SEQ ID NO: 7063007 - DNA, 21 bp, Homo sapiens
tcacatctatgttaagcaaac

SEQ ID NO: 7063008 - DNA, 22 bp, Homo sapiens
tcacagctaagcttggtcactg

SEQ ID NO: 7063009 - DNA, 22 bp, Homo sapiens
tcacatcaacattatagcatga

SEQ ID NO: 7063010 - DNA, 17 bp, Homo sapiens
tcacatcacacaagcaa

SEQ ID NO: 7063011 - DNA, 22 bp, Homo sapiens
tcacatcacatgacagtaggcc

SEQ ID NO: 7063012 - DNA, 22 bp, Homo sapiens
tcacatcacatgagtgcaagga

SEQ ID NO: 7063013 - DNA, 22 bp, Homo sapiens
tcacagcaacactggggcagac

SEQ ID NO: 7063014 - DNA, 22 bp, Homo sapiens
tcacagcaaccctgaggcgagt

SEQ ID NO: 7063015 - DNA, 22 bp, Homo sapiens
tcacagcaccctgaggtgctgg

SEQ ID NO: 7063016 - DNA, 22 bp, Homo sapiens
tcacagcattcgcaatggacag

SEQ ID NO: 7063017 - DNA, 22 bp, Homo sapiens
tcacagcattgagtgtactaga

SEQ ID NO: 7063018 - DNA, 22 bp, Homo sapiens
tcacagcattgtcacaaggctg

SEQ ID NO: 7063019 - DNA, 22 bp, Homo sapiens
tcacagaatgtcagagttgggg

SEQ ID NO: 7063020 - DNA, 22 bp, Homo sapiens
tcacagaatctctgataagtct

SEQ ID NO: 7063021 - DNA, 22 bp, Homo sapiens
tcacagaatctctgataagtct

SEQ ID NO: 7063022 - DNA, 22 bp, Homo sapiens
tcacagaatagcactgtaagcg

SEQ ID NO: 7063023 - DNA, 18 bp, Homo sapiens
tcacagaatattgagtgg

SEQ ID NO: 7063024 - DNA, 22 bp, Homo sapiens
tcacacatactcatgtgtgagt

SEQ ID NO: 7063025 - DNA, 22 bp, Homo sapiens
tcacacatctcaggtgtttaat

SEQ ID NO: 7063026 - DNA, 22 bp, Homo sapiens
tcacacagggttctggtctcat

SEQ ID NO: 7063027 - DNA, 22 bp, Homo sapiens
tcacacaggtttgcaatgattt

SEQ ID NO: 7063028 - DNA, 21 bp, Homo sapiens
tcacagagccacagaattggt

SEQ ID NO: 7063029 - DNA, 20 bp, Homo sapiens
tcacagatgaaagttcaaga

SEQ ID NO: 7063030 - DNA, 22 bp, Homo sapiens
tcaattctggtcctcaggaact

SEQ ID NO: 7063031 - DNA, 22 bp, Homo sapiens
tcaattcaacacatgcacattg

SEQ ID NO: 7063032 - DNA, 22 bp, Homo sapiens
tcaattatgccattgcaatatt

SEQ ID NO: 7063033 - DNA, 22 bp, Homo sapiens
tcaattactaaccaaataatgt

SEQ ID NO: 7063034 - DNA, 22 bp, Homo sapiens
tcacacacataatctaagatta

SEQ ID NO: 7063035 - DNA, 22 bp, Homo sapiens
tcacacacatggatagtatttt

SEQ ID NO: 7063036 - DNA, 22 bp, Homo sapiens
tcacacacatttgctgtctgat

SEQ ID NO: 7063037 - DNA, 21 bp, Homo sapiens
tcacacacgtttccaagggca

SEQ ID NO: 7063038 - DNA, 22 bp, Homo sapiens
tcacacagattggtagagctga

SEQ ID NO: 7063039 - DNA, 22 bp, Homo sapiens
tcacacagcttggagttatggt

SEQ ID NO: 7063040 - DNA, 22 bp, Homo sapiens
tcacacagggtcggaaagagtg

SEQ ID NO: 7063041 - DNA, 18 bp, Homo sapiens
tcaaaatatttctgtgga

SEQ ID NO: 7063042 - DNA, 18 bp, Homo sapiens
tcaaaatatttctgtgga

SEQ ID NO: 7063043 - DNA, 22 bp, Homo sapiens
tcaaaagtttcacatagagata

SEQ ID NO: 7063044 - DNA, 22 bp, Homo sapiens
tcaaaaatggtctttgagctgc

SEQ ID NO: 7063045 - DNA, 23 bp, Homo sapiens
tcaaacatattgtgagacacagg

SEQ ID NO: 7063046 - DNA, 22 bp, Homo sapiens
tcagaggaccttactgagaacc

SEQ ID NO: 7063047 - DNA, 22 bp, Homo sapiens
tcagaggacgcactagggttgt

SEQ ID NO: 7063048 - DNA, 22 bp, Homo sapiens
tcagaggactaccttctccagt

SEQ ID NO: 7063049 - DNA, 22 bp, Homo sapiens
tcagaggactaccttctccagt

SEQ ID NO: 7063050 - DNA, 22 bp, Homo sapiens
tcagaggactaccttctccagt

SEQ ID NO: 7063051 - DNA, 22 bp, Homo sapiens
tcagaggagaagttgggaaaat

SEQ ID NO: 7063052 - DNA, 22 bp, Homo sapiens
tcagaggagaagttgggaaaat

SEQ ID NO: 7063053 - DNA, 22 bp, Homo sapiens
tcagaggagaccaaggggaata

SEQ ID NO: 7063054 - DNA, 22 bp, Homo sapiens
tcagaggagaccaaggggaata

SEQ ID NO: 7063055 - DNA, 18 bp, Homo sapiens
tcagaggagatacctaaa

SEQ ID NO: 7063056 - DNA, 22 bp, Homo sapiens
tcagaggattgcctcagcgagc

SEQ ID NO: 7063057 - DNA, 22 bp, Homo sapiens
tcagaggattgcctcagcgagc

SEQ ID NO: 7063058 - DNA, 22 bp, Homo sapiens
tcagaggattggacttttatgt

SEQ ID NO: 7063059 - DNA, 19 bp, Homo sapiens
tcagaggatttggctatga

SEQ ID NO: 7063060 - DNA, 19 bp, Homo sapiens
tcagaggatttggctatga

SEQ ID NO: 7063061 - DNA, 18 bp, Homo sapiens
tcagagagaatagtaatt

SEQ ID NO: 7063062 - DNA, 23 bp, Homo sapiens
tcagagagctgttgagagctgcc

SEQ ID NO: 7063063 - DNA, 22 bp, Homo sapiens
tcagagaggattttaataagtg

SEQ ID NO: 7063064 - DNA, 22 bp, Homo sapiens
tcagagaggcaatactgtttaa

SEQ ID NO: 7063065 - DNA, 22 bp, Homo sapiens
tcagaggaagccttggtgggag

SEQ ID NO: 7063066 - DNA, 22 bp, Homo sapiens
tcagaggaataatgctgcattt

SEQ ID NO: 7063067 - DNA, 22 bp, Homo sapiens
tcagaggaataatgctgcattt

SEQ ID NO: 7063068 - DNA, 22 bp, Homo sapiens
tcagaggaatttgcttttcatg

SEQ ID NO: 7063069 - DNA, 22 bp, Homo sapiens
tcagaggacaagctccctggtg

SEQ ID NO: 7063070 - DNA, 22 bp, Homo sapiens
tcagaggacaagctccctggtg

SEQ ID NO: 7063071 - DNA, 22 bp, Homo sapiens
tcagaggacagcagctaaataa

SEQ ID NO: 7063072 - DNA, 22 bp, Homo sapiens
tcagaggacagcagctaaataa

SEQ ID NO: 7063073 - DNA, 22 bp, Homo sapiens
tcagaggacagcagctaaataa

SEQ ID NO: 7063074 - DNA, 22 bp, Homo sapiens
tcagaggaccttactgagaacc

SEQ ID NO: 7063075 - DNA, 22 bp, Homo sapiens
tcagaagcaaacatcactctag

SEQ ID NO: 7063076 - DNA, 22 bp, Homo sapiens
tcagaagcaggagtgtgcacaa

SEQ ID NO: 7063077 - DNA, 22 bp, Homo sapiens
tcagaagcatgtggggagcctg

SEQ ID NO: 7063078 - DNA, 20 bp, Homo sapiens
tcagagaagggactgagatt

SEQ ID NO: 7063079 - DNA, 22 bp, Homo sapiens
tcagagaaggtaagtgacctgc

SEQ ID NO: 7063080 - DNA, 22 bp, Homo sapiens
tcagagaaggtaagtgacctgc

SEQ ID NO: 7063081 - DNA, 22 bp, Homo sapiens
tcagagaagtaaggtggggtgc

SEQ ID NO: 7063082 - DNA, 22 bp, Homo sapiens
tcagagaagtaggctaatggtg

SEQ ID NO: 7063083 - DNA, 23 bp, Homo sapiens
tcagagaagttgtaggctgggga

SEQ ID NO: 7063084 - DNA, 22 bp, Homo sapiens
tcagagaatctctccttagttt

SEQ ID NO: 7063085 - DNA, 23 bp, Homo sapiens
tcagagaatggtatgcttttcct

SEQ ID NO: 7063086 - DNA, 22 bp, Homo sapiens
tcagagaattcgattaaatgca

SEQ ID NO: 7063087 - DNA, 22 bp, Homo sapiens
tcagagaattctcagatgactc

SEQ ID NO: 7063088 - DNA, 22 bp, Homo sapiens
tcagagaattgtttaatggaat

SEQ ID NO: 7063089 - DNA, 22 bp, Homo sapiens
tcacgtgagggacctgtgtctg

SEQ ID NO: 7063090 - DNA, 22 bp, Homo sapiens
tcacgtgagggacctgtgtctg

SEQ ID NO: 7063091 - DNA, 22 bp, Homo sapiens
tcacgagggccctgggcagctg

SEQ ID NO: 7063092 - DNA, 22 bp, Homo sapiens
tcacctctctggccgtctacct

SEQ ID NO: 7063093 - DNA, 22 bp, Homo sapiens
tcacctgtattaatacagaact

SEQ ID NO: 7063094 - DNA, 22 bp, Homo sapiens
tcaccgaggctggagtgcagtg

SEQ ID NO: 7063095 - DNA, 22 bp, Homo sapiens
tcaccgccttgcccggccgggc

SEQ ID NO: 7063096 - DNA, 22 bp, Homo sapiens
tcacccttgataatgttcttct

SEQ ID NO: 7063097 - DNA, 22 bp, Homo sapiens
tcaccgaggctggagtgcagtg

SEQ ID NO: 7063098 - DNA, 22 bp, Homo sapiens
tcacccaggtaatagcagtttg

SEQ ID NO: 7063099 - DNA, 22 bp, Homo sapiens
tcacatgccacagatgaggcaa

SEQ ID NO: 7063100 - DNA, 22 bp, Homo sapiens
tcacatctgcctccatagcacc

SEQ ID NO: 7063101 - DNA, 20 bp, Homo sapiens
tcacatctggcagctgatga

SEQ ID NO: 7063102 - DNA, 22 bp, Homo sapiens
tcacatctgtgtgattgtcatt

SEQ ID NO: 7063103 - DNA, 22 bp, Homo sapiens
tcactgggagagctgacaagga

SEQ ID NO: 7063104 - DNA, 17 bp, Homo sapiens
tcactgggcctgctccc

SEQ ID NO: 7063105 - DNA, 22 bp, Homo sapiens
tcactggggccatgtgagggac

SEQ ID NO: 7063106 - DNA, 22 bp, Homo sapiens
tcactaatgagctaaggaaaag

SEQ ID NO: 7063107 - DNA, 22 bp, Homo sapiens
tcactggggcctttggtcagga

SEQ ID NO: 7063108 - DNA, 18 bp, Homo sapiens
tcactgggtgtatgtggc

SEQ ID NO: 7063109 - DNA, 22 bp, Homo sapiens
tcactggtgtgagaggagcaaa

SEQ ID NO: 7063110 - DNA, 22 bp, Homo sapiens
tcactggtgtgagaggagcaaa

SEQ ID NO: 7063111 - DNA, 22 bp, Homo sapiens
tcactgtagagtctgtttccac

SEQ ID NO: 7063112 - DNA, 22 bp, Homo sapiens
tcactgtctgaaagaaatggcc

SEQ ID NO: 7063113 - DNA, 22 bp, Homo sapiens
tcaggcaatctgacagctggag

SEQ ID NO: 7063114 - DNA, 22 bp, Homo sapiens
tcaggagggtgacaggccctgg

SEQ ID NO: 7063115 - DNA, 22 bp, Homo sapiens
tcaggcagatgcagggatggat

SEQ ID NO: 7063116 - DNA, 22 bp, Homo sapiens
tcaggcagcattaaacttcagc

SEQ ID NO: 7063117 - DNA, 22 bp, Homo sapiens
tcaggcagctccaggaatggta

SEQ ID NO: 7063118 - DNA, 22 bp, Homo sapiens
tcaggcaggaagggaggacttg

SEQ ID NO: 7063119 - DNA, 22 bp, Homo sapiens
tcaggcaggacaattatttagg

SEQ ID NO: 7063120 - DNA, 22 bp, Homo sapiens
tcaggcaggatcccagggaagg

SEQ ID NO: 7063121 - DNA, 21 bp, Homo sapiens
tcaggcaggcgcagagggaag

SEQ ID NO: 7063122 - DNA, 21 bp, Homo sapiens
tcaggcaggcgcagagggaag

SEQ ID NO: 7063123 - DNA, 22 bp, Homo sapiens
tcaggcaggctcagaggaaaac

SEQ ID NO: 7063124 - DNA, 22 bp, Homo sapiens
tcaggcaggctcagaggaaaac

SEQ ID NO: 7063125 - DNA, 21 bp, Homo sapiens
tcaggcaggtcccactgaaca

SEQ ID NO: 7063126 - DNA, 22 bp, Homo sapiens
tcaggcaggtggctggctatgg

SEQ ID NO: 7063127 - DNA, 22 bp, Homo sapiens
tcaggcaggttggctgcaggtc

SEQ ID NO: 7063128 - DNA, 22 bp, Homo sapiens
tcaggcaggttggctgcaggtc

SEQ ID NO: 7063129 - DNA, 22 bp, Homo sapiens
tcaggagggctaagactgtagc

SEQ ID NO: 7063130 - DNA, 22 bp, Homo sapiens
tcaggaggatgtcggcaaattt

SEQ ID NO: 7063131 - DNA, 22 bp, Homo sapiens
tcaggagcagggggaagctctg

SEQ ID NO: 7063132 - DNA, 22 bp, Homo sapiens
tcaggagctatggactgtcaaa

SEQ ID NO: 7063133 - DNA, 22 bp, Homo sapiens
tcaggagatgtaaccttagctg

SEQ ID NO: 7063134 - DNA, 22 bp, Homo sapiens
tcaggagcagcatgggtgagag

SEQ ID NO: 7063135 - DNA, 22 bp, Homo sapiens
tcaggaaatggacatctttgct

SEQ ID NO: 7063136 - DNA, 22 bp, Homo sapiens
tcaggaaatggtgatttggttg

SEQ ID NO: 7063137 - DNA, 22 bp, Homo sapiens
tcaggaaattaaacacttgaaa

SEQ ID NO: 7063138 - DNA, 22 bp, Homo sapiens
tcaggagagtgttcagtggagg

SEQ ID NO: 7063139 - DNA, 22 bp, Homo sapiens
tcaggaaagagtgtatccatca

SEQ ID NO: 7063140 - DNA, 22 bp, Homo sapiens
tcaggaaagagttagatgatta

SEQ ID NO: 7063141 - DNA, 22 bp, Homo sapiens
tcaggaaagcctagaagagaac

SEQ ID NO: 7063142 - DNA, 22 bp, Homo sapiens
tcaggaaaggtttgttgaatgg

SEQ ID NO: 7063143 - DNA, 22 bp, Homo sapiens
tcagaggcttgaagcccaagcc

SEQ ID NO: 7063144 - DNA, 17 bp, Homo sapiens
tcagagggatgagcagg

SEQ ID NO: 7063145 - DNA, 22 bp, Homo sapiens
tcagaggtaaaaactcactgta

SEQ ID NO: 7063146 - DNA, 22 bp, Homo sapiens
tcagaggtaagggctgagagga

SEQ ID NO: 7063147 - DNA, 18 bp, Homo sapiens
tcagaggtacagaaaagt

SEQ ID NO: 7063148 - DNA, 22 bp, Homo sapiens
tcagaggtagtagcagagttga

SEQ ID NO: 7063149 - DNA, 22 bp, Homo sapiens
tcagaggtagtagcagagttga

SEQ ID NO: 7063150 - DNA, 22 bp, Homo sapiens
tcagaggtcacacagcaagttt

SEQ ID NO: 7063151 - DNA, 22 bp, Homo sapiens
tcagaggtcagcagcttgccca

SEQ ID NO: 7063152 - DNA, 22 bp, Homo sapiens
tcagaggtccctagcaggagtg

SEQ ID NO: 7063153 - DNA, 22 bp, Homo sapiens
tcagaggtgagcatgtgaccaa

SEQ ID NO: 7063154 - DNA, 22 bp, Homo sapiens
tcagaggtgagcttcttgctaa

SEQ ID NO: 7063155 - DNA, 22 bp, Homo sapiens
tcagaggtgcaagaagttctga

SEQ ID NO: 7063156 - DNA, 22 bp, Homo sapiens
tcagaggtggagatagttggga

SEQ ID NO: 7063157 - DNA, 22 bp, Homo sapiens
tcagaggtggcaggggtgtcca

SEQ ID NO: 7063158 - DNA, 22 bp, Homo sapiens
tcagaggtggcccctgccctca

SEQ ID NO: 7063159 - DNA, 22 bp, Homo sapiens
tcagaggtggtaaaggacagca

SEQ ID NO: 7063160 - DNA, 22 bp, Homo sapiens
tcagaggtggtaaaggacagca

SEQ ID NO: 7063161 - DNA, 22 bp, Homo sapiens
tcagaggttacccatgggacag

SEQ ID NO: 7063162 - DNA, 22 bp, Homo sapiens
tcagaggttccggccataacca

SEQ ID NO: 7063163 - DNA, 22 bp, Homo sapiens
tcagaggttcttctcagtggcc

SEQ ID NO: 7063164 - DNA, 22 bp, Homo sapiens
tcagagtcaactgttgcctgtt

SEQ ID NO: 7063165 - DNA, 22 bp, Homo sapiens
tcagagtcctttggcctgacag

SEQ ID NO: 7063166 - DNA, 22 bp, Homo sapiens
tcagagtctgtgcattctgcta

SEQ ID NO: 7063167 - DNA, 22 bp, Homo sapiens
tcagctttccttgctttagatt

SEQ ID NO: 7063168 - DNA, 22 bp, Homo sapiens
tcagcttggacagcttggttga

SEQ ID NO: 7063169 - DNA, 22 bp, Homo sapiens
tcagcttcctctgtggttccag

SEQ ID NO: 7063170 - DNA, 22 bp, Homo sapiens
tcagctgtgtatcccagggcct

SEQ ID NO: 7063171 - DNA, 22 bp, Homo sapiens
tcagcttcaaatttggtgaagt

SEQ ID NO: 7063172 - DNA, 23 bp, Homo sapiens
tcagcttcattgtcttctatggc

SEQ ID NO: 7063173 - DNA, 22 bp, Homo sapiens
tcagcctctctgagtccagacc

SEQ ID NO: 7063174 - DNA, 23 bp, Homo sapiens
tcagcctcttaggacttctcacc

SEQ ID NO: 7063175 - DNA, 23 bp, Homo sapiens
tcagtttgtataatccatatgca

SEQ ID NO: 7063176 - DNA, 22 bp, Homo sapiens
tcagtggattggatgagatctg

SEQ ID NO: 7063177 - DNA, 22 bp, Homo sapiens
tcagtggattgtagaaggctta

SEQ ID NO: 7063178 - DNA, 22 bp, Homo sapiens
tcagtggagctaagcatgagat

SEQ ID NO: 7063179 - DNA, 22 bp, Homo sapiens
tcagtggagtatggatgaagtc

SEQ ID NO: 7063180 - DNA, 22 bp, Homo sapiens
tcagtggatatttctgtggctg

SEQ ID NO: 7063181 - DNA, 19 bp, Homo sapiens
tcagtggatgaacatgttt

SEQ ID NO: 7063182 - DNA, 22 bp, Homo sapiens
tcagtggattgacatgaaaaag

SEQ ID NO: 7063183 - DNA, 22 bp, Homo sapiens
tcagtgcttgcctctggaggag

SEQ ID NO: 7063184 - DNA, 22 bp, Homo sapiens
tcagtggaactgtctgggtgag

SEQ ID NO: 7063185 - DNA, 19 bp, Homo sapiens
tcagtggagaaaggggaag

SEQ ID NO: 7063186 - DNA, 22 bp, Homo sapiens
tcagtggagagcttccaggatt

SEQ ID NO: 7063187 - DNA, 20 bp, Homo sapiens
tcataaagaggaaataaata

SEQ ID NO: 7063188 - DNA, 22 bp, Homo sapiens
tcatatttgggggtgtgtgttt

SEQ ID NO: 7063189 - DNA, 22 bp, Homo sapiens
tcatccagagcttcataagtaa

SEQ ID NO: 7063190 - DNA, 20 bp, Homo sapiens
tcatccaggacaggagtggc

SEQ ID NO: 7063191 - DNA, 22 bp, Homo sapiens
tcatccagtatgactggtgtct

SEQ ID NO: 7063192 - DNA, 22 bp, Homo sapiens
tcatccttttgcatgggaaggc

SEQ ID NO: 7063193 - DNA, 22 bp, Homo sapiens
tcatctccatacggtctcgcag

SEQ ID NO: 7063194 - DNA, 22 bp, Homo sapiens
tcagggacttacaaaccagaag

SEQ ID NO: 7063195 - DNA, 22 bp, Homo sapiens
tcaggctgaccaggttttgctc

SEQ ID NO: 7063196 - DNA, 22 bp, Homo sapiens
tcaggctgagaaaatctggacc

SEQ ID NO: 7063197 - DNA, 22 bp, Homo sapiens
tcaggctgagaaaatctggacc

SEQ ID NO: 7063198 - DNA, 22 bp, Homo sapiens
tcaggctgaggtcatctgcatc

SEQ ID NO: 7063199 - DNA, 22 bp, Homo sapiens
tcaggctgaggtcatctgcatc

SEQ ID NO: 7063200 - DNA, 22 bp, Homo sapiens
tcaggctgaaaggactccagtt

SEQ ID NO: 7063201 - DNA, 22 bp, Homo sapiens
tcaggctgaaaggactccagtt

SEQ ID NO: 7063202 - DNA, 22 bp, Homo sapiens
tcaggctgaaggaggcctatct

SEQ ID NO: 7063203 - DNA, 22 bp, Homo sapiens
tcaggctgaaggaggcctatct

SEQ ID NO: 7063204 - DNA, 22 bp, Homo sapiens
tcaggctgaatcatcctagctt

SEQ ID NO: 7063205 - DNA, 22 bp, Homo sapiens
tcaggctgaatcatcctagctt

SEQ ID NO: 7063206 - DNA, 21 bp, Homo sapiens
tcagggttcaaaggaactgat

SEQ ID NO: 7063207 - DNA, 22 bp, Homo sapiens
tcagggtaaaccttcactgtga

SEQ ID NO: 7063208 - DNA, 22 bp, Homo sapiens
tcagggtatgttctagatctga

SEQ ID NO: 7063209 - DNA, 22 bp, Homo sapiens
tcaggtccagctcctgtgcctc

SEQ ID NO: 7063210 - DNA, 22 bp, Homo sapiens
tcaggggcttgaggtgcatgtc

SEQ ID NO: 7063211 - DNA, 22 bp, Homo sapiens
tcaggggaaatctctcagcgaa

SEQ ID NO: 7063212 - DNA, 22 bp, Homo sapiens
tcaggggaaatctctcagcgaa

SEQ ID NO: 7063213 - DNA, 22 bp, Homo sapiens
tcccagcttagatttgctcatt

SEQ ID NO: 7063214 - DNA, 22 bp, Homo sapiens
tcccagctgagattgagcaagg

SEQ ID NO: 7063215 - DNA, 21 bp, Homo sapiens
tcccagctgggtcagtgctgc

SEQ ID NO: 7063216 - DNA, 22 bp, Homo sapiens
tcccagagttcaatgggaaggt

SEQ ID NO: 7063217 - DNA, 22 bp, Homo sapiens
tcccagagtttcctgtgtccca

SEQ ID NO: 7063218 - DNA, 22 bp, Homo sapiens
tcccagattcctgctcttatat

SEQ ID NO: 7063219 - DNA, 22 bp, Homo sapiens
tcccagattcctgctcttatat

SEQ ID NO: 7063220 - DNA, 22 bp, Homo sapiens
tcccagattcctgctcttatat

SEQ ID NO: 7063221 - DNA, 22 bp, Homo sapiens
tcccagcagatgagctgaccta

SEQ ID NO: 7063222 - DNA, 22 bp, Homo sapiens
tcccagcaggagtccagttccc

SEQ ID NO: 7063223 - DNA, 22 bp, Homo sapiens
tcccagcaggagtccagttccc

SEQ ID NO: 7063224 - DNA, 22 bp, Homo sapiens
tcccagcagggccgaccagcct

SEQ ID NO: 7063225 - DNA, 22 bp, Homo sapiens
tccagtgtggacccctgcagtc

SEQ ID NO: 7063226 - DNA, 22 bp, Homo sapiens
tcccacagtggtacagccctga

SEQ ID NO: 7063227 - DNA, 22 bp, Homo sapiens
tcccactggacgtctgtgctgg

SEQ ID NO: 7063228 - DNA, 22 bp, Homo sapiens
tcccactgtgcctgttgtaatc

SEQ ID NO: 7063229 - DNA, 22 bp, Homo sapiens
tcccagagaaagtcaaggtctt

SEQ ID NO: 7063230 - DNA, 22 bp, Homo sapiens
tcccagagaaagtcaaggtctt

SEQ ID NO: 7063231 - DNA, 22 bp, Homo sapiens
tcccagagtattagcaattgct

SEQ ID NO: 7063232 - DNA, 22 bp, Homo sapiens
tcccagagtcagaggtggggcc

SEQ ID NO: 7063233 - DNA, 19 bp, Homo sapiens
tcccagagtctagaggttg

SEQ ID NO: 7063234 - DNA, 19 bp, Homo sapiens
tcccagagtctagaggttg

SEQ ID NO: 7063235 - DNA, 22 bp, Homo sapiens
tcccagagtcttctcctgtaat

SEQ ID NO: 7063236 - DNA, 22 bp, Homo sapiens
tcccagagtgagccaggggcag

SEQ ID NO: 7063237 - DNA, 21 bp, Homo sapiens
tcccagagtgcttgggactgc

SEQ ID NO: 7063238 - DNA, 22 bp, Homo sapiens
tcccagagtgtgggcatcaagg

SEQ ID NO: 7063239 - DNA, 22 bp, Homo sapiens
tcccagagtgtgggcatcaagg

SEQ ID NO: 7063240 - DNA, 22 bp, Homo sapiens
tccaggcccagacggggtgagg

SEQ ID NO: 7063241 - DNA, 22 bp, Homo sapiens
tccaggcccagacggggtgagg

SEQ ID NO: 7063242 - DNA, 22 bp, Homo sapiens
tccaggcccactcagctgaaat

SEQ ID NO: 7063243 - DNA, 22 bp, Homo sapiens
tccaggcccactcagctgaaat

SEQ ID NO: 7063244 - DNA, 20 bp, Homo sapiens
tccaggcccactcagctgaa

SEQ ID NO: 7063245 - DNA, 22 bp, Homo sapiens
tccaggccattgactgcatcct

SEQ ID NO: 7063246 - DNA, 21 bp, Homo sapiens
tccaggccatggtggggaggc

SEQ ID NO: 7063247 - DNA, 21 bp, Homo sapiens
tccaggccatggtggggaggc

SEQ ID NO: 7063248 - DNA, 22 bp, Homo sapiens
tccaggaggaggaaggctgcca

SEQ ID NO: 7063249 - DNA, 22 bp, Homo sapiens
tccagggagatggcagaggctg

SEQ ID NO: 7063250 - DNA, 22 bp, Homo sapiens
tccagggagcaagtcaggccgg

SEQ ID NO: 7063251 - DNA, 22 bp, Homo sapiens
tccagggacctccctgagagct

SEQ ID NO: 7063252 - DNA, 22 bp, Homo sapiens
tccagtctggtatgaatcctag

SEQ ID NO: 7063253 - DNA, 23 bp, Homo sapiens
tccagtctcctgaaaggcagcgt

SEQ ID NO: 7063254 - DNA, 20 bp, Homo sapiens
tccagtggcctgaatctgga

SEQ ID NO: 7063255 - DNA, 22 bp, Homo sapiens
tccagggagttggctggatagt

SEQ ID NO: 7063256 - DNA, 22 bp, Homo sapiens
tccagggatctttagagtcttt

SEQ ID NO: 7063257 - DNA, 22 bp, Homo sapiens
tccagggatgccagccatgttg

SEQ ID NO: 7063258 - DNA, 22 bp, Homo sapiens
tccagggatggtaatgagcagt

SEQ ID NO: 7063259 - DNA, 20 bp, Homo sapiens
tccagggcaaactcatcacc

SEQ ID NO: 7063260 - DNA, 20 bp, Homo sapiens
tccagggcaaactcatcacc

SEQ ID NO: 7063261 - DNA, 20 bp, Homo sapiens
tccagggcaactagagtgtg

SEQ ID NO: 7063262 - DNA, 20 bp, Homo sapiens
tccagggcaactagagtgtg

SEQ ID NO: 7063263 - DNA, 20 bp, Homo sapiens
tccagggcaactagagtgtg

SEQ ID NO: 7063264 - DNA, 22 bp, Homo sapiens
tccagggcagccgcgggtgcgc

SEQ ID NO: 7063265 - DNA, 22 bp, Homo sapiens
tccagggcagccgcgggtgcgc

SEQ ID NO: 7063266 - DNA, 22 bp, Homo sapiens
tccaggaggactgagggggctg

SEQ ID NO: 7063267 - DNA, 22 bp, Homo sapiens
tccaggagctcatccacgtcaa

SEQ ID NO: 7063268 - DNA, 22 bp, Homo sapiens
tccaggaggactgagggggctg

SEQ ID NO: 7063269 - DNA, 22 bp, Homo sapiens
tccaggagcatccaggtgaagc

SEQ ID NO: 7063270 - DNA, 22 bp, Homo sapiens
tccaggagcatccaggtgaagc

SEQ ID NO: 7063271 - DNA, 20 bp, Homo sapiens
tccagccctgcttctctctt

SEQ ID NO: 7063272 - DNA, 20 bp, Homo sapiens
tccagccctgcttctctctt

SEQ ID NO: 7063273 - DNA, 22 bp, Homo sapiens
tccagccctgtggcttccaccc

SEQ ID NO: 7063274 - DNA, 22 bp, Homo sapiens
tccagaaacttttccagtctca

SEQ ID NO: 7063275 - DNA, 20 bp, Homo sapiens
tccagcccaggtcctgcctg

SEQ ID NO: 7063276 - DNA, 22 bp, Homo sapiens
tccagcccgactgggcctgccg

SEQ ID NO: 7063277 - DNA, 17 bp, Homo sapiens
tccagccctgcccgacg

SEQ ID NO: 7063278 - DNA, 17 bp, Homo sapiens
tccagccctgcccgacg

SEQ ID NO: 7063279 - DNA, 22 bp, Homo sapiens
tccagccctgcttcctgcctca

SEQ ID NO: 7063280 - DNA, 22 bp, Homo sapiens
tcatgttttagctgcaaaatga

SEQ ID NO: 7063281 - DNA, 22 bp, Homo sapiens
tcatgtttttgccatatgactc

SEQ ID NO: 7063282 - DNA, 22 bp, Homo sapiens
tcatgtttggagtttgctcact

SEQ ID NO: 7063283 - DNA, 22 bp, Homo sapiens
tcatgtttgccctaagaaaaag

SEQ ID NO: 7063284 - DNA, 22 bp, Homo sapiens
tcatgtttgttggaaatgtggc

SEQ ID NO: 7063285 - DNA, 22 bp, Homo sapiens
tcatgttattgactcataatat

SEQ ID NO: 7063286 - DNA, 20 bp, Homo sapiens
tcatggctgctgagaggttc

SEQ ID NO: 7063287 - DNA, 18 bp, Homo sapiens
tcatggcttgcagatggt

SEQ ID NO: 7063288 - DNA, 22 bp, Homo sapiens
tcattaaatgtttgttgtgcca

SEQ ID NO: 7063289 - DNA, 22 bp, Homo sapiens
tccacagaccagtatctgcagc

SEQ ID NO: 7063290 - DNA, 22 bp, Homo sapiens
tccacttcatccagggtcacca

SEQ ID NO: 7063291 - DNA, 22 bp, Homo sapiens
tccacgtgagcttcgtgtgcag

SEQ ID NO: 7063292 - DNA, 22 bp, Homo sapiens
tccactgacaggtgaatggata

SEQ ID NO: 7063293 - DNA, 22 bp, Homo sapiens
tccaccagagccttcccatgct

SEQ ID NO: 7063294 - DNA, 22 bp, Homo sapiens
tccaccagccaggcccaggctg

SEQ ID NO: 7063295 - DNA, 22 bp, Homo sapiens
tccaccagcttcttcaccagct

SEQ ID NO: 7063296 - DNA, 22 bp, Homo sapiens
tccaccaggctccatgttcagt

SEQ ID NO: 7063297 - DNA, 22 bp, Homo sapiens
tccaccatgtaacaagctctgt

SEQ ID NO: 7063298 - DNA, 23 bp, Homo sapiens
tcctcctgagtgagagtgccagc

SEQ ID NO: 7063299 - DNA, 22 bp, Homo sapiens
tcctcctgcctttgcttcttgt

SEQ ID NO: 7063300 - DNA, 23 bp, Homo sapiens
tcctcctgacacagcctgagtga

SEQ ID NO: 7063301 - DNA, 23 bp, Homo sapiens
tcctcctgacacagcctgagtga

SEQ ID NO: 7063302 - DNA, 22 bp, Homo sapiens
tcctcctcctcacagtcacctg

SEQ ID NO: 7063303 - DNA, 22 bp, Homo sapiens
tcctcctcctcacagtcacctg

SEQ ID NO: 7063304 - DNA, 22 bp, Homo sapiens
tcctcccttgactcctgctttt

SEQ ID NO: 7063305 - DNA, 22 bp, Homo sapiens
tcctcctcacgctgttgcttgt

SEQ ID NO: 7063306 - DNA, 22 bp, Homo sapiens
tcctccagggggatcttcagcc

SEQ ID NO: 7063307 - DNA, 22 bp, Homo sapiens
tcctccaggtctagggtggctt

SEQ ID NO: 7063308 - DNA, 22 bp, Homo sapiens
tcctccagtcttggtgaggttg

SEQ ID NO: 7063309 - DNA, 22 bp, Homo sapiens
tcctccagtggcccagtccttc

SEQ ID NO: 7063310 - DNA, 22 bp, Homo sapiens
tcctccagtggtactggccaat

SEQ ID NO: 7063311 - DNA, 22 bp, Homo sapiens
tcctccagtgtctggggccttg

SEQ ID NO: 7063312 - DNA, 22 bp, Homo sapiens
tcctccagttccttggtttcag

SEQ ID NO: 7063313 - DNA, 22 bp, Homo sapiens
tcctccctgtaccattcctctg

SEQ ID NO: 7063314 - DNA, 22 bp, Homo sapiens
tccgctggagagggggctgcca

SEQ ID NO: 7063315 - DNA, 22 bp, Homo sapiens
tccctttgatcactaacagaac

SEQ ID NO: 7063316 - DNA, 22 bp, Homo sapiens
tccctttggatccaagcttatg

SEQ ID NO: 7063317 - DNA, 22 bp, Homo sapiens
tccgaggcgcaccggcgctcct

SEQ ID NO: 7063318 - DNA, 22 bp, Homo sapiens
tccgggggtggtagatttcctt

SEQ ID NO: 7063319 - DNA, 22 bp, Homo sapiens
tcctcatacatatctcagtctt

SEQ ID NO: 7063320 - DNA, 22 bp, Homo sapiens
tcctcatagactgactgcttgc

SEQ ID NO: 7063321 - DNA, 22 bp, Homo sapiens
tcctcatctcggaacctgccac

SEQ ID NO: 7063322 - DNA, 22 bp, Homo sapiens
tcctcatctgtaccttggggta

SEQ ID NO: 7063323 - DNA, 22 bp, Homo sapiens
tcctccacgatggcacacctgg

SEQ ID NO: 7063324 - DNA, 22 bp, Homo sapiens
tcctccagaaactgaggcagaa

SEQ ID NO: 7063325 - DNA, 20 bp, Homo sapiens
tcctccagaagggcagggtg

SEQ ID NO: 7063326 - DNA, 22 bp, Homo sapiens
tcctccagaccacttctgtgcg

SEQ ID NO: 7063327 - DNA, 22 bp, Homo sapiens
tcctccagagatttgagttatt

SEQ ID NO: 7063328 - DNA, 23 bp, Homo sapiens
tcctccagaggccctccttggcc

SEQ ID NO: 7063329 - DNA, 22 bp, Homo sapiens
tcctccagcaggactgaggccc

SEQ ID NO: 7063330 - DNA, 22 bp, Homo sapiens
tcctccagccctctaggaaaat

SEQ ID NO: 7063331 - DNA, 22 bp, Homo sapiens
tcctccagctactaggcaaata

SEQ ID NO: 7063332 - DNA, 22 bp, Homo sapiens
tcctccagctgtatcctgcctg

SEQ ID NO: 7063333 - DNA, 22 bp, Homo sapiens
tcctccagcttctcttttgggg

SEQ ID NO: 7063334 - DNA, 22 bp, Homo sapiens
tcctccaggataaaatgtgttg

SEQ ID NO: 7063335 - DNA, 22 bp, Homo sapiens
tcctccaggcacctcactggct

SEQ ID NO: 7063336 - DNA, 22 bp, Homo sapiens
tcctccaggcacctcactggct

SEQ ID NO: 7063337 - DNA, 23 bp, Homo sapiens
tccctgggcccgtgccagcggtg

SEQ ID NO: 7063338 - DNA, 22 bp, Homo sapiens
tccctgggccacagctgtgagc

SEQ ID NO: 7063339 - DNA, 22 bp, Homo sapiens
tccctgggcacaatctgctggc

SEQ ID NO: 7063340 - DNA, 22 bp, Homo sapiens
tccctgccaatgattggagcaa

SEQ ID NO: 7063341 - DNA, 22 bp, Homo sapiens
tccctgccagtcctggtctgaa

SEQ ID NO: 7063342 - DNA, 22 bp, Homo sapiens
tccctgccctcagtgcacccgg

SEQ ID NO: 7063343 - DNA, 22 bp, Homo sapiens
tccctgccctcagtgcacccgg

SEQ ID NO: 7063344 - DNA, 22 bp, Homo sapiens
tccctgccctgccttcatggtt

SEQ ID NO: 7063345 - DNA, 22 bp, Homo sapiens
tccctgcacagccgagccatgc

SEQ ID NO: 7063346 - DNA, 22 bp, Homo sapiens
tccctgcagacgtcctgcgggt

SEQ ID NO: 7063347 - DNA, 22 bp, Homo sapiens
tccctgagcttcatcaggcttt

SEQ ID NO: 7063348 - DNA, 22 bp, Homo sapiens
tccctgagctgagctcaacagc

SEQ ID NO: 7063349 - DNA, 23 bp, Homo sapiens
tccctgagctggagagactgcac

SEQ ID NO: 7063350 - DNA, 22 bp, Homo sapiens
tccctgagggcagctcaagtcc

SEQ ID NO: 7063351 - DNA, 19 bp, Homo sapiens
tccctgagttccagcccag

SEQ ID NO: 7063352 - DNA, 23 bp, Homo sapiens
tccctgagatgctgctctgtccc

SEQ ID NO: 7063353 - DNA, 22 bp, Homo sapiens
tcccaggcaaaggcagctcatt

SEQ ID NO: 7063354 - DNA, 18 bp, Homo sapiens
tcccttctcccttgcctc

SEQ ID NO: 7063355 - DNA, 22 bp, Homo sapiens
tccctgtgggcagaggctgcct

SEQ ID NO: 7063356 - DNA, 22 bp, Homo sapiens
tccctgtggctaagacatgaca

SEQ ID NO: 7063357 - DNA, 23 bp, Homo sapiens
tccctgtgtacagcctgcatgag

SEQ ID NO: 7063358 - DNA, 22 bp, Homo sapiens
tccctgtgtcttcctcttgccc

SEQ ID NO: 7063359 - DNA, 22 bp, Homo sapiens
tccctgtgtgtatataaacggt

SEQ ID NO: 7063360 - DNA, 22 bp, Homo sapiens
tcccttcaagatttggggaaat

SEQ ID NO: 7063361 - DNA, 22 bp, Homo sapiens
tcccttcacagatgcgatgttt

SEQ ID NO: 7063362 - DNA, 22 bp, Homo sapiens
tccctggggatgttggcctgcc

SEQ ID NO: 7063363 - DNA, 22 bp, Homo sapiens
tccctggggaagggcaagcaag

SEQ ID NO: 7063364 - DNA, 22 bp, Homo sapiens
tccctggggaagggcaagcaag

SEQ ID NO: 7063365 - DNA, 22 bp, Homo sapiens
tccctgggcctcctgctatgca

SEQ ID NO: 7063366 - DNA, 22 bp, Homo sapiens
tccctgggcctatcttagctcc

SEQ ID NO: 7063367 - DNA, 22 bp, Homo sapiens
tccctgggcctatcttagctcc

SEQ ID NO: 7063368 - DNA, 22 bp, Homo sapiens
tccctgtgcctatatgtgctga

SEQ ID NO: 7063369 - DNA, 22 bp, Homo sapiens
tccctgtggatatctgcagctg

SEQ ID NO: 7063370 - DNA, 22 bp, Homo sapiens
tccctgtgaatcagaagcaggt

SEQ ID NO: 7063371 - DNA, 22 bp, Homo sapiens
tccctgtgagaaatgaagcagg

SEQ ID NO: 7063372 - DNA, 21 bp, Homo sapiens
tccctgtgagcagctcttcct

SEQ ID NO: 7063373 - DNA, 22 bp, Homo sapiens
tccctgtgagtcaactaaacaa

SEQ ID NO: 7063374 - DNA, 20 bp, Homo sapiens
tccctggggccctacttcct

SEQ ID NO: 7063375 - DNA, 22 bp, Homo sapiens
tccctgtctaatatgccatgaa

SEQ ID NO: 7063376 - DNA, 22 bp, Homo sapiens
tccctgtctcccttgagactag

SEQ ID NO: 7063377 - DNA, 22 bp, Homo sapiens
tccctgtccaaagtcttcctat

SEQ ID NO: 7063378 - DNA, 22 bp, Homo sapiens
gttataaaatgcacagttgttt

SEQ ID NO: 7063379 - DNA, 22 bp, Homo sapiens
gttataaaatgcacagttgttt

SEQ ID NO: 7063380 - DNA, 22 bp, Homo sapiens
gttataaaggtgataatggtca

SEQ ID NO: 7063381 - DNA, 22 bp, Homo sapiens
gttataaatacctaataggatt

SEQ ID NO: 7063382 - DNA, 22 bp, Homo sapiens
gttataaatacctaataggatt

SEQ ID NO: 7063383 - DNA, 22 bp, Homo sapiens
gttagacatgagtgtgcttaca

SEQ ID NO: 7063384 - DNA, 22 bp, Homo sapiens
gttagacatgcagaatctcagg

SEQ ID NO: 7063385 - DNA, 22 bp, Homo sapiens
gttaggtagaagtttactttga

SEQ ID NO: 7063386 - DNA, 22 bp, Homo sapiens
gttaggtagaagtttactttga

SEQ ID NO: 7063387 - DNA, 22 bp, Homo sapiens
gtgctttccatcctccctgctg

SEQ ID NO: 7063388 - DNA, 22 bp, Homo sapiens
gtgctttctgctgcattcctct

SEQ ID NO: 7063389 - DNA, 22 bp, Homo sapiens
gtgcttttaaaggcaattagta

SEQ ID NO: 7063390 - DNA, 21 bp, Homo sapiens
gtgcttttccttaatgttctt

SEQ ID NO: 7063391 - DNA, 19 bp, Homo sapiens
gtgctttttaagagctcag

SEQ ID NO: 7063392 - DNA, 22 bp, Homo sapiens
gtgtgtgtatctgcctatcaca

SEQ ID NO: 7063393 - DNA, 22 bp, Homo sapiens
gtgtgtgtctccgcggccgtag

SEQ ID NO: 7063394 - DNA, 22 bp, Homo sapiens
gtgtgtgtgcatataacatata

SEQ ID NO: 7063395 - DNA, 22 bp, Homo sapiens
gtgtgtgtgcatctcttttatt

SEQ ID NO: 7063396 - DNA, 22 bp, Homo sapiens
gtgtgtgtgcctgcacacacac

SEQ ID NO: 7063397 - DNA, 22 bp, Homo sapiens
gtgtgtgtgtaaaaatccagag

SEQ ID NO: 7063398 - DNA, 22 bp, Homo sapiens
gtgtgtgttcaataaatttaag

SEQ ID NO: 7063399 - DNA, 22 bp, Homo sapiens
gtgtgtttagcattagcagggg

SEQ ID NO: 7063400 - DNA, 22 bp, Homo sapiens
gtgtgtttcagaagccaggtgt

SEQ ID NO: 7063401 - DNA, 22 bp, Homo sapiens
gtgttaaacatgttcacagcat

SEQ ID NO: 7063402 - DNA, 22 bp, Homo sapiens
gtgttaaatgcaatcacatgca

SEQ ID NO: 7063403 - DNA, 22 bp, Homo sapiens
gtgttaaatgcaatcacatgca

SEQ ID NO: 7063404 - DNA, 22 bp, Homo sapiens
gtgttaaatttctaatttgtga

SEQ ID NO: 7063405 - DNA, 22 bp, Homo sapiens
gtttagaatgaaacttttgagc

SEQ ID NO: 7063406 - DNA, 22 bp, Homo sapiens
gtttagaatggcaaaattaagt

SEQ ID NO: 7063407 - DNA, 22 bp, Homo sapiens
gtttagaattctaactttaagg

SEQ ID NO: 7063408 - DNA, 22 bp, Homo sapiens
gtttagaccaatcataatttat

SEQ ID NO: 7063409 - DNA, 22 bp, Homo sapiens
gtttagactccttggtcttctg

SEQ ID NO: 7063410 - DNA, 22 bp, Homo sapiens
gtttacaaatattttaaatggt

SEQ ID NO: 7063411 - DNA, 22 bp, Homo sapiens
gtttagaaaatagtgaagcaag

SEQ ID NO: 7063412 - DNA, 22 bp, Homo sapiens
gtttagaacacggaaatactga

SEQ ID NO: 7063413 - DNA, 22 bp, Homo sapiens
gtttagaagccaagatttgggt

SEQ ID NO: 7063414 - DNA, 21 bp, Homo sapiens
gtttagaagtagtctggctca

SEQ ID NO: 7063415 - DNA, 22 bp, Homo sapiens
gttccaggaccctggcctctga

SEQ ID NO: 7063416 - DNA, 22 bp, Homo sapiens
gttccaggcagtggcaacagct

SEQ ID NO: 7063417 - DNA, 22 bp, Homo sapiens
gttccaggtggtcacagagctc

SEQ ID NO: 7063418 - DNA, 18 bp, Homo sapiens
gttcccagatggtgctga

SEQ ID NO: 7063419 - DNA, 22 bp, Homo sapiens
gtttcttaatagcaggggccaa

SEQ ID NO: 7063420 - DNA, 22 bp, Homo sapiens
gtttcttaccacttggacctct

SEQ ID NO: 7063421 - DNA, 22 bp, Homo sapiens
gtttcttaagttacaaaatctt

SEQ ID NO: 7063422 - DNA, 22 bp, Homo sapiens
gtttcttaaatgtagcaggacc

SEQ ID NO: 7063423 - DNA, 22 bp, Homo sapiens
gtttcttaaatgtagcaggacc

SEQ ID NO: 7063424 - DNA, 22 bp, Homo sapiens
gtttcttaaaagaggagttaga

SEQ ID NO: 7063425 - DNA, 22 bp, Homo sapiens
gttttacacacctatgaaagac

SEQ ID NO: 7063426 - DNA, 23 bp, Homo sapiens
gttttacaggtgagaaaatggag

SEQ ID NO: 7063427 - DNA, 22 bp, Homo sapiens
gtttctctttgaagcctggctg

SEQ ID NO: 7063428 - DNA, 22 bp, Homo sapiens
gtttctcctctgtgtcttgttt

SEQ ID NO: 7063429 - DNA, 22 bp, Homo sapiens
gtttatatgtgtgccactctta

SEQ ID NO: 7063430 - DNA, 22 bp, Homo sapiens
gtttcctacactgtagtattat

SEQ ID NO: 7063431 - DNA, 22 bp, Homo sapiens
gtttcctaccagtggttccaga

SEQ ID NO: 7063432 - DNA, 22 bp, Homo sapiens
gtttcctagatcagtgttctta

SEQ ID NO: 7063433 - DNA, 22 bp, Homo sapiens
gtttcctaggcttatacagctg

SEQ ID NO: 7063434 - DNA, 22 bp, Homo sapiens
gtttatatgaacttcataccca

SEQ ID NO: 7063435 - DNA, 22 bp, Homo sapiens
gtttctaattggaactttgagg

SEQ ID NO: 7063436 - DNA, 22 bp, Homo sapiens
gtttctatggtttatattactg

SEQ ID NO: 7063437 - DNA, 22 bp, Homo sapiens
taaacagctactgtgtcaaagg

SEQ ID NO: 7063438 - DNA, 22 bp, Homo sapiens
taaacatggattctgatcacag

SEQ ID NO: 7063439 - DNA, 23 bp, Homo sapiens
gttttcaacacaataaatgtaac

SEQ ID NO: 7063440 - DNA, 22 bp, Homo sapiens
gttttcaaggggatttaactga

SEQ ID NO: 7063441 - DNA, 22 bp, Homo sapiens
gttttcaattataagatggctt

SEQ ID NO: 7063442 - DNA, 16 bp, Homo sapiens
taaacagcagacagtt

SEQ ID NO: 7063443 - DNA, 22 bp, Homo sapiens
taaacagcctaaaactttcttt

SEQ ID NO: 7063444 - DNA, 22 bp, Homo sapiens
taaacagcctcccctttcactc

SEQ ID NO: 7063445 - DNA, 22 bp, Homo sapiens
gttttatttccatgagagaccg

SEQ ID NO: 7063446 - DNA, 22 bp, Homo sapiens
gttttattggaacacagccatg

SEQ ID NO: 7063447 - DNA, 22 bp, Homo sapiens
gttttatttccatgagagaccg

SEQ ID NO: 7063448 - DNA, 22 bp, Homo sapiens
gttttatttccatgagagaccg

SEQ ID NO: 7063449 - DNA, 22 bp, Homo sapiens
gttttattggaacacagccatg

SEQ ID NO: 7063450 - DNA, 20 bp, Homo sapiens
gttttatgccagttctgtgt

SEQ ID NO: 7063451 - DNA, 22 bp, Homo sapiens
gttttatgagacctcaggaata

SEQ ID NO: 7063452 - DNA, 22 bp, Homo sapiens
gttttataggtgaaatattact

SEQ ID NO: 7063453 - DNA, 22 bp, Homo sapiens
gttttataggctgttgctatat

SEQ ID NO: 7063454 - DNA, 22 bp, Homo sapiens
gttttagtgggtggccactgat

SEQ ID NO: 7063455 - DNA, 22 bp, Homo sapiens
gttttataattgcttcataaga

SEQ ID NO: 7063456 - DNA, 22 bp, Homo sapiens
taaactgtgtaatatgatgtct

SEQ ID NO: 7063457 - DNA, 21 bp, Homo sapiens
taaagaagatgaatgtgatca

SEQ ID NO: 7063458 - DNA, 22 bp, Homo sapiens
taaagtttatttgaacatctct

SEQ ID NO: 7063459 - DNA, 22 bp, Homo sapiens
taaagtttggcagacaataaca

SEQ ID NO: 7063460 - DNA, 21 bp, Homo sapiens
taaataataagttgctgagat

SEQ ID NO: 7063461 - DNA, 21 bp, Homo sapiens
taaataataagttgctgagat

SEQ ID NO: 7063462 - DNA, 21 bp, Homo sapiens
taaataataagttgctgagat

SEQ ID NO: 7063463 - DNA, 17 bp, Homo sapiens
taaatacacaagggtat

SEQ ID NO: 7063464 - DNA, 22 bp, Homo sapiens
taacacagacagccactagtaa

SEQ ID NO: 7063465 - DNA, 22 bp, Homo sapiens
taacaatagtgtttgctagtca

SEQ ID NO: 7063466 - DNA, 22 bp, Homo sapiens
taacacataagctgagaccatg

SEQ ID NO: 7063467 - DNA, 22 bp, Homo sapiens
taacacatagatattttaactt

SEQ ID NO: 7063468 - DNA, 22 bp, Homo sapiens
taacacatatctacaacatgtg

SEQ ID NO: 7063469 - DNA, 22 bp, Homo sapiens
taacacatatttcaagagtagt

SEQ ID NO: 7063470 - DNA, 22 bp, Homo sapiens
taacacatatttcaagagtagt

SEQ ID NO: 7063471 - DNA, 22 bp, Homo sapiens
taacacatatttgcagtaagca

SEQ ID NO: 7063472 - DNA, 22 bp, Homo sapiens
taacacatgaaagcaccttctt

SEQ ID NO: 7063473 - DNA, 22 bp, Homo sapiens
taacacatggttagtacacaat

SEQ ID NO: 7063474 - DNA, 22 bp, Homo sapiens
taacacatggttctgtcaggaa

SEQ ID NO: 7063475 - DNA, 22 bp, Homo sapiens
taacacatgtctgggatgtgaa

SEQ ID NO: 7063476 - DNA, 22 bp, Homo sapiens
taacacattagttctcctagat

SEQ ID NO: 7063477 - DNA, 22 bp, Homo sapiens
taacacattttaagccatttta

SEQ ID NO: 7063478 - DNA, 22 bp, Homo sapiens
taacacattttcctcatacgga

SEQ ID NO: 7063479 - DNA, 22 bp, Homo sapiens
taacacattttcctcatacgga

SEQ ID NO: 7063480 - DNA, 21 bp, Homo sapiens
taacacattttggtactttgg

SEQ ID NO: 7063481 - DNA, 22 bp, Homo sapiens
taagatgactacttaccactga

SEQ ID NO: 7063482 - DNA, 22 bp, Homo sapiens
taagatagaactctgaggctac

SEQ ID NO: 7063483 - DNA, 22 bp, Homo sapiens
taagatatggtaggaagtttgg

SEQ ID NO: 7063484 - DNA, 22 bp, Homo sapiens
taagaggcagcattcctcgcct

SEQ ID NO: 7063485 - DNA, 22 bp, Homo sapiens
taagaggcattagagacatagc

SEQ ID NO: 7063486 - DNA, 22 bp, Homo sapiens
taagataagtgggttgagatgg

SEQ ID NO: 7063487 - DNA, 22 bp, Homo sapiens
taagaaatttagttatagaatg

SEQ ID NO: 7063488 - DNA, 22 bp, Homo sapiens
taactgtgaagtaattgtggat

SEQ ID NO: 7063489 - DNA, 22 bp, Homo sapiens
taactgtgtgaacgtgatcatt

SEQ ID NO: 7063490 - DNA, 22 bp, Homo sapiens
taacttcaagtctgtggatcag

SEQ ID NO: 7063491 - DNA, 22 bp, Homo sapiens
taacttctctgctatcatagga

SEQ ID NO: 7063492 - DNA, 22 bp, Homo sapiens
tacacccacattgagcatggga

SEQ ID NO: 7063493 - DNA, 22 bp, Homo sapiens
tacaccattcccaggtggattt

SEQ ID NO: 7063494 - DNA, 22 bp, Homo sapiens
tacacatttctcttagagacac

SEQ ID NO: 7063495 - DNA, 22 bp, Homo sapiens
tacacattttgcgggtacatgt

SEQ ID NO: 7063496 - DNA, 22 bp, Homo sapiens
tacacattacataatactatct

SEQ ID NO: 7063497 - DNA, 22 bp, Homo sapiens
tacacatccatgttttgacttt

SEQ ID NO: 7063498 - DNA, 20 bp, Homo sapiens
tacaatattcccactttgct

SEQ ID NO: 7063499 - DNA, 22 bp, Homo sapiens
tacaatatgtggccttttgtga

SEQ ID NO: 7063500 - DNA, 22 bp, Homo sapiens
taatttttccacgtacactggg

SEQ ID NO: 7063501 - DNA, 22 bp, Homo sapiens
tacaatgagctgtacatctcca

SEQ ID NO: 7063502 - DNA, 22 bp, Homo sapiens
taattttgtcacagtgacatgc

SEQ ID NO: 7063503 - DNA, 22 bp, Homo sapiens
taattttgtattgccattgtag

SEQ ID NO: 7063504 - DNA, 22 bp, Homo sapiens
taattttatgacagtgtatttt

SEQ ID NO: 7063505 - DNA, 22 bp, Homo sapiens
taatttctggagggagaaagag

SEQ ID NO: 7063506 - DNA, 22 bp, Homo sapiens
taatgcttaacagctggctttt

SEQ ID NO: 7063507 - DNA, 22 bp, Homo sapiens
taatgcttttccttcaaataag

SEQ ID NO: 7063508 - DNA, 22 bp, Homo sapiens
taatgcaaggaattccaagtag

SEQ ID NO: 7063509 - DNA, 22 bp, Homo sapiens
taatgcaacgtgagataattaa

SEQ ID NO: 7063510 - DNA, 22 bp, Homo sapiens
taatgcaggtgcccttgggttt

SEQ ID NO: 7063511 - DNA, 19 bp, Homo sapiens
taataagcaatatggaagt

SEQ ID NO: 7063512 - DNA, 22 bp, Homo sapiens
taatgaataaacttgagagtca

SEQ ID NO: 7063513 - DNA, 22 bp, Homo sapiens
taataaatgaaagtgctggcat

SEQ ID NO: 7063514 - DNA, 22 bp, Homo sapiens
taataaatgaaagtgctggcat

SEQ ID NO: 7063515 - DNA, 22 bp, Homo sapiens
taataaatgaaagtgctggcat

SEQ ID NO: 7063516 - DNA, 22 bp, Homo sapiens
taataaatgaaagtgctggcat

SEQ ID NO: 7063517 - DNA, 22 bp, Homo sapiens
taataacaattgtaggacatga

SEQ ID NO: 7063518 - DNA, 22 bp, Homo sapiens
taataacaattgtaggacatga

SEQ ID NO: 7063519 - DNA, 22 bp, Homo sapiens
taagttctgagtaaatactgtt

SEQ ID NO: 7063520 - DNA, 22 bp, Homo sapiens
taagcagtttttcttgtattaa

SEQ ID NO: 7063521 - DNA, 22 bp, Homo sapiens
taagcataactaaaaatgattt

SEQ ID NO: 7063522 - DNA, 22 bp, Homo sapiens
tacagtttttattcatgacaag

SEQ ID NO: 7063523 - DNA, 20 bp, Homo sapiens
tacaggaatcaagactgcat

SEQ ID NO: 7063524 - DNA, 22 bp, Homo sapiens
tacagcttaaaagatgcattta

SEQ ID NO: 7063525 - DNA, 22 bp, Homo sapiens
tacagcttatccagcttgatag

SEQ ID NO: 7063526 - DNA, 22 bp, Homo sapiens
tacagcttcagtgtgccccagt

SEQ ID NO: 7063527 - DNA, 22 bp, Homo sapiens
tacagcttgacccataatgtct

SEQ ID NO: 7063528 - DNA, 18 bp, Homo sapiens
tacagcttgagttgactg

SEQ ID NO: 7063529 - DNA, 22 bp, Homo sapiens
tacagcttgatgagagcgcgag

SEQ ID NO: 7063530 - DNA, 22 bp, Homo sapiens
tacagcttgatgtttgtgtgtt

SEQ ID NO: 7063531 - DNA, 22 bp, Homo sapiens
tacagctttagcaaattaccta

SEQ ID NO: 7063532 - DNA, 22 bp, Homo sapiens
tacagctttatacccatcaaaa

SEQ ID NO: 7063533 - DNA, 22 bp, Homo sapiens
tacagctttgggaaggccccat

SEQ ID NO: 7063534 - DNA, 22 bp, Homo sapiens
tacagcttttcatatttgtgtt

SEQ ID NO: 7063535 - DNA, 22 bp, Homo sapiens
tacagcttttgcagctgttttg

SEQ ID NO: 7063536 - DNA, 18 bp, Homo sapiens
tacaggaaggggttctcg

SEQ ID NO: 7063537 - DNA, 22 bp, Homo sapiens
tacattatcttgttatctttca

SEQ ID NO: 7063538 - DNA, 22 bp, Homo sapiens
tacattatcttgttatctttca

SEQ ID NO: 7063539 - DNA, 22 bp, Homo sapiens
tacattcagaagaatggacacg

SEQ ID NO: 7063540 - DNA, 22 bp, Homo sapiens
tacattcagcaaaagaatggtt

SEQ ID NO: 7063541 - DNA, 22 bp, Homo sapiens
tacatacagccaagtatgaagt

SEQ ID NO: 7063542 - DNA, 22 bp, Homo sapiens
tacatacacaaatatactgttt

SEQ ID NO: 7063543 - DNA, 22 bp, Homo sapiens
tactgaaggacttgagggtttc

SEQ ID NO: 7063544 - DNA, 22 bp, Homo sapiens
tactgaagcaccattaaagaca

SEQ ID NO: 7063545 - DNA, 22 bp, Homo sapiens
tactgaaatggcagatatataa

SEQ ID NO: 7063546 - DNA, 22 bp, Homo sapiens
tactgaaatagcactctgatgc

SEQ ID NO: 7063547 - DNA, 22 bp, Homo sapiens
tactgaaagactgaatatttag

SEQ ID NO: 7063548 - DNA, 22 bp, Homo sapiens
tacctttgatctggaattttaa

SEQ ID NO: 7063549 - DNA, 22 bp, Homo sapiens
tactaaatgattaagcaggaat

SEQ ID NO: 7063550 - DNA, 22 bp, Homo sapiens
taccttcaggctgccctttgat

SEQ ID NO: 7063551 - DNA, 22 bp, Homo sapiens
tacattccacaagcattgcttt

SEQ ID NO: 7063552 - DNA, 22 bp, Homo sapiens
tacattccaaaggaaactggct

SEQ ID NO: 7063553 - DNA, 19 bp, Homo sapiens
tacattccacacaatctct

SEQ ID NO: 7063554 - DNA, 22 bp, Homo sapiens
tacattccactagtgactggcg

SEQ ID NO: 7063555 - DNA, 22 bp, Homo sapiens
tacattccatgtgtgtgtattc

SEQ ID NO: 7063556 - DNA, 22 bp, Homo sapiens
tacccaaggccctttcaatttc

SEQ ID NO: 7063557 - DNA, 22 bp, Homo sapiens
tacccagcccatgcctacctca

SEQ ID NO: 7063558 - DNA, 22 bp, Homo sapiens
tacctgagcccagtgcagcata

SEQ ID NO: 7063559 - DNA, 22 bp, Homo sapiens
tacttcctgtttccatgtctgt

SEQ ID NO: 7063560 - DNA, 22 bp, Homo sapiens
tacttcattattctagttttga

SEQ ID NO: 7063561 - DNA, 22 bp, Homo sapiens
tacttcctgtttccatgtctgt

SEQ ID NO: 7063562 - DNA, 22 bp, Homo sapiens
tacttcctgtttccatgtctgt

SEQ ID NO: 7063563 - DNA, 18 bp, Homo sapiens
tactggtccttttatgat

SEQ ID NO: 7063564 - DNA, 22 bp, Homo sapiens
tacttcaaacaatggtacaaac

SEQ ID NO: 7063565 - DNA, 22 bp, Homo sapiens
tacttcaacaccatatggtcct

SEQ ID NO: 7063566 - DNA, 22 bp, Homo sapiens
tacttcaaccttctctattaga

SEQ ID NO: 7063567 - DNA, 18 bp, Homo sapiens
tacttcaactcccagggc

SEQ ID NO: 7063568 - DNA, 22 bp, Homo sapiens
tacttcaattatatgccagtta

SEQ ID NO: 7063569 - DNA, 22 bp, Homo sapiens
tacttcaatttgtatatgtgaa

SEQ ID NO: 7063570 - DNA, 22 bp, Homo sapiens
tactgcagatggccttgttctt

SEQ ID NO: 7063571 - DNA, 21 bp, Homo sapiens
tactgagacctcacagtgtgc

SEQ ID NO: 7063572 - DNA, 22 bp, Homo sapiens
tactgcctggagcattggtgct

SEQ ID NO: 7063573 - DNA, 23 bp, Homo sapiens
tactgcctggggccagagagcgg

SEQ ID NO: 7063574 - DNA, 22 bp, Homo sapiens
tactgcctgggggagacagctg

SEQ ID NO: 7063575 - DNA, 22 bp, Homo sapiens
tactgctgagctgggtagaagg

SEQ ID NO: 7063576 - DNA, 22 bp, Homo sapiens
tactgctgattagagctgaggt

SEQ ID NO: 7063577 - DNA, 22 bp, Homo sapiens
tactggaaggctggaagtcagg

SEQ ID NO: 7063578 - DNA, 22 bp, Homo sapiens
tatattaaatgaccagttttaa

SEQ ID NO: 7063579 - DNA, 22 bp, Homo sapiens
tatattaaagtgctttgcagtg

SEQ ID NO: 7063580 - DNA, 22 bp, Homo sapiens
tatattaaagtgctttgcagtg

SEQ ID NO: 7063581 - DNA, 22 bp, Homo sapiens
tatatgttgatactaattctgg

SEQ ID NO: 7063582 - DNA, 22 bp, Homo sapiens
tatattaaaccctctctgtagg

SEQ ID NO: 7063583 - DNA, 22 bp, Homo sapiens
tatattaacacccacttgcctc

SEQ ID NO: 7063584 - DNA, 22 bp, Homo sapiens
tatattaaccatagggttctag

SEQ ID NO: 7063585 - DNA, 22 bp, Homo sapiens
tatattaacttgtgatcctgga

SEQ ID NO: 7063586 - DNA, 22 bp, Homo sapiens
tatattacctgcctgatctata

SEQ ID NO: 7063587 - DNA, 22 bp, Homo sapiens
tatattagtgagatttatccat

SEQ ID NO: 7063588 - DNA, 22 bp, Homo sapiens
tatattataagccctttcagaa

SEQ ID NO: 7063589 - DNA, 22 bp, Homo sapiens
tatattcaacaggctaatgtca

SEQ ID NO: 7063590 - DNA, 22 bp, Homo sapiens
tatatgtaagctatgtaagagt

SEQ ID NO: 7063591 - DNA, 22 bp, Homo sapiens
tatatgtagattgtaccaatgt

SEQ ID NO: 7063592 - DNA, 22 bp, Homo sapiens
tatatgtagtcagtcagagtaa

SEQ ID NO: 7063593 - DNA, 22 bp, Homo sapiens
tatatgcaattttttagtgcaa

SEQ ID NO: 7063594 - DNA, 22 bp, Homo sapiens
tatactttcctgcaactttgat

SEQ ID NO: 7063595 - DNA, 22 bp, Homo sapiens
tatacttatgctaaaaaatgtt

SEQ ID NO: 7063596 - DNA, 22 bp, Homo sapiens
tatagaagagacatgtgcatag

SEQ ID NO: 7063597 - DNA, 22 bp, Homo sapiens
tatagaagtaagcattgtgatg

SEQ ID NO: 7063598 - DNA, 22 bp, Homo sapiens
tatactgagagcaaatacattc

SEQ ID NO: 7063599 - DNA, 22 bp, Homo sapiens
tatactgatttgtctatactct

SEQ ID NO: 7063600 - DNA, 22 bp, Homo sapiens
tatacatgttttacataagtga

SEQ ID NO: 7063601 - DNA, 22 bp, Homo sapiens
tataccaaaatatcagaaaggg

SEQ ID NO: 7063602 - DNA, 20 bp, Homo sapiens
tatactaacatatatctgtt

SEQ ID NO: 7063603 - DNA, 20 bp, Homo sapiens
tatactaacatatatctgtt

SEQ ID NO: 7063604 - DNA, 22 bp, Homo sapiens
tagttaaagccctaaattgata

SEQ ID NO: 7063605 - DNA, 22 bp, Homo sapiens
tatacagaactgcacgtgcacg

SEQ ID NO: 7063606 - DNA, 22 bp, Homo sapiens
tagttaaaataatggagatgtt

SEQ ID NO: 7063607 - DNA, 22 bp, Homo sapiens
tagttaaaataatggagatgtt

SEQ ID NO: 7063608 - DNA, 22 bp, Homo sapiens
tatcaacattaatattttctgg

SEQ ID NO: 7063609 - DNA, 21 bp, Homo sapiens
tatcaaggcactttttaaaga

SEQ ID NO: 7063610 - DNA, 22 bp, Homo sapiens
tatcaatacatgttatcagtgt

SEQ ID NO: 7063611 - DNA, 22 bp, Homo sapiens
tatcaatacatgttatcagtgt

SEQ ID NO: 7063612 - DNA, 22 bp, Homo sapiens
tatcaattgggccaaatggtac

SEQ ID NO: 7063613 - DNA, 22 bp, Homo sapiens
tatcacaattcctatagtttgt

SEQ ID NO: 7063614 - DNA, 22 bp, Homo sapiens
tatctgttaggatcagagctgg

SEQ ID NO: 7063615 - DNA, 22 bp, Homo sapiens
tatctgttatgggctgaattgc

SEQ ID NO: 7063616 - DNA, 22 bp, Homo sapiens
tatctgttatgggctgaattgc

SEQ ID NO: 7063617 - DNA, 22 bp, Homo sapiens
tatctgttcaatggaagatgac

SEQ ID NO: 7063618 - DNA, 22 bp, Homo sapiens
tatctgttcatgtttatatgtc

SEQ ID NO: 7063619 - DNA, 22 bp, Homo sapiens
tatctgttccaggcactcagct

SEQ ID NO: 7063620 - DNA, 22 bp, Homo sapiens
tatctgttcttagctatagatg

SEQ ID NO: 7063621 - DNA, 22 bp, Homo sapiens
tatctgttggctcctagttgta

SEQ ID NO: 7063622 - DNA, 20 bp, Homo sapiens
tatattttctctttggcctt

SEQ ID NO: 7063623 - DNA, 22 bp, Homo sapiens
tatattttagacaccctcacgc

SEQ ID NO: 7063624 - DNA, 22 bp, Homo sapiens
tatatttaaatccaggttgaaa

SEQ ID NO: 7063625 - DNA, 22 bp, Homo sapiens
tatatttaatcctagagccatt

SEQ ID NO: 7063626 - DNA, 22 bp, Homo sapiens
tatatttaattagttgctggat

SEQ ID NO: 7063627 - DNA, 18 bp, Homo sapiens
tatatttcacacatattc

SEQ ID NO: 7063628 - DNA, 18 bp, Homo sapiens
tatatttcacacatattc

SEQ ID NO: 7063629 - DNA, 18 bp, Homo sapiens
tatatttcacacatattc

SEQ ID NO: 7063630 - DNA, 22 bp, Homo sapiens
tatatttgtgtgtgatttatga

SEQ ID NO: 7063631 - DNA, 22 bp, Homo sapiens
tatctttattatgtctatctgc

SEQ ID NO: 7063632 - DNA, 22 bp, Homo sapiens
tatctttagaggaagagaatct

SEQ ID NO: 7063633 - DNA, 22 bp, Homo sapiens
tatctttagaggaagagaatct

SEQ ID NO: 7063634 - DNA, 22 bp, Homo sapiens
tatcttgtaataggtccacttg

SEQ ID NO: 7063635 - DNA, 22 bp, Homo sapiens
tatctttaacttgcagtattta

SEQ ID NO: 7063636 - DNA, 22 bp, Homo sapiens
tatctttaacttgcagtattta

SEQ ID NO: 7063637 - DNA, 22 bp, Homo sapiens
tatctttaacttgcagtattta

SEQ ID NO: 7063638 - DNA, 22 bp, Homo sapiens
tatctgttgtagtacagatgat

SEQ ID NO: 7063639 - DNA, 22 bp, Homo sapiens
tatctgttgtccatgcagaaag

SEQ ID NO: 7063640 - DNA, 22 bp, Homo sapiens
tatctgttgtcttttacatgta

SEQ ID NO: 7063641 - DNA, 19 bp, Homo sapiens
tatctgtttcctgcttgtc

SEQ ID NO: 7063642 - DNA, 22 bp, Homo sapiens
tatctgtttgctcacaggtgtt

SEQ ID NO: 7063643 - DNA, 22 bp, Homo sapiens
tatgcatatgtgttcattggag

SEQ ID NO: 7063644 - DNA, 22 bp, Homo sapiens
tatgagtttaaggctaaaatag

SEQ ID NO: 7063645 - DNA, 20 bp, Homo sapiens
tatgataattacaaaatagt

SEQ ID NO: 7063646 - DNA, 20 bp, Homo sapiens
tatgataattacaaaatagt

SEQ ID NO: 7063647 - DNA, 22 bp, Homo sapiens
tattcacaaaatgaggtcctca

SEQ ID NO: 7063648 - DNA, 22 bp, Homo sapiens
tatgtttatactttgatgtact

SEQ ID NO: 7063649 - DNA, 22 bp, Homo sapiens
tatgtttatactttgatgtact

SEQ ID NO: 7063650 - DNA, 22 bp, Homo sapiens
tattcacaaaatgaggtcctca

SEQ ID NO: 7063651 - DNA, 22 bp, Homo sapiens
tattcacagctgccgcactcag

SEQ ID NO: 7063652 - DNA, 22 bp, Homo sapiens
tattcacaggcacgaaatattg

SEQ ID NO: 7063653 - DNA, 22 bp, Homo sapiens
tattcacaggcacgaaatattg

SEQ ID NO: 7063654 - DNA, 22 bp, Homo sapiens
tattcacaggctggagtgatgt

SEQ ID NO: 7063655 - DNA, 22 bp, Homo sapiens
tattcacaggctggagtgatgt

SEQ ID NO: 7063656 - DNA, 22 bp, Homo sapiens
tattcacagttgatttacagtt

SEQ ID NO: 7063657 - DNA, 22 bp, Homo sapiens
tattcacatgaaaacaaatttt

SEQ ID NO: 7063658 - DNA, 22 bp, Homo sapiens
tattcacatgtacatatgctca

SEQ ID NO: 7063659 - DNA, 22 bp, Homo sapiens
tattcacatgtacatatgctca

SEQ ID NO: 7063660 - DNA, 22 bp, Homo sapiens
tattgacatttttatagcttga

SEQ ID NO: 7063661 - DNA, 17 bp, Homo sapiens
tattgacctttgtatgt

SEQ ID NO: 7063662 - DNA, 22 bp, Homo sapiens
tattgacttttaaagtgatata

SEQ ID NO: 7063663 - DNA, 22 bp, Homo sapiens
tattgagacttccagtatatga

SEQ ID NO: 7063664 - DNA, 22 bp, Homo sapiens
tattgatgcttggattgggcca

SEQ ID NO: 7063665 - DNA, 22 bp, Homo sapiens
tattcacattctcaggcctggt

SEQ ID NO: 7063666 - DNA, 22 bp, Homo sapiens
tattcagagggttgaattttta

SEQ ID NO: 7063667 - DNA, 22 bp, Homo sapiens
tatgcctgataactgtgtctct

SEQ ID NO: 7063668 - DNA, 22 bp, Homo sapiens
tatgtgtttgacaccctgcaag

SEQ ID NO: 7063669 - DNA, 22 bp, Homo sapiens
tatgttaagtgggataatcaaa

SEQ ID NO: 7063670 - DNA, 22 bp, Homo sapiens
tatgttaagtgggataatcaaa

SEQ ID NO: 7063671 - DNA, 22 bp, Homo sapiens
tatgttattttcatacaacaga

SEQ ID NO: 7063672 - DNA, 22 bp, Homo sapiens
tatgttattttcatacaacaga

SEQ ID NO: 7063673 - DNA, 22 bp, Homo sapiens
tatgttcatctggtgcatcagt

SEQ ID NO: 7063674 - DNA, 22 bp, Homo sapiens
tatgttcatgtcaaacaaatgc

SEQ ID NO: 7063675 - DNA, 22 bp, Homo sapiens
tatgttctgactctacatggga

SEQ ID NO: 7063676 - DNA, 22 bp, Homo sapiens
tatgttctgtctgtacagattt

SEQ ID NO: 7063677 - DNA, 22 bp, Homo sapiens
tatgttctgtctgtacagattt

SEQ ID NO: 7063678 - DNA, 22 bp, Homo sapiens
tatgttgcaccaacctaataat

SEQ ID NO: 7063679 - DNA, 22 bp, Homo sapiens
tatgtttaaatgtatgtgtatg

SEQ ID NO: 7063680 - DNA, 22 bp, Homo sapiens
tatgtttaaatgtatgtgtatg

SEQ ID NO: 7063681 - DNA, 22 bp, Homo sapiens
tatgtttaaatgtatgtgtatg

SEQ ID NO: 7063682 - DNA, 22 bp, Homo sapiens
tatgtttacgctggtagaatta

SEQ ID NO: 7063683 - DNA, 22 bp, Homo sapiens
tatgtttagtatccattttcag

SEQ ID NO: 7063684 - DNA, 22 bp, Homo sapiens
tatttcactcagtataccatag

SEQ ID NO: 7063685 - DNA, 22 bp, Homo sapiens
tattgtatcttaccacatgtat

SEQ ID NO: 7063686 - DNA, 22 bp, Homo sapiens
tatttcacagcagctcatttaa

SEQ ID NO: 7063687 - DNA, 22 bp, Homo sapiens
tatttcacataccacagagtgt

SEQ ID NO: 7063688 - DNA, 22 bp, Homo sapiens
tatttcaccttactaagctgtg

SEQ ID NO: 7063689 - DNA, 22 bp, Homo sapiens
tatttctaagagatatctgtac

SEQ ID NO: 7063690 - DNA, 22 bp, Homo sapiens
tatttcctgcatggtgatgtaa

SEQ ID NO: 7063691 - DNA, 22 bp, Homo sapiens
tatttcctgtggatacttttag

SEQ ID NO: 7063692 - DNA, 22 bp, Homo sapiens
tatttcctgtggatacttttag

SEQ ID NO: 7063693 - DNA, 22 bp, Homo sapiens
tatttccttgagacggagtctc

SEQ ID NO: 7063694 - DNA, 22 bp, Homo sapiens
tatttctaagctgtaagtctga

SEQ ID NO: 7063695 - DNA, 22 bp, Homo sapiens
tatttctaagctgtaagtctga

SEQ ID NO: 7063696 - DNA, 22 bp, Homo sapiens
tatttgtatgtgtgtacatata

SEQ ID NO: 7063697 - DNA, 22 bp, Homo sapiens
tatttgtatgtgtgtacatata

SEQ ID NO: 7063698 - DNA, 22 bp, Homo sapiens
tatttgtatgtgtgtacatata

SEQ ID NO: 7063699 - DNA, 22 bp, Homo sapiens
tatttgtatttcatgcagtaaa

SEQ ID NO: 7063700 - DNA, 22 bp, Homo sapiens
tatttgtccttattaagatctg

SEQ ID NO: 7063701 - DNA, 22 bp, Homo sapiens
tatttgtatttcatgcagtaaa

SEQ ID NO: 7063702 - DNA, 22 bp, Homo sapiens
tatttgttccagagataaaaat

SEQ ID NO: 7063703 - DNA, 22 bp, Homo sapiens
tatttgttgagttgttatgtct

SEQ ID NO: 7063704 - DNA, 22 bp, Homo sapiens
tatttgttgagttgttatgtct

SEQ ID NO: 7063705 - DNA, 22 bp, Homo sapiens
tattttcaccttctctggatat

SEQ ID NO: 7063706 - DNA, 22 bp, Homo sapiens
tattttcaccttctctggatat

SEQ ID NO: 7063707 - DNA, 22 bp, Homo sapiens
tattttcatcttgtccttggat

SEQ ID NO: 7063708 - DNA, 22 bp, Homo sapiens
tattttcattctgtgtgactgt

SEQ ID NO: 7063709 - DNA, 22 bp, Homo sapiens
tattttcatcttgtccttggat

SEQ ID NO: 7063710 - DNA, 22 bp, Homo sapiens
tattttcatcttgtccttggat

SEQ ID NO: 7063711 - DNA, 22 bp, Homo sapiens
tattttcattctgtgtgactgt

SEQ ID NO: 7063712 - DNA, 22 bp, Homo sapiens
tattttcattctgtgtgactgt

SEQ ID NO: 7063713 - DNA, 22 bp, Homo sapiens
tagaggagggctgttcttcagt

SEQ ID NO: 7063714 - DNA, 22 bp, Homo sapiens
tagaggcaaccagtgttgagaa

SEQ ID NO: 7063715 - DNA, 22 bp, Homo sapiens
tagaggcaccctggaggagact

SEQ ID NO: 7063716 - DNA, 22 bp, Homo sapiens
tagaggagcggcgagctgagct

SEQ ID NO: 7063717 - DNA, 22 bp, Homo sapiens
tagaggagagttgctggatgga

SEQ ID NO: 7063718 - DNA, 22 bp, Homo sapiens
tagaggcaccctggaggagact

SEQ ID NO: 7063719 - DNA, 22 bp, Homo sapiens
tagaggcagaagaaattgacaa

SEQ ID NO: 7063720 - DNA, 22 bp, Homo sapiens
tagatgaccttgtgttaggcaa

SEQ ID NO: 7063721 - DNA, 22 bp, Homo sapiens
tagatgatagggccagaatttg

SEQ ID NO: 7063722 - DNA, 22 bp, Homo sapiens
tagatggaggctagatgcaggg

SEQ ID NO: 7063723 - DNA, 23 bp, Homo sapiens
tagaatctgtatttctgcagttc

SEQ ID NO: 7063724 - DNA, 22 bp, Homo sapiens
tagaatctggaaggggctattc

SEQ ID NO: 7063725 - DNA, 22 bp, Homo sapiens
tagagatgaattctgcagtctt

SEQ ID NO: 7063726 - DNA, 22 bp, Homo sapiens
tagagcagaacttgttaacacc

SEQ ID NO: 7063727 - DNA, 22 bp, Homo sapiens
tagagcagttggcagctgtatt

SEQ ID NO: 7063728 - DNA, 22 bp, Homo sapiens
tagaatcagaagatttgactgt

SEQ ID NO: 7063729 - DNA, 22 bp, Homo sapiens
tagaataagttgatgatatatg

SEQ ID NO: 7063730 - DNA, 22 bp, Homo sapiens
tagaataagttgatgatatatg

SEQ ID NO: 7063731 - DNA, 22 bp, Homo sapiens
tagaagttaggaaataggaata

SEQ ID NO: 7063732 - DNA, 22 bp, Homo sapiens
tagaagttatgataataatagt

SEQ ID NO: 7063733 - DNA, 22 bp, Homo sapiens
tagaagttcatgcgaattattt

SEQ ID NO: 7063734 - DNA, 22 bp, Homo sapiens
tactttctttctgatccttatg

SEQ ID NO: 7063735 - DNA, 22 bp, Homo sapiens
tactttctgtccttctgttaaa

SEQ ID NO: 7063736 - DNA, 22 bp, Homo sapiens
tactttctaagacatacaactt

SEQ ID NO: 7063737 - DNA, 22 bp, Homo sapiens
tactttcatgtctatacatatt

SEQ ID NO: 7063738 - DNA, 18 bp, Homo sapiens
tagcacagagcaggatgt

SEQ ID NO: 7063739 - DNA, 22 bp, Homo sapiens
tagcacaggtcttgttgccatt

SEQ ID NO: 7063740 - DNA, 22 bp, Homo sapiens
tagattttaggagattttactg

SEQ ID NO: 7063741 - DNA, 22 bp, Homo sapiens
tagattttacttctgtcattac

SEQ ID NO: 7063742 - DNA, 22 bp, Homo sapiens
tagattttacttctgtcattac

SEQ ID NO: 7063743 - DNA, 22 bp, Homo sapiens
tagatgttaagcttctagaagg

SEQ ID NO: 7063744 - DNA, 23 bp, Homo sapiens
tagatgtattaagtgcattttca

SEQ ID NO: 7063745 - DNA, 22 bp, Homo sapiens
tagatgttgaagtcatatttgg

SEQ ID NO: 7063746 - DNA, 22 bp, Homo sapiens
tagcagaaccagtcagtgagcc

SEQ ID NO: 7063747 - DNA, 22 bp, Homo sapiens
tagcacttgtgttatgccttgt

SEQ ID NO: 7063748 - DNA, 22 bp, Homo sapiens
tagcacagttcctgactctttg

SEQ ID NO: 7063749 - DNA, 22 bp, Homo sapiens
tagcacatacataatagataga

SEQ ID NO: 7063750 - DNA, 22 bp, Homo sapiens
tagcacatctggcgcttatagg

SEQ ID NO: 7063751 - DNA, 22 bp, Homo sapiens
tagcacatcttcttggcctgca

SEQ ID NO: 7063752 - DNA, 22 bp, Homo sapiens
tagcacattgttgaccagaagg

SEQ ID NO: 7063753 - DNA, 22 bp, Homo sapiens
tagcatttattccagatttgga

SEQ ID NO: 7063754 - DNA, 22 bp, Homo sapiens
tagcatttcactgatcttcact

SEQ ID NO: 7063755 - DNA, 22 bp, Homo sapiens
tagcatttcccaaatgcatttg

SEQ ID NO: 7063756 - DNA, 22 bp, Homo sapiens
tagccaaagaaggtatatttgt

SEQ ID NO: 7063757 - DNA, 22 bp, Homo sapiens
tagccaggcgaggtcagtgtcg

SEQ ID NO: 7063758 - DNA, 22 bp, Homo sapiens
tagccaggctgcagctgatccg

SEQ ID NO: 7063759 - DNA, 22 bp, Homo sapiens
taggctgaaaggagaggtgaag

SEQ ID NO: 7063760 - DNA, 22 bp, Homo sapiens
taggctaggctgaaggttttgg

SEQ ID NO: 7063761 - DNA, 22 bp, Homo sapiens
taggaaggcctgtcactacttg

SEQ ID NO: 7063762 - DNA, 22 bp, Homo sapiens
taggaattatgatgctatcaag

SEQ ID NO: 7063763 - DNA, 23 bp, Homo sapiens
taggaagacagcaaaagaatgga

SEQ ID NO: 7063764 - DNA, 22 bp, Homo sapiens
taggaagataaacatttgtatg

SEQ ID NO: 7063765 - DNA, 22 bp, Homo sapiens
taggaagatcaagtttatctca

SEQ ID NO: 7063766 - DNA, 22 bp, Homo sapiens
taggaagatgagtatcaacttg

SEQ ID NO: 7063767 - DNA, 22 bp, Homo sapiens
taggaagcctaaattaagtggt

SEQ ID NO: 7063768 - DNA, 22 bp, Homo sapiens
taggaagctatgggagatgtga

SEQ ID NO: 7063769 - DNA, 22 bp, Homo sapiens
taggaagctctttgttttgtga

SEQ ID NO: 7063770 - DNA, 22 bp, Homo sapiens
taggaagctgagcagcattcct

SEQ ID NO: 7063771 - DNA, 18 bp, Homo sapiens
taggaagcttaatgtttt

SEQ ID NO: 7063772 - DNA, 22 bp, Homo sapiens
tagcccagcatgagcagagctg

SEQ ID NO: 7063773 - DNA, 22 bp, Homo sapiens
taggaaactctcagctggtcat

SEQ ID NO: 7063774 - DNA, 22 bp, Homo sapiens
tagtatatctttagtacatagt

SEQ ID NO: 7063775 - DNA, 22 bp, Homo sapiens
tagtaaaagtttagttgaaagt

SEQ ID NO: 7063776 - DNA, 22 bp, Homo sapiens
taggttttcctaaaattctggt

SEQ ID NO: 7063777 - DNA, 22 bp, Homo sapiens
taggctggaacttaggcagagg

SEQ ID NO: 7063778 - DNA, 22 bp, Homo sapiens
taggctggaacttaggcagagg

SEQ ID NO: 7063779 - DNA, 22 bp, Homo sapiens
taggctgaggttgatgccaggg

SEQ ID NO: 7063780 - DNA, 22 bp, Homo sapiens
taggctgacttgtttcataaag

SEQ ID NO: 7063781 - DNA, 22 bp, Homo sapiens
taggctgagctaagagagctta

SEQ ID NO: 7063782 - DNA, 22 bp, Homo sapiens
taggctgagcttgtagatcgta

SEQ ID NO: 7063783 - DNA, 22 bp, Homo sapiens
taggctggaacttaggcagagg

SEQ ID NO: 7063784 - DNA, 22 bp, Homo sapiens
taggctggaacttaggcagagg

SEQ ID NO: 7063785 - DNA, 22 bp, Homo sapiens
taggctggaacttaggcagagg

SEQ ID NO: 7063786 - DNA, 22 bp, Homo sapiens
taggctggaggaagcagtgcct

SEQ ID NO: 7063787 - DNA, 22 bp, Homo sapiens
taggctggaggaagcagtgcct

SEQ ID NO: 7063788 - DNA, 22 bp, Homo sapiens
taggctggaggaagcagtgcct

SEQ ID NO: 7063789 - DNA, 22 bp, Homo sapiens
taggctggaggaagcagtgcct

SEQ ID NO: 7063790 - DNA, 22 bp, Homo sapiens
taggctgggaagaaagattctc

SEQ ID NO: 7063791 - DNA, 22 bp, Homo sapiens
taggctgggaagaaagattctc

SEQ ID NO: 7063792 - DNA, 22 bp, Homo sapiens
taggctgggagcctgaggctag

SEQ ID NO: 7063793 - DNA, 22 bp, Homo sapiens
taggctgggagcctgaggctag

SEQ ID NO: 7063794 - DNA, 22 bp, Homo sapiens
taggctgggaagaaagattctc

SEQ ID NO: 7063795 - DNA, 22 bp, Homo sapiens
taggtgtgggctcaggaatgtg

SEQ ID NO: 7063796 - DNA, 22 bp, Homo sapiens
tagtggggcctgggagggttcc

SEQ ID NO: 7063797 - DNA, 22 bp, Homo sapiens
tagtccaggttaatccctgcct

SEQ ID NO: 7063798 - DNA, 22 bp, Homo sapiens
tagtatttcctgtaagctatag

SEQ ID NO: 7063799 - DNA, 22 bp, Homo sapiens
tagtatttaatcacttttgtct

SEQ ID NO: 7063800 - DNA, 22 bp, Homo sapiens
tagtatttaatcacttttgtct

SEQ ID NO: 7063801 - DNA, 22 bp, Homo sapiens
tagtcaactagtgagcatatgg

SEQ ID NO: 7063802 - DNA, 20 bp, Homo sapiens
tagtatttgcataaggatag

SEQ ID NO: 7063803 - DNA, 22 bp, Homo sapiens
tagtcattctccttacaaagcc

SEQ ID NO: 7063804 - DNA, 22 bp, Homo sapiens
tagtccagaaactgagcttata

SEQ ID NO: 7063805 - DNA, 22 bp, Homo sapiens
gtcctctgagggggctgcacgc

SEQ ID NO: 7063806 - DNA, 22 bp, Homo sapiens
gtcctctgaagttgtgcaatgc

SEQ ID NO: 7063807 - DNA, 22 bp, Homo sapiens
gtcattttatgggaacagattt

SEQ ID NO: 7063808 - DNA, 22 bp, Homo sapiens
gtccctggagctgagcagtgct

SEQ ID NO: 7063809 - DNA, 22 bp, Homo sapiens
gtccctggagctgagcagtgct

SEQ ID NO: 7063810 - DNA, 22 bp, Homo sapiens
gtccctggatctgggacagctg

SEQ ID NO: 7063811 - DNA, 22 bp, Homo sapiens
gtcaggggatgtgctggtggcc

SEQ ID NO: 7063812 - DNA, 22 bp, Homo sapiens
gtcattcaaactgtatcacttg

SEQ ID NO: 7063813 - DNA, 17 bp, Homo sapiens
gtcattctcagaaaatg

SEQ ID NO: 7063814 - DNA, 22 bp, Homo sapiens
gtcacaggtgtggaggtgctgg

SEQ ID NO: 7063815 - DNA, 22 bp, Homo sapiens
gtcacaggtgtggaggtgctgg

SEQ ID NO: 7063816 - DNA, 22 bp, Homo sapiens
gtcacatgccagtgcacacagg

SEQ ID NO: 7063817 - DNA, 22 bp, Homo sapiens
gtcaccagcaccaatgccacat

SEQ ID NO: 7063818 - DNA, 19 bp, Homo sapiens
gtcacatttgtctcccagg

SEQ ID NO: 7063819 - DNA, 22 bp, Homo sapiens
gtaatccaaagtaacattaaac

SEQ ID NO: 7063820 - DNA, 22 bp, Homo sapiens
gtaacactagctctgtcacttt

SEQ ID NO: 7063821 - DNA, 22 bp, Homo sapiens
gtaacattattcatgagataca

SEQ ID NO: 7063822 - DNA, 22 bp, Homo sapiens
gtaaatattccctcggttccta

SEQ ID NO: 7063823 - DNA, 22 bp, Homo sapiens
gtaaatattccctcggttccta

SEQ ID NO: 7063824 - DNA, 22 bp, Homo sapiens
gtaaatattccctcggttccta

SEQ ID NO: 7063825 - DNA, 22 bp, Homo sapiens
gtaaatgagtcaaatgggggaa

SEQ ID NO: 7063826 - DNA, 22 bp, Homo sapiens
gtaaattatttcaagatcatct

SEQ ID NO: 7063827 - DNA, 22 bp, Homo sapiens
gtcaagcagaagataatttaaa

SEQ ID NO: 7063828 - DNA, 17 bp, Homo sapiens
gtcaacaggatttcttt

SEQ ID NO: 7063829 - DNA, 22 bp, Homo sapiens
gtcaagtcatgactcaaaggaa

SEQ ID NO: 7063830 - DNA, 20 bp, Homo sapiens
gtcaagtccctggggcagct

SEQ ID NO: 7063831 - DNA, 22 bp, Homo sapiens
gtcaataattgatagatattgg

SEQ ID NO: 7063832 - DNA, 22 bp, Homo sapiens
gtcaataattgatagatattgg

SEQ ID NO: 7063833 - DNA, 22 bp, Homo sapiens
gtcaataattttatggagagaa

SEQ ID NO: 7063834 - DNA, 22 bp, Homo sapiens
gtaggaaagggagtgaagggaa

SEQ ID NO: 7063835 - DNA, 22 bp, Homo sapiens
gtaggaagctctgaggctagtt

SEQ ID NO: 7063836 - DNA, 22 bp, Homo sapiens
gtagagtcaggacggcaattct

SEQ ID NO: 7063837 - DNA, 22 bp, Homo sapiens
gtagatcatgagaatgtttttg

SEQ ID NO: 7063838 - DNA, 22 bp, Homo sapiens
gtagaccatttatctggggagt

SEQ ID NO: 7063839 - DNA, 22 bp, Homo sapiens
gtagaccatttatctggggagt

SEQ ID NO: 7063840 - DNA, 22 bp, Homo sapiens
gtagcagaatcagtgctacaga

SEQ ID NO: 7063841 - DNA, 22 bp, Homo sapiens
gtagcaggtattctggtgtgag

SEQ ID NO: 7063842 - DNA, 22 bp, Homo sapiens
gtagccattggcaatgaagcct

SEQ ID NO: 7063843 - DNA, 22 bp, Homo sapiens
gtagcccacctggggagggcga

SEQ ID NO: 7063844 - DNA, 22 bp, Homo sapiens
gtgataattgcagagaaaggag

SEQ ID NO: 7063845 - DNA, 22 bp, Homo sapiens
gtgatggagtcaaggctagaac

SEQ ID NO: 7063846 - DNA, 22 bp, Homo sapiens
gtgatgggtaactgtttaggga

SEQ ID NO: 7063847 - DNA, 23 bp, Homo sapiens
gtgagtcttgcctttgctgtgga

SEQ ID NO: 7063848 - DNA, 22 bp, Homo sapiens
gtgataaaatagaaacagtggt

SEQ ID NO: 7063849 - DNA, 22 bp, Homo sapiens
gtgataaaatagaaacagtggt

SEQ ID NO: 7063850 - DNA, 22 bp, Homo sapiens
gtgataaaggggaggaagtgtg

SEQ ID NO: 7063851 - DNA, 22 bp, Homo sapiens
gtcttcttttcagtctgcttgt

SEQ ID NO: 7063852 - DNA, 22 bp, Homo sapiens
gtcttctgtaagatgaggtccc

SEQ ID NO: 7063853 - DNA, 22 bp, Homo sapiens
gtgaggcagggaaagaggataa

SEQ ID NO: 7063854 - DNA, 22 bp, Homo sapiens
gtgaggtcatatagcgaactcc

SEQ ID NO: 7063855 - DNA, 22 bp, Homo sapiens
gtgaggtccagtaacttgtcca

SEQ ID NO: 7063856 - DNA, 22 bp, Homo sapiens
gtgaggtccatgttaatgggtt

SEQ ID NO: 7063857 - DNA, 22 bp, Homo sapiens
gtgaggtcctaatagacatcga

SEQ ID NO: 7063858 - DNA, 22 bp, Homo sapiens
gtgaggtcctccctgctgggag

SEQ ID NO: 7063859 - DNA, 22 bp, Homo sapiens
gtgaggtcctgagaggcttgtg

SEQ ID NO: 7063860 - DNA, 19 bp, Homo sapiens
gtgaggtctttccttttgt

SEQ ID NO: 7063861 - DNA, 22 bp, Homo sapiens
gtgaggtctttgggaggtgatt

SEQ ID NO: 7063862 - DNA, 22 bp, Homo sapiens
gtgaggtgactagcaggtgggg

SEQ ID NO: 7063863 - DNA, 22 bp, Homo sapiens
gtgaggtgagtagtgagaagcc

SEQ ID NO: 7063864 - DNA, 22 bp, Homo sapiens
gtcttatagtacaatttgaagt

SEQ ID NO: 7063865 - DNA, 22 bp, Homo sapiens
gtcttatttaaagagatcatac

SEQ ID NO: 7063866 - DNA, 22 bp, Homo sapiens
gtctcctgagactgcagtcacc

SEQ ID NO: 7063867 - DNA, 22 bp, Homo sapiens
gtctcctgagactgcagtcacc

SEQ ID NO: 7063868 - DNA, 22 bp, Homo sapiens
gtctcctgagccttgactgcaa

SEQ ID NO: 7063869 - DNA, 22 bp, Homo sapiens
gtctcctgagccttgactgcaa

SEQ ID NO: 7063870 - DNA, 22 bp, Homo sapiens
gtctcctgccacactcagtccc

SEQ ID NO: 7063871 - DNA, 22 bp, Homo sapiens
gtctcctggaaatatgcccata

SEQ ID NO: 7063872 - DNA, 22 bp, Homo sapiens
gtctcctggctgcagctaagac

SEQ ID NO: 7063873 - DNA, 22 bp, Homo sapiens
gtctcctgtcctgcaggatgga

SEQ ID NO: 7063874 - DNA, 22 bp, Homo sapiens
gtctctctgctaggcctccagt

SEQ ID NO: 7063875 - DNA, 22 bp, Homo sapiens
gtgattttctcctcctagaagt

SEQ ID NO: 7063876 - DNA, 22 bp, Homo sapiens
gtgattttgagacctatatagt

SEQ ID NO: 7063877 - DNA, 22 bp, Homo sapiens
gtgattttgagacctatatagt

SEQ ID NO: 7063878 - DNA, 22 bp, Homo sapiens
gtgccctggaggggttgaaggg

SEQ ID NO: 7063879 - DNA, 22 bp, Homo sapiens
gtgccctgagtgggtaggagag

SEQ ID NO: 7063880 - DNA, 22 bp, Homo sapiens
gtgcacagaaacatacaatgtg

SEQ ID NO: 7063881 - DNA, 22 bp, Homo sapiens
gtgcacagaaattggtaagact

SEQ ID NO: 7063882 - DNA, 22 bp, Homo sapiens
gtgcccaggggccagctgccgg

SEQ ID NO: 7063883 - DNA, 22 bp, Homo sapiens
gtgcaaattccactggaaagct

SEQ ID NO: 7063884 - DNA, 22 bp, Homo sapiens
gtgcacactcttggggcacttt

SEQ ID NO: 7063885 - DNA, 22 bp, Homo sapiens
gtgctggggagataggaagaga

SEQ ID NO: 7063886 - DNA, 22 bp, Homo sapiens
gtgctggggagataggaagaga

SEQ ID NO: 7063887 - DNA, 22 bp, Homo sapiens
gtgctgggggtttctgtaggtc

SEQ ID NO: 7063888 - DNA, 22 bp, Homo sapiens
gtgctgtaacaacagagtgtct

SEQ ID NO: 7063889 - DNA, 23 bp, Homo sapiens
gtgctgtgagccccttggcctcc

SEQ ID NO: 7063890 - DNA, 22 bp, Homo sapiens
gtgcttgggggaagtaacagac

SEQ ID NO: 7063891 - DNA, 22 bp, Homo sapiens
gtgccctgtctcttgtctccag

SEQ ID NO: 7063892 - DNA, 22 bp, Homo sapiens
gtgccgcgacgcagtcggtgcc

SEQ ID NO: 7063893 - DNA, 22 bp, Homo sapiens
gtgcctccatcagtgcctccaa

SEQ ID NO: 7063894 - DNA, 22 bp, Homo sapiens
gtgcctccttaaattctgcacc

SEQ ID NO: 7063895 - DNA, 22 bp, Homo sapiens
gtgcctctcattggctgagccc

SEQ ID NO: 7063896 - DNA, 22 bp, Homo sapiens
gtgcctctgagctctgctacag

SEQ ID NO: 7063897 - DNA, 22 bp, Homo sapiens
gggtccagcgacagcaggctca

SEQ ID NO: 7063898 - DNA, 22 bp, Homo sapiens
ggtaaattttatgtgatgaaac

SEQ ID NO: 7063899 - DNA, 22 bp, Homo sapiens
ggtaacacaggtgcagttttaa

SEQ ID NO: 7063900 - DNA, 22 bp, Homo sapiens
ggtacagggcttcctggacaag

SEQ ID NO: 7063901 - DNA, 19 bp, Homo sapiens
ggtagaagggaagtgtttt

SEQ ID NO: 7063902 - DNA, 22 bp, Homo sapiens
gggtccagacactccagaggaa

SEQ ID NO: 7063903 - DNA, 22 bp, Homo sapiens
gggtccacctgagcagcagcct

SEQ ID NO: 7063904 - DNA, 23 bp, Homo sapiens
gggtccagagacaggcatgggtg

SEQ ID NO: 7063905 - DNA, 23 bp, Homo sapiens
gggtccagagacaggcatgggtg

SEQ ID NO: 7063906 - DNA, 22 bp, Homo sapiens
gggtccagagttgaagaggtta

SEQ ID NO: 7063907 - DNA, 22 bp, Homo sapiens
gggtcaggctcagcagggcagc

SEQ ID NO: 7063908 - DNA, 22 bp, Homo sapiens
gggtcaggctcagcagggcagc

SEQ ID NO: 7063909 - DNA, 22 bp, Homo sapiens
gggtcaggctcagcagggcagc

SEQ ID NO: 7063910 - DNA, 22 bp, Homo sapiens
gggtcagggaggccccaccatg

SEQ ID NO: 7063911 - DNA, 22 bp, Homo sapiens
gggtcagggctgcctgggctca

SEQ ID NO: 7063912 - DNA, 22 bp, Homo sapiens
gggtcaggaagaattctgccaa

SEQ ID NO: 7063913 - DNA, 22 bp, Homo sapiens
gggtcaggcctcaaggtgggct

SEQ ID NO: 7063914 - DNA, 22 bp, Homo sapiens
gggtcaggcctcaaggtgggct

SEQ ID NO: 7063915 - DNA, 22 bp, Homo sapiens
gggtcaggcctcaaggtgggct

SEQ ID NO: 7063916 - DNA, 22 bp, Homo sapiens
gggtcaggctagcccagacttc

SEQ ID NO: 7063917 - DNA, 22 bp, Homo sapiens
ggtagcaagcgcttgccctgcg

SEQ ID NO: 7063918 - DNA, 22 bp, Homo sapiens
ggtaggagtattttgcagcagt

SEQ ID NO: 7063919 - DNA, 22 bp, Homo sapiens
ggtaggcactggtgggaagaga

SEQ ID NO: 7063920 - DNA, 22 bp, Homo sapiens
ggtaggcagatcactgtctatg

SEQ ID NO: 7063921 - DNA, 22 bp, Homo sapiens
ggtcagcatctggttgagggca

SEQ ID NO: 7063922 - DNA, 22 bp, Homo sapiens
ggtcagccttggatttggtagc

SEQ ID NO: 7063923 - DNA, 22 bp, Homo sapiens
ggtcagccttggatttggtagc

SEQ ID NO: 7063924 - DNA, 22 bp, Homo sapiens
ggtcaggatccaagtctgtgct

SEQ ID NO: 7063925 - DNA, 22 bp, Homo sapiens
ggtcagggttccaggtatcttc

SEQ ID NO: 7063926 - DNA, 22 bp, Homo sapiens
ggtgggatgcctctggagaagt

SEQ ID NO: 7063927 - DNA, 16 bp, Homo sapiens
ggtgggaggtgaggtg

SEQ ID NO: 7063928 - DNA, 22 bp, Homo sapiens
ggtgccagcctagtgcagtggt

SEQ ID NO: 7063929 - DNA, 22 bp, Homo sapiens
ggtgccaggctgtagtcagggt

SEQ ID NO: 7063930 - DNA, 22 bp, Homo sapiens
ggtgcccagagccaggaatgag

SEQ ID NO: 7063931 - DNA, 22 bp, Homo sapiens
ggtgccctgtaaaagccatgca

SEQ ID NO: 7063932 - DNA, 22 bp, Homo sapiens
ggtgaagggccttaggagacag

SEQ ID NO: 7063933 - DNA, 22 bp, Homo sapiens
ggtgaagggccttaggagacag

SEQ ID NO: 7063934 - DNA, 22 bp, Homo sapiens
ggtgaaggcacaagagggcaag

SEQ ID NO: 7063935 - DNA, 22 bp, Homo sapiens
ggtgaaggcacaagagggcaag

SEQ ID NO: 7063936 - DNA, 22 bp, Homo sapiens
ggtgaagggtgtcatggcattt

SEQ ID NO: 7063937 - DNA, 22 bp, Homo sapiens
ggtgaaggtcagagcaggaaaa

SEQ ID NO: 7063938 - DNA, 22 bp, Homo sapiens
ggtgaaggtggaacgcagagca

SEQ ID NO: 7063939 - DNA, 22 bp, Homo sapiens
ggtgaaggtggaacgcagagca

SEQ ID NO: 7063940 - DNA, 22 bp, Homo sapiens
ggtgaataagctgaacacttgg

SEQ ID NO: 7063941 - DNA, 20 bp, Homo sapiens
ggtgcaggtaacgctgtgct

SEQ ID NO: 7063942 - DNA, 22 bp, Homo sapiens
ggtgcagtggtgtggcaaaggg

SEQ ID NO: 7063943 - DNA, 18 bp, Homo sapiens
ggtctttaggtcagtgtc

SEQ ID NO: 7063944 - DNA, 22 bp, Homo sapiens
ggtgaaatatttttgatatgtt

SEQ ID NO: 7063945 - DNA, 22 bp, Homo sapiens
ggtgaaattccttgtggaaagt

SEQ ID NO: 7063946 - DNA, 22 bp, Homo sapiens
ggtgaacattgatgtggttaca

SEQ ID NO: 7063947 - DNA, 22 bp, Homo sapiens
gggctggggctcaataatttgt

SEQ ID NO: 7063948 - DNA, 22 bp, Homo sapiens
gggctggggctcaataatttgt

SEQ ID NO: 7063949 - DNA, 16 bp, Homo sapiens
gggctgggggattctg

SEQ ID NO: 7063950 - DNA, 22 bp, Homo sapiens
gggctggggctcaataatttgt

SEQ ID NO: 7063951 - DNA, 22 bp, Homo sapiens
gggctgggcatggtgttccctc

SEQ ID NO: 7063952 - DNA, 22 bp, Homo sapiens
gggctgggcatggtgttccctc

SEQ ID NO: 7063953 - DNA, 22 bp, Homo sapiens
gggctgggattgcttgctgtga

SEQ ID NO: 7063954 - DNA, 22 bp, Homo sapiens
gggctgggatggcttgaagatt

SEQ ID NO: 7063955 - DNA, 22 bp, Homo sapiens
gggctgggaatggctaagtatg

SEQ ID NO: 7063956 - DNA, 22 bp, Homo sapiens
gggctgggatggcttgaagatt

SEQ ID NO: 7063957 - DNA, 22 bp, Homo sapiens
gggctgggattgcttgctgtga

SEQ ID NO: 7063958 - DNA, 22 bp, Homo sapiens
gggctgggaatggctaagtatg

SEQ ID NO: 7063959 - DNA, 22 bp, Homo sapiens
gggctggctcccaggtgttgaa

SEQ ID NO: 7063960 - DNA, 22 bp, Homo sapiens
ggggcagctcccgagggcagga

SEQ ID NO: 7063961 - DNA, 22 bp, Homo sapiens
ggggcagctcccgagggcagga

SEQ ID NO: 7063962 - DNA, 22 bp, Homo sapiens
ggggatggtgggaaggcaatct

SEQ ID NO: 7063963 - DNA, 22 bp, Homo sapiens
ggggatggaggcgtgtggtcct

SEQ ID NO: 7063964 - DNA, 22 bp, Homo sapiens
ggggatggaatgtagtagtgat

SEQ ID NO: 7063965 - DNA, 23 bp, Homo sapiens
gggggccgtcctggggattatag

SEQ ID NO: 7063966 - DNA, 22 bp, Homo sapiens
gggggccttgttagtggatgga

SEQ ID NO: 7063967 - DNA, 22 bp, Homo sapiens
gggggagctacaggtcccttgg

SEQ ID NO: 7063968 - DNA, 22 bp, Homo sapiens
gggtatgagatataggtgaata

SEQ ID NO: 7063969 - DNA, 22 bp, Homo sapiens
gggtatgatagggaggtgaaat

SEQ ID NO: 7063970 - DNA, 22 bp, Homo sapiens
gggtcagagcaagactggggtc

SEQ ID NO: 7063971 - DNA, 22 bp, Homo sapiens
gggtcagagttcaggtcgaggg

SEQ ID NO: 7063972 - DNA, 22 bp, Homo sapiens
ggggcttttgcacgtgggaggc

SEQ ID NO: 7063973 - DNA, 22 bp, Homo sapiens
ggggcaggaggtgttctctttt

SEQ ID NO: 7063974 - DNA, 22 bp, Homo sapiens
gggggaagaaagaacatggcat

SEQ ID NO: 7063975 - DNA, 22 bp, Homo sapiens
gggggaagactgggctagtgat

SEQ ID NO: 7063976 - DNA, 21 bp, Homo sapiens
gggggaagaggagttgctagt

SEQ ID NO: 7063977 - DNA, 22 bp, Homo sapiens
gggggactaactggatcctgga

SEQ ID NO: 7063978 - DNA, 22 bp, Homo sapiens
gggcctgccattgctgccccag

SEQ ID NO: 7063979 - DNA, 22 bp, Homo sapiens
gggcctgggaacttgcatttag

SEQ ID NO: 7063980 - DNA, 22 bp, Homo sapiens
gggcctggggacaccaccatga

SEQ ID NO: 7063981 - DNA, 22 bp, Homo sapiens
gggcctggtgcttctgactcct

SEQ ID NO: 7063982 - DNA, 22 bp, Homo sapiens
gggcatgcctgcgcagtgcatg

SEQ ID NO: 7063983 - DNA, 22 bp, Homo sapiens
gggcatgagagggcagctggca

SEQ ID NO: 7063984 - DNA, 22 bp, Homo sapiens
gggcatgacttttggagtggga

SEQ ID NO: 7063985 - DNA, 22 bp, Homo sapiens
gggcatctggtggagcctcagg

SEQ ID NO: 7063986 - DNA, 22 bp, Homo sapiens
gggctcctggcagtcatgctca

SEQ ID NO: 7063987 - DNA, 22 bp, Homo sapiens
gggctcctgcctcctggcacct

SEQ ID NO: 7063988 - DNA, 22 bp, Homo sapiens
gggctggcgggaaaggcaattc

SEQ ID NO: 7063989 - DNA, 20 bp, Homo sapiens
gggctggcgcatggggaaag

SEQ ID NO: 7063990 - DNA, 17 bp, Homo sapiens
ggctgtgccaggtgaga

SEQ ID NO: 7063991 - DNA, 22 bp, Homo sapiens
ggctgtgccctcacatggggca

SEQ ID NO: 7063992 - DNA, 22 bp, Homo sapiens
ggctggtggggaaagaggacca

SEQ ID NO: 7063993 - DNA, 22 bp, Homo sapiens
ggctgtgagcaggcagaatgct

SEQ ID NO: 7063994 - DNA, 22 bp, Homo sapiens
ggctgggttctgagaaagagta

SEQ ID NO: 7063995 - DNA, 22 bp, Homo sapiens
ggctgggttctgagaaagagta

SEQ ID NO: 7063996 - DNA, 22 bp, Homo sapiens
ggctggtcacaccactgcaggg

SEQ ID NO: 7063997 - DNA, 22 bp, Homo sapiens
ggctggtcaggaaactaggctc

SEQ ID NO: 7063998 - DNA, 22 bp, Homo sapiens
ggctggtcccgggtcctccggc

SEQ ID NO: 7063999 - DNA, 22 bp, Homo sapiens
ggctggtcctttctctgtccta

SEQ ID NO: 7064000 - DNA, 21 bp, Homo sapiens
ggctggtcgcgtgcatgtctc

SEQ ID NO: 7064001 - DNA, 22 bp, Homo sapiens
ggctggtctcagtgctgggttc

SEQ ID NO: 7064002 - DNA, 22 bp, Homo sapiens
ggctggtctccaacccccgatc

SEQ ID NO: 7064003 - DNA, 22 bp, Homo sapiens
ggctggtgagttcagagaaccc

SEQ ID NO: 7064004 - DNA, 22 bp, Homo sapiens
ggctggtgagttcagagaaccc

SEQ ID NO: 7064005 - DNA, 22 bp, Homo sapiens
ggctggtggggaaagaggacca

SEQ ID NO: 7064006 - DNA, 22 bp, Homo sapiens
ggctggactttctgctgggctc

SEQ ID NO: 7064007 - DNA, 19 bp, Homo sapiens
ggctggagaaaggaatcag

SEQ ID NO: 7064008 - DNA, 19 bp, Homo sapiens
ggctggagaaaggaatcag

SEQ ID NO: 7064009 - DNA, 22 bp, Homo sapiens
ggctggagaagggtggttgaca

SEQ ID NO: 7064010 - DNA, 22 bp, Homo sapiens
ggctgggtacagggcagtgtgc

SEQ ID NO: 7064011 - DNA, 22 bp, Homo sapiens
ggctgggtacagggcagtgtgc

SEQ ID NO: 7064012 - DNA, 22 bp, Homo sapiens
ggctgggtcccagctgggagga

SEQ ID NO: 7064013 - DNA, 22 bp, Homo sapiens
ggctgggtcccagctgggagga

SEQ ID NO: 7064014 - DNA, 19 bp, Homo sapiens
ggctgggtctggcaggttc

SEQ ID NO: 7064015 - DNA, 22 bp, Homo sapiens
ggctgagttgagaggattactt

SEQ ID NO: 7064016 - DNA, 22 bp, Homo sapiens
ggctgagttgagaggattactt

SEQ ID NO: 7064017 - DNA, 22 bp, Homo sapiens
ggctgagttctcttgctgaatc

SEQ ID NO: 7064018 - DNA, 22 bp, Homo sapiens
ggctgagttctcttgctgaatc

SEQ ID NO: 7064019 - DNA, 22 bp, Homo sapiens
ggctgctggggacgtgggagag

SEQ ID NO: 7064020 - DNA, 21 bp, Homo sapiens
ggctgctgggggttggcacag

SEQ ID NO: 7064021 - DNA, 22 bp, Homo sapiens
ggctgctgggtcatgatgcaga

SEQ ID NO: 7064022 - DNA, 20 bp, Homo sapiens
ggctgctgtgggcagagagg

SEQ ID NO: 7064023 - DNA, 22 bp, Homo sapiens
ggctgctgtttcagagactgtt

SEQ ID NO: 7064024 - DNA, 22 bp, Homo sapiens
ggctgcttgctgtttcttggat

SEQ ID NO: 7064025 - DNA, 22 bp, Homo sapiens
ggctgctttatcggctgctgaa

SEQ ID NO: 7064026 - DNA, 21 bp, Homo sapiens
ggctggacatcccaggagact

SEQ ID NO: 7064027 - DNA, 22 bp, Homo sapiens
ggctgagggttaagatcagaca

SEQ ID NO: 7064028 - DNA, 22 bp, Homo sapiens
ggctgaggtgtggggaactata

SEQ ID NO: 7064029 - DNA, 18 bp, Homo sapiens
ggctgaggttgactagaa

SEQ ID NO: 7064030 - DNA, 22 bp, Homo sapiens
ggctgagggtcccagaccctaa

SEQ ID NO: 7064031 - DNA, 22 bp, Homo sapiens
ggctgagggttaagatcagaca

SEQ ID NO: 7064032 - DNA, 22 bp, Homo sapiens
ggctgagggttaagatcagaca

SEQ ID NO: 7064033 - DNA, 18 bp, Homo sapiens
ggctgaggttgactagaa

SEQ ID NO: 7064034 - DNA, 18 bp, Homo sapiens
ggctgaggttgactagaa

SEQ ID NO: 7064035 - DNA, 22 bp, Homo sapiens
ggctgagtctgtgacccatgcg

SEQ ID NO: 7064036 - DNA, 22 bp, Homo sapiens
ggctgagtggaggtagccctgt

SEQ ID NO: 7064037 - DNA, 22 bp, Homo sapiens
ggctgagtggctgggtctagtt

SEQ ID NO: 7064038 - DNA, 22 bp, Homo sapiens
ggctgagtggctgggtctagtt

SEQ ID NO: 7064039 - DNA, 22 bp, Homo sapiens
ggctgagggtcccagaccctaa

SEQ ID NO: 7064040 - DNA, 22 bp, Homo sapiens
ggctgagggtatagctgtccca

SEQ ID NO: 7064041 - DNA, 22 bp, Homo sapiens
ggctgagggtatagctgtccca

SEQ ID NO: 7064042 - DNA, 22 bp, Homo sapiens
ggctgaggggcccagaggaaca

SEQ ID NO: 7064043 - DNA, 22 bp, Homo sapiens
ggctgaggggcccagaggaaca

SEQ ID NO: 7064044 - DNA, 22 bp, Homo sapiens
ggctgagggccagggctagtct

SEQ ID NO: 7064045 - DNA, 22 bp, Homo sapiens
ggctgaggggcccagaggaaca

SEQ ID NO: 7064046 - DNA, 22 bp, Homo sapiens
ggctgagggccagggctagtct

SEQ ID NO: 7064047 - DNA, 22 bp, Homo sapiens
ggctgagccccctctgcgtagg

SEQ ID NO: 7064048 - DNA, 22 bp, Homo sapiens
ggctgagggccagggctagtct

SEQ ID NO: 7064049 - DNA, 22 bp, Homo sapiens
ggctgagggccagggctagtct

SEQ ID NO: 7064050 - DNA, 17 bp, Homo sapiens
ggctctgggtgtcacat

SEQ ID NO: 7064051 - DNA, 22 bp, Homo sapiens
ggctctgggtctgtggggagcg

SEQ ID NO: 7064052 - DNA, 22 bp, Homo sapiens
ggctctgggtgtgaccttgggt

SEQ ID NO: 7064053 - DNA, 22 bp, Homo sapiens
ggctctggttgaccatgatggc

SEQ ID NO: 7064054 - DNA, 22 bp, Homo sapiens
ggctcttcacacagtgatgtca

SEQ ID NO: 7064055 - DNA, 22 bp, Homo sapiens
ggctcttctacttcagatgggg

SEQ ID NO: 7064056 - DNA, 22 bp, Homo sapiens
ggctgagccactgcgcctggct

SEQ ID NO: 7064057 - DNA, 22 bp, Homo sapiens
ggctgagccatgggcactgcag

SEQ ID NO: 7064058 - DNA, 22 bp, Homo sapiens
ggctgagccatgggcactgcag

SEQ ID NO: 7064059 - DNA, 22 bp, Homo sapiens
ggctctgggccagagttggctt

SEQ ID NO: 7064060 - DNA, 22 bp, Homo sapiens
ggctctgggcctccaaggtctg

SEQ ID NO: 7064061 - DNA, 22 bp, Homo sapiens
ggctctggggggaagtctgttg

SEQ ID NO: 7064062 - DNA, 22 bp, Homo sapiens
ggctctggggttggcccatctc

SEQ ID NO: 7064063 - DNA, 22 bp, Homo sapiens
ggctctgggtaaggcgtttgac

SEQ ID NO: 7064064 - DNA, 22 bp, Homo sapiens
ggctacagcggggtggagacgg

SEQ ID NO: 7064065 - DNA, 22 bp, Homo sapiens
ggcgtttcaccatgttgaccag

SEQ ID NO: 7064066 - DNA, 22 bp, Homo sapiens
ggcgtgggaagtggggcttctg

SEQ ID NO: 7064067 - DNA, 22 bp, Homo sapiens
ggcgtggcagtcaggaaaaggt

SEQ ID NO: 7064068 - DNA, 22 bp, Homo sapiens
ggctagagtggaactggagcgg

SEQ ID NO: 7064069 - DNA, 22 bp, Homo sapiens
ggctagagtggaactggagcgg

SEQ ID NO: 7064070 - DNA, 22 bp, Homo sapiens
ggctagagtggaactggagcgg

SEQ ID NO: 7064071 - DNA, 23 bp, Homo sapiens
ggctagagtggaggggaactgca

SEQ ID NO: 7064072 - DNA, 22 bp, Homo sapiens
ggctaggcaggctcagagccta

SEQ ID NO: 7064073 - DNA, 22 bp, Homo sapiens
ggctaggcgggcacatggtgga

SEQ ID NO: 7064074 - DNA, 22 bp, Homo sapiens
ggctaggcgggcacatggtgga

SEQ ID NO: 7064075 - DNA, 22 bp, Homo sapiens
ggctccctagggagagtgggag

SEQ ID NO: 7064076 - DNA, 22 bp, Homo sapiens
ggctccctgcaacctccgcctc

SEQ ID NO: 7064077 - DNA, 22 bp, Homo sapiens
ggctccctgggtgctcctgctc

SEQ ID NO: 7064078 - DNA, 22 bp, Homo sapiens
ggctgtgcctctggcagcacat

SEQ ID NO: 7064079 - DNA, 22 bp, Homo sapiens
ggctttgcattttgatggaggt

SEQ ID NO: 7064080 - DNA, 22 bp, Homo sapiens
ggctttgcctggaatttccttg

SEQ ID NO: 7064081 - DNA, 22 bp, Homo sapiens
gggagctgagctggaagagaat

SEQ ID NO: 7064082 - DNA, 22 bp, Homo sapiens
gggagctgacctgcaggttccc

SEQ ID NO: 7064083 - DNA, 22 bp, Homo sapiens
gggagctgaggagccccgtcgg

SEQ ID NO: 7064084 - DNA, 22 bp, Homo sapiens
gggagctggagctggaagactc

SEQ ID NO: 7064085 - DNA, 22 bp, Homo sapiens
gggaatgagagtcagcccagga

SEQ ID NO: 7064086 - DNA, 22 bp, Homo sapiens
gggaagtgatggagccaggatt

SEQ ID NO: 7064087 - DNA, 23 bp, Homo sapiens
gggaagtggggatttgaagtcat

SEQ ID NO: 7064088 - DNA, 22 bp, Homo sapiens
gggaagtttgtgggaggaatat

SEQ ID NO: 7064089 - DNA, 22 bp, Homo sapiens
gggcactgggtcttctccacgc

SEQ ID NO: 7064090 - DNA, 22 bp, Homo sapiens
gggcactggccgcccatccctg

SEQ ID NO: 7064091 - DNA, 18 bp, Homo sapiens
gggcactggggactggag

SEQ ID NO: 7064092 - DNA, 18 bp, Homo sapiens
gggcactggggactggag

SEQ ID NO: 7064093 - DNA, 23 bp, Homo sapiens
gggcaggtttttataggcttcag

SEQ ID NO: 7064094 - DNA, 23 bp, Homo sapiens
gggcaggtttttataggcttcag

SEQ ID NO: 7064095 - DNA, 22 bp, Homo sapiens
gggcagtcacagtgctggagca

SEQ ID NO: 7064096 - DNA, 22 bp, Homo sapiens
gggcagtgaatattggtgggaa

SEQ ID NO: 7064097 - DNA, 22 bp, Homo sapiens
gggcagtgaatattggtgggaa

SEQ ID NO: 7064098 - DNA, 22 bp, Homo sapiens
gggcagtgacaaaggggatgaa

SEQ ID NO: 7064099 - DNA, 22 bp, Homo sapiens
gggcagtgacaaaggggatgaa

SEQ ID NO: 7064100 - DNA, 19 bp, Homo sapiens
gggcagtggcactagggag

SEQ ID NO: 7064101 - DNA, 22 bp, Homo sapiens
gggcactggcagtcggggacgc

SEQ ID NO: 7064102 - DNA, 22 bp, Homo sapiens
gggcactggaggccaaggagct

SEQ ID NO: 7064103 - DNA, 22 bp, Homo sapiens
gggcactggaggccaaggagct

SEQ ID NO: 7064104 - DNA, 22 bp, Homo sapiens
gggcactgctttgctctgtcac

SEQ ID NO: 7064105 - DNA, 22 bp, Homo sapiens
gggcactggaaggctctcaggc

SEQ ID NO: 7064106 - DNA, 22 bp, Homo sapiens
gggcactgacagggtcccaact

SEQ ID NO: 7064107 - DNA, 22 bp, Homo sapiens
gggcactgagaattttccactt

SEQ ID NO: 7064108 - DNA, 22 bp, Homo sapiens
gggcactgagggcccacaggat

SEQ ID NO: 7064109 - DNA, 22 bp, Homo sapiens
gggcactgagtggatgatgcag

SEQ ID NO: 7064110 - DNA, 22 bp, Homo sapiens
gggcactgctggaggctccctg

SEQ ID NO: 7064111 - DNA, 22 bp, Homo sapiens
gggcacagtctaaagttgggcc

SEQ ID NO: 7064112 - DNA, 22 bp, Homo sapiens
gggcacatgcttagggaggaaa

SEQ ID NO: 7064113 - DNA, 22 bp, Homo sapiens
gggcacatgtaaagctggagaa

SEQ ID NO: 7064114 - DNA, 21 bp, Homo sapiens
gggcactgaaagggaatagca

SEQ ID NO: 7064115 - DNA, 22 bp, Homo sapiens
gggcactgaacaccctcttcgc

SEQ ID NO: 7064116 - DNA, 22 bp, Homo sapiens
gggcacaggagaaggatctggc

SEQ ID NO: 7064117 - DNA, 22 bp, Homo sapiens
gggaggtgatggcaagcagcgg

SEQ ID NO: 7064118 - DNA, 22 bp, Homo sapiens
gggagggattagttctgcctgg

SEQ ID NO: 7064119 - DNA, 21 bp, Homo sapiens
gggagggatggaaatgatgtt

SEQ ID NO: 7064120 - DNA, 21 bp, Homo sapiens
gggagggatggaaatgatgtt

SEQ ID NO: 7064121 - DNA, 22 bp, Homo sapiens
gggagggaggtgatgcttggct

SEQ ID NO: 7064122 - DNA, 22 bp, Homo sapiens
gggagggagaggacagttctat

SEQ ID NO: 7064123 - DNA, 22 bp, Homo sapiens
gggagctggagctggaagactc

SEQ ID NO: 7064124 - DNA, 22 bp, Homo sapiens
ggcagcagggtctagattgatg

SEQ ID NO: 7064125 - DNA, 22 bp, Homo sapiens
ggcagcagggctgtctccctac

SEQ ID NO: 7064126 - DNA, 22 bp, Homo sapiens
ggcagcagggtagccatttctc

SEQ ID NO: 7064127 - DNA, 22 bp, Homo sapiens
ggcagcagtggctgctattgtc

SEQ ID NO: 7064128 - DNA, 22 bp, Homo sapiens
ggcagccagcaatgagaagttt

SEQ ID NO: 7064129 - DNA, 22 bp, Homo sapiens
ggcagccaggagggtgtagttt

SEQ ID NO: 7064130 - DNA, 22 bp, Homo sapiens
ggcagccatactcagacctggg

SEQ ID NO: 7064131 - DNA, 22 bp, Homo sapiens
ggcagccatgcacgctgcctgg

SEQ ID NO: 7064132 - DNA, 22 bp, Homo sapiens
ggcagccatgcacgctgcctgg

SEQ ID NO: 7064133 - DNA, 22 bp, Homo sapiens
ggcagccatgctccaggtgcag

SEQ ID NO: 7064134 - DNA, 22 bp, Homo sapiens
ggcagccatgctccaggtgcag

SEQ ID NO: 7064135 - DNA, 22 bp, Homo sapiens
ggcagccatggacactggctag

SEQ ID NO: 7064136 - DNA, 17 bp, Homo sapiens
ggcagctgtgtgcatgc

SEQ ID NO: 7064137 - DNA, 22 bp, Homo sapiens
ggcaggagaatggcgtgaactc

SEQ ID NO: 7064138 - DNA, 22 bp, Homo sapiens
ggatttgggcttgcagcagagc

SEQ ID NO: 7064139 - DNA, 22 bp, Homo sapiens
ggattttagagtacctaagtgt

SEQ ID NO: 7064140 - DNA, 22 bp, Homo sapiens
ggattgagagcactggtagctg

SEQ ID NO: 7064141 - DNA, 21 bp, Homo sapiens
ggattttaaaaactgcacctg

SEQ ID NO: 7064142 - DNA, 22 bp, Homo sapiens
ggcactgggtgagggtcactgg

SEQ ID NO: 7064143 - DNA, 18 bp, Homo sapiens
ggcactggtgatgcagag

SEQ ID NO: 7064144 - DNA, 18 bp, Homo sapiens
ggcactggtgatgcagag

SEQ ID NO: 7064145 - DNA, 22 bp, Homo sapiens
ggcagaaggcaattagagactg

SEQ ID NO: 7064146 - DNA, 22 bp, Homo sapiens
ggagaggcttggcccagcctgg

SEQ ID NO: 7064147 - DNA, 22 bp, Homo sapiens
ggagatggctggcaggtagatg

SEQ ID NO: 7064148 - DNA, 22 bp, Homo sapiens
ggagcaccctgctcagccaagc

SEQ ID NO: 7064149 - DNA, 22 bp, Homo sapiens
ggagcaccctgctcagccaagc

SEQ ID NO: 7064150 - DNA, 22 bp, Homo sapiens
ggagcaagtcccaggcactagt

SEQ ID NO: 7064151 - DNA, 22 bp, Homo sapiens
ggagatttatagcacacttcag

SEQ ID NO: 7064152 - DNA, 22 bp, Homo sapiens
ggagcagagcatttcacagcct

SEQ ID NO: 7064153 - DNA, 22 bp, Homo sapiens
ggagttggaggctccagggaac

SEQ ID NO: 7064154 - DNA, 23 bp, Homo sapiens
ggagttggattgtacttgctgct

SEQ ID NO: 7064155 - DNA, 22 bp, Homo sapiens
ggagttggtgagcaccaggctt

SEQ ID NO: 7064156 - DNA, 22 bp, Homo sapiens
ggagttggtggcccggaatctc

SEQ ID NO: 7064157 - DNA, 19 bp, Homo sapiens
ggagtttccaatgggtaaa

SEQ ID NO: 7064158 - DNA, 22 bp, Homo sapiens
ggatgaggaaaccacagtgtcc

SEQ ID NO: 7064159 - DNA, 22 bp, Homo sapiens
ggatgaggaagattactgagaa

SEQ ID NO: 7064160 - DNA, 19 bp, Homo sapiens
ggatgagggtcaggcatag

SEQ ID NO: 7064161 - DNA, 22 bp, Homo sapiens
ggatgaggtagatgaacaaggg

SEQ ID NO: 7064162 - DNA, 19 bp, Homo sapiens
ggatgagggtcaggcatag

SEQ ID NO: 7064163 - DNA, 22 bp, Homo sapiens
ggatgcaggaacacagcgacct

SEQ ID NO: 7064164 - DNA, 22 bp, Homo sapiens
ggatgcaggacggcatggatgt

SEQ ID NO: 7064165 - DNA, 22 bp, Homo sapiens
ggatgcaggagttgaagaagga

SEQ ID NO: 7064166 - DNA, 22 bp, Homo sapiens
ggatgcaggggcagcagagcct

SEQ ID NO: 7064167 - DNA, 22 bp, Homo sapiens
ggatggagatgaccatggtgac

SEQ ID NO: 7064168 - DNA, 22 bp, Homo sapiens
ggattagcttttgttcttgact

SEQ ID NO: 7064169 - DNA, 22 bp, Homo sapiens
ggatggctgtaaaaggtgggaa

SEQ ID NO: 7064170 - DNA, 22 bp, Homo sapiens
ggatgggaacttggtagggcat

SEQ ID NO: 7064171 - DNA, 22 bp, Homo sapiens
ggatgggaacttggtagggcat

SEQ ID NO: 7064172 - DNA, 22 bp, Homo sapiens
ggatggaggttctcagatgctc

SEQ ID NO: 7064173 - DNA, 22 bp, Homo sapiens
ggatggagatgaccatggtgac

SEQ ID NO: 7064174 - DNA, 22 bp, Homo sapiens
ggatggcagacagtgagtggct

SEQ ID NO: 7064175 - DNA, 22 bp, Homo sapiens
ggatggcagtctgcatgagaaa

SEQ ID NO: 7064176 - DNA, 22 bp, Homo sapiens
ggcctggaaggacagcgtgatg

SEQ ID NO: 7064177 - DNA, 22 bp, Homo sapiens
ggcctggaaggacagcgtgatg

SEQ ID NO: 7064178 - DNA, 22 bp, Homo sapiens
ggcctggacacctgaggtctta

SEQ ID NO: 7064179 - DNA, 22 bp, Homo sapiens
ggcctggagcagagactaggga

SEQ ID NO: 7064180 - DNA, 19 bp, Homo sapiens
ggcctggctatccctgctg

SEQ ID NO: 7064181 - DNA, 19 bp, Homo sapiens
ggcctggctatccctgctg

SEQ ID NO: 7064182 - DNA, 21 bp, Homo sapiens
ggccctggttacgcctcctct

SEQ ID NO: 7064183 - DNA, 22 bp, Homo sapiens
ggccctgggacacaacaccgaa

SEQ ID NO: 7064184 - DNA, 22 bp, Homo sapiens
ggccctgggatgctcagcagtg

SEQ ID NO: 7064185 - DNA, 22 bp, Homo sapiens
ggccaggagaggagggcactga

SEQ ID NO: 7064186 - DNA, 22 bp, Homo sapiens
ggccaggagcaagccaggctct

SEQ ID NO: 7064187 - DNA, 22 bp, Homo sapiens
ggccaggcactgtgtgagatat

SEQ ID NO: 7064188 - DNA, 22 bp, Homo sapiens
ggccaggcactgtgtgagatat

SEQ ID NO: 7064189 - DNA, 22 bp, Homo sapiens
ggccaggccaagagggttggaa

SEQ ID NO: 7064190 - DNA, 22 bp, Homo sapiens
ggccaggccaagagggttggaa

SEQ ID NO: 7064191 - DNA, 22 bp, Homo sapiens
ggccaggcgatgacccctccac

SEQ ID NO: 7064192 - DNA, 19 bp, Homo sapiens
ggccaggctgactgtggtc

SEQ ID NO: 7064193 - DNA, 22 bp, Homo sapiens
ggccctggcagccacgaaagcc

SEQ ID NO: 7064194 - DNA, 22 bp, Homo sapiens
ggcagggtgcctggctcctgtt

SEQ ID NO: 7064195 - DNA, 22 bp, Homo sapiens
ggcaggagataaaatattagtt

SEQ ID NO: 7064196 - DNA, 18 bp, Homo sapiens
ggcaggagcaagaatagg

SEQ ID NO: 7064197 - DNA, 22 bp, Homo sapiens
ggcaggagctcaggttggttcc

SEQ ID NO: 7064198 - DNA, 22 bp, Homo sapiens
ggcaggagctctccagtttgcc

SEQ ID NO: 7064199 - DNA, 22 bp, Homo sapiens
ggcaggaggaagagttagcacc

SEQ ID NO: 7064200 - DNA, 22 bp, Homo sapiens
ggcaggtgaggcatgtgcctgg

SEQ ID NO: 7064201 - DNA, 17 bp, Homo sapiens
ggcaggtgacagacacc

SEQ ID NO: 7064202 - DNA, 22 bp, Homo sapiens
ggcaggtgacctggcctcccag

SEQ ID NO: 7064203 - DNA, 22 bp, Homo sapiens
ggcaggtgacggggatgagtat

SEQ ID NO: 7064204 - DNA, 17 bp, Homo sapiens
ggcagggtgctgggtat

SEQ ID NO: 7064205 - DNA, 17 bp, Homo sapiens
ggcagggtgctgggtat

SEQ ID NO: 7064206 - DNA, 22 bp, Homo sapiens
ggcagggtggccctccagtgag

SEQ ID NO: 7064207 - DNA, 22 bp, Homo sapiens
ggcagggtgtggagttgggaca

SEQ ID NO: 7064208 - DNA, 22 bp, Homo sapiens
ggccaggaacttttgggatggg

SEQ ID NO: 7064209 - DNA, 22 bp, Homo sapiens
ggcatgagtggcagtgggcagt

SEQ ID NO: 7064210 - DNA, 22 bp, Homo sapiens
ggcatgagtggcagtgggcagt

SEQ ID NO: 7064211 - DNA, 22 bp, Homo sapiens
ggcatcagtatggccatagggt

SEQ ID NO: 7064212 - DNA, 22 bp, Homo sapiens
ggcatcgtcctgggcataggga

SEQ ID NO: 7064213 - DNA, 22 bp, Homo sapiens
ggcatgagaggtcctggggatt

SEQ ID NO: 7064214 - DNA, 22 bp, Homo sapiens
ggcatgagaggtcctggggatt

SEQ ID NO: 7064215 - DNA, 22 bp, Homo sapiens
ggcatctggatctgcttctccc

SEQ ID NO: 7064216 - DNA, 22 bp, Homo sapiens
ggcatgagaggtcctggggatt

SEQ ID NO: 7064217 - DNA, 20 bp, Homo sapiens
ggcatgagatgtgagggagg

SEQ ID NO: 7064218 - DNA, 20 bp, Homo sapiens
ggcatgagatgtgagggagg

SEQ ID NO: 7064219 - DNA, 21 bp, Homo sapiens
ggcatgagggcagtgagcaga

SEQ ID NO: 7064220 - DNA, 22 bp, Homo sapiens
ggcatgagtaacgtgagtgagg

SEQ ID NO: 7064221 - DNA, 22 bp, Homo sapiens
ggcatgagtaacgtgagtgagg

SEQ ID NO: 7064222 - DNA, 22 bp, Homo sapiens
gcctggggtctctgactcacag

SEQ ID NO: 7064223 - DNA, 22 bp, Homo sapiens
gcctgggtccactgatcatgct

SEQ ID NO: 7064224 - DNA, 23 bp, Homo sapiens
gcctgggttgtaactagtgcatc

SEQ ID NO: 7064225 - DNA, 22 bp, Homo sapiens
gcctggtgaaaggcagagagcg

SEQ ID NO: 7064226 - DNA, 21 bp, Homo sapiens
gccttcactcccagagtttgt

SEQ ID NO: 7064227 - DNA, 22 bp, Homo sapiens
gccttattacctgcactttgaa

SEQ ID NO: 7064228 - DNA, 22 bp, Homo sapiens
gcctggtggtgtgctcaagtgg

SEQ ID NO: 7064229 - DNA, 22 bp, Homo sapiens
gcctggtgtccagaggcgagtg

SEQ ID NO: 7064230 - DNA, 22 bp, Homo sapiens
gccttcagcggccgctcgctgc

SEQ ID NO: 7064231 - DNA, 23 bp, Homo sapiens
gccttcagctcgggaaggctccc

SEQ ID NO: 7064232 - DNA, 22 bp, Homo sapiens
gccttccacctaggcctctgct

SEQ ID NO: 7064233 - DNA, 22 bp, Homo sapiens
gcctcaggccgccctgctgctc

SEQ ID NO: 7064234 - DNA, 22 bp, Homo sapiens
gcctcagggataggatgagcat

SEQ ID NO: 7064235 - DNA, 22 bp, Homo sapiens
gcctggctagttagtgtcaggt

SEQ ID NO: 7064236 - DNA, 22 bp, Homo sapiens
gcctggctgctagccagaggca

SEQ ID NO: 7064237 - DNA, 22 bp, Homo sapiens
gcctggctggtcactgcctggc

SEQ ID NO: 7064238 - DNA, 22 bp, Homo sapiens
gcctggcttcccttggagcatt

SEQ ID NO: 7064239 - DNA, 22 bp, Homo sapiens
gcctggcttcccttggagcatt

SEQ ID NO: 7064240 - DNA, 22 bp, Homo sapiens
gcctggcttgccagccctggcg

SEQ ID NO: 7064241 - DNA, 22 bp, Homo sapiens
gcctggcttgccagccctggcg

SEQ ID NO: 7064242 - DNA, 22 bp, Homo sapiens
gcctggcttgccagccctggcg

SEQ ID NO: 7064243 - DNA, 22 bp, Homo sapiens
gcctggggaacttgatcctgtc

SEQ ID NO: 7064244 - DNA, 22 bp, Homo sapiens
gctcactgcaacctccacctcc

SEQ ID NO: 7064245 - DNA, 22 bp, Homo sapiens
gctcactgcaacctccgccttc

SEQ ID NO: 7064246 - DNA, 22 bp, Homo sapiens
gctcaccttcgtccagcagccg

SEQ ID NO: 7064247 - DNA, 22 bp, Homo sapiens
gctcacagccggctggcagggg

SEQ ID NO: 7064248 - DNA, 22 bp, Homo sapiens
gctcaagagagatgcagttctt

SEQ ID NO: 7064249 - DNA, 22 bp, Homo sapiens
gctcaagccttctgcccacctc

SEQ ID NO: 7064250 - DNA, 22 bp, Homo sapiens
gccttttttgttgctctgtcac

SEQ ID NO: 7064251 - DNA, 22 bp, Homo sapiens
gccttttttgttgctctgtcac

SEQ ID NO: 7064252 - DNA, 22 bp, Homo sapiens
gcgacgctcgggctccgatgcc

SEQ ID NO: 7064253 - DNA, 22 bp, Homo sapiens
gccttgccaaggggcagcagag

SEQ ID NO: 7064254 - DNA, 22 bp, Homo sapiens
gcgagaaactaagtgccctttg

SEQ ID NO: 7064255 - DNA, 22 bp, Homo sapiens
gcgcgcctctgcccggtgttcc

SEQ ID NO: 7064256 - DNA, 22 bp, Homo sapiens
gcgcgctaccgccagggctgca

SEQ ID NO: 7064257 - DNA, 17 bp, Homo sapiens
gccttctctgccctcac

SEQ ID NO: 7064258 - DNA, 22 bp, Homo sapiens
gccttctctgtgagctcctagg

SEQ ID NO: 7064259 - DNA, 22 bp, Homo sapiens
gccttctctgtgagctcctagg

SEQ ID NO: 7064260 - DNA, 22 bp, Homo sapiens
gccttctgatatctcttggcat

SEQ ID NO: 7064261 - DNA, 22 bp, Homo sapiens
gccttctgtgctcctggccttt

SEQ ID NO: 7064262 - DNA, 22 bp, Homo sapiens
gcggggcacagtgatggagcac

SEQ ID NO: 7064263 - DNA, 22 bp, Homo sapiens
gcgctcaggtgccaggcctgcg

SEQ ID NO: 7064264 - DNA, 22 bp, Homo sapiens
gcgctgcgcctcctcttccgca

SEQ ID NO: 7064265 - DNA, 22 bp, Homo sapiens
gcggagggagataggccttgct

SEQ ID NO: 7064266 - DNA, 22 bp, Homo sapiens
gctgccagctcactctcctgag

SEQ ID NO: 7064267 - DNA, 22 bp, Homo sapiens
gctgccagctttccttggctga

SEQ ID NO: 7064268 - DNA, 22 bp, Homo sapiens
gctgccagccaacttgctgtgc

SEQ ID NO: 7064269 - DNA, 22 bp, Homo sapiens
gctgccacttggtcatgtcatg

SEQ ID NO: 7064270 - DNA, 22 bp, Homo sapiens
gctgcagactgggaggcaggtg

SEQ ID NO: 7064271 - DNA, 23 bp, Homo sapiens
gctgcagctgtggatgttctcag

SEQ ID NO: 7064272 - DNA, 22 bp, Homo sapiens
gctgcaggagctggagctgtgg

SEQ ID NO: 7064273 - DNA, 22 bp, Homo sapiens
gctgatggcttgctggctgaca

SEQ ID NO: 7064274 - DNA, 22 bp, Homo sapiens
gctgatgtaagacttttggttt

SEQ ID NO: 7064275 - DNA, 22 bp, Homo sapiens
gctgatgtttagttgatgttac

SEQ ID NO: 7064276 - DNA, 22 bp, Homo sapiens
gctgaagggagtgctgagtctg

SEQ ID NO: 7064277 - DNA, 22 bp, Homo sapiens
gctgaaggtctctggagaggtc

SEQ ID NO: 7064278 - DNA, 22 bp, Homo sapiens
gctgaagctgacacatagtgct

SEQ ID NO: 7064279 - DNA, 20 bp, Homo sapiens
gctgaagattcccatgcaag

SEQ ID NO: 7064280 - DNA, 22 bp, Homo sapiens
gctgaagctgcagcaggaggaa

SEQ ID NO: 7064281 - DNA, 22 bp, Homo sapiens
gctgaaggcccggaggacaggg

SEQ ID NO: 7064282 - DNA, 22 bp, Homo sapiens
gctcagggaaagagctcctgtc

SEQ ID NO: 7064283 - DNA, 22 bp, Homo sapiens
gctcagggaactttttgcaggc

SEQ ID NO: 7064284 - DNA, 22 bp, Homo sapiens
gctcagggaactttttgcaggc

SEQ ID NO: 7064285 - DNA, 22 bp, Homo sapiens
gctcagggaaagagctcctgtc

SEQ ID NO: 7064286 - DNA, 18 bp, Homo sapiens
gctcaggccctagtcagt

SEQ ID NO: 7064287 - DNA, 21 bp, Homo sapiens
gctcctggtgctgcgtggcgc

SEQ ID NO: 7064288 - DNA, 22 bp, Homo sapiens
gctccttcaggtggtagctgtt

SEQ ID NO: 7064289 - DNA, 22 bp, Homo sapiens
gctctatgttgaccttcagtgg

SEQ ID NO: 7064290 - DNA, 22 bp, Homo sapiens
gctctattactttcaataaaaa

SEQ ID NO: 7064291 - DNA, 22 bp, Homo sapiens
gctgaagagcaaggctgggtct

SEQ ID NO: 7064292 - DNA, 22 bp, Homo sapiens
gctctggctactgtggctaccg

SEQ ID NO: 7064293 - DNA, 22 bp, Homo sapiens
gctctggctactgtggctaccg

SEQ ID NO: 7064294 - DNA, 22 bp, Homo sapiens
gctctggccagaccctcagtgg

SEQ ID NO: 7064295 - DNA, 22 bp, Homo sapiens
gctctggcccaaaccctttcta

SEQ ID NO: 7064296 - DNA, 21 bp, Homo sapiens
gctctggcctactgttccctc

SEQ ID NO: 7064297 - DNA, 22 bp, Homo sapiens
gctctggctactccaccctgtt

SEQ ID NO: 7064298 - DNA, 22 bp, Homo sapiens
gctctggcagctgatattagga

SEQ ID NO: 7064299 - DNA, 22 bp, Homo sapiens
gctctccaaaccctgtggcttt

SEQ ID NO: 7064300 - DNA, 22 bp, Homo sapiens
gctctgcctcccctagtgttac

SEQ ID NO: 7064301 - DNA, 19 bp, Homo sapiens
ggagaggctggagggatgc

SEQ ID NO: 7064302 - DNA, 22 bp, Homo sapiens
ggagaggaaatgccagcacttc

SEQ ID NO: 7064303 - DNA, 22 bp, Homo sapiens
ggagaggaaatgccagcacttc

SEQ ID NO: 7064304 - DNA, 22 bp, Homo sapiens
ggagaggacatggctcccacag

SEQ ID NO: 7064305 - DNA, 22 bp, Homo sapiens
ggagaggagattgtggcatttt

SEQ ID NO: 7064306 - DNA, 22 bp, Homo sapiens
ggagaggagctattgggggctc

SEQ ID NO: 7064307 - DNA, 20 bp, Homo sapiens
ggactacaatttgcagtgtg

SEQ ID NO: 7064308 - DNA, 22 bp, Homo sapiens
ggactgaggacatgtgaggcat

SEQ ID NO: 7064309 - DNA, 22 bp, Homo sapiens
ggactgaggacatgtgaggcat

SEQ ID NO: 7064310 - DNA, 22 bp, Homo sapiens
ggactgaggcccacttgaggga

SEQ ID NO: 7064311 - DNA, 22 bp, Homo sapiens
ggagagaggagcccactgctgt

SEQ ID NO: 7064312 - DNA, 22 bp, Homo sapiens
ggagagctggtagctggctcca

SEQ ID NO: 7064313 - DNA, 22 bp, Homo sapiens
ggacagagggcaggagcccaga

SEQ ID NO: 7064314 - DNA, 23 bp, Homo sapiens
ggaccctgtggagggtgagagtc

SEQ ID NO: 7064315 - DNA, 22 bp, Homo sapiens
ggacctgaacataaaacgaggc

SEQ ID NO: 7064316 - DNA, 22 bp, Homo sapiens
ggacagagccctggtggcctaa

SEQ ID NO: 7064317 - DNA, 22 bp, Homo sapiens
ggacagagcagacgagcagcgg

SEQ ID NO: 7064318 - DNA, 22 bp, Homo sapiens
ggacagagcagacgagcagcgg

SEQ ID NO: 7064319 - DNA, 21 bp, Homo sapiens
ggacactgataatcttgttgc

SEQ ID NO: 7064320 - DNA, 22 bp, Homo sapiens
ggacactgttcatggggagggg

SEQ ID NO: 7064321 - DNA, 20 bp, Homo sapiens
ggaacatgaatgtgagtggc

SEQ ID NO: 7064322 - DNA, 22 bp, Homo sapiens
ggaacatgtagagggcctgtag

SEQ ID NO: 7064323 - DNA, 22 bp, Homo sapiens
ggaacatttcctggcagagagg

SEQ ID NO: 7064324 - DNA, 22 bp, Homo sapiens
ggaacattttttaaggcagaaa

SEQ ID NO: 7064325 - DNA, 22 bp, Homo sapiens
ggaacctgtacgttgtccttga

SEQ ID NO: 7064326 - DNA, 22 bp, Homo sapiens
ggaagccacccagctttgatag

SEQ ID NO: 7064327 - DNA, 22 bp, Homo sapiens
ggaagccagaaagtgagaatat

SEQ ID NO: 7064328 - DNA, 22 bp, Homo sapiens
ggaagccagagtgctgggcagg

SEQ ID NO: 7064329 - DNA, 20 bp, Homo sapiens
ggaagccagcatccttgagg

SEQ ID NO: 7064330 - DNA, 22 bp, Homo sapiens
ggaagccaggccaatgagaaca

SEQ ID NO: 7064331 - DNA, 22 bp, Homo sapiens
ggaagccaggctgggggatctg

SEQ ID NO: 7064332 - DNA, 20 bp, Homo sapiens
ggaagccagggtgcagggga

SEQ ID NO: 7064333 - DNA, 22 bp, Homo sapiens
ggaagccagttgcttggtgtgg

SEQ ID NO: 7064334 - DNA, 22 bp, Homo sapiens
ggaagccatgagggacagttct

SEQ ID NO: 7064335 - DNA, 21 bp, Homo sapiens
ggaagctgtgtccatgctcct

SEQ ID NO: 7064336 - DNA, 22 bp, Homo sapiens
ggaagctgttcctgtgtggcca

SEQ ID NO: 7064337 - DNA, 22 bp, Homo sapiens
ggaagctgttgtgagtgcagca

SEQ ID NO: 7064338 - DNA, 22 bp, Homo sapiens
ggaaggaaattggggcagttgt

SEQ ID NO: 7064339 - DNA, 22 bp, Homo sapiens
ggacacagtggaagacagcttg

SEQ ID NO: 7064340 - DNA, 21 bp, Homo sapiens
ggacaccagtcacactggatt

SEQ ID NO: 7064341 - DNA, 21 bp, Homo sapiens
ggacaccagtcacactggatt

SEQ ID NO: 7064342 - DNA, 22 bp, Homo sapiens
gcttcccctccaagcactgcct

SEQ ID NO: 7064343 - DNA, 22 bp, Homo sapiens
gcttcctacatgtgtctgcgag

SEQ ID NO: 7064344 - DNA, 22 bp, Homo sapiens
gcttcctagatctgtggtactc

SEQ ID NO: 7064345 - DNA, 17 bp, Homo sapiens
gcttcctcatgcagttc

SEQ ID NO: 7064346 - DNA, 22 bp, Homo sapiens
gcttcctccctgctgctcacta

SEQ ID NO: 7064347 - DNA, 22 bp, Homo sapiens
gcttcctccctgctgctcacta

SEQ ID NO: 7064348 - DNA, 18 bp, Homo sapiens
gcttcctgaaagctgccc

SEQ ID NO: 7064349 - DNA, 22 bp, Homo sapiens
gcttcctgagaaacaatctgat

SEQ ID NO: 7064350 - DNA, 22 bp, Homo sapiens
gcttcctgagaaacaatctgat

SEQ ID NO: 7064351 - DNA, 22 bp, Homo sapiens
gcttcctgagacaacattgagt

SEQ ID NO: 7064352 - DNA, 22 bp, Homo sapiens
gcttcctgagtacaccctcatc

SEQ ID NO: 7064353 - DNA, 22 bp, Homo sapiens
gcttcctgagtacaccctcatc

SEQ ID NO: 7064354 - DNA, 22 bp, Homo sapiens
gcttcctgatattcatactgtt

SEQ ID NO: 7064355 - DNA, 22 bp, Homo sapiens
gcttcctggaacaactgttgct

SEQ ID NO: 7064356 - DNA, 22 bp, Homo sapiens
ggaaagggcagaggccttggag

SEQ ID NO: 7064357 - DNA, 22 bp, Homo sapiens
ggaaagggagttttgcttatga

SEQ ID NO: 7064358 - DNA, 22 bp, Homo sapiens
ggaaaggagatgaataggatta

SEQ ID NO: 7064359 - DNA, 22 bp, Homo sapiens
ggaaagggcatggccttttcac

SEQ ID NO: 7064360 - DNA, 22 bp, Homo sapiens
ggaaaggggcctggatcttttg

SEQ ID NO: 7064361 - DNA, 17 bp, Homo sapiens
ggaaaggtagagtaatc

SEQ ID NO: 7064362 - DNA, 22 bp, Homo sapiens
gctgtgagggcttctgaggcat

SEQ ID NO: 7064363 - DNA, 22 bp, Homo sapiens
gctgtgagggcttctgaggcat

SEQ ID NO: 7064364 - DNA, 22 bp, Homo sapiens
gctgtgagggtctagtgaggtg

SEQ ID NO: 7064365 - DNA, 22 bp, Homo sapiens
gctgtcttgggtagaaagaggt

SEQ ID NO: 7064366 - DNA, 22 bp, Homo sapiens
gctgtgagaaacagggagtgtc

SEQ ID NO: 7064367 - DNA, 22 bp, Homo sapiens
gctgtgagcactgctgggtgga

SEQ ID NO: 7064368 - DNA, 22 bp, Homo sapiens
gctgtgagccgctgctgagcat

SEQ ID NO: 7064369 - DNA, 22 bp, Homo sapiens
gctgtgagctgcctgtgtcaca

SEQ ID NO: 7064370 - DNA, 22 bp, Homo sapiens
gcttccatctatgtcttcatca

SEQ ID NO: 7064371 - DNA, 22 bp, Homo sapiens
gcttccatgttgctgctggtca

SEQ ID NO: 7064372 - DNA, 23 bp, Homo sapiens
gcttccattctagtttgctgtgc

SEQ ID NO: 7064373 - DNA, 22 bp, Homo sapiens
gctggggtctgtgaggagggct

SEQ ID NO: 7064374 - DNA, 22 bp, Homo sapiens
gctggggtgtggtggataagct

SEQ ID NO: 7064375 - DNA, 22 bp, Homo sapiens
gctgggagtgggcaagatgaga

SEQ ID NO: 7064376 - DNA, 16 bp, Homo sapiens
gctgggagggagaggt

SEQ ID NO: 7064377 - DNA, 16 bp, Homo sapiens
gctgggagggagaggt

SEQ ID NO: 7064378 - DNA, 22 bp, Homo sapiens
gctgggagtcgcgtctgtggcc

SEQ ID NO: 7064379 - DNA, 22 bp, Homo sapiens
gctggtcagagagaaaggaggc

SEQ ID NO: 7064380 - DNA, 22 bp, Homo sapiens
gctgtctgttcgagcgtgtgtt

SEQ ID NO: 7064381 - DNA, 22 bp, Homo sapiens
gctgtcttcacttcctggtttc

SEQ ID NO: 7064382 - DNA, 22 bp, Homo sapiens
gctgggtgtcacggggctcgtg

SEQ ID NO: 7064383 - DNA, 22 bp, Homo sapiens
gctgggtgtcacggggctcgtg

SEQ ID NO: 7064384 - DNA, 22 bp, Homo sapiens
gctgggttttcttccgggccta

SEQ ID NO: 7064385 - DNA, 22 bp, Homo sapiens
gctgggtggatcggaggctctg

SEQ ID NO: 7064386 - DNA, 22 bp, Homo sapiens
gctggcagagacaagaagacta

SEQ ID NO: 7064387 - DNA, 22 bp, Homo sapiens
gctggcaggagcctttcccttt

SEQ ID NO: 7064388 - DNA, 22 bp, Homo sapiens
gctggcagggacagctgcgtgt

SEQ ID NO: 7064389 - DNA, 22 bp, Homo sapiens
gctggctcaagtgtgcttccca

SEQ ID NO: 7064390 - DNA, 22 bp, Homo sapiens
gctggctcaagtgtgcttccca

SEQ ID NO: 7064391 - DNA, 22 bp, Homo sapiens
gctggctcagggactagagttt

SEQ ID NO: 7064392 - DNA, 22 bp, Homo sapiens
gctggctccaaaagcaggggct

SEQ ID NO: 7064393 - DNA, 22 bp, Homo sapiens
gctggcagactgggggcagaac

SEQ ID NO: 7064394 - DNA, 22 bp, Homo sapiens
gctggcagacttcctctggaac

SEQ ID NO: 7064395 - DNA, 22 bp, Homo sapiens
gctgggaggatctctccctgtc

SEQ ID NO: 7064396 - DNA, 22 bp, Homo sapiens
gctgggaggatctctccctgtc

SEQ ID NO: 7064397 - DNA, 22 bp, Homo sapiens
gctgggagaggccctgaagtga

SEQ ID NO: 7064398 - DNA, 22 bp, Homo sapiens
gctgggagaggccctgaagtga

SEQ ID NO: 7064399 - DNA, 22 bp, Homo sapiens
gctgggagcaaagccatgcata

SEQ ID NO: 7064400 - DNA, 22 bp, Homo sapiens
gctgggagacagacttggaacc

SEQ ID NO: 7064401 - DNA, 22 bp, Homo sapiens
gctgggagaggcagctttcgga

SEQ ID NO: 7064402 - DNA, 22 bp, Homo sapiens
gctgggagaggccctgaagtga

SEQ ID NO: 7064403 - DNA, 22 bp, Homo sapiens
gctgggaaccatgggaaggcag

SEQ ID NO: 7064404 - DNA, 22 bp, Homo sapiens
gctgggaaccatgggaaggcag

SEQ ID NO: 7064405 - DNA, 22 bp, Homo sapiens
gctgggaagtggcagagctgga

SEQ ID NO: 7064406 - DNA, 22 bp, Homo sapiens
gctggctgcacaggggctcact

SEQ ID NO: 7064407 - DNA, 22 bp, Homo sapiens
gctggctcgggaagcaggggat

SEQ ID NO: 7064408 - DNA, 21 bp, Homo sapiens
gctggctctctgacgtgcttt

SEQ ID NO: 7064409 - DNA, 21 bp, Homo sapiens
gctggctctctgacgtgcttt

SEQ ID NO: 7064410 - DNA, 22 bp, Homo sapiens
gctggctctgcacccaggcctc

SEQ ID NO: 7064411 - DNA, 22 bp, Homo sapiens
gccagcagggcggagccatcta

SEQ ID NO: 7064412 - DNA, 22 bp, Homo sapiens
gccagcaggttgtcaaggagct

SEQ ID NO: 7064413 - DNA, 22 bp, Homo sapiens
gccagaggcccaaggacagctg

SEQ ID NO: 7064414 - DNA, 23 bp, Homo sapiens
gccagaggaacgcagagctttct

SEQ ID NO: 7064415 - DNA, 22 bp, Homo sapiens
gccagcagtccagtccttagtg

SEQ ID NO: 7064416 - DNA, 22 bp, Homo sapiens
gccagcagtcctgctgtgtgcc

SEQ ID NO: 7064417 - DNA, 22 bp, Homo sapiens
gccagcccattaacccctgtcc

SEQ ID NO: 7064418 - DNA, 22 bp, Homo sapiens
gccagccccagacatcctatcg

SEQ ID NO: 7064419 - DNA, 22 bp, Homo sapiens
gccagcccctccatcctgttca

SEQ ID NO: 7064420 - DNA, 22 bp, Homo sapiens
gccagccccttagggctctccc

SEQ ID NO: 7064421 - DNA, 22 bp, Homo sapiens
gccagagcacaggctggtagta

SEQ ID NO: 7064422 - DNA, 22 bp, Homo sapiens
gccagagcagaatagagtggcc

SEQ ID NO: 7064423 - DNA, 21 bp, Homo sapiens
gccagagcagtacaatgaggt

SEQ ID NO: 7064424 - DNA, 18 bp, Homo sapiens
gccagagcatatctccag

SEQ ID NO: 7064425 - DNA, 22 bp, Homo sapiens
gccagagccggcttcacaggat

SEQ ID NO: 7064426 - DNA, 22 bp, Homo sapiens
gcattttagaatattggagcaa

SEQ ID NO: 7064427 - DNA, 22 bp, Homo sapiens
gccaaggcctctgcaggatgag

SEQ ID NO: 7064428 - DNA, 22 bp, Homo sapiens
gccaaggcctgcagcacctcat

SEQ ID NO: 7064429 - DNA, 22 bp, Homo sapiens
gccaaggctgaggccctgggct

SEQ ID NO: 7064430 - DNA, 19 bp, Homo sapiens
gcatttctctttacagcca

SEQ ID NO: 7064431 - DNA, 22 bp, Homo sapiens
gcatttcctgtgcttggcatat

SEQ ID NO: 7064432 - DNA, 22 bp, Homo sapiens
gcatcttcacacaaagccagtg

SEQ ID NO: 7064433 - DNA, 22 bp, Homo sapiens
gcatgaggggggttaggaagtt

SEQ ID NO: 7064434 - DNA, 22 bp, Homo sapiens
gcagtgaagccagatctgaaat

SEQ ID NO: 7064435 - DNA, 22 bp, Homo sapiens
gcatccagaggtagccactgtg

SEQ ID NO: 7064436 - DNA, 22 bp, Homo sapiens
gcatccctctgaggggccaggc

SEQ ID NO: 7064437 - DNA, 22 bp, Homo sapiens
gcagggctctgctgtagtccta

SEQ ID NO: 7064438 - DNA, 22 bp, Homo sapiens
gcagtcagacaggaggagctcc

SEQ ID NO: 7064439 - DNA, 22 bp, Homo sapiens
gcagtcagacaggaggagctcc

SEQ ID NO: 7064440 - DNA, 22 bp, Homo sapiens
gcagtcagacaggaggagctcc

SEQ ID NO: 7064441 - DNA, 22 bp, Homo sapiens
gcagtcagtaaggcagccagaa

SEQ ID NO: 7064442 - DNA, 22 bp, Homo sapiens
gcagtcagtaaggcagccagaa

SEQ ID NO: 7064443 - DNA, 22 bp, Homo sapiens
gcagggctccactgtggccaag

SEQ ID NO: 7064444 - DNA, 22 bp, Homo sapiens
gcagggctcagccgctcccacc

SEQ ID NO: 7064445 - DNA, 22 bp, Homo sapiens
gcagggctcattgccaggcatt

SEQ ID NO: 7064446 - DNA, 22 bp, Homo sapiens
gcagtcctctcattggcctcct

SEQ ID NO: 7064447 - DNA, 22 bp, Homo sapiens
gcagtgaaaaagtgcaccctgt

SEQ ID NO: 7064448 - DNA, 22 bp, Homo sapiens
gcagtgaacataacacagaagg

SEQ ID NO: 7064449 - DNA, 18 bp, Homo sapiens
gcagtgaagaaagagctt

SEQ ID NO: 7064450 - DNA, 22 bp, Homo sapiens
gccagtggcatgcggcagggac

SEQ ID NO: 7064451 - DNA, 22 bp, Homo sapiens
gccagtggcatgcggcagggac

SEQ ID NO: 7064452 - DNA, 22 bp, Homo sapiens
gccagtggccctctggagaagg

SEQ ID NO: 7064453 - DNA, 22 bp, Homo sapiens
gccagtggcttgccaggcagga

SEQ ID NO: 7064454 - DNA, 22 bp, Homo sapiens
gcccactctggagcctgttccc

SEQ ID NO: 7064455 - DNA, 22 bp, Homo sapiens
gccagtggagcacatggtgaag

SEQ ID NO: 7064456 - DNA, 22 bp, Homo sapiens
gccagtctgctcccacaagttc

SEQ ID NO: 7064457 - DNA, 22 bp, Homo sapiens
gccaggttgctgacgacgatct

SEQ ID NO: 7064458 - DNA, 22 bp, Homo sapiens
gcccactgagtgactccctcag

SEQ ID NO: 7064459 - DNA, 22 bp, Homo sapiens
gcccactggctggagtgctggt

SEQ ID NO: 7064460 - DNA, 22 bp, Homo sapiens
gcccagagtgagtcctgggccc

SEQ ID NO: 7064461 - DNA, 22 bp, Homo sapiens
gccaggatgactatacaacagc

SEQ ID NO: 7064462 - DNA, 22 bp, Homo sapiens
gccaggcaaattaaggaatgca

SEQ ID NO: 7064463 - DNA, 22 bp, Homo sapiens
gccaggagttcagatgcatgtt

SEQ ID NO: 7064464 - DNA, 22 bp, Homo sapiens
gccaggagttcagatgcatgtt

SEQ ID NO: 7064465 - DNA, 22 bp, Homo sapiens
gccaggtgggagacagacagca

SEQ ID NO: 7064466 - DNA, 22 bp, Homo sapiens
gccaggtgtagtggccacacct

SEQ ID NO: 7064467 - DNA, 22 bp, Homo sapiens
gccaggtgtcctcacagtgagg

SEQ ID NO: 7064468 - DNA, 22 bp, Homo sapiens
gccaggagccctgggcaagttc

SEQ ID NO: 7064469 - DNA, 22 bp, Homo sapiens
gccaggagagctccttcaggtt

SEQ ID NO: 7064470 - DNA, 22 bp, Homo sapiens
gccaggagaatgctagcagagg

SEQ ID NO: 7064471 - DNA, 22 bp, Homo sapiens
gccaggagaaaaggcgaatgat

SEQ ID NO: 7064472 - DNA, 22 bp, Homo sapiens
gccctgaggggtggtgtctgta

SEQ ID NO: 7064473 - DNA, 22 bp, Homo sapiens
gcctcagctcccagcccaggct

SEQ ID NO: 7064474 - DNA, 22 bp, Homo sapiens
gcctcagctgttgcaggggccc

SEQ ID NO: 7064475 - DNA, 22 bp, Homo sapiens
gccctgagaatgtgtgtgtcta

SEQ ID NO: 7064476 - DNA, 22 bp, Homo sapiens
gccctgagaagaagtcggaggg

SEQ ID NO: 7064477 - DNA, 22 bp, Homo sapiens
gccctgagactgaagaactgtc

SEQ ID NO: 7064478 - DNA, 22 bp, Homo sapiens
gccctgagactgagcatgggtt

SEQ ID NO: 7064479 - DNA, 22 bp, Homo sapiens
gccctctgttattgcatcctta

SEQ ID NO: 7064480 - DNA, 22 bp, Homo sapiens
gccctctgttattgcatcctta

SEQ ID NO: 7064481 - DNA, 19 bp, Homo sapiens
gccctgagagcttgggttc

SEQ ID NO: 7064482 - DNA, 22 bp, Homo sapiens
gccctgagaggcaatgactctt

SEQ ID NO: 7064483 - DNA, 22 bp, Homo sapiens
gccctgagattcttggattctg

SEQ ID NO: 7064484 - DNA, 22 bp, Homo sapiens
gccctgagcacacagtagcaaa

SEQ ID NO: 7064485 - DNA, 22 bp, Homo sapiens
gccctgagcactgctgctgggg

SEQ ID NO: 7064486 - DNA, 22 bp, Homo sapiens
gccctgagccaccaatgccatt

SEQ ID NO: 7064487 - DNA, 22 bp, Homo sapiens
gccctgagcctatgagcctctc

SEQ ID NO: 7064488 - DNA, 22 bp, Homo sapiens
gccctgagctagtgtgggcagg

SEQ ID NO: 7064489 - DNA, 22 bp, Homo sapiens
gccctgaggcaaaagaacagtc

SEQ ID NO: 7064490 - DNA, 22 bp, Homo sapiens
gcccatcttctagcagctgtta

SEQ ID NO: 7064491 - DNA, 22 bp, Homo sapiens
gcccagtggtaaaagcaggcct

SEQ ID NO: 7064492 - DNA, 22 bp, Homo sapiens
gcccagggcttcaaagagagaa

SEQ ID NO: 7064493 - DNA, 22 bp, Homo sapiens
gcccagggcttcaaagagagaa

SEQ ID NO: 7064494 - DNA, 22 bp, Homo sapiens
gcccaggggagtagtcaattta

SEQ ID NO: 7064495 - DNA, 22 bp, Homo sapiens
gcccaggggagtagtcaattta

SEQ ID NO: 7064496 - DNA, 22 bp, Homo sapiens
gcccaggggcagcgcatagtgg

SEQ ID NO: 7064497 - DNA, 22 bp, Homo sapiens
gcccaggggcagcgcatagtgg

SEQ ID NO: 7064498 - DNA, 22 bp, Homo sapiens
gcccaggggcagcgcatagtgg

SEQ ID NO: 7064499 - DNA, 22 bp, Homo sapiens
gcccaggggcagcgcatagtgg

SEQ ID NO: 7064500 - DNA, 22 bp, Homo sapiens
gccctctggcacagagatgcag

SEQ ID NO: 7064501 - DNA, 22 bp, Homo sapiens
gccctctggcagccttggctgg

SEQ ID NO: 7064502 - DNA, 22 bp, Homo sapiens
gccctctggtgggtgagccccg

SEQ ID NO: 7064503 - DNA, 22 bp, Homo sapiens
gccctctgtgtaacaatccaga

SEQ ID NO: 7064504 - DNA, 20 bp, Homo sapiens
gcccatgaggactgcagctg

SEQ ID NO: 7064505 - DNA, 22 bp, Homo sapiens
gcccagagttcaaggctgcagt

SEQ ID NO: 7064506 - DNA, 23 bp, Homo sapiens
gcccagggactgggaatcagtgg

SEQ ID NO: 7064507 - DNA, 23 bp, Homo sapiens
gcccagggactgggaatcagtgg

SEQ ID NO: 7064508 - DNA, 22 bp, Homo sapiens
gcccagggcagggcaagagtga

SEQ ID NO: 7064509 - DNA, 22 bp, Homo sapiens
gcccagggcagggcaagagtga

SEQ ID NO: 7064510 - DNA, 22 bp, Homo sapiens
gcccagggcagggcaagagtga

SEQ ID NO: 7064511 - DNA, 22 bp, Homo sapiens
gcccagggcagggcaagagtga

SEQ ID NO: 7064512 - DNA, 22 bp, Homo sapiens
gcccagggcagggcaagagtga

SEQ ID NO: 7064513 - DNA, 22 bp, Homo sapiens
gcccagggcgatggtcggggcc

SEQ ID NO: 7064514 - DNA, 22 bp, Homo sapiens
gcccagggctgcaagtggacgc

SEQ ID NO: 7064515 - DNA, 22 bp, Homo sapiens
gcccagggctgcaagtggacgc

SEQ ID NO: 7064516 - DNA, 22 bp, Homo sapiens
gcagcagtgtctcccatcttgc

SEQ ID NO: 7064517 - DNA, 22 bp, Homo sapiens
gcagcattgcacttttgttctt

SEQ ID NO: 7064518 - DNA, 22 bp, Homo sapiens
gcagccacagaggagggatgca

SEQ ID NO: 7064519 - DNA, 22 bp, Homo sapiens
gcagctgcaagcacttctggca

SEQ ID NO: 7064520 - DNA, 22 bp, Homo sapiens
gcagctgcaataggcatcaagc

SEQ ID NO: 7064521 - DNA, 22 bp, Homo sapiens
gcagctgcagaccctcagtgct

SEQ ID NO: 7064522 - DNA, 22 bp, Homo sapiens
gcagctgcaggtggtcccatgc

SEQ ID NO: 7064523 - DNA, 22 bp, Homo sapiens
gcagctgccagtccccttccag

SEQ ID NO: 7064524 - DNA, 22 bp, Homo sapiens
gcagcaggcacttaccgttgct

SEQ ID NO: 7064525 - DNA, 22 bp, Homo sapiens
gcagcaggcacggtctcgacat

SEQ ID NO: 7064526 - DNA, 22 bp, Homo sapiens
gcagcaggatggccaattgcca

SEQ ID NO: 7064527 - DNA, 22 bp, Homo sapiens
gcagcaggagagtttgtcctgc

SEQ ID NO: 7064528 - DNA, 22 bp, Homo sapiens
gcagaggagcaagttgctacag

SEQ ID NO: 7064529 - DNA, 23 bp, Homo sapiens
gcagaggagcaagctggacacca

SEQ ID NO: 7064530 - DNA, 22 bp, Homo sapiens
gcagaggagcaagttgctacag

SEQ ID NO: 7064531 - DNA, 22 bp, Homo sapiens
gcagaggagcaagttgctacag

SEQ ID NO: 7064532 - DNA, 22 bp, Homo sapiens
gcagaggaggacccaggaatta

SEQ ID NO: 7064533 - DNA, 22 bp, Homo sapiens
gcagaggaggacccaggaatta

SEQ ID NO: 7064534 - DNA, 22 bp, Homo sapiens
gcagaggaggacccaggaatta

SEQ ID NO: 7064535 - DNA, 22 bp, Homo sapiens
gcagaggaggacccaggaatta

SEQ ID NO: 7064536 - DNA, 22 bp, Homo sapiens
gcagcagctccctatccaggct

SEQ ID NO: 7064537 - DNA, 22 bp, Homo sapiens
gcaggagtggagaccatgggga

SEQ ID NO: 7064538 - DNA, 22 bp, Homo sapiens
gcaggagtgtggtgggacatcc

SEQ ID NO: 7064539 - DNA, 22 bp, Homo sapiens
gcaggagttaggcgtcgtggat

SEQ ID NO: 7064540 - DNA, 22 bp, Homo sapiens
gcaggaggttgagccaggactg

SEQ ID NO: 7064541 - DNA, 22 bp, Homo sapiens
gcaggagtatgcagctatggtt

SEQ ID NO: 7064542 - DNA, 22 bp, Homo sapiens
gcaggagtgacatggatgtgga

SEQ ID NO: 7064543 - DNA, 22 bp, Homo sapiens
gcaggaggatcacttgagccca

SEQ ID NO: 7064544 - DNA, 22 bp, Homo sapiens
gcagctgcctattcagggcttg

SEQ ID NO: 7064545 - DNA, 22 bp, Homo sapiens
gcagctggacccacacggctta

SEQ ID NO: 7064546 - DNA, 22 bp, Homo sapiens
gcagctggagccagccagacac

SEQ ID NO: 7064547 - DNA, 22 bp, Homo sapiens
gcagggctaatggggcaagtag

SEQ ID NO: 7064548 - DNA, 22 bp, Homo sapiens
gcagggctaatggggcaagtag

SEQ ID NO: 7064549 - DNA, 22 bp, Homo sapiens
gcagggctaggtcttctagggc

SEQ ID NO: 7064550 - DNA, 22 bp, Homo sapiens
gcagggctagatatttgcaagt

SEQ ID NO: 7064551 - DNA, 22 bp, Homo sapiens
gcagggctattggaaggagatg

SEQ ID NO: 7064552 - DNA, 22 bp, Homo sapiens
gcagggctattggaaggagatg

SEQ ID NO: 7064553 - DNA, 22 bp, Homo sapiens
gcagggctcaacaggacacccc

SEQ ID NO: 7064554 - DNA, 22 bp, Homo sapiens
gcaggctgatagaggattccat

SEQ ID NO: 7064555 - DNA, 22 bp, Homo sapiens
gcaggctgatgactggagttgg

SEQ ID NO: 7064556 - DNA, 22 bp, Homo sapiens
gcaggctgatgactggagttgg

SEQ ID NO: 7064557 - DNA, 22 bp, Homo sapiens
gcaggctgaaactcggggtcta

SEQ ID NO: 7064558 - DNA, 22 bp, Homo sapiens
gcaggctgaaactcggggtcta

SEQ ID NO: 7064559 - DNA, 22 bp, Homo sapiens
gcaggctgagagtccaagaagg

SEQ ID NO: 7064560 - DNA, 22 bp, Homo sapiens
gcaggctgagtattaccctagt

SEQ ID NO: 7064561 - DNA, 22 bp, Homo sapiens
gcaggctgagttgggaaaccaa

SEQ ID NO: 7064562 - DNA, 17 bp, Homo sapiens
gcactcccccacctcct

SEQ ID NO: 7064563 - DNA, 22 bp, Homo sapiens
gcacaggcacagagggccactg

SEQ ID NO: 7064564 - DNA, 22 bp, Homo sapiens
gcacctgggacccagaggcacc

SEQ ID NO: 7064565 - DNA, 22 bp, Homo sapiens
gcacctgggacccagaggcacc

SEQ ID NO: 7064566 - DNA, 22 bp, Homo sapiens
gcacctgggcaaggattcagag

SEQ ID NO: 7064567 - DNA, 22 bp, Homo sapiens
gcacctggggtacacagctaca

SEQ ID NO: 7064568 - DNA, 22 bp, Homo sapiens
gcactgaaattatatgcatttg

SEQ ID NO: 7064569 - DNA, 20 bp, Homo sapiens
gcactgaaattcaatgtttg

SEQ ID NO: 7064570 - DNA, 19 bp, Homo sapiens
gcactgaagagttggtcac

SEQ ID NO: 7064571 - DNA, 22 bp, Homo sapiens
gcactgaatgcttttactgtaa

SEQ ID NO: 7064572 - DNA, 22 bp, Homo sapiens
gcactgccatcaatgcatgaca

SEQ ID NO: 7064573 - DNA, 22 bp, Homo sapiens
gcacttagggtatgtactgggc

SEQ ID NO: 7064574 - DNA, 22 bp, Homo sapiens
gcacttcacatgccttttcctg

SEQ ID NO: 7064575 - DNA, 22 bp, Homo sapiens
gcactgtgctagaagccagggg

SEQ ID NO: 7064576 - DNA, 23 bp, Homo sapiens
gcagaggagcaagctggacacca

SEQ ID NO: 7064577 - DNA, 22 bp, Homo sapiens
gcagaggagcaagctggacacc

SEQ ID NO: 7064578 - DNA, 22 bp, Homo sapiens
gcagaggacacaggagggcaag

SEQ ID NO: 7064579 - DNA, 22 bp, Homo sapiens
gcagaggacagggatttagatt

SEQ ID NO: 7064580 - DNA, 22 bp, Homo sapiens
gcagaggactcaatcaaggtat

SEQ ID NO: 7064581 - DNA, 22 bp, Homo sapiens
gcagaggagatgaagatacttt

SEQ ID NO: 7064582 - DNA, 21 bp, Homo sapiens
gcagaggaatggtatacataa

SEQ ID NO: 7064583 - DNA, 22 bp, Homo sapiens
gcagaggacacaggagggcaag

SEQ ID NO: 7064584 - DNA, 22 bp, Homo sapiens
gcagaggacacaggagggcaag

SEQ ID NO: 7064585 - DNA, 22 bp, Homo sapiens
gcagaggacacaggagggcaag

SEQ ID NO: 7064586 - DNA, 22 bp, Homo sapiens
gcagagctccccaagacaccaa

SEQ ID NO: 7064587 - DNA, 22 bp, Homo sapiens
gcagagctctgttcttatctcc

SEQ ID NO: 7064588 - DNA, 22 bp, Homo sapiens
gagggggaaagtccctggagtc

SEQ ID NO: 7064589 - DNA, 22 bp, Homo sapiens
gaggggctggggttgactccaa

SEQ ID NO: 7064590 - DNA, 22 bp, Homo sapiens
gagggggcgaacagaagcaagg

SEQ ID NO: 7064591 - DNA, 22 bp, Homo sapiens
gaggggtgggctggaagttata

SEQ ID NO: 7064592 - DNA, 22 bp, Homo sapiens
gcaaatgagttgtaacataaaa

SEQ ID NO: 7064593 - DNA, 22 bp, Homo sapiens
gcaagacaatggagcataaacg

SEQ ID NO: 7064594 - DNA, 22 bp, Homo sapiens
gcaagacatgtctaaggtttaa

SEQ ID NO: 7064595 - DNA, 22 bp, Homo sapiens
gcaagagttttttctctcttga

SEQ ID NO: 7064596 - DNA, 22 bp, Homo sapiens
gcaagatgttaacatagggaga

SEQ ID NO: 7064597 - DNA, 22 bp, Homo sapiens
gcaagcaaaatgggagattccc

SEQ ID NO: 7064598 - DNA, 22 bp, Homo sapiens
gcaagcaagcaggtagagctga

SEQ ID NO: 7064599 - DNA, 22 bp, Homo sapiens
gcaagcagacattcaggtaggt

SEQ ID NO: 7064600 - DNA, 22 bp, Homo sapiens
gcaagcagacattcaggtaggt

SEQ ID NO: 7064601 - DNA, 22 bp, Homo sapiens
gcaagcagttacccaggattcg

SEQ ID NO: 7064602 - DNA, 20 bp, Homo sapiens
gcaagcatgaagagtagaga

SEQ ID NO: 7064603 - DNA, 22 bp, Homo sapiens
gcaagcagttgtggcttctgag

SEQ ID NO: 7064604 - DNA, 22 bp, Homo sapiens
gcaagctgatgtgatagtgaaa

SEQ ID NO: 7064605 - DNA, 22 bp, Homo sapiens
gcaagctgctcttatgtggagg

SEQ ID NO: 7064606 - DNA, 22 bp, Homo sapiens
gcaaggaacaaatgctctgctt

SEQ ID NO: 7064607 - DNA, 22 bp, Homo sapiens
gcaaggaagagcaggtggtgct

SEQ ID NO: 7064608 - DNA, 22 bp, Homo sapiens
gcacagcagtggcataaacaat

SEQ ID NO: 7064609 - DNA, 22 bp, Homo sapiens
gcacagcagtggcataaacaat

SEQ ID NO: 7064610 - DNA, 21 bp, Homo sapiens
gcacagcatgagtgttggcat

SEQ ID NO: 7064611 - DNA, 19 bp, Homo sapiens
gcacaggacatctgatgga

SEQ ID NO: 7064612 - DNA, 22 bp, Homo sapiens
gcacaggcacagagggccactg

SEQ ID NO: 7064613 - DNA, 22 bp, Homo sapiens
gaatgaaagatttgcattctat

SEQ ID NO: 7064614 - DNA, 22 bp, Homo sapiens
gaatgaattcagcacatggaat

SEQ ID NO: 7064615 - DNA, 22 bp, Homo sapiens
gacagaagaggaacttggacag

SEQ ID NO: 7064616 - DNA, 22 bp, Homo sapiens
gaatatttgtaattactgttga

SEQ ID NO: 7064617 - DNA, 22 bp, Homo sapiens
gaaggtttgatccttatttata

SEQ ID NO: 7064618 - DNA, 22 bp, Homo sapiens
gaaggttttcaggagcctagtc

SEQ ID NO: 7064619 - DNA, 22 bp, Homo sapiens
gaatatttgtaattactgttga

SEQ ID NO: 7064620 - DNA, 22 bp, Homo sapiens
gaaggtttactgaagatttaaa

SEQ ID NO: 7064621 - DNA, 17 bp, Homo sapiens
gaaggtttctcttaggt

SEQ ID NO: 7064622 - DNA, 22 bp, Homo sapiens
gaaggtttgaaataggtataga

SEQ ID NO: 7064623 - DNA, 22 bp, Homo sapiens
gaatcccttgcaagttgttgta

SEQ ID NO: 7064624 - DNA, 22 bp, Homo sapiens
gaatctatgcctcatatagacc

SEQ ID NO: 7064625 - DNA, 22 bp, Homo sapiens
gaagggctttctgggagaagag

SEQ ID NO: 7064626 - DNA, 18 bp, Homo sapiens
gaagggagctggaatgca

SEQ ID NO: 7064627 - DNA, 22 bp, Homo sapiens
gaagggtgcatggagggaagtc

SEQ ID NO: 7064628 - DNA, 22 bp, Homo sapiens
gaagggtgcatggagggaagtc

SEQ ID NO: 7064629 - DNA, 22 bp, Homo sapiens
gaagggtgtgatttgcctgaga

SEQ ID NO: 7064630 - DNA, 22 bp, Homo sapiens
gaagggtgtgtgtgagggacac

SEQ ID NO: 7064631 - DNA, 22 bp, Homo sapiens
gaagggtgtgtgtgagggacac

SEQ ID NO: 7064632 - DNA, 22 bp, Homo sapiens
gaaggtggcgagcggattgctg

SEQ ID NO: 7064633 - DNA, 20 bp, Homo sapiens
gaagccagaggggaaaggag

SEQ ID NO: 7064634 - DNA, 22 bp, Homo sapiens
gaagccacaactttttcttagc

SEQ ID NO: 7064635 - DNA, 23 bp, Homo sapiens
gaagccacacaaaggtcgccaag

SEQ ID NO: 7064636 - DNA, 22 bp, Homo sapiens
gaagccacagagattgtggggg

SEQ ID NO: 7064637 - DNA, 22 bp, Homo sapiens
gaagccacagggaaggagaaca

SEQ ID NO: 7064638 - DNA, 22 bp, Homo sapiens
gaagccaccctccttccagccc

SEQ ID NO: 7064639 - DNA, 22 bp, Homo sapiens
gaagccactatagatattctaa

SEQ ID NO: 7064640 - DNA, 22 bp, Homo sapiens
gaaggcactgaactccttctgg

SEQ ID NO: 7064641 - DNA, 22 bp, Homo sapiens
gaaggcagggaatgtggtgcta

SEQ ID NO: 7064642 - DNA, 22 bp, Homo sapiens
gaaggcagggaatgtggtgcta

SEQ ID NO: 7064643 - DNA, 22 bp, Homo sapiens
gaaggcaggtttttcaaaactg

SEQ ID NO: 7064644 - DNA, 22 bp, Homo sapiens
gaaggcagtaaatggctgtttt

SEQ ID NO: 7064645 - DNA, 22 bp, Homo sapiens
gaagggagaaggttgggtgacg

SEQ ID NO: 7064646 - DNA, 22 bp, Homo sapiens
gaagcatcagcaatggctggaa

SEQ ID NO: 7064647 - DNA, 22 bp, Homo sapiens
gaagcatgctaaggattctcag

SEQ ID NO: 7064648 - DNA, 22 bp, Homo sapiens
gaagccaacattccaagtagaa

SEQ ID NO: 7064649 - DNA, 22 bp, Homo sapiens
gaagccaagtcctcgagtttca

SEQ ID NO: 7064650 - DNA, 22 bp, Homo sapiens
gaagccaagtgcaaatgcctta

SEQ ID NO: 7064651 - DNA, 22 bp, Homo sapiens
gaaaggagagggttaaggagct

SEQ ID NO: 7064652 - DNA, 22 bp, Homo sapiens
gaaagctgaaccaggaaccatg

SEQ ID NO: 7064653 - DNA, 22 bp, Homo sapiens
gaaaggaaatattctaagcact

SEQ ID NO: 7064654 - DNA, 22 bp, Homo sapiens
gaccactgaatgcacttctaat

SEQ ID NO: 7064655 - DNA, 22 bp, Homo sapiens
gaccactgatgacatgaggaga

SEQ ID NO: 7064656 - DNA, 22 bp, Homo sapiens
gaccactggcgctgcgagaccc

SEQ ID NO: 7064657 - DNA, 22 bp, Homo sapiens
gaccactggggtgagggccatc

SEQ ID NO: 7064658 - DNA, 22 bp, Homo sapiens
gaccagagaaaggcactggaag

SEQ ID NO: 7064659 - DNA, 22 bp, Homo sapiens
gacatttagctgttttgcattt

SEQ ID NO: 7064660 - DNA, 22 bp, Homo sapiens
gaccaggaaagagtgtgactaa

SEQ ID NO: 7064661 - DNA, 22 bp, Homo sapiens
gaccaggcccaggtgcaaggga

SEQ ID NO: 7064662 - DNA, 17 bp, Homo sapiens
gactgaggtaaggtgag

SEQ ID NO: 7064663 - DNA, 22 bp, Homo sapiens
gactgagggacagggcagtgga

SEQ ID NO: 7064664 - DNA, 22 bp, Homo sapiens
gactgaggctcccctaggctca

SEQ ID NO: 7064665 - DNA, 22 bp, Homo sapiens
gactgagggatagaggtgcttc

SEQ ID NO: 7064666 - DNA, 22 bp, Homo sapiens
gactgagggatagaggtgcttc

SEQ ID NO: 7064667 - DNA, 22 bp, Homo sapiens
gactgaggaggtaaggtttgaa

SEQ ID NO: 7064668 - DNA, 22 bp, Homo sapiens
gactgagaatcatagaaggcaa

SEQ ID NO: 7064669 - DNA, 22 bp, Homo sapiens
gactctttcaaacagaaagcca

SEQ ID NO: 7064670 - DNA, 21 bp, Homo sapiens
gactctggggtcagctcaacc

SEQ ID NO: 7064671 - DNA, 22 bp, Homo sapiens
gacagagaggctgagcagtaca

SEQ ID NO: 7064672 - DNA, 22 bp, Homo sapiens
gacagagattgaatcaggaaat

SEQ ID NO: 7064673 - DNA, 22 bp, Homo sapiens
gacagaggagaagatgctgtgg

SEQ ID NO: 7064674 - DNA, 22 bp, Homo sapiens
gacagaggcaagaccagaagcc

SEQ ID NO: 7064675 - DNA, 22 bp, Homo sapiens
gacagcagaatccattcccagt

SEQ ID NO: 7064676 - DNA, 22 bp, Homo sapiens
gacagcagacaaaccatgtttt

SEQ ID NO: 7064677 - DNA, 22 bp, Homo sapiens
gacagcagcatgtttacaggcc

SEQ ID NO: 7064678 - DNA, 19 bp, Homo sapiens
gacattcctgacactggct

SEQ ID NO: 7064679 - DNA, 22 bp, Homo sapiens
gacattggctgttcattgggat

SEQ ID NO: 7064680 - DNA, 22 bp, Homo sapiens
gacattgggtgtacaattggca

SEQ ID NO: 7064681 - DNA, 22 bp, Homo sapiens
gacatttaaggcagtcacttaa

SEQ ID NO: 7064682 - DNA, 22 bp, Homo sapiens
gacatttactgaatactgatta

SEQ ID NO: 7064683 - DNA, 22 bp, Homo sapiens
gacatttagaagttagattcaa

SEQ ID NO: 7064684 - DNA, 22 bp, Homo sapiens
gagagggctgcctggtgtgagg

SEQ ID NO: 7064685 - DNA, 22 bp, Homo sapiens
gagagggctctgtgtgggtact

SEQ ID NO: 7064686 - DNA, 21 bp, Homo sapiens
gagagggcattataggaagtg

SEQ ID NO: 7064687 - DNA, 22 bp, Homo sapiens
gagagggccagggtgagaacta

SEQ ID NO: 7064688 - DNA, 22 bp, Homo sapiens
gagagaagaaagccatggtcct

SEQ ID NO: 7064689 - DNA, 18 bp, Homo sapiens
gagagggatccctcagga

SEQ ID NO: 7064690 - DNA, 22 bp, Homo sapiens
gagactgcatagatggccacaa

SEQ ID NO: 7064691 - DNA, 22 bp, Homo sapiens
gagactgctggtaaagatggga

SEQ ID NO: 7064692 - DNA, 22 bp, Homo sapiens
gagaaagggaacttacagagtg

SEQ ID NO: 7064693 - DNA, 22 bp, Homo sapiens
gagacagatgctgctggagcat

SEQ ID NO: 7064694 - DNA, 22 bp, Homo sapiens
gagacattcttaggaacaatgt

SEQ ID NO: 7064695 - DNA, 22 bp, Homo sapiens
gagaccaggaagtacagcagcc

SEQ ID NO: 7064696 - DNA, 22 bp, Homo sapiens
gactgcagtgaaggcacatggg

SEQ ID NO: 7064697 - DNA, 22 bp, Homo sapiens
gactgaggtgacctaggactac

SEQ ID NO: 7064698 - DNA, 22 bp, Homo sapiens
gactgaggtgcccagaggtgac

SEQ ID NO: 7064699 - DNA, 22 bp, Homo sapiens
gagaaacactgttagtttatta

SEQ ID NO: 7064700 - DNA, 22 bp, Homo sapiens
gagaaacaggaattgagtcgct

SEQ ID NO: 7064701 - DNA, 22 bp, Homo sapiens
gagaaactaacatctgaaggtg

SEQ ID NO: 7064702 - DNA, 22 bp, Homo sapiens
gagaaacttggagttattctgg

SEQ ID NO: 7064703 - DNA, 22 bp, Homo sapiens
gagaaagatggaatcttacagg

SEQ ID NO: 7064704 - DNA, 22 bp, Homo sapiens
gagaggggacctgtgtgtctag

SEQ ID NO: 7064705 - DNA, 22 bp, Homo sapiens
gagcagggagacaactctggtg

SEQ ID NO: 7064706 - DNA, 22 bp, Homo sapiens
gagcagtgagtgaatgttgcct

SEQ ID NO: 7064707 - DNA, 22 bp, Homo sapiens
gagcagtgggaaggaacagggt

SEQ ID NO: 7064708 - DNA, 22 bp, Homo sapiens
gagaggtaatttgaagtgcaaa

SEQ ID NO: 7064709 - DNA, 22 bp, Homo sapiens
gagcagtgggaaggaacagggt

SEQ ID NO: 7064710 - DNA, 22 bp, Homo sapiens
gagcagtgggaaggaacagggt

SEQ ID NO: 7064711 - DNA, 22 bp, Homo sapiens
gagcagtggttgaacagaggca

SEQ ID NO: 7064712 - DNA, 22 bp, Homo sapiens
gagcatgagggaaggcagcaga

SEQ ID NO: 7064713 - DNA, 22 bp, Homo sapiens
gagcccaggaagtggaggctga

SEQ ID NO: 7064714 - DNA, 22 bp, Homo sapiens
gagcatggttccataggttggt

SEQ ID NO: 7064715 - DNA, 22 bp, Homo sapiens
gagcatttggttatagtaattt

SEQ ID NO: 7064716 - DNA, 22 bp, Homo sapiens
gagccagtgatcagacagggag

SEQ ID NO: 7064717 - DNA, 22 bp, Homo sapiens
gagccctgaacaacagcaggaa

SEQ ID NO: 7064718 - DNA, 22 bp, Homo sapiens
gagccctgaacaacagcaggaa

SEQ ID NO: 7064719 - DNA, 22 bp, Homo sapiens
gagccctgaacaacagcaggaa

SEQ ID NO: 7064720 - DNA, 22 bp, Homo sapiens
gagccctgacactgagggagtt

SEQ ID NO: 7064721 - DNA, 22 bp, Homo sapiens
gagccctgacactgagggagtt

SEQ ID NO: 7064722 - DNA, 22 bp, Homo sapiens
gaggaagaagcaaaccagctaa

SEQ ID NO: 7064723 - DNA, 22 bp, Homo sapiens
gaggaagaagcaaaccagctaa

SEQ ID NO: 7064724 - DNA, 22 bp, Homo sapiens
gaggaagaagggattagaactc

SEQ ID NO: 7064725 - DNA, 22 bp, Homo sapiens
gaggaagaagggattagaactc

SEQ ID NO: 7064726 - DNA, 22 bp, Homo sapiens
gaggaagaattggttattggag

SEQ ID NO: 7064727 - DNA, 22 bp, Homo sapiens
gaggagagatggtagattgggt

SEQ ID NO: 7064728 - DNA, 22 bp, Homo sapiens
gaggaaccaaatcagcttgcac

SEQ ID NO: 7064729 - DNA, 22 bp, Homo sapiens
gaggaaccaatctgtgatattc

SEQ ID NO: 7064730 - DNA, 22 bp, Homo sapiens
gaggaaccactctgagaagcca

SEQ ID NO: 7064731 - DNA, 22 bp, Homo sapiens
gaggaacccagctggggttgcc

SEQ ID NO: 7064732 - DNA, 19 bp, Homo sapiens
gaggaactggcttggttcc

SEQ ID NO: 7064733 - DNA, 22 bp, Homo sapiens
gaggaacttatgatattctact

SEQ ID NO: 7064734 - DNA, 22 bp, Homo sapiens
gaggaagaaagcataggtgggg

SEQ ID NO: 7064735 - DNA, 18 bp, Homo sapiens
gaggaaacaggctctgtg

SEQ ID NO: 7064736 - DNA, 22 bp, Homo sapiens
gaggaaacattgtagaagcagt

SEQ ID NO: 7064737 - DNA, 18 bp, Homo sapiens
gaggaaacaaggcagagg

SEQ ID NO: 7064738 - DNA, 23 bp, Homo sapiens
gaggaaagaatatagatgcaatc

SEQ ID NO: 7064739 - DNA, 19 bp, Homo sapiens
gagctgccttttgaagacc

SEQ ID NO: 7064740 - DNA, 22 bp, Homo sapiens
gaggaaaatgggacaggctgta

SEQ ID NO: 7064741 - DNA, 22 bp, Homo sapiens
gagctgagtagaggctgctccc

SEQ ID NO: 7064742 - DNA, 22 bp, Homo sapiens
gagctgagtatcccactgaagt

SEQ ID NO: 7064743 - DNA, 22 bp, Homo sapiens
gagctgagggtctaggagggtt

SEQ ID NO: 7064744 - DNA, 22 bp, Homo sapiens
gagctgaggtgatgtggtcgtt

SEQ ID NO: 7064745 - DNA, 22 bp, Homo sapiens
gagctgagtatgaaggatgtga

SEQ ID NO: 7064746 - DNA, 22 bp, Homo sapiens
gagctgagtctgcagtcgccat

SEQ ID NO: 7064747 - DNA, 23 bp, Homo sapiens
gagctgagtgtagggagactagg

SEQ ID NO: 7064748 - DNA, 23 bp, Homo sapiens
gagctgagtgtagggagactagg

SEQ ID NO: 7064749 - DNA, 22 bp, Homo sapiens
gagctgcctgtgtgccatgatg

SEQ ID NO: 7064750 - DNA, 22 bp, Homo sapiens
gagctgagggtctaggagggtt

SEQ ID NO: 7064751 - DNA, 22 bp, Homo sapiens
gagctgaggctcaggctggcgt

SEQ ID NO: 7064752 - DNA, 22 bp, Homo sapiens
gagctgaggctcaggctggcgt

SEQ ID NO: 7064753 - DNA, 22 bp, Homo sapiens
gagctgaggctgaggcctcact

SEQ ID NO: 7064754 - DNA, 22 bp, Homo sapiens
gagctgaggatacatcagtgaa

SEQ ID NO: 7064755 - DNA, 22 bp, Homo sapiens
gagctgaggccagagtcttctg

SEQ ID NO: 7064756 - DNA, 22 bp, Homo sapiens
gagctgaggccagagtcttctg

SEQ ID NO: 7064757 - DNA, 22 bp, Homo sapiens
gagctgaggctcaggctggcgt

SEQ ID NO: 7064758 - DNA, 22 bp, Homo sapiens
gagctgagcctgggtggaccgc

SEQ ID NO: 7064759 - DNA, 22 bp, Homo sapiens
gagctgagcttaactccttgaa

SEQ ID NO: 7064760 - DNA, 22 bp, Homo sapiens
gagctgagcagggagcctcact

SEQ ID NO: 7064761 - DNA, 22 bp, Homo sapiens
gagctgagatttgaagcaagtt

SEQ ID NO: 7064762 - DNA, 22 bp, Homo sapiens
gagctgagatttgaagcaagtt

SEQ ID NO: 7064763 - DNA, 22 bp, Homo sapiens
gagctgagatcatgtacactag

SEQ ID NO: 7064764 - DNA, 22 bp, Homo sapiens
gagccctgttcaggcctcctca

SEQ ID NO: 7064765 - DNA, 22 bp, Homo sapiens
gagccctggcagtctgggatgg

SEQ ID NO: 7064766 - DNA, 22 bp, Homo sapiens
gagccctgtagcaagtcatgtc

SEQ ID NO: 7064767 - DNA, 22 bp, Homo sapiens
gagccctgtagcaagtcatgtc

SEQ ID NO: 7064768 - DNA, 22 bp, Homo sapiens
gagccctgtagcaagtcatgtc

SEQ ID NO: 7064769 - DNA, 22 bp, Homo sapiens
gagccctgagagttgtgaggcc

SEQ ID NO: 7064770 - DNA, 18 bp, Homo sapiens
gagccctgagtctgcaca

SEQ ID NO: 7064771 - DNA, 22 bp, Homo sapiens
gagccctgatttgcagcatttg

SEQ ID NO: 7064772 - DNA, 22 bp, Homo sapiens
gagccctgcgtgtctgggggca

SEQ ID NO: 7064773 - DNA, 22 bp, Homo sapiens
gagccctgcgtgtctgggggca

SEQ ID NO: 7064774 - DNA, 22 bp, Homo sapiens
gagccctgctgggccttgtctc

SEQ ID NO: 7064775 - DNA, 22 bp, Homo sapiens
gagccctgcttccaagggggca

SEQ ID NO: 7064776 - DNA, 22 bp, Homo sapiens
gagccctggcagtctgggatgg

SEQ ID NO: 7064777 - DNA, 22 bp, Homo sapiens
gaggctgaagtgtacatgggtg

SEQ ID NO: 7064778 - DNA, 22 bp, Homo sapiens
gaggctgaacaggttctcatga

SEQ ID NO: 7064779 - DNA, 22 bp, Homo sapiens
gaggctcattgcattgtgcatt

SEQ ID NO: 7064780 - DNA, 22 bp, Homo sapiens
gaggctcagttatgtcatcagg

SEQ ID NO: 7064781 - DNA, 22 bp, Homo sapiens
gaggctcagagaggtccacata

SEQ ID NO: 7064782 - DNA, 22 bp, Homo sapiens
gaggctgaagtgtacatgggtg

SEQ ID NO: 7064783 - DNA, 20 bp, Homo sapiens
gaggctgaagtgtttttgct

SEQ ID NO: 7064784 - DNA, 22 bp, Homo sapiens
gaggctgaatggccagaagcca

SEQ ID NO: 7064785 - DNA, 22 bp, Homo sapiens
gaggctgaatggccagaagcca

SEQ ID NO: 7064786 - DNA, 22 bp, Homo sapiens
gaggctgaatggccagaagcca

SEQ ID NO: 7064787 - DNA, 22 bp, Homo sapiens
gaggctgacggcaccatcttct

SEQ ID NO: 7064788 - DNA, 22 bp, Homo sapiens
gaggctgagactctgaattttt

SEQ ID NO: 7064789 - DNA, 22 bp, Homo sapiens
gaggctgagagtttgttctact

SEQ ID NO: 7064790 - DNA, 22 bp, Homo sapiens
gaggctgagagtttgttctact

SEQ ID NO: 7064791 - DNA, 22 bp, Homo sapiens
gaggctgaggcaggaggatcac

SEQ ID NO: 7064792 - DNA, 22 bp, Homo sapiens
gaggctcagagaagtcatggta

SEQ ID NO: 7064793 - DNA, 22 bp, Homo sapiens
gaggctcactaggcatcctggg

SEQ ID NO: 7064794 - DNA, 22 bp, Homo sapiens
gaggcatgcagagctggagcag

SEQ ID NO: 7064795 - DNA, 22 bp, Homo sapiens
gaggctcaacccacaggggttg

SEQ ID NO: 7064796 - DNA, 22 bp, Homo sapiens
gaggcagttcctgagtgacaag

SEQ ID NO: 7064797 - DNA, 22 bp, Homo sapiens
gaggcagtttgccatgccagga

SEQ ID NO: 7064798 - DNA, 22 bp, Homo sapiens
gaggcagggtgttgattacaga

SEQ ID NO: 7064799 - DNA, 22 bp, Homo sapiens
gaggcagtaattgtgggcaata

SEQ ID NO: 7064800 - DNA, 22 bp, Homo sapiens
gaggcagtgttgaaaaggagag

SEQ ID NO: 7064801 - DNA, 22 bp, Homo sapiens
gaggagccctgttccccaggcc

SEQ ID NO: 7064802 - DNA, 22 bp, Homo sapiens
gaggcagcttagggtactgact

SEQ ID NO: 7064803 - DNA, 22 bp, Homo sapiens
gaggcagcttagggtactgact

SEQ ID NO: 7064804 - DNA, 22 bp, Homo sapiens
gaggcagcttggggctgtgggt

SEQ ID NO: 7064805 - DNA, 22 bp, Homo sapiens
gaggcaggaggattgcttgagc

SEQ ID NO: 7064806 - DNA, 22 bp, Homo sapiens
gaggcaggaggattgcttgagc

SEQ ID NO: 7064807 - DNA, 22 bp, Homo sapiens
gaggcaggaggattgcttgagc

SEQ ID NO: 7064808 - DNA, 22 bp, Homo sapiens
gaggcaggcagattgcttgagg

SEQ ID NO: 7064809 - DNA, 22 bp, Homo sapiens
gaggcaggcagattgcttgagg

SEQ ID NO: 7064810 - DNA, 22 bp, Homo sapiens
gaggcaggcagattgcttgagg

SEQ ID NO: 7064811 - DNA, 22 bp, Homo sapiens
gaggcaggccctgaatgagtca

SEQ ID NO: 7064812 - DNA, 22 bp, Homo sapiens
gaggagagatggtagattgggt

SEQ ID NO: 7064813 - DNA, 22 bp, Homo sapiens
gaggagagatggtagattgggt

SEQ ID NO: 7064814 - DNA, 22 bp, Homo sapiens
gaggagagcctgcactttgacc

SEQ ID NO: 7064815 - DNA, 22 bp, Homo sapiens
gaggagaggctggacgcggtga

SEQ ID NO: 7064816 - DNA, 22 bp, Homo sapiens
gaggagagggctgcgggcccac

SEQ ID NO: 7064817 - DNA, 22 bp, Homo sapiens
gaggagaggggctcccaagagc

SEQ ID NO: 7064818 - DNA, 22 bp, Homo sapiens
gaggagaggggctcccaagagc

SEQ ID NO: 7064819 - DNA, 22 bp, Homo sapiens
gaggagaggggctcccaagagc

SEQ ID NO: 7064820 - DNA, 22 bp, Homo sapiens
gaggagcacatgaggctgaggg

SEQ ID NO: 7064821 - DNA, 22 bp, Homo sapiens
gaggagcacatgaggctgaggg

SEQ ID NO: 7064822 - DNA, 22 bp, Homo sapiens
gaggagcacatgaggctgaggg

SEQ ID NO: 7064823 - DNA, 22 bp, Homo sapiens
gaggagcatgggaaggctctgg

SEQ ID NO: 7064824 - DNA, 22 bp, Homo sapiens
gaggagcatgggaaggctctgg

SEQ ID NO: 7064825 - DNA, 22 bp, Homo sapiens
gaggagccaaggtatgtgtgtt

SEQ ID NO: 7064826 - DNA, 22 bp, Homo sapiens
gaggagccaaggtatgtgtgtt

SEQ ID NO: 7064827 - DNA, 22 bp, Homo sapiens
gaggctgcaggcaatgctgccc

SEQ ID NO: 7064828 - DNA, 22 bp, Homo sapiens
gaggctgagtagctttgtgctc

SEQ ID NO: 7064829 - DNA, 22 bp, Homo sapiens
gaggctgatgctgcctcacaga

SEQ ID NO: 7064830 - DNA, 22 bp, Homo sapiens
gaggctgattcggggaacagca

SEQ ID NO: 7064831 - DNA, 22 bp, Homo sapiens
gaggctgattcggggaacagca

SEQ ID NO: 7064832 - DNA, 22 bp, Homo sapiens
gaggctgattcggggaacagca

SEQ ID NO: 7064833 - DNA, 22 bp, Homo sapiens
gaggctgaggcaggaggatcac

SEQ ID NO: 7064834 - DNA, 22 bp, Homo sapiens
gaggctgaggcggatggatcac

SEQ ID NO: 7064835 - DNA, 22 bp, Homo sapiens
gaggctgaggcggatggatcac

SEQ ID NO: 7064836 - DNA, 22 bp, Homo sapiens
gaggctgagggttagagagtca

SEQ ID NO: 7064837 - DNA, 22 bp, Homo sapiens
gaggctgaggttgcagtgagcc

SEQ ID NO: 7064838 - DNA, 22 bp, Homo sapiens
gaggctgaggttgcagtgagcc

SEQ ID NO: 7064839 - DNA, 22 bp, Homo sapiens
gaggctgaggttgcagtgagcc

SEQ ID NO: 7064840 - DNA, 22 bp, Homo sapiens
gaggctgaggttgcagtgagct

SEQ ID NO: 7064841 - DNA, 22 bp, Homo sapiens
gaggctgaggttgcagtgagct

SEQ ID NO: 7064842 - DNA, 22 bp, Homo sapiens
gaggctgaggttgcagtgagct

SEQ ID NO: 7064843 - DNA, 22 bp, Homo sapiens
gagggaggggagctccaccctc

SEQ ID NO: 7064844 - DNA, 22 bp, Homo sapiens
gagggagagtgatggaccattg

SEQ ID NO: 7064845 - DNA, 22 bp, Homo sapiens
gagggagagtgatggaccattg

SEQ ID NO: 7064846 - DNA, 22 bp, Homo sapiens
gagggaggcatcatgaatccag

SEQ ID NO: 7064847 - DNA, 22 bp, Homo sapiens
gaggggctggcacgatggctgc

SEQ ID NO: 7064848 - DNA, 22 bp, Homo sapiens
gaggggaaagtgtgaggctgcg

SEQ ID NO: 7064849 - DNA, 22 bp, Homo sapiens
gaggggctgccctggtgtcagg

SEQ ID NO: 7064850 - DNA, 22 bp, Homo sapiens
gagggctgtgaaggagcgggtt

SEQ ID NO: 7064851 - DNA, 22 bp, Homo sapiens
gagggctgtgaaggagcgggtt

SEQ ID NO: 7064852 - DNA, 22 bp, Homo sapiens
gagggctgctggaaaaatgcag

SEQ ID NO: 7064853 - DNA, 22 bp, Homo sapiens
gagggctggggcttaggcttag

SEQ ID NO: 7064854 - DNA, 22 bp, Homo sapiens
gagggctgtgaaggagcgggtt

SEQ ID NO: 7064855 - DNA, 22 bp, Homo sapiens
gagggctgtggggcatgaccag

SEQ ID NO: 7064856 - DNA, 22 bp, Homo sapiens
gagggctgtggggcatgaccag

SEQ ID NO: 7064857 - DNA, 22 bp, Homo sapiens
gagggctgctggaaaaatgcag

SEQ ID NO: 7064858 - DNA, 22 bp, Homo sapiens
gagggctgctgccagatatgcc

SEQ ID NO: 7064859 - DNA, 22 bp, Homo sapiens
gagggctgctgccagatatgcc

SEQ ID NO: 7064860 - DNA, 22 bp, Homo sapiens
gagggctgccacgttgggcgag

SEQ ID NO: 7064861 - DNA, 22 bp, Homo sapiens
gagggctgctgccagatatgcc

SEQ ID NO: 7064862 - DNA, 22 bp, Homo sapiens
gagggctgcaatgagacagaga

SEQ ID NO: 7064863 - DNA, 22 bp, Homo sapiens
gagggctgcaatgagacagaga

SEQ ID NO: 7064864 - DNA, 22 bp, Homo sapiens
gagggctgcaatgagacagaga

SEQ ID NO: 7064865 - DNA, 18 bp, Homo sapiens
gagggagtagctgaggtt

SEQ ID NO: 7064866 - DNA, 22 bp, Homo sapiens
gagggctgatgttgccacctca

SEQ ID NO: 7064867 - DNA, 22 bp, Homo sapiens
gaaaatgtttcctgttatttgc

SEQ ID NO: 7064868 - DNA, 22 bp, Homo sapiens
gaaaatgtttgtccggagctga

SEQ ID NO: 7064869 - DNA, 22 bp, Homo sapiens
gaaaattattgaaaatggctct

SEQ ID NO: 7064870 - DNA, 22 bp, Homo sapiens
gaaacaatcatcatgtgatttg

SEQ ID NO: 7064871 - DNA, 22 bp, Homo sapiens
gaaacacatatgaacagttgat

SEQ ID NO: 7064872 - DNA, 22 bp, Homo sapiens
gaaacacatatgaacagttgat

SEQ ID NO: 7064873 - DNA, 22 bp, Homo sapiens
gaaacagcacgtttggagagat

SEQ ID NO: 7064874 - DNA, 22 bp, Homo sapiens
gaaagagaggggctgagatgca

SEQ ID NO: 7064875 - DNA, 22 bp, Homo sapiens
gaaagccatagcccagctttac

SEQ ID NO: 7064876 - DNA, 22 bp, Homo sapiens
gaaagccatctggctgctggga

SEQ ID NO: 7064877 - DNA, 22 bp, Homo sapiens
cttttcttactcccgcaaggca

SEQ ID NO: 7064878 - DNA, 21 bp, Homo sapiens
cttttctgtgttcctccctgt

SEQ ID NO: 7064879 - DNA, 22 bp, Homo sapiens
cttttcttactcccgcaaggca

SEQ ID NO: 7064880 - DNA, 22 bp, Homo sapiens
cttttcttatgtggacgtacct

SEQ ID NO: 7064881 - DNA, 22 bp, Homo sapiens
cttttcttctcacggctgtcag

SEQ ID NO: 7064882 - DNA, 22 bp, Homo sapiens
cttttcttgtattggatgcccc

SEQ ID NO: 7064883 - DNA, 22 bp, Homo sapiens
cttttctctgcgggtctttcat

SEQ ID NO: 7064884 - DNA, 22 bp, Homo sapiens
cttttctcttacattccactgg

SEQ ID NO: 7064885 - DNA, 22 bp, Homo sapiens
ctttgcagaaataaacttgatg

SEQ ID NO: 7064886 - DNA, 17 bp, Homo sapiens
ctttgcagcagacatgt

SEQ ID NO: 7064887 - DNA, 22 bp, Homo sapiens
ctttgaaaacttaaataacagc

SEQ ID NO: 7064888 - DNA, 22 bp, Homo sapiens
ctttgaaaacttaaataacagc

SEQ ID NO: 7064889 - DNA, 22 bp, Homo sapiens
ctttgaaaacacacgaatagac

SEQ ID NO: 7064890 - DNA, 22 bp, Homo sapiens
ctttctcttcagcacccagccc

SEQ ID NO: 7064891 - DNA, 22 bp, Homo sapiens
ctttctttgtccaccaacaatg

SEQ ID NO: 7064892 - DNA, 22 bp, Homo sapiens
ctttctttgtccaccaacaatg

SEQ ID NO: 7064893 - DNA, 22 bp, Homo sapiens
ctttgaagagattactgtgctc

SEQ ID NO: 7064894 - DNA, 22 bp, Homo sapiens
ctttgaagatcacatgttgctc

SEQ ID NO: 7064895 - DNA, 22 bp, Homo sapiens
ctttgaattgccgtttcatctg

SEQ ID NO: 7064896 - DNA, 22 bp, Homo sapiens
ctttacaaatagggagggagtg

SEQ ID NO: 7064897 - DNA, 22 bp, Homo sapiens
ctttacaaattagctctcggga

SEQ ID NO: 7064898 - DNA, 22 bp, Homo sapiens
ctttacaaactataaagtgcgg

SEQ ID NO: 7064899 - DNA, 22 bp, Homo sapiens
ctttacaaagcaattttgtctc

SEQ ID NO: 7064900 - DNA, 22 bp, Homo sapiens
ctttaattaggaagtataatga

SEQ ID NO: 7064901 - DNA, 22 bp, Homo sapiens
ctttaaataatacaaggtccag

SEQ ID NO: 7064902 - DNA, 22 bp, Homo sapiens
ctttaaataatacaaggtccag

SEQ ID NO: 7064903 - DNA, 22 bp, Homo sapiens
ctttaagactaaattagagttt

SEQ ID NO: 7064904 - DNA, 22 bp, Homo sapiens
ctttaaggtgatgagagatgct

SEQ ID NO: 7064905 - DNA, 22 bp, Homo sapiens
cttctcttggtagttcttgttg

SEQ ID NO: 7064906 - DNA, 22 bp, Homo sapiens
cttctgacccctggtctacagc

SEQ ID NO: 7064907 - DNA, 23 bp, Homo sapiens
cttctggctctatatcagaattc

SEQ ID NO: 7064908 - DNA, 22 bp, Homo sapiens
cttctgggagagcttttgcttc

SEQ ID NO: 7064909 - DNA, 22 bp, Homo sapiens
cttctgggattaatttttcctg

SEQ ID NO: 7064910 - DNA, 22 bp, Homo sapiens
cttctgggatttttgaagactc

SEQ ID NO: 7064911 - DNA, 22 bp, Homo sapiens
cttctgggcagaagttttgaga

SEQ ID NO: 7064912 - DNA, 22 bp, Homo sapiens
cttctgggccatggccttcctc

SEQ ID NO: 7064913 - DNA, 22 bp, Homo sapiens
cttctgggtaattcttcttcat

SEQ ID NO: 7064914 - DNA, 22 bp, Homo sapiens
cttctgggtgcctgtgagtgtt

SEQ ID NO: 7064915 - DNA, 22 bp, Homo sapiens
cttctgggtgtggagtgaggac

SEQ ID NO: 7064916 - DNA, 22 bp, Homo sapiens
cttctgggtgtggagtgaggac

SEQ ID NO: 7064917 - DNA, 22 bp, Homo sapiens
cttctgggttgcaggtcttggc

SEQ ID NO: 7064918 - DNA, 22 bp, Homo sapiens
cttctgggttgcaggtcttggc

SEQ ID NO: 7064919 - DNA, 22 bp, Homo sapiens
cttgttttctaaaacatcattt

SEQ ID NO: 7064920 - DNA, 22 bp, Homo sapiens
cttgttttggaacagagtgaat

SEQ ID NO: 7064921 - DNA, 22 bp, Homo sapiens
cttgttttggaacagagtgaat

SEQ ID NO: 7064922 - DNA, 22 bp, Homo sapiens
ctttaaataatacaaggtccag

SEQ ID NO: 7064923 - DNA, 22 bp, Homo sapiens
cttacgtgataacttctcaaaa

SEQ ID NO: 7064924 - DNA, 22 bp, Homo sapiens
cttagaaatcgaactcaggtta

SEQ ID NO: 7064925 - DNA, 22 bp, Homo sapiens
cttacaacttgtatgtgattgt

SEQ ID NO: 7064926 - DNA, 22 bp, Homo sapiens
cttaaagtctatcctttctaga

SEQ ID NO: 7064927 - DNA, 22 bp, Homo sapiens
cttaaagtattggtttaaccaa

SEQ ID NO: 7064928 - DNA, 22 bp, Homo sapiens
cttaaagtagaatacaagacct

SEQ ID NO: 7064929 - DNA, 22 bp, Homo sapiens
cttaattacccaatgtggtagg

SEQ ID NO: 7064930 - DNA, 22 bp, Homo sapiens
cttaaagaaattgaggagagga

SEQ ID NO: 7064931 - DNA, 22 bp, Homo sapiens
ctgtttttgtgctgtgtctccc

SEQ ID NO: 7064932 - DNA, 22 bp, Homo sapiens
ctgttttcaaagagagagaatg

SEQ ID NO: 7064933 - DNA, 22 bp, Homo sapiens
ctgtttaatgaggtgtaacaac

SEQ ID NO: 7064934 - DNA, 22 bp, Homo sapiens
cttcatttcaggctgaagaata

SEQ ID NO: 7064935 - DNA, 22 bp, Homo sapiens
cttccaaaatttatatgttgaa

SEQ ID NO: 7064936 - DNA, 19 bp, Homo sapiens
cttcattcttcagcttttg

SEQ ID NO: 7064937 - DNA, 22 bp, Homo sapiens
cttcagttagtttcatgtgagc

SEQ ID NO: 7064938 - DNA, 22 bp, Homo sapiens
cttatatttgtcaactttacaa

SEQ ID NO: 7064939 - DNA, 22 bp, Homo sapiens
cttcagtgttgccagggcctag

SEQ ID NO: 7064940 - DNA, 22 bp, Homo sapiens
cttataaagtccatctgaacaa

SEQ ID NO: 7064941 - DNA, 22 bp, Homo sapiens
cttaggatgagtttttgcgttt

SEQ ID NO: 7064942 - DNA, 22 bp, Homo sapiens
cttagcatgtggtgtccttgta

SEQ ID NO: 7064943 - DNA, 20 bp, Homo sapiens
cttagcttctaaggttctgg

SEQ ID NO: 7064944 - DNA, 22 bp, Homo sapiens
cttagcttctctgcatctgtgt

SEQ ID NO: 7064945 - DNA, 22 bp, Homo sapiens
cttagctttgtcctaggtctct

SEQ ID NO: 7064946 - DNA, 22 bp, Homo sapiens
cttaggaatatccacagcaggt

SEQ ID NO: 7064947 - DNA, 22 bp, Homo sapiens
cttcctgttgtcacagtctgcg

SEQ ID NO: 7064948 - DNA, 22 bp, Homo sapiens
cttctaggcttctcagggggca

SEQ ID NO: 7064949 - DNA, 22 bp, Homo sapiens
cttctattcactggtcacagtt

SEQ ID NO: 7064950 - DNA, 22 bp, Homo sapiens
cttctattttcatgcctgggtc

SEQ ID NO: 7064951 - DNA, 22 bp, Homo sapiens
cttctcaactgcacttgccagg

SEQ ID NO: 7064952 - DNA, 23 bp, Homo sapiens
cttctcagaagtctgtgccagga

SEQ ID NO: 7064953 - DNA, 22 bp, Homo sapiens
cttctcagaggccagaagctat

SEQ ID NO: 7064954 - DNA, 22 bp, Homo sapiens
cttctcagaggccagaagctat

SEQ ID NO: 7064955 - DNA, 22 bp, Homo sapiens
cttctcagatctcagctttgag

SEQ ID NO: 7064956 - DNA, 22 bp, Homo sapiens
cttctcagcatggttactgtga

SEQ ID NO: 7064957 - DNA, 22 bp, Homo sapiens
cttctcagcattttgtcagtct

SEQ ID NO: 7064958 - DNA, 22 bp, Homo sapiens
ctgtctgtgcctcttctcccag

SEQ ID NO: 7064959 - DNA, 22 bp, Homo sapiens
ctgtgctgagtgatgtgactta

SEQ ID NO: 7064960 - DNA, 22 bp, Homo sapiens
ctgtgctgcagacgcagtagct

SEQ ID NO: 7064961 - DNA, 17 bp, Homo sapiens
ctgtctgcgcatgaggt

SEQ ID NO: 7064962 - DNA, 19 bp, Homo sapiens
ctgtctgcggggcctgttc

SEQ ID NO: 7064963 - DNA, 22 bp, Homo sapiens
ctgtctgctagaacatctatac

SEQ ID NO: 7064964 - DNA, 22 bp, Homo sapiens
ctgtctgctatgcttgttgtca

SEQ ID NO: 7064965 - DNA, 22 bp, Homo sapiens
ctgtctgctcataatggagggc

SEQ ID NO: 7064966 - DNA, 17 bp, Homo sapiens
ctgtctgctgcttcctc

SEQ ID NO: 7064967 - DNA, 22 bp, Homo sapiens
ctgtctggatataccttggcca

SEQ ID NO: 7064968 - DNA, 22 bp, Homo sapiens
ctgtctggatataccttggcca

SEQ ID NO: 7064969 - DNA, 22 bp, Homo sapiens
ctgtctggccggcccagcttcc

SEQ ID NO: 7064970 - DNA, 22 bp, Homo sapiens
ctgtctgggtctacatcctctg

SEQ ID NO: 7064971 - DNA, 19 bp, Homo sapiens
ctgtctggttcatgtgttc

SEQ ID NO: 7064972 - DNA, 22 bp, Homo sapiens
ctgtagttgatgatttctgata

SEQ ID NO: 7064973 - DNA, 22 bp, Homo sapiens
ctgtagttgggcattataatag

SEQ ID NO: 7064974 - DNA, 22 bp, Homo sapiens
ctgtatttgtcctctatttatt

SEQ ID NO: 7064975 - DNA, 22 bp, Homo sapiens
ctgtattttcatgcctacgtac

SEQ ID NO: 7064976 - DNA, 22 bp, Homo sapiens
ctgtcaggggcgggtggagcgg

SEQ ID NO: 7064977 - DNA, 22 bp, Homo sapiens
ctgtcctgtggacctgaggacg

SEQ ID NO: 7064978 - DNA, 22 bp, Homo sapiens
ctgtcctgtggacctgaggacg

SEQ ID NO: 7064979 - DNA, 22 bp, Homo sapiens
ctgtcctgtgtcagcctgaaat

SEQ ID NO: 7064980 - DNA, 19 bp, Homo sapiens
ctgtccttggctgcactgt

SEQ ID NO: 7064981 - DNA, 22 bp, Homo sapiens
ctgtctctgttgcctgtaggtg

SEQ ID NO: 7064982 - DNA, 22 bp, Homo sapiens
ctgtctgcaggatagtaccctc

SEQ ID NO: 7064983 - DNA, 22 bp, Homo sapiens
ctgtctgccaataatctatggc

SEQ ID NO: 7064984 - DNA, 22 bp, Homo sapiens
ctgtctgccctggccagagccc

SEQ ID NO: 7064985 - DNA, 21 bp, Homo sapiens
ctgggctttctctcaaagaca

SEQ ID NO: 7064986 - DNA, 22 bp, Homo sapiens
ctgggctttggtactgtgatta

SEQ ID NO: 7064987 - DNA, 22 bp, Homo sapiens
ctgggcttgtgttagctgacaa

SEQ ID NO: 7064988 - DNA, 20 bp, Homo sapiens
ctggggagctgctcccacga

SEQ ID NO: 7064989 - DNA, 22 bp, Homo sapiens
ctggtcactggtctcatccagc

SEQ ID NO: 7064990 - DNA, 18 bp, Homo sapiens
ctggtctcccttcgcttt

SEQ ID NO: 7064991 - DNA, 22 bp, Homo sapiens
ctggtctgggatgagggatgta

SEQ ID NO: 7064992 - DNA, 22 bp, Homo sapiens
ctggtgaatattggaggcattg

SEQ ID NO: 7064993 - DNA, 22 bp, Homo sapiens
ctggtgccattctgtggcctag

SEQ ID NO: 7064994 - DNA, 22 bp, Homo sapiens
ctggtgcaggaaggagctggca

SEQ ID NO: 7064995 - DNA, 22 bp, Homo sapiens
ctggtgaccttgccccaggtca

SEQ ID NO: 7064996 - DNA, 22 bp, Homo sapiens
ctggtgagactcagggatgctt

SEQ ID NO: 7064997 - DNA, 22 bp, Homo sapiens
ctgtacaatgttacctatttat

SEQ ID NO: 7064998 - DNA, 22 bp, Homo sapiens
ctgtacatcccgagagccagta

SEQ ID NO: 7064999 - DNA, 23 bp, Homo sapiens
ctgtagctaaaagctgggatttg

SEQ ID NO: 7065000 - DNA, 22 bp, Homo sapiens
ctgggacagctgagacaggaga

SEQ ID NO: 7065001 - DNA, 18 bp, Homo sapiens
ctgggactcaatgctact

SEQ ID NO: 7065002 - DNA, 22 bp, Homo sapiens
ctgggactcagaccagttctgt

SEQ ID NO: 7065003 - DNA, 19 bp, Homo sapiens
ctgggactcctgatacctt

SEQ ID NO: 7065004 - DNA, 22 bp, Homo sapiens
ctgggactgccattcacagcca

SEQ ID NO: 7065005 - DNA, 22 bp, Homo sapiens
ctgggactgggtcctcaggaca

SEQ ID NO: 7065006 - DNA, 22 bp, Homo sapiens
ctgggacttgcagagcaggagg

SEQ ID NO: 7065007 - DNA, 22 bp, Homo sapiens
ctgggagaggctgctccgctct

SEQ ID NO: 7065008 - DNA, 22 bp, Homo sapiens
ctgggagatctgttgggactgg

SEQ ID NO: 7065009 - DNA, 22 bp, Homo sapiens
ctgggaagaatccaagggccct

SEQ ID NO: 7065010 - DNA, 22 bp, Homo sapiens
ctgggacagagcagcagtgggg

SEQ ID NO: 7065011 - DNA, 22 bp, Homo sapiens
ctgcttcaccctgcctgagaac

SEQ ID NO: 7065012 - DNA, 22 bp, Homo sapiens
ctgcttcacgttgtgccttgtt

SEQ ID NO: 7065013 - DNA, 22 bp, Homo sapiens
ctgcttcacttcggttgcatag

SEQ ID NO: 7065014 - DNA, 19 bp, Homo sapiens
ctgcttcaggcgccttgcc

SEQ ID NO: 7065015 - DNA, 22 bp, Homo sapiens
ctgcttcatatttcatagtgat

SEQ ID NO: 7065016 - DNA, 22 bp, Homo sapiens
ctgcttccataaataatgtgct

SEQ ID NO: 7065017 - DNA, 22 bp, Homo sapiens
ctgctgtgtttcacacctctgg

SEQ ID NO: 7065018 - DNA, 22 bp, Homo sapiens
ctgctgtgtttctgctagaaaa

SEQ ID NO: 7065019 - DNA, 22 bp, Homo sapiens
ctgctgtgttggcattggatag

SEQ ID NO: 7065020 - DNA, 23 bp, Homo sapiens
ctgctgtgttggtctcgatggga

SEQ ID NO: 7065021 - DNA, 22 bp, Homo sapiens
ctgctgtttctcaaaattaagt

SEQ ID NO: 7065022 - DNA, 23 bp, Homo sapiens
ctgctgttttctgtacctgaagc

SEQ ID NO: 7065023 - DNA, 20 bp, Homo sapiens
ctgcttaagtaagtgacaca

SEQ ID NO: 7065024 - DNA, 22 bp, Homo sapiens
ctgcttcacccaactttgggat

SEQ ID NO: 7065025 - DNA, 22 bp, Homo sapiens
ctgctgtgttgccagtgtcacc

SEQ ID NO: 7065026 - DNA, 22 bp, Homo sapiens
ctgctgtgttcctcctgcatct

SEQ ID NO: 7065027 - DNA, 20 bp, Homo sapiens
ctgctgtgtgtgcctcagcc

SEQ ID NO: 7065028 - DNA, 22 bp, Homo sapiens
ctgctgtgttagcaggtttagt

SEQ ID NO: 7065029 - DNA, 20 bp, Homo sapiens
ctgctgtgttattgtagaac

SEQ ID NO: 7065030 - DNA, 22 bp, Homo sapiens
ctgctgtgcaacattgcaccta

SEQ ID NO: 7065031 - DNA, 22 bp, Homo sapiens
ctgctgtgcacccaggaaggct

SEQ ID NO: 7065032 - DNA, 22 bp, Homo sapiens
ctgctgtgattgggagaaaccg

SEQ ID NO: 7065033 - DNA, 22 bp, Homo sapiens
ctgctgtgtggattcaatggct

SEQ ID NO: 7065034 - DNA, 22 bp, Homo sapiens
ctgctgtgtggtgaaactcagt

SEQ ID NO: 7065035 - DNA, 22 bp, Homo sapiens
ctgggcagctgtgcaaacaata

SEQ ID NO: 7065036 - DNA, 22 bp, Homo sapiens
ctgggcagctgtatcagggagt

SEQ ID NO: 7065037 - DNA, 22 bp, Homo sapiens
ctgggcagctgtatcagggagt

SEQ ID NO: 7065038 - DNA, 22 bp, Homo sapiens
ctgggcagctaccaccactgct

SEQ ID NO: 7065039 - DNA, 22 bp, Homo sapiens
ctgggcagctaccaccactgct

SEQ ID NO: 7065040 - DNA, 22 bp, Homo sapiens
ctgggcagagtccggaagatgg

SEQ ID NO: 7065041 - DNA, 22 bp, Homo sapiens
ctgggcagaattttaggatggc

SEQ ID NO: 7065042 - DNA, 17 bp, Homo sapiens
ctgggatgtggactctt

SEQ ID NO: 7065043 - DNA, 22 bp, Homo sapiens
ctgggcaatatgctgggcctgg

SEQ ID NO: 7065044 - DNA, 22 bp, Homo sapiens
ctgggcactgcagcaggcatca

SEQ ID NO: 7065045 - DNA, 22 bp, Homo sapiens
ctgggccttatgagtacctgga

SEQ ID NO: 7065046 - DNA, 22 bp, Homo sapiens
ctgggctggcgcatccgacacg

SEQ ID NO: 7065047 - DNA, 22 bp, Homo sapiens
ctgggctagaaggaccaggatg

SEQ ID NO: 7065048 - DNA, 22 bp, Homo sapiens
ctgggctcaaatcctatctcca

SEQ ID NO: 7065049 - DNA, 22 bp, Homo sapiens
ctgggccttggattgacactgt

SEQ ID NO: 7065050 - DNA, 22 bp, Homo sapiens
ctgggctacgtgttgacagcat

SEQ ID NO: 7065051 - DNA, 22 bp, Homo sapiens
ctgggctaattaagcacagctg

SEQ ID NO: 7065052 - DNA, 22 bp, Homo sapiens
ctgggctagaaggaccaggatg

SEQ ID NO: 7065053 - DNA, 22 bp, Homo sapiens
ctctggaggccgttggccctta

SEQ ID NO: 7065054 - DNA, 22 bp, Homo sapiens
ctctggagggaggctgagctgg

SEQ ID NO: 7065055 - DNA, 22 bp, Homo sapiens
ctctggaggttgagcccagcaa

SEQ ID NO: 7065056 - DNA, 21 bp, Homo sapiens
ctctggagtcaagagcttcca

SEQ ID NO: 7065057 - DNA, 22 bp, Homo sapiens
ctctggaattgacctgggaggg

SEQ ID NO: 7065058 - DNA, 22 bp, Homo sapiens
tttgaagtgttatttctatcac

SEQ ID NO: 7065059 - DNA, 22 bp, Homo sapiens
tttgaagttcccccatatcaga

SEQ ID NO: 7065060 - DNA, 23 bp, Homo sapiens
tttgaagttgactgccttccaga

SEQ ID NO: 7065061 - DNA, 22 bp, Homo sapiens
tttgaataaacggttaatgttc

SEQ ID NO: 7065062 - DNA, 22 bp, Homo sapiens
tttgaataatcactgggcatta

SEQ ID NO: 7065063 - DNA, 22 bp, Homo sapiens
ctctgcttgtgtcaggcatgct

SEQ ID NO: 7065064 - DNA, 20 bp, Homo sapiens
ctctgctttaggagagtcag

SEQ ID NO: 7065065 - DNA, 22 bp, Homo sapiens
tttgaagtcagacactgctttg

SEQ ID NO: 7065066 - DNA, 22 bp, Homo sapiens
tttgaagtcaggctttctaccc

SEQ ID NO: 7065067 - DNA, 22 bp, Homo sapiens
tttgaagtggaaaaggatttaa

SEQ ID NO: 7065068 - DNA, 22 bp, Homo sapiens
tttgaagtgggcattagaacct

SEQ ID NO: 7065069 - DNA, 22 bp, Homo sapiens
tttcttagtcctagagtgattt

SEQ ID NO: 7065070 - DNA, 22 bp, Homo sapiens
tttcttaaatatttgcaggaca

SEQ ID NO: 7065071 - DNA, 19 bp, Homo sapiens
tttcttaggcctttggcct

SEQ ID NO: 7065072 - DNA, 21 bp, Homo sapiens
tttcttaggctctaaaatgac

SEQ ID NO: 7065073 - DNA, 21 bp, Homo sapiens
tttcttaggctctaaaatgac

SEQ ID NO: 7065074 - DNA, 22 bp, Homo sapiens
tttcttagggactgtaaaatag

SEQ ID NO: 7065075 - DNA, 22 bp, Homo sapiens
tttcttcttgatttaaacaggg

SEQ ID NO: 7065076 - DNA, 22 bp, Homo sapiens
tttcttgaccactatgttgata

SEQ ID NO: 7065077 - DNA, 22 bp, Homo sapiens
tttcttgaccactatgttgata

SEQ ID NO: 7065078 - DNA, 22 bp, Homo sapiens
tttcttgactgcttaggaatgc

SEQ ID NO: 7065079 - DNA, 22 bp, Homo sapiens
tttcttgagtgatgcttagtgt

SEQ ID NO: 7065080 - DNA, 19 bp, Homo sapiens
ctctgcctctggctgtggc

SEQ ID NO: 7065081 - DNA, 19 bp, Homo sapiens
ctctgcctctggctgtggc

SEQ ID NO: 7065082 - DNA, 19 bp, Homo sapiens
ctctgcctctggctgtggc

SEQ ID NO: 7065083 - DNA, 22 bp, Homo sapiens
ctctgctgcccaggcctgctag

SEQ ID NO: 7065084 - DNA, 22 bp, Homo sapiens
ctctgctgctttgccagtggaa

SEQ ID NO: 7065085 - DNA, 21 bp, Homo sapiens
ctctgctgtctaccagctgtt

SEQ ID NO: 7065086 - DNA, 22 bp, Homo sapiens
ctctgctgttcttatgtgtcct

SEQ ID NO: 7065087 - DNA, 22 bp, Homo sapiens
ctctgcttcatccaccactggc

SEQ ID NO: 7065088 - DNA, 19 bp, Homo sapiens
ctctgcttggtccatatgc

SEQ ID NO: 7065089 - DNA, 22 bp, Homo sapiens
tttctgcaacgagtctttgact

SEQ ID NO: 7065090 - DNA, 22 bp, Homo sapiens
tttctgcacatttctaaagttg

SEQ ID NO: 7065091 - DNA, 22 bp, Homo sapiens
tttctgataattttgtgaaatc

SEQ ID NO: 7065092 - DNA, 22 bp, Homo sapiens
tttctgatatactgtagaatcc

SEQ ID NO: 7065093 - DNA, 22 bp, Homo sapiens
tttctgatattcatttagaaga

SEQ ID NO: 7065094 - DNA, 19 bp, Homo sapiens
tttctgcagctcagagaag

SEQ ID NO: 7065095 - DNA, 22 bp, Homo sapiens
tttctgcagtctctcagaagcc

SEQ ID NO: 7065096 - DNA, 19 bp, Homo sapiens
tttctgtttgcttctggtt

SEQ ID NO: 7065097 - DNA, 22 bp, Homo sapiens
ctctctggcccatcctgttgcc

SEQ ID NO: 7065098 - DNA, 22 bp, Homo sapiens
ctctgacagccttcattatgca

SEQ ID NO: 7065099 - DNA, 22 bp, Homo sapiens
ctctctggacttgagtatcagc

SEQ ID NO: 7065100 - DNA, 22 bp, Homo sapiens
ctctctggacttgagtatcagc

SEQ ID NO: 7065101 - DNA, 22 bp, Homo sapiens
tttctctgctgcctgtgtcgat

SEQ ID NO: 7065102 - DNA, 22 bp, Homo sapiens
tttctctcagcctgtagaaact

SEQ ID NO: 7065103 - DNA, 22 bp, Homo sapiens
tttctctccccaagtggaattg

SEQ ID NO: 7065104 - DNA, 19 bp, Homo sapiens
tttctctccctcatcccga

SEQ ID NO: 7065105 - DNA, 19 bp, Homo sapiens
tttctctccctcatcccga

SEQ ID NO: 7065106 - DNA, 22 bp, Homo sapiens
tttctctcctccaaaccaaaga

SEQ ID NO: 7065107 - DNA, 22 bp, Homo sapiens
tttctctctacagtactttcat

SEQ ID NO: 7065108 - DNA, 22 bp, Homo sapiens
tttctctctatttagacaggta

SEQ ID NO: 7065109 - DNA, 22 bp, Homo sapiens
tttctctctgactgggagctga

SEQ ID NO: 7065110 - DNA, 16 bp, Homo sapiens
tttctctctgctattt

SEQ ID NO: 7065111 - DNA, 22 bp, Homo sapiens
tttctctctggccctgattgtc

SEQ ID NO: 7065112 - DNA, 22 bp, Homo sapiens
tttctctctggccctgattgtc

SEQ ID NO: 7065113 - DNA, 22 bp, Homo sapiens
tttctctcttaaggagtttaaa

SEQ ID NO: 7065114 - DNA, 23 bp, Homo sapiens
tttctctgagaagcagttctcta

SEQ ID NO: 7065115 - DNA, 22 bp, Homo sapiens
ctctatttatggcatctttatg

SEQ ID NO: 7065116 - DNA, 22 bp, Homo sapiens
ctctatttttcttggctagtgt

SEQ ID NO: 7065117 - DNA, 22 bp, Homo sapiens
tttctctattaggggctagctt

SEQ ID NO: 7065118 - DNA, 22 bp, Homo sapiens
ttgtttcaaatatttcagaata

SEQ ID NO: 7065119 - DNA, 22 bp, Homo sapiens
ttgtttaatgcctcatacatct

SEQ ID NO: 7065120 - DNA, 22 bp, Homo sapiens
ctccccaggttcaggaggtggg

SEQ ID NO: 7065121 - DNA, 22 bp, Homo sapiens
ctccccagcattctgacttcct

SEQ ID NO: 7065122 - DNA, 22 bp, Homo sapiens
ctccccagctcgcgggtgacgg

SEQ ID NO: 7065123 - DNA, 22 bp, Homo sapiens
ctccccagctcgcgggtgacgg

SEQ ID NO: 7065124 - DNA, 22 bp, Homo sapiens
ctcaggctgccctgacagcccc

SEQ ID NO: 7065125 - DNA, 22 bp, Homo sapiens
ctcaggctgtctaatggattag

SEQ ID NO: 7065126 - DNA, 22 bp, Homo sapiens
ctcagggaagctatggtgaggg

SEQ ID NO: 7065127 - DNA, 22 bp, Homo sapiens
ctccccacacactaggcctgat

SEQ ID NO: 7065128 - DNA, 22 bp, Homo sapiens
ctcctcagctgggaggagtccc

SEQ ID NO: 7065129 - DNA, 21 bp, Homo sapiens
ctcctcaggaccagccacagg

SEQ ID NO: 7065130 - DNA, 21 bp, Homo sapiens
ctcctcaggaccagccacagg

SEQ ID NO: 7065131 - DNA, 22 bp, Homo sapiens
ctcctcagtcaggtctagggtc

SEQ ID NO: 7065132 - DNA, 19 bp, Homo sapiens
ctcctcagtcccagaggtc

SEQ ID NO: 7065133 - DNA, 19 bp, Homo sapiens
ctcctcagtcccagaggtc

SEQ ID NO: 7065134 - DNA, 22 bp, Homo sapiens
ctccctggctttgtcctgaggc

SEQ ID NO: 7065135 - DNA, 22 bp, Homo sapiens
ctccctggcacagcgagaggtt

SEQ ID NO: 7065136 - DNA, 22 bp, Homo sapiens
ctccctgacctggattccaggc

SEQ ID NO: 7065137 - DNA, 22 bp, Homo sapiens
ctccctgcttgtttcccttcag

SEQ ID NO: 7065138 - DNA, 22 bp, Homo sapiens
tttacaattggttttctctaat

SEQ ID NO: 7065139 - DNA, 22 bp, Homo sapiens
tttacaattggttttctctaat

SEQ ID NO: 7065140 - DNA, 22 bp, Homo sapiens
tttacacaaaagatagcacacc

SEQ ID NO: 7065141 - DNA, 20 bp, Homo sapiens
ctcctcagttccatgggagg

SEQ ID NO: 7065142 - DNA, 22 bp, Homo sapiens
tttacacaaaagatagcacacc

SEQ ID NO: 7065143 - DNA, 22 bp, Homo sapiens
tttacacaaaagatagcacacc

SEQ ID NO: 7065144 - DNA, 22 bp, Homo sapiens
tttacacaaaatgttagtagat

SEQ ID NO: 7065145 - DNA, 22 bp, Homo sapiens
tttacacagaggacactgggct

SEQ ID NO: 7065146 - DNA, 22 bp, Homo sapiens
tttacacataaatgtgtagaca

SEQ ID NO: 7065147 - DNA, 22 bp, Homo sapiens
ctcctgctcctgcttgcaagga

SEQ ID NO: 7065148 - DNA, 22 bp, Homo sapiens
ctcctggacatggagcggagga

SEQ ID NO: 7065149 - DNA, 22 bp, Homo sapiens
tttatatccatctttgaagtaa

SEQ ID NO: 7065150 - DNA, 22 bp, Homo sapiens
tttatatctggagttgctagga

SEQ ID NO: 7065151 - DNA, 22 bp, Homo sapiens
tttatatcttatgtcatttcaa

SEQ ID NO: 7065152 - DNA, 18 bp, Homo sapiens
tttatatggatagagacc

SEQ ID NO: 7065153 - DNA, 22 bp, Homo sapiens
tttatatgtttgtacaattaag

SEQ ID NO: 7065154 - DNA, 22 bp, Homo sapiens
tttatatgtttgtacaattaag

SEQ ID NO: 7065155 - DNA, 22 bp, Homo sapiens
ctctaaatccacggtatagttg

SEQ ID NO: 7065156 - DNA, 22 bp, Homo sapiens
ctctaaatccaaataagtgtcc

SEQ ID NO: 7065157 - DNA, 22 bp, Homo sapiens
ctccttcctggttagcacctta

SEQ ID NO: 7065158 - DNA, 22 bp, Homo sapiens
ctcgttgctgaagccaaagtca

SEQ ID NO: 7065159 - DNA, 22 bp, Homo sapiens
tttcaaataccataaacctaat

SEQ ID NO: 7065160 - DNA, 22 bp, Homo sapiens
tttcaaataccataaacctaat

SEQ ID NO: 7065161 - DNA, 22 bp, Homo sapiens
tttcaaagttgggaattgtaat

SEQ ID NO: 7065162 - DNA, 22 bp, Homo sapiens
tttcaaataccataaacctaat

SEQ ID NO: 7065163 - DNA, 22 bp, Homo sapiens
tttcaaatggagtcgtgaaatg

SEQ ID NO: 7065164 - DNA, 22 bp, Homo sapiens
tttatattacctggaatagctt

SEQ ID NO: 7065165 - DNA, 22 bp, Homo sapiens
ctcctgtcaataggctcctggc

SEQ ID NO: 7065166 - DNA, 22 bp, Homo sapiens
ctcctgtcagaagcatcctgag

SEQ ID NO: 7065167 - DNA, 22 bp, Homo sapiens
tttcaaagtcaatatcattacc

SEQ ID NO: 7065168 - DNA, 22 bp, Homo sapiens
ctcctgtgcatgcatctcccta

SEQ ID NO: 7065169 - DNA, 19 bp, Homo sapiens
tttttacaagtaggtgtga

SEQ ID NO: 7065170 - DNA, 22 bp, Homo sapiens
tttttctgagaatatgagagga

SEQ ID NO: 7065171 - DNA, 22 bp, Homo sapiens
tttttctgccattcaaagagga

SEQ ID NO: 7065172 - DNA, 22 bp, Homo sapiens
ttttctcccgctggctgctctt

SEQ ID NO: 7065173 - DNA, 22 bp, Homo sapiens
ttttctcctaagacccttcacc

SEQ ID NO: 7065174 - DNA, 17 bp, Homo sapiens
ttttctcctgcccattc

SEQ ID NO: 7065175 - DNA, 22 bp, Homo sapiens
ttttctcctttcaagatagcat

SEQ ID NO: 7065176 - DNA, 22 bp, Homo sapiens
ttttctctatattgtctgtgaa

SEQ ID NO: 7065177 - DNA, 22 bp, Homo sapiens
ttttcctctgtatttgaaatgc

SEQ ID NO: 7065178 - DNA, 22 bp, Homo sapiens
ttttcctctgtatttgaaatgc

SEQ ID NO: 7065179 - DNA, 22 bp, Homo sapiens
ttttcctctgttattagtgtga

SEQ ID NO: 7065180 - DNA, 19 bp, Homo sapiens
ttttcctgcctcattgttt

SEQ ID NO: 7065181 - DNA, 22 bp, Homo sapiens
ttttcctgcctgtctctagagg

SEQ ID NO: 7065182 - DNA, 22 bp, Homo sapiens
ttttcctgcctttgctcaggga

SEQ ID NO: 7065183 - DNA, 22 bp, Homo sapiens
ttttcctggagatggagttgtt

SEQ ID NO: 7065184 - DNA, 22 bp, Homo sapiens
ttttcctggggcttctggactc

SEQ ID NO: 7065185 - DNA, 22 bp, Homo sapiens
ttttcctgtccaggcaattatt

SEQ ID NO: 7065186 - DNA, 23 bp, Homo sapiens
ttttcctgtggagacatgactgg

SEQ ID NO: 7065187 - DNA, 22 bp, Homo sapiens
ttttcctgtccaggcaattatt

SEQ ID NO: 7065188 - DNA, 20 bp, Homo sapiens
ttttcctgtggtttgatatg

SEQ ID NO: 7065189 - DNA, 23 bp, Homo sapiens
ttttcctgtggagacatgactgg

SEQ ID NO: 7065190 - DNA, 22 bp, Homo sapiens
ttttcctgttaaatctgggcac

SEQ ID NO: 7065191 - DNA, 22 bp, Homo sapiens
ttttctcaggtgcttatctaag

SEQ ID NO: 7065192 - DNA, 22 bp, Homo sapiens
ttttctcaggtgcttatctaag

SEQ ID NO: 7065193 - DNA, 22 bp, Homo sapiens
ctgaaaaatatgttttggagaa

SEQ ID NO: 7065194 - DNA, 22 bp, Homo sapiens
ctgaaacattgcaataacaaag

SEQ ID NO: 7065195 - DNA, 22 bp, Homo sapiens
tttttctggataactgtatctc

SEQ ID NO: 7065196 - DNA, 20 bp, Homo sapiens
tttttctgggcttccatagc

SEQ ID NO: 7065197 - DNA, 20 bp, Homo sapiens
tttttctgggcttccatagc

SEQ ID NO: 7065198 - DNA, 22 bp, Homo sapiens
tttttctgtctcttacattgca

SEQ ID NO: 7065199 - DNA, 22 bp, Homo sapiens
tttttcttaaatgtgggttggc

SEQ ID NO: 7065200 - DNA, 22 bp, Homo sapiens
tttttcttaaatgtgggttggc

SEQ ID NO: 7065201 - DNA, 22 bp, Homo sapiens
tttttcttaaatgtgggttggc

SEQ ID NO: 7065202 - DNA, 22 bp, Homo sapiens
tttttcttgtgctggatctaat

SEQ ID NO: 7065203 - DNA, 22 bp, Homo sapiens
ctgaaaaacgggatttggctgg

SEQ ID NO: 7065204 - DNA, 22 bp, Homo sapiens
ctgaaggaggtagagtgacata

SEQ ID NO: 7065205 - DNA, 22 bp, Homo sapiens
ctgaaggagcatagtcagtttt

SEQ ID NO: 7065206 - DNA, 22 bp, Homo sapiens
ctgaaggacacgtgaggagcca

SEQ ID NO: 7065207 - DNA, 22 bp, Homo sapiens
ctgaagtcagatggcacaaggt

SEQ ID NO: 7065208 - DNA, 22 bp, Homo sapiens
ctgaagtcatacactgttctga

SEQ ID NO: 7065209 - DNA, 22 bp, Homo sapiens
ctgaaggctgaggctgtgttgt

SEQ ID NO: 7065210 - DNA, 19 bp, Homo sapiens
ctgaagtcttttcagctgg

SEQ ID NO: 7065211 - DNA, 22 bp, Homo sapiens
ctgagctgggagtagagactct

SEQ ID NO: 7065212 - DNA, 22 bp, Homo sapiens
ctgagccttgatgtcccttgtc

SEQ ID NO: 7065213 - DNA, 22 bp, Homo sapiens
ctgagcgcgggacctgaggctg

SEQ ID NO: 7065214 - DNA, 20 bp, Homo sapiens
ctgagagtctgtgcttagtc

SEQ ID NO: 7065215 - DNA, 20 bp, Homo sapiens
ctgagagtctgtgcttagtc

SEQ ID NO: 7065216 - DNA, 22 bp, Homo sapiens
ctgagagtgctctttgatgtca

SEQ ID NO: 7065217 - DNA, 22 bp, Homo sapiens
ctgagagtgtggcttccaggcc

SEQ ID NO: 7065218 - DNA, 22 bp, Homo sapiens
ctgagatcccaggcagggtggc

SEQ ID NO: 7065219 - DNA, 22 bp, Homo sapiens
ctgagatctttatacgaggcac

SEQ ID NO: 7065220 - DNA, 22 bp, Homo sapiens
ctgagatggagtttcgctcttc

SEQ ID NO: 7065221 - DNA, 22 bp, Homo sapiens
ctgagatggagttttgctcttg

SEQ ID NO: 7065222 - DNA, 22 bp, Homo sapiens
ctgagatggccactgggtctca

SEQ ID NO: 7065223 - DNA, 22 bp, Homo sapiens
ctgaataatattccattatgag

SEQ ID NO: 7065224 - DNA, 22 bp, Homo sapiens
ctgaataattttatagttgctg

SEQ ID NO: 7065225 - DNA, 22 bp, Homo sapiens
ctgaatatcatttacatttgga

SEQ ID NO: 7065226 - DNA, 22 bp, Homo sapiens
ctgagagatcaagccacaggat

SEQ ID NO: 7065227 - DNA, 22 bp, Homo sapiens
ctgagagatgatatagcttaat

SEQ ID NO: 7065228 - DNA, 22 bp, Homo sapiens
ctgagaggtaagcagcgcagtg

SEQ ID NO: 7065229 - DNA, 22 bp, Homo sapiens
ctgagaggtaagcagcgcagtg

SEQ ID NO: 7065230 - DNA, 22 bp, Homo sapiens
ctgagaggtaagcagcgcagtg

SEQ ID NO: 7065231 - DNA, 22 bp, Homo sapiens
ctgagaggtaatcacacaaaat

SEQ ID NO: 7065232 - DNA, 22 bp, Homo sapiens
ctgagagtagctggagaacatt

SEQ ID NO: 7065233 - DNA, 22 bp, Homo sapiens
ctgagagtattggcaggcttgg

SEQ ID NO: 7065234 - DNA, 22 bp, Homo sapiens
ctgagagtattggcaggcttgg

SEQ ID NO: 7065235 - DNA, 22 bp, Homo sapiens
ctgagctgttactctgtcctcg

SEQ ID NO: 7065236 - DNA, 22 bp, Homo sapiens
ctgagctgtttaatcccagata

SEQ ID NO: 7065237 - DNA, 22 bp, Homo sapiens
ctgagcttaaccctgttagcaa

SEQ ID NO: 7065238 - DNA, 22 bp, Homo sapiens
ctgagcttcagtgcactgggag

SEQ ID NO: 7065239 - DNA, 22 bp, Homo sapiens
ctgaggaaagtattgcctggtg

SEQ ID NO: 7065240 - DNA, 22 bp, Homo sapiens
ctgaggaagaggtaccatttgt

SEQ ID NO: 7065241 - DNA, 22 bp, Homo sapiens
ctgaggaaggctgggggcatcc

SEQ ID NO: 7065242 - DNA, 22 bp, Homo sapiens
ctgaggaatgagtgaggagcca

SEQ ID NO: 7065243 - DNA, 22 bp, Homo sapiens
ctgaggacattgatgaggcaat

SEQ ID NO: 7065244 - DNA, 22 bp, Homo sapiens
ctgaggacattgatgaggcaat

SEQ ID NO: 7065245 - DNA, 18 bp, Homo sapiens
ctgaggctggcaggagcc

SEQ ID NO: 7065246 - DNA, 18 bp, Homo sapiens
ctgaggctggcaggagcc

SEQ ID NO: 7065247 - DNA, 22 bp, Homo sapiens
ctgaggctgggcatggggtcca

SEQ ID NO: 7065248 - DNA, 22 bp, Homo sapiens
ctgaggctgggcatggggtcca

SEQ ID NO: 7065249 - DNA, 22 bp, Homo sapiens
ctgagggagaagtcacgggcag

SEQ ID NO: 7065250 - DNA, 18 bp, Homo sapiens
ctgagggcaacagaggct

SEQ ID NO: 7065251 - DNA, 18 bp, Homo sapiens
ctgagggcaacagaggct

SEQ ID NO: 7065252 - DNA, 22 bp, Homo sapiens
ctgagggcaccgacagagtgga

SEQ ID NO: 7065253 - DNA, 22 bp, Homo sapiens
ctgagggcagtgatgaaggtga

SEQ ID NO: 7065254 - DNA, 22 bp, Homo sapiens
ctgagggcatgaacattccata

SEQ ID NO: 7065255 - DNA, 22 bp, Homo sapiens
ctgagggccctgaagcttggca

SEQ ID NO: 7065256 - DNA, 22 bp, Homo sapiens
ctgcagtatgagctacccaggt

SEQ ID NO: 7065257 - DNA, 22 bp, Homo sapiens
ctgcagtgcaagcccagatgga

SEQ ID NO: 7065258 - DNA, 22 bp, Homo sapiens
ctgcagtgttctggaatgcatt

SEQ ID NO: 7065259 - DNA, 22 bp, Homo sapiens
ctgcagtgttctggaatgcatt

SEQ ID NO: 7065260 - DNA, 22 bp, Homo sapiens
ctgcagttctcaatttctattg

SEQ ID NO: 7065261 - DNA, 22 bp, Homo sapiens
ctgcagtttgaccttgttttct

SEQ ID NO: 7065262 - DNA, 22 bp, Homo sapiens
ctgcatatcaaattactcctgg

SEQ ID NO: 7065263 - DNA, 22 bp, Homo sapiens
ctgcatatgagaataggagaaa

SEQ ID NO: 7065264 - DNA, 22 bp, Homo sapiens
ctgcatatgagaataggagaaa

SEQ ID NO: 7065265 - DNA, 22 bp, Homo sapiens
ctgcatatgatagatgccttgc

SEQ ID NO: 7065266 - DNA, 22 bp, Homo sapiens
ctgcatatgatagatgccttgc

SEQ ID NO: 7065267 - DNA, 22 bp, Homo sapiens
ctgcatatgatagatgccttgc

SEQ ID NO: 7065268 - DNA, 23 bp, Homo sapiens
ctgcatatggaggttagcaactc

SEQ ID NO: 7065269 - DNA, 22 bp, Homo sapiens
ctgcaggttgagcagccaggtt

SEQ ID NO: 7065270 - DNA, 22 bp, Homo sapiens
ctgcaggtctctgtgtgcattc

SEQ ID NO: 7065271 - DNA, 22 bp, Homo sapiens
ctgagggcttccttgtcccggg

SEQ ID NO: 7065272 - DNA, 21 bp, Homo sapiens
ctgagggccgcagctgggctc

SEQ ID NO: 7065273 - DNA, 22 bp, Homo sapiens
ctgagggccttctatgctgagc

SEQ ID NO: 7065274 - DNA, 22 bp, Homo sapiens
ctgagggccttggctcctgccc

SEQ ID NO: 7065275 - DNA, 22 bp, Homo sapiens
ctgagggctggagctgaggcct

SEQ ID NO: 7065276 - DNA, 22 bp, Homo sapiens
ctgagggctggagctgaggcct

SEQ ID NO: 7065277 - DNA, 22 bp, Homo sapiens
ctgagggctggagctgaggcct

SEQ ID NO: 7065278 - DNA, 23 bp, Homo sapiens
ctgagggctggtctgaagtctgc

SEQ ID NO: 7065279 - DNA, 22 bp, Homo sapiens
ctgcccctggtgatggacgcca

SEQ ID NO: 7065280 - DNA, 22 bp, Homo sapiens
ctgccctgagtcatgccagatg

SEQ ID NO: 7065281 - DNA, 23 bp, Homo sapiens
ctgccctgatcttgatctattgt

SEQ ID NO: 7065282 - DNA, 22 bp, Homo sapiens
ctgccctgcagctccacggact

SEQ ID NO: 7065283 - DNA, 22 bp, Homo sapiens
ctgccctgcttgatgacagcga

SEQ ID NO: 7065284 - DNA, 22 bp, Homo sapiens
ctgccctggccactgtgcccag

SEQ ID NO: 7065285 - DNA, 22 bp, Homo sapiens
ctgccctgggagtacctgtcct

SEQ ID NO: 7065286 - DNA, 22 bp, Homo sapiens
ctgcctctattcactgaggcag

SEQ ID NO: 7065287 - DNA, 22 bp, Homo sapiens
ctgcctctgttgggcatggtct

SEQ ID NO: 7065288 - DNA, 22 bp, Homo sapiens
ctgctccagtagccccatgtgg

SEQ ID NO: 7065289 - DNA, 22 bp, Homo sapiens
ctgctcctccccatcaggcagc

SEQ ID NO: 7065290 - DNA, 22 bp, Homo sapiens
ctgctcctggtcatcctccact

SEQ ID NO: 7065291 - DNA, 22 bp, Homo sapiens
ctgctccaagccagccctgcag

SEQ ID NO: 7065292 - DNA, 22 bp, Homo sapiens
ctgctccacacctccatttcct

SEQ ID NO: 7065293 - DNA, 22 bp, Homo sapiens
ctgctccagacacctgcagggg

SEQ ID NO: 7065294 - DNA, 22 bp, Homo sapiens
ctgcctctgttgggcatggtct

SEQ ID NO: 7065295 - DNA, 22 bp, Homo sapiens
ctgcctcttaagtggatggagt

SEQ ID NO: 7065296 - DNA, 22 bp, Homo sapiens
ctgcctcttgacagatcgtggc

SEQ ID NO: 7065297 - DNA, 22 bp, Homo sapiens
ctgcctcttgacagatcgtggc

SEQ ID NO: 7065298 - DNA, 22 bp, Homo sapiens
ctgcctgcactgcctggctcca

SEQ ID NO: 7065299 - DNA, 22 bp, Homo sapiens
ctgcctgcactgcctggctcca

SEQ ID NO: 7065300 - DNA, 22 bp, Homo sapiens
ctgcctgcaggacacctcgcta

SEQ ID NO: 7065301 - DNA, 22 bp, Homo sapiens
ctgcctgcaggacacctcgcta

SEQ ID NO: 7065302 - DNA, 22 bp, Homo sapiens
ctgcctgcatcccacagtgggg

SEQ ID NO: 7065303 - DNA, 22 bp, Homo sapiens
ctgcctgcatcccacagtgggg

SEQ ID NO: 7065304 - DNA, 22 bp, Homo sapiens
ctgcctgcatgctgccatagct

SEQ ID NO: 7065305 - DNA, 22 bp, Homo sapiens
ctgcctgccacgttcagctgta

SEQ ID NO: 7065306 - DNA, 22 bp, Homo sapiens
ctgcctgccacgttcagctgta

SEQ ID NO: 7065307 - DNA, 22 bp, Homo sapiens
ctgcctgcctggagacagatgg

SEQ ID NO: 7065308 - DNA, 22 bp, Homo sapiens
ctgcctgccttggcctccagga

SEQ ID NO: 7065309 - DNA, 22 bp, Homo sapiens
ctgcctgccttggcctccagga

SEQ ID NO: 7065310 - DNA, 22 bp, Homo sapiens
ctgcctgcgccaccaccacgtc

SEQ ID NO: 7065311 - DNA, 22 bp, Homo sapiens
ctgctgggaaggtctgctcagt

SEQ ID NO: 7065312 - DNA, 22 bp, Homo sapiens
ctgctgtgagtttggaggtcta

SEQ ID NO: 7065313 - DNA, 20 bp, Homo sapiens
ctgctgtgattccctcctcc

SEQ ID NO: 7065314 - DNA, 22 bp, Homo sapiens
ctgctggaagtttgctgtggat

SEQ ID NO: 7065315 - DNA, 22 bp, Homo sapiens
ctgctggcaagcccagttggag

SEQ ID NO: 7065316 - DNA, 22 bp, Homo sapiens
ctgctgctgagagctcagcctg

SEQ ID NO: 7065317 - DNA, 22 bp, Homo sapiens
ctgctgctgctatctacccagg

SEQ ID NO: 7065318 - DNA, 20 bp, Homo sapiens
ctgctgccctgtcagcctct

SEQ ID NO: 7065319 - DNA, 20 bp, Homo sapiens
ctgctgccctgtcagcctct

SEQ ID NO: 7065320 - DNA, 22 bp, Homo sapiens
ctgctgccggcgagcctccctt

SEQ ID NO: 7065321 - DNA, 20 bp, Homo sapiens
ctgctgccctgtcagcctct

SEQ ID NO: 7065322 - DNA, 22 bp, Homo sapiens
ctgctgcccctgagctcagcct

SEQ ID NO: 7065323 - DNA, 22 bp, Homo sapiens
ctgctctaactgcattagtttt

SEQ ID NO: 7065324 - DNA, 22 bp, Homo sapiens
ctgctctaactgcattagtttt

SEQ ID NO: 7065325 - DNA, 22 bp, Homo sapiens
ctgctctaatatcagatagact

SEQ ID NO: 7065326 - DNA, 22 bp, Homo sapiens
ctgctctagagagcattagtca

SEQ ID NO: 7065327 - DNA, 22 bp, Homo sapiens
ctgctctaggttcctgcatatg

SEQ ID NO: 7065328 - DNA, 22 bp, Homo sapiens
ctgctctccccaggccagtctg

SEQ ID NO: 7065329 - DNA, 19 bp, Homo sapiens
ctgctctccttgacttgga

SEQ ID NO: 7065330 - DNA, 19 bp, Homo sapiens
ctgctctccttgacttgga

SEQ ID NO: 7065331 - DNA, 22 bp, Homo sapiens
ctgctctgaagccaggattctg

SEQ ID NO: 7065332 - DNA, 22 bp, Homo sapiens
ttccactggctttcagtgatct

SEQ ID NO: 7065333 - DNA, 22 bp, Homo sapiens
cgtctgcccgactgttcttcac

SEQ ID NO: 7065334 - DNA, 22 bp, Homo sapiens
cgtctgcctaaggactgccttc

SEQ ID NO: 7065335 - DNA, 22 bp, Homo sapiens
cgtgaaatgagttgaattattg

SEQ ID NO: 7065336 - DNA, 22 bp, Homo sapiens
ttcctaacaaacttcagtgaat

SEQ ID NO: 7065337 - DNA, 22 bp, Homo sapiens
ttcctaacaaacttcagtgaat

SEQ ID NO: 7065338 - DNA, 22 bp, Homo sapiens
ttcctccagcctggagcacttc

SEQ ID NO: 7065339 - DNA, 22 bp, Homo sapiens
ttcctcctacgcttatcacttt

SEQ ID NO: 7065340 - DNA, 17 bp, Homo sapiens
ttcctcctcaccatgtt

SEQ ID NO: 7065341 - DNA, 22 bp, Homo sapiens
ttcctctcaacatgcctgccgg

SEQ ID NO: 7065342 - DNA, 22 bp, Homo sapiens
ttcctctcctcacatgagtcac

SEQ ID NO: 7065343 - DNA, 22 bp, Homo sapiens
ttcctctcgctctccggggccc

SEQ ID NO: 7065344 - DNA, 22 bp, Homo sapiens
ttcctctgaaatggcttggaaa

SEQ ID NO: 7065345 - DNA, 21 bp, Homo sapiens
ttcctctgcaactgatgctca

SEQ ID NO: 7065346 - DNA, 22 bp, Homo sapiens
ctaaatgatggatttaaacttt

SEQ ID NO: 7065347 - DNA, 22 bp, Homo sapiens
cggctgggttcggctgcaggcc

SEQ ID NO: 7065348 - DNA, 22 bp, Homo sapiens
cggctgggttcggctgcaggcc

SEQ ID NO: 7065349 - DNA, 22 bp, Homo sapiens
cggctggtgtcgggcacagcaa

SEQ ID NO: 7065350 - DNA, 22 bp, Homo sapiens
cggctggtgtcgggcacagcaa

SEQ ID NO: 7065351 - DNA, 22 bp, Homo sapiens
cggctgggtagaggtgccgggt

SEQ ID NO: 7065352 - DNA, 18 bp, Homo sapiens
ttcagtttctagttcctt

SEQ ID NO: 7065353 - DNA, 22 bp, Homo sapiens
ttcagtttcgttatctatgaga

SEQ ID NO: 7065354 - DNA, 22 bp, Homo sapiens
ttcagtttcgttatctatgaga

SEQ ID NO: 7065355 - DNA, 22 bp, Homo sapiens
ctacataatctggatttgtctg

SEQ ID NO: 7065356 - DNA, 22 bp, Homo sapiens
ctacatgaactcttaagtcaca

SEQ ID NO: 7065357 - DNA, 22 bp, Homo sapiens
ctacatgtaggtttccttaatt

SEQ ID NO: 7065358 - DNA, 22 bp, Homo sapiens
ctacattaaattggcttactta

SEQ ID NO: 7065359 - DNA, 22 bp, Homo sapiens
ctacattaaattggcttactta

SEQ ID NO: 7065360 - DNA, 22 bp, Homo sapiens
ttctacattgtgaagttcttta

SEQ ID NO: 7065361 - DNA, 22 bp, Homo sapiens
ttctacctcagtttcccactta

SEQ ID NO: 7065362 - DNA, 22 bp, Homo sapiens
ttctacagaataaatgtttaca

SEQ ID NO: 7065363 - DNA, 22 bp, Homo sapiens
ttctacagactataactgtgat

SEQ ID NO: 7065364 - DNA, 22 bp, Homo sapiens
ctaaatgtcagagtagcttgca

SEQ ID NO: 7065365 - DNA, 22 bp, Homo sapiens
ctaaatgttttatcttcctggc

SEQ ID NO: 7065366 - DNA, 22 bp, Homo sapiens
ctaaattatcatgagaattatg

SEQ ID NO: 7065367 - DNA, 22 bp, Homo sapiens
ctaactacaagcggggcatcct

SEQ ID NO: 7065368 - DNA, 22 bp, Homo sapiens
ttctcattctgactcagtgtag

SEQ ID NO: 7065369 - DNA, 22 bp, Homo sapiens
ttctcaggtgaggctgaggctg

SEQ ID NO: 7065370 - DNA, 22 bp, Homo sapiens
ttctatttttgtggaactgtag

SEQ ID NO: 7065371 - DNA, 22 bp, Homo sapiens
ctagttctagatccctgaggaa

SEQ ID NO: 7065372 - DNA, 22 bp, Homo sapiens
ctagtggaaactaactggaatt

SEQ ID NO: 7065373 - DNA, 19 bp, Homo sapiens
ctagggcttggcagcaggc

SEQ ID NO: 7065374 - DNA, 22 bp, Homo sapiens
ttctcctggggccgtgatgtga

SEQ ID NO: 7065375 - DNA, 21 bp, Homo sapiens
ttctcctgttttgcaccacag

SEQ ID NO: 7065376 - DNA, 21 bp, Homo sapiens
ttcttcatgatgattaatggc

SEQ ID NO: 7065377 - DNA, 22 bp, Homo sapiens
ttcttcagtgcccctctagtag

SEQ ID NO: 7065378 - DNA, 21 bp, Homo sapiens
ttgaaggatcacttctgtacc

SEQ ID NO: 7065379 - DNA, 19 bp, Homo sapiens
ttgaatatgcaaactgaag

SEQ ID NO: 7065380 - DNA, 22 bp, Homo sapiens
ctcactggcaagactacaggtg

SEQ ID NO: 7065381 - DNA, 22 bp, Homo sapiens
ctcactgtccaacaggctttac

SEQ ID NO: 7065382 - DNA, 22 bp, Homo sapiens
ctcactgtctgtactagctgat

SEQ ID NO: 7065383 - DNA, 22 bp, Homo sapiens
ctcactgtgacctcagcagaca

SEQ ID NO: 7065384 - DNA, 22 bp, Homo sapiens
ctcactgtgccttttcccaaac

SEQ ID NO: 7065385 - DNA, 22 bp, Homo sapiens
ctcactgtttaatagctggatc

SEQ ID NO: 7065386 - DNA, 22 bp, Homo sapiens
ctcagaaaacctctttcttgat

SEQ ID NO: 7065387 - DNA, 20 bp, Homo sapiens
ctcagaaaagctaaggagaa

SEQ ID NO: 7065388 - DNA, 19 bp, Homo sapiens
ttcttacaacaccctggga

SEQ ID NO: 7065389 - DNA, 22 bp, Homo sapiens
ttcttaatcccacaaatcttca

SEQ ID NO: 7065390 - DNA, 22 bp, Homo sapiens
ttcttaatacctattttctacc

SEQ ID NO: 7065391 - DNA, 22 bp, Homo sapiens
ttcttacaagtattccaggtcc

SEQ ID NO: 7065392 - DNA, 22 bp, Homo sapiens
ttcttcaggatacgtcatccag

SEQ ID NO: 7065393 - DNA, 22 bp, Homo sapiens
ttcttcagggaagcttgttaat

SEQ ID NO: 7065394 - DNA, 22 bp, Homo sapiens
ttcttcagtctaggcctttctt

SEQ ID NO: 7065395 - DNA, 22 bp, Homo sapiens
ttcttaagcagtttggcatgtt

SEQ ID NO: 7065396 - DNA, 22 bp, Homo sapiens
ttctgtctccctgatgtagagc

SEQ ID NO: 7065397 - DNA, 22 bp, Homo sapiens
ttctgaaataggagatagctgt

SEQ ID NO: 7065398 - DNA, 22 bp, Homo sapiens
ttctgaaattcgactatccaat

SEQ ID NO: 7065399 - DNA, 22 bp, Homo sapiens
ctataaatctacccagcattgg

SEQ ID NO: 7065400 - DNA, 22 bp, Homo sapiens
ttctgaaaattgggtcatactt

SEQ ID NO: 7065401 - DNA, 22 bp, Homo sapiens
ttctgaaaattgggtcatactt

SEQ ID NO: 7065402 - DNA, 22 bp, Homo sapiens
ttctgaaaccactgaccaacta

SEQ ID NO: 7065403 - DNA, 20 bp, Homo sapiens
ttctgaaagcagcagaggga

SEQ ID NO: 7065404 - DNA, 22 bp, Homo sapiens
ttgcctattgttcttacatgtt

SEQ ID NO: 7065405 - DNA, 22 bp, Homo sapiens
ttgcactccagcccgagcaaca

SEQ ID NO: 7065406 - DNA, 22 bp, Homo sapiens
ttgcactagtctcagaggcaaa

SEQ ID NO: 7065407 - DNA, 22 bp, Homo sapiens
ctcaggccttgaagtcttttct

SEQ ID NO: 7065408 - DNA, 22 bp, Homo sapiens
ctcaggcctgagtggcagtccc

SEQ ID NO: 7065409 - DNA, 22 bp, Homo sapiens
ttgctggcttgaagatagagga

SEQ ID NO: 7065410 - DNA, 22 bp, Homo sapiens
ctcaggctaagaaggccaagtg

SEQ ID NO: 7065411 - DNA, 22 bp, Homo sapiens
ttgatttttttctactatgcgc

SEQ ID NO: 7065412 - DNA, 22 bp, Homo sapiens
ctcagaaacggagctgccattt

SEQ ID NO: 7065413 - DNA, 22 bp, Homo sapiens
ctcagaaagcaatctggtgagg

SEQ ID NO: 7065414 - DNA, 22 bp, Homo sapiens
ttgcaaaagccgaggcactcca

SEQ ID NO: 7065415 - DNA, 22 bp, Homo sapiens
ctcaggccattcttccagctgc

SEQ ID NO: 7065416 - DNA, 22 bp, Homo sapiens
ctcagccccaatttgccctctt

SEQ ID NO: 7065417 - DNA, 22 bp, Homo sapiens
ctcaggagtagttcagcagctg

SEQ ID NO: 7065418 - DNA, 22 bp, Homo sapiens
ctcagccatgcaacatgctggg

SEQ ID NO: 7065419 - DNA, 22 bp, Homo sapiens
ttcaaaaaggtatgttcaagtc

SEQ ID NO: 7065420 - DNA, 22 bp, Homo sapiens
ttatttttaaaagttcacacag

SEQ ID NO: 7065421 - DNA, 22 bp, Homo sapiens
ttcaaaacagctagatattgga

SEQ ID NO: 7065422 - DNA, 21 bp, Homo sapiens
cgcagagcgaacttgcggcgc

SEQ ID NO: 7065423 - DNA, 22 bp, Homo sapiens
cgcagagggcaggcagtgctgg

SEQ ID NO: 7065424 - DNA, 22 bp, Homo sapiens
cgcagagggcaggcagtgctgg

SEQ ID NO: 7065425 - DNA, 22 bp, Homo sapiens
cgcagagggcaggcagtgctgg

SEQ ID NO: 7065426 - DNA, 19 bp, Homo sapiens
cgcagagggcttctgagag

SEQ ID NO: 7065427 - DNA, 22 bp, Homo sapiens
ttatttttaaaagttcacacag

SEQ ID NO: 7065428 - DNA, 22 bp, Homo sapiens
ttatttcattgatttctaagac

SEQ ID NO: 7065429 - DNA, 22 bp, Homo sapiens
ttattcagattggctacaggat

SEQ ID NO: 7065430 - DNA, 22 bp, Homo sapiens
ttatttcatgtaaaatttatgt

SEQ ID NO: 7065431 - DNA, 22 bp, Homo sapiens
ttattattttgtgtacagcaaa

SEQ ID NO: 7065432 - DNA, 22 bp, Homo sapiens
ttattattttgtgtacagcaaa

SEQ ID NO: 7065433 - DNA, 22 bp, Homo sapiens
ttattcacatgggctcattcta

SEQ ID NO: 7065434 - DNA, 22 bp, Homo sapiens
ttattattgtggttgcattatc

SEQ ID NO: 7065435 - DNA, 22 bp, Homo sapiens
ttattattgtggttgcattatc

SEQ ID NO: 7065436 - DNA, 22 bp, Homo sapiens
cgatgggggcagtgttacattg

SEQ ID NO: 7065437 - DNA, 22 bp, Homo sapiens
cgatggagaggtcctgatagtt

SEQ ID NO: 7065438 - DNA, 22 bp, Homo sapiens
cgatggaattggaaagaggaat

SEQ ID NO: 7065439 - DNA, 22 bp, Homo sapiens
cgagtgtccctaccatttccta

SEQ ID NO: 7065440 - DNA, 22 bp, Homo sapiens
cgagtgtctgctatgggctgag

SEQ ID NO: 7065441 - DNA, 22 bp, Homo sapiens
cgaggtgggcagatcacagagt

SEQ ID NO: 7065442 - DNA, 17 bp, Homo sapiens
cgagggcttgctggctc

SEQ ID NO: 7065443 - DNA, 22 bp, Homo sapiens
cctttgcattctagatgtttag

SEQ ID NO: 7065444 - DNA, 22 bp, Homo sapiens
ttatgtatgaatatagtagaag

SEQ ID NO: 7065445 - DNA, 22 bp, Homo sapiens
ttatgggagcaattggggaggt

SEQ ID NO: 7065446 - DNA, 23 bp, Homo sapiens
ccttctgttaaccatctgggggg

SEQ ID NO: 7065447 - DNA, 22 bp, Homo sapiens
ccttctgtgtgcccacgtttat

SEQ ID NO: 7065448 - DNA, 22 bp, Homo sapiens
ccttctgtctccctcatattga

SEQ ID NO: 7065449 - DNA, 22 bp, Homo sapiens
ccttctgagcttcaatttcagt

SEQ ID NO: 7065450 - DNA, 22 bp, Homo sapiens
ccttctgctggtcatcccagtg

SEQ ID NO: 7065451 - DNA, 22 bp, Homo sapiens
ttaccaagctctgcatgttaag

SEQ ID NO: 7065452 - DNA, 22 bp, Homo sapiens
ttacagaagagtaacttggcaa

SEQ ID NO: 7065453 - DNA, 21 bp, Homo sapiens
ccttctccacagggtctccgg

SEQ ID NO: 7065454 - DNA, 21 bp, Homo sapiens
ccttctcttgcttcagcttca

SEQ ID NO: 7065455 - DNA, 22 bp, Homo sapiens
cctttaagtcctcttttatatt

SEQ ID NO: 7065456 - DNA, 22 bp, Homo sapiens
ccttgggtgtttaatagatata

SEQ ID NO: 7065457 - DNA, 22 bp, Homo sapiens
ccttgggttccaagtcactgaa

SEQ ID NO: 7065458 - DNA, 22 bp, Homo sapiens
ccttggtgctctgctgggatgg

SEQ ID NO: 7065459 - DNA, 23 bp, Homo sapiens
ccttgtctggctggctggacttt

SEQ ID NO: 7065460 - DNA, 22 bp, Homo sapiens
ccttgtcttgcacagatgcagc

SEQ ID NO: 7065461 - DNA, 22 bp, Homo sapiens
cctttaaatggatgttcaactg

SEQ ID NO: 7065462 - DNA, 22 bp, Homo sapiens
ttacctgcaactcccatggtga

SEQ ID NO: 7065463 - DNA, 22 bp, Homo sapiens
ccttgcctcattgtgcttctcc

SEQ ID NO: 7065464 - DNA, 19 bp, Homo sapiens
ccttgcctgtccctgcagc

SEQ ID NO: 7065465 - DNA, 22 bp, Homo sapiens
ccttggctggaattactctggg

SEQ ID NO: 7065466 - DNA, 22 bp, Homo sapiens
ccttggctggaattactctggg

SEQ ID NO: 7065467 - DNA, 21 bp, Homo sapiens
ccttggctggcatctagcacc

SEQ ID NO: 7065468 - DNA, 22 bp, Homo sapiens
ccttggcttaccttctgtgtgg

SEQ ID NO: 7065469 - DNA, 22 bp, Homo sapiens
ccttggcttccttccctctaga

SEQ ID NO: 7065470 - DNA, 22 bp, Homo sapiens
ccttggcttgtgggctgcagcc

SEQ ID NO: 7065471 - DNA, 22 bp, Homo sapiens
ccttgggaccctgctggaggtt

SEQ ID NO: 7065472 - DNA, 22 bp, Homo sapiens
ccttgggagaaattgcagagtc

SEQ ID NO: 7065473 - DNA, 21 bp, Homo sapiens
ccttgggatgcaagtgagact

SEQ ID NO: 7065474 - DNA, 22 bp, Homo sapiens
ttacaatagttccttcttttgt

SEQ ID NO: 7065475 - DNA, 22 bp, Homo sapiens
ttacaatagttccttcttttgt

SEQ ID NO: 7065476 - DNA, 20 bp, Homo sapiens
ttacaagtttctaataacca

SEQ ID NO: 7065477 - DNA, 22 bp, Homo sapiens
ttacaagtgtcaggtactggca

SEQ ID NO: 7065478 - DNA, 22 bp, Homo sapiens
ttacaagtttctggcttcatcc

SEQ ID NO: 7065479 - DNA, 21 bp, Homo sapiens
ttacaaagctacagatgttgc

SEQ ID NO: 7065480 - DNA, 22 bp, Homo sapiens
ttacaagtatttaagatgctgt

SEQ ID NO: 7065481 - DNA, 22 bp, Homo sapiens
ttaatccaataacaaggttcaa

SEQ ID NO: 7065482 - DNA, 22 bp, Homo sapiens
ttaatccaatatcctggctatt

SEQ ID NO: 7065483 - DNA, 22 bp, Homo sapiens
ttaatccatggcagttattaaa

SEQ ID NO: 7065484 - DNA, 22 bp, Homo sapiens
ttaaaatctaaagcagttgtct

SEQ ID NO: 7065485 - DNA, 22 bp, Homo sapiens
ttaaaatgaatattgattagca

SEQ ID NO: 7065486 - DNA, 22 bp, Homo sapiens
ttaaaatgaatattgattagca

SEQ ID NO: 7065487 - DNA, 22 bp, Homo sapiens
ttaatatacaattttacgggct

SEQ ID NO: 7065488 - DNA, 22 bp, Homo sapiens
ttaatatgttgaaatttattag

SEQ ID NO: 7065489 - DNA, 23 bp, Homo sapiens
cctgctcaggcgtgtgccctgct

SEQ ID NO: 7065490 - DNA, 22 bp, Homo sapiens
cctgctcagagcgtcttgtgtg

SEQ ID NO: 7065491 - DNA, 22 bp, Homo sapiens
cctgctcagagcgtcttgtgtg

SEQ ID NO: 7065492 - DNA, 22 bp, Homo sapiens
cctgctcagccccagctcaccc

SEQ ID NO: 7065493 - DNA, 22 bp, Homo sapiens
cctgctcagccccagctcaccc

SEQ ID NO: 7065494 - DNA, 22 bp, Homo sapiens
cctgctccatgctcaccatcag

SEQ ID NO: 7065495 - DNA, 22 bp, Homo sapiens
cctgctcctgctattcttctgg

SEQ ID NO: 7065496 - DNA, 22 bp, Homo sapiens
tgttcccaagataagattatga

SEQ ID NO: 7065497 - DNA, 22 bp, Homo sapiens
tgttgattagtgtttagactta

SEQ ID NO: 7065498 - DNA, 19 bp, Homo sapiens
tgttgccaggtatcatgtt

SEQ ID NO: 7065499 - DNA, 22 bp, Homo sapiens
tgttgcccaggttctctcctgc

SEQ ID NO: 7065500 - DNA, 22 bp, Homo sapiens
tgttgcctggggaagctctgat

SEQ ID NO: 7065501 - DNA, 22 bp, Homo sapiens
tgttggaaaggccaggctgtgg

SEQ ID NO: 7065502 - DNA, 22 bp, Homo sapiens
tgttttcagtcatatagcaggt

SEQ ID NO: 7065503 - DNA, 22 bp, Homo sapiens
tgttttcatggagatggtggcg

SEQ ID NO: 7065504 - DNA, 21 bp, Homo sapiens
tgttttccaccttgaggcaag

SEQ ID NO: 7065505 - DNA, 22 bp, Homo sapiens
tgtttcttctcacacaaactca

SEQ ID NO: 7065506 - DNA, 22 bp, Homo sapiens
tgtttcttacgtttttagaggc

SEQ ID NO: 7065507 - DNA, 22 bp, Homo sapiens
tgtttataatatgcagtgagca

SEQ ID NO: 7065508 - DNA, 22 bp, Homo sapiens
tgtttatacctgcaacctgtca

SEQ ID NO: 7065509 - DNA, 22 bp, Homo sapiens
tgtttataccttggtataacca

SEQ ID NO: 7065510 - DNA, 22 bp, Homo sapiens
tgtttctagagaaaatatttac

SEQ ID NO: 7065511 - DNA, 22 bp, Homo sapiens
tgtttctaggtcaataattttt

SEQ ID NO: 7065512 - DNA, 22 bp, Homo sapiens
tgtttctaggtcaataattttt

SEQ ID NO: 7065513 - DNA, 22 bp, Homo sapiens
cctggggagccgcctgagcccc

SEQ ID NO: 7065514 - DNA, 22 bp, Homo sapiens
ccaggcaggcgatggtgcagtg

SEQ ID NO: 7065515 - DNA, 22 bp, Homo sapiens
ccaggcccccgagcagaagaca

SEQ ID NO: 7065516 - DNA, 22 bp, Homo sapiens
ccaggcctcccttttccagcca

SEQ ID NO: 7065517 - DNA, 22 bp, Homo sapiens
tcttctctcatgtaggagggaa

SEQ ID NO: 7065518 - DNA, 22 bp, Homo sapiens
tcttctctcctgcttggcagaa

SEQ ID NO: 7065519 - DNA, 22 bp, Homo sapiens
tcttagaaattccccagtggct

SEQ ID NO: 7065520 - DNA, 22 bp, Homo sapiens
tcttagaaattccccagtggct

SEQ ID NO: 7065521 - DNA, 22 bp, Homo sapiens
tcttagaagttcatgttccagc

SEQ ID NO: 7065522 - DNA, 22 bp, Homo sapiens
tcttagaagtttatggcacgga

SEQ ID NO: 7065523 - DNA, 17 bp, Homo sapiens
tcttctcttccagtctt

SEQ ID NO: 7065524 - DNA, 17 bp, Homo sapiens
tcttctcttccagtctt

SEQ ID NO: 7065525 - DNA, 22 bp, Homo sapiens
tcttctgagacttctctttggt

SEQ ID NO: 7065526 - DNA, 22 bp, Homo sapiens
tcttctgatgccagtaaccatg

SEQ ID NO: 7065527 - DNA, 22 bp, Homo sapiens
tcttctggatcgatcacattgt

SEQ ID NO: 7065528 - DNA, 22 bp, Homo sapiens
ccaggagggaccgcggcatccc

SEQ ID NO: 7065529 - DNA, 22 bp, Homo sapiens
ccaggcacttgtttgccaggca

SEQ ID NO: 7065530 - DNA, 22 bp, Homo sapiens
ccaggaggctcttgtccctggt

SEQ ID NO: 7065531 - DNA, 22 bp, Homo sapiens
ccaggaggctctgactggaccc

SEQ ID NO: 7065532 - DNA, 22 bp, Homo sapiens
ccaggaggctctgactggaccc

SEQ ID NO: 7065533 - DNA, 22 bp, Homo sapiens
ccaggaggcggaggttgcagtg

SEQ ID NO: 7065534 - DNA, 22 bp, Homo sapiens
ccaggaggcggaggttgcagtg

SEQ ID NO: 7065535 - DNA, 22 bp, Homo sapiens
ccaggaggcggaggttgcagcg

SEQ ID NO: 7065536 - DNA, 22 bp, Homo sapiens
ccaggaggcggaggttgcagcg

SEQ ID NO: 7065537 - DNA, 22 bp, Homo sapiens
ccaggaggcggaggttgcagtg

SEQ ID NO: 7065538 - DNA, 22 bp, Homo sapiens
ccaggcagagtgctccagaaag

SEQ ID NO: 7065539 - DNA, 22 bp, Homo sapiens
tcttaatgctagccaatagaga

SEQ ID NO: 7065540 - DNA, 17 bp, Homo sapiens
tctgttcatgcatacct

SEQ ID NO: 7065541 - DNA, 22 bp, Homo sapiens
tctgttcatgtctttttaagtg

SEQ ID NO: 7065542 - DNA, 22 bp, Homo sapiens
tctgttccatgttttgttccat

SEQ ID NO: 7065543 - DNA, 20 bp, Homo sapiens
tctgttattgcatgtacata

SEQ ID NO: 7065544 - DNA, 22 bp, Homo sapiens
ccaggagcaggagctgcagctg

SEQ ID NO: 7065545 - DNA, 22 bp, Homo sapiens
ccaggagcaggagctggacaga

SEQ ID NO: 7065546 - DNA, 22 bp, Homo sapiens
ccaggagcagggctggctgcac

SEQ ID NO: 7065547 - DNA, 22 bp, Homo sapiens
ccaggagcattaagagaacata

SEQ ID NO: 7065548 - DNA, 22 bp, Homo sapiens
ccaggagcaacttgaaggcaag

SEQ ID NO: 7065549 - DNA, 22 bp, Homo sapiens
ccaggagagcaaaggtcactct

SEQ ID NO: 7065550 - DNA, 22 bp, Homo sapiens
ccaggagcaacttgaaggcaag

SEQ ID NO: 7065551 - DNA, 22 bp, Homo sapiens
tctggggatgaggtccagtgat

SEQ ID NO: 7065552 - DNA, 22 bp, Homo sapiens
tctggggatgaggacctagatg

SEQ ID NO: 7065553 - DNA, 22 bp, Homo sapiens
tctggggagtcaaagagacctg

SEQ ID NO: 7065554 - DNA, 22 bp, Homo sapiens
tctggggagtgcctaagtggaa

SEQ ID NO: 7065555 - DNA, 22 bp, Homo sapiens
tctggggagtcaaagagacctg

SEQ ID NO: 7065556 - DNA, 22 bp, Homo sapiens
tctgggctctgtcagcacctct

SEQ ID NO: 7065557 - DNA, 21 bp, Homo sapiens
tctggggaagacatctaggat

SEQ ID NO: 7065558 - DNA, 22 bp, Homo sapiens
tctggggaccatggcatctaaa

SEQ ID NO: 7065559 - DNA, 22 bp, Homo sapiens
tctggggagcagccctggtgag

SEQ ID NO: 7065560 - DNA, 22 bp, Homo sapiens
tctggggagcagccctggtgag

SEQ ID NO: 7065561 - DNA, 22 bp, Homo sapiens
tctggggacggggcccagcaat

SEQ ID NO: 7065562 - DNA, 22 bp, Homo sapiens
tctggggagggagccacaggtc

SEQ ID NO: 7065563 - DNA, 20 bp, Homo sapiens
tctgggagggacaagtctcc

SEQ ID NO: 7065564 - DNA, 22 bp, Homo sapiens
tctgggagggagcctcagaatc

SEQ ID NO: 7065565 - DNA, 22 bp, Homo sapiens
tctgggcctgtctcagagctgg

SEQ ID NO: 7065566 - DNA, 22 bp, Homo sapiens
tctgggctctgtcagcacctct

SEQ ID NO: 7065567 - DNA, 22 bp, Homo sapiens
tcttttggaaatgatgtgcagg

SEQ ID NO: 7065568 - DNA, 22 bp, Homo sapiens
tcttttcttgcattattgcact

SEQ ID NO: 7065569 - DNA, 22 bp, Homo sapiens
tcttttcttgcattattgcact

SEQ ID NO: 7065570 - DNA, 22 bp, Homo sapiens
tcttttgggttcttatgattta

SEQ ID NO: 7065571 - DNA, 22 bp, Homo sapiens
tcttgccacttcatcccctttc

SEQ ID NO: 7065572 - DNA, 22 bp, Homo sapiens
tctttgtaaatgcctagcataa

SEQ ID NO: 7065573 - DNA, 22 bp, Homo sapiens
tcttgcacttcatgaatatgtt

SEQ ID NO: 7065574 - DNA, 22 bp, Homo sapiens
tcttgcacttcatgaatatgtt

SEQ ID NO: 7065575 - DNA, 22 bp, Homo sapiens
tcttgcaggcatgaaaggactc

SEQ ID NO: 7065576 - DNA, 19 bp, Homo sapiens
ccaggcctctggggcctgt

SEQ ID NO: 7065577 - DNA, 22 bp, Homo sapiens
ccaggcctctggctgcttagtc

SEQ ID NO: 7065578 - DNA, 22 bp, Homo sapiens
tcttttgtgccaagtaatgaat

SEQ ID NO: 7065579 - DNA, 22 bp, Homo sapiens
tgaaacagagtggatacagtga

SEQ ID NO: 7065580 - DNA, 22 bp, Homo sapiens
ccaggctgtaagagtgatgttg

SEQ ID NO: 7065581 - DNA, 22 bp, Homo sapiens
ccaggctgtgcttttcataaat

SEQ ID NO: 7065582 - DNA, 22 bp, Homo sapiens
ccaggctgtggtttagatagag

SEQ ID NO: 7065583 - DNA, 22 bp, Homo sapiens
ccaggctgtggtttagatagag

SEQ ID NO: 7065584 - DNA, 22 bp, Homo sapiens
ccaggctgtggtttagatagag

SEQ ID NO: 7065585 - DNA, 22 bp, Homo sapiens
ccaggctgttttcaaacttggg

SEQ ID NO: 7065586 - DNA, 22 bp, Homo sapiens
ccaggcttccctgagaggctgc

SEQ ID NO: 7065587 - DNA, 22 bp, Homo sapiens
tgaaatgaaacagaacatatca

SEQ ID NO: 7065588 - DNA, 22 bp, Homo sapiens
tgaaatgaagggcttgttctgg

SEQ ID NO: 7065589 - DNA, 22 bp, Homo sapiens
tgaaatgaatgtgattcgatag

SEQ ID NO: 7065590 - DNA, 22 bp, Homo sapiens
tgaaatgacaaaggtttttctt

SEQ ID NO: 7065591 - DNA, 22 bp, Homo sapiens
tgaaatgacagtcttaagctct

SEQ ID NO: 7065592 - DNA, 22 bp, Homo sapiens
tgaaatgacagtcttaagctct

SEQ ID NO: 7065593 - DNA, 21 bp, Homo sapiens
tgaaatgagaatgctgagcac

SEQ ID NO: 7065594 - DNA, 22 bp, Homo sapiens
tgaaatgagagcacagaataaa

SEQ ID NO: 7065595 - DNA, 22 bp, Homo sapiens
tgaaatgatatctgataacaaa

SEQ ID NO: 7065596 - DNA, 22 bp, Homo sapiens
tgaaatgatcagtttggttact

SEQ ID NO: 7065597 - DNA, 22 bp, Homo sapiens
tgaaatgatgtacaagaaggca

SEQ ID NO: 7065598 - DNA, 22 bp, Homo sapiens
tgaaatgagataatttaagtgc

SEQ ID NO: 7065599 - DNA, 22 bp, Homo sapiens
tgaaatgagatagataatcagg

SEQ ID NO: 7065600 - DNA, 22 bp, Homo sapiens
tgaaatgagatagataatcagg

SEQ ID NO: 7065601 - DNA, 22 bp, Homo sapiens
tgaaatgagcatttattcttta

SEQ ID NO: 7065602 - DNA, 22 bp, Homo sapiens
tgaaatgagcatttattcttta

SEQ ID NO: 7065603 - DNA, 22 bp, Homo sapiens
tgaaatgatatctgataacaaa

SEQ ID NO: 7065604 - DNA, 18 bp, Homo sapiens
ccagggatgcatggtccc

SEQ ID NO: 7065605 - DNA, 22 bp, Homo sapiens
ccagggatgctttcccaggact

SEQ ID NO: 7065606 - DNA, 22 bp, Homo sapiens
ccagggagggtcctgtggcttc

SEQ ID NO: 7065607 - DNA, 22 bp, Homo sapiens
ccagggcaacgctgtctcagag

SEQ ID NO: 7065608 - DNA, 22 bp, Homo sapiens
ccagggatgtggcagcaccata

SEQ ID NO: 7065609 - DNA, 21 bp, Homo sapiens
ccagggatgttgaactgaaag

SEQ ID NO: 7065610 - DNA, 22 bp, Homo sapiens
ccagggcaacgctgtctcagag

SEQ ID NO: 7065611 - DNA, 22 bp, Homo sapiens
ccagggcacgttgggacagtac

SEQ ID NO: 7065612 - DNA, 22 bp, Homo sapiens
ccagggcaggagaaagactcac

SEQ ID NO: 7065613 - DNA, 22 bp, Homo sapiens
ccagggcagggaccacgtgtct

SEQ ID NO: 7065614 - DNA, 22 bp, Homo sapiens
ccagggctgcctggccgtgtgt

SEQ ID NO: 7065615 - DNA, 22 bp, Homo sapiens
ccagggctgccgcatccctggt

SEQ ID NO: 7065616 - DNA, 22 bp, Homo sapiens
ccagggctgccgcatccctggt

SEQ ID NO: 7065617 - DNA, 22 bp, Homo sapiens
ccagggctgagctgtgaccatg

SEQ ID NO: 7065618 - DNA, 22 bp, Homo sapiens
ccagggctgagactgtattggg

SEQ ID NO: 7065619 - DNA, 22 bp, Homo sapiens
ccagggctctgcttctgccatg

SEQ ID NO: 7065620 - DNA, 22 bp, Homo sapiens
ccagggctctatgagggtggag

SEQ ID NO: 7065621 - DNA, 22 bp, Homo sapiens
ccagggctctatgagggtggag

SEQ ID NO: 7065622 - DNA, 22 bp, Homo sapiens
ccagggctctgcttctgccatg

SEQ ID NO: 7065623 - DNA, 22 bp, Homo sapiens
ccagggctcgggtgcttagtca

SEQ ID NO: 7065624 - DNA, 22 bp, Homo sapiens
ccagggctctatgagggtggag

SEQ ID NO: 7065625 - DNA, 22 bp, Homo sapiens
ccagggctccccagaagtaccc

SEQ ID NO: 7065626 - DNA, 22 bp, Homo sapiens
tgaagttatatatgttgaaaat

SEQ ID NO: 7065627 - DNA, 22 bp, Homo sapiens
ccagggctccattgctcatcct

SEQ ID NO: 7065628 - DNA, 22 bp, Homo sapiens
tgaagtgacctggggcagtgta

SEQ ID NO: 7065629 - DNA, 23 bp, Homo sapiens
tgaagtgaaatttcacaagggac

SEQ ID NO: 7065630 - DNA, 22 bp, Homo sapiens
ccagggcatcacatccagtgtt

SEQ ID NO: 7065631 - DNA, 22 bp, Homo sapiens
ccagtggagtttttatacccag

SEQ ID NO: 7065632 - DNA, 22 bp, Homo sapiens
ccagtggccatgcacgagcagc

SEQ ID NO: 7065633 - DNA, 22 bp, Homo sapiens
tgaggcagtgctgggaagcctg

SEQ ID NO: 7065634 - DNA, 22 bp, Homo sapiens
ccagtgcttctttgctagctgg

SEQ ID NO: 7065635 - DNA, 22 bp, Homo sapiens
ccagtggaaatgtggtcaggat

SEQ ID NO: 7065636 - DNA, 22 bp, Homo sapiens
ccagtggaattaaaaataagtg

SEQ ID NO: 7065637 - DNA, 22 bp, Homo sapiens
ccagtggacaatttctgaggaa

SEQ ID NO: 7065638 - DNA, 22 bp, Homo sapiens
ccagtggacttctccctgtggt

SEQ ID NO: 7065639 - DNA, 22 bp, Homo sapiens
ccagtgctaaggtagcctctgc

SEQ ID NO: 7065640 - DNA, 22 bp, Homo sapiens
ccagtgctaaggtagcctctgc

SEQ ID NO: 7065641 - DNA, 21 bp, Homo sapiens
ccagtgctacagctgcctgac

SEQ ID NO: 7065642 - DNA, 22 bp, Homo sapiens
ccagtgcttccaggaatacggt

SEQ ID NO: 7065643 - DNA, 22 bp, Homo sapiens
ccagtgcccagctgcccaggca

SEQ ID NO: 7065644 - DNA, 22 bp, Homo sapiens
ccagtgcccagtctccctggtc

SEQ ID NO: 7065645 - DNA, 22 bp, Homo sapiens
ccagtgcccagctgcccaggca

SEQ ID NO: 7065646 - DNA, 22 bp, Homo sapiens
ccagtgcctatctcctctggga

SEQ ID NO: 7065647 - DNA, 22 bp, Homo sapiens
ccagtgcctgtgggcatggtgc

SEQ ID NO: 7065648 - DNA, 22 bp, Homo sapiens
tgagcccagagatctgagctat

SEQ ID NO: 7065649 - DNA, 23 bp, Homo sapiens
tgagcccaggaggtcaaggctgc

SEQ ID NO: 7065650 - DNA, 22 bp, Homo sapiens
tgagcccaggagtatgaggctg

SEQ ID NO: 7065651 - DNA, 22 bp, Homo sapiens
ccagtcccagctctgccatgct

SEQ ID NO: 7065652 - DNA, 22 bp, Homo sapiens
ccagtcccagctctgccatgct

SEQ ID NO: 7065653 - DNA, 22 bp, Homo sapiens
ccagtcccaggcagaaatccag

SEQ ID NO: 7065654 - DNA, 19 bp, Homo sapiens
ccagtcccatacaggagat

SEQ ID NO: 7065655 - DNA, 22 bp, Homo sapiens
ccagtcccatctctgtcgctta

SEQ ID NO: 7065656 - DNA, 22 bp, Homo sapiens
tgagccagtggaagatggcagt

SEQ ID NO: 7065657 - DNA, 22 bp, Homo sapiens
ccagggctgctgggggagttga

SEQ ID NO: 7065658 - DNA, 22 bp, Homo sapiens
ccagggctgctgggggagttga

SEQ ID NO: 7065659 - DNA, 22 bp, Homo sapiens
ccagggctgctgggggagttga

SEQ ID NO: 7065660 - DNA, 22 bp, Homo sapiens
ccagggctgctcattggctggt

SEQ ID NO: 7065661 - DNA, 22 bp, Homo sapiens
ccagggctgctgtgggactcca

SEQ ID NO: 7065662 - DNA, 22 bp, Homo sapiens
ccagggctgctgtgggactcca

SEQ ID NO: 7065663 - DNA, 22 bp, Homo sapiens
ccagggctgctgtgggactcca

SEQ ID NO: 7065664 - DNA, 22 bp, Homo sapiens
tgagcagagacgggggcctcca

SEQ ID NO: 7065665 - DNA, 22 bp, Homo sapiens
tgagcagagacgggggcctcca

SEQ ID NO: 7065666 - DNA, 22 bp, Homo sapiens
tgagcaggggagagcgaatgtg

SEQ ID NO: 7065667 - DNA, 22 bp, Homo sapiens
tgagcaggtgagtctagggcag

SEQ ID NO: 7065668 - DNA, 22 bp, Homo sapiens
tgagcagtaacagctcacaggg

SEQ ID NO: 7065669 - DNA, 22 bp, Homo sapiens
ccaggtggaggtgtgaggtcct

SEQ ID NO: 7065670 - DNA, 22 bp, Homo sapiens
ccaggtggccctgccctactct

SEQ ID NO: 7065671 - DNA, 22 bp, Homo sapiens
ccaggtgggaggaaagcagaga

SEQ ID NO: 7065672 - DNA, 17 bp, Homo sapiens
ccaggtgggaggtgggg

SEQ ID NO: 7065673 - DNA, 17 bp, Homo sapiens
ccaggtgggaggtgggg

SEQ ID NO: 7065674 - DNA, 22 bp, Homo sapiens
tgataaacttagaaagaatgtt

SEQ ID NO: 7065675 - DNA, 22 bp, Homo sapiens
tgagttttgtcttgctagaagt

SEQ ID NO: 7065676 - DNA, 22 bp, Homo sapiens
tgagttttttcaacatatgaag

SEQ ID NO: 7065677 - DNA, 22 bp, Homo sapiens
tgagttgctatctagatccaga

SEQ ID NO: 7065678 - DNA, 19 bp, Homo sapiens
tgagtttaatgcaaaactg

SEQ ID NO: 7065679 - DNA, 22 bp, Homo sapiens
tgagtttaattggagcctgaat

SEQ ID NO: 7065680 - DNA, 22 bp, Homo sapiens
tgagtctcccaagtagttggaa

SEQ ID NO: 7065681 - DNA, 22 bp, Homo sapiens
tgagtcctgctgagcagagagg

SEQ ID NO: 7065682 - DNA, 22 bp, Homo sapiens
ccatcctgcattgctattcaga

SEQ ID NO: 7065683 - DNA, 22 bp, Homo sapiens
tgaggtcatggctgatatttcc

SEQ ID NO: 7065684 - DNA, 22 bp, Homo sapiens
tgaggtcctgcatgttgaggtc

SEQ ID NO: 7065685 - DNA, 22 bp, Homo sapiens
ccatccaggctgtgggtgagct

SEQ ID NO: 7065686 - DNA, 22 bp, Homo sapiens
ccatccctgggccatgtcccct

SEQ ID NO: 7065687 - DNA, 22 bp, Homo sapiens
ccatcctatctgacctacttgt

SEQ ID NO: 7065688 - DNA, 22 bp, Homo sapiens
ccatcatttgatacagctgtct

SEQ ID NO: 7065689 - DNA, 23 bp, Homo sapiens
tgaggctgattgatttttgctca

SEQ ID NO: 7065690 - DNA, 23 bp, Homo sapiens
tgaggctgattgatttttgctca

SEQ ID NO: 7065691 - DNA, 18 bp, Homo sapiens
tgaggctgagggtagagg

SEQ ID NO: 7065692 - DNA, 22 bp, Homo sapiens
tgaggctgagatatcagggagg

SEQ ID NO: 7065693 - DNA, 18 bp, Homo sapiens
tgaggctgagggtagagg

SEQ ID NO: 7065694 - DNA, 21 bp, Homo sapiens
ccatacctacctcacctggtt

SEQ ID NO: 7065695 - DNA, 22 bp, Homo sapiens
tgaggcagtgtgagataataaa

SEQ ID NO: 7065696 - DNA, 22 bp, Homo sapiens
tgaggccatgcccgtgccggcc

SEQ ID NO: 7065697 - DNA, 20 bp, Homo sapiens
tgaggcccagcagagtcggg

SEQ ID NO: 7065698 - DNA, 22 bp, Homo sapiens
tgaggcccagccgccctgagag

SEQ ID NO: 7065699 - DNA, 22 bp, Homo sapiens
tgaggcccatctgagattttga

SEQ ID NO: 7065700 - DNA, 22 bp, Homo sapiens
tgaggctgaaactggcgataga

SEQ ID NO: 7065701 - DNA, 22 bp, Homo sapiens
tgaggctgaaactggcgataga

SEQ ID NO: 7065702 - DNA, 18 bp, Homo sapiens
tgaggctgaatatggggc

SEQ ID NO: 7065703 - DNA, 18 bp, Homo sapiens
tgaggctgaatatggggc

SEQ ID NO: 7065704 - DNA, 22 bp, Homo sapiens
tgaggctgacaaaagatgaggt

SEQ ID NO: 7065705 - DNA, 22 bp, Homo sapiens
tgaggctgacaaaagatgaggt

SEQ ID NO: 7065706 - DNA, 22 bp, Homo sapiens
tgaggctgagatatcagggagg

SEQ ID NO: 7065707 - DNA, 22 bp, Homo sapiens
tgaggctgagatatcagggagg

SEQ ID NO: 7065708 - DNA, 22 bp, Homo sapiens
tgaggctgagatatcagggagg

SEQ ID NO: 7065709 - DNA, 22 bp, Homo sapiens
tgcaggcattggtgagagaagc

SEQ ID NO: 7065710 - DNA, 22 bp, Homo sapiens
tgcaggcataaccgatgttgat

SEQ ID NO: 7065711 - DNA, 22 bp, Homo sapiens
tgcaggcaggggatgagcagcc

SEQ ID NO: 7065712 - DNA, 22 bp, Homo sapiens
tgcaggcaggggatgagcagcc

SEQ ID NO: 7065713 - DNA, 22 bp, Homo sapiens
tgcaggagaaagtacggagcgt

SEQ ID NO: 7065714 - DNA, 21 bp, Homo sapiens
tgcaggcaggcagagatgctg

SEQ ID NO: 7065715 - DNA, 22 bp, Homo sapiens
tgcaggcagggccagcgtgagg

SEQ ID NO: 7065716 - DNA, 22 bp, Homo sapiens
cccagcagcctggatgttcttt

SEQ ID NO: 7065717 - DNA, 22 bp, Homo sapiens
cccagcagggtctctgtgtcta

SEQ ID NO: 7065718 - DNA, 22 bp, Homo sapiens
tgcagggccttctagaccatgg

SEQ ID NO: 7065719 - DNA, 22 bp, Homo sapiens
tgcagggccttgggatgtgtcc

SEQ ID NO: 7065720 - DNA, 22 bp, Homo sapiens
tgcagggccttgggatgtgtcc

SEQ ID NO: 7065721 - DNA, 22 bp, Homo sapiens
tgcagggccttgttgatgtgct

SEQ ID NO: 7065722 - DNA, 22 bp, Homo sapiens
tgcagggccttgttgatgtgct

SEQ ID NO: 7065723 - DNA, 22 bp, Homo sapiens
tgcagctgattaaagggcagac

SEQ ID NO: 7065724 - DNA, 19 bp, Homo sapiens
tgcagccacgtgagagact

SEQ ID NO: 7065725 - DNA, 22 bp, Homo sapiens
cccagagggtggaggttgcagt

SEQ ID NO: 7065726 - DNA, 20 bp, Homo sapiens
tgcagctgcaggagggtggg

SEQ ID NO: 7065727 - DNA, 22 bp, Homo sapiens
cccagagggctgaggatatgaa

SEQ ID NO: 7065728 - DNA, 22 bp, Homo sapiens
cccagaggggtcgtctgagggg

SEQ ID NO: 7065729 - DNA, 22 bp, Homo sapiens
cccagagggaagggaatgaggt

SEQ ID NO: 7065730 - DNA, 22 bp, Homo sapiens
cccagagggctgaggatatgaa

SEQ ID NO: 7065731 - DNA, 22 bp, Homo sapiens
cccagaggaggatctcggcccg

SEQ ID NO: 7065732 - DNA, 22 bp, Homo sapiens
cccagaggctgagttgggagca

SEQ ID NO: 7065733 - DNA, 22 bp, Homo sapiens
cccagagggaagggaatgaggt

SEQ ID NO: 7065734 - DNA, 22 bp, Homo sapiens
tgcaggaatagctacagagctg

SEQ ID NO: 7065735 - DNA, 22 bp, Homo sapiens
tgcaggaagtttcctgaacttt

SEQ ID NO: 7065736 - DNA, 22 bp, Homo sapiens
tgcaggaatagctacagagctg

SEQ ID NO: 7065737 - DNA, 22 bp, Homo sapiens
tgcaggaatattgatgaactta

SEQ ID NO: 7065738 - DNA, 22 bp, Homo sapiens
tgcaggaattttttgcagaaag

SEQ ID NO: 7065739 - DNA, 23 bp, Homo sapiens
tgcaggactactcgagcactgct

SEQ ID NO: 7065740 - DNA, 22 bp, Homo sapiens
tgcaggactcaagggtagcagg

SEQ ID NO: 7065741 - DNA, 22 bp, Homo sapiens
tgcaatatgttgcattgtatgg

SEQ ID NO: 7065742 - DNA, 22 bp, Homo sapiens
tgcaatatgttgcattgtatgg

SEQ ID NO: 7065743 - DNA, 22 bp, Homo sapiens
tgcaatacatacttagacccag

SEQ ID NO: 7065744 - DNA, 22 bp, Homo sapiens
tgcaatactcatcattggagat

SEQ ID NO: 7065745 - DNA, 22 bp, Homo sapiens
tgcaataaggagtaatagtaaa

SEQ ID NO: 7065746 - DNA, 22 bp, Homo sapiens
tgcaaatattgggacagtctag

SEQ ID NO: 7065747 - DNA, 19 bp, Homo sapiens
tgcaagtgtcttggacaag

SEQ ID NO: 7065748 - DNA, 22 bp, Homo sapiens
tgcaataaagtgctataaatcc

SEQ ID NO: 7065749 - DNA, 22 bp, Homo sapiens
tgcaataacccagtatctgtga

SEQ ID NO: 7065750 - DNA, 22 bp, Homo sapiens
tgataaatccatgtaaatggta

SEQ ID NO: 7065751 - DNA, 22 bp, Homo sapiens
tgataatgttcgagaatgaaga

SEQ ID NO: 7065752 - DNA, 22 bp, Homo sapiens
tgcaaatattccatgctgttca

SEQ ID NO: 7065753 - DNA, 22 bp, Homo sapiens
cccaaggaagacgcttgtgata

SEQ ID NO: 7065754 - DNA, 22 bp, Homo sapiens
cccaaggcctctccttggcttg

SEQ ID NO: 7065755 - DNA, 22 bp, Homo sapiens
cccaagggagtgcctggtcaac

SEQ ID NO: 7065756 - DNA, 22 bp, Homo sapiens
tgcactatttcgccatggttgt

SEQ ID NO: 7065757 - DNA, 22 bp, Homo sapiens
tgcactgaatagtagactgtac

SEQ ID NO: 7065758 - DNA, 22 bp, Homo sapiens
tgcactgatcctgaccagtgaa

SEQ ID NO: 7065759 - DNA, 22 bp, Homo sapiens
tgcagagaaagtgtagacaggc

SEQ ID NO: 7065760 - DNA, 22 bp, Homo sapiens
tgcagagaagaggacagttcta

SEQ ID NO: 7065761 - DNA, 22 bp, Homo sapiens
tgcagagaccactgtgccttcc

SEQ ID NO: 7065762 - DNA, 22 bp, Homo sapiens
tgcagagagacccctgggccag

SEQ ID NO: 7065763 - DNA, 19 bp, Homo sapiens
tgcagagagaggcaaagaa

SEQ ID NO: 7065764 - DNA, 22 bp, Homo sapiens
tgcagagagatatggcaagagg

SEQ ID NO: 7065765 - DNA, 22 bp, Homo sapiens
tgcagagagatcctcagggttt

SEQ ID NO: 7065766 - DNA, 18 bp, Homo sapiens
cccagaggaatgcctgga

SEQ ID NO: 7065767 - DNA, 19 bp, Homo sapiens
cccagaggaatgcctggaa

SEQ ID NO: 7065768 - DNA, 23 bp, Homo sapiens
cccagaggagcagggcgtgagat

SEQ ID NO: 7065769 - DNA, 22 bp, Homo sapiens
cccagaggaggatctcggcccg

SEQ ID NO: 7065770 - DNA, 16 bp, Homo sapiens
tgcagagagcatggtg

SEQ ID NO: 7065771 - DNA, 22 bp, Homo sapiens
tgcagagagccagctctctcgg

SEQ ID NO: 7065772 - DNA, 22 bp, Homo sapiens
tgcagagagccctgccttcctc

SEQ ID NO: 7065773 - DNA, 22 bp, Homo sapiens
tgcagagagttagggcccgtat

SEQ ID NO: 7065774 - DNA, 22 bp, Homo sapiens
cccagagatgtcctgagtgata

SEQ ID NO: 7065775 - DNA, 22 bp, Homo sapiens
cctgcctcatcaacttgtcgtg

SEQ ID NO: 7065776 - DNA, 22 bp, Homo sapiens
cctgcctcaggactctgcatat

SEQ ID NO: 7065777 - DNA, 22 bp, Homo sapiens
cctgcctactgagttttatatt

SEQ ID NO: 7065778 - DNA, 22 bp, Homo sapiens
cctgcctatgagacgttttgcc

SEQ ID NO: 7065779 - DNA, 22 bp, Homo sapiens
cctgcctatgtaagtggtttct

SEQ ID NO: 7065780 - DNA, 22 bp, Homo sapiens
cctgcctcaggactctgcatat

SEQ ID NO: 7065781 - DNA, 22 bp, Homo sapiens
cctgcccttctttccccagcat

SEQ ID NO: 7065782 - DNA, 22 bp, Homo sapiens
cctgcccagagcccctttcact

SEQ ID NO: 7065783 - DNA, 22 bp, Homo sapiens
tggtaggagatatggtctccga

SEQ ID NO: 7065784 - DNA, 22 bp, Homo sapiens
cctgcccagcttcacctcaggc

SEQ ID NO: 7065785 - DNA, 22 bp, Homo sapiens
cctgcccagcttcacctcaggc

SEQ ID NO: 7065786 - DNA, 22 bp, Homo sapiens
tggtacacatgtccaaggtcag

SEQ ID NO: 7065787 - DNA, 21 bp, Homo sapiens
tggtacaccttgcctgtcaga

SEQ ID NO: 7065788 - DNA, 22 bp, Homo sapiens
tggtaccatttcccaggagtgt

SEQ ID NO: 7065789 - DNA, 22 bp, Homo sapiens
cctgcctcatcaacttgtcgtg

SEQ ID NO: 7065790 - DNA, 22 bp, Homo sapiens
cctgcctcccagaggtcctcta

SEQ ID NO: 7065791 - DNA, 23 bp, Homo sapiens
cctgcctccccatcagttataca

SEQ ID NO: 7065792 - DNA, 22 bp, Homo sapiens
cctgcctgaaggtcagccaccc

SEQ ID NO: 7065793 - DNA, 22 bp, Homo sapiens
cctgcctgacagagaaggttca

SEQ ID NO: 7065794 - DNA, 19 bp, Homo sapiens
cctgcctgagctgtccctc

SEQ ID NO: 7065795 - DNA, 22 bp, Homo sapiens
cctgcctgattccaggatggct

SEQ ID NO: 7065796 - DNA, 22 bp, Homo sapiens
tggtgggagtccgctgtgctgc

SEQ ID NO: 7065797 - DNA, 22 bp, Homo sapiens
tgggtgggagcgccctgtctgg

SEQ ID NO: 7065798 - DNA, 23 bp, Homo sapiens
tggtaatagggagcagaaggtag

SEQ ID NO: 7065799 - DNA, 22 bp, Homo sapiens
tgggtgggagcaccctgtctgg

SEQ ID NO: 7065800 - DNA, 22 bp, Homo sapiens
tggtaattaatttgataggttc

SEQ ID NO: 7065801 - DNA, 22 bp, Homo sapiens
tggtaatttacgcatttctgta

SEQ ID NO: 7065802 - DNA, 22 bp, Homo sapiens
tgggtccacaaacatcagatat

SEQ ID NO: 7065803 - DNA, 18 bp, Homo sapiens
tgggtggctagggagttt

SEQ ID NO: 7065804 - DNA, 22 bp, Homo sapiens
cctgcaggttgcagaggcggaa

SEQ ID NO: 7065805 - DNA, 19 bp, Homo sapiens
cctgcagggatgagaggtt

SEQ ID NO: 7065806 - DNA, 22 bp, Homo sapiens
tgggcctggacatctgtatttt

SEQ ID NO: 7065807 - DNA, 22 bp, Homo sapiens
tgggcaggagagaagctaaaga

SEQ ID NO: 7065808 - DNA, 22 bp, Homo sapiens
tgggcaggataatatctcatgt

SEQ ID NO: 7065809 - DNA, 22 bp, Homo sapiens
tgggcaggatgcgttgattctt

SEQ ID NO: 7065810 - DNA, 22 bp, Homo sapiens
tgggctcatggcccagcactgg

SEQ ID NO: 7065811 - DNA, 22 bp, Homo sapiens
tgggctccggcggcctcaggct

SEQ ID NO: 7065812 - DNA, 23 bp, Homo sapiens
tggggagagttaccctggaagcg

SEQ ID NO: 7065813 - DNA, 22 bp, Homo sapiens
tggggagcacggtagggaaatg

SEQ ID NO: 7065814 - DNA, 22 bp, Homo sapiens
tggggagagttacaaggaatct

SEQ ID NO: 7065815 - DNA, 22 bp, Homo sapiens
tggggagagattgaggagtttt

SEQ ID NO: 7065816 - DNA, 22 bp, Homo sapiens
tggggagagattgaggagtttt

SEQ ID NO: 7065817 - DNA, 22 bp, Homo sapiens
cctgcagggaatcgaggcagaa

SEQ ID NO: 7065818 - DNA, 22 bp, Homo sapiens
cctgcagggaatcgaggcagaa

SEQ ID NO: 7065819 - DNA, 22 bp, Homo sapiens
cctgaggtcatggtccagtgtt

SEQ ID NO: 7065820 - DNA, 22 bp, Homo sapiens
cctgaggtctagagtcagggtg

SEQ ID NO: 7065821 - DNA, 21 bp, Homo sapiens
cctgagtgagacctggcccgt

SEQ ID NO: 7065822 - DNA, 22 bp, Homo sapiens
cctgagtgccatgagagcaccc

SEQ ID NO: 7065823 - DNA, 22 bp, Homo sapiens
cctgagtgcttccagagtcatg

SEQ ID NO: 7065824 - DNA, 22 bp, Homo sapiens
cctgagttagttgctgtgtctc

SEQ ID NO: 7065825 - DNA, 22 bp, Homo sapiens
cctgagttcttatttccagtca

SEQ ID NO: 7065826 - DNA, 22 bp, Homo sapiens
cctgagttgtcagttgctgtag

SEQ ID NO: 7065827 - DNA, 22 bp, Homo sapiens
cctgatggagccctgctgcatg

SEQ ID NO: 7065828 - DNA, 22 bp, Homo sapiens
cctgatggagccctgctgcatg

SEQ ID NO: 7065829 - DNA, 22 bp, Homo sapiens
cctgatggagccctgctgcatg

SEQ ID NO: 7065830 - DNA, 19 bp, Homo sapiens
cctgatggagctggtgcaa

SEQ ID NO: 7065831 - DNA, 22 bp, Homo sapiens
tggggagaagcaatagactcta

SEQ ID NO: 7065832 - DNA, 22 bp, Homo sapiens
tggggagagaccggaatgtttc

SEQ ID NO: 7065833 - DNA, 22 bp, Homo sapiens
cctcctgggccttgctctgtga

SEQ ID NO: 7065834 - DNA, 22 bp, Homo sapiens
cctcctctggtgctgccaaccc

SEQ ID NO: 7065835 - DNA, 22 bp, Homo sapiens
cctccagtactccagtccagcg

SEQ ID NO: 7065836 - DNA, 22 bp, Homo sapiens
cctccatctccagcttctgcct

SEQ ID NO: 7065837 - DNA, 22 bp, Homo sapiens
cctccatgtaaaggtcccctca

SEQ ID NO: 7065838 - DNA, 17 bp, Homo sapiens
cctcccacaccgccctg

SEQ ID NO: 7065839 - DNA, 17 bp, Homo sapiens
cctcccacaccgccctg

SEQ ID NO: 7065840 - DNA, 22 bp, Homo sapiens
cctcccacatcctagctctgct

SEQ ID NO: 7065841 - DNA, 22 bp, Homo sapiens
cctcccacatcctagctctgct

SEQ ID NO: 7065842 - DNA, 22 bp, Homo sapiens
cctcccacattgaggacatgct

SEQ ID NO: 7065843 - DNA, 22 bp, Homo sapiens
cctcccacattgaggacatgct

SEQ ID NO: 7065844 - DNA, 22 bp, Homo sapiens
cctcccacattgaggacatgct

SEQ ID NO: 7065845 - DNA, 22 bp, Homo sapiens
cctcccacattgaggacatgct

SEQ ID NO: 7065846 - DNA, 22 bp, Homo sapiens
cctcccaccatttagagagagc

SEQ ID NO: 7065847 - DNA, 22 bp, Homo sapiens
cctcccaccatttagagagagc

SEQ ID NO: 7065848 - DNA, 22 bp, Homo sapiens
cctcccaccatttagagagagc

SEQ ID NO: 7065849 - DNA, 22 bp, Homo sapiens
cctcccaccgtatctcagtggc

SEQ ID NO: 7065850 - DNA, 22 bp, Homo sapiens
cctcccaccgtatctcagtggc

SEQ ID NO: 7065851 - DNA, 23 bp, Homo sapiens
cctcccacctatttcactttctt

SEQ ID NO: 7065852 - DNA, 23 bp, Homo sapiens
cctcccacctatttcactttctt

SEQ ID NO: 7065853 - DNA, 19 bp, Homo sapiens
cctcccacggattccttcc

SEQ ID NO: 7065854 - DNA, 19 bp, Homo sapiens
cctcccacggattccttcc

SEQ ID NO: 7065855 - DNA, 22 bp, Homo sapiens
cctcccacttcttgctgaggtc

SEQ ID NO: 7065856 - DNA, 22 bp, Homo sapiens
cctcccacttcttgctgaggtc

SEQ ID NO: 7065857 - DNA, 22 bp, Homo sapiens
cctcccacttcttgctgaggtc

SEQ ID NO: 7065858 - DNA, 22 bp, Homo sapiens
tggcagtgtgggaggaaggtac

SEQ ID NO: 7065859 - DNA, 22 bp, Homo sapiens
tggcagtgtataggtggctcct

SEQ ID NO: 7065860 - DNA, 22 bp, Homo sapiens
tggcagtggtgtctgcacaggc

SEQ ID NO: 7065861 - DNA, 22 bp, Homo sapiens
tggcagtgggaagctggaagtc

SEQ ID NO: 7065862 - DNA, 22 bp, Homo sapiens
tggcagtgggaagctggaagtc

SEQ ID NO: 7065863 - DNA, 22 bp, Homo sapiens
tggcagtgggaagctggaagtc

SEQ ID NO: 7065864 - DNA, 22 bp, Homo sapiens
tggcagtgggaagctggaagtc

SEQ ID NO: 7065865 - DNA, 20 bp, Homo sapiens
tggccaagtatccaactgga

SEQ ID NO: 7065866 - DNA, 22 bp, Homo sapiens
cctccagggcccctctcactgg

SEQ ID NO: 7065867 - DNA, 22 bp, Homo sapiens
tgggcagaaggaagagccacct

SEQ ID NO: 7065868 - DNA, 22 bp, Homo sapiens
tgggcagaatgtgggatccaga

SEQ ID NO: 7065869 - DNA, 22 bp, Homo sapiens
tgggacaggaggcctctggaga

SEQ ID NO: 7065870 - DNA, 22 bp, Homo sapiens
tgggacaggaggcctctggaga

SEQ ID NO: 7065871 - DNA, 22 bp, Homo sapiens
tgggacaggaggcctctggaga

SEQ ID NO: 7065872 - DNA, 22 bp, Homo sapiens
tgggacagattataagtctgca

SEQ ID NO: 7065873 - DNA, 22 bp, Homo sapiens
tgggacagagtgagctttggcc

SEQ ID NO: 7065874 - DNA, 22 bp, Homo sapiens
tgggacaggaggcctctggaga

SEQ ID NO: 7065875 - DNA, 22 bp, Homo sapiens
tgggacagggaatctgatcccc

SEQ ID NO: 7065876 - DNA, 22 bp, Homo sapiens
tgggagagaataatcaataggt

SEQ ID NO: 7065877 - DNA, 22 bp, Homo sapiens
tgggagagataggcttctggac

SEQ ID NO: 7065878 - DNA, 22 bp, Homo sapiens
tggcttcccatagcttgctagt

SEQ ID NO: 7065879 - DNA, 22 bp, Homo sapiens
tggcttctttccactgtcctgt

SEQ ID NO: 7065880 - DNA, 22 bp, Homo sapiens
tggcttctttccactgtcctgt

SEQ ID NO: 7065881 - DNA, 22 bp, Homo sapiens
tggcttggctaagatctaagct

SEQ ID NO: 7065882 - DNA, 22 bp, Homo sapiens
tggcttgctactgaggtgtcag

SEQ ID NO: 7065883 - DNA, 20 bp, Homo sapiens
tggcttgtttctatgggcag

SEQ ID NO: 7065884 - DNA, 19 bp, Homo sapiens
cctctcccatgcttacctc

SEQ ID NO: 7065885 - DNA, 22 bp, Homo sapiens
cctctccagcggcctcagggcc

SEQ ID NO: 7065886 - DNA, 22 bp, Homo sapiens
cctctccagttttaacgtgacc

SEQ ID NO: 7065887 - DNA, 22 bp, Homo sapiens
cctctccagttttaacgtgacc

SEQ ID NO: 7065888 - DNA, 22 bp, Homo sapiens
tggaggagaactccctggctac

SEQ ID NO: 7065889 - DNA, 22 bp, Homo sapiens
tggaggacgtgtccaccatgaa

SEQ ID NO: 7065890 - DNA, 22 bp, Homo sapiens
tggaggagaactccctggctac

SEQ ID NO: 7065891 - DNA, 22 bp, Homo sapiens
tggaggcagtttaagtctgaga

SEQ ID NO: 7065892 - DNA, 22 bp, Homo sapiens
tggaggcagtttaagtctgaga

SEQ ID NO: 7065893 - DNA, 22 bp, Homo sapiens
tggaggcataggcctgggccct

SEQ ID NO: 7065894 - DNA, 22 bp, Homo sapiens
tggaggcatcagagtgcttggc

SEQ ID NO: 7065895 - DNA, 22 bp, Homo sapiens
tggaggcatgacagtgtctgga

SEQ ID NO: 7065896 - DNA, 22 bp, Homo sapiens
tggagatgcacgagcaggtgga

SEQ ID NO: 7065897 - DNA, 22 bp, Homo sapiens
tggagatgggttaatggagaga

SEQ ID NO: 7065898 - DNA, 23 bp, Homo sapiens
tggaggaaacacatcagaagacc

SEQ ID NO: 7065899 - DNA, 22 bp, Homo sapiens
tggaggaagtggacagttgtgt

SEQ ID NO: 7065900 - DNA, 22 bp, Homo sapiens
tggaggaagtggacagttgtgt

SEQ ID NO: 7065901 - DNA, 22 bp, Homo sapiens
tggaggaagttgctggaagtca

SEQ ID NO: 7065902 - DNA, 18 bp, Homo sapiens
tggaggaatcacaatggc

SEQ ID NO: 7065903 - DNA, 22 bp, Homo sapiens
tggaggacaggactggacagcc

SEQ ID NO: 7065904 - DNA, 22 bp, Homo sapiens
tggaggacgtgtccaccatgaa

SEQ ID NO: 7065905 - DNA, 22 bp, Homo sapiens
tggaaactaggatggaagaaat

SEQ ID NO: 7065906 - DNA, 22 bp, Homo sapiens
tggaaagaaaaacaggccatga

SEQ ID NO: 7065907 - DNA, 22 bp, Homo sapiens
ccctccctgtgtgcctcatttg

SEQ ID NO: 7065908 - DNA, 22 bp, Homo sapiens
ccctccctgtgtgcctcatttg

SEQ ID NO: 7065909 - DNA, 22 bp, Homo sapiens
ccctccctgaagaagttactct

SEQ ID NO: 7065910 - DNA, 22 bp, Homo sapiens
ccctccctgtgtgcctcatttg

SEQ ID NO: 7065911 - DNA, 22 bp, Homo sapiens
ccctcctcaactctggcttcca

SEQ ID NO: 7065912 - DNA, 22 bp, Homo sapiens
tggagaattctatgttgagggg

SEQ ID NO: 7065913 - DNA, 22 bp, Homo sapiens
tggagaattctatgttgagggg

SEQ ID NO: 7065914 - DNA, 22 bp, Homo sapiens
tggagacagagatagccaattg

SEQ ID NO: 7065915 - DNA, 22 bp, Homo sapiens
tggagactctgcatctgtgaca

SEQ ID NO: 7065916 - DNA, 21 bp, Homo sapiens
tggagactctggttctttgtg

SEQ ID NO: 7065917 - DNA, 22 bp, Homo sapiens
tggagatgaacatggtgatgtt

SEQ ID NO: 7065918 - DNA, 22 bp, Homo sapiens
tggcagagaacacacatgattc

SEQ ID NO: 7065919 - DNA, 22 bp, Homo sapiens
tggcagagaacacacatgattc

SEQ ID NO: 7065920 - DNA, 22 bp, Homo sapiens
ccctggagtgtgacgaggcatt

SEQ ID NO: 7065921 - DNA, 22 bp, Homo sapiens
tggcagaagtacacaagcatgc

SEQ ID NO: 7065922 - DNA, 22 bp, Homo sapiens
ccctggaggtcagaggcctggg

SEQ ID NO: 7065923 - DNA, 22 bp, Homo sapiens
ccctggaggttgaggctgcagt

SEQ ID NO: 7065924 - DNA, 22 bp, Homo sapiens
tggcaggaaaaacattggagat

SEQ ID NO: 7065925 - DNA, 22 bp, Homo sapiens
tggcaggaaaaagggccagagg

SEQ ID NO: 7065926 - DNA, 19 bp, Homo sapiens
tggcaggcccaggatggac

SEQ ID NO: 7065927 - DNA, 22 bp, Homo sapiens
tggcagggaatacagatgttta

SEQ ID NO: 7065928 - DNA, 19 bp, Homo sapiens
tggcagggagagtttgaag

SEQ ID NO: 7065929 - DNA, 22 bp, Homo sapiens
tggcagggagccaccggtcatg

SEQ ID NO: 7065930 - DNA, 22 bp, Homo sapiens
cccttgcacatttgtctttaat

SEQ ID NO: 7065931 - DNA, 22 bp, Homo sapiens
cccttgcatcccatgtgtggcc

SEQ ID NO: 7065932 - DNA, 22 bp, Homo sapiens
tgctagtgcagggttttcagtt

SEQ ID NO: 7065933 - DNA, 22 bp, Homo sapiens
tgctagaattaggttaaacaaa

SEQ ID NO: 7065934 - DNA, 22 bp, Homo sapiens
tgctagtgtgtgagatgttcaa

SEQ ID NO: 7065935 - DNA, 22 bp, Homo sapiens
tgctcaggaggaggctgtgagg

SEQ ID NO: 7065936 - DNA, 20 bp, Homo sapiens
tgctcaggatggagaggtgt

SEQ ID NO: 7065937 - DNA, 22 bp, Homo sapiens
tgctcaggccagccggacagag

SEQ ID NO: 7065938 - DNA, 22 bp, Homo sapiens
tgctcagggacaatggagaggg

SEQ ID NO: 7065939 - DNA, 22 bp, Homo sapiens
tgctcagggacaatggagaggg

SEQ ID NO: 7065940 - DNA, 22 bp, Homo sapiens
tgctacagagccaggaagagtg

SEQ ID NO: 7065941 - DNA, 22 bp, Homo sapiens
tgctaagctgaggaagatgaga

SEQ ID NO: 7065942 - DNA, 22 bp, Homo sapiens
tgctaaggactgggaggcaggg

SEQ ID NO: 7065943 - DNA, 22 bp, Homo sapiens
tgcaggtgctgtgtcaagagag

SEQ ID NO: 7065944 - DNA, 22 bp, Homo sapiens
tgcaggtgctgtgtcaagagag

SEQ ID NO: 7065945 - DNA, 22 bp, Homo sapiens
tgccttctcccttggaccctga

SEQ ID NO: 7065946 - DNA, 22 bp, Homo sapiens
tgcaggtgctacaagaactcac

SEQ ID NO: 7065947 - DNA, 22 bp, Homo sapiens
tgcaggtgcgttttcaagcctc

SEQ ID NO: 7065948 - DNA, 22 bp, Homo sapiens
tgcagggctaagtcagagcctg

SEQ ID NO: 7065949 - DNA, 22 bp, Homo sapiens
tgcaggtgccatcgctgctcat

SEQ ID NO: 7065950 - DNA, 22 bp, Homo sapiens
cccagtggctgtccccatgggc

SEQ ID NO: 7065951 - DNA, 18 bp, Homo sapiens
cccagtgctcactgcctc

SEQ ID NO: 7065952 - DNA, 22 bp, Homo sapiens
cccagtggaaggagtagaagac

SEQ ID NO: 7065953 - DNA, 22 bp, Homo sapiens
cccagtggaaggagtagaagac

SEQ ID NO: 7065954 - DNA, 22 bp, Homo sapiens
cccagtggagataggagtgtgg

SEQ ID NO: 7065955 - DNA, 22 bp, Homo sapiens
cccagtgccaggcacaggcagc

SEQ ID NO: 7065956 - DNA, 22 bp, Homo sapiens
tgctctggacgctgagtggttt

SEQ ID NO: 7065957 - DNA, 19 bp, Homo sapiens
tgctctggagccagctctc

SEQ ID NO: 7065958 - DNA, 20 bp, Homo sapiens
tgctctggaaatggtctgag

SEQ ID NO: 7065959 - DNA, 22 bp, Homo sapiens
tgctctggaatagtcctaggca

SEQ ID NO: 7065960 - DNA, 22 bp, Homo sapiens
tgctctggaccatgactatgtg

SEQ ID NO: 7065961 - DNA, 22 bp, Homo sapiens
tgcttaaaaacagtatggtagt

SEQ ID NO: 7065962 - DNA, 21 bp, Homo sapiens
tgcttccctgggccacactga

SEQ ID NO: 7065963 - DNA, 22 bp, Homo sapiens
ccccaggagatttgggagcaca

SEQ ID NO: 7065964 - DNA, 22 bp, Homo sapiens
ccccaggagatttgggagcaca

SEQ ID NO: 7065965 - DNA, 22 bp, Homo sapiens
tgcttccttgatcattcccaaa

SEQ ID NO: 7065966 - DNA, 22 bp, Homo sapiens
tgcttccttcccgttcttctcc

SEQ ID NO: 7065967 - DNA, 22 bp, Homo sapiens
tgcttccttgagctctccaatc

SEQ ID NO: 7065968 - DNA, 20 bp, Homo sapiens
tgcttcctggccactgcggg

SEQ ID NO: 7065969 - DNA, 22 bp, Homo sapiens
tgcttccttcccgttcttctcc

SEQ ID NO: 7065970 - DNA, 22 bp, Homo sapiens
tgcttcctgctaaggctgcctg

SEQ ID NO: 7065971 - DNA, 19 bp, Homo sapiens
tgcttcctcaccatctccc

SEQ ID NO: 7065972 - DNA, 22 bp, Homo sapiens
tgcttcctgaggccgtcttctc

SEQ ID NO: 7065973 - DNA, 22 bp, Homo sapiens
tgcttcctgaggccgtcttctc

SEQ ID NO: 7065974 - DNA, 22 bp, Homo sapiens
tgcttcctgctaaggctgcctg

SEQ ID NO: 7065975 - DNA, 22 bp, Homo sapiens
tgcttcctatccacacaatgcc

SEQ ID NO: 7065976 - DNA, 22 bp, Homo sapiens
tgcttgctggaggcagacagaa

SEQ ID NO: 7065977 - DNA, 22 bp, Homo sapiens
tgcttggcctacttgtcctttg

SEQ ID NO: 7065978 - DNA, 22 bp, Homo sapiens
tgcttggctttctgagcttctg

SEQ ID NO: 7065979 - DNA, 22 bp, Homo sapiens
tgcttgggcggccagcatggcg

SEQ ID NO: 7065980 - DNA, 22 bp, Homo sapiens
ccctccagtgtcccagtgggga

SEQ ID NO: 7065981 - DNA, 22 bp, Homo sapiens
ccctccccacaaagcttcacac

SEQ ID NO: 7065982 - DNA, 22 bp, Homo sapiens
ccctccctctgctgggtgtaga

SEQ ID NO: 7065983 - DNA, 22 bp, Homo sapiens
cccagtgtctgggcctgcaggg

SEQ ID NO: 7065984 - DNA, 22 bp, Homo sapiens
cccagtgtcaccaacaggacac

SEQ ID NO: 7065985 - DNA, 22 bp, Homo sapiens
cccagttgttgccggctctgga

SEQ ID NO: 7065986 - DNA, 22 bp, Homo sapiens
cccagtggggaaatagctagct

SEQ ID NO: 7065987 - DNA, 22 bp, Homo sapiens
cccagtggtgctggcatctgtg

SEQ ID NO: 7065988 - DNA, 22 bp, Homo sapiens
ccccagctgagatttgaggaga

SEQ ID NO: 7065989 - DNA, 22 bp, Homo sapiens
ccccagctgcatacttgccaag

SEQ ID NO: 7065990 - DNA, 22 bp, Homo sapiens
ccccagctgcatacttgccaag

SEQ ID NO: 7065991 - DNA, 22 bp, Homo sapiens
tgctgggggttcagatgagtaa

SEQ ID NO: 7065992 - DNA, 18 bp, Homo sapiens
tgctggggtagaatccac

SEQ ID NO: 7065993 - DNA, 22 bp, Homo sapiens
ccccagctcagtgcagggacat

SEQ ID NO: 7065994 - DNA, 22 bp, Homo sapiens
tgctgggggtagctctgcgtag

SEQ ID NO: 7065995 - DNA, 22 bp, Homo sapiens
tgctgggggtgtctcaccaggc

SEQ ID NO: 7065996 - DNA, 22 bp, Homo sapiens
tgctggggctctgaccactcca

SEQ ID NO: 7065997 - DNA, 22 bp, Homo sapiens
tgctgggggctttctggatacc

SEQ ID NO: 7065998 - DNA, 22 bp, Homo sapiens
tacagtttagaaccatagatgg

SEQ ID NO: 7065999 - DNA, 22 bp, Homo sapiens
tacagttctttgaaggatctag

SEQ ID NO: 7066000 - DNA, 22 bp, Homo sapiens
tacagttccaggatcatagggt

SEQ ID NO: 7066001 - DNA, 22 bp, Homo sapiens
caggctccttcccagggatggt

SEQ ID NO: 7066002 - DNA, 22 bp, Homo sapiens
caggctctaggttagtaggaga

SEQ ID NO: 7066003 - DNA, 21 bp, Homo sapiens
caggctctgctagaggagcct

SEQ ID NO: 7066004 - DNA, 22 bp, Homo sapiens
caggcctgtgagttgaggcccc

SEQ ID NO: 7066005 - DNA, 22 bp, Homo sapiens
caggcctgtgacaccgtgtctg

SEQ ID NO: 7066006 - DNA, 23 bp, Homo sapiens
tacagctgcagaatcaggctaag

SEQ ID NO: 7066007 - DNA, 22 bp, Homo sapiens
tacagcatgtccttagcaaggc

SEQ ID NO: 7066008 - DNA, 22 bp, Homo sapiens
tacagcatgtccttagcaaggc

SEQ ID NO: 7066009 - DNA, 22 bp, Homo sapiens
tacagcattgcattttcctttg

SEQ ID NO: 7066010 - DNA, 22 bp, Homo sapiens
tacagagagctccggacattca

SEQ ID NO: 7066011 - DNA, 22 bp, Homo sapiens
tacagcatatacagaatgaaca

SEQ ID NO: 7066012 - DNA, 22 bp, Homo sapiens
tacagcatatacagaatgaaca

SEQ ID NO: 7066013 - DNA, 22 bp, Homo sapiens
caggccaccagatacatgcccc

SEQ ID NO: 7066014 - DNA, 22 bp, Homo sapiens
caggccctgccttggcatgtgt

SEQ ID NO: 7066015 - DNA, 22 bp, Homo sapiens
tacactgtgacaatcatgacag

SEQ ID NO: 7066016 - DNA, 22 bp, Homo sapiens
tacactgtgtaaaatgcacttt

SEQ ID NO: 7066017 - DNA, 22 bp, Homo sapiens
tacactttatggatcctacttt

SEQ ID NO: 7066018 - DNA, 22 bp, Homo sapiens
tacagaccagtagttctcagcg

SEQ ID NO: 7066019 - DNA, 22 bp, Homo sapiens
tacacagatttaaaagcaggga

SEQ ID NO: 7066020 - DNA, 22 bp, Homo sapiens
tacacagactcttcaattcaga

SEQ ID NO: 7066021 - DNA, 22 bp, Homo sapiens
tacacagaggctgatgtcttag

SEQ ID NO: 7066022 - DNA, 22 bp, Homo sapiens
tacacagaggctgatgtcttag

SEQ ID NO: 7066023 - DNA, 22 bp, Homo sapiens
tacacagatatgtgatcaatca

SEQ ID NO: 7066024 - DNA, 22 bp, Homo sapiens
cagctctgccacttcctagcta

SEQ ID NO: 7066025 - DNA, 22 bp, Homo sapiens
gtggagcaatcagagggtcagt

SEQ ID NO: 7066026 - DNA, 22 bp, Homo sapiens
tagacatttctggttattgaca

SEQ ID NO: 7066027 - DNA, 22 bp, Homo sapiens
cagggagatcttggctcctggt

SEQ ID NO: 7066028 - DNA, 22 bp, Homo sapiens
cagggagaggctggtggagtaa

SEQ ID NO: 7066029 - DNA, 22 bp, Homo sapiens
cagggagaggctggtggagtaa

SEQ ID NO: 7066030 - DNA, 22 bp, Homo sapiens
cagggagaggctggtggagtaa

SEQ ID NO: 7066031 - DNA, 22 bp, Homo sapiens
cagggagaggcctctgttgccc

SEQ ID NO: 7066032 - DNA, 22 bp, Homo sapiens
cagggagaggcctctgttgccc

SEQ ID NO: 7066033 - DNA, 22 bp, Homo sapiens
cagggagaagtctggtcagtcc

SEQ ID NO: 7066034 - DNA, 22 bp, Homo sapiens
cagggagaagtctggtcagtcc

SEQ ID NO: 7066035 - DNA, 22 bp, Homo sapiens
tagaaatgttggtattaacatt

SEQ ID NO: 7066036 - DNA, 22 bp, Homo sapiens
cagggagaaatctccaggaggt

SEQ ID NO: 7066037 - DNA, 22 bp, Homo sapiens
cagggagaagtctggtcagtcc

SEQ ID NO: 7066038 - DNA, 22 bp, Homo sapiens
tagaaagaacttcatgtaaaac

SEQ ID NO: 7066039 - DNA, 22 bp, Homo sapiens
tagaaagacaatgggaagtgct

SEQ ID NO: 7066040 - DNA, 22 bp, Homo sapiens
tagaaagactgtccagatttca

SEQ ID NO: 7066041 - DNA, 22 bp, Homo sapiens
tagaaagactgtccagatttca

SEQ ID NO: 7066042 - DNA, 22 bp, Homo sapiens
tagaaagatctgtaggcaagag

SEQ ID NO: 7066043 - DNA, 22 bp, Homo sapiens
caggctgaggcagtagggtttg

SEQ ID NO: 7066044 - DNA, 22 bp, Homo sapiens
caggctgagggttaggccttag

SEQ ID NO: 7066045 - DNA, 22 bp, Homo sapiens
caggctgatagggtccaaagtt

SEQ ID NO: 7066046 - DNA, 22 bp, Homo sapiens
caggctgatcagggctgggatg

SEQ ID NO: 7066047 - DNA, 22 bp, Homo sapiens
caggctgattaggcctcgtcca

SEQ ID NO: 7066048 - DNA, 22 bp, Homo sapiens
caggctgcagaggcctttcatg

SEQ ID NO: 7066049 - DNA, 22 bp, Homo sapiens
caggctgcagcagcagtggccc

SEQ ID NO: 7066050 - DNA, 22 bp, Homo sapiens
caggctgcagcagcagtggccc

SEQ ID NO: 7066051 - DNA, 22 bp, Homo sapiens
caggctgcagcagcagtggccc

SEQ ID NO: 7066052 - DNA, 22 bp, Homo sapiens
caggctgcagcagcagtggccc

SEQ ID NO: 7066053 - DNA, 22 bp, Homo sapiens
caggctgcagcagcagtggccc

SEQ ID NO: 7066054 - DNA, 22 bp, Homo sapiens
cagggcatgaggtgtgcttctc

SEQ ID NO: 7066055 - DNA, 22 bp, Homo sapiens
cagggcaggatgctgtgattat

SEQ ID NO: 7066056 - DNA, 22 bp, Homo sapiens
cagggcagtttgtgcctatgag

SEQ ID NO: 7066057 - DNA, 22 bp, Homo sapiens
tagcagcaggggaaacagctgt

SEQ ID NO: 7066058 - DNA, 20 bp, Homo sapiens
tagcagcagaaagaacttag

SEQ ID NO: 7066059 - DNA, 22 bp, Homo sapiens
tagcagcacctttctaatctga

SEQ ID NO: 7066060 - DNA, 22 bp, Homo sapiens
tagcagcacctacacgtcagag

SEQ ID NO: 7066061 - DNA, 22 bp, Homo sapiens
tagcataatttgtagaaaatca

SEQ ID NO: 7066062 - DNA, 22 bp, Homo sapiens
cagggagctttcccaggaccct

SEQ ID NO: 7066063 - DNA, 22 bp, Homo sapiens
cagggagctttgtcttctcatt

SEQ ID NO: 7066064 - DNA, 22 bp, Homo sapiens
cagggagcctgaatgttccagg

SEQ ID NO: 7066065 - DNA, 22 bp, Homo sapiens
cagggatgaccagagggatgtg

SEQ ID NO: 7066066 - DNA, 22 bp, Homo sapiens
cagggagtcaacaaacagatca

SEQ ID NO: 7066067 - DNA, 22 bp, Homo sapiens
tagcagcacaaatggactatga

SEQ ID NO: 7066068 - DNA, 22 bp, Homo sapiens
tagcagcaattacacagtccgt

SEQ ID NO: 7066069 - DNA, 22 bp, Homo sapiens
tagcagcaaagcaggatctgct

SEQ ID NO: 7066070 - DNA, 22 bp, Homo sapiens
tagcagcaaaatgaccttctaa

SEQ ID NO: 7066071 - DNA, 22 bp, Homo sapiens
tagcagagtttggtacctgggg

SEQ ID NO: 7066072 - DNA, 22 bp, Homo sapiens
cagggatgagagatggcacaga

SEQ ID NO: 7066073 - DNA, 22 bp, Homo sapiens
cagggatgagcagatggagcaa

SEQ ID NO: 7066074 - DNA, 22 bp, Homo sapiens
cagggatggcctggcgggccac

SEQ ID NO: 7066075 - DNA, 22 bp, Homo sapiens
cagggatggagagactactggc

SEQ ID NO: 7066076 - DNA, 22 bp, Homo sapiens
cagggatgctgcttaggcagtt

SEQ ID NO: 7066077 - DNA, 22 bp, Homo sapiens
cagtggttggtagatacttgag

SEQ ID NO: 7066078 - DNA, 22 bp, Homo sapiens
cagtggcagagaacagagacct

SEQ ID NO: 7066079 - DNA, 22 bp, Homo sapiens
cagtggcacccacgggctgggc

SEQ ID NO: 7066080 - DNA, 22 bp, Homo sapiens
tcacattctcagcatctataca

SEQ ID NO: 7066081 - DNA, 22 bp, Homo sapiens
tcacattctcagcatctataca

SEQ ID NO: 7066082 - DNA, 22 bp, Homo sapiens
tcacatgtgttttctcaccaac

SEQ ID NO: 7066083 - DNA, 22 bp, Homo sapiens
tcacatgtcaaaaactacataa

SEQ ID NO: 7066084 - DNA, 22 bp, Homo sapiens
tcacatgtcaagaagataattt

SEQ ID NO: 7066085 - DNA, 22 bp, Homo sapiens
tcacatgtcacaaaacactgcc

SEQ ID NO: 7066086 - DNA, 22 bp, Homo sapiens
tcacatgtcagtcttaaacaga

SEQ ID NO: 7066087 - DNA, 22 bp, Homo sapiens
cagtggcaatgggacagagcac

SEQ ID NO: 7066088 - DNA, 22 bp, Homo sapiens
cagtggattagccagagctgga

SEQ ID NO: 7066089 - DNA, 22 bp, Homo sapiens
cagtggaggctcaagtgtgctt

SEQ ID NO: 7066090 - DNA, 22 bp, Homo sapiens
cagtggaggccttgggaccttt

SEQ ID NO: 7066091 - DNA, 22 bp, Homo sapiens
cagtggagtgggactggtctga

SEQ ID NO: 7066092 - DNA, 22 bp, Homo sapiens
cagtggagtgggactggtctga

SEQ ID NO: 7066093 - DNA, 23 bp, Homo sapiens
tcacactggatacacatgcaaga

SEQ ID NO: 7066094 - DNA, 22 bp, Homo sapiens
tcacactggcagtgctgaaggc

SEQ ID NO: 7066095 - DNA, 22 bp, Homo sapiens
tcacactgtgaagagacaagca

SEQ ID NO: 7066096 - DNA, 22 bp, Homo sapiens
cagtgctgttgtaagctcattg

SEQ ID NO: 7066097 - DNA, 19 bp, Homo sapiens
cagtggagattggaggagg

SEQ ID NO: 7066098 - DNA, 22 bp, Homo sapiens
cagtgcaggtttagggctgggg

SEQ ID NO: 7066099 - DNA, 22 bp, Homo sapiens
cagtgcaggtttagggctgggg

SEQ ID NO: 7066100 - DNA, 22 bp, Homo sapiens
cagtgcagtcaaggaagaacca

SEQ ID NO: 7066101 - DNA, 22 bp, Homo sapiens
cagtgcagttggtggcaggggt

SEQ ID NO: 7066102 - DNA, 22 bp, Homo sapiens
cagtgcagttggtggcaggggt

SEQ ID NO: 7066103 - DNA, 22 bp, Homo sapiens
cagtgcagtttcccagatgctg

SEQ ID NO: 7066104 - DNA, 22 bp, Homo sapiens
cagtgcagtttcccagatgctg

SEQ ID NO: 7066105 - DNA, 16 bp, Homo sapiens
tcacacatttgttggt

SEQ ID NO: 7066106 - DNA, 22 bp, Homo sapiens
tcaaattagtggaataataatg

SEQ ID NO: 7066107 - DNA, 22 bp, Homo sapiens
tcaaattagtggaataataatg

SEQ ID NO: 7066108 - DNA, 22 bp, Homo sapiens
cagtctttgttcccattactga

SEQ ID NO: 7066109 - DNA, 22 bp, Homo sapiens
cagtcttctaacctagcagcct

SEQ ID NO: 7066110 - DNA, 22 bp, Homo sapiens
cagtctctcagctttcagctgt

SEQ ID NO: 7066111 - DNA, 22 bp, Homo sapiens
cagtctctctccttgcaggcgt

SEQ ID NO: 7066112 - DNA, 22 bp, Homo sapiens
cagtcccagctgctcagaaggc

SEQ ID NO: 7066113 - DNA, 15 bp, Homo sapiens
cagtcccagggaccc

SEQ ID NO: 7066114 - DNA, 22 bp, Homo sapiens
cagtcccagggttggttcagct

SEQ ID NO: 7066115 - DNA, 22 bp, Homo sapiens
cagtcccagtttgagactctgg

SEQ ID NO: 7066116 - DNA, 22 bp, Homo sapiens
cagtcccatctcccaggtggct

SEQ ID NO: 7066117 - DNA, 22 bp, Homo sapiens
cagtcccatgagcccagaacat

SEQ ID NO: 7066118 - DNA, 22 bp, Homo sapiens
cagtccctagtggagctcacag

SEQ ID NO: 7066119 - DNA, 22 bp, Homo sapiens
tattcctaatttgcagggcatg

SEQ ID NO: 7066120 - DNA, 22 bp, Homo sapiens
tcaaagcttagataatttcttt

SEQ ID NO: 7066121 - DNA, 22 bp, Homo sapiens
tcaaaggaaacacaagcttctg

SEQ ID NO: 7066122 - DNA, 22 bp, Homo sapiens
tcaaaggaatttgattttgatg

SEQ ID NO: 7066123 - DNA, 22 bp, Homo sapiens
tcaaaggagacacaaggagaaa

SEQ ID NO: 7066124 - DNA, 22 bp, Homo sapiens
tatgtacatcgttgaattcaaa

SEQ ID NO: 7066125 - DNA, 22 bp, Homo sapiens
caggtggggcgccctcaggcag

SEQ ID NO: 7066126 - DNA, 22 bp, Homo sapiens
caggtggcttattagggtcagt

SEQ ID NO: 7066127 - DNA, 22 bp, Homo sapiens
tatgtacatggagagcaattga

SEQ ID NO: 7066128 - DNA, 22 bp, Homo sapiens
cagtaaaagatggaaatagaat

SEQ ID NO: 7066129 - DNA, 22 bp, Homo sapiens
cagtaatgggcaagacaatatg

SEQ ID NO: 7066130 - DNA, 22 bp, Homo sapiens
cagtaattccaagtgcttatac

SEQ ID NO: 7066131 - DNA, 22 bp, Homo sapiens
cagtacatttcatatgattcta

SEQ ID NO: 7066132 - DNA, 22 bp, Homo sapiens
cagtacatttcatatgattcta

SEQ ID NO: 7066133 - DNA, 22 bp, Homo sapiens
tatgatttgtagacatttgatt

SEQ ID NO: 7066134 - DNA, 20 bp, Homo sapiens
tatgaagatatgtgaacagc

SEQ ID NO: 7066135 - DNA, 22 bp, Homo sapiens
tatgatatgcactttatcagaa

SEQ ID NO: 7066136 - DNA, 22 bp, Homo sapiens
tatgaagaagttctgtgaaatg

SEQ ID NO: 7066137 - DNA, 22 bp, Homo sapiens
tatgaagacaatgatagcatga

SEQ ID NO: 7066138 - DNA, 22 bp, Homo sapiens
tatgaagatatatctgatctct

SEQ ID NO: 7066139 - DNA, 22 bp, Homo sapiens
tatattctgattccatctgtgt

SEQ ID NO: 7066140 - DNA, 22 bp, Homo sapiens
tatattcttaccagtgtatgta

SEQ ID NO: 7066141 - DNA, 22 bp, Homo sapiens
tatattctattgtacctctcct

SEQ ID NO: 7066142 - DNA, 22 bp, Homo sapiens
tatattctttcaccttcttcct

SEQ ID NO: 7066143 - DNA, 22 bp, Homo sapiens
tatattgtaggtgctatttgaa

SEQ ID NO: 7066144 - DNA, 22 bp, Homo sapiens
cagggccactgcatgaggttca

SEQ ID NO: 7066145 - DNA, 22 bp, Homo sapiens
cagggccaccctctgctgggtg

SEQ ID NO: 7066146 - DNA, 22 bp, Homo sapiens
cagggccaagttggtgcctttt

SEQ ID NO: 7066147 - DNA, 21 bp, Homo sapiens
cagggccaatcctgacctcta

SEQ ID NO: 7066148 - DNA, 22 bp, Homo sapiens
tagtaaatctcagaaaaagatc

SEQ ID NO: 7066149 - DNA, 22 bp, Homo sapiens
tagtaaatctcagaaaaagatc

SEQ ID NO: 7066150 - DNA, 22 bp, Homo sapiens
cagggctggatcctccagactc

SEQ ID NO: 7066151 - DNA, 22 bp, Homo sapiens
cagggctggatcctccagactc

SEQ ID NO: 7066152 - DNA, 22 bp, Homo sapiens
cagggctggatttcatttctag

SEQ ID NO: 7066153 - DNA, 23 bp, Homo sapiens
tagtgattggaaaaactagtttt

SEQ ID NO: 7066154 - DNA, 22 bp, Homo sapiens
cagggctgaggacacaagtaaa

SEQ ID NO: 7066155 - DNA, 22 bp, Homo sapiens
cagggctgagtcatatagcctt

SEQ ID NO: 7066156 - DNA, 22 bp, Homo sapiens
cagggctgctggccgtgccctc

SEQ ID NO: 7066157 - DNA, 22 bp, Homo sapiens
tatataatttgtaaaagcacct

SEQ ID NO: 7066158 - DNA, 22 bp, Homo sapiens
tatataattttctgccatatcc

SEQ ID NO: 7066159 - DNA, 21 bp, Homo sapiens
tatacatgtgtgcatacgtgt

SEQ ID NO: 7066160 - DNA, 22 bp, Homo sapiens
tagttttagtcccattttacag

SEQ ID NO: 7066161 - DNA, 21 bp, Homo sapiens
tatacatgtgcacacacatgc

SEQ ID NO: 7066162 - DNA, 22 bp, Homo sapiens
tagttttagcagcaatgggatg

SEQ ID NO: 7066163 - DNA, 22 bp, Homo sapiens
tatatagaaaagcagatgttgg

SEQ ID NO: 7066164 - DNA, 22 bp, Homo sapiens
tatatagaaaagcagatgttgg

SEQ ID NO: 7066165 - DNA, 22 bp, Homo sapiens
tatatatatgcacacacaccta

SEQ ID NO: 7066166 - DNA, 22 bp, Homo sapiens
tatatatatgcacacacaccta

SEQ ID NO: 7066167 - DNA, 22 bp, Homo sapiens
tatattcaatgattagtatcag

SEQ ID NO: 7066168 - DNA, 22 bp, Homo sapiens
tatattcaatgattagtatcag

SEQ ID NO: 7066169 - DNA, 22 bp, Homo sapiens
tagttttacttgcgatgataat

SEQ ID NO: 7066170 - DNA, 22 bp, Homo sapiens
tagttttacttgcgatgataat

SEQ ID NO: 7066171 - DNA, 22 bp, Homo sapiens
tagttttacttgcgatgataat

SEQ ID NO: 7066172 - DNA, 22 bp, Homo sapiens
tagtttgtaatgaggagaagta

SEQ ID NO: 7066173 - DNA, 22 bp, Homo sapiens
tcagtttcctggttgtgatatt

SEQ ID NO: 7066174 - DNA, 22 bp, Homo sapiens
catcctgaagaagccgcactgt

SEQ ID NO: 7066175 - DNA, 22 bp, Homo sapiens
catctaaatttgactccaagga

SEQ ID NO: 7066176 - DNA, 22 bp, Homo sapiens
tcataattgtatacatttatgg

SEQ ID NO: 7066177 - DNA, 22 bp, Homo sapiens
tcatcaaagtcaaagaatgact

SEQ ID NO: 7066178 - DNA, 22 bp, Homo sapiens
tcatcacatgtgtagtcatccc

SEQ ID NO: 7066179 - DNA, 20 bp, Homo sapiens
tcatcagataggttagtaca

SEQ ID NO: 7066180 - DNA, 22 bp, Homo sapiens
catcagtgtggcagttcactgt

SEQ ID NO: 7066181 - DNA, 20 bp, Homo sapiens
catcagtgcctgacaggtcc

SEQ ID NO: 7066182 - DNA, 22 bp, Homo sapiens
catcagagtggtggcctggtgt

SEQ ID NO: 7066183 - DNA, 22 bp, Homo sapiens
catcaggaggagatgaagaaaa

SEQ ID NO: 7066184 - DNA, 22 bp, Homo sapiens
catcatcaaaacaaatggagtc

SEQ ID NO: 7066185 - DNA, 22 bp, Homo sapiens
catcatcaaaagtgacagagaa

SEQ ID NO: 7066186 - DNA, 22 bp, Homo sapiens
catcaaaattagacattgttga

SEQ ID NO: 7066187 - DNA, 21 bp, Homo sapiens
catattaaatcggtgccttta

SEQ ID NO: 7066188 - DNA, 19 bp, Homo sapiens
catatttttgggctggcat

SEQ ID NO: 7066189 - DNA, 22 bp, Homo sapiens
catcaaaattagacattgttga

SEQ ID NO: 7066190 - DNA, 22 bp, Homo sapiens
catcaaataggaatatttggca

SEQ ID NO: 7066191 - DNA, 22 bp, Homo sapiens
catcaaatggcaagtgaaagct

SEQ ID NO: 7066192 - DNA, 22 bp, Homo sapiens
tcaggcagagctgtggagctct

SEQ ID NO: 7066193 - DNA, 22 bp, Homo sapiens
tcaggcagaggatggggagcgt

SEQ ID NO: 7066194 - DNA, 22 bp, Homo sapiens
tcaggcagagggagaagccaag

SEQ ID NO: 7066195 - DNA, 22 bp, Homo sapiens
tcaggcagagggagaagccaag

SEQ ID NO: 7066196 - DNA, 22 bp, Homo sapiens
catatgtatttctcataattag

SEQ ID NO: 7066197 - DNA, 22 bp, Homo sapiens
tcaggctgatttcttttgaggg

SEQ ID NO: 7066198 - DNA, 22 bp, Homo sapiens
tcaggctgcagctgtcagcagc

SEQ ID NO: 7066199 - DNA, 22 bp, Homo sapiens
tcaggctgcagtggcaaaagac

SEQ ID NO: 7066200 - DNA, 22 bp, Homo sapiens
tcaggctgcatctgtaagggtg

SEQ ID NO: 7066201 - DNA, 22 bp, Homo sapiens
tcaggctgcccgttcagggctc

SEQ ID NO: 7066202 - DNA, 22 bp, Homo sapiens
tcaggctgcccgttcagggctc

SEQ ID NO: 7066203 - DNA, 18 bp, Homo sapiens
tcaggctgccctgtgtct

SEQ ID NO: 7066204 - DNA, 22 bp, Homo sapiens
tcaggctgcctatcagactgtg

SEQ ID NO: 7066205 - DNA, 22 bp, Homo sapiens
tcactgttgacctggaagtggg

SEQ ID NO: 7066206 - DNA, 22 bp, Homo sapiens
tcactgtttcatccctagcact

SEQ ID NO: 7066207 - DNA, 22 bp, Homo sapiens
tcactgtttcctgtactggaca

SEQ ID NO: 7066208 - DNA, 22 bp, Homo sapiens
tcactgttttgcctgcacttcc

SEQ ID NO: 7066209 - DNA, 22 bp, Homo sapiens
tcacttagatggggatcatcac

SEQ ID NO: 7066210 - DNA, 22 bp, Homo sapiens
tcacttataaaatgcaagatct

SEQ ID NO: 7066211 - DNA, 21 bp, Homo sapiens
tcacttataatgtatttgctg

SEQ ID NO: 7066212 - DNA, 22 bp, Homo sapiens
tcacttattgctcatctcatgc

SEQ ID NO: 7066213 - DNA, 22 bp, Homo sapiens
tcacttattgctcatctcatgc

SEQ ID NO: 7066214 - DNA, 22 bp, Homo sapiens
tcacttcacacccactatcatg

SEQ ID NO: 7066215 - DNA, 22 bp, Homo sapiens
tcaggaatgaggataaacattg

SEQ ID NO: 7066216 - DNA, 22 bp, Homo sapiens
tcaggaggccaccaggacctgt

SEQ ID NO: 7066217 - DNA, 22 bp, Homo sapiens
tcaggaggccgtgtgctcagtg

SEQ ID NO: 7066218 - DNA, 22 bp, Homo sapiens
tcaggaggcctgagtagctcta

SEQ ID NO: 7066219 - DNA, 22 bp, Homo sapiens
tcaggaggcggaggttgcagtg

SEQ ID NO: 7066220 - DNA, 22 bp, Homo sapiens
tcaggaggcggtgctgcctttg

SEQ ID NO: 7066221 - DNA, 22 bp, Homo sapiens
tcaggaggcggtgctgcctttg

SEQ ID NO: 7066222 - DNA, 21 bp, Homo sapiens
tcaggaggctcagactcctgc

SEQ ID NO: 7066223 - DNA, 21 bp, Homo sapiens
tcaggaggctcagactcctgc

SEQ ID NO: 7066224 - DNA, 22 bp, Homo sapiens
tcaggcagaaaaatcactaatt

SEQ ID NO: 7066225 - DNA, 22 bp, Homo sapiens
tcaggcagaattatcaaaagat

SEQ ID NO: 7066226 - DNA, 22 bp, Homo sapiens
tccagaggtgaacacccaggca

SEQ ID NO: 7066227 - DNA, 18 bp, Homo sapiens
tccagaggtgttggagcc

SEQ ID NO: 7066228 - DNA, 18 bp, Homo sapiens
tccagaggtgttggagcc

SEQ ID NO: 7066229 - DNA, 22 bp, Homo sapiens
tccaagcactgttaattaaact

SEQ ID NO: 7066230 - DNA, 22 bp, Homo sapiens
tccaagcatgtggtcaggagcc

SEQ ID NO: 7066231 - DNA, 22 bp, Homo sapiens
tccaagagaatactggagagta

SEQ ID NO: 7066232 - DNA, 22 bp, Homo sapiens
tccaagatctacagcagtttag

SEQ ID NO: 7066233 - DNA, 22 bp, Homo sapiens
tccaagatctacagcagtttag

SEQ ID NO: 7066234 - DNA, 22 bp, Homo sapiens
tccaagatctacagcagtttag

SEQ ID NO: 7066235 - DNA, 22 bp, Homo sapiens
tcatcagggatattggcctgaa

SEQ ID NO: 7066236 - DNA, 22 bp, Homo sapiens
catgctcacaaaagatggcaaa

SEQ ID NO: 7066237 - DNA, 22 bp, Homo sapiens
catgctgagcacattctgtatt

SEQ ID NO: 7066238 - DNA, 22 bp, Homo sapiens
catgctgattcttcctgagctt

SEQ ID NO: 7066239 - DNA, 22 bp, Homo sapiens
catgctgtgcatcttgatgacc

SEQ ID NO: 7066240 - DNA, 22 bp, Homo sapiens
catgctgtgtggttagaactgt

SEQ ID NO: 7066241 - DNA, 22 bp, Homo sapiens
catgctgtgtgttttagctcca

SEQ ID NO: 7066242 - DNA, 22 bp, Homo sapiens
catgctttttgacaacaagctg

SEQ ID NO: 7066243 - DNA, 22 bp, Homo sapiens
tccagcaaagtgataggatttc

SEQ ID NO: 7066244 - DNA, 22 bp, Homo sapiens
tccagcacagaatttcctagct

SEQ ID NO: 7066245 - DNA, 22 bp, Homo sapiens
catgggctcttctggactgcac

SEQ ID NO: 7066246 - DNA, 22 bp, Homo sapiens
catggtgaggggtgaagggcag

SEQ ID NO: 7066247 - DNA, 22 bp, Homo sapiens
catgtaaaaaattaggtcatct

SEQ ID NO: 7066248 - DNA, 22 bp, Homo sapiens
catgtaaaaagaagaatctgga

SEQ ID NO: 7066249 - DNA, 22 bp, Homo sapiens
catgtaaaccattgtgagcatc

SEQ ID NO: 7066250 - DNA, 22 bp, Homo sapiens
catgtaaagaatttcacacaag

SEQ ID NO: 7066251 - DNA, 22 bp, Homo sapiens
catgtaaagcacttcataacag

SEQ ID NO: 7066252 - DNA, 22 bp, Homo sapiens
cattacaaagttataaacagtt

SEQ ID NO: 7066253 - DNA, 22 bp, Homo sapiens
cattacaaccccaaattacaaa

SEQ ID NO: 7066254 - DNA, 22 bp, Homo sapiens
cattacaaccccaaattacaaa

SEQ ID NO: 7066255 - DNA, 22 bp, Homo sapiens
tccagggcaggtgctgggctct

SEQ ID NO: 7066256 - DNA, 22 bp, Homo sapiens
tccagggcaggtgctgggctct

SEQ ID NO: 7066257 - DNA, 22 bp, Homo sapiens
tccagggcagtgactacagcgg

SEQ ID NO: 7066258 - DNA, 22 bp, Homo sapiens
tccagggcagtgactacagcgg

SEQ ID NO: 7066259 - DNA, 23 bp, Homo sapiens
tccagggcagtggctgggtctgc

SEQ ID NO: 7066260 - DNA, 22 bp, Homo sapiens
tccagggcatggggagagagtg

SEQ ID NO: 7066261 - DNA, 22 bp, Homo sapiens
tccagggcatggggagagagtg

SEQ ID NO: 7066262 - DNA, 22 bp, Homo sapiens
tccagggtcagaagtcacatac

SEQ ID NO: 7066263 - DNA, 22 bp, Homo sapiens
tccaggtcccagactgggcagc

SEQ ID NO: 7066264 - DNA, 22 bp, Homo sapiens
catgtggatatgaattgtagaa

SEQ ID NO: 7066265 - DNA, 22 bp, Homo sapiens
catgtgctgtagcagagaggaa

SEQ ID NO: 7066266 - DNA, 22 bp, Homo sapiens
tccaggctttggggcaggagcg

SEQ ID NO: 7066267 - DNA, 23 bp, Homo sapiens
catgtacacacagctgtacagtg

SEQ ID NO: 7066268 - DNA, 23 bp, Homo sapiens
catgtacagagtttgataaagtg

SEQ ID NO: 7066269 - DNA, 22 bp, Homo sapiens
tccaggctgtgcgcaccgtgtg

SEQ ID NO: 7066270 - DNA, 22 bp, Homo sapiens
tctctgtacagtacatgccgtg

SEQ ID NO: 7066271 - DNA, 22 bp, Homo sapiens
tctctgggataaactgggccag

SEQ ID NO: 7066272 - DNA, 20 bp, Homo sapiens
tctctgtaaatcttctttta

SEQ ID NO: 7066273 - DNA, 22 bp, Homo sapiens
tctctgtaagagaggctttcat

SEQ ID NO: 7066274 - DNA, 22 bp, Homo sapiens
tctctgtaagctgccttctcgt

SEQ ID NO: 7066275 - DNA, 22 bp, Homo sapiens
tctctgtagcagcttccttcct

SEQ ID NO: 7066276 - DNA, 22 bp, Homo sapiens
tctctgtagttgggcagctgct

SEQ ID NO: 7066277 - DNA, 21 bp, Homo sapiens
tctctgtatccatgggttcca

SEQ ID NO: 7066278 - DNA, 22 bp, Homo sapiens
ccagatgtccctctcaggtttg

SEQ ID NO: 7066279 - DNA, 22 bp, Homo sapiens
ccagcaagccaggtctgtggct

SEQ ID NO: 7066280 - DNA, 22 bp, Homo sapiens
ccagcaagtgcagatggccaag

SEQ ID NO: 7066281 - DNA, 22 bp, Homo sapiens
ccagaggtgaacaggaggctgt

SEQ ID NO: 7066282 - DNA, 22 bp, Homo sapiens
ccagaggtgagggggattcttg

SEQ ID NO: 7066283 - DNA, 22 bp, Homo sapiens
ccagaggtctctctatactggg

SEQ ID NO: 7066284 - DNA, 22 bp, Homo sapiens
ccagaggtctcctgcacgggat

SEQ ID NO: 7066285 - DNA, 22 bp, Homo sapiens
ccagaggtcctgtgatgctgca

SEQ ID NO: 7066286 - DNA, 22 bp, Homo sapiens
ccagaggtcctgctcactggtg

SEQ ID NO: 7066287 - DNA, 22 bp, Homo sapiens
ccagaggtcccctgccaggagg

SEQ ID NO: 7066288 - DNA, 22 bp, Homo sapiens
ccagaggggctgagcaggtcac

SEQ ID NO: 7066289 - DNA, 22 bp, Homo sapiens
ccagagggcaaaatgaagctta

SEQ ID NO: 7066290 - DNA, 22 bp, Homo sapiens
ccagagggaactgggcctcatt

SEQ ID NO: 7066291 - DNA, 22 bp, Homo sapiens
ccagaggctggcagccagctga

SEQ ID NO: 7066292 - DNA, 22 bp, Homo sapiens
ccagaggctggcagccagctga

SEQ ID NO: 7066293 - DNA, 22 bp, Homo sapiens
ccagaggctggggaaggataca

SEQ ID NO: 7066294 - DNA, 22 bp, Homo sapiens
ccagagcctaagatctgatcct

SEQ ID NO: 7066295 - DNA, 22 bp, Homo sapiens
ccagagcctcaacacaggtcct

SEQ ID NO: 7066296 - DNA, 22 bp, Homo sapiens
ccagagcctcgcccggagcctc

SEQ ID NO: 7066297 - DNA, 22 bp, Homo sapiens
ccagaggatcagtactggctgg

SEQ ID NO: 7066298 - DNA, 22 bp, Homo sapiens
ccagaggatcagtactggctgg

SEQ ID NO: 7066299 - DNA, 22 bp, Homo sapiens
ccagagagggcgccacctggag

SEQ ID NO: 7066300 - DNA, 22 bp, Homo sapiens
ccagagcagggcagcagggctc

SEQ ID NO: 7066301 - DNA, 22 bp, Homo sapiens
ccagagcccagggtcatgcagg

SEQ ID NO: 7066302 - DNA, 22 bp, Homo sapiens
ccagagcccgggacctggactt

SEQ ID NO: 7066303 - DNA, 22 bp, Homo sapiens
ccagagccggctccctcagctt

SEQ ID NO: 7066304 - DNA, 22 bp, Homo sapiens
ccagagccggctccctcagctt

SEQ ID NO: 7066305 - DNA, 18 bp, Homo sapiens
ccacccagggggagagga

SEQ ID NO: 7066306 - DNA, 22 bp, Homo sapiens
tcctgtggtctggaaggaatgg

SEQ ID NO: 7066307 - DNA, 22 bp, Homo sapiens
tcctgtgttactgcctggagcg

SEQ ID NO: 7066308 - DNA, 21 bp, Homo sapiens
tctagaatcctgtataagact

SEQ ID NO: 7066309 - DNA, 22 bp, Homo sapiens
tctataaatgcagatatgtgtg

SEQ ID NO: 7066310 - DNA, 22 bp, Homo sapiens
tctataaattatgcagtctcag

SEQ ID NO: 7066311 - DNA, 22 bp, Homo sapiens
tctataatcctatttcaactgc

SEQ ID NO: 7066312 - DNA, 22 bp, Homo sapiens
tctatacaagtttcactttgac

SEQ ID NO: 7066313 - DNA, 22 bp, Homo sapiens
tctatacacacaaagaatgctt

SEQ ID NO: 7066314 - DNA, 23 bp, Homo sapiens
tctatacatactgcagcctctgg

SEQ ID NO: 7066315 - DNA, 22 bp, Homo sapiens
tctcagctgcctgccctgctcc

SEQ ID NO: 7066316 - DNA, 22 bp, Homo sapiens
tctcaggaatagagtggcagca

SEQ ID NO: 7066317 - DNA, 23 bp, Homo sapiens
tctcagttccagaggctacaagt

SEQ ID NO: 7066318 - DNA, 22 bp, Homo sapiens
ccacaggcggagtggcgggcag

SEQ ID NO: 7066319 - DNA, 22 bp, Homo sapiens
ccacaggctgctgcaggtcccg

SEQ ID NO: 7066320 - DNA, 22 bp, Homo sapiens
ccacaggctgctgcaggtcccg

SEQ ID NO: 7066321 - DNA, 22 bp, Homo sapiens
tcctggaggaataagttttcca

SEQ ID NO: 7066322 - DNA, 22 bp, Homo sapiens
ccacaggggtctctgtagctga

SEQ ID NO: 7066323 - DNA, 22 bp, Homo sapiens
ccacaggggtctctgtagctga

SEQ ID NO: 7066324 - DNA, 22 bp, Homo sapiens
tcctggccttgctcctgatgcc

SEQ ID NO: 7066325 - DNA, 22 bp, Homo sapiens
tcctggccttgctcctgatgcc

SEQ ID NO: 7066326 - DNA, 22 bp, Homo sapiens
ccaagaggttgaggctgcagtg

SEQ ID NO: 7066327 - DNA, 22 bp, Homo sapiens
ccaagaggttgaggctgcagtg

SEQ ID NO: 7066328 - DNA, 19 bp, Homo sapiens
tcctgcccaccagccaggg

SEQ ID NO: 7066329 - DNA, 22 bp, Homo sapiens
ccaagaggcagaatgcagagaa

SEQ ID NO: 7066330 - DNA, 22 bp, Homo sapiens
ccaagaggggcagagggctgca

SEQ ID NO: 7066331 - DNA, 22 bp, Homo sapiens
tcctgccttagagcaaggaaaa

SEQ ID NO: 7066332 - DNA, 21 bp, Homo sapiens
tcctgccttagtccagagcag

SEQ ID NO: 7066333 - DNA, 21 bp, Homo sapiens
tcctgccttagtccagagcag

SEQ ID NO: 7066334 - DNA, 21 bp, Homo sapiens
tcctgccttagtccagagcag

SEQ ID NO: 7066335 - DNA, 22 bp, Homo sapiens
tcctgccttcatactgctgtat

SEQ ID NO: 7066336 - DNA, 22 bp, Homo sapiens
tcctgccttcatactgctgtat

SEQ ID NO: 7066337 - DNA, 22 bp, Homo sapiens
tcctgccttcatactgctgtat

SEQ ID NO: 7066338 - DNA, 22 bp, Homo sapiens
tcctgccttgcctgggacatca

SEQ ID NO: 7066339 - DNA, 22 bp, Homo sapiens
tcctgccttgcctgggacatca

SEQ ID NO: 7066340 - DNA, 22 bp, Homo sapiens
tcctgctctgatgggttctcct

SEQ ID NO: 7066341 - DNA, 22 bp, Homo sapiens
ccaagaggcagaatgcagagaa

SEQ ID NO: 7066342 - DNA, 22 bp, Homo sapiens
tcctgaggtctgaaaaaggagc

SEQ ID NO: 7066343 - DNA, 22 bp, Homo sapiens
tcctgaggtggattgagcagag

SEQ ID NO: 7066344 - DNA, 22 bp, Homo sapiens
tcctgaggtggattgagcagag

SEQ ID NO: 7066345 - DNA, 22 bp, Homo sapiens
tcctgaggtggattgagcagag

SEQ ID NO: 7066346 - DNA, 20 bp, Homo sapiens
catttcattgtgtcttcact

SEQ ID NO: 7066347 - DNA, 21 bp, Homo sapiens
catttcatgattatagaaatg

SEQ ID NO: 7066348 - DNA, 22 bp, Homo sapiens
catttcatagttgtcacaataa

SEQ ID NO: 7066349 - DNA, 22 bp, Homo sapiens
catttcctgtctggaggtcaaa

SEQ ID NO: 7066350 - DNA, 22 bp, Homo sapiens
catttcctgtctggaggtcaaa

SEQ ID NO: 7066351 - DNA, 22 bp, Homo sapiens
catttccttcctgctgctcctc

SEQ ID NO: 7066352 - DNA, 22 bp, Homo sapiens
catttattggcatgtagtaggt

SEQ ID NO: 7066353 - DNA, 18 bp, Homo sapiens
tccaggtcccaggggaag

SEQ ID NO: 7066354 - DNA, 22 bp, Homo sapiens
cattttatcctctgggaagcta

SEQ ID NO: 7066355 - DNA, 22 bp, Homo sapiens
cattttatcctctgggaagcta

SEQ ID NO: 7066356 - DNA, 19 bp, Homo sapiens
cattttaagcatccccagt

SEQ ID NO: 7066357 - DNA, 22 bp, Homo sapiens
cattttacctagaagctgaaag

SEQ ID NO: 7066358 - DNA, 22 bp, Homo sapiens
cattttactgactcttgaatta

SEQ ID NO: 7066359 - DNA, 22 bp, Homo sapiens
cattttatgtttatggagtgct

SEQ ID NO: 7066360 - DNA, 22 bp, Homo sapiens
cattttcagcacccatctgaaa

SEQ ID NO: 7066361 - DNA, 22 bp, Homo sapiens
cattttcagcacccatctgaaa

SEQ ID NO: 7066362 - DNA, 22 bp, Homo sapiens
cattttcagcacccatctgaaa

SEQ ID NO: 7066363 - DNA, 22 bp, Homo sapiens
cattttcagcacccatctgaaa

SEQ ID NO: 7066364 - DNA, 22 bp, Homo sapiens
cattttcatgagtttctgttca

SEQ ID NO: 7066365 - DNA, 22 bp, Homo sapiens
cattttaagatgacctggtttc

SEQ ID NO: 7066366 - DNA, 19 bp, Homo sapiens
cattttaagcatccccagt

SEQ ID NO: 7066367 - DNA, 19 bp, Homo sapiens
cattttaagcatccccagt

SEQ ID NO: 7066368 - DNA, 22 bp, Homo sapiens
cattttaaatgatttaagccaa

SEQ ID NO: 7066369 - DNA, 22 bp, Homo sapiens
cattttaagatgacctggtttc

SEQ ID NO: 7066370 - DNA, 22 bp, Homo sapiens
cattttaaatgatttaagccaa

SEQ ID NO: 7066371 - DNA, 22 bp, Homo sapiens
cattttaaatgatttaagccaa

SEQ ID NO: 7066372 - DNA, 22 bp, Homo sapiens
ccaaaaattagatacacatata

SEQ ID NO: 7066373 - DNA, 22 bp, Homo sapiens
tcctgacttaactactctctgg

SEQ ID NO: 7066374 - DNA, 22 bp, Homo sapiens
ccaaaaagctcagagatatgtt

SEQ ID NO: 7066375 - DNA, 22 bp, Homo sapiens
ccaaaaagtacatttaggtgtg

SEQ ID NO: 7066376 - DNA, 22 bp, Homo sapiens
tcctgacttggctgttggccct

SEQ ID NO: 7066377 - DNA, 22 bp, Homo sapiens
tcctgagaaggcacagcttgca

SEQ ID NO: 7066378 - DNA, 22 bp, Homo sapiens
tcctgaggctcactttgaatgt

SEQ ID NO: 7066379 - DNA, 22 bp, Homo sapiens
tcctgagggctcggggctcatg

SEQ ID NO: 7066380 - DNA, 22 bp, Homo sapiens
tcctgagggcattttggtgact

SEQ ID NO: 7066381 - DNA, 22 bp, Homo sapiens
cattttcatgagtttctgttca

SEQ ID NO: 7066382 - DNA, 22 bp, Homo sapiens
cattttcatgagtttctgttca

SEQ ID NO: 7066383 - DNA, 22 bp, Homo sapiens
cattttctcaatgaaccctctt

SEQ ID NO: 7066384 - DNA, 19 bp, Homo sapiens
cattttctcattgtgcccc

SEQ ID NO: 7066385 - DNA, 22 bp, Homo sapiens
ttgagacacaaggcacagtaag

SEQ ID NO: 7066386 - DNA, 22 bp, Homo sapiens
ttgagacactttgggcatcact

SEQ ID NO: 7066387 - DNA, 22 bp, Homo sapiens
ttgagagtgccaagcatcctcc

SEQ ID NO: 7066388 - DNA, 22 bp, Homo sapiens
ttgagggaacatgagaatcatc

SEQ ID NO: 7066389 - DNA, 22 bp, Homo sapiens
ttgagggacagaggtgctgtct

SEQ ID NO: 7066390 - DNA, 22 bp, Homo sapiens
ttgagggtctggatctgctgct

SEQ ID NO: 7066391 - DNA, 21 bp, Homo sapiens
ttgaccaagggtgcgtgctcc

SEQ ID NO: 7066392 - DNA, 22 bp, Homo sapiens
ttgaaagatatgttaatctttc

SEQ ID NO: 7066393 - DNA, 22 bp, Homo sapiens
ttgaaaggaatacagaggccta

SEQ ID NO: 7066394 - DNA, 22 bp, Homo sapiens
ttgacataagacttagagtatt

SEQ ID NO: 7066395 - DNA, 22 bp, Homo sapiens
ttctttttatcttcccataaga

SEQ ID NO: 7066396 - DNA, 22 bp, Homo sapiens
ttctttttggatagctgatgaa

SEQ ID NO: 7066397 - DNA, 22 bp, Homo sapiens
ttgaaaaaattggtagaggatg

SEQ ID NO: 7066398 - DNA, 22 bp, Homo sapiens
ttgaaaaaattggtagaggatg

SEQ ID NO: 7066399 - DNA, 23 bp, Homo sapiens
ttgaaaaatatagtcccattgtc

SEQ ID NO: 7066400 - DNA, 22 bp, Homo sapiens
ttgaaaacagcgtagattcaca

SEQ ID NO: 7066401 - DNA, 22 bp, Homo sapiens
ttgaaaacatttatattagaat

SEQ ID NO: 7066402 - DNA, 22 bp, Homo sapiens
ttgaaaaccgtgggaggctgaa

SEQ ID NO: 7066403 - DNA, 22 bp, Homo sapiens
ttgaaaactttctagaccaaga

SEQ ID NO: 7066404 - DNA, 20 bp, Homo sapiens
ttgaaaatgcattgtgcagt

SEQ ID NO: 7066405 - DNA, 22 bp, Homo sapiens
ttgaaaatggtaagcatgatat

SEQ ID NO: 7066406 - DNA, 22 bp, Homo sapiens
ttgaaacagtagctcatagacc

SEQ ID NO: 7066407 - DNA, 22 bp, Homo sapiens
ttctttctttgtagtcctgaac

SEQ ID NO: 7066408 - DNA, 22 bp, Homo sapiens
ttctttgagttagtacagtcca

SEQ ID NO: 7066409 - DNA, 22 bp, Homo sapiens
ttctttcttctcaggctgggta

SEQ ID NO: 7066410 - DNA, 22 bp, Homo sapiens
ttctttctctactagcagagct

SEQ ID NO: 7066411 - DNA, 22 bp, Homo sapiens
ttctttctcagtgggcagatac

SEQ ID NO: 7066412 - DNA, 22 bp, Homo sapiens
ttcttcttgaaactttaggttg

SEQ ID NO: 7066413 - DNA, 20 bp, Homo sapiens
ttcttctctagttatcttca

SEQ ID NO: 7066414 - DNA, 22 bp, Homo sapiens
ttcttctctcatagattaaggt

SEQ ID NO: 7066415 - DNA, 22 bp, Homo sapiens
ttcttctgaaacataatcaata

SEQ ID NO: 7066416 - DNA, 22 bp, Homo sapiens
ttcttctgaaacataatcaata

SEQ ID NO: 7066417 - DNA, 22 bp, Homo sapiens
ttcttctgagagaaaaagctca

SEQ ID NO: 7066418 - DNA, 22 bp, Homo sapiens
ttcttctgcctcccacctgata

SEQ ID NO: 7066419 - DNA, 22 bp, Homo sapiens
ttcttctgtgaggtgtgtgcct

SEQ ID NO: 7066420 - DNA, 22 bp, Homo sapiens
ttcttctgtgaggtgtgtgcct

SEQ ID NO: 7066421 - DNA, 22 bp, Homo sapiens
ttcttctgttggcagagcatac

SEQ ID NO: 7066422 - DNA, 22 bp, Homo sapiens
ttctggagtcattggggctgat

SEQ ID NO: 7066423 - DNA, 22 bp, Homo sapiens
ttctggagtcccacagccaggg

SEQ ID NO: 7066424 - DNA, 22 bp, Homo sapiens
ttctggagttgtgacctcaggg

SEQ ID NO: 7066425 - DNA, 22 bp, Homo sapiens
ttctgggaacaaagtggagtgg

SEQ ID NO: 7066426 - DNA, 20 bp, Homo sapiens
ttctgggaattgggtagctg

SEQ ID NO: 7066427 - DNA, 22 bp, Homo sapiens
ttctgggacatctggacagttt

SEQ ID NO: 7066428 - DNA, 22 bp, Homo sapiens
ttctgggacatctggacagttt

SEQ ID NO: 7066429 - DNA, 22 bp, Homo sapiens
ttctgggacattgcaggtattc

SEQ ID NO: 7066430 - DNA, 22 bp, Homo sapiens
ttctgggaggctggctgtcata

SEQ ID NO: 7066431 - DNA, 19 bp, Homo sapiens
ttctgggaggggctgactg

SEQ ID NO: 7066432 - DNA, 22 bp, Homo sapiens
ttctgggcacacaggccctggt

SEQ ID NO: 7066433 - DNA, 22 bp, Homo sapiens
ttcttcagactccctctttaag

SEQ ID NO: 7066434 - DNA, 22 bp, Homo sapiens
ttcttcagcccatatcttccag

SEQ ID NO: 7066435 - DNA, 22 bp, Homo sapiens
ttcttcagcctaccttgacctc

SEQ ID NO: 7066436 - DNA, 23 bp, Homo sapiens
ttcttctcaattagttgattcag

SEQ ID NO: 7066437 - DNA, 22 bp, Homo sapiens
ttcttctcagggtcccacatgg

SEQ ID NO: 7066438 - DNA, 22 bp, Homo sapiens
ttcttctcagggtcccacatgg

SEQ ID NO: 7066439 - DNA, 22 bp, Homo sapiens
ttcttctccgaggagggctggt

SEQ ID NO: 7066440 - DNA, 22 bp, Homo sapiens
ttcttctccgaggagggctggt

SEQ ID NO: 7066441 - DNA, 22 bp, Homo sapiens
ttcttctcctaaggagagtcct

SEQ ID NO: 7066442 - DNA, 22 bp, Homo sapiens
ttcttctcggctgtcagatagt

SEQ ID NO: 7066443 - DNA, 20 bp, Homo sapiens
ttctgcctagggttagcctg

SEQ ID NO: 7066444 - DNA, 22 bp, Homo sapiens
ttctgcctgatgtagtcatacc

SEQ ID NO: 7066445 - DNA, 20 bp, Homo sapiens
ttctgcctagggttagcctg

SEQ ID NO: 7066446 - DNA, 22 bp, Homo sapiens
ttctggaggagaaagggtgggc

SEQ ID NO: 7066447 - DNA, 22 bp, Homo sapiens
ttctgcagatcaacttgactgc

SEQ ID NO: 7066448 - DNA, 22 bp, Homo sapiens
ttctgcagcatgaggctggagc

SEQ ID NO: 7066449 - DNA, 22 bp, Homo sapiens
ttctgcagcatgaggctggagc

SEQ ID NO: 7066450 - DNA, 22 bp, Homo sapiens
ttctgccaaaggctttgttttg

SEQ ID NO: 7066451 - DNA, 22 bp, Homo sapiens
ttctctttctgctgggctggaa

SEQ ID NO: 7066452 - DNA, 22 bp, Homo sapiens
ttctgaggcatagaggatgaga

SEQ ID NO: 7066453 - DNA, 22 bp, Homo sapiens
ttctgataacaaacaccaattt

SEQ ID NO: 7066454 - DNA, 22 bp, Homo sapiens
ttctgataataccacatcgcag

SEQ ID NO: 7066455 - DNA, 22 bp, Homo sapiens
ttctgatacagtcccaacacaa

SEQ ID NO: 7066456 - DNA, 22 bp, Homo sapiens
ttctgataccttgcaggatcct

SEQ ID NO: 7066457 - DNA, 22 bp, Homo sapiens
ttctgatgatggcggctggagc
